United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 50

SEQ ID NO: 2245352 - RNA, 19 nt, Human
acuccuugugguuuauguc

SEQ ID NO: 2245353 - RNA, 20 nt, Human
acuccuugugguuuauguca

SEQ ID NO: 2245354 - RNA, 13 nt, Human
acucgagaacuuu

SEQ ID NO: 2245355 - RNA, 17 nt, Human
acucgagaacuuucauu

SEQ ID NO: 2245356 - RNA, 16 nt, Human
acucgagaccuuuuca

SEQ ID NO: 2245357 - RNA, 17 nt, Human
acucgagaccuuuucaa

SEQ ID NO: 2245358 - RNA, 11 nt, Human
acuccuuccug

SEQ ID NO: 2245359 - RNA, 23 nt, Human
acuccuuccaguguccuuagaac

SEQ ID NO: 2245360 - RNA, 20 nt, Human
acuccuguuacuuaccuaaa

SEQ ID NO: 2245361 - RNA, 23 nt, Human
acuccuugauuuuagccuucucu

SEQ ID NO: 2245362 - RNA, 12 nt, Human
acuccuuagaga

SEQ ID NO: 2245363 - RNA, 17 nt, Human
acuccuguuacuuaccu

SEQ ID NO: 2245364 - RNA, 16 nt, Human
acuccuguuacuuacc

SEQ ID NO: 2245365 - RNA, 18 nt, Human
acuccuguacacugaaua

SEQ ID NO: 2245366 - RNA, 17 nt, Human
acuccuguacacugaau

SEQ ID NO: 2245367 - RNA, 16 nt, Human
acuccuguacacugaa

SEQ ID NO: 2245368 - RNA, 15 nt, Human
acuccuguacacuga

SEQ ID NO: 2245369 - RNA, 13 nt, Human
acuccuguacacu

SEQ ID NO: 2245370 - RNA, 15 nt, Human
acuccuguaauuccu

SEQ ID NO: 2245371 - RNA, 23 nt, Human
acuccuggguugagcuguugccu

SEQ ID NO: 2245372 - RNA, 15 nt, Human
uccuagcagagagac

SEQ ID NO: 2245373 - RNA, 18 nt, Human
uccuagccuuauccucug

SEQ ID NO: 2245374 - RNA, 19 nt, Human
uccuagccuuauccucuga

SEQ ID NO: 2245375 - RNA, 20 nt, Human
uccuagccuuauccucugau

SEQ ID NO: 2245376 - RNA, 21 nt, Human
uccuagccuuauccucugauc

SEQ ID NO: 2245377 - RNA, 22 nt, Human
uccuagccuuauccucugaucu

SEQ ID NO: 2245378 - RNA, 17 nt, Human
uccuagccacucaggag

SEQ ID NO: 2245379 - RNA, 13 nt, Human
uccuagccacuca

SEQ ID NO: 2245380 - RNA, 21 nt, Human
uccuagccaccgccuccuaca

SEQ ID NO: 2245381 - RNA, 21 nt, Human
uccuagccugugccucuggga

SEQ ID NO: 2245382 - RNA, 12 nt, Human
uccuacucugug

SEQ ID NO: 2245383 - RNA, 20 nt, Human
uccuagccacccaccacacu

SEQ ID NO: 2245384 - RNA, 12 nt, Human
uccuagcagaga

SEQ ID NO: 2245385 - RNA, 14 nt, Human
uccuagcagagaga

SEQ ID NO: 2245386 - RNA, 17 nt, Human
uccuaccucagccuaga

SEQ ID NO: 2245387 - RNA, 13 nt, Human
uccuaccucccug

SEQ ID NO: 2245388 - RNA, 16 nt, Human
uccuaccucagccuag

SEQ ID NO: 2245389 - RNA, 14 nt, Human
uccuaccucagccu

SEQ ID NO: 2245390 - RNA, 20 nt, Human
uccuacgucaaacaugaagu

SEQ ID NO: 2245391 - RNA, 16 nt, Human
uccuacuaggcaaaau

SEQ ID NO: 2245392 - RNA, 17 nt, Human
uccuacucccagacacc

SEQ ID NO: 2245393 - RNA, 18 nt, Human
uccuacucccagacaccc

SEQ ID NO: 2245394 - RNA, 15 nt, Human
acucuuccugcaagg

SEQ ID NO: 2245395 - RNA, 23 nt, Human
acucuucugagcaccuacuuaca

SEQ ID NO: 2245396 - RNA, 20 nt, Human
acucuucuuaacuuaaauuu

SEQ ID NO: 2245397 - RNA, 19 nt, Human
acucuucuuaacuuaaauu

SEQ ID NO: 2245398 - RNA, 16 nt, Human
acucuucuugaaauuu

SEQ ID NO: 2245399 - RNA, 15 nt, Human
acucuucuugaaauu

SEQ ID NO: 2245400 - RNA, 13 nt, Human
acucuugaaaaau

SEQ ID NO: 2245401 - RNA, 16 nt, Human
acucuuccugcaagga

SEQ ID NO: 2245402 - RNA, 17 nt, Human
acucuuccagaauccca

SEQ ID NO: 2245403 - RNA, 20 nt, Human
acucuuccgaaaaauccucu

SEQ ID NO: 2245404 - RNA, 21 nt, Human
acucuuccgaaaaauccucuu

SEQ ID NO: 2245405 - RNA, 22 nt, Human
acucuuccgaaaaauccucuuc

SEQ ID NO: 2245406 - RNA, 20 nt, Human
acucuucccccacuccucuu

SEQ ID NO: 2245407 - RNA, 21 nt, Human
acucuucaguuaagccuuugg

SEQ ID NO: 2245408 - RNA, 20 nt, Human
acucuucaguuaagccuuug

SEQ ID NO: 2245409 - RNA, 17 nt, Human
acucuucacaaaaucug

SEQ ID NO: 2245410 - RNA, 21 nt, Human
acucuuauugcccacgcugga

SEQ ID NO: 2245411 - RNA, 16 nt, Human
acucugcuucucugac

SEQ ID NO: 2245412 - RNA, 14 nt, Human
acucugcuucucug

SEQ ID NO: 2245413 - RNA, 15 nt, Human
acucugcuucucuga

SEQ ID NO: 2245414 - RNA, 19 nt, Human
acucuggcagcucagagag

SEQ ID NO: 2245415 - RNA, 20 nt, Human
acucuggcagcucagagagg

SEQ ID NO: 2245416 - RNA, 20 nt, Human
acucugcucugcccuuguuc

SEQ ID NO: 2245417 - RNA, 14 nt, Human
acucugcucugccc

SEQ ID NO: 2245418 - RNA, 12 nt, Human
acucugcuucuc

SEQ ID NO: 2245419 - RNA, 22 nt, Human
acucugcugucuaaccugugac

SEQ ID NO: 2245420 - RNA, 23 nt, Human
acucugcugucuaaccugugacc

SEQ ID NO: 2245421 - RNA, 9 nt, Human
acucugcug

SEQ ID NO: 2245422 - RNA, 14 nt, Human
acucugcugcuuag

SEQ ID NO: 2245423 - RNA, 15 nt, Human
acucugcugcuuaga

SEQ ID NO: 2245424 - RNA, 16 nt, Human
acucuggcagcucaga

SEQ ID NO: 2245425 - RNA, 17 nt, Human
acucuggcagcucagag

SEQ ID NO: 2245426 - RNA, 22 nt, Human
acucgcccgcccacuguccugg

SEQ ID NO: 2245427 - RNA, 16 nt, Human
acucgucugacugugu

SEQ ID NO: 2245428 - RNA, 14 nt, Human
acucguauaugucu

SEQ ID NO: 2245429 - RNA, 14 nt, Human
acucucacauguuu

SEQ ID NO: 2245430 - RNA, 17 nt, Human
acucgcgacaaugcaaa

SEQ ID NO: 2245431 - RNA, 14 nt, Human
acucgcccgcccac

SEQ ID NO: 2245432 - RNA, 15 nt, Human
acucgcccgcccacu

SEQ ID NO: 2245433 - RNA, 17 nt, Human
acucgcccgcccacugu

SEQ ID NO: 2245434 - RNA, 19 nt, Human
acucgcccgcccacugucc

SEQ ID NO: 2245435 - RNA, 12 nt, Human
acucgguuucuc

SEQ ID NO: 2245436 - RNA, 20 nt, Human
acucgcccgcccacuguccu

SEQ ID NO: 2245437 - RNA, 21 nt, Human
acucgcccgcccacuguccug

SEQ ID NO: 2245438 - RNA, 14 nt, Human
acucgguuucucca

SEQ ID NO: 2245439 - RNA, 16 nt, Human
acucgguuucuccaaa

SEQ ID NO: 2245440 - RNA, 15 nt, Human
acucgcgacaaugca

SEQ ID NO: 2245441 - RNA, 16 nt, Human
acucgcgacaaugcaa

SEQ ID NO: 2245442 - RNA, 14 nt, Human
acucugccucugcc

SEQ ID NO: 2245443 - RNA, 12 nt, Human
acucugccucug

SEQ ID NO: 2245444 - RNA, 11 nt, Human
acucugccucu

SEQ ID NO: 2245445 - RNA, 15 nt, Human
acucucauuccccag

SEQ ID NO: 2245446 - RNA, 16 nt, Human
acucugccucugccug

SEQ ID NO: 2245447 - RNA, 16 nt, Human
acucugccugcuuaca

SEQ ID NO: 2245448 - RNA, 18 nt, Human
acucugcucgccuuagca

SEQ ID NO: 2245449 - RNA, 23 nt, Human
acucugacaacagacuucugaaa

SEQ ID NO: 2245450 - RNA, 22 nt, Human
acucugacaacagacuucugaa

SEQ ID NO: 2245451 - RNA, 20 nt, Human
acucugacaacagacuucug

SEQ ID NO: 2245452 - RNA, 18 nt, Human
acucugacaacagacuuc

SEQ ID NO: 2245453 - RNA, 14 nt, Human
acucucauucccca

SEQ ID NO: 2245454 - RNA, 22 nt, Human
acucucaggaucaagaaagugu

SEQ ID NO: 2245455 - RNA, 18 nt, Human
acucucagucucugagca

SEQ ID NO: 2245456 - RNA, 17 nt, Human
acucucagucucugagc

SEQ ID NO: 2245457 - RNA, 17 nt, Human
acucugacaacagacuu

SEQ ID NO: 2245458 - RNA, 13 nt, Human
acucugacaacag

SEQ ID NO: 2245459 - RNA, 19 nt, Human
acucucaggaucaagaaag

SEQ ID NO: 2245460 - RNA, 18 nt, Human
acucucaggaucaagaaa

SEQ ID NO: 2245461 - RNA, 13 nt, Human
acucucagucucu

SEQ ID NO: 2245462 - RNA, 16 nt, Human
acucucagucucugag

SEQ ID NO: 2245463 - RNA, 14 nt, Human
acucucagucucug

SEQ ID NO: 2245464 - RNA, 22 nt, Human
acucucaggaccaaagcuuuca

SEQ ID NO: 2245465 - RNA, 20 nt, Human
uccucuuguaaauaaagccc

SEQ ID NO: 2245466 - RNA, 15 nt, Human
uccucuuuagaguua

SEQ ID NO: 2245467 - RNA, 20 nt, Human
uccucuuuagaguuagacug

SEQ ID NO: 2245468 - RNA, 21 nt, Human
uccucuuuagaguuagacugu

SEQ ID NO: 2245469 - RNA, 18 nt, Human
uccucuuguaaauaaagc

SEQ ID NO: 2245470 - RNA, 19 nt, Human
uccucuuguaaauaaagcc

SEQ ID NO: 2245471 - RNA, 21 nt, Human
uccucuuguaaauaaagcccu

SEQ ID NO: 2245472 - RNA, 21 nt, Human
uccucuuuuaucuuggacuga

SEQ ID NO: 2245473 - RNA, 23 nt, Human
uccucuuuggucuacacugugcu

SEQ ID NO: 2245474 - RNA, 16 nt, Human
uccugaaccugaugcu

SEQ ID NO: 2245475 - RNA, 13 nt, Human
uccugaagaacca

SEQ ID NO: 2245476 - RNA, 23 nt, Human
uccugaagaaccaguccccccac

SEQ ID NO: 2245477 - RNA, 18 nt, Human
uccugaagaaccaguccc

SEQ ID NO: 2245478 - RNA, 16 nt, Human
uccugaagaaccaguc

SEQ ID NO: 2245479 - RNA, 14 nt, Human
uccugaagaaccag

SEQ ID NO: 2245480 - RNA, 21 nt, Human
uccugaaaacccuugccaugu

SEQ ID NO: 2245481 - RNA, 22 nt, Human
uccugaaaacccuugccaugug

SEQ ID NO: 2245482 - RNA, 12 nt, Human
uccucuuguaaa

SEQ ID NO: 2245483 - RNA, 13 nt, Human
uccucuugcucaa

SEQ ID NO: 2245484 - RNA, 14 nt, Human
uccucuugcucaaa

SEQ ID NO: 2245485 - RNA, 17 nt, Human
uccucuugccuccugga

SEQ ID NO: 2245486 - RNA, 19 nt, Human
uccucuugccacugccucu

SEQ ID NO: 2245487 - RNA, 23 nt, Human
uccucugccaccuccccuaucca

SEQ ID NO: 2245488 - RNA, 10 nt, Human
uccucugccu

SEQ ID NO: 2245489 - RNA, 22 nt, Human
uccucugccaccuccccuaucc

SEQ ID NO: 2245490 - RNA, 18 nt, Human
uccucugccaccuccccu

SEQ ID NO: 2245491 - RNA, 12 nt, Human
uccucugccuca

SEQ ID NO: 2245492 - RNA, 11 nt, Human
uccucugccug

SEQ ID NO: 2245493 - RNA, 12 nt, Human
uccucugccugc

SEQ ID NO: 2245494 - RNA, 13 nt, Human
uccucugccugcc

SEQ ID NO: 2245495 - RNA, 14 nt, Human
uccucugccugccc

SEQ ID NO: 2245496 - RNA, 22 nt, Human
uccucugccugccccgccccca

SEQ ID NO: 2245497 - RNA, 15 nt, Human
uccucugccaccucc

SEQ ID NO: 2245498 - RNA, 14 nt, Human
uccucugccaccuc

SEQ ID NO: 2245499 - RNA, 12 nt, Human
uccucugccacc

SEQ ID NO: 2245500 - RNA, 18 nt, Human
uccucugcagugccuugg

SEQ ID NO: 2245501 - RNA, 18 nt, Human
uccucugcagcugaccuc

SEQ ID NO: 2245502 - RNA, 20 nt, Human
uccucugcagcugaccucug

SEQ ID NO: 2245503 - RNA, 13 nt, Human
uccucugcagugc

SEQ ID NO: 2245504 - RNA, 15 nt, Human
uccucugcagugccu

SEQ ID NO: 2245505 - RNA, 14 nt, Human
uccucugaggcuga

SEQ ID NO: 2245506 - RNA, 18 nt, Human
uccucugacucagggcuc

SEQ ID NO: 2245507 - RNA, 23 nt, Human
uccucucuuuguucucagcuccc

SEQ ID NO: 2245508 - RNA, 15 nt, Human
uccucugauacccag

SEQ ID NO: 2245509 - RNA, 13 nt, Human
uccucugaucucc

SEQ ID NO: 2245510 - RNA, 17 nt, Human
uccucugaucuccaugg

SEQ ID NO: 2245511 - RNA, 16 nt, Human
uccucugcagcugacc

SEQ ID NO: 2245512 - RNA, 17 nt, Human
uccucugcagcugaccu

SEQ ID NO: 2245513 - RNA, 16 nt, Human
acugaaaaccucuccu

SEQ ID NO: 2245514 - RNA, 15 nt, Human
acugaaaaccucucc

SEQ ID NO: 2245515 - RNA, 15 nt, Human
acugaaaacaucugg

SEQ ID NO: 2245516 - RNA, 16 nt, Human
acugaaaacaucugga

SEQ ID NO: 2245517 - RNA, 17 nt, Human
acugaaaacaucuggaa

SEQ ID NO: 2245518 - RNA, 18 nt, Human
acugaaaacaucuggaag

SEQ ID NO: 2245519 - RNA, 14 nt, Human
acugaaaacaucug

SEQ ID NO: 2245520 - RNA, 23 nt, Human
acucuuugagauagaagaacugc

SEQ ID NO: 2245521 - RNA, 22 nt, Human
acucuuugagauagaagaacug

SEQ ID NO: 2245522 - RNA, 19 nt, Human
acucuuugagauagaagaa

SEQ ID NO: 2245523 - RNA, 16 nt, Human
acucuuugagauagaa

SEQ ID NO: 2245524 - RNA, 18 nt, Human
acucuuugaaugacaaag

SEQ ID NO: 2245525 - RNA, 18 nt, Human
acucuuugagaaacaaca

SEQ ID NO: 2245526 - RNA, 16 nt, Human
acucuuugagaaacaa

SEQ ID NO: 2245527 - RNA, 22 nt, Human
acucuuucuguauauacuuuuu

SEQ ID NO: 2245528 - RNA, 21 nt, Human
acucuuucuguauauacuuuu

SEQ ID NO: 2245529 - RNA, 13 nt, Human
acucuuugagaaa

SEQ ID NO: 2245530 - RNA, 17 nt, Human
acucuuugaaugacaaa

SEQ ID NO: 2245531 - RNA, 17 nt, Human
acugaaaaccucuccuc

SEQ ID NO: 2245532 - RNA, 19 nt, Human
acugaaaagacucaguguu

SEQ ID NO: 2245533 - RNA, 20 nt, Human
acugaaaaggaggggucugg

SEQ ID NO: 2245534 - RNA, 15 nt, Human
acugaaaaugugcua

SEQ ID NO: 2245535 - RNA, 15 nt, Human
acugaaaaucuaaua

SEQ ID NO: 2245536 - RNA, 16 nt, Human
acugaaaaucuaauau

SEQ ID NO: 2245537 - RNA, 13 nt, Human
acugaaacuuccc

SEQ ID NO: 2245538 - RNA, 19 nt, Human
acugaaaaugugcuauacu

SEQ ID NO: 2245539 - RNA, 23 nt, Human
acugaaaaucuaauauuaaaaau

SEQ ID NO: 2245540 - RNA, 22 nt, Human
acugaaaauucgaaccaggaaa

SEQ ID NO: 2245541 - RNA, 14 nt, Human
acucuuucuguaua

SEQ ID NO: 2245542 - RNA, 20 nt, Human
uccugaccugucucaccaug

SEQ ID NO: 2245543 - RNA, 15 nt, Human
uccugaccugucuca

SEQ ID NO: 2245544 - RNA, 16 nt, Human
uccugaccugaggcuc

SEQ ID NO: 2245545 - RNA, 16 nt, Human
uccugaccucagguga

SEQ ID NO: 2245546 - RNA, 14 nt, Human
uccugaccugaggc

SEQ ID NO: 2245547 - RNA, 19 nt, Human
uccugacccaggccgcagc

SEQ ID NO: 2245548 - RNA, 14 nt, Human
uccugacccagucc

SEQ ID NO: 2245549 - RNA, 15 nt, Human
uccugacccaguccc

SEQ ID NO: 2245550 - RNA, 16 nt, Human
uccugacccagucccc

SEQ ID NO: 2245551 - RNA, 15 nt, Human
uccugaagaauugaa

SEQ ID NO: 2245552 - RNA, 20 nt, Human
uccugaaccugaugcugacu

SEQ ID NO: 2245553 - RNA, 14 nt, Human
uccugaagaggcgg

SEQ ID NO: 2245554 - RNA, 17 nt, Human
uccugaagaggcgggcc

SEQ ID NO: 2245555 - RNA, 19 nt, Human
uccugaagaggcgggccag

SEQ ID NO: 2245556 - RNA, 20 nt, Human
uccugaagaggcgggccagc

SEQ ID NO: 2245557 - RNA, 21 nt, Human
uccugaagaggcgggccagcc

SEQ ID NO: 2245558 - RNA, 22 nt, Human
uccugaagaggcgggccagcca

SEQ ID NO: 2245559 - RNA, 23 nt, Human
uccugaagaggcgggccagccag

SEQ ID NO: 2245560 - RNA, 19 nt, Human
uccugaccacccuccccuc

SEQ ID NO: 2245561 - RNA, 13 nt, Human
uccugaagcugag

SEQ ID NO: 2245562 - RNA, 18 nt, Human
uccugaagcugaggcuca

SEQ ID NO: 2245563 - RNA, 20 nt, Human
uccugaccacccuccccucu

SEQ ID NO: 2245564 - RNA, 12 nt, Human
uccugacccagg

SEQ ID NO: 2245565 - RNA, 13 nt, Human
uccugacccaggc

SEQ ID NO: 2245566 - RNA, 14 nt, Human
uccugacccaggcc

SEQ ID NO: 2245567 - RNA, 15 nt, Human
uccugacccaggccg

SEQ ID NO: 2245568 - RNA, 16 nt, Human
uccugacccaggccgc

SEQ ID NO: 2245569 - RNA, 17 nt, Human
uccugacccaggccgca

SEQ ID NO: 2245570 - RNA, 13 nt, Human
uccucccaccuca

SEQ ID NO: 2245571 - RNA, 14 nt, Human
uccucccaccucag

SEQ ID NO: 2245572 - RNA, 14 nt, Human
acucuugaaaaaug

SEQ ID NO: 2245573 - RNA, 19 nt, Human
acucuugaaaaaugcaugu

SEQ ID NO: 2245574 - RNA, 15 nt, Human
uccucccaccucagc

SEQ ID NO: 2245575 - RNA, 16 nt, Human
uccucccaccucagcc

SEQ ID NO: 2245576 - RNA, 18 nt, Human
uccucccaccucagccuc

SEQ ID NO: 2245577 - RNA, 20 nt, Human
uccucccaccucagccuccc

SEQ ID NO: 2245578 - RNA, 24 nt, Human
uccucccccugccagugccuuacc

SEQ ID NO: 2245579 - RNA, 16 nt, Human
uccuccccucacagcc

SEQ ID NO: 2245580 - RNA, 14 nt, Human
uccuccccucacag

SEQ ID NO: 2245581 - RNA, 17 nt, Human
uccuccccucacagccu

SEQ ID NO: 2245582 - RNA, 18 nt, Human
uccuccccucacagccuc

SEQ ID NO: 2245583 - RNA, 19 nt, Human
uccuccccucacagccucu

SEQ ID NO: 2245584 - RNA, 21 nt, Human
uccuccccucacagccucuga

SEQ ID NO: 2245585 - RNA, 23 nt, Human
uccuccccucacagccucugacc

SEQ ID NO: 2245586 - RNA, 12 nt, Human
uccucccuggcu

SEQ ID NO: 2245587 - RNA, 17 nt, Human
uccucccuggcugcccu

SEQ ID NO: 2245588 - RNA, 18 nt, Human
uccucccuggcugcccug

SEQ ID NO: 2245589 - RNA, 19 nt, Human
uccucccuggcugcccugg

SEQ ID NO: 2245590 - RNA, 21 nt, Human
uccucccuggcugcccuggcc

SEQ ID NO: 2245591 - RNA, 22 nt, Human
uccucccuggcugcccuggccc

SEQ ID NO: 2245592 - RNA, 19 nt, Human
uccucccugggcagaaagu

SEQ ID NO: 2245593 - RNA, 10 nt, Human
uccucccuuc

SEQ ID NO: 2245594 - RNA, 14 nt, Human
uccucccuuagcuc

SEQ ID NO: 2245595 - RNA, 13 nt, Human
uccucccuucugc

SEQ ID NO: 2245596 - RNA, 22 nt, Human
uccucccuuccuuuucccugcu

SEQ ID NO: 2245597 - RNA, 19 nt, Human
uccucccuuccuuuucccu

SEQ ID NO: 2245598 - RNA, 21 nt, Human
uccucccuuccuuuucccugc

SEQ ID NO: 2245599 - RNA, 13 nt, Human
uccucccuuccuu

SEQ ID NO: 2245600 - RNA, 17 nt, Human
uccucccuuccuuuucc

SEQ ID NO: 2245601 - RNA, 18 nt, Human
uccucccuuccuuuuccc

SEQ ID NO: 2245602 - RNA, 22 nt, Human
uccuccccauuagagucagccu

SEQ ID NO: 2245603 - RNA, 13 nt, Human
uccuccccagcag

SEQ ID NO: 2245604 - RNA, 10 nt, Human
uccuccccag

SEQ ID NO: 2245605 - RNA, 21 nt, Human
uccuccccacuuguccgcugg

SEQ ID NO: 2245606 - RNA, 19 nt, Human
uccuccccaaggagacaca

SEQ ID NO: 2245607 - RNA, 23 nt, Human
uccucccccugccagugccuuac

SEQ ID NO: 2245608 - RNA, 20 nt, Human
uccucccccugccagugccu

SEQ ID NO: 2245609 - RNA, 17 nt, Human
uccucccccugccagug

SEQ ID NO: 2245610 - RNA, 15 nt, Human
uccucccccugccag

SEQ ID NO: 2245611 - RNA, 14 nt, Human
uccucccccugcca

SEQ ID NO: 2245612 - RNA, 16 nt, Human
uccuccccagcaggug

SEQ ID NO: 2245613 - RNA, 13 nt, Human
uccucccccugcc

SEQ ID NO: 2245614 - RNA, 21 nt, Human
uccucccaccucagccucccg

SEQ ID NO: 2245615 - RNA, 21 nt, Human
uccuccccaaaucaauacacu

SEQ ID NO: 2245616 - RNA, 19 nt, Human
acucuucuugaaauuuuaa

SEQ ID NO: 2245617 - RNA, 20 nt, Human
uccucuccgcaguuccuguc

SEQ ID NO: 2245618 - RNA, 19 nt, Human
uccucuccccucuaaggcc

SEQ ID NO: 2245619 - RNA, 17 nt, Human
uccucuccccucuaagg

SEQ ID NO: 2245620 - RNA, 11 nt, Human
uccucuccccu

SEQ ID NO: 2245621 - RNA, 17 nt, Human
uccucuccccuaccacu

SEQ ID NO: 2245622 - RNA, 18 nt, Human
uccucuccccuaccacug

SEQ ID NO: 2245623 - RNA, 12 nt, Human
uccucuccugga

SEQ ID NO: 2245624 - RNA, 13 nt, Human
uccucuccuggag

SEQ ID NO: 2245625 - RNA, 14 nt, Human
uccucuccuggagg

SEQ ID NO: 2245626 - RNA, 23 nt, Human
uccucucccauugucccucugcc

SEQ ID NO: 2245627 - RNA, 20 nt, Human
uccucuccccagcccagaga

SEQ ID NO: 2245628 - RNA, 22 nt, Human
uccucucccauugucccucugc

SEQ ID NO: 2245629 - RNA, 20 nt, Human
uccucucccauugucccucu

SEQ ID NO: 2245630 - RNA, 23 nt, Human
uccucuccccagcccagagacau

SEQ ID NO: 2245631 - RNA, 21 nt, Human
uccucuccccagcccagagac

SEQ ID NO: 2245632 - RNA, 17 nt, Human
uccucuccccaugaugu

SEQ ID NO: 2245633 - RNA, 17 nt, Human
uccucuccacugccuuc

SEQ ID NO: 2245634 - RNA, 18 nt, Human
uccucuccacugccuucg

SEQ ID NO: 2245635 - RNA, 18 nt, Human
uccucccuucugcuacug

SEQ ID NO: 2245636 - RNA, 19 nt, Human
uccucccuuggguucugau

SEQ ID NO: 2245637 - RNA, 20 nt, Human
uccucccuuggguucugaua

SEQ ID NO: 2245638 - RNA, 16 nt, Human
uccucccuuguucucu

SEQ ID NO: 2245639 - RNA, 17 nt, Human
uccucccuucugcuacu

SEQ ID NO: 2245640 - RNA, 16 nt, Human
uccucccuucugcuac

SEQ ID NO: 2245641 - RNA, 15 nt, Human
uccucccuucugcua

SEQ ID NO: 2245642 - RNA, 14 nt, Human
uccucccuucugcu

SEQ ID NO: 2245643 - RNA, 19 nt, Human
uccucucccauugucccuc

SEQ ID NO: 2245644 - RNA, 18 nt, Human
uccucucccauugucccu

SEQ ID NO: 2245645 - RNA, 22 nt, Human
uccucucccaucccccugcccu

SEQ ID NO: 2245646 - RNA, 23 nt, Human
uccucucccaucccccugcccuc

SEQ ID NO: 2245647 - RNA, 17 nt, Human
uccucucccaucccccu

SEQ ID NO: 2245648 - RNA, 18 nt, Human
uccucucccaucccccug

SEQ ID NO: 2245649 - RNA, 19 nt, Human
uccucucccaucccccugc

SEQ ID NO: 2245650 - RNA, 20 nt, Human
uccucucccaucccccugcc

SEQ ID NO: 2245651 - RNA, 11 nt, Human
uccucuccagg

SEQ ID NO: 2245652 - RNA, 12 nt, Human
uccucuccaggc

SEQ ID NO: 2245653 - RNA, 14 nt, Human
uccucuccaggcac

SEQ ID NO: 2245654 - RNA, 15 nt, Human
uccucuccaggcacc

SEQ ID NO: 2245655 - RNA, 13 nt, Human
uccucucccaucc

SEQ ID NO: 2245656 - RNA, 14 nt, Human
uccucucccauccc

SEQ ID NO: 2245657 - RNA, 15 nt, Human
uccucucccaucccc

SEQ ID NO: 2245658 - RNA, 16 nt, Human
uccucucccauccccc

SEQ ID NO: 2245659 - RNA, 15 nt, Human
uccucuccuggagga

SEQ ID NO: 2245660 - RNA, 16 nt, Human
uccucuccuggaggau

SEQ ID NO: 2245661 - RNA, 19 nt, Human
uccucucuccagauguuuc

SEQ ID NO: 2245662 - RNA, 16 nt, Human
uccucucucuguguua

SEQ ID NO: 2245663 - RNA, 14 nt, Human
uccucucuccagau

SEQ ID NO: 2245664 - RNA, 15 nt, Human
uccucucugcccuaa

SEQ ID NO: 2245665 - RNA, 14 nt, Human
uccucucugcccua

SEQ ID NO: 2245666 - RNA, 13 nt, Human
uccucucugcccu

SEQ ID NO: 2245667 - RNA, 12 nt, Human
uccucucugccc

SEQ ID NO: 2245668 - RNA, 17 nt, Human
uccucugagccuuggga

SEQ ID NO: 2245669 - RNA, 13 nt, Human
uccucugagccuu

SEQ ID NO: 2245670 - RNA, 12 nt, Human
uccucugagccu

SEQ ID NO: 2245671 - RNA, 17 nt, Human
uccucugacucagggcu

SEQ ID NO: 2245672 - RNA, 16 nt, Human
uccucugacucagggc

SEQ ID NO: 2245673 - RNA, 15 nt, Human
uccucugacucaggg

SEQ ID NO: 2245674 - RNA, 20 nt, Human
uccucucuuuguucucagcu

SEQ ID NO: 2245675 - RNA, 21 nt, Human
uccucucuuuguucucagcuc

SEQ ID NO: 2245676 - RNA, 11 nt, Human
uccucucugcc

SEQ ID NO: 2245677 - RNA, 15 nt, Human
uccucucuuuguucu

SEQ ID NO: 2245678 - RNA, 17 nt, Human
uccucucuuuguucuca

SEQ ID NO: 2245679 - RNA, 19 nt, Human
uccucucuuuguucucagc

SEQ ID NO: 2245680 - RNA, 14 nt, Human
acucagaauauugc

SEQ ID NO: 2245681 - RNA, 14 nt, Human
acucagaauucucu

SEQ ID NO: 2245682 - RNA, 22 nt, Human
acucagaauucucuaguuugau

SEQ ID NO: 2245683 - RNA, 21 nt, Human
acucagaauucucuaguuuga

SEQ ID NO: 2245684 - RNA, 18 nt, Human
acucagaagccugaggcu

SEQ ID NO: 2245685 - RNA, 17 nt, Human
acucagaagccugaggc

SEQ ID NO: 2245686 - RNA, 16 nt, Human
acucagaagccugagg

SEQ ID NO: 2245687 - RNA, 15 nt, Human
acucagaagccugag

SEQ ID NO: 2245688 - RNA, 14 nt, Human
acucagaagccuga

SEQ ID NO: 2245689 - RNA, 13 nt, Human
acucagaagccug

SEQ ID NO: 2245690 - RNA, 18 nt, Human
acucagaagacacugaug

SEQ ID NO: 2245691 - RNA, 20 nt, Human
acucagaagccucuggguca

SEQ ID NO: 2245692 - RNA, 16 nt, Human
acucagaagccucugg

SEQ ID NO: 2245693 - RNA, 15 nt, Human
acucagaagccucug

SEQ ID NO: 2245694 - RNA, 12 nt, Human
acucagaagccu

SEQ ID NO: 2245695 - RNA, 21 nt, Human
acucagaaauuuaauucaugu

SEQ ID NO: 2245696 - RNA, 14 nt, Human
acucagaaauuuuu

SEQ ID NO: 2245697 - RNA, 17 nt, Human
acucaccucugccucaa

SEQ ID NO: 2245698 - RNA, 16 nt, Human
acucaccucugccuca

SEQ ID NO: 2245699 - RNA, 21 nt, Human
acucaccugccccucaacucu

SEQ ID NO: 2245700 - RNA, 14 nt, Human
acucaccugccccu

SEQ ID NO: 2245701 - RNA, 19 nt, Human
acucaccugccccucaacu

SEQ ID NO: 2245702 - RNA, 14 nt, Human
acucagaagacacu

SEQ ID NO: 2245703 - RNA, 15 nt, Human
acucagaagacacug

SEQ ID NO: 2245704 - RNA, 16 nt, Human
acucagaagacacuga

SEQ ID NO: 2245705 - RNA, 17 nt, Human
acucagaagacacugau

SEQ ID NO: 2245706 - RNA, 20 nt, Human
acuccaccaacccaucagaa

SEQ ID NO: 2245707 - RNA, 15 nt, Human
acuccaccaacccau

SEQ ID NO: 2245708 - RNA, 17 nt, Human
acuccacaucugccuua

SEQ ID NO: 2245709 - RNA, 21 nt, Human
acuccaaaccuccuguuagcu

SEQ ID NO: 2245710 - RNA, 22 nt, Human
acuccaaaauguuggucauuuu

SEQ ID NO: 2245711 - RNA, 13 nt, Human
acuccaccaccca

SEQ ID NO: 2245712 - RNA, 15 nt, Human
acuccacccauccua

SEQ ID NO: 2245713 - RNA, 14 nt, Human
acuccaccacccaa

SEQ ID NO: 2245714 - RNA, 14 nt, Human
acuccaccaagccu

SEQ ID NO: 2245715 - RNA, 21 nt, Human
acuccaaacugacucuuaaga

SEQ ID NO: 2245716 - RNA, 13 nt, Human
acuccaaaauguu

SEQ ID NO: 2245717 - RNA, 19 nt, Human
acucauuuuuuuaauuuau

SEQ ID NO: 2245718 - RNA, 16 nt, Human
acucauuuuuuuaauu

SEQ ID NO: 2245719 - RNA, 22 nt, Human
acucaucuuagugccugagagu

SEQ ID NO: 2245720 - RNA, 18 nt, Human
acucaucuuagugccuga

SEQ ID NO: 2245721 - RNA, 19 nt, Human
acucaucuuacuguaccug

SEQ ID NO: 2245722 - RNA, 21 nt, Human
acucaucuuucauuaaaggcu

SEQ ID NO: 2245723 - RNA, 18 nt, Human
acucauugaccugaggcc

SEQ ID NO: 2245724 - RNA, 22 nt, Human
acucauugaccugaggcccuuc

SEQ ID NO: 2245725 - RNA, 12 nt, Human
acucaucuuagg

SEQ ID NO: 2245726 - RNA, 21 nt, Human
acucaucuagguaaauuacag

SEQ ID NO: 2245727 - RNA, 16 nt, Human
acucauugaccugagg

SEQ ID NO: 2245728 - RNA, 17 nt, Human
acucauugaccugaggc

SEQ ID NO: 2245729 - RNA, 19 nt, Human
acucagacaggaaagggaa

SEQ ID NO: 2245730 - RNA, 12 nt, Human
acucagaccuga

SEQ ID NO: 2245731 - RNA, 18 nt, Human
acucagacauuggcaccu

SEQ ID NO: 2245732 - RNA, 14 nt, Human
acucagagggagga

SEQ ID NO: 2245733 - RNA, 21 nt, Human
acucagaucacuacugcaguc

SEQ ID NO: 2245734 - RNA, 20 nt, Human
acucagaucacuacugcagu

SEQ ID NO: 2245735 - RNA, 18 nt, Human
acucagaucacuacugca

SEQ ID NO: 2245736 - RNA, 19 nt, Human
acucagaucacuacugcag

SEQ ID NO: 2245737 - RNA, 15 nt, Human
acucagaucacuacu

SEQ ID NO: 2245738 - RNA, 16 nt, Human
acucagaucacuacug

SEQ ID NO: 2245739 - RNA, 17 nt, Human
acucagaucacuacugc

SEQ ID NO: 2245740 - RNA, 23 nt, Human
acucaucuagguaaauuacaguu

SEQ ID NO: 2245741 - RNA, 16 nt, Human
ucccugacccuguaua

SEQ ID NO: 2245742 - RNA, 23 nt, Human
ucccugacacugcggggcuuggc

SEQ ID NO: 2245743 - RNA, 14 nt, Human
ucccugacccgucu

SEQ ID NO: 2245744 - RNA, 21 nt, Human
ucccugaaucccccuugccac

SEQ ID NO: 2245745 - RNA, 16 nt, Human
ucccugacacugcggg

SEQ ID NO: 2245746 - RNA, 22 nt, Human
ucccugacacugcggggcuugg

SEQ ID NO: 2245747 - RNA, 23 nt, Human
ucccugaaggccccgcccaggcu

SEQ ID NO: 2245748 - RNA, 17 nt, Human
ucccugacccuguauau

SEQ ID NO: 2245749 - RNA, 22 nt, Human
ucccugacccuguauauagccc

SEQ ID NO: 2245750 - RNA, 16 nt, Human
ucccugaccucccucu

SEQ ID NO: 2245751 - RNA, 17 nt, Human
ucccugaccucccucua

SEQ ID NO: 2245752 - RNA, 21 nt, Human
ucccugaccucccucuaauuu

SEQ ID NO: 2245753 - RNA, 14 nt, Human
ucccugacucauuc

SEQ ID NO: 2245754 - RNA, 19 nt, Human
ucccugacucauucugaag

SEQ ID NO: 2245755 - RNA, 16 nt, Human
ucccugacucauucug

SEQ ID NO: 2245756 - RNA, 16 nt, Human
acucaccucuaaaaca

SEQ ID NO: 2245757 - RNA, 23 nt, Human
acucaccuaauguuuaugagcca

SEQ ID NO: 2245758 - RNA, 20 nt, Human
acucaccuaauguuuaugag

SEQ ID NO: 2245759 - RNA, 15 nt, Human
acucaccucugccuc

SEQ ID NO: 2245760 - RNA, 14 nt, Human
acucaccucugccu

SEQ ID NO: 2245761 - RNA, 13 nt, Human
acucaccucugcc

SEQ ID NO: 2245762 - RNA, 11 nt, Human
acucaccucug

SEQ ID NO: 2245763 - RNA, 20 nt, Human
acucaccucccccaucucuu

SEQ ID NO: 2245764 - RNA, 19 nt, Human
acucaccucccccaucucu

SEQ ID NO: 2245765 - RNA, 17 nt, Human
acucaccuaauguuuau

SEQ ID NO: 2245766 - RNA, 16 nt, Human
acucaccuaauguuua

SEQ ID NO: 2245767 - RNA, 19 nt, Human
acucaccccggcagacgcc

SEQ ID NO: 2245768 - RNA, 17 nt, Human
acucaccgaagccacuu

SEQ ID NO: 2245769 - RNA, 18 nt, Human
acucacccccaaggggca

SEQ ID NO: 2245770 - RNA, 17 nt, Human
acucaccccagccccaa

SEQ ID NO: 2245771 - RNA, 17 nt, Human
ucccugaaaauguuuuu

SEQ ID NO: 2245772 - RNA, 20 nt, Human
ucccugaaaacccagagagg

SEQ ID NO: 2245773 - RNA, 19 nt, Human
ucccugaaaacccagagag

SEQ ID NO: 2245774 - RNA, 18 nt, Human
ucccugaaaacccagaga

SEQ ID NO: 2245775 - RNA, 17 nt, Human
ucccugaaaacccagag

SEQ ID NO: 2245776 - RNA, 16 nt, Human
ucccugaaaacccaga

SEQ ID NO: 2245777 - RNA, 15 nt, Human
ucccugaaaacccag

SEQ ID NO: 2245778 - RNA, 15 nt, Human
ucccugaaccauccc

SEQ ID NO: 2245779 - RNA, 14 nt, Human
ucccugaacuggga

SEQ ID NO: 2245780 - RNA, 15 nt, Human
ucccugaacugggac

SEQ ID NO: 2245781 - RNA, 16 nt, Human
ucccugaacugggacc

SEQ ID NO: 2245782 - RNA, 17 nt, Human
ucccugaacugggaccu

SEQ ID NO: 2245783 - RNA, 12 nt, Human
ucccugaagcca

SEQ ID NO: 2245784 - RNA, 15 nt, Human
ucccugaagccagcc

SEQ ID NO: 2245785 - RNA, 17 nt, Human
ucccucuuggucuuccc

SEQ ID NO: 2245786 - RNA, 18 nt, Human
ucccucuuuggcuccccu

SEQ ID NO: 2245787 - RNA, 17 nt, Human
ucccucuucucaagugc

SEQ ID NO: 2245788 - RNA, 13 nt, Human
ucccucuuggucu

SEQ ID NO: 2245789 - RNA, 23 nt, Human
ucccucuuuggcuccccuguacc

SEQ ID NO: 2245790 - RNA, 17 nt, Human
ucccugaaggccccgcc

SEQ ID NO: 2245791 - RNA, 16 nt, Human
ucccugaagccagccu

SEQ ID NO: 2245792 - RNA, 17 nt, Human
ucccugaagccagccuu

SEQ ID NO: 2245793 - RNA, 18 nt, Human
ucccugaagccagccuuc

SEQ ID NO: 2245794 - RNA, 19 nt, Human
ucccugaagccagccuucu

SEQ ID NO: 2245795 - RNA, 18 nt, Human
ucccugaaggccccgccc

SEQ ID NO: 2245796 - RNA, 21 nt, Human
ucccugaaggccccgcccagg

SEQ ID NO: 2245797 - RNA, 22 nt, Human
ucccugaaggccccgcccaggc

SEQ ID NO: 2245798 - RNA, 14 nt, Human
ucccuccccugccc

SEQ ID NO: 2245799 - RNA, 16 nt, Human
ucccuccccugccauu

SEQ ID NO: 2245800 - RNA, 13 nt, Human
ucccuccccugcc

SEQ ID NO: 2245801 - RNA, 14 nt, Human
ucccucccccuugu

SEQ ID NO: 2245802 - RNA, 21 nt, Human
ucccucccccccaugcacugu

SEQ ID NO: 2245803 - RNA, 12 nt, Human
ucccucccccuu

SEQ ID NO: 2245804 - RNA, 16 nt, Human
ucccucccccccaugc

SEQ ID NO: 2245805 - RNA, 14 nt, Human
ucccucccccccau

SEQ ID NO: 2245806 - RNA, 12 nt, Human
ucccuccccccc

SEQ ID NO: 2245807 - RNA, 15 nt, Human
ucccucauuucagga

SEQ ID NO: 2245808 - RNA, 19 nt, Human
ucccucauuucaggagcag

SEQ ID NO: 2245809 - RNA, 23 nt, Human
ucccucauuucaggagcagccuc

SEQ ID NO: 2245810 - RNA, 19 nt, Human
ucccuccccugcccugguc

SEQ ID NO: 2245811 - RNA, 17 nt, Human
ucccuccccugcccugg

SEQ ID NO: 2245812 - RNA, 16 nt, Human
ucccuccccugcccug

SEQ ID NO: 2245813 - RNA, 15 nt, Human
ucccuccccugcccu

SEQ ID NO: 2245814 - RNA, 14 nt, Human
ucccucuucucaag

SEQ ID NO: 2245815 - RNA, 19 nt, Human
ucccucuucucaagugccu

SEQ ID NO: 2245816 - RNA, 22 nt, Human
ucccuccccuggggacagcaag

SEQ ID NO: 2245817 - RNA, 13 nt, Human
ucccucuuucccu

SEQ ID NO: 2245818 - RNA, 11 nt, Human
ucccucuuucc

SEQ ID NO: 2245819 - RNA, 17 nt, Human
ucccucagccccucuug

SEQ ID NO: 2245820 - RNA, 16 nt, Human
ucccucagccccucuu

SEQ ID NO: 2245821 - RNA, 15 nt, Human
ucccucagccccucu

SEQ ID NO: 2245822 - RNA, 14 nt, Human
ucccucagccccuc

SEQ ID NO: 2245823 - RNA, 20 nt, Human
ucccucagucuggcccuucc

SEQ ID NO: 2245824 - RNA, 14 nt, Human
uccccugcacugga

SEQ ID NO: 2245825 - RNA, 21 nt, Human
uccccugauuacaccagccuc

SEQ ID NO: 2245826 - RNA, 12 nt, Human
uccccugaggcu

SEQ ID NO: 2245827 - RNA, 22 nt, Human
ucccucaccuuggcaccagaca

SEQ ID NO: 2245828 - RNA, 15 nt, Human
uccccucuugcccca

SEQ ID NO: 2245829 - RNA, 20 nt, Human
uccccucucuugcacccgcc

SEQ ID NO: 2245830 - RNA, 21 nt, Human
uccccucuugccccaaccccc

SEQ ID NO: 2245831 - RNA, 18 nt, Human
ucccucagucuggcccuu

SEQ ID NO: 2245832 - RNA, 20 nt, Human
acucacauggcuauguuuua

SEQ ID NO: 2245833 - RNA, 15 nt, Human
uccccggcccuacca

SEQ ID NO: 2245834 - RNA, 15 nt, Human
uccccggaguucagu

SEQ ID NO: 2245835 - RNA, 18 nt, Human
uccccgcuucugccugca

SEQ ID NO: 2245836 - RNA, 19 nt, Human
acucacauuuauucugcuc

SEQ ID NO: 2245837 - RNA, 20 nt, Human
acucacauuuauucugcuca

SEQ ID NO: 2245838 - RNA, 23 nt, Human
acucaauauuuuccaugaaaaug

SEQ ID NO: 2245839 - RNA, 23 nt, Human
acucaaucuccccuugcacuaaa

SEQ ID NO: 2245840 - RNA, 14 nt, Human
acucaaugagcucu

SEQ ID NO: 2245841 - RNA, 16 nt, Human
acucacauggcuaugu

SEQ ID NO: 2245842 - RNA, 19 nt, Human
acucacauggcuauguuuu

SEQ ID NO: 2245843 - RNA, 14 nt, Human
acucaaugcacuga

SEQ ID NO: 2245844 - RNA, 12 nt, Human
acucaauauuuu

SEQ ID NO: 2245845 - RNA, 18 nt, Human
acucaauaaaaucaugua

SEQ ID NO: 2245846 - RNA, 15 nt, Human
acucaauaaaaucau

SEQ ID NO: 2245847 - RNA, 15 nt, Human
acucaauauuuucca

SEQ ID NO: 2245848 - RNA, 18 nt, Human
acucaauauuuuccauga

SEQ ID NO: 2245849 - RNA, 21 nt, Human
acucaauauuuuccaugaaaa

SEQ ID NO: 2245850 - RNA, 22 nt, Human
acucaauauuuuccaugaaaau

SEQ ID NO: 2245851 - RNA, 22 nt, Human
uccccggucccuugagaccuca

SEQ ID NO: 2245852 - RNA, 13 nt, Human
uccccguggucuc

SEQ ID NO: 2245853 - RNA, 13 nt, Human
uccccggcucgag

SEQ ID NO: 2245854 - RNA, 17 nt, Human
uccccggcccuaccagc

SEQ ID NO: 2245855 - RNA, 21 nt, Human
uccccggcccuaccagcgccc

SEQ ID NO: 2245856 - RNA, 12 nt, Human
uccccggccuca

SEQ ID NO: 2245857 - RNA, 13 nt, Human
uccccggccucag

SEQ ID NO: 2245858 - RNA, 14 nt, Human
uccccuaaccucau

SEQ ID NO: 2245859 - RNA, 14 nt, Human
uccccucucugcac

SEQ ID NO: 2245860 - RNA, 21 nt, Human
uccccuccuugccuccugugu

SEQ ID NO: 2245861 - RNA, 20 nt, Human
uccccuccuugccuccugug

SEQ ID NO: 2245862 - RNA, 18 nt, Human
uccccuccuugccuccug

SEQ ID NO: 2245863 - RNA, 12 nt, Human
uccccuccuugc

SEQ ID NO: 2245864 - RNA, 20 nt, Human
uccccgugccccgccucccc

SEQ ID NO: 2245865 - RNA, 18 nt, Human
uccccuccuucucccuuu

SEQ ID NO: 2245866 - RNA, 14 nt, Human
uccccuccuucucc

SEQ ID NO: 2245867 - RNA, 20 nt, Human
uccccucugcugcugucccu

SEQ ID NO: 2245868 - RNA, 15 nt, Human
uccccucugcugcug

SEQ ID NO: 2245869 - RNA, 17 nt, Human
uccccucugcugcuguc

SEQ ID NO: 2245870 - RNA, 17 nt, Human
uccccucucuugcaccc

SEQ ID NO: 2245871 - RNA, 19 nt, Human
uccccucucuugcacccgc

SEQ ID NO: 2245872 - RNA, 13 nt, Human
uccccucugcugc

SEQ ID NO: 2245873 - RNA, 14 nt, Human
uccccucugcugcu

SEQ ID NO: 2245874 - RNA, 21 nt, Human
acuauaauguaagcucuacug

SEQ ID NO: 2245875 - RNA, 15 nt, Human
acuaugauuuggaaa

SEQ ID NO: 2245876 - RNA, 16 nt, Human
acuaugcacaauuuaa

SEQ ID NO: 2245877 - RNA, 15 nt, Human
acuaugacugcuccc

SEQ ID NO: 2245878 - RNA, 20 nt, Human
acuaugcauggugccccagg

SEQ ID NO: 2245879 - RNA, 16 nt, Human
acuaugauuuggaaaa

SEQ ID NO: 2245880 - RNA, 24 nt, Human
acuaugcauggugccccaggacca

SEQ ID NO: 2245881 - RNA, 23 nt, Human
acuaugcauggugccccaggacc

SEQ ID NO: 2245882 - RNA, 22 nt, Human
acuaugcauggugccccaggac

SEQ ID NO: 2245883 - RNA, 21 nt, Human
acuaugcauggugccccagga

SEQ ID NO: 2245884 - RNA, 14 nt, Human
acuauaauguaagc

SEQ ID NO: 2245885 - RNA, 13 nt, Human
acuauaauguaag

SEQ ID NO: 2245886 - RNA, 12 nt, Human
acuauaauguaa

SEQ ID NO: 2245887 - RNA, 20 nt, Human
acuagagucugaacagcugu

SEQ ID NO: 2245888 - RNA, 21 nt, Human
acuagagucugaacagcugua

SEQ ID NO: 2245889 - RNA, 14 nt, Human
acuauguaacaugu

SEQ ID NO: 2245890 - RNA, 12 nt, Human
acuaugccugug

SEQ ID NO: 2245891 - RNA, 14 nt, Human
acuauggugccaau

SEQ ID NO: 2245892 - RNA, 20 nt, Human
acuauggugccaauggaacc

SEQ ID NO: 2245893 - RNA, 21 nt, Human
acuauggugccaauggaaccu

SEQ ID NO: 2245894 - RNA, 12 nt, Human
acuauguaucaa

SEQ ID NO: 2245895 - RNA, 13 nt, Human
acuauguugauaa

SEQ ID NO: 2245896 - RNA, 18 nt, Human
acuauucaaacagucuca

SEQ ID NO: 2245897 - RNA, 16 nt, Human
acuauucaaacagucu

SEQ ID NO: 2245898 - RNA, 14 nt, Human
acuauucaaacagu

SEQ ID NO: 2245899 - RNA, 13 nt, Human
acuauucaaacag

SEQ ID NO: 2245900 - RNA, 22 nt, Human
ucccccaccagcuaaggacauu

SEQ ID NO: 2245901 - RNA, 19 nt, Human
ucccccacccccuccccag

SEQ ID NO: 2245902 - RNA, 18 nt, Human
ucccccacccccucccca

SEQ ID NO: 2245903 - RNA, 17 nt, Human
ucccccaaccucagacu

SEQ ID NO: 2245904 - RNA, 22 nt, Human
ucccccaacccccaccccacac

SEQ ID NO: 2245905 - RNA, 14 nt, Human
uccccaucuggguc

SEQ ID NO: 2245906 - RNA, 21 nt, Human
ucccccacccccuccccaggg

SEQ ID NO: 2245907 - RNA, 20 nt, Human
ucccccacccccuccccagg

SEQ ID NO: 2245908 - RNA, 19 nt, Human
ucccccacccccuccccgc

SEQ ID NO: 2245909 - RNA, 22 nt, Human
ucccccacuccucuuauuugcu

SEQ ID NO: 2245910 - RNA, 14 nt, Human
ucccccacugccau

SEQ ID NO: 2245911 - RNA, 13 nt, Human
ucccccagacuuu

SEQ ID NO: 2245912 - RNA, 19 nt, Human
uccccauccuccagcuucu

SEQ ID NO: 2245913 - RNA, 17 nt, Human
uccccauccuccagcuu

SEQ ID NO: 2245914 - RNA, 18 nt, Human
uccccauccuccagcuuc

SEQ ID NO: 2245915 - RNA, 16 nt, Human
uccccaucaucccagc

SEQ ID NO: 2245916 - RNA, 17 nt, Human
uccccaucaucccagcu

SEQ ID NO: 2245917 - RNA, 19 nt, Human
uccccaucaucccagcugc

SEQ ID NO: 2245918 - RNA, 18 nt, Human
uccccaucaucuguggaa

SEQ ID NO: 2245919 - RNA, 14 nt, Human
uccccauccuccag

SEQ ID NO: 2245920 - RNA, 15 nt, Human
uccccauccuccagc

SEQ ID NO: 2245921 - RNA, 16 nt, Human
uccccauccuccagcu

SEQ ID NO: 2245922 - RNA, 14 nt, Human
uccccaucauccca

SEQ ID NO: 2245923 - RNA, 17 nt, Human
uccccaguuugcagaaa

SEQ ID NO: 2245924 - RNA, 15 nt, Human
uccccaguaaaauug

SEQ ID NO: 2245925 - RNA, 22 nt, Human
uccccagguggcugacccaguc

SEQ ID NO: 2245926 - RNA, 14 nt, Human
uccccaguaaaauu

SEQ ID NO: 2245927 - RNA, 22 nt, Human
uccccacugccugcccacccgu

SEQ ID NO: 2245928 - RNA, 20 nt, Human
uccccacugccugcccaccc

SEQ ID NO: 2245929 - RNA, 18 nt, Human
uccccacugccugcccac

SEQ ID NO: 2245930 - RNA, 14 nt, Human
uccccacugccugc

SEQ ID NO: 2245931 - RNA, 19 nt, Human
uccccacugacagccuccc

SEQ ID NO: 2245932 - RNA, 16 nt, Human
uccccacugacagccu

SEQ ID NO: 2245933 - RNA, 15 nt, Human
uccccacugccuacu

SEQ ID NO: 2245934 - RNA, 18 nt, Human
uccccacugccuacugca

SEQ ID NO: 2245935 - RNA, 20 nt, Human
uccccacugccuacugcauc

SEQ ID NO: 2245936 - RNA, 22 nt, Human
uccccacucccuggcucucaga

SEQ ID NO: 2245937 - RNA, 23 nt, Human
uccccacggggccucgggaccuc

SEQ ID NO: 2245938 - RNA, 18 nt, Human
uccccacggccgcuccag

SEQ ID NO: 2245939 - RNA, 19 nt, Human
uccccacggccgcuccagg

SEQ ID NO: 2245940 - RNA, 20 nt, Human
uccccacggccgcuccaggg

SEQ ID NO: 2245941 - RNA, 22 nt, Human
uccccacggggccucgggaccu

SEQ ID NO: 2245942 - RNA, 20 nt, Human
acgguauuaugcuucuugga

SEQ ID NO: 2245943 - RNA, 21 nt, Human
acggucccacacuggugacug

SEQ ID NO: 2245944 - RNA, 16 nt, Human
acggucgccaccuggc

SEQ ID NO: 2245945 - RNA, 18 nt, Human
uccccacgcccuccccuc

SEQ ID NO: 2245946 - RNA, 19 nt, Human
uccccacgcccuccccucc

SEQ ID NO: 2245947 - RNA, 13 nt, Human
acguacacacaca

SEQ ID NO: 2245948 - RNA, 12 nt, Human
acguacacauuu

SEQ ID NO: 2245949 - RNA, 14 nt, Human
acguacacauuuua

SEQ ID NO: 2245950 - RNA, 13 nt, Human
acguacacauuuu

SEQ ID NO: 2245951 - RNA, 22 nt, Human
acuagagggaccucucccaggg

SEQ ID NO: 2245952 - RNA, 15 nt, Human
acuagagucugaaca

SEQ ID NO: 2245953 - RNA, 20 nt, Human
acuagaguuuagcuggaaaa

SEQ ID NO: 2245954 - RNA, 21 nt, Human
acuagagggaccucucccagg

SEQ ID NO: 2245955 - RNA, 20 nt, Human
acuagagggaccucucccag

SEQ ID NO: 2245956 - RNA, 13 nt, Human
acuagaagaugaa

SEQ ID NO: 2245957 - RNA, 23 nt, Human
acuagaagggccaguccugccug

SEQ ID NO: 2245958 - RNA, 18 nt, Human
acuagaagaugaauacaa

SEQ ID NO: 2245959 - RNA, 17 nt, Human
acuagaauucuagugcu

SEQ ID NO: 2245960 - RNA, 14 nt, Human
acuagaagggccag

SEQ ID NO: 2245961 - RNA, 16 nt, Human
acuagaacucuccauc

SEQ ID NO: 2245962 - RNA, 15 nt, Human
acuagaauuuauuca

SEQ ID NO: 2245963 - RNA, 22 nt, Human
acuagaauucuagugcugcuga

SEQ ID NO: 2245964 - RNA, 23 nt, Human
acuagaauucuagugcugcugaa

SEQ ID NO: 2245965 - RNA, 18 nt, Human
acuagaauucuagugcug

SEQ ID NO: 2245966 - RNA, 19 nt, Human
acuagaauucuagugcugc

SEQ ID NO: 2245967 - RNA, 20 nt, Human
acuagaauucuagugcugcu

SEQ ID NO: 2245968 - RNA, 21 nt, Human
acuagaauucuagugcugcug

SEQ ID NO: 2245969 - RNA, 15 nt, Human
acuacgugacugugg

SEQ ID NO: 2245970 - RNA, 15 nt, Human
acuacguuaagggaa

SEQ ID NO: 2245971 - RNA, 18 nt, Human
acuacggaauaguuggcu

SEQ ID NO: 2245972 - RNA, 17 nt, Human
acuaccuugaaaauaag

SEQ ID NO: 2245973 - RNA, 18 nt, Human
acuaccuugguuccccca

SEQ ID NO: 2245974 - RNA, 13 nt, Human
acuaccugucaag

SEQ ID NO: 2245975 - RNA, 15 nt, Human
acuagaacucuccau

SEQ ID NO: 2245976 - RNA, 13 nt, Human
acuagaacucucc

SEQ ID NO: 2245977 - RNA, 15 nt, Human
acuagaaaucugcca

SEQ ID NO: 2245978 - RNA, 15 nt, Human
acuagaacacagaaa

SEQ ID NO: 2245979 - RNA, 14 nt, Human
acuagaaccuggag

SEQ ID NO: 2245980 - RNA, 15 nt, Human
acuagaaccuggagg

SEQ ID NO: 2245981 - RNA, 23 nt, Human
acuagaaccuggagggcuagaac

SEQ ID NO: 2245982 - RNA, 19 nt, Human
acuacuagaugucuuuagg

SEQ ID NO: 2245983 - RNA, 22 nt, Human
uacuuuuauaauaaaaggaaaa

SEQ ID NO: 2245984 - RNA, 19 nt, Human
uacuuuuaugauguauauu

SEQ ID NO: 2245985 - RNA, 21 nt, Human
uacuuuuaaacuguguacaua

SEQ ID NO: 2245986 - RNA, 16 nt, Human
uacuuuuauaauaaaa

SEQ ID NO: 2245987 - RNA, 14 nt, Human
uacuuuuuaaaugu

SEQ ID NO: 2245988 - RNA, 15 nt, Human
uacuuuugcccuuug

SEQ ID NO: 2245989 - RNA, 17 nt, Human
uacuuuugcaugaaaau

SEQ ID NO: 2245990 - RNA, 22 nt, Human
uagaaaaacccugcccccaaau

SEQ ID NO: 2245991 - RNA, 13 nt, Human
uagaaaaagcagu

SEQ ID NO: 2245992 - RNA, 13 nt, Human
uagaaaacugaaa

SEQ ID NO: 2245993 - RNA, 16 nt, Human
uagaaaacauaaucuu

SEQ ID NO: 2245994 - RNA, 16 nt, Human
uacuuuuucauucuuu

SEQ ID NO: 2245995 - RNA, 20 nt, Human
uacuuuuuaaaaucuuuucu

SEQ ID NO: 2245996 - RNA, 16 nt, Human
uagaaaaacccugccc

SEQ ID NO: 2245997 - RNA, 14 nt, Human
aauucauguuucuu

SEQ ID NO: 2245998 - RNA, 11 nt, Human
aauucaugaac

SEQ ID NO: 2245999 - RNA, 14 nt, Human
aauucaugaacuuc

SEQ ID NO: 2246000 - RNA, 17 nt, Human
aauuccaauuauaugag

SEQ ID NO: 2246001 - RNA, 16 nt, Human
aauuccacacccucac

SEQ ID NO: 2246002 - RNA, 16 nt, Human
aauuccacaccuuuua

SEQ ID NO: 2246003 - RNA, 13 nt, Human
aauuccacagcug

SEQ ID NO: 2246004 - RNA, 12 nt, Human
aauuccacagcu

SEQ ID NO: 2246005 - RNA, 14 nt, Human
aauuccacagcugc

SEQ ID NO: 2246006 - RNA, 20 nt, Human
aauuccacaccuuuuauuga

SEQ ID NO: 2246007 - RNA, 22 nt, Human
uacuuuguacaaagaccacaca

SEQ ID NO: 2246008 - RNA, 23 nt, Human
aauucaugaacuucgcaucaaaa

SEQ ID NO: 2246009 - RNA, 17 nt, Human
uacuuugccuuuugcaa

SEQ ID NO: 2246010 - RNA, 21 nt, Human
uacuuugccuuuccauaauca

SEQ ID NO: 2246011 - RNA, 19 nt, Human
uacuuugccuuuugcaaac

SEQ ID NO: 2246012 - RNA, 20 nt, Human
uacuuugccuuuugcaaacu

SEQ ID NO: 2246013 - RNA, 22 nt, Human
uacuuugccuuuugcaaacuuu

SEQ ID NO: 2246014 - RNA, 20 nt, Human
uacuuuggaauacauuucuc

SEQ ID NO: 2246015 - RNA, 12 nt, Human
uagaagaacugc

SEQ ID NO: 2246016 - RNA, 14 nt, Human
uagaagaagugugu

SEQ ID NO: 2246017 - RNA, 21 nt, Human
uagaagaauacaaacauauuu

SEQ ID NO: 2246018 - RNA, 22 nt, Human
uagaagaacauccaaggagaaa

SEQ ID NO: 2246019 - RNA, 18 nt, Human
uagaagaacauccaagga

SEQ ID NO: 2246020 - RNA, 19 nt, Human
uagaaacucaccauguaaa

SEQ ID NO: 2246021 - RNA, 16 nt, Human
uagaacucccuuucaa

SEQ ID NO: 2246022 - RNA, 15 nt, Human
uagaaacauugaaga

SEQ ID NO: 2246023 - RNA, 23 nt, Human
uagaaacaugguuuugaaaugcu

SEQ ID NO: 2246024 - RNA, 14 nt, Human
uagaaaccuuaaua

SEQ ID NO: 2246025 - RNA, 15 nt, Human
uagaaaccuuaauau

SEQ ID NO: 2246026 - RNA, 18 nt, Human
uagaacucccuuucaaca

SEQ ID NO: 2246027 - RNA, 17 nt, Human
uagaacucccuuucaac

SEQ ID NO: 2246028 - RNA, 22 nt, Human
uagaaaacugaaaaucuaauau

SEQ ID NO: 2246029 - RNA, 15 nt, Human
uagaaaacugaaaau

SEQ ID NO: 2246030 - RNA, 16 nt, Human
uagaaaacugaaaauc

SEQ ID NO: 2246031 - RNA, 20 nt, Human
uagaaaacugaaaaucuaau

SEQ ID NO: 2246032 - RNA, 21 nt, Human
uagaaaacugaaaaucuaaua

SEQ ID NO: 2246033 - RNA, 21 nt, Human
uagaaaagaaaaaaaaaauau

SEQ ID NO: 2246034 - RNA, 21 nt, Human
uagaaaaggcuagguacacag

SEQ ID NO: 2246035 - RNA, 22 nt, Human
uagaaaauuuguuauuuugcaa

SEQ ID NO: 2246036 - RNA, 23 nt, Human
uagaaaauuuguuauuuugcaac

SEQ ID NO: 2246037 - RNA, 14 nt, Human
uagaaacauaaaua

SEQ ID NO: 2246038 - RNA, 18 nt, Human
uagaaacauaaauaaaau

SEQ ID NO: 2246039 - RNA, 15 nt, Human
uagaaacacaacuau

SEQ ID NO: 2246040 - RNA, 22 nt, Human
aauuuuaagugcuuuguaaugg

SEQ ID NO: 2246041 - RNA, 16 nt, Human
aauuugucuugccuua

SEQ ID NO: 2246042 - RNA, 20 nt, Human
aauuugugauacaaugcugu

SEQ ID NO: 2246043 - RNA, 19 nt, Human
aauuuuaagugcuuuguaa

SEQ ID NO: 2246044 - RNA, 15 nt, Human
aauuuuaauuuauuu

SEQ ID NO: 2246045 - RNA, 13 nt, Human
aauuuuaauuuau

SEQ ID NO: 2246046 - RNA, 16 nt, Human
aauuuuaaugaagaaa

SEQ ID NO: 2246047 - RNA, 13 nt, Human
aauuuuaaugcua

SEQ ID NO: 2246048 - RNA, 18 nt, Human
aauuugugauacaaugcu

SEQ ID NO: 2246049 - RNA, 17 nt, Human
aauuugugauacaaugc

SEQ ID NO: 2246050 - RNA, 18 nt, Human
aauuuggccugcacuaau

SEQ ID NO: 2246051 - RNA, 16 nt, Human
aauuugggagauauau

SEQ ID NO: 2246052 - RNA, 16 nt, Human
aauuuggauugcuaau

SEQ ID NO: 2246053 - RNA, 18 nt, Human
aauuugggggaaaauuua

SEQ ID NO: 2246054 - RNA, 14 nt, Human
aauuugugauacaa

SEQ ID NO: 2246055 - RNA, 19 nt, Human
uagacauuuguaaauguaa

SEQ ID NO: 2246056 - RNA, 21 nt, Human
uagacauuugcuaugagcugg

SEQ ID NO: 2246057 - RNA, 13 nt, Human
uagacauucuguc

SEQ ID NO: 2246058 - RNA, 16 nt, Human
uagacauucugucgcc

SEQ ID NO: 2246059 - RNA, 14 nt, Human
uagaccaagcuugu

SEQ ID NO: 2246060 - RNA, 14 nt, Human
uagaccaaaauaaa

SEQ ID NO: 2246061 - RNA, 13 nt, Human
uagaccaaaauaa

SEQ ID NO: 2246062 - RNA, 18 nt, Human
uagacauuucucuuacug

SEQ ID NO: 2246063 - RNA, 21 nt, Human
uagacauuucucuuacugcaa

SEQ ID NO: 2246064 - RNA, 23 nt, Human
uagacauuucucuuacugcaaau

SEQ ID NO: 2246065 - RNA, 18 nt, Human
uagaccaagcuuguccaa

SEQ ID NO: 2246066 - RNA, 18 nt, Human
uagacagucucacuuugu

SEQ ID NO: 2246067 - RNA, 13 nt, Human
uagacauaacaaa

SEQ ID NO: 2246068 - RNA, 17 nt, Human
uagacagucccugccaa

SEQ ID NO: 2246069 - RNA, 21 nt, Human
uagacagucccugccaaugga

SEQ ID NO: 2246070 - RNA, 16 nt, Human
uagaauuuuaagugcu

SEQ ID NO: 2246071 - RNA, 21 nt, Human
uagaauuuugguauaaagaaa

SEQ ID NO: 2246072 - RNA, 14 nt, Human
uagacaaauacuca

SEQ ID NO: 2246073 - RNA, 15 nt, Human
uagacaaauacucau

SEQ ID NO: 2246074 - RNA, 16 nt, Human
uagacaaauacucaug

SEQ ID NO: 2246075 - RNA, 17 nt, Human
uagacaaauacucaugu

SEQ ID NO: 2246076 - RNA, 18 nt, Human
uagacaaauacucaugug

SEQ ID NO: 2246077 - RNA, 19 nt, Human
uagacaaauacucaugugu

SEQ ID NO: 2246078 - RNA, 20 nt, Human
uagacaaauacucaugugua

SEQ ID NO: 2246079 - RNA, 21 nt, Human
uagacaaauacucauguguau

SEQ ID NO: 2246080 - RNA, 13 nt, Human
uagaauuugauua

SEQ ID NO: 2246081 - RNA, 22 nt, Human
uagaagggccaguccugccugg

SEQ ID NO: 2246082 - RNA, 22 nt, Human
uagaagggcuagaaccuggaga

SEQ ID NO: 2246083 - RNA, 24 nt, Human
uagaagggcuagaaccuggagagc

SEQ ID NO: 2246084 - RNA, 19 nt, Human
uagaagggccaguccugcc

SEQ ID NO: 2246085 - RNA, 16 nt, Human
uagaaggguuauauuu

SEQ ID NO: 2246086 - RNA, 16 nt, Human
uagaaggucggaggcu

SEQ ID NO: 2246087 - RNA, 19 nt, Human
uagaagguucucuccuccc

SEQ ID NO: 2246088 - RNA, 20 nt, Human
uagaaguaggaagugaaaau

SEQ ID NO: 2246089 - RNA, 21 nt, Human
uagaaggucggaggcuuggga

SEQ ID NO: 2246090 - RNA, 21 nt, Human
uagaaggauguacauuuccaa

SEQ ID NO: 2246091 - RNA, 11 nt, Human
uagaaggccac

SEQ ID NO: 2246092 - RNA, 19 nt, Human
uagaaggccacaugucacc

SEQ ID NO: 2246093 - RNA, 17 nt, Human
uagaaggauguacauuu

SEQ ID NO: 2246094 - RNA, 23 nt, Human
uagaaggagacagagcugguugg

SEQ ID NO: 2246095 - RNA, 17 nt, Human
uagaaggagacagagcu

SEQ ID NO: 2246096 - RNA, 15 nt, Human
uagaaggagacagag

SEQ ID NO: 2246097 - RNA, 15 nt, Human
uagaagacauuuaua

SEQ ID NO: 2246098 - RNA, 17 nt, Human
uagaagcuggaggacua

SEQ ID NO: 2246099 - RNA, 13 nt, Human
uagaagacauuua

SEQ ID NO: 2246100 - RNA, 16 nt, Human
uagaagcuguaguagc

SEQ ID NO: 2246101 - RNA, 10 nt, Human
uagacagagu

SEQ ID NO: 2246102 - RNA, 16 nt, Human
uagacagucccugcca

SEQ ID NO: 2246103 - RNA, 21 nt, Human
uagacacuccccgaagucuuu

SEQ ID NO: 2246104 - RNA, 17 nt, Human
uagacacccauuuucac

SEQ ID NO: 2246105 - RNA, 17 nt, Human
uagacacuggcugccag

SEQ ID NO: 2246106 - RNA, 18 nt, Human
uagacacccauuuucaca

SEQ ID NO: 2246107 - RNA, 19 nt, Human
uagacacuggcugccagcu

SEQ ID NO: 2246108 - RNA, 22 nt, Human
uagacacuggcugccagcuauu

SEQ ID NO: 2246109 - RNA, 18 nt, Human
uagacaauuuauuauggc

SEQ ID NO: 2246110 - RNA, 13 nt, Human
uagacacacauga

SEQ ID NO: 2246111 - RNA, 19 nt, Human
uagacacauaugaggggga

SEQ ID NO: 2246112 - RNA, 18 nt, Human
uagcacacacuuuugguu

SEQ ID NO: 2246113 - RNA, 15 nt, Human
uagcacagacccugc

SEQ ID NO: 2246114 - RNA, 20 nt, Human
uagcacagacccugcccugu

SEQ ID NO: 2246115 - RNA, 21 nt, Human
uagcacagacccugcccugug

SEQ ID NO: 2246116 - RNA, 17 nt, Human
uagcaaucacaacacug

SEQ ID NO: 2246117 - RNA, 21 nt, Human
uagcaauccauguuaguuuuu

SEQ ID NO: 2246118 - RNA, 17 nt, Human
uagcaaguucuagagaa

SEQ ID NO: 2246119 - RNA, 18 nt, Human
uagcaaguucuagagaag

SEQ ID NO: 2246120 - RNA, 19 nt, Human
uagcaaguucuagagaaga

SEQ ID NO: 2246121 - RNA, 21 nt, Human
uagcaaguucuagagaagagg

SEQ ID NO: 2246122 - RNA, 14 nt, Human
uagcacagacccug

SEQ ID NO: 2246123 - RNA, 18 nt, Human
uagcaaguuacagugaug

SEQ ID NO: 2246124 - RNA, 16 nt, Human
uagcaaagauaucuca

SEQ ID NO: 2246125 - RNA, 14 nt, Human
uagcaaacuuugua

SEQ ID NO: 2246126 - RNA, 21 nt, Human
uagcaaaauucuuaaguaugu

SEQ ID NO: 2246127 - RNA, 12 nt, Human
uagcaaacagag

SEQ ID NO: 2246128 - RNA, 15 nt, Human
uagcaaacagaggaa

SEQ ID NO: 2246129 - RNA, 20 nt, Human
uagagggaccucucccaggg

SEQ ID NO: 2246130 - RNA, 22 nt, Human
uagaggcuucuccgccagccuc

SEQ ID NO: 2246131 - RNA, 19 nt, Human
uagagggaccucucccagg

SEQ ID NO: 2246132 - RNA, 15 nt, Human
uagagggaccucucc

SEQ ID NO: 2246133 - RNA, 13 nt, Human
uagaggcuagcuu

SEQ ID NO: 2246134 - RNA, 14 nt, Human
uagaggcuucuccg

SEQ ID NO: 2246135 - RNA, 18 nt, Human
uagaggcuucuccgccag

SEQ ID NO: 2246136 - RNA, 19 nt, Human
uagaggcuucuccgccagc

SEQ ID NO: 2246137 - RNA, 20 nt, Human
uagaggcuucuccgccagcc

SEQ ID NO: 2246138 - RNA, 21 nt, Human
uagaggcuucuccgccagccu

SEQ ID NO: 2246139 - RNA, 23 nt, Human
uagaggcuucuccgccagccucc

SEQ ID NO: 2246140 - RNA, 24 nt, Human
uagaggggaaaagagaugaugaaa

SEQ ID NO: 2246141 - RNA, 14 nt, Human
uagagggaggggcc

SEQ ID NO: 2246142 - RNA, 13 nt, Human
uagagggaggggc

SEQ ID NO: 2246143 - RNA, 23 nt, Human
uagagggaggagaaugagccucg

SEQ ID NO: 2246144 - RNA, 14 nt, Human
uagaggguguguaa

SEQ ID NO: 2246145 - RNA, 22 nt, Human
uagcaaaacgcauggagugugu

SEQ ID NO: 2246146 - RNA, 23 nt, Human
uagcaaaacgcauggagugugua

SEQ ID NO: 2246147 - RNA, 17 nt, Human
uagaggguuccuguaga

SEQ ID NO: 2246148 - RNA, 13 nt, Human
uagaggguuccug

SEQ ID NO: 2246149 - RNA, 23 nt, Human
uagaggggggauuuccagccagg

SEQ ID NO: 2246150 - RNA, 20 nt, Human
uagagggagguguuuaaaga

SEQ ID NO: 2246151 - RNA, 14 nt, Human
uagagggcccuggu

SEQ ID NO: 2246152 - RNA, 23 nt, Human
uagauuuuguuuugcuuuuucug

SEQ ID NO: 2246153 - RNA, 17 nt, Human
uagauuuuguuuugcuu

SEQ ID NO: 2246154 - RNA, 17 nt, Human
uagccacuuaccuucaa

SEQ ID NO: 2246155 - RNA, 16 nt, Human
uagccacuuaccuuca

SEQ ID NO: 2246156 - RNA, 14 nt, Human
uagccacucaggag

SEQ ID NO: 2246157 - RNA, 13 nt, Human
uagccacucagga

SEQ ID NO: 2246158 - RNA, 19 nt, Human
uagccaccccagaaauggu

SEQ ID NO: 2246159 - RNA, 19 nt, Human
uagccaccgccuccuacag

SEQ ID NO: 2246160 - RNA, 22 nt, Human
acaaaucaagcuucaguuuccu

SEQ ID NO: 2246161 - RNA, 20 nt, Human
uagccacauuuggaauacuu

SEQ ID NO: 2246162 - RNA, 13 nt, Human
uagccaaggccaa

SEQ ID NO: 2246163 - RNA, 14 nt, Human
uagccaccaacucu

SEQ ID NO: 2246164 - RNA, 21 nt, Human
uagccacauuuggaauacuuu

SEQ ID NO: 2246165 - RNA, 22 nt, Human
uagccaccaacucuugcagguc

SEQ ID NO: 2246166 - RNA, 13 nt, Human
uagccaccaucuu

SEQ ID NO: 2246167 - RNA, 14 nt, Human
uagccaccaucuuu

SEQ ID NO: 2246168 - RNA, 16 nt, Human
uagccaccaucuuugc

SEQ ID NO: 2246169 - RNA, 18 nt, Human
uagccaccgccuccuaca

SEQ ID NO: 2246170 - RNA, 18 nt, Human
uagccacccaccacacug

SEQ ID NO: 2246171 - RNA, 15 nt, Human
uagcacuggccugca

SEQ ID NO: 2246172 - RNA, 12 nt, Human
uagccaaggcca

SEQ ID NO: 2246173 - RNA, 16 nt, Human
uagccaaacccuuguc

SEQ ID NO: 2246174 - RNA, 21 nt, Human
uagccaacacccaucuguuuu

SEQ ID NO: 2246175 - RNA, 20 nt, Human
uagccaaaugguuuaacuuc

SEQ ID NO: 2246176 - RNA, 13 nt, Human
uagcacugagcaa

SEQ ID NO: 2246177 - RNA, 13 nt, Human
uagcacuggccug

SEQ ID NO: 2246178 - RNA, 20 nt, Human
uagcacuaccacuccugcca

SEQ ID NO: 2246179 - RNA, 16 nt, Human
uagcacuaccacuccu

SEQ ID NO: 2246180 - RNA, 13 nt, Human
uagcaccagggac

SEQ ID NO: 2246181 - RNA, 13 nt, Human
uagcaccagggcu

SEQ ID NO: 2246182 - RNA, 24 nt, Human
uagcacagacccugcccugugggc

SEQ ID NO: 2246183 - RNA, 22 nt, Human
uagcacagacccugcccugugg

SEQ ID NO: 2246184 - RNA, 19 nt, Human
acaaaaucgauuggcuuua

SEQ ID NO: 2246185 - RNA, 24 nt, Human
acaaagguugagauguaaaaggua

SEQ ID NO: 2246186 - RNA, 19 nt, Human
acaaagguauaauuuuaug

SEQ ID NO: 2246187 - RNA, 14 nt, Human
acaaaaucuccucu

SEQ ID NO: 2246188 - RNA, 22 nt, Human
acaaaauaaccaauccuggaca

SEQ ID NO: 2246189 - RNA, 12 nt, Human
acaaaauagaag

SEQ ID NO: 2246190 - RNA, 15 nt, Human
acaaaauagaagcug

SEQ ID NO: 2246191 - RNA, 18 nt, Human
acaaaauagaagcuguag

SEQ ID NO: 2246192 - RNA, 20 nt, Human
acaaaauccagcuaugaaua

SEQ ID NO: 2246193 - RNA, 16 nt, Human
acaaauaauaagcaaa

SEQ ID NO: 2246194 - RNA, 16 nt, Human
acaaauaacaaugugc

SEQ ID NO: 2246195 - RNA, 13 nt, Human
acaaauacucaug

SEQ ID NO: 2246196 - RNA, 21 nt, Human
acaaagguuuuccucuucuau

SEQ ID NO: 2246197 - RNA, 14 nt, Human
acaaaguaauuccu

SEQ ID NO: 2246198 - RNA, 12 nt, Human
uagaggccugag

SEQ ID NO: 2246199 - RNA, 15 nt, Human
uagaggccugaggau

SEQ ID NO: 2246200 - RNA, 23 nt, Human
uagaggccugaggaugagcugga

SEQ ID NO: 2246201 - RNA, 19 nt, Human
uagaggcuuccuucauuuc

SEQ ID NO: 2246202 - RNA, 18 nt, Human
uagaggcuuccuucauuu

SEQ ID NO: 2246203 - RNA, 17 nt, Human
uagaggcuuccuucauu

SEQ ID NO: 2246204 - RNA, 16 nt, Human
uagaggcuuccuucau

SEQ ID NO: 2246205 - RNA, 17 nt, Human
uagagccugccuggagc

SEQ ID NO: 2246206 - RNA, 18 nt, Human
uagagccugccuggagcg

SEQ ID NO: 2246207 - RNA, 12 nt, Human
uagagccugccu

SEQ ID NO: 2246208 - RNA, 13 nt, Human
uagagccugccug

SEQ ID NO: 2246209 - RNA, 16 nt, Human
uagagccugccuggag

SEQ ID NO: 2246210 - RNA, 22 nt, Human
uagagcggagaaaggaagggcu

SEQ ID NO: 2246211 - RNA, 23 nt, Human
acaaauacucuuaggaagagaaa

SEQ ID NO: 2246212 - RNA, 18 nt, Human
acaaauacucauguguau

SEQ ID NO: 2246213 - RNA, 15 nt, Human
acaaauacucuuagg

SEQ ID NO: 2246214 - RNA, 17 nt, Human
acaaauacucuuaggaa

SEQ ID NO: 2246215 - RNA, 14 nt, Human
acaaauacucaugu

SEQ ID NO: 2246216 - RNA, 15 nt, Human
acaaauacucaugug

SEQ ID NO: 2246217 - RNA, 16 nt, Human
acaaauacucaugugu

SEQ ID NO: 2246218 - RNA, 17 nt, Human
acaaauacucaugugua

SEQ ID NO: 2246219 - RNA, 14 nt, Human
uagagccagggucu

SEQ ID NO: 2246220 - RNA, 14 nt, Human
uagagccugaggga

SEQ ID NO: 2246221 - RNA, 16 nt, Human
acaaaaacacagcaag

SEQ ID NO: 2246222 - RNA, 15 nt, Human
acaaaaagcuucccc

SEQ ID NO: 2246223 - RNA, 14 nt, Human
acaaaaagcuuccc

SEQ ID NO: 2246224 - RNA, 15 nt, Human
acaaaaacacagcaa

SEQ ID NO: 2246225 - RNA, 14 nt, Human
acaaaaacacagca

SEQ ID NO: 2246226 - RNA, 18 nt, Human
aauuuuacccuuuagacu

SEQ ID NO: 2246227 - RNA, 15 nt, Human
acaaaaaacuccccu

SEQ ID NO: 2246228 - RNA, 17 nt, Human
aauuuuacccuuuagac

SEQ ID NO: 2246229 - RNA, 21 nt, Human
aauuuuacccuuuagacugua

SEQ ID NO: 2246230 - RNA, 13 nt, Human
acaaaaacacagc

SEQ ID NO: 2246231 - RNA, 12 nt, Human
aauuuuacauuu

SEQ ID NO: 2246232 - RNA, 16 nt, Human
aauuuuaauauuuuau

SEQ ID NO: 2246233 - RNA, 15 nt, Human
acaaaaauugacuca

SEQ ID NO: 2246234 - RNA, 19 nt, Human
acaaaaauucucaguucuc

SEQ ID NO: 2246235 - RNA, 14 nt, Human
acaaaaauuaaaau

SEQ ID NO: 2246236 - RNA, 23 nt, Human
acaaaaaugaacugaaguuucac

SEQ ID NO: 2246237 - RNA, 21 nt, Human
acaaaaauguaaugaucauaa

SEQ ID NO: 2246238 - RNA, 22 nt, Human
acaaaaagguaaaacuuuuuau

SEQ ID NO: 2246239 - RNA, 20 nt, Human
acaaaaagguucucaggugu

SEQ ID NO: 2246240 - RNA, 18 nt, Human
acaaaaaguuuccauaug

SEQ ID NO: 2246241 - RNA, 22 nt, Human
acaaaaaugaaagcaugucuca

SEQ ID NO: 2246242 - RNA, 19 nt, Human
acaaaaaugaacugaaguu

SEQ ID NO: 2246243 - RNA, 13 nt, Human
acaaaaauauaaa

SEQ ID NO: 2246244 - RNA, 12 nt, Human
acaaaaauaaca

SEQ ID NO: 2246245 - RNA, 14 nt, Human
acaaaaauuaggua

SEQ ID NO: 2246246 - RNA, 12 nt, Human
acaaaacaaaug

SEQ ID NO: 2246247 - RNA, 17 nt, Human
acaaaacaacccuagag

SEQ ID NO: 2246248 - RNA, 23 nt, Human
acaaaacacucggcauuucaaau

SEQ ID NO: 2246249 - RNA, 21 nt, Human
acaaaaggguuuaaacugauu

SEQ ID NO: 2246250 - RNA, 15 nt, Human
acaaaacuacaugag

SEQ ID NO: 2246251 - RNA, 22 nt, Human
acaaaaguuucauccuuuucau

SEQ ID NO: 2246252 - RNA, 14 nt, Human
acaaaauaaacaaa

SEQ ID NO: 2246253 - RNA, 12 nt, Human
acaaaauaaaca

SEQ ID NO: 2246254 - RNA, 14 nt, Human
acacagggacuuga

SEQ ID NO: 2246255 - RNA, 16 nt, Human
acacaggcccucccug

SEQ ID NO: 2246256 - RNA, 13 nt, Human
acacaggcccucc

SEQ ID NO: 2246257 - RNA, 23 nt, Human
acacaggcccggcuccaggcucc

SEQ ID NO: 2246258 - RNA, 24 nt, Human
acacaggcccggcuccaggcuccu

SEQ ID NO: 2246259 - RNA, 19 nt, Human
acacaggcccggcuccagg

SEQ ID NO: 2246260 - RNA, 20 nt, Human
acacaggcccggcuccaggc

SEQ ID NO: 2246261 - RNA, 21 nt, Human
acacaggcccggcuccaggcu

SEQ ID NO: 2246262 - RNA, 22 nt, Human
acacaggcccggcuccaggcuc

SEQ ID NO: 2246263 - RNA, 13 nt, Human
acacacagaggaa

SEQ ID NO: 2246264 - RNA, 22 nt, Human
acacacagaggaagagcaggca

SEQ ID NO: 2246265 - RNA, 23 nt, Human
acacacagauuugagcucagccc

SEQ ID NO: 2246266 - RNA, 13 nt, Human
acacacagacaca

SEQ ID NO: 2246267 - RNA, 22 nt, Human
acacacagaaaauauacuguaa

SEQ ID NO: 2246268 - RNA, 21 nt, Human
acacacagaaaauauacugua

SEQ ID NO: 2246269 - RNA, 20 nt, Human
acacacagaaaauauacugu

SEQ ID NO: 2246270 - RNA, 19 nt, Human
acacacagaaaauauacug

SEQ ID NO: 2246271 - RNA, 18 nt, Human
acacacagaaaauauacu

SEQ ID NO: 2246272 - RNA, 17 nt, Human
acacacagaaaauauac

SEQ ID NO: 2246273 - RNA, 16 nt, Human
acacacagaaaauaua

SEQ ID NO: 2246274 - RNA, 15 nt, Human
acacacagaaaauau

SEQ ID NO: 2246275 - RNA, 14 nt, Human
acacacagaaaaua

SEQ ID NO: 2246276 - RNA, 13 nt, Human
acacacagaaaau

SEQ ID NO: 2246277 - RNA, 15 nt, Human
acacacacacaugca

SEQ ID NO: 2246278 - RNA, 21 nt, Human
acacaggcaacugaggcagac

SEQ ID NO: 2246279 - RNA, 12 nt, Human
acacacagccac

SEQ ID NO: 2246280 - RNA, 11 nt, Human
acacacagcca

SEQ ID NO: 2246281 - RNA, 16 nt, Human
acacaggcccggcucc

SEQ ID NO: 2246282 - RNA, 17 nt, Human
acacaggcccggcucca

SEQ ID NO: 2246283 - RNA, 18 nt, Human
acacaggcccggcuccag

SEQ ID NO: 2246284 - RNA, 15 nt, Human
uaguaaaaauacaaa

SEQ ID NO: 2246285 - RNA, 20 nt, Human
uagguuuuuuuccuucugaa

SEQ ID NO: 2246286 - RNA, 13 nt, Human
uaguaaaaauuaa

SEQ ID NO: 2246287 - RNA, 16 nt, Human
uaguaaaaauuaaaaa

SEQ ID NO: 2246288 - RNA, 14 nt, Human
uaguaaucacaguu

SEQ ID NO: 2246289 - RNA, 19 nt, Human
uagguuuuuuuguauagua

SEQ ID NO: 2246290 - RNA, 15 nt, Human
uagguuuuuuuguau

SEQ ID NO: 2246291 - RNA, 15 nt, Human
uagguuuuuauuagu

SEQ ID NO: 2246292 - RNA, 15 nt, Human
uagguuuuuguuugu

SEQ ID NO: 2246293 - RNA, 13 nt, Human
uaguaaaaauaaa

SEQ ID NO: 2246294 - RNA, 16 nt, Human
uaguaaaaauaaaauu

SEQ ID NO: 2246295 - RNA, 15 nt, Human
acacaggucuuuccu

SEQ ID NO: 2246296 - RNA, 16 nt, Human
uagguuuuguuugcua

SEQ ID NO: 2246297 - RNA, 21 nt, Human
uagguuuuguuugcuaucuua

SEQ ID NO: 2246298 - RNA, 23 nt, Human
uagguuuuguuugcuaucuuaau

SEQ ID NO: 2246299 - RNA, 11 nt, Human
acacagggcag

SEQ ID NO: 2246300 - RNA, 15 nt, Human
acacagggacuugaa

SEQ ID NO: 2246301 - RNA, 18 nt, Human
acacagggacuugaaguu

SEQ ID NO: 2246302 - RNA, 16 nt, Human
acacaggucuuuccua

SEQ ID NO: 2246303 - RNA, 14 nt, Human
acacaggucuuucc

SEQ ID NO: 2246304 - RNA, 16 nt, Human
acacagguucacgugc

SEQ ID NO: 2246305 - RNA, 15 nt, Human
uaguaauguuuuaua

SEQ ID NO: 2246306 - RNA, 21 nt, Human
uaguaaugcuacgugugauuu

SEQ ID NO: 2246307 - RNA, 22 nt, Human
uaguaaugcuacgugugauuuu

SEQ ID NO: 2246308 - RNA, 14 nt, Human
uaguaauugacaug

SEQ ID NO: 2246309 - RNA, 14 nt, Human
uaguaauucucagg

SEQ ID NO: 2246310 - RNA, 15 nt, Human
uaguaauucucaggc

SEQ ID NO: 2246311 - RNA, 14 nt, Human
uaguagagacaggg

SEQ ID NO: 2246312 - RNA, 12 nt, Human
uaguaaucauau

SEQ ID NO: 2246313 - RNA, 20 nt, Human
uaguaaugcuacgugugauu

SEQ ID NO: 2246314 - RNA, 15 nt, Human
uaguaaucacaguug

SEQ ID NO: 2246315 - RNA, 15 nt, Human
uaguagagacagggu

SEQ ID NO: 2246316 - RNA, 22 nt, Human
uaguagagacaggguuuugcca

SEQ ID NO: 2246317 - RNA, 13 nt, Human
uaguagagacggg

SEQ ID NO: 2246318 - RNA, 23 nt, Human
uagucacauggccuaugcacaua

SEQ ID NO: 2246319 - RNA, 14 nt, Human
uagucacugagaca

SEQ ID NO: 2246320 - RNA, 23 nt, Human
acaaugcaaaccaucauugaaau

SEQ ID NO: 2246321 - RNA, 19 nt, Human
acaaugcaaaccaucauug

SEQ ID NO: 2246322 - RNA, 21 nt, Human
acaaugcaaaccaucauugaa

SEQ ID NO: 2246323 - RNA, 13 nt, Human
acacaacacacac

SEQ ID NO: 2246324 - RNA, 13 nt, Human
acacaagccacag

SEQ ID NO: 2246325 - RNA, 13 nt, Human
acacaacuauauu

SEQ ID NO: 2246326 - RNA, 14 nt, Human
acacaaaugcaggg

SEQ ID NO: 2246327 - RNA, 14 nt, Human
acacaauacaauaa

SEQ ID NO: 2246328 - RNA, 14 nt, Human
acacacacacacag

SEQ ID NO: 2246329 - RNA, 12 nt, Human
acacaauacaau

SEQ ID NO: 2246330 - RNA, 14 nt, Human
acacaaguaaacau

SEQ ID NO: 2246331 - RNA, 15 nt, Human
acacaaguccuguga

SEQ ID NO: 2246332 - RNA, 16 nt, Human
acacaaguccugugaa

SEQ ID NO: 2246333 - RNA, 14 nt, Human
acacaagccacaga

SEQ ID NO: 2246334 - RNA, 15 nt, Human
acacaagccacagaa

SEQ ID NO: 2246335 - RNA, 16 nt, Human
acacaagccacagaag

SEQ ID NO: 2246336 - RNA, 19 nt, Human
acacaagccacagaagcca

SEQ ID NO: 2246337 - RNA, 14 nt, Human
acacaagcuggaag

SEQ ID NO: 2246338 - RNA, 15 nt, Human
acacaagcuggaagc

SEQ ID NO: 2246339 - RNA, 13 nt, Human
acacaaguaaaca

SEQ ID NO: 2246340 - RNA, 22 nt, Human
acacaagcuuuuuuacacaaau

SEQ ID NO: 2246341 - RNA, 23 nt, Human
acacaaggauagaugcuggccca

SEQ ID NO: 2246342 - RNA, 19 nt, Human
acacaaggauagaugcugg

SEQ ID NO: 2246343 - RNA, 13 nt, Human
acacacacacagg

SEQ ID NO: 2246344 - RNA, 15 nt, Human
acacacacacacagg

SEQ ID NO: 2246345 - RNA, 12 nt, Human
acacacacacau

SEQ ID NO: 2246346 - RNA, 15 nt, Human
acacacacacagcca

SEQ ID NO: 2246347 - RNA, 14 nt, Human
acacacacacagcc

SEQ ID NO: 2246348 - RNA, 14 nt, Human
acacacacacagga

SEQ ID NO: 2246349 - RNA, 14 nt, Human
acacacacacaugc

SEQ ID NO: 2246350 - RNA, 13 nt, Human
acacacacacaug

SEQ ID NO: 2246351 - RNA, 13 nt, Human
acacacacacagc

SEQ ID NO: 2246352 - RNA, 12 nt, Human
acacacacacag

SEQ ID NO: 2246353 - RNA, 17 nt, Human
acacacacacacaugca

SEQ ID NO: 2246354 - RNA, 16 nt, Human
acacacacacacaugc

SEQ ID NO: 2246355 - RNA, 15 nt, Human
acacacacacacaug

SEQ ID NO: 2246356 - RNA, 14 nt, Human
acacacacacacau

SEQ ID NO: 2246357 - RNA, 16 nt, Human
acacacacacacagcc

SEQ ID NO: 2246358 - RNA, 15 nt, Human
acacacacacacagc

SEQ ID NO: 2246359 - RNA, 18 nt, Human
uaggguaaggugccuucu

SEQ ID NO: 2246360 - RNA, 15 nt, Human
uaggguaaggugccu

SEQ ID NO: 2246361 - RNA, 19 nt, Human
uaggguaagugagagaggg

SEQ ID NO: 2246362 - RNA, 15 nt, Human
uagggucucuucagg

SEQ ID NO: 2246363 - RNA, 15 nt, Human
uagggucggaaccca

SEQ ID NO: 2246364 - RNA, 13 nt, Human
uaggguccugggg

SEQ ID NO: 2246365 - RNA, 17 nt, Human
uaggguuauaauaaugu

SEQ ID NO: 2246366 - RNA, 12 nt, Human
uaggguuuaauc

SEQ ID NO: 2246367 - RNA, 19 nt, Human
uaggguuuaauccccagua

SEQ ID NO: 2246368 - RNA, 21 nt, Human
uaggguuuaauccccaguaaa

SEQ ID NO: 2246369 - RNA, 15 nt, Human
uaggguuauaauaau

SEQ ID NO: 2246370 - RNA, 12 nt, Human
uaggguggcccu

SEQ ID NO: 2246371 - RNA, 16 nt, Human
uaggguggagagccac

SEQ ID NO: 2246372 - RNA, 15 nt, Human
uagggugggccuuca

SEQ ID NO: 2246373 - RNA, 14 nt, Human
acaaugacuuuauu

SEQ ID NO: 2246374 - RNA, 13 nt, Human
acaaugacuuuau

SEQ ID NO: 2246375 - RNA, 15 nt, Human
acaaugauauaugga

SEQ ID NO: 2246376 - RNA, 22 nt, Human
acaaugacuuacuguacaugaa

SEQ ID NO: 2246377 - RNA, 19 nt, Human
acaaugacuuacuguacau

SEQ ID NO: 2246378 - RNA, 20 nt, Human
acaaugacuuacuguacaug

SEQ ID NO: 2246379 - RNA, 11 nt, Human
acaaugcaaac

SEQ ID NO: 2246380 - RNA, 16 nt, Human
acaaugcaaaccauca

SEQ ID NO: 2246381 - RNA, 17 nt, Human
acaaugcaaaccaucau

SEQ ID NO: 2246382 - RNA, 18 nt, Human
acaaugcaaaccaucauu

SEQ ID NO: 2246383 - RNA, 14 nt, Human
acaaaucuaugcca

SEQ ID NO: 2246384 - RNA, 15 nt, Human
acaaaucuaugccac

SEQ ID NO: 2246385 - RNA, 21 nt, Human
acaaaucucaagcaaacagcu

SEQ ID NO: 2246386 - RNA, 21 nt, Human
acaaaucuaugccacucagaa

SEQ ID NO: 2246387 - RNA, 18 nt, Human
acaauauuuaaaauuuau

SEQ ID NO: 2246388 - RNA, 14 nt, Human
acaauauuuaaaau

SEQ ID NO: 2246389 - RNA, 13 nt, Human
acaauauuuaaaa

SEQ ID NO: 2246390 - RNA, 10 nt, Human
acaauauuua

SEQ ID NO: 2246391 - RNA, 15 nt, Human
acaauauuguuucua

SEQ ID NO: 2246392 - RNA, 14 nt, Human
acaauauuguuucu

SEQ ID NO: 2246393 - RNA, 19 nt, Human
acaaucagccacauucuag

SEQ ID NO: 2246394 - RNA, 18 nt, Human
acaaucagcuccuuccug

SEQ ID NO: 2246395 - RNA, 22 nt, Human
acaaucagcuccuuccuggaga

SEQ ID NO: 2246396 - RNA, 20 nt, Human
uagccuuagaagucacacag

SEQ ID NO: 2246397 - RNA, 23 nt, Human
acaaucaacucuaauagugcuua

SEQ ID NO: 2246398 - RNA, 19 nt, Human
acaaucaaaggaaaauagu

SEQ ID NO: 2246399 - RNA, 14 nt, Human
acaaucaaaggaaa

SEQ ID NO: 2246400 - RNA, 16 nt, Human
acaauauuuaaaauuu

SEQ ID NO: 2246401 - RNA, 17 nt, Human
acaauauuuuguggcuu

SEQ ID NO: 2246402 - RNA, 15 nt, Human
uagccuuauccucug

SEQ ID NO: 2246403 - RNA, 21 nt, Human
uagccuuagaagucacacagu

SEQ ID NO: 2246404 - RNA, 22 nt, Human
uagccuuccguaacccaacucu

SEQ ID NO: 2246405 - RNA, 20 nt, Human
uagccuuccguaacccaacu

SEQ ID NO: 2246406 - RNA, 16 nt, Human
uagccuuauccucuga

SEQ ID NO: 2246407 - RNA, 17 nt, Human
uagccuuauccucugau

SEQ ID NO: 2246408 - RNA, 18 nt, Human
uagccuuauccucugauc

SEQ ID NO: 2246409 - RNA, 20 nt, Human
uagccuuauccucugaucuc

SEQ ID NO: 2246410 - RNA, 14 nt, Human
uagcgcccaguugg

SEQ ID NO: 2246411 - RNA, 22 nt, Human
uagcgcugccgcaccccagagu

SEQ ID NO: 2246412 - RNA, 21 nt, Human
uagcgcugccgcaccccagag

SEQ ID NO: 2246413 - RNA, 17 nt, Human
uagcgcccaguugggug

SEQ ID NO: 2246414 - RNA, 14 nt, Human
uagcuuuuuaauug

SEQ ID NO: 2246415 - RNA, 15 nt, Human
uagcuuuuuaauugu

SEQ ID NO: 2246416 - RNA, 16 nt, Human
uagcuuuuuaauuguu

SEQ ID NO: 2246417 - RNA, 13 nt, Human
uaggaaaaacuga

SEQ ID NO: 2246418 - RNA, 14 nt, Human
uaggaaaaacugau

SEQ ID NO: 2246419 - RNA, 13 nt, Human
uagcuuuucccuu

SEQ ID NO: 2246420 - RNA, 18 nt, Human
uagcuuuuauuguauaaa

SEQ ID NO: 2246421 - RNA, 15 nt, Human
uagcuuugcucuuug

SEQ ID NO: 2246422 - RNA, 14 nt, Human
uagcuuuuauugua

SEQ ID NO: 2246423 - RNA, 20 nt, Human
uagcuuuauuuuuuaaguau

SEQ ID NO: 2246424 - RNA, 19 nt, Human
uagcuuuauuuuuuaagua

SEQ ID NO: 2246425 - RNA, 22 nt, Human
uagcuuuauuuuuuaaguauuu

SEQ ID NO: 2246426 - RNA, 15 nt, Human
uagcuuucaauuccg

SEQ ID NO: 2246427 - RNA, 15 nt, Human
uagcuuuauucuuca

SEQ ID NO: 2246428 - RNA, 19 nt, Human
uagcuuucccaaauaaacu

SEQ ID NO: 2246429 - RNA, 23 nt, Human
uagcuuucaauuccguagccagc

SEQ ID NO: 2246430 - RNA, 17 nt, Human
uagcuuucaauuccgua

SEQ ID NO: 2246431 - RNA, 11 nt, Human
uagcuuugcuc

SEQ ID NO: 2246432 - RNA, 14 nt, Human
uagcuuugcucugc

SEQ ID NO: 2246433 - RNA, 16 nt, Human
uagcuuugcucugcca

SEQ ID NO: 2246434 - RNA, 15 nt, Human
uagcuuggaaacugg

SEQ ID NO: 2246435 - RNA, 20 nt, Human
uagcuuggaaacuggaugag

SEQ ID NO: 2246436 - RNA, 17 nt, Human
uagcuugcgcauucuca

SEQ ID NO: 2246437 - RNA, 19 nt, Human
uagcuugcgcauucucaug

SEQ ID NO: 2246438 - RNA, 19 nt, Human
uagcuugggaggcuucccc

SEQ ID NO: 2246439 - RNA, 15 nt, Human
uagcuugggacaaau

SEQ ID NO: 2246440 - RNA, 18 nt, Human
uagcuugggacaaaucaa

SEQ ID NO: 2246441 - RNA, 13 nt, Human
uagcuuguauagu

SEQ ID NO: 2246442 - RNA, 17 nt, Human
uagcuuguauaguguaa

SEQ ID NO: 2246443 - RNA, 19 nt, Human
uagcuuguauaguguaaaa

SEQ ID NO: 2246444 - RNA, 15 nt, Human
uagcuuguucccugu

SEQ ID NO: 2246445 - RNA, 18 nt, Human
uagcuuuauuuuuuaagu

SEQ ID NO: 2246446 - RNA, 13 nt, Human
uagcuuuauucuu

SEQ ID NO: 2246447 - RNA, 14 nt, Human
uagcuuuauucuuc

SEQ ID NO: 2246448 - RNA, 16 nt, Human
uagcuuuagacccugg

SEQ ID NO: 2246449 - RNA, 17 nt, Human
uagcuuuagacccuggg

SEQ ID NO: 2246450 - RNA, 18 nt, Human
uagcuuuagacccugggu

SEQ ID NO: 2246451 - RNA, 19 nt, Human
uagcuuuacuguuuguuau

SEQ ID NO: 2246452 - RNA, 15 nt, Human
uagcuuuacccucag

SEQ ID NO: 2246453 - RNA, 14 nt, Human
uagcuuuacccuca

SEQ ID NO: 2246454 - RNA, 21 nt, Human
uagcuucaccccaaucccagc

SEQ ID NO: 2246455 - RNA, 12 nt, Human
uagcuuccauga

SEQ ID NO: 2246456 - RNA, 19 nt, Human
uagcuaagcggaccagccu

SEQ ID NO: 2246457 - RNA, 21 nt, Human
uagcuucuaccaugaacagaa

SEQ ID NO: 2246458 - RNA, 13 nt, Human
uagcuucugcuuu

SEQ ID NO: 2246459 - RNA, 15 nt, Human
uagcuucugcuuuuc

SEQ ID NO: 2246460 - RNA, 16 nt, Human
uagcuucugcuuuucu

SEQ ID NO: 2246461 - RNA, 19 nt, Human
uagcuugaaggaucuguuu

SEQ ID NO: 2246462 - RNA, 22 nt, Human
uagcuucugcuuuucugcccug

SEQ ID NO: 2246463 - RNA, 19 nt, Human
uagcuugauaaagggccaa

SEQ ID NO: 2246464 - RNA, 20 nt, Human
uagcuaagaaauaaaacugu

SEQ ID NO: 2246465 - RNA, 20 nt, Human
uagcuaacauuuuaaauaaa

SEQ ID NO: 2246466 - RNA, 23 nt, Human
uagcuaacauuuuaaauaaaaga

SEQ ID NO: 2246467 - RNA, 20 nt, Human
uagcuaaacggauuccaaag

SEQ ID NO: 2246468 - RNA, 19 nt, Human
uagcuaaacggauuccaaa

SEQ ID NO: 2246469 - RNA, 18 nt, Human
uagcuaaacggauuccaa

SEQ ID NO: 2246470 - RNA, 19 nt, Human
uagggcaguaacauugggu

SEQ ID NO: 2246471 - RNA, 15 nt, Human
uagggcagcuugccc

SEQ ID NO: 2246472 - RNA, 19 nt, Human
uagggcauaaugaugaugg

SEQ ID NO: 2246473 - RNA, 11 nt, Human
uagggcagcuu

SEQ ID NO: 2246474 - RNA, 13 nt, Human
uagggcagcuugc

SEQ ID NO: 2246475 - RNA, 18 nt, Human
uagggcauuugagaaaug

SEQ ID NO: 2246476 - RNA, 16 nt, Human
uagggccaagcccagc

SEQ ID NO: 2246477 - RNA, 23 nt, Human
uagggccaagcccagcacugcuu

SEQ ID NO: 2246478 - RNA, 11 nt, Human
uagggccaggc

SEQ ID NO: 2246479 - RNA, 14 nt, Human
uagggccaggcagg

SEQ ID NO: 2246480 - RNA, 14 nt, Human
uagggcuggaccua

SEQ ID NO: 2246481 - RNA, 14 nt, Human
uagggcuguaaaau

SEQ ID NO: 2246482 - RNA, 23 nt, Human
uagggcuacaaaaccugauguua

SEQ ID NO: 2246483 - RNA, 21 nt, Human
uagggccuggucccugggagg

SEQ ID NO: 2246484 - RNA, 21 nt, Human
uagggccaggcaggugccugg

SEQ ID NO: 2246485 - RNA, 15 nt, Human
uagggccaggcaggu

SEQ ID NO: 2246486 - RNA, 13 nt, Human
uagggguugcuaa

SEQ ID NO: 2246487 - RNA, 14 nt, Human
uaggggucaaagaa

SEQ ID NO: 2246488 - RNA, 17 nt, Human
uaggggucaggcuccau

SEQ ID NO: 2246489 - RNA, 23 nt, Human
uagggguaauauauugcugcugg

SEQ ID NO: 2246490 - RNA, 16 nt, Human
uagggguaauauauug

SEQ ID NO: 2246491 - RNA, 16 nt, Human
uagggggaacucuagc

SEQ ID NO: 2246492 - RNA, 13 nt, Human
uaggggagcaggg

SEQ ID NO: 2246493 - RNA, 23 nt, Human
uaggggacacuucccucuguuuc

SEQ ID NO: 2246494 - RNA, 23 nt, Human
uaggggagggguugccacaggcc

SEQ ID NO: 2246495 - RNA, 16 nt, Human
uagggaaaugaaagaa

SEQ ID NO: 2246496 - RNA, 13 nt, Human
uagggaaaugaaa

SEQ ID NO: 2246497 - RNA, 16 nt, Human
uagggaaaaguucaua

SEQ ID NO: 2246498 - RNA, 13 nt, Human
uagggaaagaaag

SEQ ID NO: 2246499 - RNA, 18 nt, Human
uagggaaaacauuccauc

SEQ ID NO: 2246500 - RNA, 16 nt, Human
uagggaaaacauucca

SEQ ID NO: 2246501 - RNA, 13 nt, Human
uaggcauucugga

SEQ ID NO: 2246502 - RNA, 13 nt, Human
uagggaaaacauu

SEQ ID NO: 2246503 - RNA, 13 nt, Human
uagggaagauaau

SEQ ID NO: 2246504 - RNA, 18 nt, Human
uagggagggcggcagggg

SEQ ID NO: 2246505 - RNA, 13 nt, Human
uagggaacucugg

SEQ ID NO: 2246506 - RNA, 15 nt, Human
uagggauucaggcug

SEQ ID NO: 2246507 - RNA, 18 nt, Human
uagggauguucuggcccu

SEQ ID NO: 2246508 - RNA, 16 nt, Human
uagggauucaggcugc

SEQ ID NO: 2246509 - RNA, 15 nt, Human
uagggcaccaggggu

SEQ ID NO: 2246510 - RNA, 20 nt, Human
uagggcaccagggguuucuc

SEQ ID NO: 2246511 - RNA, 17 nt, Human
uagggaucccucaucug

SEQ ID NO: 2246512 - RNA, 15 nt, Human
uagggaacucugggg

SEQ ID NO: 2246513 - RNA, 19 nt, Human
uagggauggggcugugggg

SEQ ID NO: 2246514 - RNA, 23 nt, Human
uagggaucaaccagcuaagaaaa

SEQ ID NO: 2246515 - RNA, 14 nt, Human
uagggaugaguacc

SEQ ID NO: 2246516 - RNA, 17 nt, Human
uaggaaaaguacauuua

SEQ ID NO: 2246517 - RNA, 19 nt, Human
uaggaaaaguacauuuaau

SEQ ID NO: 2246518 - RNA, 16 nt, Human
uaggaaauaaaaccuu

SEQ ID NO: 2246519 - RNA, 14 nt, Human
uaggaaauaaaacc

SEQ ID NO: 2246520 - RNA, 21 nt, Human
uaggaaacaaagcuuagcagg

SEQ ID NO: 2246521 - RNA, 19 nt, Human
uaggaaagaccauuuuucc

SEQ ID NO: 2246522 - RNA, 16 nt, Human
uaggaaaaacugauuu

SEQ ID NO: 2246523 - RNA, 17 nt, Human
uaggaaaaacugauuuu

SEQ ID NO: 2246524 - RNA, 13 nt, Human
uaggauagcauuu

SEQ ID NO: 2246525 - RNA, 23 nt, Human
uaggaguucacuucaucuucuca

SEQ ID NO: 2246526 - RNA, 22 nt, Human
uaggauaugguggguggacagg

SEQ ID NO: 2246527 - RNA, 19 nt, Human
uaggaucagcccucauuuu

SEQ ID NO: 2246528 - RNA, 21 nt, Human
uaggauccagugauccuuaca

SEQ ID NO: 2246529 - RNA, 20 nt, Human
uaggaucauuuguuggaaug

SEQ ID NO: 2246530 - RNA, 21 nt, Human
uaggaguucgagaccagccug

SEQ ID NO: 2246531 - RNA, 17 nt, Human
uaggaguucgagaccag

SEQ ID NO: 2246532 - RNA, 23 nt, Human
uaggaguucgagaccagccuggc

SEQ ID NO: 2246533 - RNA, 17 nt, Human
uaggaaauaaaaccuuu

SEQ ID NO: 2246534 - RNA, 17 nt, Human
uaggagugugugauuuu

SEQ ID NO: 2246535 - RNA, 21 nt, Human
uaggaguucacuucaucuucu

SEQ ID NO: 2246536 - RNA, 13 nt, Human
uaggauguuuuuc

SEQ ID NO: 2246537 - RNA, 18 nt, Human
uaggauguuuuucaugaa

SEQ ID NO: 2246538 - RNA, 19 nt, Human
uaggauguuuuucaugaaa

SEQ ID NO: 2246539 - RNA, 13 nt, Human
uaggauguugaaa

SEQ ID NO: 2246540 - RNA, 12 nt, Human
uaggauuuaaca

SEQ ID NO: 2246541 - RNA, 21 nt, Human
uaggauuuaacagucauuuaa

SEQ ID NO: 2246542 - RNA, 22 nt, Human
uaggauuuaacagucauuuaaa

SEQ ID NO: 2246543 - RNA, 14 nt, Human
uaggcaggaccugu

SEQ ID NO: 2246544 - RNA, 17 nt, Human
uaggcaggacaugcuga

SEQ ID NO: 2246545 - RNA, 22 nt, Human
uaggcaggacaugcugaagcca

SEQ ID NO: 2246546 - RNA, 15 nt, Human
uaggcaggaccugug

SEQ ID NO: 2246547 - RNA, 12 nt, Human
uaggcaggacca

SEQ ID NO: 2246548 - RNA, 15 nt, Human
uaggcagggauuuga

SEQ ID NO: 2246549 - RNA, 17 nt, Human
uaggcagggauuugagg

SEQ ID NO: 2246550 - RNA, 19 nt, Human
uaggcagggauuugaggag

SEQ ID NO: 2246551 - RNA, 21 nt, Human
uaggcaugagggaucacaggg

SEQ ID NO: 2246552 - RNA, 19 nt, Human
uaggcaucccaggggacca

SEQ ID NO: 2246553 - RNA, 16 nt, Human
uaggcaucccagggga

SEQ ID NO: 2246554 - RNA, 14 nt, Human
uaggcaucccaggg

SEQ ID NO: 2246555 - RNA, 22 nt, Human
uauagcccagccaggccccagg

SEQ ID NO: 2246556 - RNA, 21 nt, Human
uauagccacaucccuuugaaa

SEQ ID NO: 2246557 - RNA, 13 nt, Human
uauagcccagguc

SEQ ID NO: 2246558 - RNA, 16 nt, Human
uauagcuguacaaaua

SEQ ID NO: 2246559 - RNA, 18 nt, Human
uauagcuguacaaauaua

SEQ ID NO: 2246560 - RNA, 22 nt, Human
uauagcuguacaaauauaagaa

SEQ ID NO: 2246561 - RNA, 13 nt, Human
uauagcuguauug

SEQ ID NO: 2246562 - RNA, 14 nt, Human
uauagcuguauuga

SEQ ID NO: 2246563 - RNA, 18 nt, Human
uauagccuaggugacaga

SEQ ID NO: 2246564 - RNA, 23 nt, Human
uauagcaauccauguuaguuuuu

SEQ ID NO: 2246565 - RNA, 12 nt, Human
uauagaugucua

SEQ ID NO: 2246566 - RNA, 21 nt, Human
uauagcuguauugaaucaugu

SEQ ID NO: 2246567 - RNA, 19 nt, Human
uauagcuguauugaaucau

SEQ ID NO: 2246568 - RNA, 20 nt, Human
uauagcuguauugaaucaug

SEQ ID NO: 2246569 - RNA, 19 nt, Human
uauaggaacauaugaaaau

SEQ ID NO: 2246570 - RNA, 12 nt, Human
uauaggagagga

SEQ ID NO: 2246571 - RNA, 15 nt, Human
uauaggaucauuugu

SEQ ID NO: 2246572 - RNA, 23 nt, Human
uauaggaacuuaaauaaugugaa

SEQ ID NO: 2246573 - RNA, 12 nt, Human
uauaggaauuga

SEQ ID NO: 2246574 - RNA, 17 nt, Human
uauaggucacuccuggg

SEQ ID NO: 2246575 - RNA, 14 nt, Human
uauaggucacuccu

SEQ ID NO: 2246576 - RNA, 15 nt, Human
uauaggcaccuacca

SEQ ID NO: 2246577 - RNA, 14 nt, Human
uauaggcuggagaa

SEQ ID NO: 2246578 - RNA, 16 nt, Human
uauaggugcuacaaaa

SEQ ID NO: 2246579 - RNA, 14 nt, Human
uauauauuuuaauu

SEQ ID NO: 2246580 - RNA, 15 nt, Human
uauauauuuauaacu

SEQ ID NO: 2246581 - RNA, 14 nt, Human
uauauauuuauaac

SEQ ID NO: 2246582 - RNA, 11 nt, Human
uauauauuucc

SEQ ID NO: 2246583 - RNA, 22 nt, Human
uauauauuuuugguugucaaua

SEQ ID NO: 2246584 - RNA, 20 nt, Human
uauauauuuuugguugucaa

SEQ ID NO: 2246585 - RNA, 20 nt, Human
uauauccuuucuaacaaaaa

SEQ ID NO: 2246586 - RNA, 16 nt, Human
acacucauugaccuga

SEQ ID NO: 2246587 - RNA, 16 nt, Human
acacucaguuguucaa

SEQ ID NO: 2246588 - RNA, 12 nt, Human
acacucaugcug

SEQ ID NO: 2246589 - RNA, 22 nt, Human
uauaucuauauauaauucugua

SEQ ID NO: 2246590 - RNA, 16 nt, Human
uauaucuauauguacu

SEQ ID NO: 2246591 - RNA, 13 nt, Human
uauaucuaaauug

SEQ ID NO: 2246592 - RNA, 17 nt, Human
uauaucuaaauugaaua

SEQ ID NO: 2246593 - RNA, 18 nt, Human
uauaucuaaauugaauaa

SEQ ID NO: 2246594 - RNA, 13 nt, Human
uauaucuauauau

SEQ ID NO: 2246595 - RNA, 21 nt, Human
uauaucuauauauaauucugu

SEQ ID NO: 2246596 - RNA, 13 nt, Human
uauauauuuauaa

SEQ ID NO: 2246597 - RNA, 22 nt, Human
uauauauugguaacauccuuuc

SEQ ID NO: 2246598 - RNA, 22 nt, Human
uauauauguguguuuaaauaaa

SEQ ID NO: 2246599 - RNA, 14 nt, Human
uauauaugugugug

SEQ ID NO: 2246600 - RNA, 16 nt, Human
uauauauguguaugua

SEQ ID NO: 2246601 - RNA, 17 nt, Human
uauauauguguguuuaa

SEQ ID NO: 2246602 - RNA, 18 nt, Human
uauauauguguguuuaaa

SEQ ID NO: 2246603 - RNA, 14 nt, Human
uauauauguguaug

SEQ ID NO: 2246604 - RNA, 12 nt, Human
uauauaugugua

SEQ ID NO: 2246605 - RNA, 15 nt, Human
uauauaucuaucuua

SEQ ID NO: 2246606 - RNA, 18 nt, Human
uauauaucugcuguccag

SEQ ID NO: 2246607 - RNA, 21 nt, Human
uauauaucugcuguccagaca

SEQ ID NO: 2246608 - RNA, 19 nt, Human
uauauaucugcuucagugg

SEQ ID NO: 2246609 - RNA, 17 nt, Human
uauauaguuuacuauuu

SEQ ID NO: 2246610 - RNA, 10 nt, Human
uauauauaaa

SEQ ID NO: 2246611 - RNA, 22 nt, Human
uauauaguuuauugacaauaau

SEQ ID NO: 2246612 - RNA, 21 nt, Human
uauauaucugcuucaguggag

SEQ ID NO: 2246613 - RNA, 18 nt, Human
uauauaggcaucacauuu

SEQ ID NO: 2246614 - RNA, 21 nt, Human
uauauagguuuuguuugcuau

SEQ ID NO: 2246615 - RNA, 24 nt, Human
uauauagguuuuguuugcuaucuu

SEQ ID NO: 2246616 - RNA, 17 nt, Human
uauauagguugugcaaa

SEQ ID NO: 2246617 - RNA, 12 nt, Human
uauauagguuuu

SEQ ID NO: 2246618 - RNA, 20 nt, Human
uauauagguuuuguuugcua

SEQ ID NO: 2246619 - RNA, 20 nt, Human
uauaacugccuuaaaacuuu

SEQ ID NO: 2246620 - RNA, 19 nt, Human
uauaacuuaaaaaaaugac

SEQ ID NO: 2246621 - RNA, 18 nt, Human
uauaacuuaaaaaaauga

SEQ ID NO: 2246622 - RNA, 19 nt, Human
uauaacugccuuaaaacuu

SEQ ID NO: 2246623 - RNA, 16 nt, Human
uauaacugaaggagaa

SEQ ID NO: 2246624 - RNA, 23 nt, Human
acacuaauuccuuucuauccuac

SEQ ID NO: 2246625 - RNA, 23 nt, Human
uauaacucugcacuacuccucug

SEQ ID NO: 2246626 - RNA, 22 nt, Human
uauaacuuaaaaauguaaauau

SEQ ID NO: 2246627 - RNA, 22 nt, Human
uauaacuuaaaaaaaugacaga

SEQ ID NO: 2246628 - RNA, 20 nt, Human
uauaacuuaaaaauguaaau

SEQ ID NO: 2246629 - RNA, 19 nt, Human
uauaagugauugcugguuu

SEQ ID NO: 2246630 - RNA, 21 nt, Human
uauaacucaucauaaaauaaa

SEQ ID NO: 2246631 - RNA, 20 nt, Human
uauaacucaucauaaaauaa

SEQ ID NO: 2246632 - RNA, 19 nt, Human
uauaacucaucauaaaaua

SEQ ID NO: 2246633 - RNA, 18 nt, Human
uauaacucaucauaaaau

SEQ ID NO: 2246634 - RNA, 17 nt, Human
uauaacucaucauaaaa

SEQ ID NO: 2246635 - RNA, 16 nt, Human
uauaacucaucauaaa

SEQ ID NO: 2246636 - RNA, 17 nt, Human
acacuaauuccuuucua

SEQ ID NO: 2246637 - RNA, 17 nt, Human
acacucaaaucaagaaa

SEQ ID NO: 2246638 - RNA, 18 nt, Human
acacucaaaucaagaaac

SEQ ID NO: 2246639 - RNA, 12 nt, Human
acacuaauuccu

SEQ ID NO: 2246640 - RNA, 21 nt, Human
acacucaaaagcugggcaggu

SEQ ID NO: 2246641 - RNA, 13 nt, Human
acacucaaaucaa

SEQ ID NO: 2246642 - RNA, 15 nt, Human
acacuaaugaggaaa

SEQ ID NO: 2246643 - RNA, 22 nt, Human
acacuaaugaggaaacugcacu

SEQ ID NO: 2246644 - RNA, 14 nt, Human
acacuaagggugua

SEQ ID NO: 2246645 - RNA, 19 nt, Human
acacuaaguuauaguauau

SEQ ID NO: 2246646 - RNA, 23 nt, Human
acacuaaguuauaguauaucugg

SEQ ID NO: 2246647 - RNA, 17 nt, Human
uagucacugagacagcc

SEQ ID NO: 2246648 - RNA, 20 nt, Human
uagucacugagacagcccgg

SEQ ID NO: 2246649 - RNA, 11 nt, Human
uauacaugcca

SEQ ID NO: 2246650 - RNA, 15 nt, Human
uauacaugccaguga

SEQ ID NO: 2246651 - RNA, 18 nt, Human
uauacauaucuuuauuaa

SEQ ID NO: 2246652 - RNA, 15 nt, Human
uauacauaucuuuau

SEQ ID NO: 2246653 - RNA, 21 nt, Human
uauacauaucuuuauuaauca

SEQ ID NO: 2246654 - RNA, 15 nt, Human
uauagaucccccaga

SEQ ID NO: 2246655 - RNA, 22 nt, Human
uauagaugcaagauauuuauau

SEQ ID NO: 2246656 - RNA, 16 nt, Human
uauagaugggaaugaa

SEQ ID NO: 2246657 - RNA, 17 nt, Human
uauagaugggaaugaag

SEQ ID NO: 2246658 - RNA, 19 nt, Human
uauagaugggaaugaagcu

SEQ ID NO: 2246659 - RNA, 13 nt, Human
uauacaugccagu

SEQ ID NO: 2246660 - RNA, 18 nt, Human
uauacauguuuaguauua

SEQ ID NO: 2246661 - RNA, 22 nt, Human
uauacauagcaugacauuucuu

SEQ ID NO: 2246662 - RNA, 16 nt, Human
uauacauagcaugaca

SEQ ID NO: 2246663 - RNA, 22 nt, Human
uauacagaauugugucugcagg

SEQ ID NO: 2246664 - RNA, 15 nt, Human
uauaauuuaacuuca

SEQ ID NO: 2246665 - RNA, 22 nt, Human
uauaauuuaacuucagagggaa

SEQ ID NO: 2246666 - RNA, 19 nt, Human
uauaaguggaggcacuuua

SEQ ID NO: 2246667 - RNA, 14 nt, Human
uauaaguguacaua

SEQ ID NO: 2246668 - RNA, 18 nt, Human
uauaaguggaggcacuuu

SEQ ID NO: 2246669 - RNA, 13 nt, Human
uauaaguguacau

SEQ ID NO: 2246670 - RNA, 13 nt, Human
uauaagugcugua

SEQ ID NO: 2246671 - RNA, 14 nt, Human
uauaagugcuguau

SEQ ID NO: 2246672 - RNA, 15 nt, Human
uauaagugcuguaua

SEQ ID NO: 2246673 - RNA, 16 nt, Human
uauaagugcuguauaa

SEQ ID NO: 2246674 - RNA, 17 nt, Human
uauaagugcuguauaaa

SEQ ID NO: 2246675 - RNA, 19 nt, Human
uauaagugcuguauaaaau

SEQ ID NO: 2246676 - RNA, 20 nt, Human
uauaagugcuguauaaaauc

SEQ ID NO: 2246677 - RNA, 21 nt, Human
uauaagugcuguauaaaauca

SEQ ID NO: 2246678 - RNA, 22 nt, Human
uauacacuuacacuuuaugcac

SEQ ID NO: 2246679 - RNA, 16 nt, Human
uauaauuuaaugcaug

SEQ ID NO: 2246680 - RNA, 11 nt, Human
uauaauuuaau

SEQ ID NO: 2246681 - RNA, 18 nt, Human
uauaauuuaccugaaguc

SEQ ID NO: 2246682 - RNA, 16 nt, Human
uauccccucccaguca

SEQ ID NO: 2246683 - RNA, 22 nt, Human
uaucuaguuuaauuaaucugua

SEQ ID NO: 2246684 - RNA, 16 nt, Human
uaucuauauauaauuc

SEQ ID NO: 2246685 - RNA, 20 nt, Human
uaucuauacauaucuuuauu

SEQ ID NO: 2246686 - RNA, 18 nt, Human
uaucuauacauaucuuua

SEQ ID NO: 2246687 - RNA, 20 nt, Human
uaucuauauauaauucugua

SEQ ID NO: 2246688 - RNA, 21 nt, Human
uaucuauauauaauucuguac

SEQ ID NO: 2246689 - RNA, 13 nt, Human
uaucuauauaugu

SEQ ID NO: 2246690 - RNA, 15 nt, Human
uaucuauauaugugu

SEQ ID NO: 2246691 - RNA, 16 nt, Human
uaucuauauaugugua

SEQ ID NO: 2246692 - RNA, 17 nt, Human
uaucuauauauguguau

SEQ ID NO: 2246693 - RNA, 22 nt, Human
uaucuauauauguguauguacg

SEQ ID NO: 2246694 - RNA, 16 nt, Human
uaucuauauguacuug

SEQ ID NO: 2246695 - RNA, 15 nt, Human
uauccacccagccca

SEQ ID NO: 2246696 - RNA, 14 nt, Human
uauccacccagccc

SEQ ID NO: 2246697 - RNA, 13 nt, Human
uauccacccagcc

SEQ ID NO: 2246698 - RNA, 14 nt, Human
uaucccagaaauua

SEQ ID NO: 2246699 - RNA, 16 nt, Human
uauccccauuucuuuu

SEQ ID NO: 2246700 - RNA, 15 nt, Human
uaucccggcugcccu

SEQ ID NO: 2246701 - RNA, 19 nt, Human
uauccccccccuguauagu

SEQ ID NO: 2246702 - RNA, 21 nt, Human
uauccccccccuguauaguua

SEQ ID NO: 2246703 - RNA, 15 nt, Human
uauccccucccaguc

SEQ ID NO: 2246704 - RNA, 15 nt, Human
uauccccccaucuug

SEQ ID NO: 2246705 - RNA, 17 nt, Human
uauccccccaucuugcu

SEQ ID NO: 2246706 - RNA, 19 nt, Human
uauccccccaucuugcuuc

SEQ ID NO: 2246707 - RNA, 20 nt, Human
uauccccccaucuugcuucc

SEQ ID NO: 2246708 - RNA, 19 nt, Human
uauccaacaucaacaucuu

SEQ ID NO: 2246709 - RNA, 15 nt, Human
uaucagcacgugugg

SEQ ID NO: 2246710 - RNA, 12 nt, Human
uauccacccagc

SEQ ID NO: 2246711 - RNA, 15 nt, Human
uauccaccaccuccc

SEQ ID NO: 2246712 - RNA, 23 nt, Human
uauccacagagagucccacugcc

SEQ ID NO: 2246713 - RNA, 13 nt, Human
uauccaccaccuc

SEQ ID NO: 2246714 - RNA, 21 nt, Human
uauccacagaaacauuuucau

SEQ ID NO: 2246715 - RNA, 22 nt, Human
uauccacagagagucccacugc

SEQ ID NO: 2246716 - RNA, 14 nt, Human
uaucagcacgugug

SEQ ID NO: 2246717 - RNA, 18 nt, Human
uaucagacacucuggcug

SEQ ID NO: 2246718 - RNA, 19 nt, Human
uaucagacacucuggcugg

SEQ ID NO: 2246719 - RNA, 20 nt, Human
uaucagacacucuggcuggu

SEQ ID NO: 2246720 - RNA, 17 nt, Human
uaucagaggccuauaau

SEQ ID NO: 2246721 - RNA, 20 nt, Human
uaucagaggccuauaaugaa

SEQ ID NO: 2246722 - RNA, 16 nt, Human
uaucaccuccccuccu

SEQ ID NO: 2246723 - RNA, 15 nt, Human
uaucaccuccccucc

SEQ ID NO: 2246724 - RNA, 14 nt, Human
uaucaccuccccuc

SEQ ID NO: 2246725 - RNA, 20 nt, Human
uaucaccuccccuccuugcc

SEQ ID NO: 2246726 - RNA, 17 nt, Human
uaucagaauucucagaa

SEQ ID NO: 2246727 - RNA, 13 nt, Human
uaucaccuccccu

SEQ ID NO: 2246728 - RNA, 14 nt, Human
uaucaccucauggc

SEQ ID NO: 2246729 - RNA, 23 nt, Human
uaucaccgugggcucccugacug

SEQ ID NO: 2246730 - RNA, 19 nt, Human
uaucaccgugggcucccug

SEQ ID NO: 2246731 - RNA, 22 nt, Human
uaucacccagaagaaaauagug

SEQ ID NO: 2246732 - RNA, 19 nt, Human
uaucacccagaagaaaaua

SEQ ID NO: 2246733 - RNA, 23 nt, Human
uaucaaauauuagaugugauuua

SEQ ID NO: 2246734 - RNA, 14 nt, Human
uaucacaaaucuua

SEQ ID NO: 2246735 - RNA, 20 nt, Human
uaucacaaaucuuaacuuga

SEQ ID NO: 2246736 - RNA, 16 nt, Human
uaucacaaaucuuaac

SEQ ID NO: 2246737 - RNA, 15 nt, Human
acagacgucccucca

SEQ ID NO: 2246738 - RNA, 15 nt, Human
acagacguaugcuua

SEQ ID NO: 2246739 - RNA, 16 nt, Human
acagacgucccuccac

SEQ ID NO: 2246740 - RNA, 21 nt, Human
uaucaaacuucagcuguacuu

SEQ ID NO: 2246741 - RNA, 20 nt, Human
acagacguaugcuuauuuua

SEQ ID NO: 2246742 - RNA, 21 nt, Human
uaucaaagaccuuguguguau

SEQ ID NO: 2246743 - RNA, 18 nt, Human
uaucaaauauuagaugug

SEQ ID NO: 2246744 - RNA, 19 nt, Human
uaucaaauauuagauguga

SEQ ID NO: 2246745 - RNA, 20 nt, Human
uaucaaauauuagaugugau

SEQ ID NO: 2246746 - RNA, 21 nt, Human
uaucaaauauuagaugugauu

SEQ ID NO: 2246747 - RNA, 21 nt, Human
acagacaggagaaaugcaucc

SEQ ID NO: 2246748 - RNA, 15 nt, Human
acagacaucucugca

SEQ ID NO: 2246749 - RNA, 15 nt, Human
acagacaggcucuua

SEQ ID NO: 2246750 - RNA, 15 nt, Human
acagacaggagaaau

SEQ ID NO: 2246751 - RNA, 14 nt, Human
acagacaggagaaa

SEQ ID NO: 2246752 - RNA, 13 nt, Human
acagacaggcucu

SEQ ID NO: 2246753 - RNA, 17 nt, Human
acagacauucugccagg

SEQ ID NO: 2246754 - RNA, 18 nt, Human
acagaccgaacuguugua

SEQ ID NO: 2246755 - RNA, 19 nt, Human
acagaccgaacuguuguau

SEQ ID NO: 2246756 - RNA, 16 nt, Human
acagaccuaaugcucc

SEQ ID NO: 2246757 - RNA, 14 nt, Human
acagaccuuugaac

SEQ ID NO: 2246758 - RNA, 22 nt, Human
acagaccuggagccccugggug

SEQ ID NO: 2246759 - RNA, 17 nt, Human
acagaccuggagccccu

SEQ ID NO: 2246760 - RNA, 19 nt, Human
acagaccuggagccccugg

SEQ ID NO: 2246761 - RNA, 20 nt, Human
acagaccuggagccccuggg

SEQ ID NO: 2246762 - RNA, 21 nt, Human
acagaccuggagccccugggu

SEQ ID NO: 2246763 - RNA, 22 nt, Human
acacuuuuuuggggauaugcuu

SEQ ID NO: 2246764 - RNA, 23 nt, Human
acacuuuuuuggggauaugcuua

SEQ ID NO: 2246765 - RNA, 22 nt, Human
acacuuuugguuaagucuguuu

SEQ ID NO: 2246766 - RNA, 13 nt, Human
acacuuuugguua

SEQ ID NO: 2246767 - RNA, 22 nt, Human
acacuugguuggguccucacau

SEQ ID NO: 2246768 - RNA, 20 nt, Human
acacuugguuggguccucac

SEQ ID NO: 2246769 - RNA, 17 nt, Human
acacuugguuggguccu

SEQ ID NO: 2246770 - RNA, 20 nt, Human
acacuugccuucuucaccca

SEQ ID NO: 2246771 - RNA, 20 nt, Human
acacuuuucaugugugauuu

SEQ ID NO: 2246772 - RNA, 18 nt, Human
acacuugagaggaugaau

SEQ ID NO: 2246773 - RNA, 18 nt, Human
acacuugccuucuucacc

SEQ ID NO: 2246774 - RNA, 22 nt, Human
acacuuggcccaaguggcagag

SEQ ID NO: 2246775 - RNA, 22 nt, Human
acacuucuucuuggucuuauuu

SEQ ID NO: 2246776 - RNA, 23 nt, Human
acacuucugugagacccccacac

SEQ ID NO: 2246777 - RNA, 14 nt, Human
acacuugagaggau

SEQ ID NO: 2246778 - RNA, 16 nt, Human
acacuugagaggauga

SEQ ID NO: 2246779 - RNA, 21 nt, Human
acacuugagaggaugaaugua

SEQ ID NO: 2246780 - RNA, 20 nt, Human
acacuucugugagaccccca

SEQ ID NO: 2246781 - RNA, 13 nt, Human
acacuuccugucc

SEQ ID NO: 2246782 - RNA, 14 nt, Human
acacuuccugccua

SEQ ID NO: 2246783 - RNA, 18 nt, Human
acacuucccucuguuucu

SEQ ID NO: 2246784 - RNA, 13 nt, Human
acacuuccugccu

SEQ ID NO: 2246785 - RNA, 16 nt, Human
acacuuccuguccaga

SEQ ID NO: 2246786 - RNA, 14 nt, Human
acacuuccugucca

SEQ ID NO: 2246787 - RNA, 19 nt, Human
acacuuccuguccagagag

SEQ ID NO: 2246788 - RNA, 16 nt, Human
acagaaagguuuucuu

SEQ ID NO: 2246789 - RNA, 13 nt, Human
acagaaagcugcc

SEQ ID NO: 2246790 - RNA, 24 nt, Human
acagaaagggcaacaauaaaauag

SEQ ID NO: 2246791 - RNA, 14 nt, Human
acagaaaguggugc

SEQ ID NO: 2246792 - RNA, 22 nt, Human
acagaaaguggugcucaguugu

SEQ ID NO: 2246793 - RNA, 20 nt, Human
acagaaaacgguuaaaacug

SEQ ID NO: 2246794 - RNA, 22 nt, Human
acagaaaacauucugauuugga

SEQ ID NO: 2246795 - RNA, 15 nt, Human
acagaaaauauacug

SEQ ID NO: 2246796 - RNA, 14 nt, Human
acagaaaauauacu

SEQ ID NO: 2246797 - RNA, 13 nt, Human
acagaaaauauac

SEQ ID NO: 2246798 - RNA, 12 nt, Human
acagaaaauaua

SEQ ID NO: 2246799 - RNA, 13 nt, Human
acagacaggagaa

SEQ ID NO: 2246800 - RNA, 11 nt, Human
acagacaggag

SEQ ID NO: 2246801 - RNA, 13 nt, Human
acagaaauguaca

SEQ ID NO: 2246802 - RNA, 19 nt, Human
acagaaaguggugcucagu

SEQ ID NO: 2246803 - RNA, 17 nt, Human
acagaaaguggugcuca

SEQ ID NO: 2246804 - RNA, 18 nt, Human
acagaaaguggugcucag

SEQ ID NO: 2246805 - RNA, 19 nt, Human
acagacauacuaaccagca

SEQ ID NO: 2246806 - RNA, 18 nt, Human
acagacauacuaaccagc

SEQ ID NO: 2246807 - RNA, 16 nt, Human
acacuuaacagaugca

SEQ ID NO: 2246808 - RNA, 14 nt, Human
acacucaugcugaa

SEQ ID NO: 2246809 - RNA, 17 nt, Human
uauaucuauauguacuu

SEQ ID NO: 2246810 - RNA, 13 nt, Human
acacucaugcuga

SEQ ID NO: 2246811 - RNA, 14 nt, Human
acacuuaauacuac

SEQ ID NO: 2246812 - RNA, 16 nt, Human
acacuuacacuuuaug

SEQ ID NO: 2246813 - RNA, 20 nt, Human
acacuguuucaaacuuuacu

SEQ ID NO: 2246814 - RNA, 14 nt, Human
acacuuaacagaug

SEQ ID NO: 2246815 - RNA, 15 nt, Human
acacucaugcugaaa

SEQ ID NO: 2246816 - RNA, 18 nt, Human
acacuguuucaaacuuua

SEQ ID NO: 2246817 - RNA, 17 nt, Human
acacuguuucaaacuuu

SEQ ID NO: 2246818 - RNA, 17 nt, Human
acacucauugaccugag

SEQ ID NO: 2246819 - RNA, 21 nt, Human
acacuuacacuuuaugcacaa

SEQ ID NO: 2246820 - RNA, 18 nt, Human
acacuuacacuuuaugca

SEQ ID NO: 2246821 - RNA, 13 nt, Human
acacuucagagag

SEQ ID NO: 2246822 - RNA, 20 nt, Human
acacuuauuggaacucugcu

SEQ ID NO: 2246823 - RNA, 20 nt, Human
acacuuaaggguuuuagaaa

SEQ ID NO: 2246824 - RNA, 14 nt, Human
acacuuacuguugu

SEQ ID NO: 2246825 - RNA, 23 nt, Human
acacuuacuguuguccuauggga

SEQ ID NO: 2246826 - RNA, 18 nt, Human
acacuucagagagcuggu

SEQ ID NO: 2246827 - RNA, 17 nt, Human
acacuucagagagcugg

SEQ ID NO: 2246828 - RNA, 16 nt, Human
acacuucagagagcug

SEQ ID NO: 2246829 - RNA, 15 nt, Human
acacuucaggcucuu

SEQ ID NO: 2246830 - RNA, 19 nt, Human
acacuucaggcucuucucc

SEQ ID NO: 2246831 - RNA, 22 nt, Human
acacuucaggcucuucuccuuu

SEQ ID NO: 2246832 - RNA, 19 nt, Human
acacuuccaccagccugca

SEQ ID NO: 2246833 - RNA, 15 nt, Human
acacuucccucuguu

SEQ ID NO: 2246834 - RNA, 22 nt, Human
acacuucccucuguuucucuuu

SEQ ID NO: 2246835 - RNA, 14 nt, Human
acacuuccauaauc

SEQ ID NO: 2246836 - RNA, 21 nt, Human
acacuuccaccagccugcacu

SEQ ID NO: 2246837 - RNA, 17 nt, Human
acacuuccaccagccug

SEQ ID NO: 2246838 - RNA, 16 nt, Human
acacuuccaccagccu

SEQ ID NO: 2246839 - RNA, 20 nt, Human
acacuucagagagcugguag

SEQ ID NO: 2246840 - RNA, 19 nt, Human
acacuucagagagcuggua

SEQ ID NO: 2246841 - RNA, 15 nt, Human
acacuuccaccagcc

SEQ ID NO: 2246842 - RNA, 14 nt, Human
uaugggagaaauag

SEQ ID NO: 2246843 - RNA, 22 nt, Human
uauggcccagugucaaguugug

SEQ ID NO: 2246844 - RNA, 16 nt, Human
uaugggaaucaagauu

SEQ ID NO: 2246845 - RNA, 10 nt, Human
uaugggagag

SEQ ID NO: 2246846 - RNA, 21 nt, Human
uaugguaggaacugcugggcu

SEQ ID NO: 2246847 - RNA, 16 nt, Human
uaugggacucaaugca

SEQ ID NO: 2246848 - RNA, 23 nt, Human
uaugggacucaaugcacugacau

SEQ ID NO: 2246849 - RNA, 13 nt, Human
uauggcagugucu

SEQ ID NO: 2246850 - RNA, 19 nt, Human
uaugcucucgcaccuuucc

SEQ ID NO: 2246851 - RNA, 16 nt, Human
uauggcagugucuuuc

SEQ ID NO: 2246852 - RNA, 20 nt, Human
uauggcccuggccuagcaua

SEQ ID NO: 2246853 - RNA, 22 nt, Human
uauggcccuggccuagcauacg

SEQ ID NO: 2246854 - RNA, 21 nt, Human
uauggcccuggccuagcauac

SEQ ID NO: 2246855 - RNA, 15 nt, Human
acagcggaggugugg

SEQ ID NO: 2246856 - RNA, 14 nt, Human
acagcgagaggcag

SEQ ID NO: 2246857 - RNA, 15 nt, Human
acagcgagaggcaga

SEQ ID NO: 2246858 - RNA, 22 nt, Human
acagcgagaggcagagaaagaa

SEQ ID NO: 2246859 - RNA, 19 nt, Human
acagcgagaggcagagaaa

SEQ ID NO: 2246860 - RNA, 12 nt, Human
acagcgcugggu

SEQ ID NO: 2246861 - RNA, 13 nt, Human
acagcggccccug

SEQ ID NO: 2246862 - RNA, 16 nt, Human
acagcggaggugugga

SEQ ID NO: 2246863 - RNA, 18 nt, Human
acagcggcuggacuugga

SEQ ID NO: 2246864 - RNA, 22 nt, Human
acagcuaaucagcauucucacu

SEQ ID NO: 2246865 - RNA, 19 nt, Human
acagcggccccugcauccc

SEQ ID NO: 2246866 - RNA, 15 nt, Human
acagcggccccugca

SEQ ID NO: 2246867 - RNA, 16 nt, Human
acagcggccccugcau

SEQ ID NO: 2246868 - RNA, 18 nt, Human
acagcgagacuccgucuc

SEQ ID NO: 2246869 - RNA, 17 nt, Human
acagcgagacuccgucu

SEQ ID NO: 2246870 - RNA, 20 nt, Human
acagcgacauagcccauccc

SEQ ID NO: 2246871 - RNA, 19 nt, Human
uauggugccaauggaaccu

SEQ ID NO: 2246872 - RNA, 13 nt, Human
uauggugccaaug

SEQ ID NO: 2246873 - RNA, 15 nt, Human
uauggugccaaugga

SEQ ID NO: 2246874 - RNA, 12 nt, Human
uauggugagaug

SEQ ID NO: 2246875 - RNA, 14 nt, Human
uauggugagaugca

SEQ ID NO: 2246876 - RNA, 20 nt, Human
uauggugagaugcagcugga

SEQ ID NO: 2246877 - RNA, 20 nt, Human
uaugguauaaugguugacug

SEQ ID NO: 2246878 - RNA, 13 nt, Human
uaugguauaaugg

SEQ ID NO: 2246879 - RNA, 22 nt, Human
uauggucaacacuuaaggguuu

SEQ ID NO: 2246880 - RNA, 14 nt, Human
uaugguauuugagu

SEQ ID NO: 2246881 - RNA, 20 nt, Human
uauggucaucuuuuucucua

SEQ ID NO: 2246882 - RNA, 15 nt, Human
uauggucauagccca

SEQ ID NO: 2246883 - RNA, 17 nt, Human
uaugccagcucaguccc

SEQ ID NO: 2246884 - RNA, 14 nt, Human
uaugccagcucagu

SEQ ID NO: 2246885 - RNA, 22 nt, Human
uaugccauagcaagauugcuua

SEQ ID NO: 2246886 - RNA, 14 nt, Human
uaugccaugaugga

SEQ ID NO: 2246887 - RNA, 17 nt, Human
uaugccaaagaucacuu

SEQ ID NO: 2246888 - RNA, 22 nt, Human
uaugccacgggaaguuuagaga

SEQ ID NO: 2246889 - RNA, 17 nt, Human
uaugccaugauggaaau

SEQ ID NO: 2246890 - RNA, 12 nt, Human
uaugcccaguuu

SEQ ID NO: 2246891 - RNA, 20 nt, Human
uaugcccaguuucugccucu

SEQ ID NO: 2246892 - RNA, 15 nt, Human
uaugccccauucaac

SEQ ID NO: 2246893 - RNA, 18 nt, Human
uaugcccaguuucugccu

SEQ ID NO: 2246894 - RNA, 14 nt, Human
uauggcagcgaaag

SEQ ID NO: 2246895 - RNA, 18 nt, Human
uaugauauugcauaugca

SEQ ID NO: 2246896 - RNA, 17 nt, Human
uaugauacuugaaaauu

SEQ ID NO: 2246897 - RNA, 15 nt, Human
uaugauauuuucugu

SEQ ID NO: 2246898 - RNA, 22 nt, Human
uaugauauuuucugugccugaa

SEQ ID NO: 2246899 - RNA, 22 nt, Human
uaugcaugaaguaauaugcaca

SEQ ID NO: 2246900 - RNA, 21 nt, Human
uaugcauggugccccaggacc

SEQ ID NO: 2246901 - RNA, 20 nt, Human
uaugcauggugccccaggac

SEQ ID NO: 2246902 - RNA, 18 nt, Human
uaugcauggugccccagg

SEQ ID NO: 2246903 - RNA, 23 nt, Human
uaugcauggugccccaggaccag

SEQ ID NO: 2246904 - RNA, 22 nt, Human
uaugcauggugccccaggacca

SEQ ID NO: 2246905 - RNA, 20 nt, Human
uaugcauggaaaccugaaaa

SEQ ID NO: 2246906 - RNA, 22 nt, Human
uaugcaugguguagaugcccug

SEQ ID NO: 2246907 - RNA, 16 nt, Human
uaugcaugugaagaaa

SEQ ID NO: 2246908 - RNA, 15 nt, Human
uaugcaugugaagaa

SEQ ID NO: 2246909 - RNA, 12 nt, Human
acagcaagucag

SEQ ID NO: 2246910 - RNA, 16 nt, Human
acagcaagucaggguu

SEQ ID NO: 2246911 - RNA, 15 nt, Human
acagauuuuuacaaa

SEQ ID NO: 2246912 - RNA, 14 nt, Human
acagcacagagaag

SEQ ID NO: 2246913 - RNA, 13 nt, Human
acagcacagagaa

SEQ ID NO: 2246914 - RNA, 12 nt, Human
acagcacagcca

SEQ ID NO: 2246915 - RNA, 22 nt, Human
acagcacagagaagacaaaauu

SEQ ID NO: 2246916 - RNA, 15 nt, Human
acagcacagagaaga

SEQ ID NO: 2246917 - RNA, 21 nt, Human
acagcacagagaagacaaaau

SEQ ID NO: 2246918 - RNA, 12 nt, Human
acagauuuguga

SEQ ID NO: 2246919 - RNA, 22 nt, Human
acagauuugagcucagcccugg

SEQ ID NO: 2246920 - RNA, 17 nt, Human
acagauuuugauagcaa

SEQ ID NO: 2246921 - RNA, 19 nt, Human
acagauuuugauagcaaag

SEQ ID NO: 2246922 - RNA, 20 nt, Human
acagauuuugauagcaaagc

SEQ ID NO: 2246923 - RNA, 20 nt, Human
acagauuuugggguuguguu

SEQ ID NO: 2246924 - RNA, 22 nt, Human
acagauuuugggguuguguugu

SEQ ID NO: 2246925 - RNA, 19 nt, Human
uaucuauauguacuuguca

SEQ ID NO: 2246926 - RNA, 13 nt, Human
acagauuugugaa

SEQ ID NO: 2246927 - RNA, 14 nt, Human
acagauuugugaac

SEQ ID NO: 2246928 - RNA, 15 nt, Human
acagauuugugaacu

SEQ ID NO: 2246929 - RNA, 21 nt, Human
acagauuugugaacucagcca

SEQ ID NO: 2246930 - RNA, 22 nt, Human
acagauuugugaacucagccaa

SEQ ID NO: 2246931 - RNA, 17 nt, Human
acagcagccccugcaca

SEQ ID NO: 2246932 - RNA, 15 nt, Human
acagcccccucugcc

SEQ ID NO: 2246933 - RNA, 15 nt, Human
acagcagagguucuu

SEQ ID NO: 2246934 - RNA, 19 nt, Human
acagcacgggggccaagga

SEQ ID NO: 2246935 - RNA, 12 nt, Human
acagcacuacuc

SEQ ID NO: 2246936 - RNA, 13 nt, Human
acagcacuacucu

SEQ ID NO: 2246937 - RNA, 14 nt, Human
acagcacuacucug

SEQ ID NO: 2246938 - RNA, 15 nt, Human
acagcacuacucugu

SEQ ID NO: 2246939 - RNA, 20 nt, Human
acagcacuacucugugccag

SEQ ID NO: 2246940 - RNA, 17 nt, Human
acagcacuacucugugc

SEQ ID NO: 2246941 - RNA, 19 nt, Human
acagcacuggcucucucca

SEQ ID NO: 2246942 - RNA, 20 nt, Human
acagcacuggcucucuccag

SEQ ID NO: 2246943 - RNA, 22 nt, Human
acagcacuggcucucuccagga

SEQ ID NO: 2246944 - RNA, 16 nt, Human
acagccccuccuccau

SEQ ID NO: 2246945 - RNA, 14 nt, Human
acagccccuccucc

SEQ ID NO: 2246946 - RNA, 15 nt, Human
acagcccgggcucug

SEQ ID NO: 2246947 - RNA, 23 nt, Human
acagcccuccaucuaaacugccc

SEQ ID NO: 2246948 - RNA, 16 nt, Human
acagcccgggcucugc

SEQ ID NO: 2246949 - RNA, 14 nt, Human
uaugaaaaauauga

SEQ ID NO: 2246950 - RNA, 18 nt, Human
uaugaaaaacaaaaauaa

SEQ ID NO: 2246951 - RNA, 18 nt, Human
uaugaaaaauaugauauu

SEQ ID NO: 2246952 - RNA, 13 nt, Human
uaugaaaacuuau

SEQ ID NO: 2246953 - RNA, 15 nt, Human
uaugaaaacuuauga

SEQ ID NO: 2246954 - RNA, 17 nt, Human
uaugaaacuuaggaagg

SEQ ID NO: 2246955 - RNA, 24 nt, Human
uaugaagcucaccuguugcuuaca

SEQ ID NO: 2246956 - RNA, 21 nt, Human
acagcccugucagugcagccc

SEQ ID NO: 2246957 - RNA, 20 nt, Human
acagcccugucagugcagcc

SEQ ID NO: 2246958 - RNA, 19 nt, Human
acagcccuucuuuccacag

SEQ ID NO: 2246959 - RNA, 13 nt, Human
acagcccugucag

SEQ ID NO: 2246960 - RNA, 12 nt, Human
acagcccuguca

SEQ ID NO: 2246961 - RNA, 14 nt, Human
acagcccucccgcc

SEQ ID NO: 2246962 - RNA, 15 nt, Human
acagcccucccgccc

SEQ ID NO: 2246963 - RNA, 18 nt, Human
acagcccucccgccccuu

SEQ ID NO: 2246964 - RNA, 21 nt, Human
acagcccucccgccccuuccc

SEQ ID NO: 2246965 - RNA, 22 nt, Human
acagcccucccgccccuucccc

SEQ ID NO: 2246966 - RNA, 20 nt, Human
uaugaagcuuuuaugugaaa

SEQ ID NO: 2246967 - RNA, 22 nt, Human
uaugaagcuuuuaugugaaaca

SEQ ID NO: 2246968 - RNA, 23 nt, Human
uaugaagcuuuuaugugaaacau

SEQ ID NO: 2246969 - RNA, 21 nt, Human
uaugaaggcuguacacugcac

SEQ ID NO: 2246970 - RNA, 16 nt, Human
uaugaaguauauaaug

SEQ ID NO: 2246971 - RNA, 23 nt, Human
uaugaggcauuuguuugaacuga

SEQ ID NO: 2246972 - RNA, 16 nt, Human
uaugaggcauuuggca

SEQ ID NO: 2246973 - RNA, 14 nt, Human
uaugaaguauauaa

SEQ ID NO: 2246974 - RNA, 15 nt, Human
uaugaaguauauaau

SEQ ID NO: 2246975 - RNA, 21 nt, Human
uaugaggcauuuguuugaacu

SEQ ID NO: 2246976 - RNA, 15 nt, Human
uaugaggcauuuguu

SEQ ID NO: 2246977 - RNA, 14 nt, Human
uaugaggcauuugu

SEQ ID NO: 2246978 - RNA, 13 nt, Human
acagcuacacaga

SEQ ID NO: 2246979 - RNA, 21 nt, Human
acagcuaugggagccccaggg

SEQ ID NO: 2246980 - RNA, 17 nt, Human
acagcuaugggagcccc

SEQ ID NO: 2246981 - RNA, 16 nt, Human
acagcuaugggagccc

SEQ ID NO: 2246982 - RNA, 21 nt, Human
acagcucagcuuuuugucuuu

SEQ ID NO: 2246983 - RNA, 23 nt, Human
acagcucaagucuucccugauca

SEQ ID NO: 2246984 - RNA, 20 nt, Human
acagcucaagucuucccuga

SEQ ID NO: 2246985 - RNA, 18 nt, Human
acagcucagaaguuucuu

SEQ ID NO: 2246986 - RNA, 15 nt, Human
acagcuaaugggaca

SEQ ID NO: 2246987 - RNA, 16 nt, Human
acagcuaaugggacac

SEQ ID NO: 2246988 - RNA, 17 nt, Human
acagcuaaugggacacu

SEQ ID NO: 2246989 - RNA, 19 nt, Human
acagcuaaugggacacuaa

SEQ ID NO: 2246990 - RNA, 16 nt, Human
acagcugucccuguca

SEQ ID NO: 2246991 - RNA, 15 nt, Human
acagcugucccuguc

SEQ ID NO: 2246992 - RNA, 18 nt, Human
acagcugucccugucacc

SEQ ID NO: 2246993 - RNA, 14 nt, Human
acagcugucccugu

SEQ ID NO: 2246994 - RNA, 15 nt, Human
acagcuucagccagg

SEQ ID NO: 2246995 - RNA, 17 nt, Human
acagcuucagccaggag

SEQ ID NO: 2246996 - RNA, 18 nt, Human
acagcuucagccaggagc

SEQ ID NO: 2246997 - RNA, 19 nt, Human
acagcuguuuaagaugggc

SEQ ID NO: 2246998 - RNA, 15 nt, Human
acagcuguuuaagau

SEQ ID NO: 2246999 - RNA, 17 nt, Human
acagcuguuuaagaugg

SEQ ID NO: 2247000 - RNA, 14 nt, Human
acagcuguuuaaga

SEQ ID NO: 2247001 - RNA, 14 nt, Human
acagcuguaugauu

SEQ ID NO: 2247002 - RNA, 19 nt, Human
acagcuguaugauucccag

SEQ ID NO: 2247003 - RNA, 20 nt, Human
acagcuguaugauucccagc

SEQ ID NO: 2247004 - RNA, 23 nt, Human
acagcuguaugauucccagccag

SEQ ID NO: 2247005 - RNA, 20 nt, Human
acagcuucucauccugcagg

SEQ ID NO: 2247006 - RNA, 22 nt, Human
acagcuuccccucucuccuccu

SEQ ID NO: 2247007 - RNA, 22 nt, Human
acagcuucagguuaucgaaaua

SEQ ID NO: 2247008 - RNA, 17 nt, Human
acagcuugaccgugagg

SEQ ID NO: 2247009 - RNA, 20 nt, Human
acagcuugaccgugaggcca

SEQ ID NO: 2247010 - RNA, 21 nt, Human
acagcuugaccgugaggccag

SEQ ID NO: 2247011 - RNA, 21 nt, Human
acagcuucagccaggagcugg

SEQ ID NO: 2247012 - RNA, 22 nt, Human
acagcuucagccaggagcuggg

SEQ ID NO: 2247013 - RNA, 13 nt, Human
acagcuucagguu

SEQ ID NO: 2247014 - RNA, 15 nt, Human
acagcuucagguuau

SEQ ID NO: 2247015 - RNA, 20 nt, Human
acagcuucagguuaucgaaa

SEQ ID NO: 2247016 - RNA, 17 nt, Human
acagcuucauuuccugu

SEQ ID NO: 2247017 - RNA, 19 nt, Human
acagcuucauuuccugugu

SEQ ID NO: 2247018 - RNA, 21 nt, Human
acagcuucauuuccugugucu

SEQ ID NO: 2247019 - RNA, 21 nt, Human
acagcuucucauccugcaggc

SEQ ID NO: 2247020 - RNA, 20 nt, Human
acagcuuccccucucuccuc

SEQ ID NO: 2247021 - RNA, 15 nt, Human
acagcuugaccugag

SEQ ID NO: 2247022 - RNA, 17 nt, Human
acagcuugaccugaggc

SEQ ID NO: 2247023 - RNA, 19 nt, Human
acagcuugaccugaggcug

SEQ ID NO: 2247024 - RNA, 21 nt, Human
acagcuugaccugaggcugug

SEQ ID NO: 2247025 - RNA, 22 nt, Human
acagcuugaccugaggcugugg

SEQ ID NO: 2247026 - RNA, 22 nt, Human
acagcuugaccgugaggccaga

SEQ ID NO: 2247027 - RNA, 23 nt, Human
acagcuugaccgugaggccagag

SEQ ID NO: 2247028 - RNA, 18 nt, Human
acaggaaaagcugcugac

SEQ ID NO: 2247029 - RNA, 19 nt, Human
acaggaaaagcugcugaca

SEQ ID NO: 2247030 - RNA, 20 nt, Human
acaggaaaagcugcugacag

SEQ ID NO: 2247031 - RNA, 21 nt, Human
acaggaaaagcugcugacagu

SEQ ID NO: 2247032 - RNA, 11 nt, Human
acaggagaaau

SEQ ID NO: 2247033 - RNA, 15 nt, Human
acaggagagaaaggg

SEQ ID NO: 2247034 - RNA, 14 nt, Human
acaggagaccuggc

SEQ ID NO: 2247035 - RNA, 16 nt, Human
acaggacucugccucc

SEQ ID NO: 2247036 - RNA, 15 nt, Human
acaggacucugccuc

SEQ ID NO: 2247037 - RNA, 15 nt, Human
acaggcagauacagg

SEQ ID NO: 2247038 - RNA, 13 nt, Human
acaggagcuggga

SEQ ID NO: 2247039 - RNA, 19 nt, Human
acaggagagaaaggggaug

SEQ ID NO: 2247040 - RNA, 18 nt, Human
acaggagagaaaggggau

SEQ ID NO: 2247041 - RNA, 22 nt, Human
acaggaaagggaaggccccaca

SEQ ID NO: 2247042 - RNA, 19 nt, Human
acaggaaagggaaggcccc

SEQ ID NO: 2247043 - RNA, 16 nt, Human
acaggaaagggaaggc

SEQ ID NO: 2247044 - RNA, 23 nt, Human
acaggaaaauccucuggcuggcu

SEQ ID NO: 2247045 - RNA, 22 nt, Human
acaggaaccacaagacugcaca

SEQ ID NO: 2247046 - RNA, 18 nt, Human
acaggaaaauccucuggc

SEQ ID NO: 2247047 - RNA, 17 nt, Human
acaggaaaauccucugg

SEQ ID NO: 2247048 - RNA, 16 nt, Human
acaggaaaauccucug

SEQ ID NO: 2247049 - RNA, 22 nt, Human
acagcuugagccgggccccugg

SEQ ID NO: 2247050 - RNA, 23 nt, Human
acagcuugaccugaggcuguggu

SEQ ID NO: 2247051 - RNA, 16 nt, Human
acagcuugagccgggc

SEQ ID NO: 2247052 - RNA, 21 nt, Human
acagcuugagccgggccccug

SEQ ID NO: 2247053 - RNA, 20 nt, Human
acaggaaaauuuuaaaaaua

SEQ ID NO: 2247054 - RNA, 22 nt, Human
acaggcccggcgcgguggcuca

SEQ ID NO: 2247055 - RNA, 23 nt, Human
acaggcccagcauugcugguucu

SEQ ID NO: 2247056 - RNA, 21 nt, Human
acaggcccccuugaguggggu

SEQ ID NO: 2247057 - RNA, 12 nt, Human
acaggcccccuu

SEQ ID NO: 2247058 - RNA, 20 nt, Human
acaggcccagcauugcuggu

SEQ ID NO: 2247059 - RNA, 22 nt, Human
acaggcccagcauugcugguuc

SEQ ID NO: 2247060 - RNA, 22 nt, Human
acaggcccaagagaugaagagu

SEQ ID NO: 2247061 - RNA, 11 nt, Human
acaggcccagc

SEQ ID NO: 2247062 - RNA, 18 nt, Human
acaggcccaagagaugaa

SEQ ID NO: 2247063 - RNA, 12 nt, Human
acaggcccagca

SEQ ID NO: 2247064 - RNA, 13 nt, Human
acaggcccagcau

SEQ ID NO: 2247065 - RNA, 15 nt, Human
acaggcccagcauug

SEQ ID NO: 2247066 - RNA, 18 nt, Human
acaggcccagcauugcug

SEQ ID NO: 2247067 - RNA, 16 nt, Human
acaggcccggcuccag

SEQ ID NO: 2247068 - RNA, 17 nt, Human
acaggcccggcuccagg

SEQ ID NO: 2247069 - RNA, 14 nt, Human
acaggcagcauuua

SEQ ID NO: 2247070 - RNA, 14 nt, Human
acaggcagcagaga

SEQ ID NO: 2247071 - RNA, 12 nt, Human
acaggcagcaga

SEQ ID NO: 2247072 - RNA, 13 nt, Human
acaggcagcagag

SEQ ID NO: 2247073 - RNA, 16 nt, Human
acaggcagccuggaca

SEQ ID NO: 2247074 - RNA, 17 nt, Human
acaggcagcacagagac

SEQ ID NO: 2247075 - RNA, 13 nt, Human
acaggcagcacag

SEQ ID NO: 2247076 - RNA, 17 nt, Human
acaggaggacaauucau

SEQ ID NO: 2247077 - RNA, 20 nt, Human
acaggaggacaauucaugaa

SEQ ID NO: 2247078 - RNA, 14 nt, Human
acaggagcugggau

SEQ ID NO: 2247079 - RNA, 15 nt, Human
acaggaggacaauuc

SEQ ID NO: 2247080 - RNA, 16 nt, Human
acaggaggacaauuca

SEQ ID NO: 2247081 - RNA, 20 nt, Human
acaggcagcuuuaaccauua

SEQ ID NO: 2247082 - RNA, 22 nt, Human
acaggcagccuggacauagaga

SEQ ID NO: 2247083 - RNA, 22 nt, Human
acaggcagcgauggucucagaa

SEQ ID NO: 2247084 - RNA, 21 nt, Human
acaggcagcuggaugagacuu

SEQ ID NO: 2247085 - RNA, 21 nt, Human
uaugucucgugguaggacugu

SEQ ID NO: 2247086 - RNA, 12 nt, Human
uaugucuaaaga

SEQ ID NO: 2247087 - RNA, 16 nt, Human
uaugucuaaagagcuu

SEQ ID NO: 2247088 - RNA, 12 nt, Human
uaugucuauuua

SEQ ID NO: 2247089 - RNA, 13 nt, Human
uaugucuauuuaa

SEQ ID NO: 2247090 - RNA, 19 nt, Human
uaugucucuucugagcuau

SEQ ID NO: 2247091 - RNA, 14 nt, Human
uaugucucuucuga

SEQ ID NO: 2247092 - RNA, 15 nt, Human
uaugucuauuuaagc

SEQ ID NO: 2247093 - RNA, 12 nt, Human
uaugugcacugu

SEQ ID NO: 2247094 - RNA, 21 nt, Human
uaugugauuuuaacucugucu

SEQ ID NO: 2247095 - RNA, 19 nt, Human
uaugugauuuuaacucugu

SEQ ID NO: 2247096 - RNA, 18 nt, Human
uaugugauuuuaacucug

SEQ ID NO: 2247097 - RNA, 16 nt, Human
uaugugauuuuaacuc

SEQ ID NO: 2247098 - RNA, 10 nt, Human
uaugucuguu

SEQ ID NO: 2247099 - RNA, 15 nt, Human
uaugucccuugcugu

SEQ ID NO: 2247100 - RNA, 15 nt, Human
uaugucccuucacau

SEQ ID NO: 2247101 - RNA, 20 nt, Human
uaugucccuucacauaguuu

SEQ ID NO: 2247102 - RNA, 13 nt, Human
uauguccuaagga

SEQ ID NO: 2247103 - RNA, 17 nt, Human
uauguccacuguguaua

SEQ ID NO: 2247104 - RNA, 23 nt, Human
uauguccacuguguauagaagua

SEQ ID NO: 2247105 - RNA, 16 nt, Human
acaggccgcccugcgg

SEQ ID NO: 2247106 - RNA, 11 nt, Human
acaggccuccc

SEQ ID NO: 2247107 - RNA, 13 nt, Human
acaggccucccug

SEQ ID NO: 2247108 - RNA, 15 nt, Human
acaggccugagauuu

SEQ ID NO: 2247109 - RNA, 16 nt, Human
acaggccucccuguuu

SEQ ID NO: 2247110 - RNA, 17 nt, Human
acaggccugagauuuca

SEQ ID NO: 2247111 - RNA, 21 nt, Human
acaggccugagauuucaucug

SEQ ID NO: 2247112 - RNA, 13 nt, Human
acaggcccuuccu

SEQ ID NO: 2247113 - RNA, 23 nt, Human
acaggcccucccuguuccccaga

SEQ ID NO: 2247114 - RNA, 22 nt, Human
acaggcccucccuguuccccag

SEQ ID NO: 2247115 - RNA, 21 nt, Human
acaggcccucccuguucccca

SEQ ID NO: 2247116 - RNA, 18 nt, Human
acaggcccuuuccucagg

SEQ ID NO: 2247117 - RNA, 19 nt, Human
acaggcccuuuccucaggc

SEQ ID NO: 2247118 - RNA, 20 nt, Human
acaggcccuuuccucaggca

SEQ ID NO: 2247119 - RNA, 21 nt, Human
acaggcccuuuccucaggcaa

SEQ ID NO: 2247120 - RNA, 15 nt, Human
acaggcccuuccucu

SEQ ID NO: 2247121 - RNA, 22 nt, Human
acaggcccuuccucuccacugc

SEQ ID NO: 2247122 - RNA, 18 nt, Human
acaggcccggcuccaggc

SEQ ID NO: 2247123 - RNA, 20 nt, Human
acaggcccggcuccaggcuc

SEQ ID NO: 2247124 - RNA, 21 nt, Human
acaggcccggcuccaggcucc

SEQ ID NO: 2247125 - RNA, 22 nt, Human
acaggcccggcuccaggcuccu

SEQ ID NO: 2247126 - RNA, 22 nt, Human
aauuaaguuagggaauggcaca

SEQ ID NO: 2247127 - RNA, 14 nt, Human
aauuaaguuaucuu

SEQ ID NO: 2247128 - RNA, 23 nt, Human
aauuaauaaaaaauggaaagaau

SEQ ID NO: 2247129 - RNA, 15 nt, Human
aauuaauaaucuuau

SEQ ID NO: 2247130 - RNA, 14 nt, Human
aauuaaguaucuga

SEQ ID NO: 2247131 - RNA, 13 nt, Human
aauuaaguaucug

SEQ ID NO: 2247132 - RNA, 11 nt, Human
aauuaauaaau

SEQ ID NO: 2247133 - RNA, 21 nt, Human
uacauuagucauucaauaaau

SEQ ID NO: 2247134 - RNA, 15 nt, Human
uacauucaauguuua

SEQ ID NO: 2247135 - RNA, 15 nt, Human
uacauucauuuagcu

SEQ ID NO: 2247136 - RNA, 13 nt, Human
uacauucauuuag

SEQ ID NO: 2247137 - RNA, 17 nt, Human
uacauuuaugauuuaau

SEQ ID NO: 2247138 - RNA, 12 nt, Human
uacauucuguua

SEQ ID NO: 2247139 - RNA, 15 nt, Human
uacauuuccaaauga

SEQ ID NO: 2247140 - RNA, 23 nt, Human
uacauuuaugauuuaauaaaaua

SEQ ID NO: 2247141 - RNA, 18 nt, Human
uacauuuaugauuuaaua

SEQ ID NO: 2247142 - RNA, 19 nt, Human
uacauuuaugauuuaauaa

SEQ ID NO: 2247143 - RNA, 20 nt, Human
uacauuuaugauuuaauaaa

SEQ ID NO: 2247144 - RNA, 22 nt, Human
uacauuuaugauuuaauaaaau

SEQ ID NO: 2247145 - RNA, 13 nt, Human
uacauuuccuaaa

SEQ ID NO: 2247146 - RNA, 16 nt, Human
uacauuucugaaauga

SEQ ID NO: 2247147 - RNA, 14 nt, Human
uacauuucugaaau

SEQ ID NO: 2247148 - RNA, 22 nt, Human
uacauuucuccuuugauaaaau

SEQ ID NO: 2247149 - RNA, 23 nt, Human
uacauuucuccuuugauaaaaua

SEQ ID NO: 2247150 - RNA, 21 nt, Human
uacauuuccaaauucacaagu

SEQ ID NO: 2247151 - RNA, 16 nt, Human
uacauuuccaaaugaa

SEQ ID NO: 2247152 - RNA, 16 nt, Human
uacauuucccugugcu

SEQ ID NO: 2247153 - RNA, 18 nt, Human
uacauuucuccuuugaua

SEQ ID NO: 2247154 - RNA, 12 nt, Human
uaccagcagagc

SEQ ID NO: 2247155 - RNA, 18 nt, Human
uaccagaugaugggggag

SEQ ID NO: 2247156 - RNA, 22 nt, Human
uacauuucuuagacuacauuua

SEQ ID NO: 2247157 - RNA, 19 nt, Human
uaccagaguuguucugucu

SEQ ID NO: 2247158 - RNA, 15 nt, Human
uaccagauaaaauua

SEQ ID NO: 2247159 - RNA, 18 nt, Human
uaccagccaguaaauggg

SEQ ID NO: 2247160 - RNA, 22 nt, Human
uaccagcagagcaccuuagaca

SEQ ID NO: 2247161 - RNA, 13 nt, Human
uaccagcagagca

SEQ ID NO: 2247162 - RNA, 14 nt, Human
uaccagcagagcac

SEQ ID NO: 2247163 - RNA, 16 nt, Human
uaccaugucacugugg

SEQ ID NO: 2247164 - RNA, 16 nt, Human
uaccaugugccugauc

SEQ ID NO: 2247165 - RNA, 18 nt, Human
uaccagugaaccaaagag

SEQ ID NO: 2247166 - RNA, 14 nt, Human
uaccaugucacugu

SEQ ID NO: 2247167 - RNA, 15 nt, Human
uaccaugucacugug

SEQ ID NO: 2247168 - RNA, 15 nt, Human
uaccaugugccugau

SEQ ID NO: 2247169 - RNA, 11 nt, Human
uaccagugugg

SEQ ID NO: 2247170 - RNA, 15 nt, Human
uaccagugaaccaaa

SEQ ID NO: 2247171 - RNA, 16 nt, Human
uaccagugaaccaaag

SEQ ID NO: 2247172 - RNA, 16 nt, Human
uaccaugccauuuaaa

SEQ ID NO: 2247173 - RNA, 23 nt, Human
uacccccugcaaagcccagcuug

SEQ ID NO: 2247174 - RNA, 19 nt, Human
uacccccugcaaagcccag

SEQ ID NO: 2247175 - RNA, 15 nt, Human
uacccccugcaaagc

SEQ ID NO: 2247176 - RNA, 17 nt, Human
uacccccuccuucagac

SEQ ID NO: 2247177 - RNA, 16 nt, Human
uacccccuccuucaga

SEQ ID NO: 2247178 - RNA, 13 nt, Human
uacccccuccuuc

SEQ ID NO: 2247179 - RNA, 23 nt, Human
uaccauucagugauuacugucaa

SEQ ID NO: 2247180 - RNA, 14 nt, Human
uaccauucagugau

SEQ ID NO: 2247181 - RNA, 16 nt, Human
uaccagguugaaagac

SEQ ID NO: 2247182 - RNA, 15 nt, Human
uaccagguugaaaga

SEQ ID NO: 2247183 - RNA, 14 nt, Human
uaccagguugaaag

SEQ ID NO: 2247184 - RNA, 14 nt, Human
uaccagguguucua

SEQ ID NO: 2247185 - RNA, 22 nt, Human
uaccaggucuccuccaccgcca

SEQ ID NO: 2247186 - RNA, 18 nt, Human
uaccaggucuccuccacc

SEQ ID NO: 2247187 - RNA, 20 nt, Human
uaccaggucuccuccaccgc

SEQ ID NO: 2247188 - RNA, 22 nt, Human
uaccaggccgccccagccucug

SEQ ID NO: 2247189 - RNA, 14 nt, Human
uaccaggucuccuc

SEQ ID NO: 2247190 - RNA, 16 nt, Human
uaccaggucuccucca

SEQ ID NO: 2247191 - RNA, 20 nt, Human
uaccaggccgccccagccuc

SEQ ID NO: 2247192 - RNA, 21 nt, Human
uaccagccuccguauuucaga

SEQ ID NO: 2247193 - RNA, 17 nt, Human
uaccagcgcccgcuggg

SEQ ID NO: 2247194 - RNA, 20 nt, Human
uaccagcgaggaggcuccag

SEQ ID NO: 2247195 - RNA, 18 nt, Human
uaccagcgcccgcugggc

SEQ ID NO: 2247196 - RNA, 19 nt, Human
uaccagcgcccgcugggcu

SEQ ID NO: 2247197 - RNA, 20 nt, Human
uaccagcgcccgcugggcug

SEQ ID NO: 2247198 - RNA, 15 nt, Human
uaccagcgaggaggc

SEQ ID NO: 2247199 - RNA, 13 nt, Human
uaccagcgaggag

SEQ ID NO: 2247200 - RNA, 13 nt, Human
uaccagcugcgcu

SEQ ID NO: 2247201 - RNA, 14 nt, Human
uaccagcugcgcuu

SEQ ID NO: 2247202 - RNA, 21 nt, Human
uaccagcugcgcuugcuuuuc

SEQ ID NO: 2247203 - RNA, 22 nt, Human
uaccagcugcgcuugcuuuucu

SEQ ID NO: 2247204 - RNA, 16 nt, Human
uaccaggaacuauaaa

SEQ ID NO: 2247205 - RNA, 19 nt, Human
uaccagggacugaggggag

SEQ ID NO: 2247206 - RNA, 16 nt, Human
uacagggagcugggac

SEQ ID NO: 2247207 - RNA, 20 nt, Human
uacagggagccuccugccca

SEQ ID NO: 2247208 - RNA, 21 nt, Human
uacagggagccuccugcccag

SEQ ID NO: 2247209 - RNA, 21 nt, Human
uacagggcaugcauuuugcag

SEQ ID NO: 2247210 - RNA, 22 nt, Human
uacagagaggucaagcccagga

SEQ ID NO: 2247211 - RNA, 17 nt, Human
uacagggaugguguuca

SEQ ID NO: 2247212 - RNA, 15 nt, Human
uacagggagccuccu

SEQ ID NO: 2247213 - RNA, 16 nt, Human
uacagggagccuccug

SEQ ID NO: 2247214 - RNA, 17 nt, Human
uacagggagccuccugc

SEQ ID NO: 2247215 - RNA, 18 nt, Human
uacagggagccuccugcc

SEQ ID NO: 2247216 - RNA, 21 nt, Human
uacagguaaggugagggaaua

SEQ ID NO: 2247217 - RNA, 18 nt, Human
uacaggguagcagguacc

SEQ ID NO: 2247218 - RNA, 22 nt, Human
uacaggguagcagguaccacug

SEQ ID NO: 2247219 - RNA, 19 nt, Human
uacaggguagauaaccugu

SEQ ID NO: 2247220 - RNA, 21 nt, Human
aaugugcugaaugguuuucaa

SEQ ID NO: 2247221 - RNA, 22 nt, Human
aauguggcaaggaaaaacaggu

SEQ ID NO: 2247222 - RNA, 21 nt, Human
aauguggccccugaacaagaa

SEQ ID NO: 2247223 - RNA, 20 nt, Human
aaugugcuguguaaaguuag

SEQ ID NO: 2247224 - RNA, 21 nt, Human
aaugugcuguguaaaguuagu

SEQ ID NO: 2247225 - RNA, 12 nt, Human
aaugugcugugu

SEQ ID NO: 2247226 - RNA, 13 nt, Human
aaugugcugugua

SEQ ID NO: 2247227 - RNA, 14 nt, Human
aaugugcuguguaa

SEQ ID NO: 2247228 - RNA, 15 nt, Human
aaugugcuguguaaa

SEQ ID NO: 2247229 - RNA, 16 nt, Human
aaugugcuguguaaag

SEQ ID NO: 2247230 - RNA, 17 nt, Human
aaugugcuguguaaagu

SEQ ID NO: 2247231 - RNA, 18 nt, Human
aaugugcuguguaaaguu

SEQ ID NO: 2247232 - RNA, 19 nt, Human
aaugugcuguguaaaguua

SEQ ID NO: 2247233 - RNA, 15 nt, Human
aauguuagauaguua

SEQ ID NO: 2247234 - RNA, 22 nt, Human
aauguuacugaucaugcauugu

SEQ ID NO: 2247235 - RNA, 17 nt, Human
aauguuagagguuuuaa

SEQ ID NO: 2247236 - RNA, 22 nt, Human
aauguuagagguuuuaaaguga

SEQ ID NO: 2247237 - RNA, 21 nt, Human
aauguuacugaucaugcauug

SEQ ID NO: 2247238 - RNA, 20 nt, Human
aauguuacugaucaugcauu

SEQ ID NO: 2247239 - RNA, 19 nt, Human
aauguuacugaucaugcau

SEQ ID NO: 2247240 - RNA, 18 nt, Human
aauguuacugaucaugca

SEQ ID NO: 2247241 - RNA, 13 nt, Human
aauguuacugauc

SEQ ID NO: 2247242 - RNA, 15 nt, Human
aauguuacauuguuu

SEQ ID NO: 2247243 - RNA, 16 nt, Human
aauguuacauuauuau

SEQ ID NO: 2247244 - RNA, 20 nt, Human
aauguggccuaaaaaugcaa

SEQ ID NO: 2247245 - RNA, 17 nt, Human
aauguggccuaaaaaug

SEQ ID NO: 2247246 - RNA, 15 nt, Human
aauguuacauuauua

SEQ ID NO: 2247247 - RNA, 22 nt, Human
aauguuauguuguguucuaaua

SEQ ID NO: 2247248 - RNA, 14 nt, Human
aauguuauuuaaca

SEQ ID NO: 2247249 - RNA, 21 nt, Human
aauguuauuuguuauuuucag

SEQ ID NO: 2247250 - RNA, 23 nt, Human
aauguuauuuguuauuuucagua

SEQ ID NO: 2247251 - RNA, 13 nt, Human
aauguucaucaau

SEQ ID NO: 2247252 - RNA, 19 nt, Human
aauguuauuuuuuaauuau

SEQ ID NO: 2247253 - RNA, 20 nt, Human
aauguuauuuuuuaauuauu

SEQ ID NO: 2247254 - RNA, 21 nt, Human
aauguucauuguaauguuacu

SEQ ID NO: 2247255 - RNA, 17 nt, Human
aauguucauuguaaugu

SEQ ID NO: 2247256 - RNA, 12 nt, Human
aauguucauugu

SEQ ID NO: 2247257 - RNA, 11 nt, Human
aauguucauug

SEQ ID NO: 2247258 - RNA, 24 nt, Human
aauguucauuguaauguuacugau

SEQ ID NO: 2247259 - RNA, 22 nt, Human
aauguucauuguaauguuacug

SEQ ID NO: 2247260 - RNA, 22 nt, Human
aauguuauuuguuauuuucagu

SEQ ID NO: 2247261 - RNA, 21 nt, Human
aauguuauuuuuuaauuauua

SEQ ID NO: 2247262 - RNA, 12 nt, Human
aauguucaucau

SEQ ID NO: 2247263 - RNA, 21 nt, Human
aauguucaucccaugauguag

SEQ ID NO: 2247264 - RNA, 22 nt, Human
aauguucaucccaugauguagu

SEQ ID NO: 2247265 - RNA, 20 nt, Human
aauguucaucaaugaaugaa

SEQ ID NO: 2247266 - RNA, 16 nt, Human
aauguucaucaaugaa

SEQ ID NO: 2247267 - RNA, 22 nt, Human
aauguuggauuuauaaaugcua

SEQ ID NO: 2247268 - RNA, 19 nt, Human
aauguuggauuuauaaaug

SEQ ID NO: 2247269 - RNA, 23 nt, Human
aauguuggucauuuuauguuaag

SEQ ID NO: 2247270 - RNA, 13 nt, Human
aauguugggacug

SEQ ID NO: 2247271 - RNA, 21 nt, Human
aauguugggacugcuaaauaa

SEQ ID NO: 2247272 - RNA, 17 nt, Human
aauuaaguacuauguau

SEQ ID NO: 2247273 - RNA, 16 nt, Human
aauuaaguacuaugua

SEQ ID NO: 2247274 - RNA, 16 nt, Human
aauuaacuuuuauaaa

SEQ ID NO: 2247275 - RNA, 15 nt, Human
aauuaacuuuuauaa

SEQ ID NO: 2247276 - RNA, 21 nt, Human
aauguuguucauuauuggagg

SEQ ID NO: 2247277 - RNA, 15 nt, Human
aauguuguuauuuaa

SEQ ID NO: 2247278 - RNA, 17 nt, Human
aauguuguauucaguga

SEQ ID NO: 2247279 - RNA, 22 nt, Human
aauguugggacugcuaaauaaa

SEQ ID NO: 2247280 - RNA, 13 nt, Human
aauuaacuuuuau

SEQ ID NO: 2247281 - RNA, 12 nt, Human
aauuaacuuuua

SEQ ID NO: 2247282 - RNA, 16 nt, Human
uaccuguucagugucc

SEQ ID NO: 2247283 - RNA, 20 nt, Human
uaccuguucagugucccggg

SEQ ID NO: 2247284 - RNA, 22 nt, Human
uaccuguuuuguggucagcugu

SEQ ID NO: 2247285 - RNA, 21 nt, Human
uaccuguucagugucccgggc

SEQ ID NO: 2247286 - RNA, 13 nt, Human
uaccuguuccuua

SEQ ID NO: 2247287 - RNA, 20 nt, Human
uaccugugcguuacuaauug

SEQ ID NO: 2247288 - RNA, 16 nt, Human
uaccugugccucggcu

SEQ ID NO: 2247289 - RNA, 12 nt, Human
uaccugugccug

SEQ ID NO: 2247290 - RNA, 18 nt, Human
uaccugauuuuuuuuccu

SEQ ID NO: 2247291 - RNA, 16 nt, Human
uaccugccacucacac

SEQ ID NO: 2247292 - RNA, 19 nt, Human
uaccugccacucacacagc

SEQ ID NO: 2247293 - RNA, 20 nt, Human
uaccugccacucacacagcc

SEQ ID NO: 2247294 - RNA, 21 nt, Human
uaccugccacucacacagcca

SEQ ID NO: 2247295 - RNA, 22 nt, Human
uaccugccacucacacagccag

SEQ ID NO: 2247296 - RNA, 12 nt, Human
uaccugauuuuu

SEQ ID NO: 2247297 - RNA, 18 nt, Human
uaccugaucaaugacaga

SEQ ID NO: 2247298 - RNA, 19 nt, Human
uaccugaucaaugacagag

SEQ ID NO: 2247299 - RNA, 16 nt, Human
uaccugccaggaagcc

SEQ ID NO: 2247300 - RNA, 12 nt, Human
uaccugagacca

SEQ ID NO: 2247301 - RNA, 13 nt, Human
uaccugagaccag

SEQ ID NO: 2247302 - RNA, 20 nt, Human
uaccugacacucccuugggc

SEQ ID NO: 2247303 - RNA, 16 nt, Human
uaccugaggggccucu

SEQ ID NO: 2247304 - RNA, 17 nt, Human
aauuacauguaaaacau

SEQ ID NO: 2247305 - RNA, 14 nt, Human
aauuacauuuguau

SEQ ID NO: 2247306 - RNA, 14 nt, Human
aauuacauaauuuu

SEQ ID NO: 2247307 - RNA, 20 nt, Human
uaccuuacagugagggcuau

SEQ ID NO: 2247308 - RNA, 12 nt, Human
uaccuuacugug

SEQ ID NO: 2247309 - RNA, 13 nt, Human
aauuacauuugua

SEQ ID NO: 2247310 - RNA, 17 nt, Human
aauuacaggaaguacug

SEQ ID NO: 2247311 - RNA, 19 nt, Human
aauuacaggaaguacugga

SEQ ID NO: 2247312 - RNA, 20 nt, Human
aauuacaggaaguacuggag

SEQ ID NO: 2247313 - RNA, 21 nt, Human
uaccugaaaacacugugcaca

SEQ ID NO: 2247314 - RNA, 20 nt, Human
uaccugaaaacacugugcac

SEQ ID NO: 2247315 - RNA, 13 nt, Human
uaccugaaaacac

SEQ ID NO: 2247316 - RNA, 23 nt, Human
uaccugaagcuaucguaaaauua

SEQ ID NO: 2247317 - RNA, 13 nt, Human
uaccugaagucuu

SEQ ID NO: 2247318 - RNA, 14 nt, Human
uaccugaagucuuu

SEQ ID NO: 2247319 - RNA, 17 nt, Human
uaccugacacucccuug

SEQ ID NO: 2247320 - RNA, 16 nt, Human
uaccugaagucuuugu

SEQ ID NO: 2247321 - RNA, 13 nt, Human
uaccugaggggcc

SEQ ID NO: 2247322 - RNA, 15 nt, Human
uaccugaggggccuc

SEQ ID NO: 2247323 - RNA, 21 nt, Human
uacccucaggcauaggccugg

SEQ ID NO: 2247324 - RNA, 22 nt, Human
uacccucaggacaaugucugaa

SEQ ID NO: 2247325 - RNA, 16 nt, Human
uacccuauucucucuu

SEQ ID NO: 2247326 - RNA, 22 nt, Human
uaccucuugagccuugaacuuu

SEQ ID NO: 2247327 - RNA, 23 nt, Human
uacccucaggcauaggccugggu

SEQ ID NO: 2247328 - RNA, 19 nt, Human
uaccucuuuauuuuuugau

SEQ ID NO: 2247329 - RNA, 13 nt, Human
uaccucuuggcug

SEQ ID NO: 2247330 - RNA, 23 nt, Human
uaccucuugagccuugaacuuug

SEQ ID NO: 2247331 - RNA, 15 nt, Human
uacccuagccauucc

SEQ ID NO: 2247332 - RNA, 16 nt, Human
uacccuagccauuccu

SEQ ID NO: 2247333 - RNA, 17 nt, Human
uacccguucacauuuuu

SEQ ID NO: 2247334 - RNA, 23 nt, Human
uacccgggaagggggcugggaca

SEQ ID NO: 2247335 - RNA, 18 nt, Human
uacccccuccuucagaca

SEQ ID NO: 2247336 - RNA, 17 nt, Human
uacccccuccucucugc

SEQ ID NO: 2247337 - RNA, 13 nt, Human
uacccccuucugg

SEQ ID NO: 2247338 - RNA, 12 nt, Human
aauuagagcaga

SEQ ID NO: 2247339 - RNA, 22 nt, Human
aauuagagcagaugaccccucc

SEQ ID NO: 2247340 - RNA, 22 nt, Human
aauuaugucugcugaauaauaa

SEQ ID NO: 2247341 - RNA, 22 nt, Human
aauuaugugccagauuuaugca

SEQ ID NO: 2247342 - RNA, 14 nt, Human
aauuauguuaaacu

SEQ ID NO: 2247343 - RNA, 15 nt, Human
aauuauguuaaacua

SEQ ID NO: 2247344 - RNA, 13 nt, Human
aauuauguuaaac

SEQ ID NO: 2247345 - RNA, 15 nt, Human
aauuaccaaccuguu

SEQ ID NO: 2247346 - RNA, 22 nt, Human
aauuacuuaucauccacauugu

SEQ ID NO: 2247347 - RNA, 18 nt, Human
aauuagaaauuggcugga

SEQ ID NO: 2247348 - RNA, 22 nt, Human
aauuagaaaauguuauuuaaca

SEQ ID NO: 2247349 - RNA, 15 nt, Human
aauuagaauaguguu

SEQ ID NO: 2247350 - RNA, 15 nt, Human
aauuagaagacauuu

SEQ ID NO: 2247351 - RNA, 13 nt, Human
aauuagaagacau

SEQ ID NO: 2247352 - RNA, 14 nt, Human
aauuagaagacauu

SEQ ID NO: 2247353 - RNA, 12 nt, Human
aauuauuguaua

SEQ ID NO: 2247354 - RNA, 13 nt, Human
aauuauugugauu

SEQ ID NO: 2247355 - RNA, 14 nt, Human
aauuauuuaauaaa

SEQ ID NO: 2247356 - RNA, 16 nt, Human
aauuauugugauuucc

SEQ ID NO: 2247357 - RNA, 21 nt, Human
aauuauuuauuaaaugcccag

SEQ ID NO: 2247358 - RNA, 21 nt, Human
aauuauuauuuauauauguau

SEQ ID NO: 2247359 - RNA, 12 nt, Human
aauuauuguaca

SEQ ID NO: 2247360 - RNA, 21 nt, Human
aauuauuguacauuuauaguu

SEQ ID NO: 2247361 - RNA, 11 nt, Human
aauuauuauuu

SEQ ID NO: 2247362 - RNA, 13 nt, Human
aauuauuauuuau

SEQ ID NO: 2247363 - RNA, 16 nt, Human
aauuauuauuuauaua

SEQ ID NO: 2247364 - RNA, 18 nt, Human
aauuauuauuuauauaug

SEQ ID NO: 2247365 - RNA, 14 nt, Human
aauuauguuuauau

SEQ ID NO: 2247366 - RNA, 19 nt, Human
aauuauguuaaacuagcau

SEQ ID NO: 2247367 - RNA, 23 nt, Human
aauuauguuaaacuagcauaucu

SEQ ID NO: 2247368 - RNA, 22 nt, Human
aauuauguuugccacuuugcaa

SEQ ID NO: 2247369 - RNA, 17 nt, Human
aauuauguuuauauaaa

SEQ ID NO: 2247370 - RNA, 18 nt, Human
aauuauguuuauauaaau

SEQ ID NO: 2247371 - RNA, 16 nt, Human
aauuauuaaugaaaau

SEQ ID NO: 2247372 - RNA, 13 nt, Human
aauuauuauucuu

SEQ ID NO: 2247373 - RNA, 21 nt, Human
aauuauuauucuucauaacaa

SEQ ID NO: 2247374 - RNA, 21 nt, Human
aauuauguuuauauaaaugcu

SEQ ID NO: 2247375 - RNA, 17 nt, Human
aauuauuaaugaaaaua

SEQ ID NO: 2247376 - RNA, 22 nt, Human
aauuauuaaugaaaauaagaau

SEQ ID NO: 2247377 - RNA, 20 nt, Human
aauuauuaguuuacaucauu

SEQ ID NO: 2247378 - RNA, 20 nt, Human
aauucagauauauuuuucac

SEQ ID NO: 2247379 - RNA, 13 nt, Human
aauucacaaacuu

SEQ ID NO: 2247380 - RNA, 23 nt, Human
aauucaauuguaaauugaaucag

SEQ ID NO: 2247381 - RNA, 19 nt, Human
aauucaauuguaaauugaa

SEQ ID NO: 2247382 - RNA, 15 nt, Human
aauucagcacugauu

SEQ ID NO: 2247383 - RNA, 20 nt, Human
aauucagcacugauuucaca

SEQ ID NO: 2247384 - RNA, 23 nt, Human
aauucagcacugauuucacaaca

SEQ ID NO: 2247385 - RNA, 11 nt, Human
aauucaguugu

SEQ ID NO: 2247386 - RNA, 23 nt, Human
aauucaucaaauggaagacacau

SEQ ID NO: 2247387 - RNA, 18 nt, Human
aauucaucccaacugucu

SEQ ID NO: 2247388 - RNA, 13 nt, Human
aauucauauucug

SEQ ID NO: 2247389 - RNA, 16 nt, Human
aauucagugcuguacu

SEQ ID NO: 2247390 - RNA, 17 nt, Human
aauucaguuguuagugu

SEQ ID NO: 2247391 - RNA, 22 nt, Human
aauucaguuguuagugugucuu

SEQ ID NO: 2247392 - RNA, 14 nt, Human
aauuauuuuaaaca

SEQ ID NO: 2247393 - RNA, 18 nt, Human
aauuauuuuaaacaaaau

SEQ ID NO: 2247394 - RNA, 15 nt, Human
aauuauuuuaaaaga

SEQ ID NO: 2247395 - RNA, 12 nt, Human
aauucaagaaaa

SEQ ID NO: 2247396 - RNA, 20 nt, Human
aauucaagaaaacaacuuca

SEQ ID NO: 2247397 - RNA, 14 nt, Human
aauucaauuguaaa

SEQ ID NO: 2247398 - RNA, 17 nt, Human
aauucaauuguaaauug

SEQ ID NO: 2247399 - RNA, 17 nt, Human
aauuauuucagaaaugu

SEQ ID NO: 2247400 - RNA, 12 nt, Human
aauuauuugcau

SEQ ID NO: 2247401 - RNA, 14 nt, Human
aauuauuuguguaa

SEQ ID NO: 2247402 - RNA, 12 nt, Human
aauuauuuuaaa

SEQ ID NO: 2247403 - RNA, 15 nt, Human
aauuauuuguguaau

SEQ ID NO: 2247404 - RNA, 18 nt, Human
aauuauuuguguaauaga

SEQ ID NO: 2247405 - RNA, 19 nt, Human
aauuauuuguguaauagaa

SEQ ID NO: 2247406 - RNA, 21 nt, Human
aauuauuuguguaauagaaaa

SEQ ID NO: 2247407 - RNA, 20 nt, Human
aauuauuuauuuauggagga

SEQ ID NO: 2247408 - RNA, 18 nt, Human
aauuauuuauuauuaaga

SEQ ID NO: 2247409 - RNA, 19 nt, Human
aauuauuuauuuaauaaca

SEQ ID NO: 2247410 - RNA, 13 nt, Human
aauuauuucagaa

SEQ ID NO: 2247411 - RNA, 12 nt, Human
aauuauuucaga

SEQ ID NO: 2247412 - RNA, 22 nt, Human
aauuauuuauuaaaugcccagc

SEQ ID NO: 2247413 - RNA, 18 nt, Human
aauggaaccccaccacug

SEQ ID NO: 2247414 - RNA, 16 nt, Human
aauggaaccuccuuuc

SEQ ID NO: 2247415 - RNA, 22 nt, Human
aauggaaccuccuuucucuucu

SEQ ID NO: 2247416 - RNA, 13 nt, Human
aauggaagacaca

SEQ ID NO: 2247417 - RNA, 13 nt, Human
aauggaagacagc

SEQ ID NO: 2247418 - RNA, 20 nt, Human
aaugcuuguggauugagggu

SEQ ID NO: 2247419 - RNA, 18 nt, Human
aaugcuuuaaaaacuauu

SEQ ID NO: 2247420 - RNA, 22 nt, Human
aaugcuuuaaaaacuauuuaac

SEQ ID NO: 2247421 - RNA, 23 nt, Human
aaugcuuuaaaaacuauuuaacu

SEQ ID NO: 2247422 - RNA, 17 nt, Human
aaugcuuggcuucucau

SEQ ID NO: 2247423 - RNA, 16 nt, Human
aaugcuugaaaaaugu

SEQ ID NO: 2247424 - RNA, 21 nt, Human
aaugcuuggcuucucauacgu

SEQ ID NO: 2247425 - RNA, 21 nt, Human
aaugcuucugacuucauagau

SEQ ID NO: 2247426 - RNA, 17 nt, Human
aaugcuucugacuucau

SEQ ID NO: 2247427 - RNA, 19 nt, Human
aaugcuugaaaaaugugca

SEQ ID NO: 2247428 - RNA, 16 nt, Human
aaugcuucuucucagg

SEQ ID NO: 2247429 - RNA, 13 nt, Human
aaugcuugaaaaa

SEQ ID NO: 2247430 - RNA, 23 nt, Human
aaugcugguuuuccuaaaugcag

SEQ ID NO: 2247431 - RNA, 22 nt, Human
aaugcugguuuuccuaaaugca

SEQ ID NO: 2247432 - RNA, 21 nt, Human
aaugcugguuuuccuaaaugc

SEQ ID NO: 2247433 - RNA, 19 nt, Human
aaugcugguuuuccuaaau

SEQ ID NO: 2247434 - RNA, 17 nt, Human
aaugcugucaacuauga

SEQ ID NO: 2247435 - RNA, 22 nt, Human
aaugcuguauuuuaaaagaaug

SEQ ID NO: 2247436 - RNA, 16 nt, Human
aaugcauauuguauua

SEQ ID NO: 2247437 - RNA, 19 nt, Human
aaugcauccauuccucagg

SEQ ID NO: 2247438 - RNA, 13 nt, Human
aaugcauauugua

SEQ ID NO: 2247439 - RNA, 23 nt, Human
aaugcauccauuccucagggaca

SEQ ID NO: 2247440 - RNA, 16 nt, Human
aaugcaucuagauuau

SEQ ID NO: 2247441 - RNA, 16 nt, Human
aaugcaucuguccuca

SEQ ID NO: 2247442 - RNA, 19 nt, Human
aaugcaucuagauuaugga

SEQ ID NO: 2247443 - RNA, 15 nt, Human
aaugcaucuguccuc

SEQ ID NO: 2247444 - RNA, 21 nt, Human
aaugcuggcuguuggcugggg

SEQ ID NO: 2247445 - RNA, 19 nt, Human
aaugcaugcagccacugug

SEQ ID NO: 2247446 - RNA, 19 nt, Human
aaugcaugauuuuguaacc

SEQ ID NO: 2247447 - RNA, 17 nt, Human
aaugcaugauuuuguaa

SEQ ID NO: 2247448 - RNA, 16 nt, Human
aaugcaugauuuugua

SEQ ID NO: 2247449 - RNA, 22 nt, Human
aaugcuggcuguuggcuggggg

SEQ ID NO: 2247450 - RNA, 18 nt, Human
aaugcauguuaggaaaau

SEQ ID NO: 2247451 - RNA, 18 nt, Human
aaugcugggacucagccu

SEQ ID NO: 2247452 - RNA, 18 nt, Human
aaugcugguuuuccuaaa

SEQ ID NO: 2247453 - RNA, 15 nt, Human
aaugcugguuuuccu

SEQ ID NO: 2247454 - RNA, 12 nt, Human
aaugcugggcug

SEQ ID NO: 2247455 - RNA, 20 nt, Human
aaugcuguauuuuaaaagaa

SEQ ID NO: 2247456 - RNA, 21 nt, Human
aaugcuguauuuuaaaagaau

SEQ ID NO: 2247457 - RNA, 21 nt, Human
uacaaugaacccccaugaugu

SEQ ID NO: 2247458 - RNA, 18 nt, Human
uacaaugacuuuauugca

SEQ ID NO: 2247459 - RNA, 14 nt, Human
uacaaugacuuuau

SEQ ID NO: 2247460 - RNA, 16 nt, Human
uacaaugcugugcccu

SEQ ID NO: 2247461 - RNA, 14 nt, Human
uacaaugcugugcc

SEQ ID NO: 2247462 - RNA, 13 nt, Human
uacaaugcugugc

SEQ ID NO: 2247463 - RNA, 22 nt, Human
uacaauuauuuuuacaguucuc

SEQ ID NO: 2247464 - RNA, 18 nt, Human
uacaauuauuuuuacagu

SEQ ID NO: 2247465 - RNA, 17 nt, Human
uacaauucccugcuguc

SEQ ID NO: 2247466 - RNA, 19 nt, Human
aaugcauauccugagccau

SEQ ID NO: 2247467 - RNA, 16 nt, Human
uacaauugaaaugacu

SEQ ID NO: 2247468 - RNA, 14 nt, Human
uacaauugaaauga

SEQ ID NO: 2247469 - RNA, 13 nt, Human
uacaauugaaaug

SEQ ID NO: 2247470 - RNA, 18 nt, Human
uacaauucuacauuguca

SEQ ID NO: 2247471 - RNA, 19 nt, Human
uacaauuauaucaguccuc

SEQ ID NO: 2247472 - RNA, 15 nt, Human
uacaauuauaucagu

SEQ ID NO: 2247473 - RNA, 22 nt, Human
uacaauuaaaaaaaaagaucug

SEQ ID NO: 2247474 - RNA, 19 nt, Human
uacaauuaaagcuguuauu

SEQ ID NO: 2247475 - RNA, 15 nt, Human
uacaauguucauccc

SEQ ID NO: 2247476 - RNA, 18 nt, Human
uacaauuaaaaaaaaaga

SEQ ID NO: 2247477 - RNA, 16 nt, Human
uacaauguucauccca

SEQ ID NO: 2247478 - RNA, 22 nt, Human
uacaauguucaucccaugaugu

SEQ ID NO: 2247479 - RNA, 13 nt, Human
uaauuuuuauuca

SEQ ID NO: 2247480 - RNA, 23 nt, Human
uaauuuuuauucauaagccaauu

SEQ ID NO: 2247481 - RNA, 16 nt, Human
uaauuuuuccuauauu

SEQ ID NO: 2247482 - RNA, 16 nt, Human
uaauuuuugcucuaga

SEQ ID NO: 2247483 - RNA, 15 nt, Human
uaauuuuuguauuuu

SEQ ID NO: 2247484 - RNA, 14 nt, Human
uaauuuuuguaauu

SEQ ID NO: 2247485 - RNA, 22 nt, Human
uaauuuuuuuuuuccuuuuaaa

SEQ ID NO: 2247486 - RNA, 13 nt, Human
uacaaugacuuua

SEQ ID NO: 2247487 - RNA, 21 nt, Human
uacaaaaaaaaaaaaaaauua

SEQ ID NO: 2247488 - RNA, 22 nt, Human
uaauuuuuuucaauauuuauua

SEQ ID NO: 2247489 - RNA, 18 nt, Human
uaauuuuuuugagacaga

SEQ ID NO: 2247490 - RNA, 17 nt, Human
uacagagaggagaaaca

SEQ ID NO: 2247491 - RNA, 16 nt, Human
uacagagaggagaaac

SEQ ID NO: 2247492 - RNA, 22 nt, Human
uacagagaggagaaacacaucu

SEQ ID NO: 2247493 - RNA, 21 nt, Human
uacagagaggagaaacacauc

SEQ ID NO: 2247494 - RNA, 20 nt, Human
uacagagaggagaaacacau

SEQ ID NO: 2247495 - RNA, 18 nt, Human
uacagagaggagaaacac

SEQ ID NO: 2247496 - RNA, 23 nt, Human
uacagagcagacaguuaagagaa

SEQ ID NO: 2247497 - RNA, 19 nt, Human
uacagagcccacgccccca

SEQ ID NO: 2247498 - RNA, 22 nt, Human
uacagagcccacgcccccacug

SEQ ID NO: 2247499 - RNA, 17 nt, Human
uacagagacagaaagca

SEQ ID NO: 2247500 - RNA, 22 nt, Human
uacaccuaacucaccuaacuca

SEQ ID NO: 2247501 - RNA, 12 nt, Human
uacaccuaacuc

SEQ ID NO: 2247502 - RNA, 14 nt, Human
uacacccuuggacu

SEQ ID NO: 2247503 - RNA, 15 nt, Human
uacaccgggccugga

SEQ ID NO: 2247504 - RNA, 17 nt, Human
uacaccgggccuggaga

SEQ ID NO: 2247505 - RNA, 13 nt, Human
uacagacaaagcg

SEQ ID NO: 2247506 - RNA, 14 nt, Human
uacagacaaagcgu

SEQ ID NO: 2247507 - RNA, 15 nt, Human
uacagacaaagcgug

SEQ ID NO: 2247508 - RNA, 14 nt, Human
aauguaauugaaua

SEQ ID NO: 2247509 - RNA, 15 nt, Human
aauguaaugaucaua

SEQ ID NO: 2247510 - RNA, 19 nt, Human
aauguaaucaauguuucuu

SEQ ID NO: 2247511 - RNA, 21 nt, Human
aauguaaugaucauaagucua

SEQ ID NO: 2247512 - RNA, 16 nt, Human
aauguaauugaauaaa

SEQ ID NO: 2247513 - RNA, 16 nt, Human
uacacccuuuuccagc

SEQ ID NO: 2247514 - RNA, 15 nt, Human
uacacccuuuuccag

SEQ ID NO: 2247515 - RNA, 14 nt, Human
uacacccaaagagg

SEQ ID NO: 2247516 - RNA, 17 nt, Human
aaugguuugcaaggaag

SEQ ID NO: 2247517 - RNA, 18 nt, Human
aaugguuugcaaggaagc

SEQ ID NO: 2247518 - RNA, 19 nt, Human
aaugguuugcaaggaagcc

SEQ ID NO: 2247519 - RNA, 14 nt, Human
aaugguuuucaaaa

SEQ ID NO: 2247520 - RNA, 16 nt, Human
aauggauuggauuauu

SEQ ID NO: 2247521 - RNA, 18 nt, Human
aauggauuggauuauuua

SEQ ID NO: 2247522 - RNA, 20 nt, Human
aauggauuggauuauuuaau

SEQ ID NO: 2247523 - RNA, 21 nt, Human
aauggauuggauuauuuaaua

SEQ ID NO: 2247524 - RNA, 19 nt, Human
aauggagucaguuugcagu

SEQ ID NO: 2247525 - RNA, 14 nt, Human
aauggaagacacau

SEQ ID NO: 2247526 - RNA, 18 nt, Human
aauggaagacagcucuua

SEQ ID NO: 2247527 - RNA, 17 nt, Human
aauggaggccauugugu

SEQ ID NO: 2247528 - RNA, 16 nt, Human
aauggaagacagcucu

SEQ ID NO: 2247529 - RNA, 23 nt, Human
aauguaaaggagucaaaacuaca

SEQ ID NO: 2247530 - RNA, 21 nt, Human
aauguaaaggagucaaaacua

SEQ ID NO: 2247531 - RNA, 20 nt, Human
aauguaaaggagucaaaacu

SEQ ID NO: 2247532 - RNA, 16 nt, Human
aaugguuuucaaaaua

SEQ ID NO: 2247533 - RNA, 16 nt, Human
aaugguuuucuugugu

SEQ ID NO: 2247534 - RNA, 12 nt, Human
aauguaaauauu

SEQ ID NO: 2247535 - RNA, 12 nt, Human
aauguaaauaaa

SEQ ID NO: 2247536 - RNA, 15 nt, Human
aauguaagcuguuua

SEQ ID NO: 2247537 - RNA, 16 nt, Human
aauguaagcuguuuau

SEQ ID NO: 2247538 - RNA, 18 nt, Human
aauguaaauauucuauau

SEQ ID NO: 2247539 - RNA, 20 nt, Human
aauguaagggaaacugccag

SEQ ID NO: 2247540 - RNA, 21 nt, Human
aaugcaaaaauuagccgggcg

SEQ ID NO: 2247541 - RNA, 12 nt, Human
aaugcaaaccau

SEQ ID NO: 2247542 - RNA, 17 nt, Human
aaugcacacuagccucu

SEQ ID NO: 2247543 - RNA, 13 nt, Human
aaugcacacuagc

SEQ ID NO: 2247544 - RNA, 17 nt, Human
aaugcacacaaaacaac

SEQ ID NO: 2247545 - RNA, 14 nt, Human
aaugcacacaaaac

SEQ ID NO: 2247546 - RNA, 20 nt, Human
aaugcaaacacacaaaggua

SEQ ID NO: 2247547 - RNA, 15 nt, Human
aaugcacacaaaaca

SEQ ID NO: 2247548 - RNA, 19 nt, Human
aaugauuuuaucugugaau

SEQ ID NO: 2247549 - RNA, 18 nt, Human
aaugauuuccaaagagaa

SEQ ID NO: 2247550 - RNA, 14 nt, Human
aaugauuuuuagau

SEQ ID NO: 2247551 - RNA, 16 nt, Human
aaugauuucauucaau

SEQ ID NO: 2247552 - RNA, 20 nt, Human
aaugauuuccaaagagaaaa

SEQ ID NO: 2247553 - RNA, 20 nt, Human
aaugauuuuaucugugaauu

SEQ ID NO: 2247554 - RNA, 11 nt, Human
aaugcaaacca

SEQ ID NO: 2247555 - RNA, 13 nt, Human
uaauuauuauuaa

SEQ ID NO: 2247556 - RNA, 12 nt, Human
uaauuauuauuc

SEQ ID NO: 2247557 - RNA, 14 nt, Human
uaauuauuauucuu

SEQ ID NO: 2247558 - RNA, 12 nt, Human
uaauuauuauuu

SEQ ID NO: 2247559 - RNA, 13 nt, Human
uaauuauuauuua

SEQ ID NO: 2247560 - RNA, 22 nt, Human
aaugcacuuucuauccucugua

SEQ ID NO: 2247561 - RNA, 13 nt, Human
aaugcaccuggaa

SEQ ID NO: 2247562 - RNA, 11 nt, Human
aaugcacuuuc

SEQ ID NO: 2247563 - RNA, 19 nt, Human
aaugcacguagcugaggcc

SEQ ID NO: 2247564 - RNA, 13 nt, Human
aaugcacuuucua

SEQ ID NO: 2247565 - RNA, 15 nt, Human
aaugcacuuucuauc

SEQ ID NO: 2247566 - RNA, 21 nt, Human
uaauuuauaaaagaauaaaau

SEQ ID NO: 2247567 - RNA, 18 nt, Human
uaauuuuuauauuugaaa

SEQ ID NO: 2247568 - RNA, 19 nt, Human
uaauuuuuauauuugaaau

SEQ ID NO: 2247569 - RNA, 21 nt, Human
uaauuuuuauauuugaaauau

SEQ ID NO: 2247570 - RNA, 15 nt, Human
uaauuuaguuauuga

SEQ ID NO: 2247571 - RNA, 16 nt, Human
uaauuuaguuauugau

SEQ ID NO: 2247572 - RNA, 19 nt, Human
uaauuuaaacaggcccagc

SEQ ID NO: 2247573 - RNA, 14 nt, Human
uaauuuaaacaggc

SEQ ID NO: 2247574 - RNA, 17 nt, Human
uaauuuaaacaggccca

SEQ ID NO: 2247575 - RNA, 20 nt, Human
uaauuuaaacaggcccagca

SEQ ID NO: 2247576 - RNA, 19 nt, Human
uaauuccucaacguauugu

SEQ ID NO: 2247577 - RNA, 11 nt, Human
uaauuuaaaca

SEQ ID NO: 2247578 - RNA, 17 nt, Human
uaauuuaaacaccuccu

SEQ ID NO: 2247579 - RNA, 19 nt, Human
uaauuuaaacaccuccuca

SEQ ID NO: 2247580 - RNA, 20 nt, Human
uaauucccuaucuuuuaguu

SEQ ID NO: 2247581 - RNA, 19 nt, Human
uaauuccuaccucccugca

SEQ ID NO: 2247582 - RNA, 15 nt, Human
uaauucccuaucuuu

SEQ ID NO: 2247583 - RNA, 23 nt, Human
uaauucccauuuugcaaaauuuc

SEQ ID NO: 2247584 - RNA, 21 nt, Human
uaauucccauuuugcaaaauu

SEQ ID NO: 2247585 - RNA, 20 nt, Human
uaauucccauuuugcaaaau

SEQ ID NO: 2247586 - RNA, 20 nt, Human
uaauuuaaaauugugaugug

SEQ ID NO: 2247587 - RNA, 19 nt, Human
uaauuuaaaauugugaugu

SEQ ID NO: 2247588 - RNA, 19 nt, Human
uaauucccauuuugcaaaa

SEQ ID NO: 2247589 - RNA, 18 nt, Human
uaauucccauuuugcaaa

SEQ ID NO: 2247590 - RNA, 17 nt, Human
uaauucccauuuugcaa

SEQ ID NO: 2247591 - RNA, 17 nt, Human
uaauuauuauuuguguu

SEQ ID NO: 2247592 - RNA, 14 nt, Human
uaauuauuauuuau

SEQ ID NO: 2247593 - RNA, 17 nt, Human
uaauuauuauuuauaua

SEQ ID NO: 2247594 - RNA, 22 nt, Human
uaauuauuauuuauauauguau

SEQ ID NO: 2247595 - RNA, 14 nt, Human
uaauuauuauuugu

SEQ ID NO: 2247596 - RNA, 22 nt, Human
uaauuccguagguuauuuucag

SEQ ID NO: 2247597 - RNA, 19 nt, Human
aaugaguuaccuacauuuu

SEQ ID NO: 2247598 - RNA, 19 nt, Human
aaugaggucugaaauggag

SEQ ID NO: 2247599 - RNA, 23 nt, Human
aaugaggugggagguggaagaag

SEQ ID NO: 2247600 - RNA, 21 nt, Human
aaugaguuuuuauggggcuga

SEQ ID NO: 2247601 - RNA, 15 nt, Human
aaugauaaacucucu

SEQ ID NO: 2247602 - RNA, 14 nt, Human
aaugauucaguguu

SEQ ID NO: 2247603 - RNA, 13 nt, Human
aaugauucagugu

SEQ ID NO: 2247604 - RNA, 23 nt, Human
aaugauucaguguuaaaugugau

SEQ ID NO: 2247605 - RNA, 22 nt, Human
aaugauucaguguuaaauguga

SEQ ID NO: 2247606 - RNA, 21 nt, Human
aaugauucaguguuaaaugug

SEQ ID NO: 2247607 - RNA, 13 nt, Human
aaugauuguaaaa

SEQ ID NO: 2247608 - RNA, 14 nt, Human
aaugauuguaaaau

SEQ ID NO: 2247609 - RNA, 20 nt, Human
aaugauuguaaaauagcuug

SEQ ID NO: 2247610 - RNA, 24 nt, Human
aaugauuucagcucacugcaaccu

SEQ ID NO: 2247611 - RNA, 22 nt, Human
aaugauuucaugcuaucucugu

SEQ ID NO: 2247612 - RNA, 13 nt, Human
aaugauuucaugc

SEQ ID NO: 2247613 - RNA, 13 nt, Human
aaugagccuggca

SEQ ID NO: 2247614 - RNA, 12 nt, Human
aaugagccuggc

SEQ ID NO: 2247615 - RNA, 18 nt, Human
aaugaggaggaaggagag

SEQ ID NO: 2247616 - RNA, 12 nt, Human
aaugaggaggaa

SEQ ID NO: 2247617 - RNA, 13 nt, Human
aaugaggcuugcu

SEQ ID NO: 2247618 - RNA, 15 nt, Human
aaugaggcuugcuga

SEQ ID NO: 2247619 - RNA, 18 nt, Human
aaugaggcuugcugagag

SEQ ID NO: 2247620 - RNA, 14 nt, Human
aaugagccuggcaa

SEQ ID NO: 2247621 - RNA, 18 nt, Human
aaugagggccaagaaaga

SEQ ID NO: 2247622 - RNA, 15 nt, Human
aaugaggucagcaug

SEQ ID NO: 2247623 - RNA, 14 nt, Human
aaugagggacugga

SEQ ID NO: 2247624 - RNA, 20 nt, Human
aaugagggacuggaaccagg

SEQ ID NO: 2247625 - RNA, 21 nt, Human
aaugagggacuggaaccaggg

SEQ ID NO: 2247626 - RNA, 16 nt, Human
aaugaggucugaaaug

SEQ ID NO: 2247627 - RNA, 14 nt, Human
aaugagggccaaga

SEQ ID NO: 2247628 - RNA, 16 nt, Human
aaugaggucccaggca

SEQ ID NO: 2247629 - RNA, 15 nt, Human
aaugaggucccaggc

SEQ ID NO: 2247630 - RNA, 19 nt, Human
aaugaggucagcaugucua

SEQ ID NO: 2247631 - RNA, 16 nt, Human
aaugaggucagagccu

SEQ ID NO: 2247632 - RNA, 18 nt, Human
aaugaggucagagccugc

SEQ ID NO: 2247633 - RNA, 14 nt, Human
aaugagaaccaaca

SEQ ID NO: 2247634 - RNA, 17 nt, Human
aaugagaaggaauuuga

SEQ ID NO: 2247635 - RNA, 15 nt, Human
aaugagaaggcagcc

SEQ ID NO: 2247636 - RNA, 22 nt, Human
aaugagagacacacugaagaag

SEQ ID NO: 2247637 - RNA, 12 nt, Human
aaugagaaaucu

SEQ ID NO: 2247638 - RNA, 22 nt, Human
aaugagaaaucuaaaaaacgaa

SEQ ID NO: 2247639 - RNA, 17 nt, Human
aaugagaucaggcucug

SEQ ID NO: 2247640 - RNA, 17 nt, Human
aaugagaucccgccucu

SEQ ID NO: 2247641 - RNA, 19 nt, Human
aaugagagggcaguguuuc

SEQ ID NO: 2247642 - RNA, 17 nt, Human
aaugagagguuccuaag

SEQ ID NO: 2247643 - RNA, 16 nt, Human
aaugagauaguagcau

SEQ ID NO: 2247644 - RNA, 23 nt, Human
aaugagagggcaguguuuccuuu

SEQ ID NO: 2247645 - RNA, 16 nt, Human
aaugagaucaggcucu

SEQ ID NO: 2247646 - RNA, 11 nt, Human
aaugagccugg

SEQ ID NO: 2247647 - RNA, 21 nt, Human
aaugagccuacgcugaagaug

SEQ ID NO: 2247648 - RNA, 24 nt, Human
aaugacuaaaaauauuauaacuua

SEQ ID NO: 2247649 - RNA, 17 nt, Human
aaugacuaaaaauauua

SEQ ID NO: 2247650 - RNA, 20 nt, Human
aaugacuaaaaaacaaagaa

SEQ ID NO: 2247651 - RNA, 17 nt, Human
aaugacuaaaaaacaaa

SEQ ID NO: 2247652 - RNA, 20 nt, Human
aaucuguaucuguagugaga

SEQ ID NO: 2247653 - RNA, 20 nt, Human
aaugacucagaauauugcuu

SEQ ID NO: 2247654 - RNA, 13 nt, Human
aaucuguacaaug

SEQ ID NO: 2247655 - RNA, 23 nt, Human
aaucuguaaacuguguauuccaa

SEQ ID NO: 2247656 - RNA, 15 nt, Human
aaucuguagggcugg

SEQ ID NO: 2247657 - RNA, 21 nt, Human
aaucuguaaacuguguauucc

SEQ ID NO: 2247658 - RNA, 16 nt, Human
aaucuguaaacugugu

SEQ ID NO: 2247659 - RNA, 15 nt, Human
aaucuguaaacugug

SEQ ID NO: 2247660 - RNA, 14 nt, Human
aaucuguaaacugu

SEQ ID NO: 2247661 - RNA, 21 nt, Human
aaugaccuuucaauaggaaaa

SEQ ID NO: 2247662 - RNA, 20 nt, Human
aaugaccuuucaauaggaaa

SEQ ID NO: 2247663 - RNA, 16 nt, Human
aaucuguagggcugga

SEQ ID NO: 2247664 - RNA, 19 nt, Human
aaucuguagggcuggaccu

SEQ ID NO: 2247665 - RNA, 22 nt, Human
aaucuguagggcuggaccuaug

SEQ ID NO: 2247666 - RNA, 15 nt, Human
aaucccagcacuuug

SEQ ID NO: 2247667 - RNA, 18 nt, Human
aaucccacccacauguga

SEQ ID NO: 2247668 - RNA, 17 nt, Human
aaucccacccacaugug

SEQ ID NO: 2247669 - RNA, 20 nt, Human
aaucccaagaucugugcagc

SEQ ID NO: 2247670 - RNA, 18 nt, Human
aaucccagcuacucagga

SEQ ID NO: 2247671 - RNA, 20 nt, Human
aaucccagcacuuugggagg

SEQ ID NO: 2247672 - RNA, 12 nt, Human
aaucccaggaug

SEQ ID NO: 2247673 - RNA, 17 nt, Human
aaucccauuuaaaaaaa

SEQ ID NO: 2247674 - RNA, 13 nt, Human
uaauaaaaaggca

SEQ ID NO: 2247675 - RNA, 18 nt, Human
aaucauaaacugugugca

SEQ ID NO: 2247676 - RNA, 17 nt, Human
aaucauaaacugugugc

SEQ ID NO: 2247677 - RNA, 21 nt, Human
aaucccaaauuugauugauuu

SEQ ID NO: 2247678 - RNA, 20 nt, Human
aaucauaagauauuuuucau

SEQ ID NO: 2247679 - RNA, 17 nt, Human
aaucagugugucuaaau

SEQ ID NO: 2247680 - RNA, 18 nt, Human
aaucagugugucuaaauu

SEQ ID NO: 2247681 - RNA, 22 nt, Human
aaucagugugucuaaauuugaa

SEQ ID NO: 2247682 - RNA, 19 nt, Human
aauccccucauucaggaaa

SEQ ID NO: 2247683 - RNA, 14 nt, Human
aauccccucauuca

SEQ ID NO: 2247684 - RNA, 21 nt, Human
aauccccucccugucaaagcu

SEQ ID NO: 2247685 - RNA, 11 nt, Human
aauccccuccu

SEQ ID NO: 2247686 - RNA, 15 nt, Human
aaucccccuugccac

SEQ ID NO: 2247687 - RNA, 18 nt, Human
aaucccccuugccacccc

SEQ ID NO: 2247688 - RNA, 18 nt, Human
aauccccuccuugggcac

SEQ ID NO: 2247689 - RNA, 18 nt, Human
aauccccuucucaucacu

SEQ ID NO: 2247690 - RNA, 12 nt, Human
aauccccuccuu

SEQ ID NO: 2247691 - RNA, 17 nt, Human
aauccccuccuugggca

SEQ ID NO: 2247692 - RNA, 19 nt, Human
aauccccuccuugggcacu

SEQ ID NO: 2247693 - RNA, 20 nt, Human
aaucccauucauaacuuuca

SEQ ID NO: 2247694 - RNA, 18 nt, Human
aaucccauucauaacuuu

SEQ ID NO: 2247695 - RNA, 15 nt, Human
aauccccaguaaaau

SEQ ID NO: 2247696 - RNA, 16 nt, Human
aauccccaguaaaauu

SEQ ID NO: 2247697 - RNA, 17 nt, Human
aauccccaguaaaauug

SEQ ID NO: 2247698 - RNA, 21 nt, Human
aauccccaguaaaauugccau

SEQ ID NO: 2247699 - RNA, 21 nt, Human
aaucccugggcauugcuuucc

SEQ ID NO: 2247700 - RNA, 23 nt, Human
aaucccugguuuuaaguaucaau

SEQ ID NO: 2247701 - RNA, 19 nt, Human
aaucccugggcauugcuuu

SEQ ID NO: 2247702 - RNA, 17 nt, Human
aaucccugggcauugcu

SEQ ID NO: 2247703 - RNA, 13 nt, Human
aaucccuguuuaa

SEQ ID NO: 2247704 - RNA, 20 nt, Human
aauccucaguuuuugugaaa

SEQ ID NO: 2247705 - RNA, 16 nt, Human
aaucccgauucacccu

SEQ ID NO: 2247706 - RNA, 17 nt, Human
aaucccgccaccuaucu

SEQ ID NO: 2247707 - RNA, 14 nt, Human
aaucccuggcaaag

SEQ ID NO: 2247708 - RNA, 12 nt, Human
aaucuauuuaag

SEQ ID NO: 2247709 - RNA, 12 nt, Human
aaucuauuucua

SEQ ID NO: 2247710 - RNA, 14 nt, Human
aaucuauuuuguaa

SEQ ID NO: 2247711 - RNA, 17 nt, Human
aaucuauuuuguaacuu

SEQ ID NO: 2247712 - RNA, 13 nt, Human
aaucucaaauaac

SEQ ID NO: 2247713 - RNA, 18 nt, Human
aaucugggccagaauuuc

SEQ ID NO: 2247714 - RNA, 12 nt, Human
aaucuguaaacu

SEQ ID NO: 2247715 - RNA, 11 nt, Human
aaucuguaaac

SEQ ID NO: 2247716 - RNA, 11 nt, Human
aaucuauuuaa

SEQ ID NO: 2247717 - RNA, 19 nt, Human
aaucuauuggguucauuau

SEQ ID NO: 2247718 - RNA, 18 nt, Human
aaucuauuggguucauua

SEQ ID NO: 2247719 - RNA, 17 nt, Human
aaucuauuggguucauu

SEQ ID NO: 2247720 - RNA, 16 nt, Human
aaucuauuggguucau

SEQ ID NO: 2247721 - RNA, 15 nt, Human
aaucuauuggguuca

SEQ ID NO: 2247722 - RNA, 16 nt, Human
aaucuauuauacugua

SEQ ID NO: 2247723 - RNA, 17 nt, Human
aaucuauuauacuguau

SEQ ID NO: 2247724 - RNA, 18 nt, Human
aaucuauuauacuguauu

SEQ ID NO: 2247725 - RNA, 12 nt, Human
aaucuauucaga

SEQ ID NO: 2247726 - RNA, 13 nt, Human
aaucuauucagac

SEQ ID NO: 2247727 - RNA, 18 nt, Human
aaucuauucagacaagca

SEQ ID NO: 2247728 - RNA, 19 nt, Human
aaucuauucagacaagcaa

SEQ ID NO: 2247729 - RNA, 18 nt, Human
aaucuaugauuccaggug

SEQ ID NO: 2247730 - RNA, 15 nt, Human
aaucuaugauuccag

SEQ ID NO: 2247731 - RNA, 21 nt, Human
aaucuauggucgggagacagc

SEQ ID NO: 2247732 - RNA, 22 nt, Human
aaucuauuaauagcugccuuaa

SEQ ID NO: 2247733 - RNA, 12 nt, Human
aaucuauuauac

SEQ ID NO: 2247734 - RNA, 16 nt, Human
aaucuaugccaaagau

SEQ ID NO: 2247735 - RNA, 17 nt, Human
aaucuaugccaaagauc

SEQ ID NO: 2247736 - RNA, 18 nt, Human
aaucuaugccaaagauca

SEQ ID NO: 2247737 - RNA, 20 nt, Human
aaucuaugccaaagaucacu

SEQ ID NO: 2247738 - RNA, 14 nt, Human
aaucuaaaagcuuu

SEQ ID NO: 2247739 - RNA, 14 nt, Human
aaucuaaagccagu

SEQ ID NO: 2247740 - RNA, 18 nt, Human
aaucguuauguguguaua

SEQ ID NO: 2247741 - RNA, 17 nt, Human
aaucguuauguguguau

SEQ ID NO: 2247742 - RNA, 16 nt, Human
aaucguuaugugugua

SEQ ID NO: 2247743 - RNA, 15 nt, Human
aaucguuaugugugu

SEQ ID NO: 2247744 - RNA, 23 nt, Human
aaucggaucuggggcucugggau

SEQ ID NO: 2247745 - RNA, 18 nt, Human
aaucggcccacagcuccc

SEQ ID NO: 2247746 - RNA, 22 nt, Human
aaucggcccacagcucccaccc

SEQ ID NO: 2247747 - RNA, 15 nt, Human
aaucgguuuaaacau

SEQ ID NO: 2247748 - RNA, 20 nt, Human
aaucuaucugcuuaugcagu

SEQ ID NO: 2247749 - RNA, 14 nt, Human
aaucuaugaaguau

SEQ ID NO: 2247750 - RNA, 17 nt, Human
aaucuaugaaguauaua

SEQ ID NO: 2247751 - RNA, 19 nt, Human
aaucuaugaaguauauaau

SEQ ID NO: 2247752 - RNA, 20 nt, Human
aaucuaugaaguauauaaug

SEQ ID NO: 2247753 - RNA, 21 nt, Human
aaucggaucuggggcucuggg

SEQ ID NO: 2247754 - RNA, 22 nt, Human
aaucggaucuggggcucuggga

SEQ ID NO: 2247755 - RNA, 14 nt, Human
aaucgcuuaaagau

SEQ ID NO: 2247756 - RNA, 21 nt, Human
aaucgcuuaaagauguuccua

SEQ ID NO: 2247757 - RNA, 12 nt, Human
aaucgcuucucu

SEQ ID NO: 2247758 - RNA, 23 nt, Human
aaucgcuucucuuuugaaacaau

SEQ ID NO: 2247759 - RNA, 20 nt, Human
aauccucuuccucugaggcu

SEQ ID NO: 2247760 - RNA, 18 nt, Human
aauccucuuccucugagg

SEQ ID NO: 2247761 - RNA, 10 nt, Human
aauccugccc

SEQ ID NO: 2247762 - RNA, 12 nt, Human
aauccugccccc

SEQ ID NO: 2247763 - RNA, 11 nt, Human
aauccugcccc

SEQ ID NO: 2247764 - RNA, 11 nt, Human
aauccucuggc

SEQ ID NO: 2247765 - RNA, 18 nt, Human
aauccucucucuguguua

SEQ ID NO: 2247766 - RNA, 13 nt, Human
aauccucuuccuc

SEQ ID NO: 2247767 - RNA, 14 nt, Human
aauccucuuccucu

SEQ ID NO: 2247768 - RNA, 15 nt, Human
aauccucuuccucug

SEQ ID NO: 2247769 - RNA, 17 nt, Human
aauccucuuccucugag

SEQ ID NO: 2247770 - RNA, 14 nt, Human
aaucccuguuuaau

SEQ ID NO: 2247771 - RNA, 21 nt, Human
aauccucucaaccaccuuuca

SEQ ID NO: 2247772 - RNA, 22 nt, Human
uaaguuucaggugacaugugaa

SEQ ID NO: 2247773 - RNA, 17 nt, Human
uaaguuucaguugauuu

SEQ ID NO: 2247774 - RNA, 14 nt, Human
uaaguuauaguaua

SEQ ID NO: 2247775 - RNA, 18 nt, Human
uaaguuuaugucuaaaga

SEQ ID NO: 2247776 - RNA, 17 nt, Human
uaaguuuauuucuuaaa

SEQ ID NO: 2247777 - RNA, 20 nt, Human
uaaguuuaugucuaaagagc

SEQ ID NO: 2247778 - RNA, 16 nt, Human
uaaguuucaggugaca

SEQ ID NO: 2247779 - RNA, 17 nt, Human
uaaguuucaggugacau

SEQ ID NO: 2247780 - RNA, 18 nt, Human
uaaguuucaggugacaug

SEQ ID NO: 2247781 - RNA, 19 nt, Human
uaaguuucaggugacaugu

SEQ ID NO: 2247782 - RNA, 20 nt, Human
uaaguuucaggugacaugug

SEQ ID NO: 2247783 - RNA, 14 nt, Human
uaauaaaaaggcac

SEQ ID NO: 2247784 - RNA, 16 nt, Human
uaauaaaaagauugaa

SEQ ID NO: 2247785 - RNA, 13 nt, Human
uaauaaaaagauu

SEQ ID NO: 2247786 - RNA, 21 nt, Human
uaauaaaaaauggaaagaauc

SEQ ID NO: 2247787 - RNA, 14 nt, Human
uaauaaaaaaugga

SEQ ID NO: 2247788 - RNA, 15 nt, Human
uaauaaaaaauggaa

SEQ ID NO: 2247789 - RNA, 19 nt, Human
uaauaaaaaauggaaagaa

SEQ ID NO: 2247790 - RNA, 20 nt, Human
uaauaaaaaauggaaagaau

SEQ ID NO: 2247791 - RNA, 13 nt, Human
uaaguuucucagc

SEQ ID NO: 2247792 - RNA, 14 nt, Human
uaaguuucucagcu

SEQ ID NO: 2247793 - RNA, 21 nt, Human
uaaguuacacauuuuucagau

SEQ ID NO: 2247794 - RNA, 14 nt, Human
uaagugugugugug

SEQ ID NO: 2247795 - RNA, 14 nt, Human
uaaguuacuucacu

SEQ ID NO: 2247796 - RNA, 14 nt, Human
uaaguguuguaaau

SEQ ID NO: 2247797 - RNA, 21 nt, Human
uaagugugaguaagagcuggu

SEQ ID NO: 2247798 - RNA, 19 nt, Human
uaagugugaguaagagcug

SEQ ID NO: 2247799 - RNA, 23 nt, Human
uaaguauuuauauauuuauaacu

SEQ ID NO: 2247800 - RNA, 13 nt, Human
uaaguauuucaaa

SEQ ID NO: 2247801 - RNA, 17 nt, Human
uaaguguguguuuuuca

SEQ ID NO: 2247802 - RNA, 19 nt, Human
uaaguauuuauauauuuau

SEQ ID NO: 2247803 - RNA, 18 nt, Human
uaaguauuuauauauuua

SEQ ID NO: 2247804 - RNA, 17 nt, Human
uaaguauuuauauauuu

SEQ ID NO: 2247805 - RNA, 15 nt, Human
uaaguauuuauauau

SEQ ID NO: 2247806 - RNA, 14 nt, Human
uaaguauuuauaua

SEQ ID NO: 2247807 - RNA, 13 nt, Human
uaaguauuuauau

SEQ ID NO: 2247808 - RNA, 20 nt, Human
uaaguauuuagguuuuuguu

SEQ ID NO: 2247809 - RNA, 20 nt, Human
uaaguauugcaucuguauaa

SEQ ID NO: 2247810 - RNA, 18 nt, Human
uaaguaccacucaggcca

SEQ ID NO: 2247811 - RNA, 11 nt, Human
uaaguauugca

SEQ ID NO: 2247812 - RNA, 17 nt, Human
uaaguauugcaucugua

SEQ ID NO: 2247813 - RNA, 12 nt, Human
uaaguauuuagg

SEQ ID NO: 2247814 - RNA, 18 nt, Human
uaaguauugcaucuguau

SEQ ID NO: 2247815 - RNA, 19 nt, Human
uaaguauugcaucuguaua

SEQ ID NO: 2247816 - RNA, 21 nt, Human
uaaguauucuuauuuaaugaa

SEQ ID NO: 2247817 - RNA, 17 nt, Human
uaaguaccacucaggcc

SEQ ID NO: 2247818 - RNA, 21 nt, Human
uaaguaauuaucgggaacagu

SEQ ID NO: 2247819 - RNA, 16 nt, Human
uaaguaauucaagaaa

SEQ ID NO: 2247820 - RNA, 23 nt, Human
uaaguaauuaucgggaacagugu

SEQ ID NO: 2247821 - RNA, 16 nt, Human
uaagguucucauagga

SEQ ID NO: 2247822 - RNA, 19 nt, Human
uaagguuucguuucuguau

SEQ ID NO: 2247823 - RNA, 20 nt, Human
uaagguuucguuucuguaua

SEQ ID NO: 2247824 - RNA, 22 nt, Human
uaagguuucguuucuguauaca

SEQ ID NO: 2247825 - RNA, 20 nt, Human
uaaguaaugauaacuggaaa

SEQ ID NO: 2247826 - RNA, 19 nt, Human
uaaguaaaaccacagcagu

SEQ ID NO: 2247827 - RNA, 18 nt, Human
uaaguaaaaccacagcag

SEQ ID NO: 2247828 - RNA, 17 nt, Human
uaaguaaaaccacagca

SEQ ID NO: 2247829 - RNA, 16 nt, Human
uaaguaaaaccacagc

SEQ ID NO: 2247830 - RNA, 17 nt, Human
uaaggauacuuuacaug

SEQ ID NO: 2247831 - RNA, 19 nt, Human
uaaggaucagaacagcaga

SEQ ID NO: 2247832 - RNA, 20 nt, Human
uaaggaguaaucuguguaca

SEQ ID NO: 2247833 - RNA, 19 nt, Human
uaaggaguaaucuguguac

SEQ ID NO: 2247834 - RNA, 16 nt, Human
uaaggagaugggccuu

SEQ ID NO: 2247835 - RNA, 19 nt, Human
uaaggagaaaucuauagaa

SEQ ID NO: 2247836 - RNA, 21 nt, Human
uaagguuauuuauuuaaaugu

SEQ ID NO: 2247837 - RNA, 16 nt, Human
uaaggaucucucagga

SEQ ID NO: 2247838 - RNA, 17 nt, Human
uaaggaugcuaaaccuu

SEQ ID NO: 2247839 - RNA, 18 nt, Human
uaagguuaccuuuguucc

SEQ ID NO: 2247840 - RNA, 15 nt, Human
uaaguaaaaccacag

SEQ ID NO: 2247841 - RNA, 13 nt, Human
uaaguaaaaccac

SEQ ID NO: 2247842 - RNA, 15 nt, Human
uaagacguguuugug

SEQ ID NO: 2247843 - RNA, 14 nt, Human
uaagacgacaagga

SEQ ID NO: 2247844 - RNA, 16 nt, Human
uaagacuguaaugaau

SEQ ID NO: 2247845 - RNA, 22 nt, Human
uaagacuccucggccuggcucc

SEQ ID NO: 2247846 - RNA, 23 nt, Human
uaagacuccucggccuggcuccu

SEQ ID NO: 2247847 - RNA, 18 nt, Human
uaagacucauucccuaga

SEQ ID NO: 2247848 - RNA, 13 nt, Human
uaagacuccucgg

SEQ ID NO: 2247849 - RNA, 18 nt, Human
aauauuuauauuucacua

SEQ ID NO: 2247850 - RNA, 17 nt, Human
aauauuuauauuucacu

SEQ ID NO: 2247851 - RNA, 14 nt, Human
aauauuuauauuuc

SEQ ID NO: 2247852 - RNA, 17 nt, Human
aauauuuauauauuuau

SEQ ID NO: 2247853 - RNA, 14 nt, Human
aauauuuauauauu

SEQ ID NO: 2247854 - RNA, 15 nt, Human
uaagacuguguauuc

SEQ ID NO: 2247855 - RNA, 19 nt, Human
uaagacuguaaugaaucua

SEQ ID NO: 2247856 - RNA, 15 nt, Human
aauauuuauagguca

SEQ ID NO: 2247857 - RNA, 12 nt, Human
aauauuuauuac

SEQ ID NO: 2247858 - RNA, 13 nt, Human
aauauuuauuacc

SEQ ID NO: 2247859 - RNA, 14 nt, Human
aauauuuauuaccu

SEQ ID NO: 2247860 - RNA, 15 nt, Human
aauauuuauuaccuc

SEQ ID NO: 2247861 - RNA, 16 nt, Human
aauauuuauuaccucu

SEQ ID NO: 2247862 - RNA, 17 nt, Human
aauauuuauuaccucug

SEQ ID NO: 2247863 - RNA, 18 nt, Human
aauauuuauuaccucuga

SEQ ID NO: 2247864 - RNA, 12 nt, Human
aauauuuauuau

SEQ ID NO: 2247865 - RNA, 15 nt, Human
aauauuuauguaaac

SEQ ID NO: 2247866 - RNA, 19 nt, Human
aauauuuaugucuauuuaa

SEQ ID NO: 2247867 - RNA, 21 nt, Human
aauauuuaugucuauuuaagc

SEQ ID NO: 2247868 - RNA, 23 nt, Human
aauauuuaugucuauuuaagccu

SEQ ID NO: 2247869 - RNA, 15 nt, Human
aaucacguaaagcua

SEQ ID NO: 2247870 - RNA, 17 nt, Human
aaucacuaaaaaugauc

SEQ ID NO: 2247871 - RNA, 21 nt, Human
aaucacguaaagcuagaaaug

SEQ ID NO: 2247872 - RNA, 20 nt, Human
aaucacguaaagcuagaaau

SEQ ID NO: 2247873 - RNA, 20 nt, Human
aauauuuugaaucaauaaua

SEQ ID NO: 2247874 - RNA, 21 nt, Human
aauauuuucuuuaaugcuuuu

SEQ ID NO: 2247875 - RNA, 19 nt, Human
aauauuuucuuuaaugcuu

SEQ ID NO: 2247876 - RNA, 13 nt, Human
aauauuuugaauc

SEQ ID NO: 2247877 - RNA, 14 nt, Human
aauauuuugaauca

SEQ ID NO: 2247878 - RNA, 15 nt, Human
aauauuuugaaucaa

SEQ ID NO: 2247879 - RNA, 16 nt, Human
aauauuuugaaucaau

SEQ ID NO: 2247880 - RNA, 18 nt, Human
aauauuuugaaucaauaa

SEQ ID NO: 2247881 - RNA, 22 nt, Human
aauauuuugaaucaauaauaua

SEQ ID NO: 2247882 - RNA, 11 nt, Human
aauauuuauuu

SEQ ID NO: 2247883 - RNA, 21 nt, Human
aauauuuauugcuuuauaaau

SEQ ID NO: 2247884 - RNA, 23 nt, Human
aauauuuauugcuuuauaaauaa

SEQ ID NO: 2247885 - RNA, 14 nt, Human
aauauuuauugcuu

SEQ ID NO: 2247886 - RNA, 15 nt, Human
aauauuuauugcuuu

SEQ ID NO: 2247887 - RNA, 16 nt, Human
aauauuuauugcuuua

SEQ ID NO: 2247888 - RNA, 17 nt, Human
aauauuuauugcuuuau

SEQ ID NO: 2247889 - RNA, 19 nt, Human
aauauuuauuauuuucacc

SEQ ID NO: 2247890 - RNA, 20 nt, Human
aauauuuauuauuuucaccu

SEQ ID NO: 2247891 - RNA, 13 nt, Human
aauauuuauugcu

SEQ ID NO: 2247892 - RNA, 12 nt, Human
aauauuuauugc

SEQ ID NO: 2247893 - RNA, 18 nt, Human
aauauuuucuuuaaugcu

SEQ ID NO: 2247894 - RNA, 13 nt, Human
aauauuuauuuau

SEQ ID NO: 2247895 - RNA, 15 nt, Human
aauauuuucuggguu

SEQ ID NO: 2247896 - RNA, 15 nt, Human
aauauuuauuuuaau

SEQ ID NO: 2247897 - RNA, 16 nt, Human
aaucagccucuuaaag

SEQ ID NO: 2247898 - RNA, 12 nt, Human
aaucagccucuu

SEQ ID NO: 2247899 - RNA, 23 nt, Human
aaucagccuaggggucagggacc

SEQ ID NO: 2247900 - RNA, 21 nt, Human
aaucagccaauuauguuaaac

SEQ ID NO: 2247901 - RNA, 11 nt, Human
aaucagccugc

SEQ ID NO: 2247902 - RNA, 14 nt, Human
aaucagccaauuau

SEQ ID NO: 2247903 - RNA, 18 nt, Human
aaucagccaauuauguua

SEQ ID NO: 2247904 - RNA, 19 nt, Human
aaucagccaauuauguuaa

SEQ ID NO: 2247905 - RNA, 20 nt, Human
aaucagccaauuauguuaaa

SEQ ID NO: 2247906 - RNA, 16 nt, Human
aaucagccuaguugau

SEQ ID NO: 2247907 - RNA, 18 nt, Human
aaucagcauucucacucc

SEQ ID NO: 2247908 - RNA, 19 nt, Human
aaucagcauucucacuccu

SEQ ID NO: 2247909 - RNA, 12 nt, Human
aaucagcauucu

SEQ ID NO: 2247910 - RNA, 18 nt, Human
aaucacucuguccuugga

SEQ ID NO: 2247911 - RNA, 22 nt, Human
aaucacucuuguggauguuuua

SEQ ID NO: 2247912 - RNA, 12 nt, Human
aaucacucuugu

SEQ ID NO: 2247913 - RNA, 16 nt, Human
aaucacucuuguggau

SEQ ID NO: 2247914 - RNA, 18 nt, Human
aaucacucuuguggaugu

SEQ ID NO: 2247915 - RNA, 18 nt, Human
aaucagccugcuccagcu

SEQ ID NO: 2247916 - RNA, 13 nt, Human
aaucagccugcuc

SEQ ID NO: 2247917 - RNA, 19 nt, Human
aaucagccugcuccagcug

SEQ ID NO: 2247918 - RNA, 23 nt, Human
aaucagcuauuuacugccaaagg

SEQ ID NO: 2247919 - RNA, 20 nt, Human
aaucagcuccuuccuggaga

SEQ ID NO: 2247920 - RNA, 21 nt, Human
aaucaguaauauuuauauauu

SEQ ID NO: 2247921 - RNA, 15 nt, Human
aaucaguauaaacaa

SEQ ID NO: 2247922 - RNA, 14 nt, Human
aaucaguauaaaca

SEQ ID NO: 2247923 - RNA, 17 nt, Human
aaucaguauaaacaaag

SEQ ID NO: 2247924 - RNA, 14 nt, Human
aaucaguauaauuc

SEQ ID NO: 2247925 - RNA, 17 nt, Human
aaucaguauaauucugu

SEQ ID NO: 2247926 - RNA, 11 nt, Human
aaucaguauau

SEQ ID NO: 2247927 - RNA, 19 nt, Human
aaucagucagugcaaaugu

SEQ ID NO: 2247928 - RNA, 21 nt, Human
aaucagucagugcaaauguca

SEQ ID NO: 2247929 - RNA, 13 nt, Human
aaucaguccccuc

SEQ ID NO: 2247930 - RNA, 14 nt, Human
aaucaguccccucc

SEQ ID NO: 2247931 - RNA, 19 nt, Human
aaucagggaggucauuuug

SEQ ID NO: 2247932 - RNA, 18 nt, Human
aaucagggaggucauuuu

SEQ ID NO: 2247933 - RNA, 20 nt, Human
aaucaggaauauuuuccaaa

SEQ ID NO: 2247934 - RNA, 18 nt, Human
aaucaggaauauuuucca

SEQ ID NO: 2247935 - RNA, 20 nt, Human
uaagcucaaggcgugaggau

SEQ ID NO: 2247936 - RNA, 12 nt, Human
uaagcucagaau

SEQ ID NO: 2247937 - RNA, 21 nt, Human
uaagcuauucaguaauaacuc

SEQ ID NO: 2247938 - RNA, 21 nt, Human
uaagcagauuuaacaauucca

SEQ ID NO: 2247939 - RNA, 16 nt, Human
uaagauuaucugggga

SEQ ID NO: 2247940 - RNA, 18 nt, Human
uaagcagcauuucugaag

SEQ ID NO: 2247941 - RNA, 19 nt, Human
uaagcagcauuucugaagu

SEQ ID NO: 2247942 - RNA, 23 nt, Human
uaagcagcauuucugaaguggac

SEQ ID NO: 2247943 - RNA, 21 nt, Human
uaagcagcauuucugaagugg

SEQ ID NO: 2247944 - RNA, 12 nt, Human
uaagcagcucuu

SEQ ID NO: 2247945 - RNA, 18 nt, Human
uaagcagcucuugcuaau

SEQ ID NO: 2247946 - RNA, 17 nt, Human
uaagcagcucuugcuaa

SEQ ID NO: 2247947 - RNA, 15 nt, Human
uaagcaggaggaggu

SEQ ID NO: 2247948 - RNA, 18 nt, Human
uaagcaggaggaggugcc

SEQ ID NO: 2247949 - RNA, 23 nt, Human
uaagcaggaggaggugccaacag

SEQ ID NO: 2247950 - RNA, 14 nt, Human
uaagauucauauuu

SEQ ID NO: 2247951 - RNA, 14 nt, Human
uaagcaaaauguga

SEQ ID NO: 2247952 - RNA, 21 nt, Human
uaagcaaaaugugauauguac

SEQ ID NO: 2247953 - RNA, 15 nt, Human
uaagcaaaaugugau

SEQ ID NO: 2247954 - RNA, 14 nt, Human
aaucagugugucua

SEQ ID NO: 2247955 - RNA, 17 nt, Human
aaucagucuauccacag

SEQ ID NO: 2247956 - RNA, 20 nt, Human
aaucagucuauccacagaga

SEQ ID NO: 2247957 - RNA, 15 nt, Human
aaucaguccccuccc

SEQ ID NO: 2247958 - RNA, 16 nt, Human
aaucaguccccuccca

SEQ ID NO: 2247959 - RNA, 17 nt, Human
aaucaguccccucccau

SEQ ID NO: 2247960 - RNA, 18 nt, Human
aaucaguccccucccauc

SEQ ID NO: 2247961 - RNA, 13 nt, Human
uaagauuagaaug

SEQ ID NO: 2247962 - RNA, 15 nt, Human
uaagauuagaaugaa

SEQ ID NO: 2247963 - RNA, 18 nt, Human
uaagauuagaaugaaaau

SEQ ID NO: 2247964 - RNA, 13 nt, Human
uaagcucuggcuu

SEQ ID NO: 2247965 - RNA, 15 nt, Human
uaagcucagaaucca

SEQ ID NO: 2247966 - RNA, 14 nt, Human
uaaggaaacugggu

SEQ ID NO: 2247967 - RNA, 12 nt, Human
uaaggaaacugg

SEQ ID NO: 2247968 - RNA, 10 nt, Human
uaaggaaacu

SEQ ID NO: 2247969 - RNA, 15 nt, Human
uaaggaaacucuuau

SEQ ID NO: 2247970 - RNA, 17 nt, Human
uaaggaaacucuuaucu

SEQ ID NO: 2247971 - RNA, 19 nt, Human
uaaggaaacucuuaucuca

SEQ ID NO: 2247972 - RNA, 13 nt, Human
uaagcugaaaaua

SEQ ID NO: 2247973 - RNA, 11 nt, Human
uaaggaaacaa

SEQ ID NO: 2247974 - RNA, 13 nt, Human
uaaggaagacaau

SEQ ID NO: 2247975 - RNA, 9 nt, Human
uaaggaaua

SEQ ID NO: 2247976 - RNA, 21 nt, Human
uaaggaaagcaauaaaugaau

SEQ ID NO: 2247977 - RNA, 18 nt, Human
uaaggaaagcaauaaaug

SEQ ID NO: 2247978 - RNA, 16 nt, Human
uaaggaaagcaauaaa

SEQ ID NO: 2247979 - RNA, 19 nt, Human
uaaggaaacuggguuccug

SEQ ID NO: 2247980 - RNA, 20 nt, Human
uaaggaaacucuuaucucag

SEQ ID NO: 2247981 - RNA, 19 nt, Human
uaaggaauguagcugguuu

SEQ ID NO: 2247982 - RNA, 18 nt, Human
uaaggacaaaaaugaacu

SEQ ID NO: 2247983 - RNA, 20 nt, Human
uaaggaauaugggagaaaua

SEQ ID NO: 2247984 - RNA, 14 nt, Human
uaaggaauauggga

SEQ ID NO: 2247985 - RNA, 22 nt, Human
uaaggaauuuuauuuuuuucug

SEQ ID NO: 2247986 - RNA, 17 nt, Human
uaaggaauaccuguccc

SEQ ID NO: 2247987 - RNA, 18 nt, Human
uaaggaauaccugucccc

SEQ ID NO: 2247988 - RNA, 18 nt, Human
uaaggacauuucccaggg

SEQ ID NO: 2247989 - RNA, 14 nt, Human
uaaggacacacuaa

SEQ ID NO: 2247990 - RNA, 15 nt, Human
uaaggacacacuaau

SEQ ID NO: 2247991 - RNA, 15 nt, Human
uaacuuagcaugugu

SEQ ID NO: 2247992 - RNA, 17 nt, Human
uaacuuauauuguaaga

SEQ ID NO: 2247993 - RNA, 23 nt, Human
uaacuuauaucaucagcauaccu

SEQ ID NO: 2247994 - RNA, 21 nt, Human
uaacuuauauuguaagaaaua

SEQ ID NO: 2247995 - RNA, 20 nt, Human
uaacuuauauuguaagaaau

SEQ ID NO: 2247996 - RNA, 19 nt, Human
uaacuuauauuguaagaaa

SEQ ID NO: 2247997 - RNA, 18 nt, Human
uaacuuauauuguaagaa

SEQ ID NO: 2247998 - RNA, 15 nt, Human
uaacuagcuuggaaa

SEQ ID NO: 2247999 - RNA, 15 nt, Human
uaacuaggcucagag

SEQ ID NO: 2248000 - RNA, 17 nt, Human
uaacuaguccuuuacua

SEQ ID NO: 2248001 - RNA, 15 nt, Human
uaacuagcaccaggg

SEQ ID NO: 2248002 - RNA, 16 nt, Human
uaacuaggcucagaga

SEQ ID NO: 2248003 - RNA, 17 nt, Human
uaacuaguguugcuugg

SEQ ID NO: 2248004 - RNA, 23 nt, Human
uaacuauaguccagcuuuguucu

SEQ ID NO: 2248005 - RNA, 18 nt, Human
uaacuauauuugcuuuuu

SEQ ID NO: 2248006 - RNA, 19 nt, Human
uaacuaggcucagagaugu

SEQ ID NO: 2248007 - RNA, 17 nt, Human
uaacuauauuugcuuuu

SEQ ID NO: 2248008 - RNA, 17 nt, Human
uaacuuacccuuaggga

SEQ ID NO: 2248009 - RNA, 18 nt, Human
uaacuuacccuuagggag

SEQ ID NO: 2248010 - RNA, 15 nt, Human
uaacuuaauugcuau

SEQ ID NO: 2248011 - RNA, 15 nt, Human
uaacguaaauacaca

SEQ ID NO: 2248012 - RNA, 18 nt, Human
uaacggcuccaggauuuu

SEQ ID NO: 2248013 - RNA, 13 nt, Human
uaacggcuccagg

SEQ ID NO: 2248014 - RNA, 15 nt, Human
uaacggcuccaggau

SEQ ID NO: 2248015 - RNA, 16 nt, Human
uaacguugagccccug

SEQ ID NO: 2248016 - RNA, 22 nt, Human
uaacguuagaccacaaauagug

SEQ ID NO: 2248017 - RNA, 14 nt, Human
uaacguugcugugg

SEQ ID NO: 2248018 - RNA, 16 nt, Human
uaacguugcuguggga

SEQ ID NO: 2248019 - RNA, 17 nt, Human
uaacguugcugugggaa

SEQ ID NO: 2248020 - RNA, 21 nt, Human
uaacuagauggugcugagaag

SEQ ID NO: 2248021 - RNA, 20 nt, Human
uaacuagauggugcugagaa

SEQ ID NO: 2248022 - RNA, 19 nt, Human
uaacuagauggugcugaga

SEQ ID NO: 2248023 - RNA, 18 nt, Human
uaacuagauggugcugag

SEQ ID NO: 2248024 - RNA, 16 nt, Human
uaacuagauggugcug

SEQ ID NO: 2248025 - RNA, 22 nt, Human
uaacuagagcagcccuggaguc

SEQ ID NO: 2248026 - RNA, 20 nt, Human
uaacguuuuuccuuuaaaaa

SEQ ID NO: 2248027 - RNA, 18 nt, Human
uaacguuuuuccuuuaaa

SEQ ID NO: 2248028 - RNA, 19 nt, Human
uaacguuuuuccuuuaaaa

SEQ ID NO: 2248029 - RNA, 15 nt, Human
uaacguuuuuccuuu

SEQ ID NO: 2248030 - RNA, 18 nt, Human
uaacguugcugugggaac

SEQ ID NO: 2248031 - RNA, 13 nt, Human
uaacguauaaaag

SEQ ID NO: 2248032 - RNA, 17 nt, Human
uaacguauaaaagccug

SEQ ID NO: 2248033 - RNA, 21 nt, Human
uaacggaucagaaauacagau

SEQ ID NO: 2248034 - RNA, 12 nt, Human
uaacggcuccag

SEQ ID NO: 2248035 - RNA, 14 nt, Human
uaacggaucagaaa

SEQ ID NO: 2248036 - RNA, 19 nt, Human
uaacggaucagaaauacag

SEQ ID NO: 2248037 - RNA, 13 nt, Human
uaacggaucagaa

SEQ ID NO: 2248038 - RNA, 17 nt, Human
uaacgcgucuuccugag

SEQ ID NO: 2248039 - RNA, 15 nt, Human
uaacgcgucuuccug

SEQ ID NO: 2248040 - RNA, 16 nt, Human
uaacgcgucuuccuga

SEQ ID NO: 2248041 - RNA, 13 nt, Human
uaacuucugccug

SEQ ID NO: 2248042 - RNA, 17 nt, Human
uaacuucuuauggaauu

SEQ ID NO: 2248043 - RNA, 18 nt, Human
uaacuucuuaaaaguugu

SEQ ID NO: 2248044 - RNA, 15 nt, Human
uaacuuggcuuucau

SEQ ID NO: 2248045 - RNA, 19 nt, Human
uaacuucuuauggaauuga

SEQ ID NO: 2248046 - RNA, 18 nt, Human
uaacuucuuauggaauug

SEQ ID NO: 2248047 - RNA, 21 nt, Human
uaacuuccuuggacucauuuu

SEQ ID NO: 2248048 - RNA, 17 nt, Human
uaacuuguuuccaaugu

SEQ ID NO: 2248049 - RNA, 16 nt, Human
uaacuugucuaaauaa

SEQ ID NO: 2248050 - RNA, 17 nt, Human
uaacuugucuaaauaag

SEQ ID NO: 2248051 - RNA, 22 nt, Human
uaacuuuaauucucuuucaaag

SEQ ID NO: 2248052 - RNA, 12 nt, Human
uaacuuuaaguu

SEQ ID NO: 2248053 - RNA, 15 nt, Human
uaacuuuaaguuuca

SEQ ID NO: 2248054 - RNA, 16 nt, Human
uaacuuuaaguuucag

SEQ ID NO: 2248055 - RNA, 15 nt, Human
uaagaagcuguugua

SEQ ID NO: 2248056 - RNA, 18 nt, Human
uaagaagcuguuguacau

SEQ ID NO: 2248057 - RNA, 19 nt, Human
uaagaagcuguuguacauu

SEQ ID NO: 2248058 - RNA, 16 nt, Human
uaacuugucuuuggac

SEQ ID NO: 2248059 - RNA, 20 nt, Human
uaacuugucuuuggacccug

SEQ ID NO: 2248060 - RNA, 13 nt, Human
uaagaagugaaaa

SEQ ID NO: 2248061 - RNA, 17 nt, Human
uaagaaggcaaaaaugu

SEQ ID NO: 2248062 - RNA, 13 nt, Human
uaagaaggcaaaa

SEQ ID NO: 2248063 - RNA, 22 nt, Human
uaagaagcuguuguacauuuau

SEQ ID NO: 2248064 - RNA, 18 nt, Human
uaagaauucaaacugggg

SEQ ID NO: 2248065 - RNA, 14 nt, Human
uaagaauucaaacu

SEQ ID NO: 2248066 - RNA, 12 nt, Human
uaagaauuauuu

SEQ ID NO: 2248067 - RNA, 17 nt, Human
uaagaauuauuuugaug

SEQ ID NO: 2248068 - RNA, 18 nt, Human
uaagaaggcaaaaaugua

SEQ ID NO: 2248069 - RNA, 21 nt, Human
uaagaagcuguuguacauuua

SEQ ID NO: 2248070 - RNA, 19 nt, Human
uaagaagggauggauucca

SEQ ID NO: 2248071 - RNA, 20 nt, Human
uaagaagggauggauuccaa

SEQ ID NO: 2248072 - RNA, 17 nt, Human
uaagaccuggcagcucu

SEQ ID NO: 2248073 - RNA, 18 nt, Human
uaagaccuggcagcucug

SEQ ID NO: 2248074 - RNA, 20 nt, Human
uaagacggauuuauuuuucc

SEQ ID NO: 2248075 - RNA, 22 nt, Human
uaagaauucaaacuggggccuc

SEQ ID NO: 2248076 - RNA, 16 nt, Human
uaagaauuuagggaga

SEQ ID NO: 2248077 - RNA, 19 nt, Human
uaacaggucuccucuuaaa

SEQ ID NO: 2248078 - RNA, 18 nt, Human
uaacaggucuccucuuaa

SEQ ID NO: 2248079 - RNA, 16 nt, Human
uaacagguuauuuuag

SEQ ID NO: 2248080 - RNA, 21 nt, Human
uaacagguuauuuuaguuucu

SEQ ID NO: 2248081 - RNA, 16 nt, Human
uaacaggucuccucuu

SEQ ID NO: 2248082 - RNA, 15 nt, Human
uaacaggucuccucu

SEQ ID NO: 2248083 - RNA, 14 nt, Human
uaacaggucuccuc

SEQ ID NO: 2248084 - RNA, 13 nt, Human
uaacaggucuccu

SEQ ID NO: 2248085 - RNA, 23 nt, Human
uaacagggucucuagugcuguga

SEQ ID NO: 2248086 - RNA, 19 nt, Human
uaacaugaauauuuagugu

SEQ ID NO: 2248087 - RNA, 15 nt, Human
uaacaguaacgcagg

SEQ ID NO: 2248088 - RNA, 22 nt, Human
uaacagguuauuuuaguuucug

SEQ ID NO: 2248089 - RNA, 23 nt, Human
uaacagguuauuuuaguuucugu

SEQ ID NO: 2248090 - RNA, 13 nt, Human
uaacagucauuua

SEQ ID NO: 2248091 - RNA, 14 nt, Human
uaacagucauuuaa

SEQ ID NO: 2248092 - RNA, 15 nt, Human
uaacagucauuuaaa

SEQ ID NO: 2248093 - RNA, 18 nt, Human
uaacagucauuuaaaaaa

SEQ ID NO: 2248094 - RNA, 15 nt, Human
aauauauuuucuguu

SEQ ID NO: 2248095 - RNA, 21 nt, Human
aauauauuuucuguuuucuuu

SEQ ID NO: 2248096 - RNA, 15 nt, Human
aauauauuuuuauau

SEQ ID NO: 2248097 - RNA, 19 nt, Human
aauauauuuuuauauuuag

SEQ ID NO: 2248098 - RNA, 20 nt, Human
aauauauuuuuauauuuagu

SEQ ID NO: 2248099 - RNA, 15 nt, Human
uaacauguaucccaa

SEQ ID NO: 2248100 - RNA, 17 nt, Human
uaacgcccuauuuuugc

SEQ ID NO: 2248101 - RNA, 20 nt, Human
uaacgcccuauuuuugcaau

SEQ ID NO: 2248102 - RNA, 22 nt, Human
uaacauguguuaaguauuuuca

SEQ ID NO: 2248103 - RNA, 23 nt, Human
uaacaugaggggacauuuuggug

SEQ ID NO: 2248104 - RNA, 15 nt, Human
uaacauguaggaagu

SEQ ID NO: 2248105 - RNA, 19 nt, Human
uaacauguaauuaaguacu

SEQ ID NO: 2248106 - RNA, 14 nt, Human
uaacaugaauauuu

SEQ ID NO: 2248107 - RNA, 20 nt, Human
uaacaugaggggacauuuug

SEQ ID NO: 2248108 - RNA, 19 nt, Human
uaacaugaggggacauuuu

SEQ ID NO: 2248109 - RNA, 18 nt, Human
uaacaugaggggacauuu

SEQ ID NO: 2248110 - RNA, 21 nt, Human
uaacaguccuaacugguauag

SEQ ID NO: 2248111 - RNA, 20 nt, Human
uaacaugaauauuuaguguu

SEQ ID NO: 2248112 - RNA, 21 nt, Human
uaacaugaauauuuaguguuc

SEQ ID NO: 2248113 - RNA, 21 nt, Human
aauaguucagguaacaggcag

SEQ ID NO: 2248114 - RNA, 21 nt, Human
aauauauucagccuggcuuca

SEQ ID NO: 2248115 - RNA, 21 nt, Human
aauaguuaagacaugauuucc

SEQ ID NO: 2248116 - RNA, 17 nt, Human
aauaguguuaaucaauu

SEQ ID NO: 2248117 - RNA, 18 nt, Human
aauaguguuaaucaauuu

SEQ ID NO: 2248118 - RNA, 19 nt, Human
aauaguguuaaucaauuua

SEQ ID NO: 2248119 - RNA, 22 nt, Human
aauaguguuaaucaauuuaaac

SEQ ID NO: 2248120 - RNA, 23 nt, Human
aauaguuaagacaugauuuccuu

SEQ ID NO: 2248121 - RNA, 22 nt, Human
aauaguuaagacaugauuuccu

SEQ ID NO: 2248122 - RNA, 20 nt, Human
aauaguuacuccagugccaa

SEQ ID NO: 2248123 - RNA, 18 nt, Human
aauaguuacuccagugcc

SEQ ID NO: 2248124 - RNA, 15 nt, Human
aauaguuacuccagu

SEQ ID NO: 2248125 - RNA, 22 nt, Human
aauaguucaaagccaaguuuau

SEQ ID NO: 2248126 - RNA, 21 nt, Human
aauauauugcugcugguaauu

SEQ ID NO: 2248127 - RNA, 15 nt, Human
aauauauuuaagaua

SEQ ID NO: 2248128 - RNA, 21 nt, Human
aauauauuuuaagacgaaaca

SEQ ID NO: 2248129 - RNA, 19 nt, Human
aauauauuuaagauaauua

SEQ ID NO: 2248130 - RNA, 20 nt, Human
aauauauuuaagauaauuau

SEQ ID NO: 2248131 - RNA, 14 nt, Human
aauauauuuaauga

SEQ ID NO: 2248132 - RNA, 20 nt, Human
aauagcuauauccauguacu

SEQ ID NO: 2248133 - RNA, 18 nt, Human
aauagcuauauccaugua

SEQ ID NO: 2248134 - RNA, 17 nt, Human
aauagcuauauccaugu

SEQ ID NO: 2248135 - RNA, 15 nt, Human
aauagcuauauccau

SEQ ID NO: 2248136 - RNA, 19 nt, Human
aauagucaaauugugugaa

SEQ ID NO: 2248137 - RNA, 23 nt, Human
aauaguguguucugauuagaaau

SEQ ID NO: 2248138 - RNA, 22 nt, Human
aauaguguguucugauuagaaa

SEQ ID NO: 2248139 - RNA, 15 nt, Human
aauaguguuaaucaa

SEQ ID NO: 2248140 - RNA, 16 nt, Human
aauaguguuaaucaau

SEQ ID NO: 2248141 - RNA, 20 nt, Human
aauagugcuuaaaaaucauu

SEQ ID NO: 2248142 - RNA, 21 nt, Human
aauaguguguucugauuagaa

SEQ ID NO: 2248143 - RNA, 15 nt, Human
aauagucugugugaa

SEQ ID NO: 2248144 - RNA, 20 nt, Human
aauagucuagauggcuccuc

SEQ ID NO: 2248145 - RNA, 13 nt, Human
aauagugaaauga

SEQ ID NO: 2248146 - RNA, 22 nt, Human
aauagugcucgcuuucuaugua

SEQ ID NO: 2248147 - RNA, 15 nt, Human
aauagugaaaugaau

SEQ ID NO: 2248148 - RNA, 19 nt, Human
aauagugcagaaucucaua

SEQ ID NO: 2248149 - RNA, 14 nt, Human
aauagucuguguga

SEQ ID NO: 2248150 - RNA, 13 nt, Human
aauagucugugug

SEQ ID NO: 2248151 - RNA, 21 nt, Human
aauagucuagauggcuccucu

SEQ ID NO: 2248152 - RNA, 14 nt, Human
aauagucuagaugg

SEQ ID NO: 2248153 - RNA, 21 nt, Human
aauagcuauauccauguacug

SEQ ID NO: 2248154 - RNA, 13 nt, Human
aauagucaagaaa

SEQ ID NO: 2248155 - RNA, 17 nt, Human
aauagucaagaaaaauu

SEQ ID NO: 2248156 - RNA, 16 nt, Human
aauagucaagaaaaau

SEQ ID NO: 2248157 - RNA, 20 nt, Human
uaaauuaacuuuuauaaacu

SEQ ID NO: 2248158 - RNA, 19 nt, Human
uaaauuaacuuuuauaaac

SEQ ID NO: 2248159 - RNA, 12 nt, Human
uaaaugaagaaa

SEQ ID NO: 2248160 - RNA, 16 nt, Human
uaaaugaagcagcuuu

SEQ ID NO: 2248161 - RNA, 17 nt, Human
uaaaugaagcagcuuua

SEQ ID NO: 2248162 - RNA, 13 nt, Human
uaaaugugguaaa

SEQ ID NO: 2248163 - RNA, 22 nt, Human
uaaaugaagcagcuuuaaacaa

SEQ ID NO: 2248164 - RNA, 23 nt, Human
uaaaugaagcagcuuuaaacaaa

SEQ ID NO: 2248165 - RNA, 18 nt, Human
aaguguaugcacgugugc

SEQ ID NO: 2248166 - RNA, 22 nt, Human
aagugcguguguagaguuaaga

SEQ ID NO: 2248167 - RNA, 19 nt, Human
aagugcguguguagaguua

SEQ ID NO: 2248168 - RNA, 21 nt, Human
aagugcguguguagaguuaag

SEQ ID NO: 2248169 - RNA, 22 nt, Human
aaguguauuuuucaauaaagca

SEQ ID NO: 2248170 - RNA, 15 nt, Human
aaguguauuuuucaa

SEQ ID NO: 2248171 - RNA, 13 nt, Human
aaguguauuuuuc

SEQ ID NO: 2248172 - RNA, 22 nt, Human
aagugcguccacgagcuguuua

SEQ ID NO: 2248173 - RNA, 15 nt, Human
aagugcguguguaga

SEQ ID NO: 2248174 - RNA, 16 nt, Human
aagugcguguguagag

SEQ ID NO: 2248175 - RNA, 17 nt, Human
aagugcguguguagagu

SEQ ID NO: 2248176 - RNA, 18 nt, Human
aagugcguguguagaguu

SEQ ID NO: 2248177 - RNA, 18 nt, Human
uaaaugaaaaucgugaca

SEQ ID NO: 2248178 - RNA, 16 nt, Human
uaaaugaaauuguaaa

SEQ ID NO: 2248179 - RNA, 14 nt, Human
uaaaugaaauugua

SEQ ID NO: 2248180 - RNA, 15 nt, Human
uaaaugaaauuguaa

SEQ ID NO: 2248181 - RNA, 21 nt, Human
aaguguauuuuuuuacuaaua

SEQ ID NO: 2248182 - RNA, 18 nt, Human
aaguguauuuuuuuacua

SEQ ID NO: 2248183 - RNA, 21 nt, Human
aauacaccagguagaacacaa

SEQ ID NO: 2248184 - RNA, 16 nt, Human
aauacacgagguauga

SEQ ID NO: 2248185 - RNA, 21 nt, Human
aauacaccacuacauucuguu

SEQ ID NO: 2248186 - RNA, 13 nt, Human
uaacaaugcugua

SEQ ID NO: 2248187 - RNA, 19 nt, Human
aauacagaaauuagccggg

SEQ ID NO: 2248188 - RNA, 13 nt, Human
aauacagacacua

SEQ ID NO: 2248189 - RNA, 15 nt, Human
aauacagacacuaag

SEQ ID NO: 2248190 - RNA, 20 nt, Human
aauacacuaauuccuuucua

SEQ ID NO: 2248191 - RNA, 16 nt, Human
aauacacuaguuguuu

SEQ ID NO: 2248192 - RNA, 17 nt, Human
aauacacuaguuguuuc

SEQ ID NO: 2248193 - RNA, 13 nt, Human
aauacagaggcaa

SEQ ID NO: 2248194 - RNA, 21 nt, Human
uaacaauaacuacuguguucc

SEQ ID NO: 2248195 - RNA, 19 nt, Human
uaacaauaacuacuguguu

SEQ ID NO: 2248196 - RNA, 23 nt, Human
uaacaauaacuacuguguuccug

SEQ ID NO: 2248197 - RNA, 18 nt, Human
uaacaauaacuacugugu

SEQ ID NO: 2248198 - RNA, 17 nt, Human
uaacaauaacuacugug

SEQ ID NO: 2248199 - RNA, 16 nt, Human
uaacaauaacuacugu

SEQ ID NO: 2248200 - RNA, 14 nt, Human
uaacaaucagcucc

SEQ ID NO: 2248201 - RNA, 17 nt, Human
uaacaaugaagauaaaa

SEQ ID NO: 2248202 - RNA, 13 nt, Human
uaacaaugauaua

SEQ ID NO: 2248203 - RNA, 19 nt, Human
uaacaaugauauauggaua

SEQ ID NO: 2248204 - RNA, 22 nt, Human
uaacaaugauauauggauaaug

SEQ ID NO: 2248205 - RNA, 22 nt, Human
uaaauuauaacuuaaaauauuu

SEQ ID NO: 2248206 - RNA, 13 nt, Human
uaaauuauguuua

SEQ ID NO: 2248207 - RNA, 14 nt, Human
uaaauuauguuuau

SEQ ID NO: 2248208 - RNA, 15 nt, Human
uaaauuauguuuaua

SEQ ID NO: 2248209 - RNA, 17 nt, Human
uaaauuauguuuauaua

SEQ ID NO: 2248210 - RNA, 16 nt, Human
uaaauuauacuggaga

SEQ ID NO: 2248211 - RNA, 20 nt, Human
uaaauuaugggaaucaagau

SEQ ID NO: 2248212 - RNA, 21 nt, Human
uaaauuaugggaaucaagauu

SEQ ID NO: 2248213 - RNA, 17 nt, Human
uaaauuauaacuuaaaa

SEQ ID NO: 2248214 - RNA, 21 nt, Human
uaaauuaacuuuuauaaacuu

SEQ ID NO: 2248215 - RNA, 20 nt, Human
uaacaaacuacauguaaucc

SEQ ID NO: 2248216 - RNA, 22 nt, Human
uaacaaacaucacucugcugcu

SEQ ID NO: 2248217 - RNA, 21 nt, Human
uaacaaacaucacucugcugc

SEQ ID NO: 2248218 - RNA, 19 nt, Human
uaaauuauuaguuuacauc

SEQ ID NO: 2248219 - RNA, 19 nt, Human
uaaauuauguuuauauaaa

SEQ ID NO: 2248220 - RNA, 20 nt, Human
uaaauuauguuuauauaaau

SEQ ID NO: 2248221 - RNA, 16 nt, Human
uaaauuauuuauuauu

SEQ ID NO: 2248222 - RNA, 16 nt, Human
aauagacuuaaaucuc

SEQ ID NO: 2248223 - RNA, 20 nt, Human
aauagagcaaaauugaugug

SEQ ID NO: 2248224 - RNA, 14 nt, Human
aauagagccugagg

SEQ ID NO: 2248225 - RNA, 22 nt, Human
aauagagcaaaauugauguguu

SEQ ID NO: 2248226 - RNA, 18 nt, Human
aauagaguauaugcacuu

SEQ ID NO: 2248227 - RNA, 15 nt, Human
aauagaguauaugca

SEQ ID NO: 2248228 - RNA, 16 nt, Human
aauagagccugaggga

SEQ ID NO: 2248229 - RNA, 16 nt, Human
aauagaguauaugcac

SEQ ID NO: 2248230 - RNA, 17 nt, Human
aauagaguauaugcacu

SEQ ID NO: 2248231 - RNA, 19 nt, Human
aauagcauguauugugucu

SEQ ID NO: 2248232 - RNA, 14 nt, Human
aauagcauguauug

SEQ ID NO: 2248233 - RNA, 18 nt, Human
aauagcauguauuguguc

SEQ ID NO: 2248234 - RNA, 12 nt, Human
aauaccugcccu

SEQ ID NO: 2248235 - RNA, 19 nt, Human
aauaccugucccccugaca

SEQ ID NO: 2248236 - RNA, 15 nt, Human
aauaccugucccccu

SEQ ID NO: 2248237 - RNA, 18 nt, Human
aauaccugucccccugac

SEQ ID NO: 2248238 - RNA, 14 nt, Human
aauaccucugugug

SEQ ID NO: 2248239 - RNA, 13 nt, Human
aauaccucugugu

SEQ ID NO: 2248240 - RNA, 15 nt, Human
aauaccucugugugc

SEQ ID NO: 2248241 - RNA, 16 nt, Human
aauaccucugugugcu

SEQ ID NO: 2248242 - RNA, 14 nt, Human
aauaccucuuagcu

SEQ ID NO: 2248243 - RNA, 16 nt, Human
aauaccucuuagcuga

SEQ ID NO: 2248244 - RNA, 17 nt, Human
aauaccucuuagcugag

SEQ ID NO: 2248245 - RNA, 21 nt, Human
aauaccucuuagcugagugga

SEQ ID NO: 2248246 - RNA, 20 nt, Human
aauaccagugaaccaaagag

SEQ ID NO: 2248247 - RNA, 13 nt, Human
aauaccaguucug

SEQ ID NO: 2248248 - RNA, 20 nt, Human
aauaccauuuuuuaaggaaa

SEQ ID NO: 2248249 - RNA, 22 nt, Human
aauaccauuuuuuaaggaaaca

SEQ ID NO: 2248250 - RNA, 23 nt, Human
aauaccauuuuuuaaggaaacaa

SEQ ID NO: 2248251 - RNA, 20 nt, Human
aauaccaaaauuauuucaga

SEQ ID NO: 2248252 - RNA, 16 nt, Human
aauaccaaguauuuau

SEQ ID NO: 2248253 - RNA, 12 nt, Human
aauacauuuuau

SEQ ID NO: 2248254 - RNA, 17 nt, Human
aauaccagccaguaaau

SEQ ID NO: 2248255 - RNA, 19 nt, Human
aauaccagccaguaaaugg

SEQ ID NO: 2248256 - RNA, 18 nt, Human
aauaccaugccauuuaaa

SEQ ID NO: 2248257 - RNA, 17 nt, Human
aauacauugaauuagaa

SEQ ID NO: 2248258 - RNA, 18 nt, Human
aauacauugaauuagaaa

SEQ ID NO: 2248259 - RNA, 12 nt, Human
aauaccaaggaa

SEQ ID NO: 2248260 - RNA, 23 nt, Human
aauaccacaggaaccacaagacu

SEQ ID NO: 2248261 - RNA, 23 nt, Human
aauacagggcaugcauuuugcag

SEQ ID NO: 2248262 - RNA, 19 nt, Human
aauacaguaagcugcucua

SEQ ID NO: 2248263 - RNA, 21 nt, Human
aauacaguaagcugcucuauu

SEQ ID NO: 2248264 - RNA, 16 nt, Human
aauacagggcaugcau

SEQ ID NO: 2248265 - RNA, 16 nt, Human
aauacagggcauuuug

SEQ ID NO: 2248266 - RNA, 23 nt, Human
aauacaucccuuaccugggaaag

SEQ ID NO: 2248267 - RNA, 15 nt, Human
aauacauucugcuuu

SEQ ID NO: 2248268 - RNA, 14 nt, Human
aauacaugcugcua

SEQ ID NO: 2248269 - RNA, 13 nt, Human
aauacaugcaucu

SEQ ID NO: 2248270 - RNA, 23 nt, Human
aauacaugacauuuauuuuucau

SEQ ID NO: 2248271 - RNA, 17 nt, Human
aauacaugacauuuauu

SEQ ID NO: 2248272 - RNA, 24 nt, Human
aauacagccaaagauaaucucuca

SEQ ID NO: 2248273 - RNA, 19 nt, Human
aauacagccaaagauaauc

SEQ ID NO: 2248274 - RNA, 21 nt, Human
aauacagauuuugauagcaaa

SEQ ID NO: 2248275 - RNA, 23 nt, Human
aauacagauuuugauagcaaagc

SEQ ID NO: 2248276 - RNA, 18 nt, Human
aauacagcaacaauuuau

SEQ ID NO: 2248277 - RNA, 20 nt, Human
aauacagacacuaaguuaua

SEQ ID NO: 2248278 - RNA, 21 nt, Human
aauacagacacuaaguuauag

SEQ ID NO: 2248279 - RNA, 19 nt, Human
aauacagauuuugauagca

SEQ ID NO: 2248280 - RNA, 20 nt, Human
aauacagauuuugauagcaa

SEQ ID NO: 2248281 - RNA, 15 nt, Human
guuaggauuuaacag

SEQ ID NO: 2248282 - RNA, 23 nt, Human
guuaggauuuaacagucauuuaa

SEQ ID NO: 2248283 - RNA, 12 nt, Human
guuagaauuccu

SEQ ID NO: 2248284 - RNA, 16 nt, Human
guuaggccuggcacag

SEQ ID NO: 2248285 - RNA, 13 nt, Human
guuaggccuggca

SEQ ID NO: 2248286 - RNA, 15 nt, Human
guuaggccuggcaca

SEQ ID NO: 2248287 - RNA, 20 nt, Human
guuagggaaaacauuccauc

SEQ ID NO: 2248288 - RNA, 15 nt, Human
guuagggaaaacauu

SEQ ID NO: 2248289 - RNA, 19 nt, Human
guuaggcauugugggaagg

SEQ ID NO: 2248290 - RNA, 20 nt, Human
guuaggcauugugggaaggg

SEQ ID NO: 2248291 - RNA, 15 nt, Human
guuaggaguucgaga

SEQ ID NO: 2248292 - RNA, 23 nt, Human
guuaggaaauaaaaccuuucaaa

SEQ ID NO: 2248293 - RNA, 22 nt, Human
guuaggaaauaaaaccuuucaa

SEQ ID NO: 2248294 - RNA, 21 nt, Human
guuaggaaauaaaaccuuuca

SEQ ID NO: 2248295 - RNA, 19 nt, Human
guuaggaaauaaaaccuuu

SEQ ID NO: 2248296 - RNA, 18 nt, Human
guuaggaaauaaaaccuu

SEQ ID NO: 2248297 - RNA, 17 nt, Human
guuaggaaauaaaaccu

SEQ ID NO: 2248298 - RNA, 16 nt, Human
guuaggaaauaaaacc

SEQ ID NO: 2248299 - RNA, 14 nt, Human
guuagaaugaggag

SEQ ID NO: 2248300 - RNA, 16 nt, Human
guuagaaugaggagga

SEQ ID NO: 2248301 - RNA, 15 nt, Human
guuagaaugaggagg

SEQ ID NO: 2248302 - RNA, 16 nt, Human
guuagcuccuguggcc

SEQ ID NO: 2248303 - RNA, 14 nt, Human
guuaggaaauaaaa

SEQ ID NO: 2248304 - RNA, 11 nt, Human
guuagcuggag

SEQ ID NO: 2248305 - RNA, 11 nt, Human
guuagcugagc

SEQ ID NO: 2248306 - RNA, 20 nt, Human
guuagcuccuguggccccac

SEQ ID NO: 2248307 - RNA, 16 nt, Human
guuacuugaaauacca

SEQ ID NO: 2248308 - RNA, 19 nt, Human
guuacuugaaauaccagug

SEQ ID NO: 2248309 - RNA, 19 nt, Human
guuagaaaugcagaauccu

SEQ ID NO: 2248310 - RNA, 13 nt, Human
guuacuuccuauc

SEQ ID NO: 2248311 - RNA, 23 nt, Human
guuacuucacuuuaauucucaug

SEQ ID NO: 2248312 - RNA, 17 nt, Human
guuacuuaccuaaacag

SEQ ID NO: 2248313 - RNA, 16 nt, Human
guuacuucacuuuaau

SEQ ID NO: 2248314 - RNA, 14 nt, Human
guuacuucugaggu

SEQ ID NO: 2248315 - RNA, 15 nt, Human
guuaagauaugaugu

SEQ ID NO: 2248316 - RNA, 22 nt, Human
guuaagagugggggagagcagg

SEQ ID NO: 2248317 - RNA, 18 nt, Human
guuaagcauuaccacuca

SEQ ID NO: 2248318 - RNA, 16 nt, Human
guuaagcauuaccacu

SEQ ID NO: 2248319 - RNA, 23 nt, Human
guuacuguugugaccugaaguuc

SEQ ID NO: 2248320 - RNA, 18 nt, Human
guuaagagaaaugagcuu

SEQ ID NO: 2248321 - RNA, 14 nt, Human
guuaagauuccuaa

SEQ ID NO: 2248322 - RNA, 11 nt, Human
guuaagagaaa

SEQ ID NO: 2248323 - RNA, 12 nt, Human
guuaagagaaau

SEQ ID NO: 2248324 - RNA, 12 nt, Human
guucaaagccag

SEQ ID NO: 2248325 - RNA, 13 nt, Human
guucaaagccagc

SEQ ID NO: 2248326 - RNA, 18 nt, Human
guucaagcgauucuucug

SEQ ID NO: 2248327 - RNA, 19 nt, Human
guucaacuuuuccuuugaa

SEQ ID NO: 2248328 - RNA, 15 nt, Human
guucaacuuccagaa

SEQ ID NO: 2248329 - RNA, 13 nt, Human
guucaaaaugucu

SEQ ID NO: 2248330 - RNA, 14 nt, Human
guucaaaaugucug

SEQ ID NO: 2248331 - RNA, 14 nt, Human
guucaaaaagucua

SEQ ID NO: 2248332 - RNA, 21 nt, Human
guuauuuuuuaauuauuauuu

SEQ ID NO: 2248333 - RNA, 20 nt, Human
guucaaagauauuuugcuuu

SEQ ID NO: 2248334 - RNA, 22 nt, Human
guucaaagauauuuugcuuugu

SEQ ID NO: 2248335 - RNA, 21 nt, Human
guucaaagauauuuugcuuug

SEQ ID NO: 2248336 - RNA, 13 nt, Human
guuagggaauggc

SEQ ID NO: 2248337 - RNA, 23 nt, Human
guuagggaaaacauuccauccuu

SEQ ID NO: 2248338 - RNA, 13 nt, Human
guuauucuggagu

SEQ ID NO: 2248339 - RNA, 23 nt, Human
guuauuuuuauuuauuuaaauuu

SEQ ID NO: 2248340 - RNA, 22 nt, Human
guuauuuuuguuucuuccaaag

SEQ ID NO: 2248341 - RNA, 16 nt, Human
guuauuuuuuaauuau

SEQ ID NO: 2248342 - RNA, 16 nt, Human
guuauuuuuauaucag

SEQ ID NO: 2248343 - RNA, 23 nt, Human
guuauuuuuauaucagccugagu

SEQ ID NO: 2248344 - RNA, 16 nt, Human
guuauugacaaacucu

SEQ ID NO: 2248345 - RNA, 13 nt, Human
guuauuuugcaac

SEQ ID NO: 2248346 - RNA, 19 nt, Human
guuauuuuuacauucugaa

SEQ ID NO: 2248347 - RNA, 20 nt, Human
guuauuuuuacauucugaau

SEQ ID NO: 2248348 - RNA, 17 nt, Human
aagcuauuuaucuguag

SEQ ID NO: 2248349 - RNA, 21 nt, Human
aagcucagcccaccccccuca

SEQ ID NO: 2248350 - RNA, 17 nt, Human
aagcucagcuacugauu

SEQ ID NO: 2248351 - RNA, 16 nt, Human
aagcucagcccacccc

SEQ ID NO: 2248352 - RNA, 15 nt, Human
aagcucagcccaccc

SEQ ID NO: 2248353 - RNA, 15 nt, Human
aagcucacaguuccu

SEQ ID NO: 2248354 - RNA, 11 nt, Human
aagcucacagu

SEQ ID NO: 2248355 - RNA, 20 nt, Human
aagcucacagaccuuugaac

SEQ ID NO: 2248356 - RNA, 12 nt, Human
aagcucagggcc

SEQ ID NO: 2248357 - RNA, 13 nt, Human
aagcucagggccu

SEQ ID NO: 2248358 - RNA, 16 nt, Human
aagcucagggccuggc

SEQ ID NO: 2248359 - RNA, 17 nt, Human
aagcucagggccuggcu

SEQ ID NO: 2248360 - RNA, 20 nt, Human
aagcucagggccuggcucag

SEQ ID NO: 2248361 - RNA, 17 nt, Human
aagcucaggaccaggca

SEQ ID NO: 2248362 - RNA, 12 nt, Human
aagcucauauuu

SEQ ID NO: 2248363 - RNA, 20 nt, Human
aagcucauauuuuguauaua

SEQ ID NO: 2248364 - RNA, 21 nt, Human
aagcucauauuuuguauauau

SEQ ID NO: 2248365 - RNA, 22 nt, Human
aagcucauauuuuguauauauc

SEQ ID NO: 2248366 - RNA, 23 nt, Human
aagcucauauuuuguauauaucu

SEQ ID NO: 2248367 - RNA, 18 nt, Human
aagcucagggccuggcuc

SEQ ID NO: 2248368 - RNA, 19 nt, Human
aagcucagggccuggcuca

SEQ ID NO: 2248369 - RNA, 17 nt, Human
aagcuccaagcucccag

SEQ ID NO: 2248370 - RNA, 18 nt, Human
aagcuccaagcucccagg

SEQ ID NO: 2248371 - RNA, 13 nt, Human
aagcuccagguag

SEQ ID NO: 2248372 - RNA, 14 nt, Human
aagcuccagguaga

SEQ ID NO: 2248373 - RNA, 22 nt, Human
guucagcuaagcuaggaaugaa

SEQ ID NO: 2248374 - RNA, 13 nt, Human
guucagcuacucc

SEQ ID NO: 2248375 - RNA, 13 nt, Human
guucagcuccagc

SEQ ID NO: 2248376 - RNA, 23 nt, Human
guucagccccuccucugccaccu

SEQ ID NO: 2248377 - RNA, 22 nt, Human
guucagccccuccucugccacc

SEQ ID NO: 2248378 - RNA, 21 nt, Human
guucagccccuccucugccac

SEQ ID NO: 2248379 - RNA, 20 nt, Human
guucagccccuccucugcca

SEQ ID NO: 2248380 - RNA, 19 nt, Human
guucagcuaagcuaggaau

SEQ ID NO: 2248381 - RNA, 19 nt, Human
guucagccccuccucugcc

SEQ ID NO: 2248382 - RNA, 18 nt, Human
guucagccccuccucugc

SEQ ID NO: 2248383 - RNA, 17 nt, Human
guucagccccuccucug

SEQ ID NO: 2248384 - RNA, 13 nt, Human
aagccucagagaa

SEQ ID NO: 2248385 - RNA, 22 nt, Human
aagccucaacuagucauuuuuu

SEQ ID NO: 2248386 - RNA, 20 nt, Human
aagccuagaagagcuucuga

SEQ ID NO: 2248387 - RNA, 16 nt, Human
aagccuaccugcucuc

SEQ ID NO: 2248388 - RNA, 19 nt, Human
aagccuaccugcucuccaa

SEQ ID NO: 2248389 - RNA, 21 nt, Human
aagccuaucaaagaccuugug

SEQ ID NO: 2248390 - RNA, 22 nt, Human
aagccuagugaaggcuucucuc

SEQ ID NO: 2248391 - RNA, 14 nt, Human
aagccuaagaaucu

SEQ ID NO: 2248392 - RNA, 14 nt, Human
aagccuaccugcuc

SEQ ID NO: 2248393 - RNA, 15 nt, Human
aagccugaggcuggg

SEQ ID NO: 2248394 - RNA, 24 nt, Human
aagccugaaggggcgucuguuccc

SEQ ID NO: 2248395 - RNA, 20 nt, Human
aagccugaguuugcuuucaa

SEQ ID NO: 2248396 - RNA, 22 nt, Human
aagcuagacgagcaggcuucuu

SEQ ID NO: 2248397 - RNA, 15 nt, Human
aagccugaugcugac

SEQ ID NO: 2248398 - RNA, 21 nt, Human
aagccugcacaauaaaaaugu

SEQ ID NO: 2248399 - RNA, 17 nt, Human
aagccugcaauuucaua

SEQ ID NO: 2248400 - RNA, 22 nt, Human
aagccugcaauuucauaugcug

SEQ ID NO: 2248401 - RNA, 12 nt, Human
aagcuaggccug

SEQ ID NO: 2248402 - RNA, 14 nt, Human
aagcuagagauaug

SEQ ID NO: 2248403 - RNA, 12 nt, Human
aagccugcaacu

SEQ ID NO: 2248404 - RNA, 12 nt, Human
aagcuagcuccc

SEQ ID NO: 2248405 - RNA, 13 nt, Human
aagcuagcucccc

SEQ ID NO: 2248406 - RNA, 15 nt, Human
aagcuagcuccccuc

SEQ ID NO: 2248407 - RNA, 18 nt, Human
aagcuagcuccccuccuc

SEQ ID NO: 2248408 - RNA, 19 nt, Human
aagcuagcuccccuccucu

SEQ ID NO: 2248409 - RNA, 20 nt, Human
aagcuagcuccccuccucuc

SEQ ID NO: 2248410 - RNA, 14 nt, Human
aagcuaggaaugaa

SEQ ID NO: 2248411 - RNA, 16 nt, Human
gugugugggagugugu

SEQ ID NO: 2248412 - RNA, 22 nt, Human
aagcagguugaggggcuccugg

SEQ ID NO: 2248413 - RNA, 10 nt, Human
gugugugcgu

SEQ ID NO: 2248414 - RNA, 19 nt, Human
aagcagguucccaagcuca

SEQ ID NO: 2248415 - RNA, 21 nt, Human
gugugugcgccuacaggagug

SEQ ID NO: 2248416 - RNA, 17 nt, Human
gugugugaaugaacacu

SEQ ID NO: 2248417 - RNA, 14 nt, Human
gugugugaaaggaa

SEQ ID NO: 2248418 - RNA, 16 nt, Human
aagcagguuuuucucc

SEQ ID NO: 2248419 - RNA, 13 nt, Human
aagcaguaacuga

SEQ ID NO: 2248420 - RNA, 20 nt, Human
aagcaguagaaauaauaugc

SEQ ID NO: 2248421 - RNA, 14 nt, Human
aagcaguagacaag

SEQ ID NO: 2248422 - RNA, 21 nt, Human
aagcaguagaaauaauaugca

SEQ ID NO: 2248423 - RNA, 22 nt, Human
aagcaguagaaauaauaugcau

SEQ ID NO: 2248424 - RNA, 17 nt, Human
aagcagucgugccugug

SEQ ID NO: 2248425 - RNA, 18 nt, Human
aagcagucgugccugugu

SEQ ID NO: 2248426 - RNA, 19 nt, Human
aagcagucgugccuguguc

SEQ ID NO: 2248427 - RNA, 12 nt, Human
aagcagugcaug

SEQ ID NO: 2248428 - RNA, 19 nt, Human
aagcagucuacccaccuca

SEQ ID NO: 2248429 - RNA, 18 nt, Human
aagcagucuacccaccuc

SEQ ID NO: 2248430 - RNA, 15 nt, Human
aagcagugccuucca

SEQ ID NO: 2248431 - RNA, 20 nt, Human
aagcagugcaugcugucccu

SEQ ID NO: 2248432 - RNA, 14 nt, Human
aagcagugcaugcu

SEQ ID NO: 2248433 - RNA, 15 nt, Human
aagcagugcaugcug

SEQ ID NO: 2248434 - RNA, 22 nt, Human
aagcauaaaugcaaacacacaa

SEQ ID NO: 2248435 - RNA, 12 nt, Human
aagcauccaugu

SEQ ID NO: 2248436 - RNA, 14 nt, Human
aagcauccaugugu

SEQ ID NO: 2248437 - RNA, 22 nt, Human
aagcaucauuauuugcagagac

SEQ ID NO: 2248438 - RNA, 20 nt, Human
aagcagugccuuccauaauu

SEQ ID NO: 2248439 - RNA, 15 nt, Human
aagcagugcuucuca

SEQ ID NO: 2248440 - RNA, 18 nt, Human
aagcagugccuuccauaa

SEQ ID NO: 2248441 - RNA, 17 nt, Human
aagcagugccuuccaua

SEQ ID NO: 2248442 - RNA, 17 nt, Human
aagcaguggacaccagg

SEQ ID NO: 2248443 - RNA, 15 nt, Human
aagcaguugugucag

SEQ ID NO: 2248444 - RNA, 22 nt, Human
aagcauuggguggguaaauuca

SEQ ID NO: 2248445 - RNA, 12 nt, Human
aagcauuuauaa

SEQ ID NO: 2248446 - RNA, 12 nt, Human
aagcauuugaau

SEQ ID NO: 2248447 - RNA, 13 nt, Human
aagcauuugaaug

SEQ ID NO: 2248448 - RNA, 14 nt, Human
aagcauuugaaugc

SEQ ID NO: 2248449 - RNA, 17 nt, Human
aagcauuugaaugcauu

SEQ ID NO: 2248450 - RNA, 15 nt, Human
aagcauuugaaugca

SEQ ID NO: 2248451 - RNA, 16 nt, Human
aagcauuugaaugcau

SEQ ID NO: 2248452 - RNA, 16 nt, Human
aagcauuuacuuugug

SEQ ID NO: 2248453 - RNA, 16 nt, Human
aagcauuuagauguau

SEQ ID NO: 2248454 - RNA, 13 nt, Human
aagcauuguaaau

SEQ ID NO: 2248455 - RNA, 13 nt, Human
aagcauucugucu

SEQ ID NO: 2248456 - RNA, 21 nt, Human
aagcauucaauuuauucaaga

SEQ ID NO: 2248457 - RNA, 23 nt, Human
aagcauucaauuuauucaagaaa

SEQ ID NO: 2248458 - RNA, 22 nt, Human
aagcauucaauuuauucaagaa

SEQ ID NO: 2248459 - RNA, 12 nt, Human
aagcauucacaa

SEQ ID NO: 2248460 - RNA, 13 nt, Human
aagcauucacaac

SEQ ID NO: 2248461 - RNA, 15 nt, Human
aagcauucagagagc

SEQ ID NO: 2248462 - RNA, 17 nt, Human
aagcauucagagagcag

SEQ ID NO: 2248463 - RNA, 13 nt, Human
aagcauuccaaca

SEQ ID NO: 2248464 - RNA, 14 nt, Human
aagcauuccaacaa

SEQ ID NO: 2248465 - RNA, 22 nt, Human
aagcauuccuucuuugauaaug

SEQ ID NO: 2248466 - RNA, 23 nt, Human
aagcauuccuucuuugauaaugu

SEQ ID NO: 2248467 - RNA, 17 nt, Human
aagcauuccaacaaagg

SEQ ID NO: 2248468 - RNA, 13 nt, Human
aagcauuccuucu

SEQ ID NO: 2248469 - RNA, 14 nt, Human
aagcauuccuucuu

SEQ ID NO: 2248470 - RNA, 16 nt, Human
aagcauuccuucuuug

SEQ ID NO: 2248471 - RNA, 17 nt, Human
aagcauuccuucuuuga

SEQ ID NO: 2248472 - RNA, 18 nt, Human
aagcauuccuucuuugau

SEQ ID NO: 2248473 - RNA, 20 nt, Human
aagcauuccuucuuugauaa

SEQ ID NO: 2248474 - RNA, 21 nt, Human
aagcauuccuucuuugauaau

SEQ ID NO: 2248475 - RNA, 18 nt, Human
aagcauuaacuucucugg

SEQ ID NO: 2248476 - RNA, 18 nt, Human
aagcauuaagaacacuuu

SEQ ID NO: 2248477 - RNA, 18 nt, Human
aagcauuacauuuccaaa

SEQ ID NO: 2248478 - RNA, 18 nt, Human
aagcauuaccacucaggc

SEQ ID NO: 2248479 - RNA, 19 nt, Human
aagcauuaccacucaggca

SEQ ID NO: 2248480 - RNA, 21 nt, Human
aagcauccauguguggacuca

SEQ ID NO: 2248481 - RNA, 20 nt, Human
aagcauccauguguggacuc

SEQ ID NO: 2248482 - RNA, 19 nt, Human
aagcauccauguguggacu

SEQ ID NO: 2248483 - RNA, 17 nt, Human
aagcauccaugugugga

SEQ ID NO: 2248484 - RNA, 18 nt, Human
aagcaucggagggaauug

SEQ ID NO: 2248485 - RNA, 19 nt, Human
aagcccugggaucacugug

SEQ ID NO: 2248486 - RNA, 12 nt, Human
aagcccugaggg

SEQ ID NO: 2248487 - RNA, 19 nt, Human
aagcccuggagccaacugc

SEQ ID NO: 2248488 - RNA, 23 nt, Human
aagcccugauuguguauauucau

SEQ ID NO: 2248489 - RNA, 18 nt, Human
aagcccucuuccaucaug

SEQ ID NO: 2248490 - RNA, 21 nt, Human
aagcccucuuccaucaugucc

SEQ ID NO: 2248491 - RNA, 19 nt, Human
aagcccugagcuuucugcu

SEQ ID NO: 2248492 - RNA, 15 nt, Human
aagcccuccuuccac

SEQ ID NO: 2248493 - RNA, 13 nt, Human
aagcccucuucca

SEQ ID NO: 2248494 - RNA, 14 nt, Human
aagcccucuuccau

SEQ ID NO: 2248495 - RNA, 16 nt, Human
aagcccucuuccauca

SEQ ID NO: 2248496 - RNA, 14 nt, Human
aagcccuccuucca

SEQ ID NO: 2248497 - RNA, 13 nt, Human
aagcccuccuucc

SEQ ID NO: 2248498 - RNA, 12 nt, Human
aagcccuccuuc

SEQ ID NO: 2248499 - RNA, 11 nt, Human
aagcccuccuu

SEQ ID NO: 2248500 - RNA, 9 nt, Human
aagcccucc

SEQ ID NO: 2248501 - RNA, 17 nt, Human
aagcccgacuugcuguu

SEQ ID NO: 2248502 - RNA, 16 nt, Human
aagcccccccuuccac

SEQ ID NO: 2248503 - RNA, 17 nt, Human
aagccccugcccaucug

SEQ ID NO: 2248504 - RNA, 21 nt, Human
aagccccuugcucuccccugc

SEQ ID NO: 2248505 - RNA, 15 nt, Human
aagcccgacuugcug

SEQ ID NO: 2248506 - RNA, 23 nt, Human
aagcccccagcuaagaaccugga

SEQ ID NO: 2248507 - RNA, 21 nt, Human
aagcccccagcuaagaaccug

SEQ ID NO: 2248508 - RNA, 16 nt, Human
aagcccccagcuaaga

SEQ ID NO: 2248509 - RNA, 20 nt, Human
aagcccccaccgugggcagg

SEQ ID NO: 2248510 - RNA, 14 nt, Human
aagcccccaccgug

SEQ ID NO: 2248511 - RNA, 22 nt, Human
aagccccaugcuggagccugug

SEQ ID NO: 2248512 - RNA, 23 nt, Human
aagccccaugcuggagccugugu

SEQ ID NO: 2248513 - RNA, 18 nt, Human
aagccccaugcuggagcc

SEQ ID NO: 2248514 - RNA, 19 nt, Human
aagccccaugcuggagccu

SEQ ID NO: 2248515 - RNA, 20 nt, Human
aagccccaugcuggagccug

SEQ ID NO: 2248516 - RNA, 21 nt, Human
aagccccaugcuggagccugu

SEQ ID NO: 2248517 - RNA, 14 nt, Human
aagccgggaacaga

SEQ ID NO: 2248518 - RNA, 19 nt, Human
aagccggcggcccaagccc

SEQ ID NO: 2248519 - RNA, 12 nt, Human
aagccggcggcc

SEQ ID NO: 2248520 - RNA, 13 nt, Human
aagccggcggccc

SEQ ID NO: 2248521 - RNA, 14 nt, Human
aagccggcggccca

SEQ ID NO: 2248522 - RNA, 18 nt, Human
guuaagacaaacugcaua

SEQ ID NO: 2248523 - RNA, 19 nt, Human
guuaagaagcuguuguaca

SEQ ID NO: 2248524 - RNA, 20 nt, Human
guuaagaagcuguuguacau

SEQ ID NO: 2248525 - RNA, 15 nt, Human
guuaagaagcuguug

SEQ ID NO: 2248526 - RNA, 17 nt, Human
guuaagaagcuguugua

SEQ ID NO: 2248527 - RNA, 13 nt, Human
guuaagaccuggc

SEQ ID NO: 2248528 - RNA, 22 nt, Human
guuaagacaugauuuccuugaa

SEQ ID NO: 2248529 - RNA, 19 nt, Human
guuaagacaugauuuccuu

SEQ ID NO: 2248530 - RNA, 17 nt, Human
guuaagacaugauuucc

SEQ ID NO: 2248531 - RNA, 16 nt, Human
guuaagaccuggcagc

SEQ ID NO: 2248532 - RNA, 14 nt, Human
guuaagaccuggca

SEQ ID NO: 2248533 - RNA, 21 nt, Human
guuaagaagcuguuguacauu

SEQ ID NO: 2248534 - RNA, 13 nt, Human
aagccgcugcugg

SEQ ID NO: 2248535 - RNA, 23 nt, Human
aagcccuuccaugucgccucugc

SEQ ID NO: 2248536 - RNA, 20 nt, Human
aagccgcuggggccaguugg

SEQ ID NO: 2248537 - RNA, 15 nt, Human
aagcccuuccauguc

SEQ ID NO: 2248538 - RNA, 20 nt, Human
aagcccuuccaugucgccuc

SEQ ID NO: 2248539 - RNA, 22 nt, Human
aagcccuguugacacaggucuu

SEQ ID NO: 2248540 - RNA, 23 nt, Human
aagcccuggagccaacugcugcu

SEQ ID NO: 2248541 - RNA, 18 nt, Human
aagcccugucgagacacu

SEQ ID NO: 2248542 - RNA, 19 nt, Human
aagcccugucgagacacuu

SEQ ID NO: 2248543 - RNA, 20 nt, Human
aagcccugucgagacacuug

SEQ ID NO: 2248544 - RNA, 22 nt, Human
aagcccaucaauuauagaaagc

SEQ ID NO: 2248545 - RNA, 14 nt, Human
aagcccaggccccu

SEQ ID NO: 2248546 - RNA, 21 nt, Human
aagcccauucauuccauucug

SEQ ID NO: 2248547 - RNA, 16 nt, Human
aagcccauucauucca

SEQ ID NO: 2248548 - RNA, 19 nt, Human
aagcccaugaguccuugaa

SEQ ID NO: 2248549 - RNA, 20 nt, Human
aagcccaugaguccuugaaa

SEQ ID NO: 2248550 - RNA, 16 nt, Human
aagccccaugcuggag

SEQ ID NO: 2248551 - RNA, 17 nt, Human
aagccccaugcuggagc

SEQ ID NO: 2248552 - RNA, 21 nt, Human
aagccccaggcaggcugugcg

SEQ ID NO: 2248553 - RNA, 17 nt, Human
aagccccaggcaggcug

SEQ ID NO: 2248554 - RNA, 14 nt, Human
aagccccaggcagg

SEQ ID NO: 2248555 - RNA, 12 nt, Human
aagccccaggca

SEQ ID NO: 2248556 - RNA, 14 nt, Human
aagccccagcaagc

SEQ ID NO: 2248557 - RNA, 23 nt, Human
aagcccauucauuccauucugga

SEQ ID NO: 2248558 - RNA, 22 nt, Human
aagcccaugaguccuugaaaau

SEQ ID NO: 2248559 - RNA, 19 nt, Human
aagcccaggaaaggcucca

SEQ ID NO: 2248560 - RNA, 22 nt, Human
aagcccaggaaaggcuccagga

SEQ ID NO: 2248561 - RNA, 19 nt, Human
aagccaacuuguaaauaca

SEQ ID NO: 2248562 - RNA, 19 nt, Human
aagcccaguucagcuuggg

SEQ ID NO: 2248563 - RNA, 18 nt, Human
aagcccaguucagcuugg

SEQ ID NO: 2248564 - RNA, 17 nt, Human
aagccaacagucaaaac

SEQ ID NO: 2248565 - RNA, 22 nt, Human
aagccaacuuggcuuucccgga

SEQ ID NO: 2248566 - RNA, 16 nt, Human
aagccaacuuguaaau

SEQ ID NO: 2248567 - RNA, 17 nt, Human
aagccaacuuguaaaua

SEQ ID NO: 2248568 - RNA, 16 nt, Human
aagccaacgacaaagc

SEQ ID NO: 2248569 - RNA, 15 nt, Human
aagccaaagaaaaau

SEQ ID NO: 2248570 - RNA, 16 nt, Human
aagccaacacccuguc

SEQ ID NO: 2248571 - RNA, 22 nt, Human
aagccaagaggcugcagccagg

SEQ ID NO: 2248572 - RNA, 18 nt, Human
aagccaagaggcugcagc

SEQ ID NO: 2248573 - RNA, 14 nt, Human
aagcccaggaaagg

SEQ ID NO: 2248574 - RNA, 17 nt, Human
aagcccaggaaaggcuc

SEQ ID NO: 2248575 - RNA, 22 nt, Human
aagccaaagcuaggccuggcca

SEQ ID NO: 2248576 - RNA, 21 nt, Human
aagccaaagaaaaauaacccu

SEQ ID NO: 2248577 - RNA, 11 nt, Human
aagccaaagaa

SEQ ID NO: 2248578 - RNA, 13 nt, Human
aagccaaagaaaa

SEQ ID NO: 2248579 - RNA, 20 nt, Human
aagccaaacucugccagcca

SEQ ID NO: 2248580 - RNA, 12 nt, Human
aagccaaagaaa

SEQ ID NO: 2248581 - RNA, 16 nt, Human
aagccaaacucugcca

SEQ ID NO: 2248582 - RNA, 15 nt, Human
aagccaaacucugcc

SEQ ID NO: 2248583 - RNA, 14 nt, Human
aagccaaacucugc

SEQ ID NO: 2248584 - RNA, 17 nt, Human
aagccaaaccucuguga

SEQ ID NO: 2248585 - RNA, 9 nt, Human
aagagccau

SEQ ID NO: 2248586 - RNA, 19 nt, Human
aagagccauauaaguuuga

SEQ ID NO: 2248587 - RNA, 20 nt, Human
aagagccauauaaguuugaa

SEQ ID NO: 2248588 - RNA, 23 nt, Human
aagaggaaugaaguacucauaca

SEQ ID NO: 2248589 - RNA, 21 nt, Human
aagaggaguuucgagguagag

SEQ ID NO: 2248590 - RNA, 16 nt, Human
aagaggaucggaggcu

SEQ ID NO: 2248591 - RNA, 20 nt, Human
aagaggaguuucgagguaga

SEQ ID NO: 2248592 - RNA, 22 nt, Human
aagaggacauaaugggguccug

SEQ ID NO: 2248593 - RNA, 22 nt, Human
aagaggagagaggaagcucucu

SEQ ID NO: 2248594 - RNA, 17 nt, Human
guggccgcccaaggccc

SEQ ID NO: 2248595 - RNA, 9 nt, Human
guggccuca

SEQ ID NO: 2248596 - RNA, 14 nt, Human
aagaggcaagaggc

SEQ ID NO: 2248597 - RNA, 22 nt, Human
guggcccugucccucccaccuc

SEQ ID NO: 2248598 - RNA, 23 nt, Human
guggcccugucccucccaccucu

SEQ ID NO: 2248599 - RNA, 11 nt, Human
guggcccuugc

SEQ ID NO: 2248600 - RNA, 24 nt, Human
guggccucugccccgucucaugag

SEQ ID NO: 2248601 - RNA, 13 nt, Human
guggccucugugg

SEQ ID NO: 2248602 - RNA, 20 nt, Human
guggccucugccccgucuca

SEQ ID NO: 2248603 - RNA, 23 nt, Human
guggccucuccuuguggccuggg

SEQ ID NO: 2248604 - RNA, 17 nt, Human
guggccucuugagcagu

SEQ ID NO: 2248605 - RNA, 20 nt, Human
guggccucuugagcaguggc

SEQ ID NO: 2248606 - RNA, 19 nt, Human
guggccucaacccucccuc

SEQ ID NO: 2248607 - RNA, 22 nt, Human
guggccucgggacaccugcccu

SEQ ID NO: 2248608 - RNA, 21 nt, Human
guggccucuccuuguggccug

SEQ ID NO: 2248609 - RNA, 22 nt, Human
guggccucuccuuguggccugg

SEQ ID NO: 2248610 - RNA, 21 nt, Human
guggccucccaacucacccca

SEQ ID NO: 2248611 - RNA, 22 nt, Human
guggccucccaacucaccccag

SEQ ID NO: 2248612 - RNA, 20 nt, Human
guggccuggccaggagcucu

SEQ ID NO: 2248613 - RNA, 18 nt, Human
guggccuggccaggagcu

SEQ ID NO: 2248614 - RNA, 16 nt, Human
guggccuggccaggag

SEQ ID NO: 2248615 - RNA, 13 nt, Human
guggccuggccag

SEQ ID NO: 2248616 - RNA, 12 nt, Human
guggccuggcca

SEQ ID NO: 2248617 - RNA, 19 nt, Human
guggccucuuugucuaaaa

SEQ ID NO: 2248618 - RNA, 16 nt, Human
guggccucuuugucua

SEQ ID NO: 2248619 - RNA, 13 nt, Human
guggccucuuugu

SEQ ID NO: 2248620 - RNA, 21 nt, Human
guggccucuugagcaguggcu

SEQ ID NO: 2248621 - RNA, 14 nt, Human
guggccugggcaag

SEQ ID NO: 2248622 - RNA, 12 nt, Human
guggccugggca

SEQ ID NO: 2248623 - RNA, 21 nt, Human
guggccuggccaggagcucuu

SEQ ID NO: 2248624 - RNA, 12 nt, Human
guggccugggcc

SEQ ID NO: 2248625 - RNA, 15 nt, Human
guggccugggccucc

SEQ ID NO: 2248626 - RNA, 15 nt, Human
guggccuguggccug

SEQ ID NO: 2248627 - RNA, 16 nt, Human
guggccuguggccugu

SEQ ID NO: 2248628 - RNA, 19 nt, Human
guggccuuccccagccucu

SEQ ID NO: 2248629 - RNA, 15 nt, Human
guggccuuccccagc

SEQ ID NO: 2248630 - RNA, 17 nt, Human
guggccuuccccagccu

SEQ ID NO: 2248631 - RNA, 12 nt, Human
guggccuucccc

SEQ ID NO: 2248632 - RNA, 17 nt, Human
guggccugugucccaug

SEQ ID NO: 2248633 - RNA, 19 nt, Human
guggccugugucccaugac

SEQ ID NO: 2248634 - RNA, 20 nt, Human
guggcgacucuauagacucu

SEQ ID NO: 2248635 - RNA, 22 nt, Human
guggcgcagcauauucaggaag

SEQ ID NO: 2248636 - RNA, 20 nt, Human
guggccuuccccagccucuu

SEQ ID NO: 2248637 - RNA, 13 nt, Human
gugggaagggaga

SEQ ID NO: 2248638 - RNA, 14 nt, Human
gugggaaggccagc

SEQ ID NO: 2248639 - RNA, 13 nt, Human
gugggaaggccag

SEQ ID NO: 2248640 - RNA, 17 nt, Human
gugggaagcgucugucc

SEQ ID NO: 2248641 - RNA, 13 nt, Human
gugggacacccug

SEQ ID NO: 2248642 - RNA, 14 nt, Human
gugggagcugccug

SEQ ID NO: 2248643 - RNA, 15 nt, Human
gugggacacccugug

SEQ ID NO: 2248644 - RNA, 18 nt, Human
guggggcugcuccuccag

SEQ ID NO: 2248645 - RNA, 17 nt, Human
gugggggaagaccuggc

SEQ ID NO: 2248646 - RNA, 12 nt, Human
guggggcuuggg

SEQ ID NO: 2248647 - RNA, 19 nt, Human
gugggggaagagcacagcc

SEQ ID NO: 2248648 - RNA, 21 nt, Human
gugggggaagagcacagcccu

SEQ ID NO: 2248649 - RNA, 22 nt, Human
gugggggaagagcacagcccuc

SEQ ID NO: 2248650 - RNA, 20 nt, Human
gugggggagagcaggcuggc

SEQ ID NO: 2248651 - RNA, 15 nt, Human
guggggucacucugg

SEQ ID NO: 2248652 - RNA, 20 nt, Human
guggggcugguagcucaggu

SEQ ID NO: 2248653 - RNA, 17 nt, Human
guggggcugcuccucca

SEQ ID NO: 2248654 - RNA, 16 nt, Human
guggggcugcuccucc

SEQ ID NO: 2248655 - RNA, 14 nt, Human
guggggcugcuccu

SEQ ID NO: 2248656 - RNA, 12 nt, Human
guggggcugcuc

SEQ ID NO: 2248657 - RNA, 15 nt, Human
guggggccuagaucc

SEQ ID NO: 2248658 - RNA, 13 nt, Human
guggggccuuggu

SEQ ID NO: 2248659 - RNA, 17 nt, Human
guggggcucgccaugcc

SEQ ID NO: 2248660 - RNA, 15 nt, Human
gugggagcugccugu

SEQ ID NO: 2248661 - RNA, 18 nt, Human
gugggagcugccuguuca

SEQ ID NO: 2248662 - RNA, 14 nt, Human
gugggaagggagag

SEQ ID NO: 2248663 - RNA, 17 nt, Human
guggggccgccgccucu

SEQ ID NO: 2248664 - RNA, 17 nt, Human
gugggaagggcuacacc

SEQ ID NO: 2248665 - RNA, 22 nt, Human
aagaccuuguguguauguguac

SEQ ID NO: 2248666 - RNA, 21 nt, Human
aagacgaggcccucgggccca

SEQ ID NO: 2248667 - RNA, 13 nt, Human
aagacgcugugcu

SEQ ID NO: 2248668 - RNA, 20 nt, Human
aagaccuucuccccauucug

SEQ ID NO: 2248669 - RNA, 18 nt, Human
aagaccuuguguguaugu

SEQ ID NO: 2248670 - RNA, 21 nt, Human
aagaccuuuggagcaaagcug

SEQ ID NO: 2248671 - RNA, 23 nt, Human
aagaccuugcuuaugauugcaga

SEQ ID NO: 2248672 - RNA, 15 nt, Human
aagacgcugugcugc

SEQ ID NO: 2248673 - RNA, 17 nt, Human
aagacgcugugcugccc

SEQ ID NO: 2248674 - RNA, 18 nt, Human
aagacgcugugcugcccu

SEQ ID NO: 2248675 - RNA, 19 nt, Human
aagacgcugugcugcccug

SEQ ID NO: 2248676 - RNA, 21 nt, Human
gugccuuaccuccugcccagg

SEQ ID NO: 2248677 - RNA, 22 nt, Human
aacuugagggcccagagcagga

SEQ ID NO: 2248678 - RNA, 20 nt, Human
gugccuuaccuccugcccag

SEQ ID NO: 2248679 - RNA, 19 nt, Human
gugccuuaccuccugccca

SEQ ID NO: 2248680 - RNA, 16 nt, Human
aacuugaggguaauaa

SEQ ID NO: 2248681 - RNA, 19 nt, Human
aacuugaggguaauaaacu

SEQ ID NO: 2248682 - RNA, 22 nt, Human
aacuugaggguaauaaacuuag

SEQ ID NO: 2248683 - RNA, 18 nt, Human
gugccuuaccuccugccc

SEQ ID NO: 2248684 - RNA, 17 nt, Human
gugccuuaccuccugcc

SEQ ID NO: 2248685 - RNA, 15 nt, Human
gugccuuaccuccug

SEQ ID NO: 2248686 - RNA, 14 nt, Human
gugccuuaccuccu

SEQ ID NO: 2248687 - RNA, 20 nt, Human
aacuugagggcccagagcag

SEQ ID NO: 2248688 - RNA, 15 nt, Human
aacuugcauggagca

SEQ ID NO: 2248689 - RNA, 21 nt, Human
aacuugcauccaacuccagga

SEQ ID NO: 2248690 - RNA, 22 nt, Human
aacuugcugcaguaugaaaaua

SEQ ID NO: 2248691 - RNA, 20 nt, Human
aacuugcugcaguaugaaaa

SEQ ID NO: 2248692 - RNA, 15 nt, Human
aagaccuucuccuuc

SEQ ID NO: 2248693 - RNA, 18 nt, Human
aagaccuucuccuucacc

SEQ ID NO: 2248694 - RNA, 19 nt, Human
aagaccuucuccuucaccu

SEQ ID NO: 2248695 - RNA, 23 nt, Human
aagagcaggcacauggaggagcu

SEQ ID NO: 2248696 - RNA, 16 nt, Human
aagagcagccuguggc

SEQ ID NO: 2248697 - RNA, 14 nt, Human
aagagcagccugug

SEQ ID NO: 2248698 - RNA, 12 nt, Human
aagacuuguuuu

SEQ ID NO: 2248699 - RNA, 13 nt, Human
aagagcagccugu

SEQ ID NO: 2248700 - RNA, 18 nt, Human
aagagcagccuguggcau

SEQ ID NO: 2248701 - RNA, 17 nt, Human
aagagcagccuguggca

SEQ ID NO: 2248702 - RNA, 19 nt, Human
aagagcagccuguggcauc

SEQ ID NO: 2248703 - RNA, 16 nt, Human
aagacuuggcaacaga

SEQ ID NO: 2248704 - RNA, 21 nt, Human
aagacuucaguauguugucaa

SEQ ID NO: 2248705 - RNA, 22 nt, Human
aagacuucaguauguugucaaa

SEQ ID NO: 2248706 - RNA, 16 nt, Human
aagacuuuggaaagac

SEQ ID NO: 2248707 - RNA, 17 nt, Human
aagacuuggcaacagaa

SEQ ID NO: 2248708 - RNA, 20 nt, Human
aagacuuggcaacagaagca

SEQ ID NO: 2248709 - RNA, 18 nt, Human
aagacuuggcaacagaag

SEQ ID NO: 2248710 - RNA, 19 nt, Human
aagacuuggcaacagaagc

SEQ ID NO: 2248711 - RNA, 20 nt, Human
aagacuagaggcuugcauaa

SEQ ID NO: 2248712 - RNA, 23 nt, Human
aagacugaguacguugugcauuu

SEQ ID NO: 2248713 - RNA, 16 nt, Human
aagacugcacaucaaa

SEQ ID NO: 2248714 - RNA, 17 nt, Human
aagacugcauuauauuu

SEQ ID NO: 2248715 - RNA, 23 nt, Human
aagacguguuuguguuugugugu

SEQ ID NO: 2248716 - RNA, 18 nt, Human
aagacgucccuuuuuucu

SEQ ID NO: 2248717 - RNA, 16 nt, Human
aagacuaauuuaaaaa

SEQ ID NO: 2248718 - RNA, 19 nt, Human
aagacuaauuuaaaaaaua

SEQ ID NO: 2248719 - RNA, 15 nt, Human
aagacguguuugugu

SEQ ID NO: 2248720 - RNA, 16 nt, Human
aagacguguuuguguu

SEQ ID NO: 2248721 - RNA, 23 nt, Human
aagacgugauuuugcuguagaag

SEQ ID NO: 2248722 - RNA, 16 nt, Human
aagacgugauuuugcu

SEQ ID NO: 2248723 - RNA, 22 nt, Human
aagacgugauuuugcuguagaa

SEQ ID NO: 2248724 - RNA, 14 nt, Human
aagacgccugagcu

SEQ ID NO: 2248725 - RNA, 15 nt, Human
aagacgccugagcuc

SEQ ID NO: 2248726 - RNA, 22 nt, Human
aagauggggucuguaaaaucuu

SEQ ID NO: 2248727 - RNA, 20 nt, Human
aagauggggucuguaaaauc

SEQ ID NO: 2248728 - RNA, 21 nt, Human
aagauggggucuguaaaaucu

SEQ ID NO: 2248729 - RNA, 13 nt, Human
aagauguagagga

SEQ ID NO: 2248730 - RNA, 17 nt, Human
aagaugggggcaagaag

SEQ ID NO: 2248731 - RNA, 15 nt, Human
aagauggggucugua

SEQ ID NO: 2248732 - RNA, 17 nt, Human
aagauggggucuguaaa

SEQ ID NO: 2248733 - RNA, 18 nt, Human
aagauggggucuguaaaa

SEQ ID NO: 2248734 - RNA, 19 nt, Human
aagauggggucuguaaaau

SEQ ID NO: 2248735 - RNA, 17 nt, Human
guguauuuacgcuuuga

SEQ ID NO: 2248736 - RNA, 21 nt, Human
guguauuuacgcuuugauuca

SEQ ID NO: 2248737 - RNA, 16 nt, Human
aagaugguauauuugg

SEQ ID NO: 2248738 - RNA, 14 nt, Human
aagaugggugggga

SEQ ID NO: 2248739 - RNA, 22 nt, Human
guguauuuauuuuccuccccag

SEQ ID NO: 2248740 - RNA, 14 nt, Human
guguauuugcuuuu

SEQ ID NO: 2248741 - RNA, 19 nt, Human
guguauuuccagugcaauu

SEQ ID NO: 2248742 - RNA, 21 nt, Human
guguauuuauuuuccucccca

SEQ ID NO: 2248743 - RNA, 19 nt, Human
guguauuuauuuuccuccc

SEQ ID NO: 2248744 - RNA, 23 nt, Human
gugucacuggcugccuccacucc

SEQ ID NO: 2248745 - RNA, 17 nt, Human
gugucacuuacuguuuc

SEQ ID NO: 2248746 - RNA, 19 nt, Human
gugucacuuacuguuucug

SEQ ID NO: 2248747 - RNA, 16 nt, Human
gugucagcauagaagu

SEQ ID NO: 2248748 - RNA, 17 nt, Human
gugucaaauaaacacug

SEQ ID NO: 2248749 - RNA, 15 nt, Human
gugucaacuucaaca

SEQ ID NO: 2248750 - RNA, 13 nt, Human
gugucacuggcug

SEQ ID NO: 2248751 - RNA, 14 nt, Human
gugucacuggcugc

SEQ ID NO: 2248752 - RNA, 15 nt, Human
gugucacuggcugcc

SEQ ID NO: 2248753 - RNA, 16 nt, Human
gugucacuggcugccu

SEQ ID NO: 2248754 - RNA, 17 nt, Human
gugucacuggcugccuc

SEQ ID NO: 2248755 - RNA, 18 nt, Human
gugucacuggcugccucc

SEQ ID NO: 2248756 - RNA, 19 nt, Human
gugucacuggcugccucca

SEQ ID NO: 2248757 - RNA, 23 nt, Human
guguauuuguauuuuuuugcaag

SEQ ID NO: 2248758 - RNA, 23 nt, Human
guguauuuuucaauaaagcauuu

SEQ ID NO: 2248759 - RNA, 16 nt, Human
gugucaaauaaacacu

SEQ ID NO: 2248760 - RNA, 19 nt, Human
gugucaaauaaacacugug

SEQ ID NO: 2248761 - RNA, 20 nt, Human
gugucaagagggucugagga

SEQ ID NO: 2248762 - RNA, 23 nt, Human
guguauuuuuuuacuaauagaca

SEQ ID NO: 2248763 - RNA, 17 nt, Human
guguauuuuuuuacuaa

SEQ ID NO: 2248764 - RNA, 17 nt, Human
guguggguaccuguauu

SEQ ID NO: 2248765 - RNA, 16 nt, Human
gugugggggcugcagc

SEQ ID NO: 2248766 - RNA, 14 nt, Human
gugugggucugugu

SEQ ID NO: 2248767 - RNA, 16 nt, Human
guguggguaccuguau

SEQ ID NO: 2248768 - RNA, 16 nt, Human
gugugguagagugugc

SEQ ID NO: 2248769 - RNA, 15 nt, Human
guguguauuguuccc

SEQ ID NO: 2248770 - RNA, 14 nt, Human
guguguauuaaaaa

SEQ ID NO: 2248771 - RNA, 20 nt, Human
guguguauuaaaaaaaacaa

SEQ ID NO: 2248772 - RNA, 11 nt, Human
guguguauuaa

SEQ ID NO: 2248773 - RNA, 13 nt, Human
guguguaugugua

SEQ ID NO: 2248774 - RNA, 15 nt, Human
guguguauguggggg

SEQ ID NO: 2248775 - RNA, 13 nt, Human
guguguauguggg

SEQ ID NO: 2248776 - RNA, 20 nt, Human
gugugugaaaaugugugugu

SEQ ID NO: 2248777 - RNA, 18 nt, Human
guguguccaaaacugccu

SEQ ID NO: 2248778 - RNA, 20 nt, Human
gugugucacccuuaggccag

SEQ ID NO: 2248779 - RNA, 13 nt, Human
guguccaaagcag

SEQ ID NO: 2248780 - RNA, 18 nt, Human
gugucauuuaugaaaaga

SEQ ID NO: 2248781 - RNA, 21 nt, Human
gugucaugauucacccccaaa

SEQ ID NO: 2248782 - RNA, 16 nt, Human
gugucaucagaagaua

SEQ ID NO: 2248783 - RNA, 20 nt, Human
gugucagguggggcagcuug

SEQ ID NO: 2248784 - RNA, 14 nt, Human
gugucaggcugcug

SEQ ID NO: 2248785 - RNA, 15 nt, Human
gugucaggcugcugg

SEQ ID NO: 2248786 - RNA, 18 nt, Human
gugucauaccaggccgcc

SEQ ID NO: 2248787 - RNA, 23 nt, Human
gugucauauauggggggccaaca

SEQ ID NO: 2248788 - RNA, 22 nt, Human
gugucaggcugcuggcgccucu

SEQ ID NO: 2248789 - RNA, 16 nt, Human
gugucaggcugcuggc

SEQ ID NO: 2248790 - RNA, 19 nt, Human
gugucaggcugcuggcgcc

SEQ ID NO: 2248791 - RNA, 17 nt, Human
guguccaagugugugug

SEQ ID NO: 2248792 - RNA, 19 nt, Human
guguccaaaggaagacgug

SEQ ID NO: 2248793 - RNA, 13 nt, Human
guguccaccuggc

SEQ ID NO: 2248794 - RNA, 13 nt, Human
gugugaaugaaca

SEQ ID NO: 2248795 - RNA, 14 nt, Human
gugugaaugaacac

SEQ ID NO: 2248796 - RNA, 22 nt, Human
gugugacaaggauugcuacugu

SEQ ID NO: 2248797 - RNA, 20 nt, Human
gugugacaucaguggcaugg

SEQ ID NO: 2248798 - RNA, 15 nt, Human
gugugaaugaacacu

SEQ ID NO: 2248799 - RNA, 15 nt, Human
gugugacaucagugg

SEQ ID NO: 2248800 - RNA, 21 nt, Human
gugugaccacugcagaagaca

SEQ ID NO: 2248801 - RNA, 23 nt, Human
aagaugaaggagaggcaacaucc

SEQ ID NO: 2248802 - RNA, 13 nt, Human
aagaugacauugc

SEQ ID NO: 2248803 - RNA, 15 nt, Human
aagaugaaucaaugg

SEQ ID NO: 2248804 - RNA, 13 nt, Human
aagaugacacaag

SEQ ID NO: 2248805 - RNA, 14 nt, Human
aagaugaagaggau

SEQ ID NO: 2248806 - RNA, 16 nt, Human
aagaugcuucucacug

SEQ ID NO: 2248807 - RNA, 17 nt, Human
aagaugcuucucacugc

SEQ ID NO: 2248808 - RNA, 19 nt, Human
aagaugcuucucacugcca

SEQ ID NO: 2248809 - RNA, 18 nt, Human
aagauggcugugccucug

SEQ ID NO: 2248810 - RNA, 20 nt, Human
aagauggcugugccucugcc

SEQ ID NO: 2248811 - RNA, 21 nt, Human
aagauggcugugccucugccu

SEQ ID NO: 2248812 - RNA, 21 nt, Human
aagaugggaacgcagaugauc

SEQ ID NO: 2248813 - RNA, 18 nt, Human
aagaugggcagcuaguuc

SEQ ID NO: 2248814 - RNA, 23 nt, Human
aagauggcugugccucugccugu

SEQ ID NO: 2248815 - RNA, 23 nt, Human
aagaucugcagggggugugucug

SEQ ID NO: 2248816 - RNA, 17 nt, Human
aagaucuguccucagcc

SEQ ID NO: 2248817 - RNA, 14 nt, Human
aagaucguuaguau

SEQ ID NO: 2248818 - RNA, 18 nt, Human
aagaucucagugguuaag

SEQ ID NO: 2248819 - RNA, 14 nt, Human
aagaugaaaauauu

SEQ ID NO: 2248820 - RNA, 13 nt, Human
aagaugaaaauau

SEQ ID NO: 2248821 - RNA, 16 nt, Human
aagaucguucucugcc

SEQ ID NO: 2248822 - RNA, 17 nt, Human
aagaucguucucugccu

SEQ ID NO: 2248823 - RNA, 16 nt, Human
aagaucgcccccaccu

SEQ ID NO: 2248824 - RNA, 20 nt, Human
aagaucgcgccacugcacuc

SEQ ID NO: 2248825 - RNA, 18 nt, Human
aagaguagcauuucauuc

SEQ ID NO: 2248826 - RNA, 19 nt, Human
aagaguagcauuucauucu

SEQ ID NO: 2248827 - RNA, 16 nt, Human
aagaucgaauuuuuca

SEQ ID NO: 2248828 - RNA, 13 nt, Human
aagaguaggaaga

SEQ ID NO: 2248829 - RNA, 14 nt, Human
aagaguaggaagac

SEQ ID NO: 2248830 - RNA, 21 nt, Human
aagaguagcaaguucuagaga

SEQ ID NO: 2248831 - RNA, 23 nt, Human
aagaguagcaaguucuagagaag

SEQ ID NO: 2248832 - RNA, 14 nt, Human
aagaguagcauuuc

SEQ ID NO: 2248833 - RNA, 17 nt, Human
aagaguagcauuucauu

SEQ ID NO: 2248834 - RNA, 14 nt, Human
aagaggcugaggca

SEQ ID NO: 2248835 - RNA, 21 nt, Human
aagaggcugauaauuccagug

SEQ ID NO: 2248836 - RNA, 22 nt, Human
aagaggcugaggcuggcacagg

SEQ ID NO: 2248837 - RNA, 18 nt, Human
aagaggcugaggccugga

SEQ ID NO: 2248838 - RNA, 20 nt, Human
aagaggcugaggccuggacu

SEQ ID NO: 2248839 - RNA, 14 nt, Human
aagaggcugcagcc

SEQ ID NO: 2248840 - RNA, 23 nt, Human
aagagggagggagggcuccagac

SEQ ID NO: 2248841 - RNA, 16 nt, Human
aagagggcacacacug

SEQ ID NO: 2248842 - RNA, 17 nt, Human
aagagggcacacacugu

SEQ ID NO: 2248843 - RNA, 19 nt, Human
aagaggggaccagaagcca

SEQ ID NO: 2248844 - RNA, 11 nt, Human
aagaggggcag

SEQ ID NO: 2248845 - RNA, 13 nt, Human
aagaggggcagcc

SEQ ID NO: 2248846 - RNA, 15 nt, Human
aagaggggcagcccu

SEQ ID NO: 2248847 - RNA, 12 nt, Human
aagagggccugu

SEQ ID NO: 2248848 - RNA, 14 nt, Human
aagagggccugugg

SEQ ID NO: 2248849 - RNA, 19 nt, Human
aagagggccugugggagcc

SEQ ID NO: 2248850 - RNA, 13 nt, Human
aagaggggacagg

SEQ ID NO: 2248851 - RNA, 15 nt, Human
aagaggggcugggcu

SEQ ID NO: 2248852 - RNA, 16 nt, Human
aagaggggcagcccuu

SEQ ID NO: 2248853 - RNA, 16 nt, Human
aagaggggguggaggg

SEQ ID NO: 2248854 - RNA, 12 nt, Human
aagaguaggaag

SEQ ID NO: 2248855 - RNA, 15 nt, Human
aagaguagaauugca

SEQ ID NO: 2248856 - RNA, 15 nt, Human
aagagggguggagac

SEQ ID NO: 2248857 - RNA, 13 nt, Human
aagaguagacauu

SEQ ID NO: 2248858 - RNA, 20 nt, Human
aagaguagaaacugcaggga

SEQ ID NO: 2248859 - RNA, 13 nt, Human
aagagggggugga

SEQ ID NO: 2248860 - RNA, 14 nt, Human
aagagggguggaga

SEQ ID NO: 2248861 - RNA, 22 nt, Human
guggggucucccucuccugccu

SEQ ID NO: 2248862 - RNA, 21 nt, Human
guggggucucccucuccugcc

SEQ ID NO: 2248863 - RNA, 19 nt, Human
guggggucucccucuccug

SEQ ID NO: 2248864 - RNA, 17 nt, Human
guggggucucccucucc

SEQ ID NO: 2248865 - RNA, 14 nt, Human
guggggucucccuc

SEQ ID NO: 2248866 - RNA, 19 nt, Human
guggggucaugcccuccuc

SEQ ID NO: 2248867 - RNA, 21 nt, Human
guggggucaugcccuccucuc

SEQ ID NO: 2248868 - RNA, 15 nt, Human
guggggucaugcccu

SEQ ID NO: 2248869 - RNA, 20 nt, Human
guggggguggaggcuuccug

SEQ ID NO: 2248870 - RNA, 19 nt, Human
gugggguagguugggagaa

SEQ ID NO: 2248871 - RNA, 13 nt, Human
aagaggcugaggc

SEQ ID NO: 2248872 - RNA, 22 nt, Human
aagaggcgggccagccaggcgg

SEQ ID NO: 2248873 - RNA, 15 nt, Human
aagaggcugaggccu

SEQ ID NO: 2248874 - RNA, 18 nt, Human
aagaggcugaaagaggcc

SEQ ID NO: 2248875 - RNA, 16 nt, Human
aagaggcugaaagagg

SEQ ID NO: 2248876 - RNA, 15 nt, Human
aagaggcgggccagc

SEQ ID NO: 2248877 - RNA, 17 nt, Human
aagaggcgggccagcca

SEQ ID NO: 2248878 - RNA, 18 nt, Human
aagaggcgggccagccag

SEQ ID NO: 2248879 - RNA, 20 nt, Human
aagaggcgggccagccaggc

SEQ ID NO: 2248880 - RNA, 21 nt, Human
aagaggcgggccagccaggcg

SEQ ID NO: 2248881 - RNA, 19 nt, Human
aagaggcgucuguauauuu

SEQ ID NO: 2248882 - RNA, 17 nt, Human
guggggucacucuggca

SEQ ID NO: 2248883 - RNA, 20 nt, Human
guggggucacucuggcagcu

SEQ ID NO: 2248884 - RNA, 21 nt, Human
guggggucacucuggcagcuc

SEQ ID NO: 2248885 - RNA, 22 nt, Human
guggggucacucuggcagcuca

SEQ ID NO: 2248886 - RNA, 12 nt, Human
uaaaauacuauu

SEQ ID NO: 2248887 - RNA, 15 nt, Human
uaaaauacuauuuuu

SEQ ID NO: 2248888 - RNA, 20 nt, Human
uaaaauacuauuuuuacugc

SEQ ID NO: 2248889 - RNA, 21 nt, Human
uaaaauacuauuuuuacugcc

SEQ ID NO: 2248890 - RNA, 17 nt, Human
uaaaauagaaauaagug

SEQ ID NO: 2248891 - RNA, 20 nt, Human
uaaaauagauaaauaaauau

SEQ ID NO: 2248892 - RNA, 18 nt, Human
uaaaauaucuuuugaccu

SEQ ID NO: 2248893 - RNA, 19 nt, Human
uaaaauaugaagacauaaa

SEQ ID NO: 2248894 - RNA, 16 nt, Human
uaaaauaauucuaaag

SEQ ID NO: 2248895 - RNA, 17 nt, Human
uaaaauaauucuaaagg

SEQ ID NO: 2248896 - RNA, 20 nt, Human
uaaaauaauuuuuauauuug

SEQ ID NO: 2248897 - RNA, 22 nt, Human
uaaaauaccagccaguaaaugg

SEQ ID NO: 2248898 - RNA, 13 nt, Human
uaaaagacuuuuu

SEQ ID NO: 2248899 - RNA, 22 nt, Human
uaaaagugggcuugauucugca

SEQ ID NO: 2248900 - RNA, 23 nt, Human
uaaaagacacuguuuacaagaaa

SEQ ID NO: 2248901 - RNA, 15 nt, Human
uaaaagacaagacuu

SEQ ID NO: 2248902 - RNA, 20 nt, Human
uaaaagacaaaucaaagcag

SEQ ID NO: 2248903 - RNA, 22 nt, Human
uaaaagacaaaucaaagcagau

SEQ ID NO: 2248904 - RNA, 20 nt, Human
uaaaagacagugaaagaaaa

SEQ ID NO: 2248905 - RNA, 17 nt, Human
uaaaaguuauuaauauu

SEQ ID NO: 2248906 - RNA, 12 nt, Human
uaaaaguuacuu

SEQ ID NO: 2248907 - RNA, 18 nt, Human
uaaaagugugagcaguga

SEQ ID NO: 2248908 - RNA, 23 nt, Human
uaaaagugggcuugauucugcag

SEQ ID NO: 2248909 - RNA, 14 nt, Human
uaaaagugugagca

SEQ ID NO: 2248910 - RNA, 14 nt, Human
uaaaaguugugauu

SEQ ID NO: 2248911 - RNA, 15 nt, Human
uaaaaguugugauuc

SEQ ID NO: 2248912 - RNA, 21 nt, Human
uaaaaguugugauuccagaua

SEQ ID NO: 2248913 - RNA, 13 nt, Human
uaaaaguuucaau

SEQ ID NO: 2248914 - RNA, 15 nt, Human
uaaaaguuucaaugu

SEQ ID NO: 2248915 - RNA, 18 nt, Human
uaaaaguuucaaugugau

SEQ ID NO: 2248916 - RNA, 21 nt, Human
uaaaauaaaaauucugaaugu

SEQ ID NO: 2248917 - RNA, 15 nt, Human
uaaaauaaugggauu

SEQ ID NO: 2248918 - RNA, 15 nt, Human
uaaaauaauucuaaa

SEQ ID NO: 2248919 - RNA, 19 nt, Human
uaaaaguuucaaugugauu

SEQ ID NO: 2248920 - RNA, 17 nt, Human
uaaaauaaaauaaaaau

SEQ ID NO: 2248921 - RNA, 12 nt, Human
aagugccuuaau

SEQ ID NO: 2248922 - RNA, 19 nt, Human
aagugccccugcugccucc

SEQ ID NO: 2248923 - RNA, 14 nt, Human
aagugaucaauaaa

SEQ ID NO: 2248924 - RNA, 22 nt, Human
aagugaucaauaaaaugugauu

SEQ ID NO: 2248925 - RNA, 23 nt, Human
aagugccccugcugccuccccaa

SEQ ID NO: 2248926 - RNA, 22 nt, Human
aagugccccugcugccucccca

SEQ ID NO: 2248927 - RNA, 21 nt, Human
aagugauucucaugccucagc

SEQ ID NO: 2248928 - RNA, 19 nt, Human
aagugauucuccugccuca

SEQ ID NO: 2248929 - RNA, 15 nt, Human
aagugauucuccugc

SEQ ID NO: 2248930 - RNA, 16 nt, Human
aagugauucuccugcc

SEQ ID NO: 2248931 - RNA, 17 nt, Human
aagugauucuccugccu

SEQ ID NO: 2248932 - RNA, 18 nt, Human
aagugauucuccugccuc

SEQ ID NO: 2248933 - RNA, 17 nt, Human
aagugagcuuugcugcu

SEQ ID NO: 2248934 - RNA, 18 nt, Human
aagugagcuuugcugcua

SEQ ID NO: 2248935 - RNA, 21 nt, Human
aagugagcuuugcugcuacag

SEQ ID NO: 2248936 - RNA, 16 nt, Human
aagugaggaugaaaaa

SEQ ID NO: 2248937 - RNA, 18 nt, Human
aagugagggucagagagg

SEQ ID NO: 2248938 - RNA, 11 nt, Human
aagugaggaag

SEQ ID NO: 2248939 - RNA, 22 nt, Human
aagugagggccgagugagagcg

SEQ ID NO: 2248940 - RNA, 15 nt, Human
aagugauaauuucug

SEQ ID NO: 2248941 - RNA, 20 nt, Human
aagugauucucaugccucag

SEQ ID NO: 2248942 - RNA, 20 nt, Human
uaaaauaugaagacauaaac

SEQ ID NO: 2248943 - RNA, 14 nt, Human
uaaaauauggcuau

SEQ ID NO: 2248944 - RNA, 13 nt, Human
uaaaauauuccug

SEQ ID NO: 2248945 - RNA, 22 nt, Human
uaaaauauuccugcauuuguga

SEQ ID NO: 2248946 - RNA, 15 nt, Human
uaaaauauuuaucug

SEQ ID NO: 2248947 - RNA, 18 nt, Human
uaaaauauggcuauaaau

SEQ ID NO: 2248948 - RNA, 12 nt, Human
uaaaauauuuau

SEQ ID NO: 2248949 - RNA, 13 nt, Human
uaaaacuuuaauc

SEQ ID NO: 2248950 - RNA, 13 nt, Human
uaaaacuuuccuc

SEQ ID NO: 2248951 - RNA, 13 nt, Human
uaaaacuugcugc

SEQ ID NO: 2248952 - RNA, 18 nt, Human
uaaaacuaaauagcaugu

SEQ ID NO: 2248953 - RNA, 20 nt, Human
uaaaacuaaauagcauguau

SEQ ID NO: 2248954 - RNA, 22 nt, Human
uaaaacuugauguguuaucucu

SEQ ID NO: 2248955 - RNA, 20 nt, Human
uaaaacuugauguguuaucu

SEQ ID NO: 2248956 - RNA, 20 nt, Human
uaaaagaaugggcaguuaca

SEQ ID NO: 2248957 - RNA, 15 nt, Human
uaaaacuuuccucgc

SEQ ID NO: 2248958 - RNA, 17 nt, Human
uaaaacuuuccucgccu

SEQ ID NO: 2248959 - RNA, 12 nt, Human
uaaaagaauugu

SEQ ID NO: 2248960 - RNA, 21 nt, Human
uaaaagaaugggcaguuacau

SEQ ID NO: 2248961 - RNA, 11 nt, Human
uaaaagacaaa

SEQ ID NO: 2248962 - RNA, 12 nt, Human
uaaaagacaaau

SEQ ID NO: 2248963 - RNA, 12 nt, Human
uaaaagaaugau

SEQ ID NO: 2248964 - RNA, 23 nt, Human
uaaaagaauauuuuaacuuccuu

SEQ ID NO: 2248965 - RNA, 21 nt, Human
uaaaaccuuucaaauuucaca

SEQ ID NO: 2248966 - RNA, 20 nt, Human
uaaaaccuuucaaauuucac

SEQ ID NO: 2248967 - RNA, 16 nt, Human
uaaaaccuuucaaauu

SEQ ID NO: 2248968 - RNA, 14 nt, Human
uaaaaccuuucaaa

SEQ ID NO: 2248969 - RNA, 10 nt, Human
uaaaacuaaa

SEQ ID NO: 2248970 - RNA, 15 nt, Human
uaaaacuaaauagca

SEQ ID NO: 2248971 - RNA, 19 nt, Human
uaaaaccccaucucuacua

SEQ ID NO: 2248972 - RNA, 20 nt, Human
uaaaaaucuaccuucuguag

SEQ ID NO: 2248973 - RNA, 21 nt, Human
uaaaaccccagccaacucauu

SEQ ID NO: 2248974 - RNA, 15 nt, Human
uaaaaccugucaaug

SEQ ID NO: 2248975 - RNA, 13 nt, Human
uaaaaccuuucaa

SEQ ID NO: 2248976 - RNA, 11 nt, Human
uaaaaccuuuc

SEQ ID NO: 2248977 - RNA, 10 nt, Human
uaaaaccuuu

SEQ ID NO: 2248978 - RNA, 18 nt, Human
uaaaaccugagcuagaag

SEQ ID NO: 2248979 - RNA, 16 nt, Human
uaaaaccugucaauga

SEQ ID NO: 2248980 - RNA, 17 nt, Human
uaaaaaucauugauugu

SEQ ID NO: 2248981 - RNA, 15 nt, Human
uaaaaaucauaguac

SEQ ID NO: 2248982 - RNA, 20 nt, Human
uaaaaaucauaaacugugug

SEQ ID NO: 2248983 - RNA, 19 nt, Human
uaaaaaucuaccuucugua

SEQ ID NO: 2248984 - RNA, 19 nt, Human
uaaaacccauuuaaauuuu

SEQ ID NO: 2248985 - RNA, 21 nt, Human
uaaaaaucucaaauuucuaaa

SEQ ID NO: 2248986 - RNA, 20 nt, Human
uaaaaaucucaaauuucuaa

SEQ ID NO: 2248987 - RNA, 19 nt, Human
uaaaaaucucaaauuucua

SEQ ID NO: 2248988 - RNA, 15 nt, Human
guuuuucuucucccu

SEQ ID NO: 2248989 - RNA, 23 nt, Human
guuuuucuucaacaucaauguuc

SEQ ID NO: 2248990 - RNA, 22 nt, Human
guuuuucuucaacaucaauguu

SEQ ID NO: 2248991 - RNA, 12 nt, Human
guuuuucuucaa

SEQ ID NO: 2248992 - RNA, 21 nt, Human
guuuuucuuaaauaauaaaga

SEQ ID NO: 2248993 - RNA, 15 nt, Human
uaaaaaguggaaaaa

SEQ ID NO: 2248994 - RNA, 19 nt, Human
guuuuugaaggcagaaagc

SEQ ID NO: 2248995 - RNA, 14 nt, Human
guuuuugaaacaga

SEQ ID NO: 2248996 - RNA, 17 nt, Human
guuuuugaaacagaacc

SEQ ID NO: 2248997 - RNA, 20 nt, Human
guuuuugaaggcagaaagca

SEQ ID NO: 2248998 - RNA, 18 nt, Human
guuuuugauagcuuuauu

SEQ ID NO: 2248999 - RNA, 9 nt, Human
uaaaaaguu

SEQ ID NO: 2249000 - RNA, 15 nt, Human
uaaaaaguuaaaaag

SEQ ID NO: 2249001 - RNA, 13 nt, Human
uaaaaaguuaaaa

SEQ ID NO: 2249002 - RNA, 12 nt, Human
uaaaaaguuaaa

SEQ ID NO: 2249003 - RNA, 11 nt, Human
uaaaaaguuaa

SEQ ID NO: 2249004 - RNA, 18 nt, Human
uaaaaauaaaaaacacug

SEQ ID NO: 2249005 - RNA, 19 nt, Human
uaaaaauaaaaaacacugg

SEQ ID NO: 2249006 - RNA, 17 nt, Human
uaaaaauaaauuugguu

SEQ ID NO: 2249007 - RNA, 14 nt, Human
uaaaaauaaauuca

SEQ ID NO: 2249008 - RNA, 17 nt, Human
uaaaaaguuaaaaaguu

SEQ ID NO: 2249009 - RNA, 20 nt, Human
uaaaaaguuuuaguuuugau

SEQ ID NO: 2249010 - RNA, 21 nt, Human
uaaaaauaaaaaacacuggga

SEQ ID NO: 2249011 - RNA, 17 nt, Human
uaaaaaucauaaacugu

SEQ ID NO: 2249012 - RNA, 11 nt, Human
uaaaaaucaua

SEQ ID NO: 2249013 - RNA, 15 nt, Human
uaaaaaucucaaauu

SEQ ID NO: 2249014 - RNA, 17 nt, Human
uaaaaaucucaaauuuc

SEQ ID NO: 2249015 - RNA, 16 nt, Human
uaaaaaucucaaauuu

SEQ ID NO: 2249016 - RNA, 14 nt, Human
aaguauuucccagc

SEQ ID NO: 2249017 - RNA, 22 nt, Human
aaguauuuucauaaguauuuca

SEQ ID NO: 2249018 - RNA, 17 nt, Human
aaguauuuucauaagua

SEQ ID NO: 2249019 - RNA, 21 nt, Human
aagucaugcguuuaaucacau

SEQ ID NO: 2249020 - RNA, 14 nt, Human
aaguauuuuccugu

SEQ ID NO: 2249021 - RNA, 15 nt, Human
aaguauuuuccugua

SEQ ID NO: 2249022 - RNA, 18 nt, Human
aaguauuuuccuguaaaa

SEQ ID NO: 2249023 - RNA, 23 nt, Human
aaguauuuauauauuuauaacuc

SEQ ID NO: 2249024 - RNA, 22 nt, Human
aaguauuuauauauuuauaacu

SEQ ID NO: 2249025 - RNA, 21 nt, Human
aaguauuuauauauuuauaac

SEQ ID NO: 2249026 - RNA, 20 nt, Human
aaguauuuauauauuuauaa

SEQ ID NO: 2249027 - RNA, 13 nt, Human
aaguauuugggaa

SEQ ID NO: 2249028 - RNA, 22 nt, Human
aaguauuucaaauuggagcuuc

SEQ ID NO: 2249029 - RNA, 21 nt, Human
aaguauuucaaauuggagcuu

SEQ ID NO: 2249030 - RNA, 13 nt, Human
aaguauuucaaau

SEQ ID NO: 2249031 - RNA, 14 nt, Human
aagucaugugcauu

SEQ ID NO: 2249032 - RNA, 15 nt, Human
aagucaugugcauuu

SEQ ID NO: 2249033 - RNA, 12 nt, Human
aagucauguucc

SEQ ID NO: 2249034 - RNA, 20 nt, Human
aagucaugcaaaggcuggga

SEQ ID NO: 2249035 - RNA, 15 nt, Human
aagucauggcugugc

SEQ ID NO: 2249036 - RNA, 16 nt, Human
aagucauuuuaacuuu

SEQ ID NO: 2249037 - RNA, 20 nt, Human
aagucauuggcuuuauccuc

SEQ ID NO: 2249038 - RNA, 13 nt, Human
aagucauuggcuu

SEQ ID NO: 2249039 - RNA, 22 nt, Human
aagucuuauauauuguagauaa

SEQ ID NO: 2249040 - RNA, 14 nt, Human
aagucuuuuguucg

SEQ ID NO: 2249041 - RNA, 16 nt, Human
aagucuuucacauuua

SEQ ID NO: 2249042 - RNA, 22 nt, Human
aagucuucccugaucaagucac

SEQ ID NO: 2249043 - RNA, 18 nt, Human
aagucuucccugaucaag

SEQ ID NO: 2249044 - RNA, 20 nt, Human
aagucuucacucucugaaga

SEQ ID NO: 2249045 - RNA, 16 nt, Human
aagucuuaucaagcag

SEQ ID NO: 2249046 - RNA, 17 nt, Human
aagucuuaucaagcagc

SEQ ID NO: 2249047 - RNA, 22 nt, Human
aagucauuuuaacuuuaucaca

SEQ ID NO: 2249048 - RNA, 21 nt, Human
aaguccaaauguuuacaggga

SEQ ID NO: 2249049 - RNA, 20 nt, Human
aagucauuuuaacuuuauca

SEQ ID NO: 2249050 - RNA, 18 nt, Human
aagucauuuuaacuuuau

SEQ ID NO: 2249051 - RNA, 12 nt, Human
aagucuucaggg

SEQ ID NO: 2249052 - RNA, 19 nt, Human
guuuuuccuguucuuaaga

SEQ ID NO: 2249053 - RNA, 22 nt, Human
aagugagacaguccagccugga

SEQ ID NO: 2249054 - RNA, 19 nt, Human
guuuuuccuuguauuuaaa

SEQ ID NO: 2249055 - RNA, 20 nt, Human
guuuuucuuaaauaauaaag

SEQ ID NO: 2249056 - RNA, 14 nt, Human
guuuuuccuuuaaa

SEQ ID NO: 2249057 - RNA, 15 nt, Human
guuuuuccuuuaaaa

SEQ ID NO: 2249058 - RNA, 14 nt, Human
guuuuucaguuuuc

SEQ ID NO: 2249059 - RNA, 18 nt, Human
aagugaagguuuacaauu

SEQ ID NO: 2249060 - RNA, 20 nt, Human
aagugagacaguccagccug

SEQ ID NO: 2249061 - RNA, 18 nt, Human
guuuuuccacuacugcua

SEQ ID NO: 2249062 - RNA, 17 nt, Human
guuuuuccacuacugcu

SEQ ID NO: 2249063 - RNA, 16 nt, Human
guuuuuccacuacugc

SEQ ID NO: 2249064 - RNA, 15 nt, Human
guuuuuccacuacug

SEQ ID NO: 2249065 - RNA, 15 nt, Human
aagugagagcugggu

SEQ ID NO: 2249066 - RNA, 15 nt, Human
guuuuucauaaagca

SEQ ID NO: 2249067 - RNA, 14 nt, Human
aagugagagcuggg

SEQ ID NO: 2249068 - RNA, 12 nt, Human
aagugagagagg

SEQ ID NO: 2249069 - RNA, 10 nt, Human
aagugaaggu

SEQ ID NO: 2249070 - RNA, 17 nt, Human
aagugaagguuuacaau

SEQ ID NO: 2249071 - RNA, 22 nt, Human
aagugaagguuuacaauuuaca

SEQ ID NO: 2249072 - RNA, 15 nt, Human
aagugagacagucca

SEQ ID NO: 2249073 - RNA, 16 nt, Human
aagugaacacuagcca

SEQ ID NO: 2249074 - RNA, 16 nt, Human
aagugaagaaaaguga

SEQ ID NO: 2249075 - RNA, 16 nt, Human
aagugaagacuggaag

SEQ ID NO: 2249076 - RNA, 13 nt, Human
aagugaagacugg

SEQ ID NO: 2249077 - RNA, 19 nt, Human
aagugaagacaaugacuua

SEQ ID NO: 2249078 - RNA, 17 nt, Human
aagugaagacaaugacu

SEQ ID NO: 2249079 - RNA, 21 nt, Human
aagugaaaaaggaggaagaga

SEQ ID NO: 2249080 - RNA, 18 nt, Human
aagucuuuuguucgcaug

SEQ ID NO: 2249081 - RNA, 16 nt, Human
aagucuuuuuugauca

SEQ ID NO: 2249082 - RNA, 16 nt, Human
aagugaaaucaaaggu

SEQ ID NO: 2249083 - RNA, 21 nt, Human
aaguaauccaccugccucggc

SEQ ID NO: 2249084 - RNA, 20 nt, Human
guuuuggcaaacgcuaaaga

SEQ ID NO: 2249085 - RNA, 16 nt, Human
guuuuggggacucauu

SEQ ID NO: 2249086 - RNA, 23 nt, Human
guuuuggcugaaauucuccugga

SEQ ID NO: 2249087 - RNA, 20 nt, Human
guuuuggcugaaauucuccu

SEQ ID NO: 2249088 - RNA, 22 nt, Human
guuuuggcugaaauucuccugg

SEQ ID NO: 2249089 - RNA, 16 nt, Human
guuuugcuguuuccuu

SEQ ID NO: 2249090 - RNA, 19 nt, Human
guuuugcuauuagacugua

SEQ ID NO: 2249091 - RNA, 13 nt, Human
guuuugcacuuuu

SEQ ID NO: 2249092 - RNA, 14 nt, Human
guuuugccaacauu

SEQ ID NO: 2249093 - RNA, 16 nt, Human
guuuugccaacauugc

SEQ ID NO: 2249094 - RNA, 16 nt, Human
guuuuggaagcucuga

SEQ ID NO: 2249095 - RNA, 18 nt, Human
guuuugcuuuuucugacu

SEQ ID NO: 2249096 - RNA, 18 nt, Human
aaguacacuguuucaaac

SEQ ID NO: 2249097 - RNA, 13 nt, Human
aaguacacuguuu

SEQ ID NO: 2249098 - RNA, 14 nt, Human
aaguaaugauaacu

SEQ ID NO: 2249099 - RNA, 19 nt, Human
aaguaaugauaacuggaaa

SEQ ID NO: 2249100 - RNA, 21 nt, Human
guuucugcccacauuggaccc

SEQ ID NO: 2249101 - RNA, 15 nt, Human
guuucugccgcagcc

SEQ ID NO: 2249102 - RNA, 20 nt, Human
guuucugaguuccugcaugc

SEQ ID NO: 2249103 - RNA, 14 nt, Human
guuucugcaguagu

SEQ ID NO: 2249104 - RNA, 20 nt, Human
guuucugcaguagucucugu

SEQ ID NO: 2249105 - RNA, 22 nt, Human
guuucugcaguagucucugugc

SEQ ID NO: 2249106 - RNA, 14 nt, Human
guuucugccgcagc

SEQ ID NO: 2249107 - RNA, 16 nt, Human
guuuugccauguuggc

SEQ ID NO: 2249108 - RNA, 20 nt, Human
guuuugccauguuggccagg

SEQ ID NO: 2249109 - RNA, 21 nt, Human
guuuugccauguuggccaggc

SEQ ID NO: 2249110 - RNA, 22 nt, Human
guuuugccauguuggccaggcu

SEQ ID NO: 2249111 - RNA, 21 nt, Human
aaguaaugaauuuuuaugaua

SEQ ID NO: 2249112 - RNA, 18 nt, Human
aaguaaucccgccaccua

SEQ ID NO: 2249113 - RNA, 16 nt, Human
aaguaauccuagggaa

SEQ ID NO: 2249114 - RNA, 23 nt, Human
aaguacacuguuucaaacuuuac

SEQ ID NO: 2249115 - RNA, 20 nt, Human
aaguacacuguuucaaacuu

SEQ ID NO: 2249116 - RNA, 19 nt, Human
aaguacacuguuucaaacu

SEQ ID NO: 2249117 - RNA, 17 nt, Human
aaguaccacucaggcca

SEQ ID NO: 2249118 - RNA, 18 nt, Human
aaguacccguucacauuu

SEQ ID NO: 2249119 - RNA, 20 nt, Human
aaguacauauuaggaaaaua

SEQ ID NO: 2249120 - RNA, 12 nt, Human
aaguacauuuaa

SEQ ID NO: 2249121 - RNA, 13 nt, Human
aaguacauuuaau

SEQ ID NO: 2249122 - RNA, 18 nt, Human
aaguauuuauauauuuau

SEQ ID NO: 2249123 - RNA, 17 nt, Human
aaguauuuauauauuua

SEQ ID NO: 2249124 - RNA, 16 nt, Human
aaguauuuauauauuu

SEQ ID NO: 2249125 - RNA, 15 nt, Human
aaguauuuauauauu

SEQ ID NO: 2249126 - RNA, 14 nt, Human
aaguauuuauauau

SEQ ID NO: 2249127 - RNA, 13 nt, Human
aaguauuuauaua

SEQ ID NO: 2249128 - RNA, 12 nt, Human
aaguauuuauau

SEQ ID NO: 2249129 - RNA, 19 nt, Human
aaguauuuaauuagugcua

SEQ ID NO: 2249130 - RNA, 20 nt, Human
aaguauuuaauuagugcuaa

SEQ ID NO: 2249131 - RNA, 21 nt, Human
aaguauuuaauuagugcuaag

SEQ ID NO: 2249132 - RNA, 22 nt, Human
aaguauuuaauuagugcuaagu

SEQ ID NO: 2249133 - RNA, 23 nt, Human
aaguauuuaauuagugcuaagug

SEQ ID NO: 2249134 - RNA, 10 nt, Human
aaguauuuag

SEQ ID NO: 2249135 - RNA, 16 nt, Human
aaguauuuagguuuuu

SEQ ID NO: 2249136 - RNA, 11 nt, Human
aaguauuuagg

SEQ ID NO: 2249137 - RNA, 20 nt, Human
aaguauuagggguaauauau

SEQ ID NO: 2249138 - RNA, 22 nt, Human
aaguauuagggguaauauauug

SEQ ID NO: 2249139 - RNA, 16 nt, Human
aaguauuuaauuagug

SEQ ID NO: 2249140 - RNA, 17 nt, Human
aaguauuuaauuagugc

SEQ ID NO: 2249141 - RNA, 18 nt, Human
aaguauuuaauuagugcu

SEQ ID NO: 2249142 - RNA, 13 nt, Human
aaguauuagaaua

SEQ ID NO: 2249143 - RNA, 21 nt, Human
guugcuugccugauauaaaug

SEQ ID NO: 2249144 - RNA, 23 nt, Human
guugcguggacucugcacauguc

SEQ ID NO: 2249145 - RNA, 16 nt, Human
guugcuuacaauuuuu

SEQ ID NO: 2249146 - RNA, 23 nt, Human
guugcuuaggaugugugcaugug

SEQ ID NO: 2249147 - RNA, 13 nt, Human
guugcggggggag

SEQ ID NO: 2249148 - RNA, 15 nt, Human
guugcggggggaggg

SEQ ID NO: 2249149 - RNA, 18 nt, Human
guugcguaacuggcugug

SEQ ID NO: 2249150 - RNA, 22 nt, Human
guuggaaaagaauacagaaaga

SEQ ID NO: 2249151 - RNA, 20 nt, Human
guuggaaaagaauacagaaa

SEQ ID NO: 2249152 - RNA, 15 nt, Human
guuggaaaagaauac

SEQ ID NO: 2249153 - RNA, 15 nt, Human
guugcuuugcccugg

SEQ ID NO: 2249154 - RNA, 14 nt, Human
guugggaggauucu

SEQ ID NO: 2249155 - RNA, 18 nt, Human
guugggauacugcagggc

SEQ ID NO: 2249156 - RNA, 21 nt, Human
guugggauacugcagggccag

SEQ ID NO: 2249157 - RNA, 16 nt, Human
guugggauuccugacc

SEQ ID NO: 2249158 - RNA, 18 nt, Human
guugggauuccugaccca

SEQ ID NO: 2249159 - RNA, 19 nt, Human
guugggauuccugacccag

SEQ ID NO: 2249160 - RNA, 21 nt, Human
guugggauugggggcuggugc

SEQ ID NO: 2249161 - RNA, 22 nt, Human
guugggauugggggcuggugcc

SEQ ID NO: 2249162 - RNA, 20 nt, Human
guugggauuccugacccagg

SEQ ID NO: 2249163 - RNA, 21 nt, Human
guugggauuccugacccaggc

SEQ ID NO: 2249164 - RNA, 22 nt, Human
guugggauuccugacccaggcc

SEQ ID NO: 2249165 - RNA, 23 nt, Human
guugggauuccugacccaggccg

SEQ ID NO: 2249166 - RNA, 16 nt, Human
guugggagcacuggag

SEQ ID NO: 2249167 - RNA, 15 nt, Human
guugggagcacugga

SEQ ID NO: 2249168 - RNA, 14 nt, Human
guugggagcacugg

SEQ ID NO: 2249169 - RNA, 22 nt, Human
guuggaagcuagcuccccuccu

SEQ ID NO: 2249170 - RNA, 16 nt, Human
guuggaaagcaggugg

SEQ ID NO: 2249171 - RNA, 18 nt, Human
guuggaaauauucaugcu

SEQ ID NO: 2249172 - RNA, 23 nt, Human
guuggaaauagaaauuuccagag

SEQ ID NO: 2249173 - RNA, 22 nt, Human
guuggaaugaauuaaauaaacc

SEQ ID NO: 2249174 - RNA, 23 nt, Human
guugcccaggcaggucuugaacu

SEQ ID NO: 2249175 - RNA, 13 nt, Human
aaggccucccaca

SEQ ID NO: 2249176 - RNA, 14 nt, Human
aaggccucccacag

SEQ ID NO: 2249177 - RNA, 15 nt, Human
aaggccucccacagu

SEQ ID NO: 2249178 - RNA, 12 nt, Human
guugcccaggcu

SEQ ID NO: 2249179 - RNA, 13 nt, Human
guugcccaggcug

SEQ ID NO: 2249180 - RNA, 21 nt, Human
guugccuugaaccacuucccu

SEQ ID NO: 2249181 - RNA, 18 nt, Human
guugccuuaaagaaaguc

SEQ ID NO: 2249182 - RNA, 19 nt, Human
guugccuugaaccacuucc

SEQ ID NO: 2249183 - RNA, 16 nt, Human
guugccuaauaaacau

SEQ ID NO: 2249184 - RNA, 19 nt, Human
aaggccucccacagugacu

SEQ ID NO: 2249185 - RNA, 16 nt, Human
aaggccucccacagug

SEQ ID NO: 2249186 - RNA, 17 nt, Human
aaggccucccacaguga

SEQ ID NO: 2249187 - RNA, 19 nt, Human
aaggccucccuagccagca

SEQ ID NO: 2249188 - RNA, 22 nt, Human
aaggccauccuucccugucugc

SEQ ID NO: 2249189 - RNA, 22 nt, Human
aaggccaucugggcuccuccag

SEQ ID NO: 2249190 - RNA, 24 nt, Human
aaggccauaaaacagguaauauaa

SEQ ID NO: 2249191 - RNA, 18 nt, Human
aaggccauaaaacaggua

SEQ ID NO: 2249192 - RNA, 19 nt, Human
aaggccagcuggcagcaga

SEQ ID NO: 2249193 - RNA, 17 nt, Human
aaggccagcuggcagca

SEQ ID NO: 2249194 - RNA, 17 nt, Human
aaggccauaaaacaggu

SEQ ID NO: 2249195 - RNA, 14 nt, Human
aaggccauaaaaca

SEQ ID NO: 2249196 - RNA, 14 nt, Human
aaggccagcuggca

SEQ ID NO: 2249197 - RNA, 17 nt, Human
aaggccaaaccucuguu

SEQ ID NO: 2249198 - RNA, 16 nt, Human
aaggccaaaggaagca

SEQ ID NO: 2249199 - RNA, 17 nt, Human
aaggcauucucugaaga

SEQ ID NO: 2249200 - RNA, 14 nt, Human
aaggcauucucuga

SEQ ID NO: 2249201 - RNA, 15 nt, Human
aaggcauuguuugag

SEQ ID NO: 2249202 - RNA, 16 nt, Human
aaggccaaaccucugu

SEQ ID NO: 2249203 - RNA, 13 nt, Human
aaggcauuuuauu

SEQ ID NO: 2249204 - RNA, 21 nt, Human
aaggcccacgagcuuguucuu

SEQ ID NO: 2249205 - RNA, 21 nt, Human
aaggccauggagagcuggagc

SEQ ID NO: 2249206 - RNA, 14 nt, Human
aaggccaucagagc

SEQ ID NO: 2249207 - RNA, 18 nt, Human
aaggccauggagagcugg

SEQ ID NO: 2249208 - RNA, 22 nt, Human
aaggccauggagagcuggagcc

SEQ ID NO: 2249209 - RNA, 14 nt, Human
aaggccccagagac

SEQ ID NO: 2249210 - RNA, 22 nt, Human
aaggccgcuguucacccacagg

SEQ ID NO: 2249211 - RNA, 18 nt, Human
aaggccgagaagcaagaa

SEQ ID NO: 2249212 - RNA, 17 nt, Human
aaggccgagaagcaaga

SEQ ID NO: 2249213 - RNA, 14 nt, Human
aaggccgagaagca

SEQ ID NO: 2249214 - RNA, 16 nt, Human
aaggccgaagcucugg

SEQ ID NO: 2249215 - RNA, 18 nt, Human
aaggccgaagcucuggcu

SEQ ID NO: 2249216 - RNA, 19 nt, Human
aaggccgaagcucuggcug

SEQ ID NO: 2249217 - RNA, 20 nt, Human
aaggccgaagcucuggcuga

SEQ ID NO: 2249218 - RNA, 22 nt, Human
aaggccgaagaaggguccuucc

SEQ ID NO: 2249219 - RNA, 22 nt, Human
aaggcccuaucuguuuacagug

SEQ ID NO: 2249220 - RNA, 23 nt, Human
aaggauacuguaacacuuuacaa

SEQ ID NO: 2249221 - RNA, 15 nt, Human
aaggauagaugcugg

SEQ ID NO: 2249222 - RNA, 20 nt, Human
aaggcauaucagucucugag

SEQ ID NO: 2249223 - RNA, 19 nt, Human
aaggauacuguaacacuuu

SEQ ID NO: 2249224 - RNA, 21 nt, Human
aaggcaugauguuaaccagaa

SEQ ID NO: 2249225 - RNA, 16 nt, Human
aaggcauguuccucug

SEQ ID NO: 2249226 - RNA, 12 nt, Human
aaggcauucucu

SEQ ID NO: 2249227 - RNA, 12 nt, Human
aaggcaugaagg

SEQ ID NO: 2249228 - RNA, 20 nt, Human
aaggcaucagucccuaugua

SEQ ID NO: 2249229 - RNA, 21 nt, Human
aaggauacaaaagcaugugag

SEQ ID NO: 2249230 - RNA, 13 nt, Human
aaggauacaaaag

SEQ ID NO: 2249231 - RNA, 20 nt, Human
aaggaguuccaugaagacca

SEQ ID NO: 2249232 - RNA, 13 nt, Human
aaggaguuaagag

SEQ ID NO: 2249233 - RNA, 19 nt, Human
aaggagugagaucauuuuc

SEQ ID NO: 2249234 - RNA, 19 nt, Human
aaggaguaaucuguguaca

SEQ ID NO: 2249235 - RNA, 20 nt, Human
aaggagucagacauuuuaag

SEQ ID NO: 2249236 - RNA, 15 nt, Human
aaggagaugaagcaa

SEQ ID NO: 2249237 - RNA, 20 nt, Human
aaggagaggcaacauccaaa

SEQ ID NO: 2249238 - RNA, 17 nt, Human
aaggagaggaaagaacu

SEQ ID NO: 2249239 - RNA, 13 nt, Human
aaggagaggaggc

SEQ ID NO: 2249240 - RNA, 11 nt, Human
aaggagagcua

SEQ ID NO: 2249241 - RNA, 22 nt, Human
aaggaaguuacuguuauagagg

SEQ ID NO: 2249242 - RNA, 14 nt, Human
aaggaagugaagag

SEQ ID NO: 2249243 - RNA, 13 nt, Human
aaggaauauaugg

SEQ ID NO: 2249244 - RNA, 15 nt, Human
aaggaauauauggca

SEQ ID NO: 2249245 - RNA, 16 nt, Human
aaggaauauauggcag

SEQ ID NO: 2249246 - RNA, 18 nt, Human
aaggaauaccuguccccc

SEQ ID NO: 2249247 - RNA, 14 nt, Human
aaggagaggaggca

SEQ ID NO: 2249248 - RNA, 14 nt, Human
aaggagauuuacaa

SEQ ID NO: 2249249 - RNA, 22 nt, Human
aaggagcucacuguggugucug

SEQ ID NO: 2249250 - RNA, 12 nt, Human
aaggagggugag

SEQ ID NO: 2249251 - RNA, 21 nt, Human
aaggaggguggaucaccugag

SEQ ID NO: 2249252 - RNA, 17 nt, Human
aaggagggucaggaagg

SEQ ID NO: 2249253 - RNA, 19 nt, Human
aaggaggguuagggagggg

SEQ ID NO: 2249254 - RNA, 18 nt, Human
aaggaggguuagggaggg

SEQ ID NO: 2249255 - RNA, 13 nt, Human
aaggaguagaaaa

SEQ ID NO: 2249256 - RNA, 17 nt, Human
aaggagucaaaacuaca

SEQ ID NO: 2249257 - RNA, 15 nt, Human
aaggaggugagggau

SEQ ID NO: 2249258 - RNA, 19 nt, Human
aaggaggugagggauguga

SEQ ID NO: 2249259 - RNA, 15 nt, Human
aaggaguaagaaccu

SEQ ID NO: 2249260 - RNA, 18 nt, Human
aaggaguaaucuguguac

SEQ ID NO: 2249261 - RNA, 15 nt, Human
aaggagggagaugga

SEQ ID NO: 2249262 - RNA, 17 nt, Human
aaggaggggcuguaaaa

SEQ ID NO: 2249263 - RNA, 13 nt, Human
aaggaggggaacc

SEQ ID NO: 2249264 - RNA, 20 nt, Human
aaggaggggauagagagaga

SEQ ID NO: 2249265 - RNA, 14 nt, Human
aaggaggcuggcag

SEQ ID NO: 2249266 - RNA, 13 nt, Human
aaggaggcuggcu

SEQ ID NO: 2249267 - RNA, 15 nt, Human
aaggaggcuggcugg

SEQ ID NO: 2249268 - RNA, 18 nt, Human
aaggaggcuggcuggggc

SEQ ID NO: 2249269 - RNA, 23 nt, Human
aaggaggcgcacuuuccuccugg

SEQ ID NO: 2249270 - RNA, 21 nt, Human
aaggagcugcuauagccuggg

SEQ ID NO: 2249271 - RNA, 11 nt, Human
aaggaggaaaa

SEQ ID NO: 2249272 - RNA, 20 nt, Human
aaggagcugcuauagccugg

SEQ ID NO: 2249273 - RNA, 18 nt, Human
aaggagcugcuauagccu

SEQ ID NO: 2249274 - RNA, 14 nt, Human
aaggagcugcuaua

SEQ ID NO: 2249275 - RNA, 12 nt, Human
aaggagcugcua

SEQ ID NO: 2249276 - RNA, 18 nt, Human
aaggaggaagagaaaaaa

SEQ ID NO: 2249277 - RNA, 22 nt, Human
aaggaagccacagcugguggua

SEQ ID NO: 2249278 - RNA, 13 nt, Human
aaggaagacuaga

SEQ ID NO: 2249279 - RNA, 16 nt, Human
aaggaagcacaugccu

SEQ ID NO: 2249280 - RNA, 14 nt, Human
aaggaagucuagga

SEQ ID NO: 2249281 - RNA, 18 nt, Human
aaggaagcuccacuguca

SEQ ID NO: 2249282 - RNA, 16 nt, Human
aaggaagcuccacugu

SEQ ID NO: 2249283 - RNA, 21 nt, Human
aaggaauaaauugcuccuuga

SEQ ID NO: 2249284 - RNA, 17 nt, Human
aaggaauaccugucccc

SEQ ID NO: 2249285 - RNA, 18 nt, Human
aaggaacucuggcuucca

SEQ ID NO: 2249286 - RNA, 20 nt, Human
aaggaacucuggcuuccagg

SEQ ID NO: 2249287 - RNA, 22 nt, Human
aaggaacucuggcuuccaggua

SEQ ID NO: 2249288 - RNA, 14 nt, Human
aaggaagacuucau

SEQ ID NO: 2249289 - RNA, 15 nt, Human
aaggaagacuucauc

SEQ ID NO: 2249290 - RNA, 13 nt, Human
aaggaagcacaug

SEQ ID NO: 2249291 - RNA, 22 nt, Human
aaggaaaucucaccccauccca

SEQ ID NO: 2249292 - RNA, 16 nt, Human
aaggaaaucucacccc

SEQ ID NO: 2249293 - RNA, 14 nt, Human
aaggaaaugauuga

SEQ ID NO: 2249294 - RNA, 21 nt, Human
aaggaaaugauugaggaguga

SEQ ID NO: 2249295 - RNA, 13 nt, Human
aaggaaaggcaaa

SEQ ID NO: 2249296 - RNA, 14 nt, Human
aaggaaaggccuga

SEQ ID NO: 2249297 - RNA, 22 nt, Human
aaggaaagggggucccaguggg

SEQ ID NO: 2249298 - RNA, 22 nt, Human
aaggaaauaccaguucugggca

SEQ ID NO: 2249299 - RNA, 23 nt, Human
aaggaaccaaagcgaauuuuaaa

SEQ ID NO: 2249300 - RNA, 22 nt, Human
aaggaaccaaagcgaauuuuaa

SEQ ID NO: 2249301 - RNA, 20 nt, Human
aaggaaagcaauaaaugaau

SEQ ID NO: 2249302 - RNA, 16 nt, Human
aaggaaagcaauaaau

SEQ ID NO: 2249303 - RNA, 13 nt, Human
aaggaaagcaaua

SEQ ID NO: 2249304 - RNA, 15 nt, Human
aaggaaagagggagg

SEQ ID NO: 2249305 - RNA, 14 nt, Human
aagcuccaucucca

SEQ ID NO: 2249306 - RNA, 13 nt, Human
aagcuccaagccc

SEQ ID NO: 2249307 - RNA, 15 nt, Human
aagcuccacugucac

SEQ ID NO: 2249308 - RNA, 16 nt, Human
aagcuccacugucacc

SEQ ID NO: 2249309 - RNA, 19 nt, Human
aagcuccacugucacccuc

SEQ ID NO: 2249310 - RNA, 21 nt, Human
aagcuccacugucacccucca

SEQ ID NO: 2249311 - RNA, 13 nt, Human
guuuauuuuaaga

SEQ ID NO: 2249312 - RNA, 14 nt, Human
guuuauuucuuaaa

SEQ ID NO: 2249313 - RNA, 13 nt, Human
guuucaaacuuua

SEQ ID NO: 2249314 - RNA, 16 nt, Human
guuucaaacuuuacua

SEQ ID NO: 2249315 - RNA, 14 nt, Human
guuucaaacuuuac

SEQ ID NO: 2249316 - RNA, 16 nt, Human
aaggcuccaggagcag

SEQ ID NO: 2249317 - RNA, 18 nt, Human
aaggcuccaggagcagcc

SEQ ID NO: 2249318 - RNA, 15 nt, Human
aaggcuccaggagca

SEQ ID NO: 2249319 - RNA, 15 nt, Human
aaggcucgauuuugu

SEQ ID NO: 2249320 - RNA, 17 nt, Human
aaggcucgauuuuguau

SEQ ID NO: 2249321 - RNA, 22 nt, Human
aaggcucgauuuuguaucugca

SEQ ID NO: 2249322 - RNA, 19 nt, Human
guuuauuuucaagaauaau

SEQ ID NO: 2249323 - RNA, 14 nt, Human
guuuauuuuauauu

SEQ ID NO: 2249324 - RNA, 22 nt, Human
aaggcucgagcaugccuggaug

SEQ ID NO: 2249325 - RNA, 19 nt, Human
aaggcucgagcaugccugg

SEQ ID NO: 2249326 - RNA, 20 nt, Human
aaggcucgagcaugccugga

SEQ ID NO: 2249327 - RNA, 19 nt, Human
aaggcuccaggagcagcca

SEQ ID NO: 2249328 - RNA, 22 nt, Human
aaggcuccaggagcagccacau

SEQ ID NO: 2249329 - RNA, 16 nt, Human
aaggcucgagcaugcc

SEQ ID NO: 2249330 - RNA, 18 nt, Human
aaggcucgagcaugccug

SEQ ID NO: 2249331 - RNA, 23 nt, Human
guuuacagggagccuccugccca

SEQ ID NO: 2249332 - RNA, 13 nt, Human
guuuacaguaaau

SEQ ID NO: 2249333 - RNA, 15 nt, Human
guuuacaguaaauaa

SEQ ID NO: 2249334 - RNA, 19 nt, Human
guuuacaguaaauaaauug

SEQ ID NO: 2249335 - RNA, 17 nt, Human
guuuacagguggacaca

SEQ ID NO: 2249336 - RNA, 19 nt, Human
guuuacagggagccuccug

SEQ ID NO: 2249337 - RNA, 20 nt, Human
guuuacagggagccuccugc

SEQ ID NO: 2249338 - RNA, 16 nt, Human
guuuacagggagccuc

SEQ ID NO: 2249339 - RNA, 17 nt, Human
guuuacagggagccucc

SEQ ID NO: 2249340 - RNA, 18 nt, Human
guuuacagggagccuccu

SEQ ID NO: 2249341 - RNA, 16 nt, Human
guuuacacucuuugua

SEQ ID NO: 2249342 - RNA, 23 nt, Human
guuuacagcacuacucugugcca

SEQ ID NO: 2249343 - RNA, 19 nt, Human
guuuauuuaucagugacag

SEQ ID NO: 2249344 - RNA, 16 nt, Human
guuuauuuaucaguga

SEQ ID NO: 2249345 - RNA, 17 nt, Human
guuuauuuauucugcau

SEQ ID NO: 2249346 - RNA, 12 nt, Human
guuuauuuccaa

SEQ ID NO: 2249347 - RNA, 21 nt, Human
guuuauuuccaaauaaaauga

SEQ ID NO: 2249348 - RNA, 14 nt, Human
guuuauuuaucagu

SEQ ID NO: 2249349 - RNA, 11 nt, Human
guuuacaugua

SEQ ID NO: 2249350 - RNA, 13 nt, Human
guuuauugucaaa

SEQ ID NO: 2249351 - RNA, 15 nt, Human
guuuacaguguuccg

SEQ ID NO: 2249352 - RNA, 13 nt, Human
guuuacaguguuc

SEQ ID NO: 2249353 - RNA, 13 nt, Human
guugggcccagau

SEQ ID NO: 2249354 - RNA, 20 nt, Human
guugggccauacuggccucg

SEQ ID NO: 2249355 - RNA, 21 nt, Human
guugggccauacuggccucgc

SEQ ID NO: 2249356 - RNA, 22 nt, Human
guugggcagggugacccugaag

SEQ ID NO: 2249357 - RNA, 18 nt, Human
guugggccauacuggccu

SEQ ID NO: 2249358 - RNA, 19 nt, Human
guugggccauacuggccuc

SEQ ID NO: 2249359 - RNA, 13 nt, Human
guugggcuggugu

SEQ ID NO: 2249360 - RNA, 15 nt, Human
guugggccaggagcc

SEQ ID NO: 2249361 - RNA, 17 nt, Human
guugggccaggagccuc

SEQ ID NO: 2249362 - RNA, 19 nt, Human
guuuaauauugagaaagaa

SEQ ID NO: 2249363 - RNA, 12 nt, Human
guuuaauauuua

SEQ ID NO: 2249364 - RNA, 15 nt, Human
guuuaauauuuaaac

SEQ ID NO: 2249365 - RNA, 17 nt, Human
guuuaauauugagaaag

SEQ ID NO: 2249366 - RNA, 15 nt, Human
guuuaauauugagaa

SEQ ID NO: 2249367 - RNA, 19 nt, Human
guuuaauccccaguaaaau

SEQ ID NO: 2249368 - RNA, 21 nt, Human
guuuaauccccaguaaaauug

SEQ ID NO: 2249369 - RNA, 17 nt, Human
guuuaauauuuaaacag

SEQ ID NO: 2249370 - RNA, 17 nt, Human
guugggcccagaucugg

SEQ ID NO: 2249371 - RNA, 16 nt, Human
guugggcccagaucug

SEQ ID NO: 2249372 - RNA, 15 nt, Human
guugggcccagaucu

SEQ ID NO: 2249373 - RNA, 15 nt, Human
guugggcugguguca

SEQ ID NO: 2249374 - RNA, 21 nt, Human
guuucugaaaauuaacacugc

SEQ ID NO: 2249375 - RNA, 12 nt, Human
guuucugacucu

SEQ ID NO: 2249376 - RNA, 20 nt, Human
guuucugaaaauuaacacug

SEQ ID NO: 2249377 - RNA, 14 nt, Human
guuucucuuuccuu

SEQ ID NO: 2249378 - RNA, 13 nt, Human
guuucugacucug

SEQ ID NO: 2249379 - RNA, 17 nt, Human
guuucugacucugagcu

SEQ ID NO: 2249380 - RNA, 21 nt, Human
guuucucuuuccuuggcuccc

SEQ ID NO: 2249381 - RNA, 18 nt, Human
guuucugaaagggacgcu

SEQ ID NO: 2249382 - RNA, 18 nt, Human
aaguaaggugcaguuccc

SEQ ID NO: 2249383 - RNA, 19 nt, Human
guuucuauguguagggcgg

SEQ ID NO: 2249384 - RNA, 15 nt, Human
guuucucugcuguug

SEQ ID NO: 2249385 - RNA, 19 nt, Human
guuucucagauccuuguuu

SEQ ID NO: 2249386 - RNA, 14 nt, Human
guuucucagauccu

SEQ ID NO: 2249387 - RNA, 21 nt, Human
aaguaaguaccacucaggcca

SEQ ID NO: 2249388 - RNA, 20 nt, Human
aaguaaguaccacucaggcc

SEQ ID NO: 2249389 - RNA, 22 nt, Human
guuucuaugacacaugcaaggu

SEQ ID NO: 2249390 - RNA, 23 nt, Human
aaguaagcccuugaagauaucuu

SEQ ID NO: 2249391 - RNA, 19 nt, Human
aaguaagcaacagcauaac

SEQ ID NO: 2249392 - RNA, 15 nt, Human
aaguaagaagacaug

SEQ ID NO: 2249393 - RNA, 17 nt, Human
aaguaagcaacagcaua

SEQ ID NO: 2249394 - RNA, 18 nt, Human
aaguaaguaccacucagg

SEQ ID NO: 2249395 - RNA, 15 nt, Human
aaguaaggugcaguu

SEQ ID NO: 2249396 - RNA, 20 nt, Human
aaguaagaagacaugaacca

SEQ ID NO: 2249397 - RNA, 14 nt, Human
aaguaagaagacau

SEQ ID NO: 2249398 - RNA, 13 nt, Human
aaguaagaagaca

SEQ ID NO: 2249399 - RNA, 13 nt, Human
aaguaagcaaaga

SEQ ID NO: 2249400 - RNA, 16 nt, Human
aaguaaggaauuuuau

SEQ ID NO: 2249401 - RNA, 13 nt, Human
aaggucaucaucg

SEQ ID NO: 2249402 - RNA, 19 nt, Human
aaggucaccagcaccaaca

SEQ ID NO: 2249403 - RNA, 21 nt, Human
aaguaagaaagugaagcaaau

SEQ ID NO: 2249404 - RNA, 12 nt, Human
aaggucauuuuu

SEQ ID NO: 2249405 - RNA, 20 nt, Human
aagguagaaauaucugaaaa

SEQ ID NO: 2249406 - RNA, 22 nt, Human
aagguauuccuuuuguguacag

SEQ ID NO: 2249407 - RNA, 18 nt, Human
aagguauuccuuuugugu

SEQ ID NO: 2249408 - RNA, 19 nt, Human
aagggucuugggaaauaug

SEQ ID NO: 2249409 - RNA, 15 nt, Human
aagggucuugggaaa

SEQ ID NO: 2249410 - RNA, 16 nt, Human
aagggucuugggaaau

SEQ ID NO: 2249411 - RNA, 14 nt, Human
aagguacuucaaau

SEQ ID NO: 2249412 - RNA, 18 nt, Human
aagggucuagggagagac

SEQ ID NO: 2249413 - RNA, 17 nt, Human
aagggucuagggagaga

SEQ ID NO: 2249414 - RNA, 16 nt, Human
aagggucuagggagag

SEQ ID NO: 2249415 - RNA, 16 nt, Human
aaggggcugaaagaac

SEQ ID NO: 2249416 - RNA, 22 nt, Human
aagggucuagggagagacccuu

SEQ ID NO: 2249417 - RNA, 20 nt, Human
aagggucuagggagagaccc

SEQ ID NO: 2249418 - RNA, 19 nt, Human
aagggugaugggaaagcau

SEQ ID NO: 2249419 - RNA, 21 nt, Human
aaggggcccugguccuuccag

SEQ ID NO: 2249420 - RNA, 14 nt, Human
aaggggcccugguc

SEQ ID NO: 2249421 - RNA, 23 nt, Human
aaggggccucaccgagugggggc

SEQ ID NO: 2249422 - RNA, 15 nt, Human
aaggggcccguggga

SEQ ID NO: 2249423 - RNA, 21 nt, Human
aaggggccuuugucuugucaa

SEQ ID NO: 2249424 - RNA, 18 nt, Human
aaggggcgucuguucccc

SEQ ID NO: 2249425 - RNA, 19 nt, Human
aaggguccuucccucuccc

SEQ ID NO: 2249426 - RNA, 13 nt, Human
aaggggcccuggu

SEQ ID NO: 2249427 - RNA, 16 nt, Human
aaggcugaccaagaga

SEQ ID NO: 2249428 - RNA, 13 nt, Human
aaggggccauccu

SEQ ID NO: 2249429 - RNA, 15 nt, Human
aaggcugaccaagag

SEQ ID NO: 2249430 - RNA, 16 nt, Human
aaggcucuucugacua

SEQ ID NO: 2249431 - RNA, 17 nt, Human
aaggggccagaggcucg

SEQ ID NO: 2249432 - RNA, 22 nt, Human
aaggggcccaaauucuuucagu

SEQ ID NO: 2249433 - RNA, 18 nt, Human
aaggcucugaaagccagc

SEQ ID NO: 2249434 - RNA, 17 nt, Human
aaggcucugaaagccag

SEQ ID NO: 2249435 - RNA, 23 nt, Human
aaggcucgauuuuguaucugcag

SEQ ID NO: 2249436 - RNA, 17 nt, Human
aaggcugaccaagagag

SEQ ID NO: 2249437 - RNA, 23 nt, Human
aaggcucugagcaaauguggcuc

SEQ ID NO: 2249438 - RNA, 17 nt, Human
aaggcucuucuccccag

SEQ ID NO: 2249439 - RNA, 19 nt, Human
aaggcucuucuccccagag

SEQ ID NO: 2249440 - RNA, 11 nt, Human
aacagggaggg

SEQ ID NO: 2249441 - RNA, 17 nt, Human
aacagggcaucuccagg

SEQ ID NO: 2249442 - RNA, 18 nt, Human
aacagggcaucuccagga

SEQ ID NO: 2249443 - RNA, 18 nt, Human
aacagggucucuagugcu

SEQ ID NO: 2249444 - RNA, 13 nt, Human
aacagggucucua

SEQ ID NO: 2249445 - RNA, 22 nt, Human
aacagggucucuagugcuguga

SEQ ID NO: 2249446 - RNA, 20 nt, Human
aacagggucucuagugcugu

SEQ ID NO: 2249447 - RNA, 23 nt, Human
aacagggucucuagugcugugaa

SEQ ID NO: 2249448 - RNA, 15 nt, Human
aacagguaauauaaa

SEQ ID NO: 2249449 - RNA, 21 nt, Human
aacaguguuucccauaauuuu

SEQ ID NO: 2249450 - RNA, 19 nt, Human
aacaguguuucccauaauu

SEQ ID NO: 2249451 - RNA, 15 nt, Human
aacagugccugcuga

SEQ ID NO: 2249452 - RNA, 14 nt, Human
aacagugccugcug

SEQ ID NO: 2249453 - RNA, 13 nt, Human
aacagugccugcu

SEQ ID NO: 2249454 - RNA, 22 nt, Human
aacagugcauauuccuuucuau

SEQ ID NO: 2249455 - RNA, 12 nt, Human
aacagugccugc

SEQ ID NO: 2249456 - RNA, 18 nt, Human
aacagguaauauaaaaag

SEQ ID NO: 2249457 - RNA, 15 nt, Human
aacagugcauauucc

SEQ ID NO: 2249458 - RNA, 22 nt, Human
aacagugauuaccagggacuga

SEQ ID NO: 2249459 - RNA, 15 nt, Human
aacagugauuaccag

SEQ ID NO: 2249460 - RNA, 18 nt, Human
aacagacaacagaaguca

SEQ ID NO: 2249461 - RNA, 16 nt, Human
aacagacaacagaagu

SEQ ID NO: 2249462 - RNA, 21 nt, Human
aacagacaaaaacagccucac

SEQ ID NO: 2249463 - RNA, 18 nt, Human
aacagacaaaaacagccu

SEQ ID NO: 2249464 - RNA, 13 nt, Human
aacagaauuuuaa

SEQ ID NO: 2249465 - RNA, 23 nt, Human
aacagaauacuguuaaaggaaaa

SEQ ID NO: 2249466 - RNA, 13 nt, Human
aacagaagugguu

SEQ ID NO: 2249467 - RNA, 14 nt, Human
aacagaauguuuua

SEQ ID NO: 2249468 - RNA, 13 nt, Human
aacagaaggauga

SEQ ID NO: 2249469 - RNA, 14 nt, Human
aacagaagcuucca

SEQ ID NO: 2249470 - RNA, 16 nt, Human
aacagaagcuuccauu

SEQ ID NO: 2249471 - RNA, 23 nt, Human
aacagauacuggaaguuuugcau

SEQ ID NO: 2249472 - RNA, 19 nt, Human
aacagacaccaucuuuugu

SEQ ID NO: 2249473 - RNA, 20 nt, Human
aacagauaguuguguuuuua

SEQ ID NO: 2249474 - RNA, 20 nt, Human
aacagauauaaauggcuggu

SEQ ID NO: 2249475 - RNA, 13 nt, Human
aacagaucuggaa

SEQ ID NO: 2249476 - RNA, 21 nt, Human
aacagaucuggaaccucagcc

SEQ ID NO: 2249477 - RNA, 16 nt, Human
aacagaucaauuugua

SEQ ID NO: 2249478 - RNA, 22 nt, Human
aacagaucuggaaccucagccu

SEQ ID NO: 2249479 - RNA, 19 nt, Human
aacagauaagcaagagaga

SEQ ID NO: 2249480 - RNA, 18 nt, Human
aacagauaagcaagagag

SEQ ID NO: 2249481 - RNA, 13 nt, Human
aacagauaaucag

SEQ ID NO: 2249482 - RNA, 16 nt, Human
aacagauaaauaguuu

SEQ ID NO: 2249483 - RNA, 22 nt, Human
gucccuugagaccucagccaug

SEQ ID NO: 2249484 - RNA, 18 nt, Human
gucccuugagaccucagc

SEQ ID NO: 2249485 - RNA, 17 nt, Human
gucccuugagaccucag

SEQ ID NO: 2249486 - RNA, 22 nt, Human
gucccccuggggcuucuccuga

SEQ ID NO: 2249487 - RNA, 13 nt, Human
gucccuugcagcu

SEQ ID NO: 2249488 - RNA, 20 nt, Human
gucccuugagaccucagcca

SEQ ID NO: 2249489 - RNA, 19 nt, Human
gucccuugagaccucagcc

SEQ ID NO: 2249490 - RNA, 21 nt, Human
gucccuugagaccucagccau

SEQ ID NO: 2249491 - RNA, 23 nt, Human
gucccuuucgacuugcauuuuug

SEQ ID NO: 2249492 - RNA, 20 nt, Human
gucccuuguuuccagcuaga

SEQ ID NO: 2249493 - RNA, 17 nt, Human
gucccuuguuuccagcu

SEQ ID NO: 2249494 - RNA, 13 nt, Human
gucccuugccuca

SEQ ID NO: 2249495 - RNA, 14 nt, Human
gucccuugccucaa

SEQ ID NO: 2249496 - RNA, 19 nt, Human
gucccuugccucaaugcca

SEQ ID NO: 2249497 - RNA, 14 nt, Human
gucccccuuccaug

SEQ ID NO: 2249498 - RNA, 18 nt, Human
gucccccugacaacacuc

SEQ ID NO: 2249499 - RNA, 13 nt, Human
guccccccacccu

SEQ ID NO: 2249500 - RNA, 16 nt, Human
gucccccuuccaugga

SEQ ID NO: 2249501 - RNA, 18 nt, Human
gucccccuuccauggacu

SEQ ID NO: 2249502 - RNA, 16 nt, Human
guccuacccacccucc

SEQ ID NO: 2249503 - RNA, 15 nt, Human
guccuacccacccuc

SEQ ID NO: 2249504 - RNA, 17 nt, Human
gucccuuucuuggccag

SEQ ID NO: 2249505 - RNA, 15 nt, Human
gucccuuucuuggcc

SEQ ID NO: 2249506 - RNA, 18 nt, Human
guccuacccauccccgca

SEQ ID NO: 2249507 - RNA, 16 nt, Human
guccuacccauccccg

SEQ ID NO: 2249508 - RNA, 14 nt, Human
guccuacccauccc

SEQ ID NO: 2249509 - RNA, 12 nt, Human
guccuacucugu

SEQ ID NO: 2249510 - RNA, 15 nt, Human
aacagaaauguacag

SEQ ID NO: 2249511 - RNA, 14 nt, Human
aacagaaauguaca

SEQ ID NO: 2249512 - RNA, 13 nt, Human
aacagaaauguac

SEQ ID NO: 2249513 - RNA, 12 nt, Human
aacagaaaugua

SEQ ID NO: 2249514 - RNA, 20 nt, Human
aacacagacauucugccagg

SEQ ID NO: 2249515 - RNA, 19 nt, Human
aacacagacauucugccag

SEQ ID NO: 2249516 - RNA, 21 nt, Human
gucauuuuuuuuaagaaaaag

SEQ ID NO: 2249517 - RNA, 19 nt, Human
gucauuuuuuuuaagaaaa

SEQ ID NO: 2249518 - RNA, 21 nt, Human
aacacacugaggcagggaagu

SEQ ID NO: 2249519 - RNA, 13 nt, Human
aacacacuguguc

SEQ ID NO: 2249520 - RNA, 16 nt, Human
aacacacuguguccug

SEQ ID NO: 2249521 - RNA, 19 nt, Human
aacacacuguguccuggug

SEQ ID NO: 2249522 - RNA, 19 nt, Human
aacacagaaaccuuuuuaa

SEQ ID NO: 2249523 - RNA, 21 nt, Human
aacacacuguguccuggugcu

SEQ ID NO: 2249524 - RNA, 22 nt, Human
aacacagaaagccuaucaaaga

SEQ ID NO: 2249525 - RNA, 15 nt, Human
aacacagcaagggug

SEQ ID NO: 2249526 - RNA, 20 nt, Human
aacacacugaggcagggaag

SEQ ID NO: 2249527 - RNA, 19 nt, Human
aacacacugaggcagggaa

SEQ ID NO: 2249528 - RNA, 18 nt, Human
aacacacugaggcaggga

SEQ ID NO: 2249529 - RNA, 17 nt, Human
aacacaacuauauuguu

SEQ ID NO: 2249530 - RNA, 13 nt, Human
aacacaaaugcag

SEQ ID NO: 2249531 - RNA, 20 nt, Human
aacacaaaugcagggauugc

SEQ ID NO: 2249532 - RNA, 23 nt, Human
aacacaccaggcugugggccuca

SEQ ID NO: 2249533 - RNA, 18 nt, Human
guccaacguggggcagca

SEQ ID NO: 2249534 - RNA, 13 nt, Human
guccaagaagccc

SEQ ID NO: 2249535 - RNA, 15 nt, Human
guccaagaagcccag

SEQ ID NO: 2249536 - RNA, 16 nt, Human
guccaagaagcccagg

SEQ ID NO: 2249537 - RNA, 20 nt, Human
guccaacguggggcagcaca

SEQ ID NO: 2249538 - RNA, 21 nt, Human
guccaacguggggcagcacag

SEQ ID NO: 2249539 - RNA, 20 nt, Human
guccaagaagcccaggaaag

SEQ ID NO: 2249540 - RNA, 17 nt, Human
guccaagaagcccagga

SEQ ID NO: 2249541 - RNA, 18 nt, Human
guccaagaagcccaggaa

SEQ ID NO: 2249542 - RNA, 21 nt, Human
gucccacccccacccccagcu

SEQ ID NO: 2249543 - RNA, 22 nt, Human
gucccacccccacccccagcuc

SEQ ID NO: 2249544 - RNA, 14 nt, Human
gucccacccccacc

SEQ ID NO: 2249545 - RNA, 15 nt, Human
gucccacccccaccc

SEQ ID NO: 2249546 - RNA, 19 nt, Human
gucccacccccacccccag

SEQ ID NO: 2249547 - RNA, 21 nt, Human
gucccaccccacacacgccag

SEQ ID NO: 2249548 - RNA, 13 nt, Human
guccauagagagc

SEQ ID NO: 2249549 - RNA, 14 nt, Human
guccauagagagca

SEQ ID NO: 2249550 - RNA, 14 nt, Human
guccaguucccaga

SEQ ID NO: 2249551 - RNA, 19 nt, Human
guccaguucccagaaggca

SEQ ID NO: 2249552 - RNA, 13 nt, Human
guccagugcccau

SEQ ID NO: 2249553 - RNA, 14 nt, Human
guccagugcccauu

SEQ ID NO: 2249554 - RNA, 12 nt, Human
guccagugccca

SEQ ID NO: 2249555 - RNA, 17 nt, Human
guccagugaccugcugg

SEQ ID NO: 2249556 - RNA, 19 nt, Human
guccccaguuugcagaaaa

SEQ ID NO: 2249557 - RNA, 15 nt, Human
guccccaucauccca

SEQ ID NO: 2249558 - RNA, 17 nt, Human
guccccaucaucccagc

SEQ ID NO: 2249559 - RNA, 19 nt, Human
guccccaucaucccagcug

SEQ ID NO: 2249560 - RNA, 20 nt, Human
guccccaucaucccagcugc

SEQ ID NO: 2249561 - RNA, 18 nt, Human
guccccaguuugcagaaa

SEQ ID NO: 2249562 - RNA, 20 nt, Human
guccccaggccccaggaagc

SEQ ID NO: 2249563 - RNA, 21 nt, Human
guccccaggccccaggaagcc

SEQ ID NO: 2249564 - RNA, 19 nt, Human
guccccaggccccaggaag

SEQ ID NO: 2249565 - RNA, 22 nt, Human
gucccaccucuucucuuccugu

SEQ ID NO: 2249566 - RNA, 23 nt, Human
gucccaccucuucucuuccugua

SEQ ID NO: 2249567 - RNA, 12 nt, Human
guccccccaccc

SEQ ID NO: 2249568 - RNA, 11 nt, Human
guccccccacc

SEQ ID NO: 2249569 - RNA, 14 nt, Human
gucccccagcucug

SEQ ID NO: 2249570 - RNA, 15 nt, Human
gucccccagcucugg

SEQ ID NO: 2249571 - RNA, 16 nt, Human
gucccccagcucuggu

SEQ ID NO: 2249572 - RNA, 22 nt, Human
gucccccauccccauccuccag

SEQ ID NO: 2249573 - RNA, 12 nt, Human
gucccccagcuc

SEQ ID NO: 2249574 - RNA, 13 nt, Human
gucccccagcucu

SEQ ID NO: 2249575 - RNA, 19 nt, Human
guccccauggcacccugcu

SEQ ID NO: 2249576 - RNA, 17 nt, Human
gucccccaaccccagcc

SEQ ID NO: 2249577 - RNA, 20 nt, Human
gucccccaaccccagccgcu

SEQ ID NO: 2249578 - RNA, 14 nt, Human
gucccaccuuggcu

SEQ ID NO: 2249579 - RNA, 23 nt, Human
gucccacccccacccccagcuca

SEQ ID NO: 2249580 - RNA, 12 nt, Human
gucccaccucuu

SEQ ID NO: 2249581 - RNA, 13 nt, Human
gucccaccucuuc

SEQ ID NO: 2249582 - RNA, 14 nt, Human
gucccaccucuucu

SEQ ID NO: 2249583 - RNA, 19 nt, Human
gucccaccucuucucuucc

SEQ ID NO: 2249584 - RNA, 21 nt, Human
gucccaccucuucucuuccug

SEQ ID NO: 2249585 - RNA, 15 nt, Human
gucccaccuuggcug

SEQ ID NO: 2249586 - RNA, 16 nt, Human
gucccaccuuggcugc

SEQ ID NO: 2249587 - RNA, 13 nt, Human
aacaauguuaagg

SEQ ID NO: 2249588 - RNA, 18 nt, Human
aacaauguuaaggaaacu

SEQ ID NO: 2249589 - RNA, 21 nt, Human
aacaauguuaaggaaacucuu

SEQ ID NO: 2249590 - RNA, 22 nt, Human
aacaauguuaaggaaacucuua

SEQ ID NO: 2249591 - RNA, 15 nt, Human
aacacaacuauauug

SEQ ID NO: 2249592 - RNA, 16 nt, Human
aacacaacuauauugu

SEQ ID NO: 2249593 - RNA, 12 nt, Human
aacaauguuaag

SEQ ID NO: 2249594 - RNA, 11 nt, Human
aacaauguuaa

SEQ ID NO: 2249595 - RNA, 17 nt, Human
aacaauggaaacugaau

SEQ ID NO: 2249596 - RNA, 18 nt, Human
aacaauggaaacugaaug

SEQ ID NO: 2249597 - RNA, 16 nt, Human
aacaauggaaacugaa

SEQ ID NO: 2249598 - RNA, 23 nt, Human
aacaauaaaauuuuuuuucaugu

SEQ ID NO: 2249599 - RNA, 14 nt, Human
aacaauaaagagau

SEQ ID NO: 2249600 - RNA, 17 nt, Human
aacaaguuuuucuguca

SEQ ID NO: 2249601 - RNA, 17 nt, Human
aacaaugcuguauuuua

SEQ ID NO: 2249602 - RNA, 22 nt, Human
aacaaugcuguauuuuaaaaga

SEQ ID NO: 2249603 - RNA, 14 nt, Human
aacaagugcuggca

SEQ ID NO: 2249604 - RNA, 15 nt, Human
aacaagugcuggcac

SEQ ID NO: 2249605 - RNA, 19 nt, Human
aacaagcaagcucccaagg

SEQ ID NO: 2249606 - RNA, 19 nt, Human
aacaagucgaugaacuauu

SEQ ID NO: 2249607 - RNA, 18 nt, Human
aacaaggcaaggcuguca

SEQ ID NO: 2249608 - RNA, 21 nt, Human
aacaaggcaaggcugucaauu

SEQ ID NO: 2249609 - RNA, 12 nt, Human
aacaauaaaaga

SEQ ID NO: 2249610 - RNA, 14 nt, Human
aacaaugcuguauu

SEQ ID NO: 2249611 - RNA, 15 nt, Human
aacaaugcuguauuu

SEQ ID NO: 2249612 - RNA, 18 nt, Human
aaauuuuggccaaagugu

SEQ ID NO: 2249613 - RNA, 12 nt, Human
aaauuuuggcca

SEQ ID NO: 2249614 - RNA, 20 nt, Human
aaauuuuuucucuaggaaau

SEQ ID NO: 2249615 - RNA, 23 nt, Human
aaauuuugauguuuuaaggaugc

SEQ ID NO: 2249616 - RNA, 18 nt, Human
aaauuuugauguuuuaag

SEQ ID NO: 2249617 - RNA, 17 nt, Human
aaauuuuaucucuuauu

SEQ ID NO: 2249618 - RNA, 12 nt, Human
aaauuuuauaug

SEQ ID NO: 2249619 - RNA, 13 nt, Human
aaauuuuauuccu

SEQ ID NO: 2249620 - RNA, 12 nt, Human
aaauuuuauucc

SEQ ID NO: 2249621 - RNA, 14 nt, Human
aaauuuuaauuuau

SEQ ID NO: 2249622 - RNA, 21 nt, Human
aaauuuuauaaaauuaagcaa

SEQ ID NO: 2249623 - RNA, 18 nt, Human
aaauuuucacauaaaaua

SEQ ID NO: 2249624 - RNA, 18 nt, Human
aaauuuuauuuccuggac

SEQ ID NO: 2249625 - RNA, 14 nt, Human
aaauuuucuagacu

SEQ ID NO: 2249626 - RNA, 18 nt, Human
aaauuuucuagacuuucu

SEQ ID NO: 2249627 - RNA, 19 nt, Human
aaauuuucuagacuuucug

SEQ ID NO: 2249628 - RNA, 20 nt, Human
aaauuuucuagacuuucugu

SEQ ID NO: 2249629 - RNA, 19 nt, Human
aacaagaucuuucaggaaa

SEQ ID NO: 2249630 - RNA, 19 nt, Human
aacaagagcgaaacuccgu

SEQ ID NO: 2249631 - RNA, 17 nt, Human
aacaagaucuuucagga

SEQ ID NO: 2249632 - RNA, 19 nt, Human
aacaagagcacuacauuca

SEQ ID NO: 2249633 - RNA, 22 nt, Human
aacaagaugcuggaugucugcc

SEQ ID NO: 2249634 - RNA, 20 nt, Human
aacaagauuuuaaagacaug

SEQ ID NO: 2249635 - RNA, 15 nt, Human
aacaaggcaaggcug

SEQ ID NO: 2249636 - RNA, 16 nt, Human
aacaaggcaaggcugu

SEQ ID NO: 2249637 - RNA, 19 nt, Human
aacaagaccccgucucaaa

SEQ ID NO: 2249638 - RNA, 22 nt, Human
aacaagaccucagugccuuccu

SEQ ID NO: 2249639 - RNA, 23 nt, Human
aacaagaccucagugccuuccug

SEQ ID NO: 2249640 - RNA, 21 nt, Human
aaauuuuuuuagaaagcauuu

SEQ ID NO: 2249641 - RNA, 13 nt, Human
aaauuuuuuuaga

SEQ ID NO: 2249642 - RNA, 15 nt, Human
aaauuuuuuuagaaa

SEQ ID NO: 2249643 - RNA, 18 nt, Human
gucaacagagaaggcagg

SEQ ID NO: 2249644 - RNA, 19 nt, Human
gucaacacuuaaggguuuu

SEQ ID NO: 2249645 - RNA, 22 nt, Human
gucaacagagaaggcaggaaug

SEQ ID NO: 2249646 - RNA, 19 nt, Human
gucaacagagaaggcagga

SEQ ID NO: 2249647 - RNA, 23 nt, Human
gucaacagagaaggcaggaaugu

SEQ ID NO: 2249648 - RNA, 21 nt, Human
gucacacaguauuacuucugc

SEQ ID NO: 2249649 - RNA, 12 nt, Human
gucacagccacc

SEQ ID NO: 2249650 - RNA, 13 nt, Human
gucacaccagcca

SEQ ID NO: 2249651 - RNA, 22 nt, Human
gucacacaguauuacuucugcu

SEQ ID NO: 2249652 - RNA, 20 nt, Human
gucagaauaauaagaggugc

SEQ ID NO: 2249653 - RNA, 21 nt, Human
gucacagccuccucugucugc

SEQ ID NO: 2249654 - RNA, 23 nt, Human
gucacagccuccucugucugccc

SEQ ID NO: 2249655 - RNA, 17 nt, Human
gucagaauagaaauuag

SEQ ID NO: 2249656 - RNA, 23 nt, Human
gucagaaguuucugccgcagccc

SEQ ID NO: 2249657 - RNA, 12 nt, Human
gucacagccuca

SEQ ID NO: 2249658 - RNA, 14 nt, Human
gucacagccuccuc

SEQ ID NO: 2249659 - RNA, 16 nt, Human
gucacagccuccucug

SEQ ID NO: 2249660 - RNA, 13 nt, Human
gucagaauagaaa

SEQ ID NO: 2249661 - RNA, 23 nt, Human
gucaggaguucgagaccagccug

SEQ ID NO: 2249662 - RNA, 23 nt, Human
gucaggaguuagaggccagccug

SEQ ID NO: 2249663 - RNA, 12 nt, Human
gucaggaugacg

SEQ ID NO: 2249664 - RNA, 22 nt, Human
gucaggaguuagaggccagccu

SEQ ID NO: 2249665 - RNA, 13 nt, Human
gucaggaguuccu

SEQ ID NO: 2249666 - RNA, 19 nt, Human
gucaggaguuagaggccag

SEQ ID NO: 2249667 - RNA, 18 nt, Human
gucagacauccauguuug

SEQ ID NO: 2249668 - RNA, 20 nt, Human
gucagacauccauguuugua

SEQ ID NO: 2249669 - RNA, 12 nt, Human
gucaggccacgg

SEQ ID NO: 2249670 - RNA, 13 nt, Human
gucaggcagggug

SEQ ID NO: 2249671 - RNA, 14 nt, Human
gucaggccacggca

SEQ ID NO: 2249672 - RNA, 15 nt, Human
gucaggccacggcag

SEQ ID NO: 2249673 - RNA, 16 nt, Human
gucaggccacggcagc

SEQ ID NO: 2249674 - RNA, 18 nt, Human
gucaggccacggcagccu

SEQ ID NO: 2249675 - RNA, 21 nt, Human
gucaggcccuuauuuucaaga

SEQ ID NO: 2249676 - RNA, 22 nt, Human
gucaggcccuuauuuucaagaa

SEQ ID NO: 2249677 - RNA, 13 nt, Human
gucaggcugcugg

SEQ ID NO: 2249678 - RNA, 14 nt, Human
gucaggcugcuggc

SEQ ID NO: 2249679 - RNA, 15 nt, Human
gucaggcugcuggcg

SEQ ID NO: 2249680 - RNA, 16 nt, Human
gucaggcugcuggcgc

SEQ ID NO: 2249681 - RNA, 17 nt, Human
gucaggcuccauuagga

SEQ ID NO: 2249682 - RNA, 12 nt, Human
gucaggcuccau

SEQ ID NO: 2249683 - RNA, 13 nt, Human
gucaggccugugu

SEQ ID NO: 2249684 - RNA, 15 nt, Human
gucaggccugugugu

SEQ ID NO: 2249685 - RNA, 23 nt, Human
gucaggccugugugugaaaggaa

SEQ ID NO: 2249686 - RNA, 19 nt, Human
gucaggcguagaucaccag

SEQ ID NO: 2249687 - RNA, 15 nt, Human
aaauuugguucuaau

SEQ ID NO: 2249688 - RNA, 16 nt, Human
aaauuugguucuaaua

SEQ ID NO: 2249689 - RNA, 14 nt, Human
aaauuugauuucua

SEQ ID NO: 2249690 - RNA, 17 nt, Human
aaauuugauugauuuga

SEQ ID NO: 2249691 - RNA, 15 nt, Human
aaauuugauugauuu

SEQ ID NO: 2249692 - RNA, 22 nt, Human
aaauuuguaaguuucaggugac

SEQ ID NO: 2249693 - RNA, 12 nt, Human
aaauuuguaagu

SEQ ID NO: 2249694 - RNA, 13 nt, Human
aaauuuguaaguu

SEQ ID NO: 2249695 - RNA, 14 nt, Human
aaauuuguaaguuu

SEQ ID NO: 2249696 - RNA, 15 nt, Human
aaauuuguaaguuuc

SEQ ID NO: 2249697 - RNA, 16 nt, Human
aaauuuguaaguuuca

SEQ ID NO: 2249698 - RNA, 17 nt, Human
aaauuuguaaguuucag

SEQ ID NO: 2249699 - RNA, 19 nt, Human
aaauuuguaaguuucaggu

SEQ ID NO: 2249700 - RNA, 20 nt, Human
aaauuuguaaguuucaggug

SEQ ID NO: 2249701 - RNA, 18 nt, Human
aaauuuguuauaaugaau

SEQ ID NO: 2249702 - RNA, 19 nt, Human
aaauuuguuauuuugcaac

SEQ ID NO: 2249703 - RNA, 23 nt, Human
aaauuugucuugccuuauuaaag

SEQ ID NO: 2249704 - RNA, 22 nt, Human
aaauuuuaauauggguucuuuu

SEQ ID NO: 2249705 - RNA, 14 nt, Human
aaauuuguuugaaa

SEQ ID NO: 2249706 - RNA, 18 nt, Human
aaauuuguuugaaaucuu

SEQ ID NO: 2249707 - RNA, 22 nt, Human
aaauuuguuuugacggaugauu

SEQ ID NO: 2249708 - RNA, 14 nt, Human
aaauuuguugcaua

SEQ ID NO: 2249709 - RNA, 18 nt, Human
aaauuuguugaaauuaug

SEQ ID NO: 2249710 - RNA, 13 nt, Human
aaauuuguugcau

SEQ ID NO: 2249711 - RNA, 14 nt, Human
aaauuugauugauu

SEQ ID NO: 2249712 - RNA, 18 nt, Human
gucauaacuaaauaaagc

SEQ ID NO: 2249713 - RNA, 19 nt, Human
gucagucaugauggcacca

SEQ ID NO: 2249714 - RNA, 13 nt, Human
gucaguuguauca

SEQ ID NO: 2249715 - RNA, 15 nt, Human
gucagugugacugau

SEQ ID NO: 2249716 - RNA, 16 nt, Human
gucagucacagccacc

SEQ ID NO: 2249717 - RNA, 14 nt, Human
gucagucacagcca

SEQ ID NO: 2249718 - RNA, 14 nt, Human
gucaguaugacauu

SEQ ID NO: 2249719 - RNA, 20 nt, Human
gucaguaucuguaucucucu

SEQ ID NO: 2249720 - RNA, 21 nt, Human
gucaguaucuguaucucucuc

SEQ ID NO: 2249721 - RNA, 17 nt, Human
gucaguauguggaagug

SEQ ID NO: 2249722 - RNA, 21 nt, Human
gucaguauguggaaguguggg

SEQ ID NO: 2249723 - RNA, 13 nt, Human
gucagucacagcc

SEQ ID NO: 2249724 - RNA, 14 nt, Human
gucaguauuguuuu

SEQ ID NO: 2249725 - RNA, 16 nt, Human
gucaguauuguuuugg

SEQ ID NO: 2249726 - RNA, 14 nt, Human
gucagggaccccug

SEQ ID NO: 2249727 - RNA, 21 nt, Human
gucagggaccaaggaccccuc

SEQ ID NO: 2249728 - RNA, 16 nt, Human
gucagggaccaaggac

SEQ ID NO: 2249729 - RNA, 14 nt, Human
gucagggaccaagg

SEQ ID NO: 2249730 - RNA, 13 nt, Human
gucagggaccaag

SEQ ID NO: 2249731 - RNA, 22 nt, Human
gucaggcugcuggcgccucugc

SEQ ID NO: 2249732 - RNA, 17 nt, Human
gucaggcugcuggcgcc

SEQ ID NO: 2249733 - RNA, 20 nt, Human
gucaggcugcuggcgccucu

SEQ ID NO: 2249734 - RNA, 18 nt, Human
gucagggaccccugcccu

SEQ ID NO: 2249735 - RNA, 16 nt, Human
gucaguaccuucaaac

SEQ ID NO: 2249736 - RNA, 22 nt, Human
gucaguaccuucaaacuagggc

SEQ ID NO: 2249737 - RNA, 23 nt, Human
gucaguaucaggccugccagacg

SEQ ID NO: 2249738 - RNA, 16 nt, Human
gucaguaucaggccug

SEQ ID NO: 2249739 - RNA, 17 nt, Human
aaauuauaacuuaaaau

SEQ ID NO: 2249740 - RNA, 16 nt, Human
aaauuauaacuuaaaa

SEQ ID NO: 2249741 - RNA, 21 nt, Human
aaauuaguuagccaauauuuu

SEQ ID NO: 2249742 - RNA, 23 nt, Human
aaauuagguuuuguacaauugaa

SEQ ID NO: 2249743 - RNA, 19 nt, Human
aaauuagguuuuguacaau

SEQ ID NO: 2249744 - RNA, 17 nt, Human
aaauuagguuuuguaca

SEQ ID NO: 2249745 - RNA, 17 nt, Human
aaauuaaggguuaagaa

SEQ ID NO: 2249746 - RNA, 13 nt, Human
aaauuaauaaucu

SEQ ID NO: 2249747 - RNA, 18 nt, Human
aaauuagguauuuugucc

SEQ ID NO: 2249748 - RNA, 19 nt, Human
aaauuauuaguuuacauca

SEQ ID NO: 2249749 - RNA, 14 nt, Human
aaauuauuaaugaa

SEQ ID NO: 2249750 - RNA, 23 nt, Human
aaauuauuaguuuacaucauuuu

SEQ ID NO: 2249751 - RNA, 15 nt, Human
aaauuauuuaauaaa

SEQ ID NO: 2249752 - RNA, 17 nt, Human
aaauuauagaugggaau

SEQ ID NO: 2249753 - RNA, 22 nt, Human
aaauuauaacuuaaaauauuuu

SEQ ID NO: 2249754 - RNA, 19 nt, Human
aaauuauaacuuaaaauau

SEQ ID NO: 2249755 - RNA, 12 nt, Human
aaauuaagacau

SEQ ID NO: 2249756 - RNA, 15 nt, Human
aaauuaagaaggcaa

SEQ ID NO: 2249757 - RNA, 14 nt, Human
aaauuaagaaggca

SEQ ID NO: 2249758 - RNA, 16 nt, Human
aaauuaagaagaaacu

SEQ ID NO: 2249759 - RNA, 15 nt, Human
aaauuaagaagaaac

SEQ ID NO: 2249760 - RNA, 14 nt, Human
aaauuaagaagaaa

SEQ ID NO: 2249761 - RNA, 13 nt, Human
aaauuaagaagaa

SEQ ID NO: 2249762 - RNA, 14 nt, Human
aaauguguuucugu

SEQ ID NO: 2249763 - RNA, 13 nt, Human
aaauguguuucug

SEQ ID NO: 2249764 - RNA, 14 nt, Human
aaauuaagaaagga

SEQ ID NO: 2249765 - RNA, 13 nt, Human
aaauguguauuuu

SEQ ID NO: 2249766 - RNA, 20 nt, Human
aaauguguaucggaugcuuu

SEQ ID NO: 2249767 - RNA, 10 nt, Human
aaauguguaa

SEQ ID NO: 2249768 - RNA, 13 nt, Human
aaaugugauuuuu

SEQ ID NO: 2249769 - RNA, 21 nt, Human
aaaugugaugaauacuguauu

SEQ ID NO: 2249770 - RNA, 16 nt, Human
aaauguguuuaaaaca

SEQ ID NO: 2249771 - RNA, 12 nt, Human
aaaugugugugu

SEQ ID NO: 2249772 - RNA, 12 nt, Human
aaauguguacau

SEQ ID NO: 2249773 - RNA, 14 nt, Human
guaugucauuuccu

SEQ ID NO: 2249774 - RNA, 17 nt, Human
guaugucauuuccuuca

SEQ ID NO: 2249775 - RNA, 14 nt, Human
guauguaaacagga

SEQ ID NO: 2249776 - RNA, 16 nt, Human
guaugcuuauuuuaaa

SEQ ID NO: 2249777 - RNA, 22 nt, Human
guaugccuuuaaaucugugaug

SEQ ID NO: 2249778 - RNA, 15 nt, Human
guaugguugacacua

SEQ ID NO: 2249779 - RNA, 14 nt, Human
guauguaaaugugc

SEQ ID NO: 2249780 - RNA, 15 nt, Human
guauguaaaugugca

SEQ ID NO: 2249781 - RNA, 11 nt, Human
guauguaaaug

SEQ ID NO: 2249782 - RNA, 12 nt, Human
guauguaaaugu

SEQ ID NO: 2249783 - RNA, 15 nt, Human
guauguaaauguaua

SEQ ID NO: 2249784 - RNA, 13 nt, Human
guauguaaaugug

SEQ ID NO: 2249785 - RNA, 15 nt, Human
guauguauaauucaa

SEQ ID NO: 2249786 - RNA, 11 nt, Human
guauguauaau

SEQ ID NO: 2249787 - RNA, 18 nt, Human
guauguacuucaugcugu

SEQ ID NO: 2249788 - RNA, 19 nt, Human
aaaugucuaguuguaacac

SEQ ID NO: 2249789 - RNA, 22 nt, Human
aaauguccuccagaagccucug

SEQ ID NO: 2249790 - RNA, 11 nt, Human
aaaugucuaau

SEQ ID NO: 2249791 - RNA, 16 nt, Human
aaaugucuaauguauu

SEQ ID NO: 2249792 - RNA, 22 nt, Human
aaaugucaguggaagaagcaga

SEQ ID NO: 2249793 - RNA, 22 nt, Human
aaaugucagauacaauguauuu

SEQ ID NO: 2249794 - RNA, 15 nt, Human
aaaugucagauacaa

SEQ ID NO: 2249795 - RNA, 20 nt, Human
aaaugucagauacaauguau

SEQ ID NO: 2249796 - RNA, 22 nt, Human
aaaugucuuuccuuuugcucuu

SEQ ID NO: 2249797 - RNA, 13 nt, Human
aaaugucuugugu

SEQ ID NO: 2249798 - RNA, 24 nt, Human
aaaugucuaguuguaacaccauga

SEQ ID NO: 2249799 - RNA, 18 nt, Human
aaaugucuaauguauuuu

SEQ ID NO: 2249800 - RNA, 19 nt, Human
aaaugucuaauguauuuua

SEQ ID NO: 2249801 - RNA, 20 nt, Human
aaaugucuaauguauuuuau

SEQ ID NO: 2249802 - RNA, 22 nt, Human
aaaugucuaauguauuuuauug

SEQ ID NO: 2249803 - RNA, 21 nt, Human
aaaugugaauaaaauuauuuu

SEQ ID NO: 2249804 - RNA, 19 nt, Human
aaaugugaaugggaaaaga

SEQ ID NO: 2249805 - RNA, 20 nt, Human
aaaugucuuuuuuuuaaugu

SEQ ID NO: 2249806 - RNA, 22 nt, Human
aaaugucuuuuuuuuaaugugc

SEQ ID NO: 2249807 - RNA, 13 nt, Human
aaaugugaugaau

SEQ ID NO: 2249808 - RNA, 22 nt, Human
aaauuguuuaaguguuguaaau

SEQ ID NO: 2249809 - RNA, 12 nt, Human
aaauuuauguga

SEQ ID NO: 2249810 - RNA, 21 nt, Human
aaauuguuucaaaauaaaaac

SEQ ID NO: 2249811 - RNA, 22 nt, Human
aaauuguuuccaagauagagag

SEQ ID NO: 2249812 - RNA, 15 nt, Human
aaauuuaugugaugg

SEQ ID NO: 2249813 - RNA, 19 nt, Human
aaauuuauuuacugcuagu

SEQ ID NO: 2249814 - RNA, 14 nt, Human
aaauuuauuuacug

SEQ ID NO: 2249815 - RNA, 19 nt, Human
aaauugugggucuauuucu

SEQ ID NO: 2249816 - RNA, 15 nt, Human
aaauugugauguguc

SEQ ID NO: 2249817 - RNA, 12 nt, Human
aaauugugaugu

SEQ ID NO: 2249818 - RNA, 13 nt, Human
aaauucuguuucu

SEQ ID NO: 2249819 - RNA, 12 nt, Human
aaauuguacaua

SEQ ID NO: 2249820 - RNA, 14 nt, Human
aaauuguauauuca

SEQ ID NO: 2249821 - RNA, 22 nt, Human
aaauuguacauauuuguggaau

SEQ ID NO: 2249822 - RNA, 15 nt, Human
aaauuguauauucac

SEQ ID NO: 2249823 - RNA, 16 nt, Human
aaauuguauauucacu

SEQ ID NO: 2249824 - RNA, 15 nt, Human
aaauuguacauauuu

SEQ ID NO: 2249825 - RNA, 13 nt, Human
aaauuauuucaga

SEQ ID NO: 2249826 - RNA, 13 nt, Human
aaauuauuugcau

SEQ ID NO: 2249827 - RNA, 13 nt, Human
aaauuauuugaaa

SEQ ID NO: 2249828 - RNA, 15 nt, Human
aaauuauuuauuauu

SEQ ID NO: 2249829 - RNA, 13 nt, Human
aaauuauuugugu

SEQ ID NO: 2249830 - RNA, 16 nt, Human
aaauuauuuguguaau

SEQ ID NO: 2249831 - RNA, 21 nt, Human
aaauuauuuguguaauagaaa

SEQ ID NO: 2249832 - RNA, 16 nt, Human
aaauucugucucugga

SEQ ID NO: 2249833 - RNA, 19 nt, Human
aaauuguaagcaugcacaa

SEQ ID NO: 2249834 - RNA, 18 nt, Human
aaauucugucucuggauu

SEQ ID NO: 2249835 - RNA, 20 nt, Human
aaauuguaagcaugcacaaa

SEQ ID NO: 2249836 - RNA, 20 nt, Human
gucaaacaaacucucugaac

SEQ ID NO: 2249837 - RNA, 15 nt, Human
gucaaacaaagccag

SEQ ID NO: 2249838 - RNA, 14 nt, Human
gucaaaaggugccu

SEQ ID NO: 2249839 - RNA, 15 nt, Human
gucaaaagcuggauu

SEQ ID NO: 2249840 - RNA, 16 nt, Human
gucaaaacucaaaugc

SEQ ID NO: 2249841 - RNA, 16 nt, Human
gucaaaaggugccugu

SEQ ID NO: 2249842 - RNA, 15 nt, Human
gucaaaaggugccug

SEQ ID NO: 2249843 - RNA, 18 nt, Human
guauuuuucaauaaagca

SEQ ID NO: 2249844 - RNA, 22 nt, Human
guauuuuguuuuugucuuaaaa

SEQ ID NO: 2249845 - RNA, 21 nt, Human
aaauuuauuuacugcuagucu

SEQ ID NO: 2249846 - RNA, 13 nt, Human
aaauuuauuuccu

SEQ ID NO: 2249847 - RNA, 18 nt, Human
guauuuuuaaugggggua

SEQ ID NO: 2249848 - RNA, 22 nt, Human
guauuuuuaauggggguagcag

SEQ ID NO: 2249849 - RNA, 21 nt, Human
guauuuuucaauaaagcauuu

SEQ ID NO: 2249850 - RNA, 20 nt, Human
aaauuuauuuccuaguucug

SEQ ID NO: 2249851 - RNA, 14 nt, Human
guauuuuuaauggg

SEQ ID NO: 2249852 - RNA, 13 nt, Human
gucaaaguaaaac

SEQ ID NO: 2249853 - RNA, 11 nt, Human
gucaaagaagg

SEQ ID NO: 2249854 - RNA, 18 nt, Human
gucaacaaacuauuucuu

SEQ ID NO: 2249855 - RNA, 23 nt, Human
gucaaagcaggggaguaugcaaa

SEQ ID NO: 2249856 - RNA, 16 nt, Human
gucaaagaaaugcuga

SEQ ID NO: 2249857 - RNA, 22 nt, Human
gucaacacuuaaggguuuuaga

SEQ ID NO: 2249858 - RNA, 21 nt, Human
gucaacaaguaugaauaaaga

SEQ ID NO: 2249859 - RNA, 17 nt, Human
gucaacacuaacaugau

SEQ ID NO: 2249860 - RNA, 20 nt, Human
gucaaacuguagaaaugaug

SEQ ID NO: 2249861 - RNA, 16 nt, Human
gucaaacuguagaaau

SEQ ID NO: 2249862 - RNA, 22 nt, Human
gucaaaccgcacucacccaugu

SEQ ID NO: 2249863 - RNA, 12 nt, Human
gucaaagaaaug

SEQ ID NO: 2249864 - RNA, 15 nt, Human
gucaaacgugaaaau

SEQ ID NO: 2249865 - RNA, 17 nt, Human
gucaaacgugaaaaugc

SEQ ID NO: 2249866 - RNA, 14 nt, Human
gucaaacgugaaaa

SEQ ID NO: 2249867 - RNA, 16 nt, Human
gucaaaccauaaacuu

SEQ ID NO: 2249868 - RNA, 13 nt, Human
gucaaaccgcacu

SEQ ID NO: 2249869 - RNA, 21 nt, Human
gucaaaccgcacucacccaug

SEQ ID NO: 2249870 - RNA, 17 nt, Human
gucaaacaaagccagaa

SEQ ID NO: 2249871 - RNA, 16 nt, Human
gucaaacaaagccaga

SEQ ID NO: 2249872 - RNA, 15 nt, Human
gucaaacaugaagug

SEQ ID NO: 2249873 - RNA, 16 nt, Human
gucaaacaugaagugu

SEQ ID NO: 2249874 - RNA, 22 nt, Human
guaucaggccugccagacggca

SEQ ID NO: 2249875 - RNA, 18 nt, Human
guaucaggccugccagac

SEQ ID NO: 2249876 - RNA, 17 nt, Human
guaucaggacgagaaug

SEQ ID NO: 2249877 - RNA, 22 nt, Human
guaucaggugcugccauccagg

SEQ ID NO: 2249878 - RNA, 15 nt, Human
guaucauagaaaugu

SEQ ID NO: 2249879 - RNA, 12 nt, Human
guaucauagaaa

SEQ ID NO: 2249880 - RNA, 15 nt, Human
guaucaggucuccca

SEQ ID NO: 2249881 - RNA, 17 nt, Human
guaucaguugcaauaau

SEQ ID NO: 2249882 - RNA, 14 nt, Human
guaucaugaagccu

SEQ ID NO: 2249883 - RNA, 14 nt, Human
guaucaucuggaua

SEQ ID NO: 2249884 - RNA, 17 nt, Human
guaucaugcccugugca

SEQ ID NO: 2249885 - RNA, 24 nt, Human
guaucaucuggauaggagccugcu

SEQ ID NO: 2249886 - RNA, 11 nt, Human
guaucaugcau

SEQ ID NO: 2249887 - RNA, 22 nt, Human
guaucauuguuguuugauuucu

SEQ ID NO: 2249888 - RNA, 18 nt, Human
guaucaugcccugugcaa

SEQ ID NO: 2249889 - RNA, 19 nt, Human
guauccacuuugcacagcu

SEQ ID NO: 2249890 - RNA, 14 nt, Human
guauccacuuugca

SEQ ID NO: 2249891 - RNA, 16 nt, Human
guauccaugggggcag

SEQ ID NO: 2249892 - RNA, 19 nt, Human
guaucccaacuccuauaau

SEQ ID NO: 2249893 - RNA, 21 nt, Human
guauccauuaucauguguaau

SEQ ID NO: 2249894 - RNA, 18 nt, Human
guauccauuaucaugugu

SEQ ID NO: 2249895 - RNA, 19 nt, Human
guauccauuaucaugugua

SEQ ID NO: 2249896 - RNA, 20 nt, Human
guauccaugggggcagggca

SEQ ID NO: 2249897 - RNA, 18 nt, Human
guauccaugggggcaggg

SEQ ID NO: 2249898 - RNA, 16 nt, Human
guauccauuaucaugu

SEQ ID NO: 2249899 - RNA, 17 nt, Human
guauccauuaucaugug

SEQ ID NO: 2249900 - RNA, 19 nt, Human
guaucccaugagccucagc

SEQ ID NO: 2249901 - RNA, 21 nt, Human
guaucccaugagccucagcau

SEQ ID NO: 2249902 - RNA, 18 nt, Human
guaugcaugugaagaaag

SEQ ID NO: 2249903 - RNA, 16 nt, Human
guaugcaugugaagaa

SEQ ID NO: 2249904 - RNA, 17 nt, Human
guaugcaugugaagaaa

SEQ ID NO: 2249905 - RNA, 15 nt, Human
guaugcgugugugug

SEQ ID NO: 2249906 - RNA, 15 nt, Human
guaugcuucauacag

SEQ ID NO: 2249907 - RNA, 14 nt, Human
guaugcuucauaca

SEQ ID NO: 2249908 - RNA, 13 nt, Human
guaugcuucauac

SEQ ID NO: 2249909 - RNA, 12 nt, Human
guaugcuucaua

SEQ ID NO: 2249910 - RNA, 15 nt, Human
guaugguggcugggu

SEQ ID NO: 2249911 - RNA, 16 nt, Human
guaugguggcuggguu

SEQ ID NO: 2249912 - RNA, 14 nt, Human
guaugguggcuggg

SEQ ID NO: 2249913 - RNA, 21 nt, Human
guaugcuucauacagggaugg

SEQ ID NO: 2249914 - RNA, 12 nt, Human
guauaauauuuu

SEQ ID NO: 2249915 - RNA, 15 nt, Human
guauaauauuuuuaa

SEQ ID NO: 2249916 - RNA, 21 nt, Human
guauaaugguugacuggguuu

SEQ ID NO: 2249917 - RNA, 19 nt, Human
guauaaugguugacugggu

SEQ ID NO: 2249918 - RNA, 21 nt, Human
guauaaguggaggcacuuuag

SEQ ID NO: 2249919 - RNA, 23 nt, Human
guauaaugguugacuggguuucu

SEQ ID NO: 2249920 - RNA, 13 nt, Human
guauauuguguuu

SEQ ID NO: 2249921 - RNA, 20 nt, Human
guauauuguguuuguguauu

SEQ ID NO: 2249922 - RNA, 19 nt, Human
guauauuguguuuguguau

SEQ ID NO: 2249923 - RNA, 23 nt, Human
guauaaguccuugcaagaaucag

SEQ ID NO: 2249924 - RNA, 20 nt, Human
guauaaguggaggcacuuua

SEQ ID NO: 2249925 - RNA, 19 nt, Human
guauaaguggaggcacuuu

SEQ ID NO: 2249926 - RNA, 15 nt, Human
guauaaguggugugu

SEQ ID NO: 2249927 - RNA, 21 nt, Human
guauaaaacuuuccucgccug

SEQ ID NO: 2249928 - RNA, 18 nt, Human
guauaaguaagaaaauau

SEQ ID NO: 2249929 - RNA, 15 nt, Human
guauaaaauaauuuu

SEQ ID NO: 2249930 - RNA, 21 nt, Human
guauaaaauaauuuuuauauu

SEQ ID NO: 2249931 - RNA, 23 nt, Human
guauauuugugauagcacuuucu

SEQ ID NO: 2249932 - RNA, 21 nt, Human
guauauuugugauagcacuuu

SEQ ID NO: 2249933 - RNA, 20 nt, Human
guauauuugugauagcacuu

SEQ ID NO: 2249934 - RNA, 14 nt, Human
guauauuuguacaa

SEQ ID NO: 2249935 - RNA, 16 nt, Human
guauauuuuauaucaa

SEQ ID NO: 2249936 - RNA, 17 nt, Human
guauauuuaaaagaaag

SEQ ID NO: 2249937 - RNA, 13 nt, Human
guauauuuauagu

SEQ ID NO: 2249938 - RNA, 22 nt, Human
guauauuuauagucacaagagc

SEQ ID NO: 2249939 - RNA, 13 nt, Human
guauauuuguaca

SEQ ID NO: 2249940 - RNA, 15 nt, Human
guauauuuguacaaa

SEQ ID NO: 2249941 - RNA, 16 nt, Human
guaucaggugcugcca

SEQ ID NO: 2249942 - RNA, 18 nt, Human
guaucaggugcugccauc

SEQ ID NO: 2249943 - RNA, 21 nt, Human
guauauuuugggaaucuuuuc

SEQ ID NO: 2249944 - RNA, 15 nt, Human
guaucaaauaaaauu

SEQ ID NO: 2249945 - RNA, 14 nt, Human
aaauguaagaucgu

SEQ ID NO: 2249946 - RNA, 22 nt, Human
aaauguaagaucguucucugcc

SEQ ID NO: 2249947 - RNA, 18 nt, Human
aaauguaacuuuuguaag

SEQ ID NO: 2249948 - RNA, 17 nt, Human
guaguguuggagaagaa

SEQ ID NO: 2249949 - RNA, 16 nt, Human
aaauguaagggaaacu

SEQ ID NO: 2249950 - RNA, 17 nt, Human
aaauguaacuuuuguaa

SEQ ID NO: 2249951 - RNA, 15 nt, Human
aaauguaaauauucu

SEQ ID NO: 2249952 - RNA, 22 nt, Human
aaauguaaagauauuuuuaucu

SEQ ID NO: 2249953 - RNA, 17 nt, Human
aaauguaaauauucuau

SEQ ID NO: 2249954 - RNA, 13 nt, Human
aaauguaacaguc

SEQ ID NO: 2249955 - RNA, 16 nt, Human
aaauguaacagucuga

SEQ ID NO: 2249956 - RNA, 17 nt, Human
aaauguaacagucugau

SEQ ID NO: 2249957 - RNA, 20 nt, Human
aaaugguuguauuagauguu

SEQ ID NO: 2249958 - RNA, 22 nt, Human
aaaugguuguauuagauguucu

SEQ ID NO: 2249959 - RNA, 14 nt, Human
aaaugguuguauua

SEQ ID NO: 2249960 - RNA, 16 nt, Human
aaaugguuguauuaga

SEQ ID NO: 2249961 - RNA, 17 nt, Human
aaaugguuguauuagau

SEQ ID NO: 2249962 - RNA, 19 nt, Human
aaaugguuguauuagaugu

SEQ ID NO: 2249963 - RNA, 17 nt, Human
guaguuuuucuucaaca

SEQ ID NO: 2249964 - RNA, 21 nt, Human
guaguuuuaucacauguaugu

SEQ ID NO: 2249965 - RNA, 12 nt, Human
guaguugucuuu

SEQ ID NO: 2249966 - RNA, 16 nt, Human
guaguugucuuuccug

SEQ ID NO: 2249967 - RNA, 15 nt, Human
guauaaaaaaaauag

SEQ ID NO: 2249968 - RNA, 12 nt, Human
guauaaaaacaa

SEQ ID NO: 2249969 - RNA, 19 nt, Human
guauaaaagggacugagaa

SEQ ID NO: 2249970 - RNA, 15 nt, Human
guauaaaacuuuccu

SEQ ID NO: 2249971 - RNA, 16 nt, Human
guauaaaacuuuccuc

SEQ ID NO: 2249972 - RNA, 18 nt, Human
guauaaaacuuuccucgc

SEQ ID NO: 2249973 - RNA, 19 nt, Human
guauaaaacuuuccucgcc

SEQ ID NO: 2249974 - RNA, 14 nt, Human
guaguuaggaaaua

SEQ ID NO: 2249975 - RNA, 13 nt, Human
guaguuaggaaau

SEQ ID NO: 2249976 - RNA, 11 nt, Human
guaguuaggaa

SEQ ID NO: 2249977 - RNA, 20 nt, Human
guaguguuggagaagaacug

SEQ ID NO: 2249978 - RNA, 22 nt, Human
guaguuaggaaauaaaaccuuu

SEQ ID NO: 2249979 - RNA, 20 nt, Human
guaguuaggaaauaaaaccu

SEQ ID NO: 2249980 - RNA, 16 nt, Human
guaguuaggaaauaaa

SEQ ID NO: 2249981 - RNA, 15 nt, Human
guaguuaggaaauaa

SEQ ID NO: 2249982 - RNA, 13 nt, Human
guaguuaguagca

SEQ ID NO: 2249983 - RNA, 18 nt, Human
guaguugcaauagaacag

SEQ ID NO: 2249984 - RNA, 23 nt, Human
aaauggugaaaauaaaauaaagc

SEQ ID NO: 2249985 - RNA, 11 nt, Human
aaauggugccu

SEQ ID NO: 2249986 - RNA, 18 nt, Human
aaauggucgcccaggaga

SEQ ID NO: 2249987 - RNA, 14 nt, Human
aaauggugccuuca

SEQ ID NO: 2249988 - RNA, 20 nt, Human
aaaugguguacauaauguau

SEQ ID NO: 2249989 - RNA, 14 nt, Human
aaaugguguacaua

SEQ ID NO: 2249990 - RNA, 14 nt, Human
aaaugguguuuuuu

SEQ ID NO: 2249991 - RNA, 11 nt, Human
aaaugguuaaa

SEQ ID NO: 2249992 - RNA, 13 nt, Human
aaaugguuguauu

SEQ ID NO: 2249993 - RNA, 16 nt, Human
aaaugguguacauaau

SEQ ID NO: 2249994 - RNA, 19 nt, Human
aaaugguuaaaagagguuu

SEQ ID NO: 2249995 - RNA, 13 nt, Human
aaaugguuaaaag

SEQ ID NO: 2249996 - RNA, 19 nt, Human
aaauggguagagaaacacu

SEQ ID NO: 2249997 - RNA, 20 nt, Human
aaauggguuggugcuucuaa

SEQ ID NO: 2249998 - RNA, 18 nt, Human
guaacaguucauguuugc

SEQ ID NO: 2249999 - RNA, 20 nt, Human
guaacaguucauguuugcuu

SEQ ID NO: 2250000 - RNA, 22 nt, Human
aaauggguuggugcuucuaacc

SEQ ID NO: 2250001 - RNA, 17 nt, Human
aaauggucgcccaggag

SEQ ID NO: 2250002 - RNA, 16 nt, Human
aaauggucgcccagga

SEQ ID NO: 2250003 - RNA, 14 nt, Human
aaaugguccaggag

SEQ ID NO: 2250004 - RNA, 19 nt, Human
aaaugguaggcauuuccua

SEQ ID NO: 2250005 - RNA, 22 nt, Human
guaacaggaaaauuuuaaaaau

SEQ ID NO: 2250006 - RNA, 12 nt, Human
guaacaggcaga

SEQ ID NO: 2250007 - RNA, 16 nt, Human
guaacaggucuccucu

SEQ ID NO: 2250008 - RNA, 14 nt, Human
guaacaggucuccu

SEQ ID NO: 2250009 - RNA, 14 nt, Human
guaacagaacagcu

SEQ ID NO: 2250010 - RNA, 15 nt, Human
guaacagaacagcuu

SEQ ID NO: 2250011 - RNA, 21 nt, Human
guaacaggucuccucuuaaaa

SEQ ID NO: 2250012 - RNA, 20 nt, Human
guaacaggucuccucuuaaa

SEQ ID NO: 2250013 - RNA, 18 nt, Human
guaacagucugaucguga

SEQ ID NO: 2250014 - RNA, 17 nt, Human
guaacaguucauguuug

SEQ ID NO: 2250015 - RNA, 19 nt, Human
aaaugggggugcauuugag

SEQ ID NO: 2250016 - RNA, 22 nt, Human
guaacacagcugagagacuuuu

SEQ ID NO: 2250017 - RNA, 22 nt, Human
guaacacagugccuucaauaaa

SEQ ID NO: 2250018 - RNA, 23 nt, Human
guaacacagugccuucaauaaau

SEQ ID NO: 2250019 - RNA, 17 nt, Human
guaacacaagccacaga

SEQ ID NO: 2250020 - RNA, 19 nt, Human
guaacacaagccacagaag

SEQ ID NO: 2250021 - RNA, 20 nt, Human
guaacacaagccacagaagc

SEQ ID NO: 2250022 - RNA, 19 nt, Human
guaaauuuagcauaucaau

SEQ ID NO: 2250023 - RNA, 18 nt, Human
guaaauuuccccaacagu

SEQ ID NO: 2250024 - RNA, 19 nt, Human
guaaauuuccccaacagug

SEQ ID NO: 2250025 - RNA, 19 nt, Human
guaacaauuuuaaugcuau

SEQ ID NO: 2250026 - RNA, 16 nt, Human
guaacacuuuacaaug

SEQ ID NO: 2250027 - RNA, 17 nt, Human
guaacacuuuacaaugu

SEQ ID NO: 2250028 - RNA, 11 nt, Human
guaacagaaag

SEQ ID NO: 2250029 - RNA, 12 nt, Human
guaacagaaagg

SEQ ID NO: 2250030 - RNA, 15 nt, Human
guaacagaaagggca

SEQ ID NO: 2250031 - RNA, 16 nt, Human
guaacagaaagggcaa

SEQ ID NO: 2250032 - RNA, 21 nt, Human
guaacagaaagggcaacaaua

SEQ ID NO: 2250033 - RNA, 22 nt, Human
guaacagaaagggcaacaauaa

SEQ ID NO: 2250034 - RNA, 23 nt, Human
guaacagaaagggcaacaauaaa

SEQ ID NO: 2250035 - RNA, 14 nt, Human
aacuacuguguucc

SEQ ID NO: 2250036 - RNA, 13 nt, Human
aacuacuguguuc

SEQ ID NO: 2250037 - RNA, 23 nt, Human
aacuagacucccaagcuggacua

SEQ ID NO: 2250038 - RNA, 20 nt, Human
aacuagacucccaagcugga

SEQ ID NO: 2250039 - RNA, 15 nt, Human
aacuacuguguuccu

SEQ ID NO: 2250040 - RNA, 16 nt, Human
aacuagagcagcccug

SEQ ID NO: 2250041 - RNA, 20 nt, Human
aacuagagaugacugagucc

SEQ ID NO: 2250042 - RNA, 22 nt, Human
aacuagagcagcccuggaguca

SEQ ID NO: 2250043 - RNA, 23 nt, Human
aacuagagcagcccuggagucau

SEQ ID NO: 2250044 - RNA, 21 nt, Human
aacuagaguuuagcuggaaaa

SEQ ID NO: 2250045 - RNA, 16 nt, Human
aacuaugauuuggaaa

SEQ ID NO: 2250046 - RNA, 21 nt, Human
aacuaugauuuggaaaauaaa

SEQ ID NO: 2250047 - RNA, 23 nt, Human
aacuaugcauggugccccaggac

SEQ ID NO: 2250048 - RNA, 22 nt, Human
aacuaugcauggugccccagga

SEQ ID NO: 2250049 - RNA, 17 nt, Human
aacuaugcauggugccc

SEQ ID NO: 2250050 - RNA, 18 nt, Human
aacuaugauaugguaaaa

SEQ ID NO: 2250051 - RNA, 17 nt, Human
aacuaugaacuacaaag

SEQ ID NO: 2250052 - RNA, 11 nt, Human
aacuaucuugg

SEQ ID NO: 2250053 - RNA, 18 nt, Human
aacuaucuuggugaauuu

SEQ ID NO: 2250054 - RNA, 21 nt, Human
aaccuugguguaguugaacug

SEQ ID NO: 2250055 - RNA, 19 nt, Human
aacuacgcuugcucauuuu

SEQ ID NO: 2250056 - RNA, 17 nt, Human
aacuacucagggaauga

SEQ ID NO: 2250057 - RNA, 19 nt, Human
aacuacuccggagacaggg

SEQ ID NO: 2250058 - RNA, 20 nt, Human
aaccuugguguaguugaacu

SEQ ID NO: 2250059 - RNA, 18 nt, Human
aaccuugguguaguugaa

SEQ ID NO: 2250060 - RNA, 23 nt, Human
aaccuugccuuucucgauuuuau

SEQ ID NO: 2250061 - RNA, 22 nt, Human
aacuacaugagaacaaacagau

SEQ ID NO: 2250062 - RNA, 11 nt, Human
aaccuguccuu

SEQ ID NO: 2250063 - RNA, 12 nt, Human
aaccugugucuc

SEQ ID NO: 2250064 - RNA, 18 nt, Human
aaccuugaaaacuuuaug

SEQ ID NO: 2250065 - RNA, 22 nt, Human
aaccugugaccagucugacccu

SEQ ID NO: 2250066 - RNA, 17 nt, Human
aaccuucuggccuccca

SEQ ID NO: 2250067 - RNA, 15 nt, Human
aaccuugagacagcu

SEQ ID NO: 2250068 - RNA, 16 nt, Human
aaccuugagacagcuu

SEQ ID NO: 2250069 - RNA, 13 nt, Human
aaccuugccuuuc

SEQ ID NO: 2250070 - RNA, 16 nt, Human
aacucuccucugcugc

SEQ ID NO: 2250071 - RNA, 15 nt, Human
aacucuccuccagag

SEQ ID NO: 2250072 - RNA, 18 nt, Human
aacucuccuccagaguca

SEQ ID NO: 2250073 - RNA, 15 nt, Human
gugaacguggacucc

SEQ ID NO: 2250074 - RNA, 14 nt, Human
gugaacucagccaa

SEQ ID NO: 2250075 - RNA, 14 nt, Human
gugaacgauuuaga

SEQ ID NO: 2250076 - RNA, 16 nt, Human
gugaacgauuuagaaa

SEQ ID NO: 2250077 - RNA, 14 nt, Human
gugaaccuguauaa

SEQ ID NO: 2250078 - RNA, 15 nt, Human
gugaaccaugucagc

SEQ ID NO: 2250079 - RNA, 16 nt, Human
gugaaccuaccuucau

SEQ ID NO: 2250080 - RNA, 22 nt, Human
gugaaccaccacacccagccca

SEQ ID NO: 2250081 - RNA, 23 nt, Human
gugaaccaccacacccagcccac

SEQ ID NO: 2250082 - RNA, 23 nt, Human
aacucauuccugccugucuccuu

SEQ ID NO: 2250083 - RNA, 22 nt, Human
aacucauuccugccugucuccu

SEQ ID NO: 2250084 - RNA, 22 nt, Human
aacucauuuccuauguaacugc

SEQ ID NO: 2250085 - RNA, 12 nt, Human
aacuccuggccu

SEQ ID NO: 2250086 - RNA, 15 nt, Human
aacucauuccugccu

SEQ ID NO: 2250087 - RNA, 21 nt, Human
aacucauuccugccugucucc

SEQ ID NO: 2250088 - RNA, 19 nt, Human
aacucauuccugccugucu

SEQ ID NO: 2250089 - RNA, 22 nt, Human
aacucaucuagguaaauuacag

SEQ ID NO: 2250090 - RNA, 17 nt, Human
aacucaucugucaccaa

SEQ ID NO: 2250091 - RNA, 14 nt, Human
aacuccuguccuuu

SEQ ID NO: 2250092 - RNA, 18 nt, Human
aacuccuuuagcaggugg

SEQ ID NO: 2250093 - RNA, 21 nt, Human
aacuccuuuagcagguggucc

SEQ ID NO: 2250094 - RNA, 14 nt, Human
aacucgaggacugu

SEQ ID NO: 2250095 - RNA, 19 nt, Human
aacucgaggacuguauuug

SEQ ID NO: 2250096 - RNA, 20 nt, Human
aacucgaggacuguauuugu

SEQ ID NO: 2250097 - RNA, 22 nt, Human
aacucgaggacuguauuuguga

SEQ ID NO: 2250098 - RNA, 19 nt, Human
gucuguauuuaugugugag

SEQ ID NO: 2250099 - RNA, 23 nt, Human
gucuguauuuaugugugaggagc

SEQ ID NO: 2250100 - RNA, 14 nt, Human
gucuguaagcugaa

SEQ ID NO: 2250101 - RNA, 14 nt, Human
gucuguacacgugu

SEQ ID NO: 2250102 - RNA, 19 nt, Human
gucuguacacguguccugu

SEQ ID NO: 2250103 - RNA, 20 nt, Human
gucuguacacguguccugua

SEQ ID NO: 2250104 - RNA, 21 nt, Human
gucuguacacguguccuguag

SEQ ID NO: 2250105 - RNA, 14 nt, Human
gucuguagagggcc

SEQ ID NO: 2250106 - RNA, 17 nt, Human
gucuguagagggcccug

SEQ ID NO: 2250107 - RNA, 18 nt, Human
gucuguagagggcccugg

SEQ ID NO: 2250108 - RNA, 19 nt, Human
gucuguagagggcccuggu

SEQ ID NO: 2250109 - RNA, 22 nt, Human
gucuguagagggcccugguguu

SEQ ID NO: 2250110 - RNA, 20 nt, Human
gucuuccugcauucacccag

SEQ ID NO: 2250111 - RNA, 12 nt, Human
gucuuccugugg

SEQ ID NO: 2250112 - RNA, 17 nt, Human
gucuuccugcauucacc

SEQ ID NO: 2250113 - RNA, 19 nt, Human
gucuuccugaguggugcca

SEQ ID NO: 2250114 - RNA, 15 nt, Human
gucugucuucacagc

SEQ ID NO: 2250115 - RNA, 14 nt, Human
gucuuccugugggg

SEQ ID NO: 2250116 - RNA, 15 nt, Human
gucuuccuucugccu

SEQ ID NO: 2250117 - RNA, 15 nt, Human
gucuucggaaaccuu

SEQ ID NO: 2250118 - RNA, 17 nt, Human
gucuucggaaaccuugg

SEQ ID NO: 2250119 - RNA, 13 nt, Human
gucuucguacagu

SEQ ID NO: 2250120 - RNA, 14 nt, Human
gucuucguacaguu

SEQ ID NO: 2250121 - RNA, 16 nt, Human
gucuucguacaguucu

SEQ ID NO: 2250122 - RNA, 18 nt, Human
gucuucguacaguucuuc

SEQ ID NO: 2250123 - RNA, 24 nt, Human
gucugucccgggguccuguggcag

SEQ ID NO: 2250124 - RNA, 21 nt, Human
gucugucccgggguccugugg

SEQ ID NO: 2250125 - RNA, 23 nt, Human
gucugucccgggguccuguggca

SEQ ID NO: 2250126 - RNA, 22 nt, Human
gucugucucuccaucuguuugg

SEQ ID NO: 2250127 - RNA, 14 nt, Human
gucugucucuguca

SEQ ID NO: 2250128 - RNA, 15 nt, Human
gucugucccaccagc

SEQ ID NO: 2250129 - RNA, 20 nt, Human
gucuguaucggagacaguga

SEQ ID NO: 2250130 - RNA, 22 nt, Human
gucugucaugaacauguuccug

SEQ ID NO: 2250131 - RNA, 16 nt, Human
gucugucccggggucc

SEQ ID NO: 2250132 - RNA, 19 nt, Human
gucugucccgggguccugu

SEQ ID NO: 2250133 - RNA, 20 nt, Human
gucugucccgggguccugug

SEQ ID NO: 2250134 - RNA, 14 nt, Human
gucuggcccuuccu

SEQ ID NO: 2250135 - RNA, 22 nt, Human
gucuggcagccucccauccagg

SEQ ID NO: 2250136 - RNA, 12 nt, Human
gucuggcagccu

SEQ ID NO: 2250137 - RNA, 13 nt, Human
gucuguaaaaucu

SEQ ID NO: 2250138 - RNA, 14 nt, Human
gucuguaaaaucuu

SEQ ID NO: 2250139 - RNA, 15 nt, Human
gucuguaaaaucuuu

SEQ ID NO: 2250140 - RNA, 18 nt, Human
gucuguaaaaucuuucuu

SEQ ID NO: 2250141 - RNA, 11 nt, Human
gucuguaaaau

SEQ ID NO: 2250142 - RNA, 12 nt, Human
gucuguaaaauc

SEQ ID NO: 2250143 - RNA, 16 nt, Human
gucugguuuuaacaau

SEQ ID NO: 2250144 - RNA, 18 nt, Human
gucugguuuuaacaauuu

SEQ ID NO: 2250145 - RNA, 21 nt, Human
gucugguuuuaacaauuuccu

SEQ ID NO: 2250146 - RNA, 20 nt, Human
aaccugagccccaaaaggua

SEQ ID NO: 2250147 - RNA, 20 nt, Human
aaccugagucguacagaaag

SEQ ID NO: 2250148 - RNA, 15 nt, Human
gucuuuuuaagcuua

SEQ ID NO: 2250149 - RNA, 15 nt, Human
gucuuuuguucgcau

SEQ ID NO: 2250150 - RNA, 16 nt, Human
gucuuuuucuggacug

SEQ ID NO: 2250151 - RNA, 11 nt, Human
aaccuggugcu

SEQ ID NO: 2250152 - RNA, 20 nt, Human
gucuuuuuaagcuuauuuaa

SEQ ID NO: 2250153 - RNA, 16 nt, Human
gucuuuuuaugcauuu

SEQ ID NO: 2250154 - RNA, 23 nt, Human
aaccuggucacaggacucugccu

SEQ ID NO: 2250155 - RNA, 23 nt, Human
aaccuguacuucaaguuaaagug

SEQ ID NO: 2250156 - RNA, 16 nt, Human
aaccuguaauaaauau

SEQ ID NO: 2250157 - RNA, 18 nt, Human
aaccuguaauaaauauga

SEQ ID NO: 2250158 - RNA, 14 nt, Human
aaccuggugcugga

SEQ ID NO: 2250159 - RNA, 14 nt, Human
aaccuguaauaaau

SEQ ID NO: 2250160 - RNA, 13 nt, Human
aaccuguaauaaa

SEQ ID NO: 2250161 - RNA, 15 nt, Human
aaccuguacuucaag

SEQ ID NO: 2250162 - RNA, 22 nt, Human
aaccuguauaaguggaggcacu

SEQ ID NO: 2250163 - RNA, 15 nt, Human
aaccuguccuugcac

SEQ ID NO: 2250164 - RNA, 16 nt, Human
gucuuuugacaugugg

SEQ ID NO: 2250165 - RNA, 14 nt, Human
gucuuuugacaugu

SEQ ID NO: 2250166 - RNA, 20 nt, Human
gucuuuguaaugucaccacc

SEQ ID NO: 2250167 - RNA, 19 nt, Human
gucuuuguaaugucaccac

SEQ ID NO: 2250168 - RNA, 18 nt, Human
gucuuuguaaugucacca

SEQ ID NO: 2250169 - RNA, 16 nt, Human
gucuuuguaaugucac

SEQ ID NO: 2250170 - RNA, 22 nt, Human
gucuuuguaagaguguagaagc

SEQ ID NO: 2250171 - RNA, 20 nt, Human
gucuuuguaagaguguagaa

SEQ ID NO: 2250172 - RNA, 21 nt, Human
gucuuuguaagaguguagaag

SEQ ID NO: 2250173 - RNA, 12 nt, Human
gucuuuguaaga

SEQ ID NO: 2250174 - RNA, 13 nt, Human
gucuuuguaagag

SEQ ID NO: 2250175 - RNA, 14 nt, Human
gucuuuguaagagu

SEQ ID NO: 2250176 - RNA, 15 nt, Human
gucuuuguaagagug

SEQ ID NO: 2250177 - RNA, 19 nt, Human
gucuuuugacauguggaaa

SEQ ID NO: 2250178 - RNA, 12 nt, Human
gucuuuugcaug

SEQ ID NO: 2250179 - RNA, 12 nt, Human
gucuuuugcuuu

SEQ ID NO: 2250180 - RNA, 13 nt, Human
gucuuuugcuuuu

SEQ ID NO: 2250181 - RNA, 14 nt, Human
gucuuuugcuuuug

SEQ ID NO: 2250182 - RNA, 13 nt, Human
gucuuuugcauga

SEQ ID NO: 2250183 - RNA, 16 nt, Human
gucuuuugcuuuuggc

SEQ ID NO: 2250184 - RNA, 18 nt, Human
gucuuuggacccugaggc

SEQ ID NO: 2250185 - RNA, 15 nt, Human
gucuuugguucagcu

SEQ ID NO: 2250186 - RNA, 22 nt, Human
gucuuuggguaccuauuuucau

SEQ ID NO: 2250187 - RNA, 16 nt, Human
gucuuucacauuuaaa

SEQ ID NO: 2250188 - RNA, 17 nt, Human
gucuuuaggcagcagcu

SEQ ID NO: 2250189 - RNA, 15 nt, Human
gucuuucacagcucc

SEQ ID NO: 2250190 - RNA, 16 nt, Human
gucuuucacagcuccu

SEQ ID NO: 2250191 - RNA, 14 nt, Human
gucuuuaacuguca

SEQ ID NO: 2250192 - RNA, 23 nt, Human
gucuucuaaacuuccccaucuuc

SEQ ID NO: 2250193 - RNA, 14 nt, Human
gucuucuaaacuuc

SEQ ID NO: 2250194 - RNA, 20 nt, Human
gucuucguacaguucuucgg

SEQ ID NO: 2250195 - RNA, 13 nt, Human
gucuucuaauuuc

SEQ ID NO: 2250196 - RNA, 15 nt, Human
gucuucuaauuucaa

SEQ ID NO: 2250197 - RNA, 23 nt, Human
gucuucuaauuucaaaaauauaa

SEQ ID NO: 2250198 - RNA, 16 nt, Human
aacaguuagcuggagc

SEQ ID NO: 2250199 - RNA, 20 nt, Human
aacaguuaacuuucagaaga

SEQ ID NO: 2250200 - RNA, 16 nt, Human
aacaguucauguuugc

SEQ ID NO: 2250201 - RNA, 14 nt, Human
aacaguuccuucag

SEQ ID NO: 2250202 - RNA, 23 nt, Human
aacaguucauguuugcuucauaa

SEQ ID NO: 2250203 - RNA, 19 nt, Human
aacaguuaauaccauuuuu

SEQ ID NO: 2250204 - RNA, 18 nt, Human
aacaguuaacuuucagaa

SEQ ID NO: 2250205 - RNA, 17 nt, Human
aacaguuaacuuucaga

SEQ ID NO: 2250206 - RNA, 13 nt, Human
aacaguuaacuuu

SEQ ID NO: 2250207 - RNA, 20 nt, Human
aacaguguuuuggaauaaaa

SEQ ID NO: 2250208 - RNA, 23 nt, Human
aacaguguuucccauaauuuucu

SEQ ID NO: 2250209 - RNA, 22 nt, Human
gucucccucuccugccuacuca

SEQ ID NO: 2250210 - RNA, 21 nt, Human
gucucccucuccugccuacuc

SEQ ID NO: 2250211 - RNA, 16 nt, Human
gucucccuggagugca

SEQ ID NO: 2250212 - RNA, 12 nt, Human
gucucccuggcc

SEQ ID NO: 2250213 - RNA, 13 nt, Human
gucucccuggccc

SEQ ID NO: 2250214 - RNA, 14 nt, Human
gucucccuggcccu

SEQ ID NO: 2250215 - RNA, 15 nt, Human
gucucccuggcccuc

SEQ ID NO: 2250216 - RNA, 20 nt, Human
gucucccucuccugccuacu

SEQ ID NO: 2250217 - RNA, 19 nt, Human
gucucccucuccugccuac

SEQ ID NO: 2250218 - RNA, 18 nt, Human
gucucccucuccugccua

SEQ ID NO: 2250219 - RNA, 17 nt, Human
gucucccucuccugccu

SEQ ID NO: 2250220 - RNA, 16 nt, Human
gucucccucuccugcc

SEQ ID NO: 2250221 - RNA, 15 nt, Human
gucucccucuccugc

SEQ ID NO: 2250222 - RNA, 14 nt, Human
gucucccucuccug

SEQ ID NO: 2250223 - RNA, 18 nt, Human
gucucccuuucccuucuu

SEQ ID NO: 2250224 - RNA, 15 nt, Human
gucucccuucuccca

SEQ ID NO: 2250225 - RNA, 19 nt, Human
gucucccuucucccaugag

SEQ ID NO: 2250226 - RNA, 18 nt, Human
gucucccuggcccucaag

SEQ ID NO: 2250227 - RNA, 16 nt, Human
gucucccuggcccuca

SEQ ID NO: 2250228 - RNA, 13 nt, Human
gucucccuucucc

SEQ ID NO: 2250229 - RNA, 21 nt, Human
gucuccugugcccacauccca

SEQ ID NO: 2250230 - RNA, 22 nt, Human
gucuccugugcccacaucccag

SEQ ID NO: 2250231 - RNA, 16 nt, Human
gucuccuuaacacuga

SEQ ID NO: 2250232 - RNA, 18 nt, Human
gucuccuuucaccccagg

SEQ ID NO: 2250233 - RNA, 22 nt, Human
gucuccuuaacacugagcuguc

SEQ ID NO: 2250234 - RNA, 19 nt, Human
aaccaccacacccagccca

SEQ ID NO: 2250235 - RNA, 20 nt, Human
aaccacauuggagauguuua

SEQ ID NO: 2250236 - RNA, 15 nt, Human
aaccaagucaaguga

SEQ ID NO: 2250237 - RNA, 16 nt, Human
aaccaagucaugugca

SEQ ID NO: 2250238 - RNA, 17 nt, Human
aaccaagcucucugcau

SEQ ID NO: 2250239 - RNA, 16 nt, Human
aaccaagccguggcuu

SEQ ID NO: 2250240 - RNA, 19 nt, Human
gucucgaacuccugaccuu

SEQ ID NO: 2250241 - RNA, 18 nt, Human
gucuccuuugcaggcuca

SEQ ID NO: 2250242 - RNA, 23 nt, Human
gucuccuuugcacugagggccac

SEQ ID NO: 2250243 - RNA, 15 nt, Human
aaccaagcucucugc

SEQ ID NO: 2250244 - RNA, 18 nt, Human
aaccaagccguggcuucc

SEQ ID NO: 2250245 - RNA, 18 nt, Human
gucucgaacuccugaccu

SEQ ID NO: 2250246 - RNA, 13 nt, Human
gucucgaacuccu

SEQ ID NO: 2250247 - RNA, 20 nt, Human
gucuccuuucaccccagggc

SEQ ID NO: 2250248 - RNA, 21 nt, Human
gucuccuuucucagccacaaa

SEQ ID NO: 2250249 - RNA, 15 nt, Human
gucuccuuugcacug

SEQ ID NO: 2250250 - RNA, 16 nt, Human
gucuccuuugcacuga

SEQ ID NO: 2250251 - RNA, 18 nt, Human
gucuccuuugcacugagg

SEQ ID NO: 2250252 - RNA, 20 nt, Human
gucuccuuugcacugagggc

SEQ ID NO: 2250253 - RNA, 22 nt, Human
gucuccuuugcacugagggcca

SEQ ID NO: 2250254 - RNA, 16 nt, Human
aacccaacucuccugg

SEQ ID NO: 2250255 - RNA, 16 nt, Human
aacccaagcuuagaac

SEQ ID NO: 2250256 - RNA, 15 nt, Human
aacccaagcuuagaa

SEQ ID NO: 2250257 - RNA, 18 nt, Human
aacccaaguccaagcaua

SEQ ID NO: 2250258 - RNA, 22 nt, Human
aacccaagguggguagaucacg

SEQ ID NO: 2250259 - RNA, 14 nt, Human
aacccaauccaaau

SEQ ID NO: 2250260 - RNA, 16 nt, Human
aacccaagugggggca

SEQ ID NO: 2250261 - RNA, 19 nt, Human
aacccacaggcccacagua

SEQ ID NO: 2250262 - RNA, 13 nt, Human
aacccaauaguug

SEQ ID NO: 2250263 - RNA, 18 nt, Human
aacccaaggacugaggga

SEQ ID NO: 2250264 - RNA, 22 nt, Human
aacccaaauuacguguacuaca

SEQ ID NO: 2250265 - RNA, 23 nt, Human
aacccaaauguucaucaaugaau

SEQ ID NO: 2250266 - RNA, 15 nt, Human
aaccauugucuuguu

SEQ ID NO: 2250267 - RNA, 18 nt, Human
aaccauugucuuguucug

SEQ ID NO: 2250268 - RNA, 19 nt, Human
aaccauugucuuguucugu

SEQ ID NO: 2250269 - RNA, 24 nt, Human
aaccauugucuuguucugugauga

SEQ ID NO: 2250270 - RNA, 14 nt, Human
aaccauugucuugu

SEQ ID NO: 2250271 - RNA, 16 nt, Human
aaccaucauuauaaac

SEQ ID NO: 2250272 - RNA, 13 nt, Human
aaccauguuuugg

SEQ ID NO: 2250273 - RNA, 23 nt, Human
aaccauuaaaacugaagucugaa

SEQ ID NO: 2250274 - RNA, 17 nt, Human
aaccaucauugaaaucu

SEQ ID NO: 2250275 - RNA, 18 nt, Human
aaccaucauugaaaucuu

SEQ ID NO: 2250276 - RNA, 20 nt, Human
aaccaagucaugugcauuuc

SEQ ID NO: 2250277 - RNA, 12 nt, Human
aaccaucauuga

SEQ ID NO: 2250278 - RNA, 21 nt, Human
aaccaccacacccagcccacu

SEQ ID NO: 2250279 - RNA, 17 nt, Human
aaccaccagaagcccag

SEQ ID NO: 2250280 - RNA, 14 nt, Human
aaccaccagaagcc

SEQ ID NO: 2250281 - RNA, 20 nt, Human
aaccccggggugcccacagg

SEQ ID NO: 2250282 - RNA, 22 nt, Human
aaccccgucgaggggcucucag

SEQ ID NO: 2250283 - RNA, 17 nt, Human
aaccccccauuucuucc

SEQ ID NO: 2250284 - RNA, 16 nt, Human
aacccccuuugugcug

SEQ ID NO: 2250285 - RNA, 18 nt, Human
aacccccuuugugcugug

SEQ ID NO: 2250286 - RNA, 19 nt, Human
aacccccuuugugcugugg

SEQ ID NO: 2250287 - RNA, 21 nt, Human
aaccccuacaugaaacagaaa

SEQ ID NO: 2250288 - RNA, 20 nt, Human
aaccccuggcuccaggccag

SEQ ID NO: 2250289 - RNA, 19 nt, Human
aacccccaccccacacuug

SEQ ID NO: 2250290 - RNA, 11 nt, Human
aaccccccagc

SEQ ID NO: 2250291 - RNA, 14 nt, Human
aaccccccagcacu

SEQ ID NO: 2250292 - RNA, 18 nt, Human
aaccccccagcacugagg

SEQ ID NO: 2250293 - RNA, 19 nt, Human
aaccccccagcacugagga

SEQ ID NO: 2250294 - RNA, 18 nt, Human
aacccccaccccacacuu

SEQ ID NO: 2250295 - RNA, 17 nt, Human
aacccccaccccacacu

SEQ ID NO: 2250296 - RNA, 15 nt, Human
aacccccaccccaca

SEQ ID NO: 2250297 - RNA, 13 nt, Human
aacccccacccca

SEQ ID NO: 2250298 - RNA, 12 nt, Human
aacccccacccc

SEQ ID NO: 2250299 - RNA, 11 nt, Human
aacccccaccc

SEQ ID NO: 2250300 - RNA, 10 nt, Human
aacccccacc

SEQ ID NO: 2250301 - RNA, 15 nt, Human
aacccccacacacac

SEQ ID NO: 2250302 - RNA, 14 nt, Human
aacccagccgcugc

SEQ ID NO: 2250303 - RNA, 10 nt, Human
aacccagccg

SEQ ID NO: 2250304 - RNA, 21 nt, Human
aacccagauuuugcuguauau

SEQ ID NO: 2250305 - RNA, 13 nt, Human
aacccagauuuug

SEQ ID NO: 2250306 - RNA, 10 nt, Human
aacccagcuc

SEQ ID NO: 2250307 - RNA, 23 nt, Human
aaccccaguucugcuccucucca

SEQ ID NO: 2250308 - RNA, 12 nt, Human
aacccccacaca

SEQ ID NO: 2250309 - RNA, 14 nt, Human
aacccccacacaca

SEQ ID NO: 2250310 - RNA, 13 nt, Human
aacccccacacac

SEQ ID NO: 2250311 - RNA, 14 nt, Human
aaccccaggccccg

SEQ ID NO: 2250312 - RNA, 16 nt, Human
aacccagccgcugccc

SEQ ID NO: 2250313 - RNA, 12 nt, Human
aaccccaguucu

SEQ ID NO: 2250314 - RNA, 13 nt, Human
aaccccaguucug

SEQ ID NO: 2250315 - RNA, 16 nt, Human
aaccccaguucugcuc

SEQ ID NO: 2250316 - RNA, 18 nt, Human
aaccccaguucugcuccu

SEQ ID NO: 2250317 - RNA, 19 nt, Human
aaccccaguucugcuccuc

SEQ ID NO: 2250318 - RNA, 22 nt, Human
aaccccaguucugcuccucucc

SEQ ID NO: 2250319 - RNA, 23 nt, Human
aacccagaccuguuagcagacag

SEQ ID NO: 2250320 - RNA, 14 nt, Human
aacccagacucaga

SEQ ID NO: 2250321 - RNA, 12 nt, Human
aacccagacuca

SEQ ID NO: 2250322 - RNA, 14 nt, Human
aacccaccugcuga

SEQ ID NO: 2250323 - RNA, 22 nt, Human
aacccaccuuguuggagccugc

SEQ ID NO: 2250324 - RNA, 22 nt, Human
aacccagaccuguuagcagaca

SEQ ID NO: 2250325 - RNA, 12 nt, Human
aacccagagagg

SEQ ID NO: 2250326 - RNA, 11 nt, Human
aacccagagag

SEQ ID NO: 2250327 - RNA, 18 nt, Human
aacccagacucagacauu

SEQ ID NO: 2250328 - RNA, 16 nt, Human
aacccagacucagaca

SEQ ID NO: 2250329 - RNA, 15 nt, Human
aacccagacucagac

SEQ ID NO: 2250330 - RNA, 14 nt, Human
aacccagauaaagg

SEQ ID NO: 2250331 - RNA, 15 nt, Human
aaccugaaccuagga

SEQ ID NO: 2250332 - RNA, 21 nt, Human
aaccugaaaaaaaguuuacaa

SEQ ID NO: 2250333 - RNA, 19 nt, Human
aaccugacaaaaaaaaagu

SEQ ID NO: 2250334 - RNA, 20 nt, Human
aaccugacagaugucagccg

SEQ ID NO: 2250335 - RNA, 23 nt, Human
aaccugacagaugucagccgagc

SEQ ID NO: 2250336 - RNA, 11 nt, Human
aaccugacccc

SEQ ID NO: 2250337 - RNA, 17 nt, Human
aaccugaccccugcuca

SEQ ID NO: 2250338 - RNA, 16 nt, Human
aaccugaccccugcuc

SEQ ID NO: 2250339 - RNA, 17 nt, Human
aaccugacguagcugca

SEQ ID NO: 2250340 - RNA, 20 nt, Human
aaccugaccgugggcggggc

SEQ ID NO: 2250341 - RNA, 19 nt, Human
aaccugaccccugcucagu

SEQ ID NO: 2250342 - RNA, 18 nt, Human
aaccugagccccaaaagg

SEQ ID NO: 2250343 - RNA, 19 nt, Human
aaccucgcuggacucucag

SEQ ID NO: 2250344 - RNA, 14 nt, Human
aaccucgcuggacu

SEQ ID NO: 2250345 - RNA, 11 nt, Human
aaccugaaaaa

SEQ ID NO: 2250346 - RNA, 18 nt, Human
aaccucaggcuuccuugg

SEQ ID NO: 2250347 - RNA, 14 nt, Human
aaccucagcucugg

SEQ ID NO: 2250348 - RNA, 15 nt, Human
aaccucagcucuggg

SEQ ID NO: 2250349 - RNA, 16 nt, Human
aaccucagcucuggga

SEQ ID NO: 2250350 - RNA, 21 nt, Human
aaccucagcucugggagagga

SEQ ID NO: 2250351 - RNA, 19 nt, Human
aaccucagugucauuuaug

SEQ ID NO: 2250352 - RNA, 18 nt, Human
aaccucagugucauuuau

SEQ ID NO: 2250353 - RNA, 13 nt, Human
aaccucaguguca

SEQ ID NO: 2250354 - RNA, 16 nt, Human
aaccucaucuucuuca

SEQ ID NO: 2250355 - RNA, 13 nt, Human
aaccuccuuucuc

SEQ ID NO: 2250356 - RNA, 17 nt, Human
aaccuccuuucucuucu

SEQ ID NO: 2250357 - RNA, 18 nt, Human
aaccuccuuucucuucuc

SEQ ID NO: 2250358 - RNA, 19 nt, Human
aaccuccuuucucuucucu

SEQ ID NO: 2250359 - RNA, 21 nt, Human
aaccuccuguuagcuguuauu

SEQ ID NO: 2250360 - RNA, 21 nt, Human
aaccucauugacaagaacuga

SEQ ID NO: 2250361 - RNA, 14 nt, Human
aaccucauucccca

SEQ ID NO: 2250362 - RNA, 16 nt, Human
aaccucauugacaaga

SEQ ID NO: 2250363 - RNA, 20 nt, Human
aacccgacagagggaagaaa

SEQ ID NO: 2250364 - RNA, 23 nt, Human
aacccgagucauucguucugugg

SEQ ID NO: 2250365 - RNA, 13 nt, Human
aaccucagcucug

SEQ ID NO: 2250366 - RNA, 20 nt, Human
aaccucagccuggccagaca

SEQ ID NO: 2250367 - RNA, 16 nt, Human
aacccgggaggcagag

SEQ ID NO: 2250368 - RNA, 17 nt, Human
aacccgacagagggaag

SEQ ID NO: 2250369 - RNA, 11 nt, Human
aaccccuuucc

SEQ ID NO: 2250370 - RNA, 16 nt, Human
aacccgacagagggaa

SEQ ID NO: 2250371 - RNA, 15 nt, Human
aacccgaggcccgca

SEQ ID NO: 2250372 - RNA, 16 nt, Human
aacccgaggcccgcau

SEQ ID NO: 2250373 - RNA, 13 nt, Human
aaccccuguggag

SEQ ID NO: 2250374 - RNA, 21 nt, Human
gugaacugugaggguaaaggc

SEQ ID NO: 2250375 - RNA, 23 nt, Human
gugaacuggacccuguugcuaag

SEQ ID NO: 2250376 - RNA, 21 nt, Human
gugaacuggacccuguugcua

SEQ ID NO: 2250377 - RNA, 22 nt, Human
gugaacuggacccuguugcuaa

SEQ ID NO: 2250378 - RNA, 19 nt, Human
gugaacuggacccuguugc

SEQ ID NO: 2250379 - RNA, 20 nt, Human
gugaacuggacccuguugcu

SEQ ID NO: 2250380 - RNA, 13 nt, Human
gugaacugacagg

SEQ ID NO: 2250381 - RNA, 16 nt, Human
gugaacugacaggcag

SEQ ID NO: 2250382 - RNA, 15 nt, Human
gugaacucagccaag

SEQ ID NO: 2250383 - RNA, 16 nt, Human
gugaacucagccaagc

SEQ ID NO: 2250384 - RNA, 17 nt, Human
gugaacucagccaagca

SEQ ID NO: 2250385 - RNA, 18 nt, Human
gugaacucagccaagcac

SEQ ID NO: 2250386 - RNA, 19 nt, Human
gugaacucagccaagcaca

SEQ ID NO: 2250387 - RNA, 21 nt, Human
gugaacucagccaagcacagu

SEQ ID NO: 2250388 - RNA, 22 nt, Human
gugaacucagccaagcacagug

SEQ ID NO: 2250389 - RNA, 23 nt, Human
gugaacucagccaagcacagugg

SEQ ID NO: 2250390 - RNA, 20 nt, Human
gugaacuuggggaacaaggg

SEQ ID NO: 2250391 - RNA, 15 nt, Human
gugaacuuuauuaaa

SEQ ID NO: 2250392 - RNA, 14 nt, Human
gugaacuuuuugua

SEQ ID NO: 2250393 - RNA, 23 nt, Human
gugaagaaaagugaaugcucaag

SEQ ID NO: 2250394 - RNA, 21 nt, Human
gugagaugcuagaacucccuu

SEQ ID NO: 2250395 - RNA, 19 nt, Human
gugaacuugggccacugug

SEQ ID NO: 2250396 - RNA, 17 nt, Human
gugaacuugggccacug

SEQ ID NO: 2250397 - RNA, 15 nt, Human
gugaggcccagggag

SEQ ID NO: 2250398 - RNA, 22 nt, Human
gugagaugcuggagaagagagg

SEQ ID NO: 2250399 - RNA, 13 nt, Human
gugaggccccugg

SEQ ID NO: 2250400 - RNA, 11 nt, Human
gugaggccugg

SEQ ID NO: 2250401 - RNA, 13 nt, Human
gugaggccuggcc

SEQ ID NO: 2250402 - RNA, 14 nt, Human
gugaggccuggcca

SEQ ID NO: 2250403 - RNA, 16 nt, Human
gugaggccuggccagg

SEQ ID NO: 2250404 - RNA, 21 nt, Human
gugagcaagaagucaaaguaa

SEQ ID NO: 2250405 - RNA, 14 nt, Human
gugaggccagggca

SEQ ID NO: 2250406 - RNA, 17 nt, Human
gugaggccagggcagag

SEQ ID NO: 2250407 - RNA, 15 nt, Human
gugaggccagggcag

SEQ ID NO: 2250408 - RNA, 22 nt, Human
gugagggcuugucauuaccaga

SEQ ID NO: 2250409 - RNA, 19 nt, Human
gugagggguaaaagcugau

SEQ ID NO: 2250410 - RNA, 17 nt, Human
gugagggagggcuguca

SEQ ID NO: 2250411 - RNA, 15 nt, Human
gugagggucccaugu

SEQ ID NO: 2250412 - RNA, 16 nt, Human
gugagggucccaugug

SEQ ID NO: 2250413 - RNA, 17 nt, Human
gugaggccagagacaca

SEQ ID NO: 2250414 - RNA, 22 nt, Human
gugaggccagagacacaagccu

SEQ ID NO: 2250415 - RNA, 15 nt, Human
gugagauguaauugu

SEQ ID NO: 2250416 - RNA, 15 nt, Human
gugagaugcagcugg

SEQ ID NO: 2250417 - RNA, 16 nt, Human
gugagaugcagcugga

SEQ ID NO: 2250418 - RNA, 18 nt, Human
gugagaugcagcuggaaa

SEQ ID NO: 2250419 - RNA, 15 nt, Human
gugagaugcuggaga

SEQ ID NO: 2250420 - RNA, 17 nt, Human
gugagaugcuggagaag

SEQ ID NO: 2250421 - RNA, 18 nt, Human
gugagaugcuggagaaga

SEQ ID NO: 2250422 - RNA, 19 nt, Human
gugagaugcuggagaagag

SEQ ID NO: 2250423 - RNA, 20 nt, Human
gugagaugcuggagaagaga

SEQ ID NO: 2250424 - RNA, 13 nt, Human
aacugaaagugaa

SEQ ID NO: 2250425 - RNA, 12 nt, Human
aacugaaaucau

SEQ ID NO: 2250426 - RNA, 12 nt, Human
aacugaaaagac

SEQ ID NO: 2250427 - RNA, 19 nt, Human
aacugaaaaucuaauauua

SEQ ID NO: 2250428 - RNA, 12 nt, Human
aacugaaaaugu

SEQ ID NO: 2250429 - RNA, 20 nt, Human
aacugaaaagacucaguguu

SEQ ID NO: 2250430 - RNA, 19 nt, Human
aacugaaaacaagccauga

SEQ ID NO: 2250431 - RNA, 18 nt, Human
aacucuucacaaaaucug

SEQ ID NO: 2250432 - RNA, 15 nt, Human
aacucuuaucucagu

SEQ ID NO: 2250433 - RNA, 19 nt, Human
aacucuguugcaagugcaa

SEQ ID NO: 2250434 - RNA, 17 nt, Human
aacucuuagaaaugaag

SEQ ID NO: 2250435 - RNA, 22 nt, Human
aacucuguugcaagugcaauaa

SEQ ID NO: 2250436 - RNA, 21 nt, Human
aacucuucaaucucuugcacu

SEQ ID NO: 2250437 - RNA, 14 nt, Human
aacucuuaucucag

SEQ ID NO: 2250438 - RNA, 13 nt, Human
aacucuuaucuca

SEQ ID NO: 2250439 - RNA, 18 nt, Human
gugagggucagagaggag

SEQ ID NO: 2250440 - RNA, 19 nt, Human
gugaggguuucugagcugc

SEQ ID NO: 2250441 - RNA, 18 nt, Human
gugaggguuucugagcug

SEQ ID NO: 2250442 - RNA, 19 nt, Human
gugaggugcagagugccca

SEQ ID NO: 2250443 - RNA, 21 nt, Human
gugagguggaauuauuuuaaa

SEQ ID NO: 2250444 - RNA, 21 nt, Human
gugaggugcagagugcccaga

SEQ ID NO: 2250445 - RNA, 14 nt, Human
gugaggugcccagc

SEQ ID NO: 2250446 - RNA, 16 nt, Human
gugagucuuggcggca

SEQ ID NO: 2250447 - RNA, 17 nt, Human
gugagucuuggcggcag

SEQ ID NO: 2250448 - RNA, 18 nt, Human
gugagucuuggcggcagc

SEQ ID NO: 2250449 - RNA, 22 nt, Human
gugagucgaggacagggaggug

SEQ ID NO: 2250450 - RNA, 20 nt, Human
aacucugacaacagacuucu

SEQ ID NO: 2250451 - RNA, 14 nt, Human
gugagugagccugg

SEQ ID NO: 2250452 - RNA, 15 nt, Human
gugagugagccuggc

SEQ ID NO: 2250453 - RNA, 18 nt, Human
gugagugagccuggcucu

SEQ ID NO: 2250454 - RNA, 13 nt, Human
gugagugagccug

SEQ ID NO: 2250455 - RNA, 19 nt, Human
gugagucuuggcggcagca

SEQ ID NO: 2250456 - RNA, 20 nt, Human
gugagucuuggcggcagcag

SEQ ID NO: 2250457 - RNA, 21 nt, Human
gugagucuuggcggcagcagc

SEQ ID NO: 2250458 - RNA, 22 nt, Human
gugagucuuggcggcagcagcc

SEQ ID NO: 2250459 - RNA, 23 nt, Human
aacucugacaacagacuucugaa

SEQ ID NO: 2250460 - RNA, 22 nt, Human
aacucugacaacagacuucuga

SEQ ID NO: 2250461 - RNA, 17 nt, Human
aacugcagaccuguccu

SEQ ID NO: 2250462 - RNA, 18 nt, Human
aacugcagaccuguccuc

SEQ ID NO: 2250463 - RNA, 19 nt, Human
aacugcagaccuguccucc

SEQ ID NO: 2250464 - RNA, 19 nt, Human
aacugcacugucaagauga

SEQ ID NO: 2250465 - RNA, 17 nt, Human
aacugccuuaaaacuuu

SEQ ID NO: 2250466 - RNA, 15 nt, Human
aacugccucuuuccu

SEQ ID NO: 2250467 - RNA, 17 nt, Human
aacugccuuggcuucag

SEQ ID NO: 2250468 - RNA, 16 nt, Human
aacugccuuggcuuca

SEQ ID NO: 2250469 - RNA, 20 nt, Human
aacugccucgaaacacagaa

SEQ ID NO: 2250470 - RNA, 13 nt, Human
aacugcaggcccu

SEQ ID NO: 2250471 - RNA, 20 nt, Human
aacugccuacuccaaaaugu

SEQ ID NO: 2250472 - RNA, 15 nt, Human
aacugcugacuguuu

SEQ ID NO: 2250473 - RNA, 23 nt, Human
aacugcugaaaacuagcucguga

SEQ ID NO: 2250474 - RNA, 16 nt, Human
aacugcguuaaaggcu

SEQ ID NO: 2250475 - RNA, 21 nt, Human
aacugcugacuguuuucucuu

SEQ ID NO: 2250476 - RNA, 20 nt, Human
aacugcugacuguuuucucu

SEQ ID NO: 2250477 - RNA, 14 nt, Human
aacugcugcuuuuu

SEQ ID NO: 2250478 - RNA, 20 nt, Human
aacugcugcuuuuugaggug

SEQ ID NO: 2250479 - RNA, 23 nt, Human
aacugcugacuguuuucucuuga

SEQ ID NO: 2250480 - RNA, 20 nt, Human
aacuggaagcauguaggaga

SEQ ID NO: 2250481 - RNA, 17 nt, Human
aacuggaauaguuuuuu

SEQ ID NO: 2250482 - RNA, 21 nt, Human
aacugcuuucuuucguuuguu

SEQ ID NO: 2250483 - RNA, 15 nt, Human
aacugcuuucuuucg

SEQ ID NO: 2250484 - RNA, 17 nt, Human
aacugcuuguuuccuag

SEQ ID NO: 2250485 - RNA, 22 nt, Human
aacuggacucaggaugcccagg

SEQ ID NO: 2250486 - RNA, 21 nt, Human
aacuggacucaggaugcccag

SEQ ID NO: 2250487 - RNA, 12 nt, Human
aacuggagcccc

SEQ ID NO: 2250488 - RNA, 17 nt, Human
aacuggcaguuuuccau

SEQ ID NO: 2250489 - RNA, 16 nt, Human
aacuggauuaaacuua

SEQ ID NO: 2250490 - RNA, 11 nt, Human
aacuggcugca

SEQ ID NO: 2250491 - RNA, 15 nt, Human
aacuggacucaggau

SEQ ID NO: 2250492 - RNA, 13 nt, Human
aacuggacucagg

SEQ ID NO: 2250493 - RNA, 22 nt, Human
aacuggacccuguugcuaagcc

SEQ ID NO: 2250494 - RNA, 20 nt, Human
aacuggacccuguugcuaag

SEQ ID NO: 2250495 - RNA, 21 nt, Human
aacuggacccuguugcuaagc

SEQ ID NO: 2250496 - RNA, 14 nt, Human
aacuggacccuguu

SEQ ID NO: 2250497 - RNA, 17 nt, Human
aacuggacccuguugcu

SEQ ID NO: 2250498 - RNA, 18 nt, Human
aacuggacccuguugcua

SEQ ID NO: 2250499 - RNA, 19 nt, Human
aacuggacccuguugcuaa

SEQ ID NO: 2250500 - RNA, 15 nt, Human
aacuggauuaaacuu

SEQ ID NO: 2250501 - RNA, 19 nt, Human
aacuggacugguucaaaug

SEQ ID NO: 2250502 - RNA, 16 nt, Human
aacuggguacuugugg

SEQ ID NO: 2250503 - RNA, 21 nt, Human
aacuggguacuuguggacaca

SEQ ID NO: 2250504 - RNA, 22 nt, Human
aacugggggagggugaagugaa

SEQ ID NO: 2250505 - RNA, 21 nt, Human
aacugggggagggugaaguga

SEQ ID NO: 2250506 - RNA, 17 nt, Human
aacuggccggucugcaa

SEQ ID NO: 2250507 - RNA, 21 nt, Human
aacuggccggucugcaaguca

SEQ ID NO: 2250508 - RNA, 23 nt, Human
aacuggccggucugcaagucaga

SEQ ID NO: 2250509 - RNA, 12 nt, Human
aacuggcugugu

SEQ ID NO: 2250510 - RNA, 17 nt, Human
aacugggacaggggaga

SEQ ID NO: 2250511 - RNA, 16 nt, Human
aacugggcugaacacu

SEQ ID NO: 2250512 - RNA, 14 nt, Human
aacugggcugaaca

SEQ ID NO: 2250513 - RNA, 13 nt, Human
aacugggaccuuu

SEQ ID NO: 2250514 - RNA, 13 nt, Human
gugccuccuucca

SEQ ID NO: 2250515 - RNA, 22 nt, Human
gugccucggcuuuucucagcug

SEQ ID NO: 2250516 - RNA, 22 nt, Human
gugccuccuuccaccucccucc

SEQ ID NO: 2250517 - RNA, 18 nt, Human
gugccuccuuccaccucc

SEQ ID NO: 2250518 - RNA, 21 nt, Human
gugccuccuuccaccucccuc

SEQ ID NO: 2250519 - RNA, 15 nt, Human
gugccuccaggugug

SEQ ID NO: 2250520 - RNA, 13 nt, Human
gugccuccaggug

SEQ ID NO: 2250521 - RNA, 23 nt, Human
gugccacugcccgagcuggugca

SEQ ID NO: 2250522 - RNA, 22 nt, Human
gugccacugcccgagcuggugc

SEQ ID NO: 2250523 - RNA, 21 nt, Human
gugccacugcccgagcuggug

SEQ ID NO: 2250524 - RNA, 20 nt, Human
gugccacugcccgagcuggu

SEQ ID NO: 2250525 - RNA, 19 nt, Human
gugccacugcccgagcugg

SEQ ID NO: 2250526 - RNA, 17 nt, Human
gugccugugaggcaggg

SEQ ID NO: 2250527 - RNA, 16 nt, Human
gugccugugaggcagg

SEQ ID NO: 2250528 - RNA, 15 nt, Human
gugccugugaggcag

SEQ ID NO: 2250529 - RNA, 20 nt, Human
gugccugucuguuacacugg

SEQ ID NO: 2250530 - RNA, 13 nt, Human
gugccugugucca

SEQ ID NO: 2250531 - RNA, 22 nt, Human
gugccuguguccaugcgcucag

SEQ ID NO: 2250532 - RNA, 23 nt, Human
gugccuggguggggcugcuccuc

SEQ ID NO: 2250533 - RNA, 22 nt, Human
gugccuggguggggcugcuccu

SEQ ID NO: 2250534 - RNA, 19 nt, Human
gugccuguaugcaacaggc

SEQ ID NO: 2250535 - RNA, 21 nt, Human
gugccuguaugcaacaggcac

SEQ ID NO: 2250536 - RNA, 15 nt, Human
gugccugucccaccc

SEQ ID NO: 2250537 - RNA, 20 nt, Human
gugccugucccacccccacc

SEQ ID NO: 2250538 - RNA, 12 nt, Human
gugccucugccu

SEQ ID NO: 2250539 - RNA, 21 nt, Human
gugccuggguggggcugcucc

SEQ ID NO: 2250540 - RNA, 20 nt, Human
gugccuggguggggcugcuc

SEQ ID NO: 2250541 - RNA, 18 nt, Human
gugccacugcccgagcug

SEQ ID NO: 2250542 - RNA, 17 nt, Human
gugccacugcccgagcu

SEQ ID NO: 2250543 - RNA, 22 nt, Human
gugccacccugggcucuguggg

SEQ ID NO: 2250544 - RNA, 22 nt, Human
gugccacucaccgaagccacuu

SEQ ID NO: 2250545 - RNA, 15 nt, Human
gugccacccugggcu

SEQ ID NO: 2250546 - RNA, 16 nt, Human
gugccacccugggcuc

SEQ ID NO: 2250547 - RNA, 20 nt, Human
gugccacccugggcucugug

SEQ ID NO: 2250548 - RNA, 21 nt, Human
gugccacccugggcucugugg

SEQ ID NO: 2250549 - RNA, 18 nt, Human
gugccacccaccagggcg

SEQ ID NO: 2250550 - RNA, 12 nt, Human
gugccacccugg

SEQ ID NO: 2250551 - RNA, 14 nt, Human
gugccacccugggc

SEQ ID NO: 2250552 - RNA, 11 nt, Human
gugccacccug

SEQ ID NO: 2250553 - RNA, 23 nt, Human
gugcauuacagagaggagaaaca

SEQ ID NO: 2250554 - RNA, 14 nt, Human
gugccaauuucaag

SEQ ID NO: 2250555 - RNA, 21 nt, Human
gugccaauuucaaguuccaag

SEQ ID NO: 2250556 - RNA, 23 nt, Human
gugcauuaucuagauacuguauc

SEQ ID NO: 2250557 - RNA, 16 nt, Human
gugcauuacagagagg

SEQ ID NO: 2250558 - RNA, 14 nt, Human
gugcauuacagaga

SEQ ID NO: 2250559 - RNA, 18 nt, Human
gugcaugugugugcucag

SEQ ID NO: 2250560 - RNA, 15 nt, Human
gugcaugugugugcu

SEQ ID NO: 2250561 - RNA, 14 nt, Human
gugcaugugugugc

SEQ ID NO: 2250562 - RNA, 13 nt, Human
gugcaugugugug

SEQ ID NO: 2250563 - RNA, 23 nt, Human
gugcauguaugucuuggacacug

SEQ ID NO: 2250564 - RNA, 19 nt, Human
gugcauguguguucaugca

SEQ ID NO: 2250565 - RNA, 19 nt, Human
gugcauuaucuagauacug

SEQ ID NO: 2250566 - RNA, 15 nt, Human
gugcauuaucuagau

SEQ ID NO: 2250567 - RNA, 13 nt, Human
gugcaacccaagg

SEQ ID NO: 2250568 - RNA, 14 nt, Human
gugcaacccuuacc

SEQ ID NO: 2250569 - RNA, 23 nt, Human
gugcaacccuuaccccuuagccu

SEQ ID NO: 2250570 - RNA, 23 nt, Human
gugcaaccucuuggccugaucag

SEQ ID NO: 2250571 - RNA, 14 nt, Human
gugaugguuccccu

SEQ ID NO: 2250572 - RNA, 16 nt, Human
gugaugguuccccugu

SEQ ID NO: 2250573 - RNA, 19 nt, Human
gugauggggcccugccucc

SEQ ID NO: 2250574 - RNA, 15 nt, Human
gugcaagccccugcu

SEQ ID NO: 2250575 - RNA, 22 nt, Human
gugcaagagacucuggccucca

SEQ ID NO: 2250576 - RNA, 20 nt, Human
gugcaaguaugugagugugu

SEQ ID NO: 2250577 - RNA, 12 nt, Human
gugcaagagagg

SEQ ID NO: 2250578 - RNA, 22 nt, Human
gugcaacccaaggacugaggga

SEQ ID NO: 2250579 - RNA, 18 nt, Human
gugcaagagacucuggcc

SEQ ID NO: 2250580 - RNA, 19 nt, Human
gugcaagagacucuggccu

SEQ ID NO: 2250581 - RNA, 20 nt, Human
gugcaagagacucuggccuc

SEQ ID NO: 2250582 - RNA, 18 nt, Human
gugcaagugucugugugc

SEQ ID NO: 2250583 - RNA, 17 nt, Human
gugcaagugucugugug

SEQ ID NO: 2250584 - RNA, 22 nt, Human
gugcaaguguaugcacgugugc

SEQ ID NO: 2250585 - RNA, 22 nt, Human
gugcaaugaccuuucaauagga

SEQ ID NO: 2250586 - RNA, 21 nt, Human
gugcaaugucugagugaaccu

SEQ ID NO: 2250587 - RNA, 15 nt, Human
gugcacaaauauuua

SEQ ID NO: 2250588 - RNA, 18 nt, Human
gugcacaaaacccagacc

SEQ ID NO: 2250589 - RNA, 21 nt, Human
gugcaauuuguuugugcuucu

SEQ ID NO: 2250590 - RNA, 23 nt, Human
gugcaauuuguuugugcuucuaa

SEQ ID NO: 2250591 - RNA, 22 nt, Human
gugcaauuguaggggugugugu

SEQ ID NO: 2250592 - RNA, 17 nt, Human
gugcaauuuguuugugc

SEQ ID NO: 2250593 - RNA, 20 nt, Human
gugcaauuuguuugugcuuc

SEQ ID NO: 2250594 - RNA, 20 nt, Human
gugcacagacgucccuccac

SEQ ID NO: 2250595 - RNA, 22 nt, Human
gugcacagacgucccuccacgu

SEQ ID NO: 2250596 - RNA, 21 nt, Human
gugcacacaccagagcccacc

SEQ ID NO: 2250597 - RNA, 18 nt, Human
gugcaugggugaagggag

SEQ ID NO: 2250598 - RNA, 13 nt, Human
gugcaugggugaa

SEQ ID NO: 2250599 - RNA, 16 nt, Human
gugcauguaugucuug

SEQ ID NO: 2250600 - RNA, 14 nt, Human
gugcaugguggcac

SEQ ID NO: 2250601 - RNA, 22 nt, Human
gugcaugcugucccuuacguga

SEQ ID NO: 2250602 - RNA, 13 nt, Human
gugcacagugauu

SEQ ID NO: 2250603 - RNA, 14 nt, Human
gugcacagugauuu

SEQ ID NO: 2250604 - RNA, 18 nt, Human
gugcacaucugugucuug

SEQ ID NO: 2250605 - RNA, 13 nt, Human
gugaugccucccu

SEQ ID NO: 2250606 - RNA, 22 nt, Human
gugaugcuaaagguuguauugc

SEQ ID NO: 2250607 - RNA, 12 nt, Human
gugaugcggcag

SEQ ID NO: 2250608 - RNA, 22 nt, Human
gugaugcgcaugucacggaggg

SEQ ID NO: 2250609 - RNA, 15 nt, Human
gugaugcugggcugg

SEQ ID NO: 2250610 - RNA, 13 nt, Human
gugaugcggcaga

SEQ ID NO: 2250611 - RNA, 16 nt, Human
gugaugcucaggcuug

SEQ ID NO: 2250612 - RNA, 17 nt, Human
gugaugggaaagcauug

SEQ ID NO: 2250613 - RNA, 14 nt, Human
gugauggggcccug

SEQ ID NO: 2250614 - RNA, 16 nt, Human
gugauggggcccugcc

SEQ ID NO: 2250615 - RNA, 17 nt, Human
gugauggggcccugccu

SEQ ID NO: 2250616 - RNA, 18 nt, Human
gugauggggcccugccuc

SEQ ID NO: 2250617 - RNA, 11 nt, Human
aacuucuucag

SEQ ID NO: 2250618 - RNA, 19 nt, Human
aacuucuucagagcugaca

SEQ ID NO: 2250619 - RNA, 14 nt, Human
gugaugagaggaaa

SEQ ID NO: 2250620 - RNA, 24 nt, Human
aacuucuuauggaauugauuugca

SEQ ID NO: 2250621 - RNA, 19 nt, Human
aacuucuuauggaauugau

SEQ ID NO: 2250622 - RNA, 17 nt, Human
aacuucuuauggaauug

SEQ ID NO: 2250623 - RNA, 16 nt, Human
aacuucuuauggaauu

SEQ ID NO: 2250624 - RNA, 13 nt, Human
aacuucugccugu

SEQ ID NO: 2250625 - RNA, 14 nt, Human
aacuucucucagac

SEQ ID NO: 2250626 - RNA, 15 nt, Human
aacuucucuggaaag

SEQ ID NO: 2250627 - RNA, 15 nt, Human
aacuucuuauggaau

SEQ ID NO: 2250628 - RNA, 19 nt, Human
gugaugccacacagagugg

SEQ ID NO: 2250629 - RNA, 15 nt, Human
gugaugccagguucu

SEQ ID NO: 2250630 - RNA, 18 nt, Human
gugaugccagguucuauu

SEQ ID NO: 2250631 - RNA, 23 nt, Human
gugaugccagguucuauuuggaa

SEQ ID NO: 2250632 - RNA, 17 nt, Human
gugaugccacacagagu

SEQ ID NO: 2250633 - RNA, 15 nt, Human
gugaugccacacaga

SEQ ID NO: 2250634 - RNA, 22 nt, Human
gugaugaucagcuguuugucau

SEQ ID NO: 2250635 - RNA, 15 nt, Human
gugaugaggggaggg

SEQ ID NO: 2250636 - RNA, 22 nt, Human
gugaugaagaaaagugggccag

SEQ ID NO: 2250637 - RNA, 14 nt, Human
gugaugaauacugu

SEQ ID NO: 2250638 - RNA, 22 nt, Human
gugaugacaacuggaauaguuu

SEQ ID NO: 2250639 - RNA, 16 nt, Human
gugaugagaggaaauc

SEQ ID NO: 2250640 - RNA, 13 nt, Human
aacuguacuucac

SEQ ID NO: 2250641 - RNA, 15 nt, Human
aacuguacuucacug

SEQ ID NO: 2250642 - RNA, 18 nt, Human
aacuguacuuuuaaggca

SEQ ID NO: 2250643 - RNA, 17 nt, Human
aacuguagaaaugauga

SEQ ID NO: 2250644 - RNA, 16 nt, Human
aacuguagaaaugaug

SEQ ID NO: 2250645 - RNA, 15 nt, Human
aacuguagaaaugau

SEQ ID NO: 2250646 - RNA, 14 nt, Human
aacuguagaaauga

SEQ ID NO: 2250647 - RNA, 14 nt, Human
aacuguaugucaga

SEQ ID NO: 2250648 - RNA, 21 nt, Human
aacugguuuguugcagccaaa

SEQ ID NO: 2250649 - RNA, 13 nt, Human
aacuguaaauaaa

SEQ ID NO: 2250650 - RNA, 22 nt, Human
aacugguauuuuaucuuugauu

SEQ ID NO: 2250651 - RNA, 19 nt, Human
aacuggucaccaugaaacu

SEQ ID NO: 2250652 - RNA, 13 nt, Human
aacugguauuuua

SEQ ID NO: 2250653 - RNA, 15 nt, Human
aacuggguuccugca

SEQ ID NO: 2250654 - RNA, 14 nt, Human
aacuggguuccugc

SEQ ID NO: 2250655 - RNA, 22 nt, Human
aacuucuccccugguagaaaga

SEQ ID NO: 2250656 - RNA, 22 nt, Human
aacuucccgucccauauccugc

SEQ ID NO: 2250657 - RNA, 23 nt, Human
aacuucccgucccauauccugcc

SEQ ID NO: 2250658 - RNA, 15 nt, Human
aacuuccugcaggua

SEQ ID NO: 2250659 - RNA, 23 nt, Human
aacuuccugcagguaaacaguuc

SEQ ID NO: 2250660 - RNA, 22 nt, Human
aacuuccagguguuacuguaau

SEQ ID NO: 2250661 - RNA, 18 nt, Human
aacuuccccaucuucuaa

SEQ ID NO: 2250662 - RNA, 17 nt, Human
aacuuccccaucuucua

SEQ ID NO: 2250663 - RNA, 19 nt, Human
aacuuccagguguuacugu

SEQ ID NO: 2250664 - RNA, 20 nt, Human
aacuucaugucaacuucugg

SEQ ID NO: 2250665 - RNA, 18 nt, Human
aacuucccagugaauucu

SEQ ID NO: 2250666 - RNA, 18 nt, Human
aacuuccagauccuggaa

SEQ ID NO: 2250667 - RNA, 14 nt, Human
aacuucauuugaug

SEQ ID NO: 2250668 - RNA, 12 nt, Human
aacuucauuuga

SEQ ID NO: 2250669 - RNA, 13 nt, Human
aacuuccaauuua

SEQ ID NO: 2250670 - RNA, 17 nt, Human
aacuucagcuguacuuc

SEQ ID NO: 2250671 - RNA, 19 nt, Human
aacuguagaaaugaugaug

SEQ ID NO: 2250672 - RNA, 14 nt, Human
aacuguauauauuc

SEQ ID NO: 2250673 - RNA, 21 nt, Human
aacuucaggauaauaaagugu

SEQ ID NO: 2250674 - RNA, 20 nt, Human
aacuucauauaugaggacuu

SEQ ID NO: 2250675 - RNA, 22 nt, Human
accucagguaaucgaccugccu

SEQ ID NO: 2250676 - RNA, 18 nt, Human
accucaggcuuccuuggc

SEQ ID NO: 2250677 - RNA, 18 nt, Human
accgugagcgacaaagau

SEQ ID NO: 2250678 - RNA, 14 nt, Human
accucaggccuggg

SEQ ID NO: 2250679 - RNA, 22 nt, Human
accucaggccugggggcugggc

SEQ ID NO: 2250680 - RNA, 16 nt, Human
accgugaggccagaga

SEQ ID NO: 2250681 - RNA, 17 nt, Human
accgugaggccagagac

SEQ ID NO: 2250682 - RNA, 12 nt, Human
accucaggccug

SEQ ID NO: 2250683 - RNA, 13 nt, Human
accucaggccugg

SEQ ID NO: 2250684 - RNA, 19 nt, Human
accucagugucauuuauga

SEQ ID NO: 2250685 - RNA, 14 nt, Human
accucaucaggaug

SEQ ID NO: 2250686 - RNA, 15 nt, Human
accucaucaggauga

SEQ ID NO: 2250687 - RNA, 18 nt, Human
accucaucaggaugaacc

SEQ ID NO: 2250688 - RNA, 15 nt, Human
accucaucuucuuca

SEQ ID NO: 2250689 - RNA, 20 nt, Human
accucaucaggaugaaccca

SEQ ID NO: 2250690 - RNA, 23 nt, Human
accucaguucccuuggccucaga

SEQ ID NO: 2250691 - RNA, 22 nt, Human
accucaguucccuuggccucag

SEQ ID NO: 2250692 - RNA, 17 nt, Human
accucaguuuuaucauu

SEQ ID NO: 2250693 - RNA, 18 nt, Human
accucaguuuuaucauuu

SEQ ID NO: 2250694 - RNA, 21 nt, Human
accucaguucccuuggccuca

SEQ ID NO: 2250695 - RNA, 20 nt, Human
accucaguucccuuggccuc

SEQ ID NO: 2250696 - RNA, 19 nt, Human
accucaguucccuuggccu

SEQ ID NO: 2250697 - RNA, 18 nt, Human
accucaguucccuuggcc

SEQ ID NO: 2250698 - RNA, 17 nt, Human
accucaguucccuuggc

SEQ ID NO: 2250699 - RNA, 16 nt, Human
accucaguucccuugg

SEQ ID NO: 2250700 - RNA, 21 nt, Human
accucagugucauuuaugaaa

SEQ ID NO: 2250701 - RNA, 16 nt, Human
accucagugucauuua

SEQ ID NO: 2250702 - RNA, 23 nt, Human
accucagugccuuccuguuuuuc

SEQ ID NO: 2250703 - RNA, 18 nt, Human
accucaggugagaagcag

SEQ ID NO: 2250704 - RNA, 19 nt, Human
accucaggcuuccuuggca

SEQ ID NO: 2250705 - RNA, 15 nt, Human
accucaggugaucca

SEQ ID NO: 2250706 - RNA, 23 nt, Human
accucagguaaucgaccugccuc

SEQ ID NO: 2250707 - RNA, 14 nt, Human
accccaaucccagc

SEQ ID NO: 2250708 - RNA, 17 nt, Human
accccaaggagggagau

SEQ ID NO: 2250709 - RNA, 16 nt, Human
accccacacacgccag

SEQ ID NO: 2250710 - RNA, 17 nt, Human
accccaauuccuuguag

SEQ ID NO: 2250711 - RNA, 15 nt, Human
accccaauuccuugu

SEQ ID NO: 2250712 - RNA, 22 nt, Human
acccugugauggggcccugccu

SEQ ID NO: 2250713 - RNA, 14 nt, Human
acccaugcugcccu

SEQ ID NO: 2250714 - RNA, 15 nt, Human
acccaugcugcccug

SEQ ID NO: 2250715 - RNA, 15 nt, Human
accccaacuccagua

SEQ ID NO: 2250716 - RNA, 17 nt, Human
accggcaauuuccggcc

SEQ ID NO: 2250717 - RNA, 16 nt, Human
accggauccugggugg

SEQ ID NO: 2250718 - RNA, 14 nt, Human
accggauccugggu

SEQ ID NO: 2250719 - RNA, 13 nt, Human
accggauccuggg

SEQ ID NO: 2250720 - RNA, 23 nt, Human
acccuuaucaccagcugccucuu

SEQ ID NO: 2250721 - RNA, 22 nt, Human
acccuuaccccuuagccucccu

SEQ ID NO: 2250722 - RNA, 19 nt, Human
acccuuaccccuuagccuc

SEQ ID NO: 2250723 - RNA, 18 nt, Human
acccuuaccccuuagccu

SEQ ID NO: 2250724 - RNA, 16 nt, Human
acccuguuuuauacug

SEQ ID NO: 2250725 - RNA, 19 nt, Human
acccuuacaguaggagccc

SEQ ID NO: 2250726 - RNA, 18 nt, Human
acccuuaccaugugccug

SEQ ID NO: 2250727 - RNA, 22 nt, Human
acccuuaccaugugccugaucc

SEQ ID NO: 2250728 - RNA, 13 nt, Human
acccuuacaguag

SEQ ID NO: 2250729 - RNA, 18 nt, Human
acccuuacagccucugac

SEQ ID NO: 2250730 - RNA, 19 nt, Human
acccuuacagccucugacu

SEQ ID NO: 2250731 - RNA, 19 nt, Human
acccugugcugguguccug

SEQ ID NO: 2250732 - RNA, 14 nt, Human
acccugugcuggug

SEQ ID NO: 2250733 - RNA, 15 nt, Human
acccugugcuggugu

SEQ ID NO: 2250734 - RNA, 23 nt, Human
acccugugcugguguccugacca

SEQ ID NO: 2250735 - RNA, 17 nt, Human
acccuguuaccauuuug

SEQ ID NO: 2250736 - RNA, 14 nt, Human
acccuguugcuaag

SEQ ID NO: 2250737 - RNA, 15 nt, Human
acccuguugcuaagc

SEQ ID NO: 2250738 - RNA, 14 nt, Human
acccuguuuccuga

SEQ ID NO: 2250739 - RNA, 15 nt, Human
acccuguuuccugag

SEQ ID NO: 2250740 - RNA, 12 nt, Human
acccuguugcua

SEQ ID NO: 2250741 - RNA, 18 nt, Human
accggcaauuuccggcca

SEQ ID NO: 2250742 - RNA, 14 nt, Human
accggauggcggac

SEQ ID NO: 2250743 - RNA, 20 nt, Human
accggcugcuuuucccuaag

SEQ ID NO: 2250744 - RNA, 14 nt, Human
accggcugcuuuuc

SEQ ID NO: 2250745 - RNA, 14 nt, Human
accggcuggccugg

SEQ ID NO: 2250746 - RNA, 15 nt, Human
accggcuggccuggc

SEQ ID NO: 2250747 - RNA, 20 nt, Human
accgggcacucagaagacac

SEQ ID NO: 2250748 - RNA, 19 nt, Human
accggcuggccuggccccu

SEQ ID NO: 2250749 - RNA, 17 nt, Human
accggcuggccuggccc

SEQ ID NO: 2250750 - RNA, 18 nt, Human
accggcuggccuggcccc

SEQ ID NO: 2250751 - RNA, 17 nt, Human
accguaauaauuauuau

SEQ ID NO: 2250752 - RNA, 22 nt, Human
accgucauggcuuaauguuuau

SEQ ID NO: 2250753 - RNA, 14 nt, Human
accgguggggcugg

SEQ ID NO: 2250754 - RNA, 23 nt, Human
accgucauggcuuaauguuuauu

SEQ ID NO: 2250755 - RNA, 14 nt, Human
accguccgcccugc

SEQ ID NO: 2250756 - RNA, 15 nt, Human
accguccgcccugcu

SEQ ID NO: 2250757 - RNA, 16 nt, Human
accguccgcccugcuc

SEQ ID NO: 2250758 - RNA, 12 nt, Human
accguccucacc

SEQ ID NO: 2250759 - RNA, 21 nt, Human
accguccucaccccuguccuc

SEQ ID NO: 2250760 - RNA, 13 nt, Human
accguccucaccc

SEQ ID NO: 2250761 - RNA, 15 nt, Human
accguccucaccccu

SEQ ID NO: 2250762 - RNA, 17 nt, Human
accguccucaccccugu

SEQ ID NO: 2250763 - RNA, 18 nt, Human
accguccucaccccuguc

SEQ ID NO: 2250764 - RNA, 14 nt, Human
accgugaggccaga

SEQ ID NO: 2250765 - RNA, 13 nt, Human
accgguacagaaa

SEQ ID NO: 2250766 - RNA, 15 nt, Human
accgggccacagaga

SEQ ID NO: 2250767 - RNA, 19 nt, Human
accgggccacagagaaagu

SEQ ID NO: 2250768 - RNA, 12 nt, Human
accucugccuca

SEQ ID NO: 2250769 - RNA, 17 nt, Human
accucugccucagaaaa

SEQ ID NO: 2250770 - RNA, 18 nt, Human
accucugccucagaaaac

SEQ ID NO: 2250771 - RNA, 21 nt, Human
accucuugagccuugaacuuu

SEQ ID NO: 2250772 - RNA, 20 nt, Human
accucuugagccuugaacuu

SEQ ID NO: 2250773 - RNA, 19 nt, Human
accucuugagccuugaacu

SEQ ID NO: 2250774 - RNA, 17 nt, Human
accucuugagccuugaa

SEQ ID NO: 2250775 - RNA, 15 nt, Human
accucugccucaaug

SEQ ID NO: 2250776 - RNA, 14 nt, Human
accucugccucaau

SEQ ID NO: 2250777 - RNA, 13 nt, Human
accucugccucaa

SEQ ID NO: 2250778 - RNA, 20 nt, Human
accucugccucagaaaacaa

SEQ ID NO: 2250779 - RNA, 11 nt, Human
accugccaggg

SEQ ID NO: 2250780 - RNA, 12 nt, Human
accugccaggga

SEQ ID NO: 2250781 - RNA, 13 nt, Human
accugccagggac

SEQ ID NO: 2250782 - RNA, 15 nt, Human
accugccauuugcac

SEQ ID NO: 2250783 - RNA, 21 nt, Human
accugccagggagacagagcu

SEQ ID NO: 2250784 - RNA, 18 nt, Human
accugccaggcaggggug

SEQ ID NO: 2250785 - RNA, 20 nt, Human
accugccaggcagggguggg

SEQ ID NO: 2250786 - RNA, 13 nt, Human
accugccagggag

SEQ ID NO: 2250787 - RNA, 18 nt, Human
accugccagggagacaga

SEQ ID NO: 2250788 - RNA, 18 nt, Human
accugccagggacagagg

SEQ ID NO: 2250789 - RNA, 15 nt, Human
accugccagggacag

SEQ ID NO: 2250790 - RNA, 16 nt, Human
accugccagggacaga

SEQ ID NO: 2250791 - RNA, 19 nt, Human
accugccauuugcacccuc

SEQ ID NO: 2250792 - RNA, 18 nt, Human
accugccauuugcacccu

SEQ ID NO: 2250793 - RNA, 23 nt, Human
accugccccuccucucugcccua

SEQ ID NO: 2250794 - RNA, 17 nt, Human
accugcccugcccccac

SEQ ID NO: 2250795 - RNA, 12 nt, Human
accugcccugcc

SEQ ID NO: 2250796 - RNA, 13 nt, Human
accugugaccagc

SEQ ID NO: 2250797 - RNA, 15 nt, Human
accugcccugccuga

SEQ ID NO: 2250798 - RNA, 16 nt, Human
accugcccugccugag

SEQ ID NO: 2250799 - RNA, 13 nt, Human
accugcccugccu

SEQ ID NO: 2250800 - RNA, 14 nt, Human
accugcccugccug

SEQ ID NO: 2250801 - RNA, 23 nt, Human
acuaacuagagcagcccuggagu

SEQ ID NO: 2250802 - RNA, 15 nt, Human
acuaacuaugcaugg

SEQ ID NO: 2250803 - RNA, 23 nt, Human
acuaacuaugcauggugccccag

SEQ ID NO: 2250804 - RNA, 15 nt, Human
acuaauagacaauuu

SEQ ID NO: 2250805 - RNA, 19 nt, Human
acuaauauuuuaugugaga

SEQ ID NO: 2250806 - RNA, 15 nt, Human
acuaauaugggcauu

SEQ ID NO: 2250807 - RNA, 22 nt, Human
acuaauaugggcauuguaguua

SEQ ID NO: 2250808 - RNA, 20 nt, Human
acuaacuccuaggaaaauac

SEQ ID NO: 2250809 - RNA, 15 nt, Human
acuaaccuggguucc

SEQ ID NO: 2250810 - RNA, 13 nt, Human
acuaaccugaccg

SEQ ID NO: 2250811 - RNA, 19 nt, Human
acguggcucagccagcacu

SEQ ID NO: 2250812 - RNA, 17 nt, Human
acguggcucagccagca

SEQ ID NO: 2250813 - RNA, 14 nt, Human
acguggcucugcug

SEQ ID NO: 2250814 - RNA, 15 nt, Human
acguggcucugcugg

SEQ ID NO: 2250815 - RNA, 18 nt, Human
acuaacguugagccccug

SEQ ID NO: 2250816 - RNA, 13 nt, Human
acuaacuaaacuc

SEQ ID NO: 2250817 - RNA, 14 nt, Human
acuaacuaaacucu

SEQ ID NO: 2250818 - RNA, 22 nt, Human
acuaacuaaacucucuuuggga

SEQ ID NO: 2250819 - RNA, 12 nt, Human
acuaacuagagc

SEQ ID NO: 2250820 - RNA, 13 nt, Human
acuaacuagagca

SEQ ID NO: 2250821 - RNA, 14 nt, Human
acguggagagggau

SEQ ID NO: 2250822 - RNA, 16 nt, Human
acguggagcucuuggc

SEQ ID NO: 2250823 - RNA, 15 nt, Human
acguggagagggaug

SEQ ID NO: 2250824 - RNA, 13 nt, Human
acguggagaggga

SEQ ID NO: 2250825 - RNA, 23 nt, Human
acgucugggagaaauugacagau

SEQ ID NO: 2250826 - RNA, 19 nt, Human
acgucugucuucacagcuc

SEQ ID NO: 2250827 - RNA, 15 nt, Human
acgucugucuucaca

SEQ ID NO: 2250828 - RNA, 14 nt, Human
acgucugucuucac

SEQ ID NO: 2250829 - RNA, 12 nt, Human
acguggagaggg

SEQ ID NO: 2250830 - RNA, 15 nt, Human
acguggcauguggcc

SEQ ID NO: 2250831 - RNA, 15 nt, Human
acguggcccagagaa

SEQ ID NO: 2250832 - RNA, 14 nt, Human
acguggcucagcca

SEQ ID NO: 2250833 - RNA, 16 nt, Human
acguggccucuugagc

SEQ ID NO: 2250834 - RNA, 21 nt, Human
acguggaggaaugcuccccca

SEQ ID NO: 2250835 - RNA, 13 nt, Human
acguggaggagca

SEQ ID NO: 2250836 - RNA, 17 nt, Human
acguggaggagcagugc

SEQ ID NO: 2250837 - RNA, 18 nt, Human
acguggaggagcagugca

SEQ ID NO: 2250838 - RNA, 13 nt, Human
acggagagcgccu

SEQ ID NO: 2250839 - RNA, 19 nt, Human
acggagagcgccugccccu

SEQ ID NO: 2250840 - RNA, 14 nt, Human
acggagauguuuca

SEQ ID NO: 2250841 - RNA, 18 nt, Human
acggagccacuccucuga

SEQ ID NO: 2250842 - RNA, 15 nt, Human
acgucugacaggcaa

SEQ ID NO: 2250843 - RNA, 20 nt, Human
acggagccacuccucugacu

SEQ ID NO: 2250844 - RNA, 19 nt, Human
acggagccacuccucugac

SEQ ID NO: 2250845 - RNA, 22 nt, Human
acgucugacccucuccacccca

SEQ ID NO: 2250846 - RNA, 16 nt, Human
acgucugacccucucc

SEQ ID NO: 2250847 - RNA, 17 nt, Human
acgucugggagaaauug

SEQ ID NO: 2250848 - RNA, 22 nt, Human
acgucugggagaaauugacaga

SEQ ID NO: 2250849 - RNA, 13 nt, Human
acgucugucuuca

SEQ ID NO: 2250850 - RNA, 16 nt, Human
acgucuguaagcugaa

SEQ ID NO: 2250851 - RNA, 23 nt, Human
acgucugacaggcaaugcuggcu

SEQ ID NO: 2250852 - RNA, 23 nt, Human
acgcugucccuaguaaaaauaca

SEQ ID NO: 2250853 - RNA, 11 nt, Human
acgcugucucc

SEQ ID NO: 2250854 - RNA, 21 nt, Human
acgcugguagagauggaggag

SEQ ID NO: 2250855 - RNA, 17 nt, Human
acgcugucuccagaccc

SEQ ID NO: 2250856 - RNA, 15 nt, Human
acgcugucuccagac

SEQ ID NO: 2250857 - RNA, 14 nt, Human
acgcugucuccaga

SEQ ID NO: 2250858 - RNA, 12 nt, Human
acgcugucucca

SEQ ID NO: 2250859 - RNA, 23 nt, Human
acgcugguagagauggaggagga

SEQ ID NO: 2250860 - RNA, 20 nt, Human
acgcugguagagauggagga

SEQ ID NO: 2250861 - RNA, 19 nt, Human
acgcugguagagauggagg

SEQ ID NO: 2250862 - RNA, 16 nt, Human
acggaagagccuugcg

SEQ ID NO: 2250863 - RNA, 15 nt, Human
acggaagagccuugc

SEQ ID NO: 2250864 - RNA, 13 nt, Human
acggaaguuuuca

SEQ ID NO: 2250865 - RNA, 14 nt, Human
acggaaguuuucaa

SEQ ID NO: 2250866 - RNA, 19 nt, Human
acggaaguuuucaaugaug

SEQ ID NO: 2250867 - RNA, 20 nt, Human
acggaaguuuucaaugaugg

SEQ ID NO: 2250868 - RNA, 15 nt, Human
acggaauaguuggcu

SEQ ID NO: 2250869 - RNA, 19 nt, Human
acggacacucaaaagcugg

SEQ ID NO: 2250870 - RNA, 16 nt, Human
acggacguuuccauca

SEQ ID NO: 2250871 - RNA, 19 nt, Human
acggacgaaccuugaaaac

SEQ ID NO: 2250872 - RNA, 20 nt, Human
acgcacgugggucuucaggg

SEQ ID NO: 2250873 - RNA, 16 nt, Human
acgcacgcacacacac

SEQ ID NO: 2250874 - RNA, 16 nt, Human
acgcacuccaugagca

SEQ ID NO: 2250875 - RNA, 17 nt, Human
acgcacuccaugagcac

SEQ ID NO: 2250876 - RNA, 21 nt, Human
acgcacuccaugagcacccca

SEQ ID NO: 2250877 - RNA, 17 nt, Human
acgcagaugauccauga

SEQ ID NO: 2250878 - RNA, 15 nt, Human
acgcagaugauccau

SEQ ID NO: 2250879 - RNA, 19 nt, Human
acgcagaugauccaugagu

SEQ ID NO: 2250880 - RNA, 14 nt, Human
acgcagcaggaggc

SEQ ID NO: 2250881 - RNA, 19 nt, Human
acgcuggagugcagugagc

SEQ ID NO: 2250882 - RNA, 21 nt, Human
acgcagcaggaggccaggccg

SEQ ID NO: 2250883 - RNA, 18 nt, Human
acgcuggagugcagugag

SEQ ID NO: 2250884 - RNA, 19 nt, Human
acgcacgugggucuucagg

SEQ ID NO: 2250885 - RNA, 11 nt, Human
acgcacgcaca

SEQ ID NO: 2250886 - RNA, 13 nt, Human
acgcacgcacaca

SEQ ID NO: 2250887 - RNA, 14 nt, Human
acgcacgcacacac

SEQ ID NO: 2250888 - RNA, 15 nt, Human
acgcacgcacacaca

SEQ ID NO: 2250889 - RNA, 17 nt, Human
acgcaccugccucagga

SEQ ID NO: 2250890 - RNA, 13 nt, Human
accugugucacua

SEQ ID NO: 2250891 - RNA, 16 nt, Human
accuguggugcaaaag

SEQ ID NO: 2250892 - RNA, 18 nt, Human
accuguggccaaguucuu

SEQ ID NO: 2250893 - RNA, 19 nt, Human
accuguggccaaguucuua

SEQ ID NO: 2250894 - RNA, 19 nt, Human
accugugaccagcacuguc

SEQ ID NO: 2250895 - RNA, 14 nt, Human
accugugaccagca

SEQ ID NO: 2250896 - RNA, 15 nt, Human
accugugagcccagc

SEQ ID NO: 2250897 - RNA, 18 nt, Human
accugugagcccagcugg

SEQ ID NO: 2250898 - RNA, 17 nt, Human
accugugagcccagcug

SEQ ID NO: 2250899 - RNA, 23 nt, Human
accuguggggauuucucccagcu

SEQ ID NO: 2250900 - RNA, 22 nt, Human
accuguggggauuucucccagc

SEQ ID NO: 2250901 - RNA, 21 nt, Human
accuguggggauuucucccag

SEQ ID NO: 2250902 - RNA, 20 nt, Human
accuguggggauuucuccca

SEQ ID NO: 2250903 - RNA, 19 nt, Human
accuguggggauuucuccc

SEQ ID NO: 2250904 - RNA, 23 nt, Human
accugugaccagcacugucucag

SEQ ID NO: 2250905 - RNA, 15 nt, Human
accuguggcucuaca

SEQ ID NO: 2250906 - RNA, 11 nt, Human
accugugucuc

SEQ ID NO: 2250907 - RNA, 13 nt, Human
acuauugcccagg

SEQ ID NO: 2250908 - RNA, 17 nt, Human
acuauugcuugcacaaa

SEQ ID NO: 2250909 - RNA, 18 nt, Human
acuauugaaguugcagau

SEQ ID NO: 2250910 - RNA, 19 nt, Human
acuauuggagggugggaga

SEQ ID NO: 2250911 - RNA, 13 nt, Human
acuauuggagggu

SEQ ID NO: 2250912 - RNA, 22 nt, Human
acuauuucccuugaaauuuuaa

SEQ ID NO: 2250913 - RNA, 16 nt, Human
acuauuguuagucucu

SEQ ID NO: 2250914 - RNA, 19 nt, Human
acuaguaguuccugcuaca

SEQ ID NO: 2250915 - RNA, 19 nt, Human
acuaguauuucuaugaaau

SEQ ID NO: 2250916 - RNA, 22 nt, Human
acuaggugcccagaaugaggcu

SEQ ID NO: 2250917 - RNA, 18 nt, Human
acuagguaacuucauauu

SEQ ID NO: 2250918 - RNA, 16 nt, Human
acuagggaucccucau

SEQ ID NO: 2250919 - RNA, 18 nt, Human
acuaguauuucuaugaaa

SEQ ID NO: 2250920 - RNA, 14 nt, Human
acuaggcucagaga

SEQ ID NO: 2250921 - RNA, 23 nt, Human
acuaggcccccacuugccucuuc

SEQ ID NO: 2250922 - RNA, 22 nt, Human
acuaggcccccacuugccucuu

SEQ ID NO: 2250923 - RNA, 17 nt, Human
acuagggagaagguuuc

SEQ ID NO: 2250924 - RNA, 17 nt, Human
acuagggaagauaauau

SEQ ID NO: 2250925 - RNA, 14 nt, Human
acuaaucuuucugc

SEQ ID NO: 2250926 - RNA, 22 nt, Human
acuaaucuauuggguucauuau

SEQ ID NO: 2250927 - RNA, 20 nt, Human
acuaaucuauuggguucauu

SEQ ID NO: 2250928 - RNA, 18 nt, Human
acuaaucuauuggguuca

SEQ ID NO: 2250929 - RNA, 19 nt, Human
acuaaucgaacuaugaacu

SEQ ID NO: 2250930 - RNA, 13 nt, Human
acuaaugauguuu

SEQ ID NO: 2250931 - RNA, 19 nt, Human
acuaaucugggaagggaag

SEQ ID NO: 2250932 - RNA, 16 nt, Human
acuugggaggcugagg

SEQ ID NO: 2250933 - RNA, 20 nt, Human
acuugggagaccuguaauca

SEQ ID NO: 2250934 - RNA, 13 nt, Human
acuugggaauaua

SEQ ID NO: 2250935 - RNA, 13 nt, Human
acuuggcuuucau

SEQ ID NO: 2250936 - RNA, 13 nt, Human
acuugggacauug

SEQ ID NO: 2250937 - RNA, 22 nt, Human
acuugggaggcugagaugggag

SEQ ID NO: 2250938 - RNA, 17 nt, Human
acuuucacauagauguc

SEQ ID NO: 2250939 - RNA, 15 nt, Human
acuuucacauagaug

SEQ ID NO: 2250940 - RNA, 15 nt, Human
acuuuauuaaauaca

SEQ ID NO: 2250941 - RNA, 12 nt, Human
acuuuauuaaau

SEQ ID NO: 2250942 - RNA, 23 nt, Human
acuuuaugccggaugugcuuuuc

SEQ ID NO: 2250943 - RNA, 16 nt, Human
acuuuauguguaaaua

SEQ ID NO: 2250944 - RNA, 21 nt, Human
acuuuauguguaaauacauaa

SEQ ID NO: 2250945 - RNA, 21 nt, Human
acuuucagguacuaaauaccu

SEQ ID NO: 2250946 - RNA, 18 nt, Human
acuuucagguacuaaaua

SEQ ID NO: 2250947 - RNA, 21 nt, Human
acuuucacauagaugucccuu

SEQ ID NO: 2250948 - RNA, 20 nt, Human
acuuucacauagaugucccu

SEQ ID NO: 2250949 - RNA, 22 nt, Human
acuuucaggccacauggcuaaa

SEQ ID NO: 2250950 - RNA, 15 nt, Human
acuuuauuuuguguu

SEQ ID NO: 2250951 - RNA, 13 nt, Human
acuuuauguguaa

SEQ ID NO: 2250952 - RNA, 17 nt, Human
acuuuaugcuaagugaa

SEQ ID NO: 2250953 - RNA, 12 nt, Human
acuuuaugcuaa

SEQ ID NO: 2250954 - RNA, 13 nt, Human
acuucugccucuu

SEQ ID NO: 2250955 - RNA, 12 nt, Human
acuucugccugg

SEQ ID NO: 2250956 - RNA, 13 nt, Human
acuucugccugga

SEQ ID NO: 2250957 - RNA, 14 nt, Human
acuucugcuuucca

SEQ ID NO: 2250958 - RNA, 16 nt, Human
acuucugcuuuccaca

SEQ ID NO: 2250959 - RNA, 19 nt, Human
acuucugcuuuccacaccu

SEQ ID NO: 2250960 - RNA, 12 nt, Human
acuucugccugu

SEQ ID NO: 2250961 - RNA, 16 nt, Human
acuucugccuggagac

SEQ ID NO: 2250962 - RNA, 23 nt, Human
acuucugugagacccccacaccu

SEQ ID NO: 2250963 - RNA, 20 nt, Human
acuucugugagacccccaca

SEQ ID NO: 2250964 - RNA, 19 nt, Human
acuucugugagacccccac

SEQ ID NO: 2250965 - RNA, 22 nt, Human
acuucugcuuuccacaccuggc

SEQ ID NO: 2250966 - RNA, 13 nt, Human
acuucuggcuccu

SEQ ID NO: 2250967 - RNA, 18 nt, Human
acuucuuauacauuugau

SEQ ID NO: 2250968 - RNA, 17 nt, Human
acuucuuauacauuuga

SEQ ID NO: 2250969 - RNA, 11 nt, Human
acuuggcuuuc

SEQ ID NO: 2250970 - RNA, 22 nt, Human
acuuggcucgaaucucugugcc

SEQ ID NO: 2250971 - RNA, 23 nt, Human
acuuggcucgaaucucugugccu

SEQ ID NO: 2250972 - RNA, 16 nt, Human
acuucuuaaaaguugu

SEQ ID NO: 2250973 - RNA, 19 nt, Human
acuuaaauaaaugucauua

SEQ ID NO: 2250974 - RNA, 19 nt, Human
acuucaacauuuacaugua

SEQ ID NO: 2250975 - RNA, 13 nt, Human
acuucaaggccca

SEQ ID NO: 2250976 - RNA, 20 nt, Human
acuucaaauccuugaagauu

SEQ ID NO: 2250977 - RNA, 17 nt, Human
acuucagcgguuuauau

SEQ ID NO: 2250978 - RNA, 18 nt, Human
acuucagcgguuuauaua

SEQ ID NO: 2250979 - RNA, 16 nt, Human
acuucacacacaggca

SEQ ID NO: 2250980 - RNA, 15 nt, Human
acuucaaugauagua

SEQ ID NO: 2250981 - RNA, 16 nt, Human
acuucaaguuaaagug

SEQ ID NO: 2250982 - RNA, 23 nt, Human
acuucaagugcaugcucucugca

SEQ ID NO: 2250983 - RNA, 22 nt, Human
acuucaagugcaugcucucugc

SEQ ID NO: 2250984 - RNA, 19 nt, Human
acuucagcgguuuauauaa

SEQ ID NO: 2250985 - RNA, 20 nt, Human
acuucugccauauucuguug

SEQ ID NO: 2250986 - RNA, 13 nt, Human
acuucagcucugu

SEQ ID NO: 2250987 - RNA, 11 nt, Human
acuuaaagauu

SEQ ID NO: 2250988 - RNA, 15 nt, Human
acuuaaagauuuauc

SEQ ID NO: 2250989 - RNA, 17 nt, Human
acuuaaaggcuguggua

SEQ ID NO: 2250990 - RNA, 13 nt, Human
acuuaaagauuua

SEQ ID NO: 2250991 - RNA, 13 nt, Human
acuuaaaauauuu

SEQ ID NO: 2250992 - RNA, 22 nt, Human
acuuaaaauauuccugcauuug

SEQ ID NO: 2250993 - RNA, 14 nt, Human
acuuaaauaaugug

SEQ ID NO: 2250994 - RNA, 19 nt, Human
acuucaaauccuugaagau

SEQ ID NO: 2250995 - RNA, 15 nt, Human
acuuaaaaaaugucc

SEQ ID NO: 2250996 - RNA, 16 nt, Human
acuuaaaaaaugucca

SEQ ID NO: 2250997 - RNA, 20 nt, Human
acuuaaaauauuccugcauu

SEQ ID NO: 2250998 - RNA, 21 nt, Human
acuuaaaaaugguuuaaaugg

SEQ ID NO: 2250999 - RNA, 14 nt, Human
acuuaaaaaugguu

SEQ ID NO: 2251000 - RNA, 13 nt, Human
acuuaaaaauggu

SEQ ID NO: 2251001 - RNA, 16 nt, Human
acuggaaguuuugcau

SEQ ID NO: 2251002 - RNA, 20 nt, Human
acuggaccacugggcaauga

SEQ ID NO: 2251003 - RNA, 16 nt, Human
acuggaccacugggca

SEQ ID NO: 2251004 - RNA, 15 nt, Human
acuggacccuguugc

SEQ ID NO: 2251005 - RNA, 21 nt, Human
acuggaccacugggcaaugau

SEQ ID NO: 2251006 - RNA, 15 nt, Human
acucuguuauuuaga

SEQ ID NO: 2251007 - RNA, 14 nt, Human
acucuuaagaagac

SEQ ID NO: 2251008 - RNA, 15 nt, Human
acucuuaagaagacu

SEQ ID NO: 2251009 - RNA, 17 nt, Human
acugaaguuaacagaga

SEQ ID NO: 2251010 - RNA, 16 nt, Human
acucuguuauuuagac

SEQ ID NO: 2251011 - RNA, 21 nt, Human
acugaaguuaacagagacaga

SEQ ID NO: 2251012 - RNA, 15 nt, Human
acugaaguuucacau

SEQ ID NO: 2251013 - RNA, 16 nt, Human
acugaaguuucacaug

SEQ ID NO: 2251014 - RNA, 20 nt, Human
acucuuaagaagacugcauu

SEQ ID NO: 2251015 - RNA, 19 nt, Human
acugaaguuucacaugagc

SEQ ID NO: 2251016 - RNA, 21 nt, Human
acucugugucagguggggcag

SEQ ID NO: 2251017 - RNA, 19 nt, Human
acucugugucagguggggc

SEQ ID NO: 2251018 - RNA, 17 nt, Human
acucugucucaguccau

SEQ ID NO: 2251019 - RNA, 15 nt, Human
acucugucucagucc

SEQ ID NO: 2251020 - RNA, 19 nt, Human
acucugucucaaaaaaaca

SEQ ID NO: 2251021 - RNA, 22 nt, Human
acucuagaugaaguuuuacauu

SEQ ID NO: 2251022 - RNA, 21 nt, Human
acucuagaugaaguuuuacau

SEQ ID NO: 2251023 - RNA, 21 nt, Human
acucuacuuagcaugucccua

SEQ ID NO: 2251024 - RNA, 21 nt, Human
acucuacuuaauccaaugggu

SEQ ID NO: 2251025 - RNA, 22 nt, Human
acucuaauucccauuuugcaaa

SEQ ID NO: 2251026 - RNA, 19 nt, Human
acucuacuuaauccaaugg

SEQ ID NO: 2251027 - RNA, 20 nt, Human
acucuacuuagcaugucccu

SEQ ID NO: 2251028 - RNA, 17 nt, Human
acuauuuuauuuucuaa

SEQ ID NO: 2251029 - RNA, 11 nt, Human
acuauuuuauu

SEQ ID NO: 2251030 - RNA, 13 nt, Human
acuauuuuacuuc

SEQ ID NO: 2251031 - RNA, 18 nt, Human
acuauuugucuuucagga

SEQ ID NO: 2251032 - RNA, 13 nt, Human
acuauuuuaugca

SEQ ID NO: 2251033 - RNA, 14 nt, Human
acuauuuuaugcaa

SEQ ID NO: 2251034 - RNA, 16 nt, Human
acuauuugucuuucag

SEQ ID NO: 2251035 - RNA, 21 nt, Human
acuauuucuuauauaugugaa

SEQ ID NO: 2251036 - RNA, 12 nt, Human
acuauuuccuuu

SEQ ID NO: 2251037 - RNA, 13 nt, Human
acuauuuccuuua

SEQ ID NO: 2251038 - RNA, 16 nt, Human
acuauuuccuuuauaa

SEQ ID NO: 2251039 - RNA, 15 nt, Human
acuauuuuaugcaaa

SEQ ID NO: 2251040 - RNA, 12 nt, Human
acuauuuuuacu

SEQ ID NO: 2251041 - RNA, 18 nt, Human
acuauuuuuauuuauauu

SEQ ID NO: 2251042 - RNA, 13 nt, Human
acuauuuuuacug

SEQ ID NO: 2251043 - RNA, 18 nt, Human
acuauuuuuacugccacu

SEQ ID NO: 2251044 - RNA, 21 nt, Human
acucuaauucccauuuugcaa

SEQ ID NO: 2251045 - RNA, 20 nt, Human
acucuaauucccauuuugca

SEQ ID NO: 2251046 - RNA, 21 nt, Human
acucuaauagugcuuaaaaau

SEQ ID NO: 2251047 - RNA, 14 nt, Human
acucuaauagugcu

SEQ ID NO: 2251048 - RNA, 22 nt, Human
acugaccaauauuguacaguuu

SEQ ID NO: 2251049 - RNA, 14 nt, Human
acugaccagaacua

SEQ ID NO: 2251050 - RNA, 12 nt, Human
acugaccagaac

SEQ ID NO: 2251051 - RNA, 20 nt, Human
acugaccaauauuguacagu

SEQ ID NO: 2251052 - RNA, 21 nt, Human
acugaccaauauuguacaguu

SEQ ID NO: 2251053 - RNA, 15 nt, Human
acugaccagccucca

SEQ ID NO: 2251054 - RNA, 20 nt, Human
acugaccagccuccaugcug

SEQ ID NO: 2251055 - RNA, 13 nt, Human
acugaccagccuc

SEQ ID NO: 2251056 - RNA, 22 nt, Human
acugacauuguuggccaaagcc

SEQ ID NO: 2251057 - RNA, 23 nt, Human
acugacauuguuggccaaagcca

SEQ ID NO: 2251058 - RNA, 18 nt, Human
acugaauauuuauauuuc

SEQ ID NO: 2251059 - RNA, 15 nt, Human
acugaauauuuauau

SEQ ID NO: 2251060 - RNA, 22 nt, Human
acugaauauuuauauuucacua

SEQ ID NO: 2251061 - RNA, 21 nt, Human
acugaauauuuauauuucacu

SEQ ID NO: 2251062 - RNA, 22 nt, Human
acugaaugaaacccccacacac

SEQ ID NO: 2251063 - RNA, 21 nt, Human
acugaaugaaacccccacaca

SEQ ID NO: 2251064 - RNA, 19 nt, Human
acugaaugaaacccccaca

SEQ ID NO: 2251065 - RNA, 16 nt, Human
acugaaugaaaccccc

SEQ ID NO: 2251066 - RNA, 22 nt, Human
acugaccauccacucuacccuc

SEQ ID NO: 2251067 - RNA, 16 nt, Human
acugaccauccacucu

SEQ ID NO: 2251068 - RNA, 23 nt, Human
acugaccagccuccaugcugccu

SEQ ID NO: 2251069 - RNA, 13 nt, Human
acugaucucucgu

SEQ ID NO: 2251070 - RNA, 15 nt, Human
acugaugcuuagaug

SEQ ID NO: 2251071 - RNA, 20 nt, Human
acugaugcugccccucaucu

SEQ ID NO: 2251072 - RNA, 19 nt, Human
acugaugcugccccucauc

SEQ ID NO: 2251073 - RNA, 15 nt, Human
acugaugcugccccu

SEQ ID NO: 2251074 - RNA, 14 nt, Human
acugaugcugcccc

SEQ ID NO: 2251075 - RNA, 12 nt, Human
acugaugcugcc

SEQ ID NO: 2251076 - RNA, 11 nt, Human
acugaugcugc

SEQ ID NO: 2251077 - RNA, 22 nt, Human
acugauggcuaauguacugcau

SEQ ID NO: 2251078 - RNA, 18 nt, Human
acugaugcuuuuagcuca

SEQ ID NO: 2251079 - RNA, 23 nt, Human
acugaccauccacucuacccucc

SEQ ID NO: 2251080 - RNA, 12 nt, Human
acugaugcuuuu

SEQ ID NO: 2251081 - RNA, 12 nt, Human
acugaugggcaa

SEQ ID NO: 2251082 - RNA, 22 nt, Human
acugaugggcaacccccagccu

SEQ ID NO: 2251083 - RNA, 15 nt, Human
acugcaaaggcgcag

SEQ ID NO: 2251084 - RNA, 20 nt, Human
acugauuucacaacagauca

SEQ ID NO: 2251085 - RNA, 23 nt, Human
acugauuuuuuuuuccuucagug

SEQ ID NO: 2251086 - RNA, 21 nt, Human
acugauuuuuuuuuccuucag

SEQ ID NO: 2251087 - RNA, 22 nt, Human
acugauuuuuuuuuccuucagu

SEQ ID NO: 2251088 - RNA, 13 nt, Human
acugauuguuuca

SEQ ID NO: 2251089 - RNA, 13 nt, Human
acugauuucacaa

SEQ ID NO: 2251090 - RNA, 17 nt, Human
acugauuucacaacaga

SEQ ID NO: 2251091 - RNA, 20 nt, Human
acugauucauaauaaauauc

SEQ ID NO: 2251092 - RNA, 15 nt, Human
acugcccggcagggu

SEQ ID NO: 2251093 - RNA, 23 nt, Human
acugccauaaaacauuaagaaaa

SEQ ID NO: 2251094 - RNA, 21 nt, Human
acugccauaaaacauuaagaa

SEQ ID NO: 2251095 - RNA, 22 nt, Human
acugccauaaaacauuaagaaa

SEQ ID NO: 2251096 - RNA, 19 nt, Human
acugccagucccccugccc

SEQ ID NO: 2251097 - RNA, 16 nt, Human
acugccagucucacug

SEQ ID NO: 2251098 - RNA, 13 nt, Human
acugccauaaaac

SEQ ID NO: 2251099 - RNA, 14 nt, Human
acugccauaaaaca

SEQ ID NO: 2251100 - RNA, 15 nt, Human
acugccauaaaacau

SEQ ID NO: 2251101 - RNA, 18 nt, Human
acugccagucccccugcc

SEQ ID NO: 2251102 - RNA, 18 nt, Human
acugccaggccagccucc

SEQ ID NO: 2251103 - RNA, 19 nt, Human
acugccaggccagccuccg

SEQ ID NO: 2251104 - RNA, 23 nt, Human
acugccaggccagccuccgagag

SEQ ID NO: 2251105 - RNA, 22 nt, Human
acugcccggggcagcugccaga

SEQ ID NO: 2251106 - RNA, 21 nt, Human
acugcccggggcagcugccag

SEQ ID NO: 2251107 - RNA, 20 nt, Human
acugcccuccagcucuuucc

SEQ ID NO: 2251108 - RNA, 20 nt, Human
acuggaagcuaauuugcauu

SEQ ID NO: 2251109 - RNA, 18 nt, Human
acuggaaggggaagggac

SEQ ID NO: 2251110 - RNA, 17 nt, Human
acuggaaguuuugcauu

SEQ ID NO: 2251111 - RNA, 13 nt, Human
acuggaaguuuug

SEQ ID NO: 2251112 - RNA, 23 nt, Human
acugcccuccagcucuuuccucc

SEQ ID NO: 2251113 - RNA, 18 nt, Human
acuggaagguggggacag

SEQ ID NO: 2251114 - RNA, 16 nt, Human
acugcuuuuggucugu

SEQ ID NO: 2251115 - RNA, 20 nt, Human
acugcuuuuggucuguguga

SEQ ID NO: 2251116 - RNA, 20 nt, Human
acugcccggggcagcugcca

SEQ ID NO: 2251117 - RNA, 17 nt, Human
acugcccggggcagcug

SEQ ID NO: 2251118 - RNA, 16 nt, Human
acugccaugcagggcc

SEQ ID NO: 2251119 - RNA, 22 nt, Human
acugcccgagcuggugcauuac

SEQ ID NO: 2251120 - RNA, 22 nt, Human
acugcccggcaggguccuagaa

SEQ ID NO: 2251121 - RNA, 14 nt, Human
acugcuuuuggucu

SEQ ID NO: 2251122 - RNA, 15 nt, Human
acugcuuuuggucug

SEQ ID NO: 2251123 - RNA, 22 nt, Human
acacugggagaggugccagcaa

SEQ ID NO: 2251124 - RNA, 20 nt, Human
acacugggagaaaugaaaaa

SEQ ID NO: 2251125 - RNA, 14 nt, Human
acacugggaaacag

SEQ ID NO: 2251126 - RNA, 13 nt, Human
acacugggacuug

SEQ ID NO: 2251127 - RNA, 19 nt, Human
acacugggacuugcaaaaa

SEQ ID NO: 2251128 - RNA, 18 nt, Human
acacugggacuugcaaaa

SEQ ID NO: 2251129 - RNA, 16 nt, Human
acacugggggagggga

SEQ ID NO: 2251130 - RNA, 20 nt, Human
acacuggggugccgccugcc

SEQ ID NO: 2251131 - RNA, 15 nt, Human
acacugggggagggg

SEQ ID NO: 2251132 - RNA, 23 nt, Human
acacugggagaggugccagcaac

SEQ ID NO: 2251133 - RNA, 17 nt, Human
acacugugcugagucug

SEQ ID NO: 2251134 - RNA, 22 nt, Human
acacugugcuuucuauuguaca

SEQ ID NO: 2251135 - RNA, 14 nt, Human
acacugugcuuucu

SEQ ID NO: 2251136 - RNA, 15 nt, Human
acacugugcuuucua

SEQ ID NO: 2251137 - RNA, 23 nt, Human
acacugugcuuucuauuguacag

SEQ ID NO: 2251138 - RNA, 22 nt, Human
acacugugcugagucugaaggc

SEQ ID NO: 2251139 - RNA, 16 nt, Human
acagaaccuuguuauu

SEQ ID NO: 2251140 - RNA, 17 nt, Human
acagaacaucauuagaa

SEQ ID NO: 2251141 - RNA, 17 nt, Human
acagaaccccuacauga

SEQ ID NO: 2251142 - RNA, 11 nt, Human
acacugugucc

SEQ ID NO: 2251143 - RNA, 13 nt, Human
acacuguguccug

SEQ ID NO: 2251144 - RNA, 18 nt, Human
acacuguguccuggugcu

SEQ ID NO: 2251145 - RNA, 19 nt, Human
acacuguguccuggugcuc

SEQ ID NO: 2251146 - RNA, 20 nt, Human
acacuguguccuggugcucu

SEQ ID NO: 2251147 - RNA, 21 nt, Human
acacuguguccuggugcucuc

SEQ ID NO: 2251148 - RNA, 22 nt, Human
acacuguguccuggugcucucu

SEQ ID NO: 2251149 - RNA, 18 nt, Human
acagaacucuuucaaaac

SEQ ID NO: 2251150 - RNA, 20 nt, Human
acagaacucuuucaaaaccu

SEQ ID NO: 2251151 - RNA, 22 nt, Human
acagaaccuuguuauuucucag

SEQ ID NO: 2251152 - RNA, 22 nt, Human
acagaacuaucucagcaucaga

SEQ ID NO: 2251153 - RNA, 19 nt, Human
acagaaccuuguuauuucu

SEQ ID NO: 2251154 - RNA, 17 nt, Human
acagaaccuuguuauuu

SEQ ID NO: 2251155 - RNA, 23 nt, Human
acagaaccuuguuauuucucaga

SEQ ID NO: 2251156 - RNA, 14 nt, Human
acagacacacgcac

SEQ ID NO: 2251157 - RNA, 23 nt, Human
acagacacacacacgcacgcaca

SEQ ID NO: 2251158 - RNA, 17 nt, Human
acagaggaagagcaggc

SEQ ID NO: 2251159 - RNA, 16 nt, Human
acagacacacacacgc

SEQ ID NO: 2251160 - RNA, 17 nt, Human
acagacacacacacgca

SEQ ID NO: 2251161 - RNA, 18 nt, Human
acagacacacacacgcac

SEQ ID NO: 2251162 - RNA, 22 nt, Human
acagacacacacacgcacgcac

SEQ ID NO: 2251163 - RNA, 18 nt, Human
acagaggaagagcaggca

SEQ ID NO: 2251164 - RNA, 23 nt, Human
acagaggacaguauuugugggga

SEQ ID NO: 2251165 - RNA, 13 nt, Human
acagaggcagccc

SEQ ID NO: 2251166 - RNA, 17 nt, Human
acagaggagagucccag

SEQ ID NO: 2251167 - RNA, 16 nt, Human
acagaggaugagcucu

SEQ ID NO: 2251168 - RNA, 17 nt, Human
acagaggccauggcaga

SEQ ID NO: 2251169 - RNA, 20 nt, Human
acagaggaugagcucuaccc

SEQ ID NO: 2251170 - RNA, 17 nt, Human
acagaggccaugggccu

SEQ ID NO: 2251171 - RNA, 21 nt, Human
acagaggccaugggccuccug

SEQ ID NO: 2251172 - RNA, 23 nt, Human
acagaggccaugggccuccugug

SEQ ID NO: 2251173 - RNA, 21 nt, Human
acagaagccucacugcaagca

SEQ ID NO: 2251174 - RNA, 21 nt, Human
acagaagcugaagugcaucca

SEQ ID NO: 2251175 - RNA, 13 nt, Human
acagaagcuucag

SEQ ID NO: 2251176 - RNA, 14 nt, Human
acagaagcuucaga

SEQ ID NO: 2251177 - RNA, 21 nt, Human
acagaagccaggagcaaaugu

SEQ ID NO: 2251178 - RNA, 13 nt, Human
acagaagcuucca

SEQ ID NO: 2251179 - RNA, 18 nt, Human
acagaagcuucagaaguu

SEQ ID NO: 2251180 - RNA, 19 nt, Human
acagaagcuucagaaguuu

SEQ ID NO: 2251181 - RNA, 16 nt, Human
acagaagcuccaggua

SEQ ID NO: 2251182 - RNA, 22 nt, Human
acagacaagguagcccuggcca

SEQ ID NO: 2251183 - RNA, 21 nt, Human
acagacaagguagcccuggcc

SEQ ID NO: 2251184 - RNA, 14 nt, Human
acagacaacagaag

SEQ ID NO: 2251185 - RNA, 16 nt, Human
acagaagucaugaagc

SEQ ID NO: 2251186 - RNA, 12 nt, Human
acagacacacac

SEQ ID NO: 2251187 - RNA, 13 nt, Human
acagacacacaca

SEQ ID NO: 2251188 - RNA, 14 nt, Human
acagacacacacac

SEQ ID NO: 2251189 - RNA, 11 nt, Human
acagacacaca

SEQ ID NO: 2251190 - RNA, 15 nt, Human
acagacacacacacg

SEQ ID NO: 2251191 - RNA, 14 nt, Human
acagacaaagcgug

SEQ ID NO: 2251192 - RNA, 14 nt, Human
acaauuuaaagcaa

SEQ ID NO: 2251193 - RNA, 20 nt, Human
acaauuuaaagcaaaggagu

SEQ ID NO: 2251194 - RNA, 13 nt, Human
acaauuuaaagca

SEQ ID NO: 2251195 - RNA, 15 nt, Human
acaauucuacauugu

SEQ ID NO: 2251196 - RNA, 23 nt, Human
acaauuccucuacuaacaaucag

SEQ ID NO: 2251197 - RNA, 16 nt, Human
acaauucccugcuguc

SEQ ID NO: 2251198 - RNA, 22 nt, Human
acaauuccucuacuaacaauca

SEQ ID NO: 2251199 - RNA, 18 nt, Human
acaauuccaaaggaaucu

SEQ ID NO: 2251200 - RNA, 14 nt, Human
acaauuccaaagga

SEQ ID NO: 2251201 - RNA, 15 nt, Human
acaauucccugcugu

SEQ ID NO: 2251202 - RNA, 21 nt, Human
acaauuauuuuuacaguucuc

SEQ ID NO: 2251203 - RNA, 14 nt, Human
acaauucaugaacu

SEQ ID NO: 2251204 - RNA, 15 nt, Human
acaauucaugaacuu

SEQ ID NO: 2251205 - RNA, 20 nt, Human
acaauucaugaacuucgcau

SEQ ID NO: 2251206 - RNA, 13 nt, Human
acaauuuauuaug

SEQ ID NO: 2251207 - RNA, 18 nt, Human
acaauuuaugaauugaau

SEQ ID NO: 2251208 - RNA, 20 nt, Human
acaauuuacaaaguguguau

SEQ ID NO: 2251209 - RNA, 23 nt, Human
acaauuuacaaaguguguauuaa

SEQ ID NO: 2251210 - RNA, 21 nt, Human
acaauuguuugggguugaaaa

SEQ ID NO: 2251211 - RNA, 13 nt, Human
acaauuuacaaag

SEQ ID NO: 2251212 - RNA, 17 nt, Human
acaauuuacaaagugug

SEQ ID NO: 2251213 - RNA, 19 nt, Human
acaauuuacaaagugugua

SEQ ID NO: 2251214 - RNA, 14 nt, Human
acaauuuauuaugg

SEQ ID NO: 2251215 - RNA, 18 nt, Human
acaauuauuuuuacaguu

SEQ ID NO: 2251216 - RNA, 18 nt, Human
acaauuauaucaguccuc

SEQ ID NO: 2251217 - RNA, 16 nt, Human
acaaggauugcuacug

SEQ ID NO: 2251218 - RNA, 20 nt, Human
acaaggaugaucuaggaaga

SEQ ID NO: 2251219 - RNA, 22 nt, Human
acaaggauagaugcuggcccag

SEQ ID NO: 2251220 - RNA, 19 nt, Human
acacagcucuucuccaggc

SEQ ID NO: 2251221 - RNA, 21 nt, Human
acaauuuuuuuaauuuuguau

SEQ ID NO: 2251222 - RNA, 19 nt, Human
acacaaaaguuucucuuuu

SEQ ID NO: 2251223 - RNA, 22 nt, Human
acaauuuuuuaucaugcauguc

SEQ ID NO: 2251224 - RNA, 16 nt, Human
acaauuuuuuaucaug

SEQ ID NO: 2251225 - RNA, 14 nt, Human
acaauuuuuuuaau

SEQ ID NO: 2251226 - RNA, 17 nt, Human
acaauuuuuuuaauuuu

SEQ ID NO: 2251227 - RNA, 18 nt, Human
acaauuuuuuuaauuuug

SEQ ID NO: 2251228 - RNA, 19 nt, Human
acaauuuuuuuaauuuugu

SEQ ID NO: 2251229 - RNA, 22 nt, Human
acacagcucuucuccaggcugu

SEQ ID NO: 2251230 - RNA, 14 nt, Human
acacauuuuuuaaa

SEQ ID NO: 2251231 - RNA, 20 nt, Human
acacagcucuucuccaggcu

SEQ ID NO: 2251232 - RNA, 21 nt, Human
acacagcucuucuccaggcug

SEQ ID NO: 2251233 - RNA, 20 nt, Human
acaccacuacauucuguuaa

SEQ ID NO: 2251234 - RNA, 17 nt, Human
acaccacuacauucugu

SEQ ID NO: 2251235 - RNA, 12 nt, Human
acacgaauauug

SEQ ID NO: 2251236 - RNA, 14 nt, Human
acacgaauauugcu

SEQ ID NO: 2251237 - RNA, 15 nt, Human
acaccacuacauucu

SEQ ID NO: 2251238 - RNA, 19 nt, Human
acacauuuuuuaaaugcac

SEQ ID NO: 2251239 - RNA, 18 nt, Human
acacauuuuuuaaaugca

SEQ ID NO: 2251240 - RNA, 16 nt, Human
acacauuuuuuaaaug

SEQ ID NO: 2251241 - RNA, 18 nt, Human
acacggaggcaucugcac

SEQ ID NO: 2251242 - RNA, 17 nt, Human
acacggaggcaucugca

SEQ ID NO: 2251243 - RNA, 14 nt, Human
acacggaggcaucu

SEQ ID NO: 2251244 - RNA, 14 nt, Human
acacggccacauca

SEQ ID NO: 2251245 - RNA, 12 nt, Human
acacggccacau

SEQ ID NO: 2251246 - RNA, 15 nt, Human
acacggaucugagaa

SEQ ID NO: 2251247 - RNA, 16 nt, Human
acacggaucugagaau

SEQ ID NO: 2251248 - RNA, 17 nt, Human
acacggaucugagaauc

SEQ ID NO: 2251249 - RNA, 19 nt, Human
acacggaucugagaaucuu

SEQ ID NO: 2251250 - RNA, 15 nt, Human
acacgaauauugcug

SEQ ID NO: 2251251 - RNA, 21 nt, Human
acacgaauauugcugauggug

SEQ ID NO: 2251252 - RNA, 16 nt, Human
acacguacuuaaauga

SEQ ID NO: 2251253 - RNA, 19 nt, Human
acacgguuugaagccugga

SEQ ID NO: 2251254 - RNA, 22 nt, Human
acacgguuugaagccuggaaca

SEQ ID NO: 2251255 - RNA, 19 nt, Human
acacguaccucucaucagu

SEQ ID NO: 2251256 - RNA, 20 nt, Human
acacguaaugaaacuuggau

SEQ ID NO: 2251257 - RNA, 23 nt, Human
acacgggggcagcugauacaaau

SEQ ID NO: 2251258 - RNA, 16 nt, Human
acacgggguauuuuag

SEQ ID NO: 2251259 - RNA, 17 nt, Human
acacgggguauuuuagg

SEQ ID NO: 2251260 - RNA, 20 nt, Human
acacggccacaucaaagagg

SEQ ID NO: 2251261 - RNA, 21 nt, Human
acacggaucugagaaucuuua

SEQ ID NO: 2251262 - RNA, 20 nt, Human
acacgggagccgcuggcaga

SEQ ID NO: 2251263 - RNA, 16 nt, Human
acacgggggcagcuga

SEQ ID NO: 2251264 - RNA, 13 nt, Human
acaaccugaaccu

SEQ ID NO: 2251265 - RNA, 15 nt, Human
acaaccucaacugcc

SEQ ID NO: 2251266 - RNA, 14 nt, Human
acaaccugaaccua

SEQ ID NO: 2251267 - RNA, 18 nt, Human
acaaccugaaccuaggag

SEQ ID NO: 2251268 - RNA, 22 nt, Human
acaaccgaugcuccagccaacc

SEQ ID NO: 2251269 - RNA, 20 nt, Human
acaaccgaugcuccagccaa

SEQ ID NO: 2251270 - RNA, 19 nt, Human
acaaccgaugcuccagcca

SEQ ID NO: 2251271 - RNA, 18 nt, Human
acaacccuguuuuauacu

SEQ ID NO: 2251272 - RNA, 16 nt, Human
acaaccucaacugccu

SEQ ID NO: 2251273 - RNA, 17 nt, Human
acaacccuguuuuauac

SEQ ID NO: 2251274 - RNA, 19 nt, Human
acaacccugcaaaggacug

SEQ ID NO: 2251275 - RNA, 14 nt, Human
acaacccugcaaag

SEQ ID NO: 2251276 - RNA, 13 nt, Human
acaaccguuggaa

SEQ ID NO: 2251277 - RNA, 22 nt, Human
acaaccugcuuggguggagaag

SEQ ID NO: 2251278 - RNA, 23 nt, Human
acaaccugcuuggguggagaagc

SEQ ID NO: 2251279 - RNA, 12 nt, Human
acaaccuggaga

SEQ ID NO: 2251280 - RNA, 21 nt, Human
acaaggaugaauuaaguuuuu

SEQ ID NO: 2251281 - RNA, 16 nt, Human
acaagaaaugaaagca

SEQ ID NO: 2251282 - RNA, 15 nt, Human
acaagaaaugaaagc

SEQ ID NO: 2251283 - RNA, 12 nt, Human
acaaagaaauua

SEQ ID NO: 2251284 - RNA, 13 nt, Human
acaaacuuuuaua

SEQ ID NO: 2251285 - RNA, 14 nt, Human
acaaagaaauuaug

SEQ ID NO: 2251286 - RNA, 16 nt, Human
acaaagaaauuaugug

SEQ ID NO: 2251287 - RNA, 13 nt, Human
acaaaaugaaacg

SEQ ID NO: 2251288 - RNA, 22 nt, Human
acaaaaugaaacgcaaccacca

SEQ ID NO: 2251289 - RNA, 18 nt, Human
aauuuugguuguauucuu

SEQ ID NO: 2251290 - RNA, 14 nt, Human
acaaaaucuguuua

SEQ ID NO: 2251291 - RNA, 21 nt, Human
acaaaaugacauuuugccaaa

SEQ ID NO: 2251292 - RNA, 15 nt, Human
aauuuucaaguaauu

SEQ ID NO: 2251293 - RNA, 12 nt, Human
aauuuuauuccu

SEQ ID NO: 2251294 - RNA, 19 nt, Human
aauuuucaaguaauuguga

SEQ ID NO: 2251295 - RNA, 19 nt, Human
aauuuucacacacgugaga

SEQ ID NO: 2251296 - RNA, 14 nt, Human
aauuuucacaugaa

SEQ ID NO: 2251297 - RNA, 16 nt, Human
aauuuucacaugaaca

SEQ ID NO: 2251298 - RNA, 17 nt, Human
aauuuucacaugaacau

SEQ ID NO: 2251299 - RNA, 17 nt, Human
aauuuucagaccccagc

SEQ ID NO: 2251300 - RNA, 21 nt, Human
aauuuucacaugaacauacug

SEQ ID NO: 2251301 - RNA, 18 nt, Human
aauuuucaucuaggauuu

SEQ ID NO: 2251302 - RNA, 17 nt, Human
aauuuuggccaaagugu

SEQ ID NO: 2251303 - RNA, 16 nt, Human
aauuuugaugaacaaa

SEQ ID NO: 2251304 - RNA, 20 nt, Human
aauuuucaguauaauuuaac

SEQ ID NO: 2251305 - RNA, 14 nt, Human
aauuuugaugaaca

SEQ ID NO: 2251306 - RNA, 14 nt, Human
aauuuugauguuuu

SEQ ID NO: 2251307 - RNA, 22 nt, Human
aauuuuggccaaaguguuaauc

SEQ ID NO: 2251308 - RNA, 15 nt, Human
aauuuugguuguauu

SEQ ID NO: 2251309 - RNA, 16 nt, Human
aauuuugguuguauuc

SEQ ID NO: 2251310 - RNA, 19 nt, Human
aauuuugguuguauucuuu

SEQ ID NO: 2251311 - RNA, 17 nt, Human
aauuuugugaagcaaaa

SEQ ID NO: 2251312 - RNA, 16 nt, Human
aauuuugugcccccau

SEQ ID NO: 2251313 - RNA, 18 nt, Human
aauuuugugaagcaaaau

SEQ ID NO: 2251314 - RNA, 15 nt, Human
aauugguucuuuauu

SEQ ID NO: 2251315 - RNA, 21 nt, Human
aauugguuggagaauuuaggu

SEQ ID NO: 2251316 - RNA, 18 nt, Human
aauugguaucaagaaagu

SEQ ID NO: 2251317 - RNA, 23 nt, Human
aauuggguggggggcuucauaca

SEQ ID NO: 2251318 - RNA, 22 nt, Human
aauuggguggggggcuucauac

SEQ ID NO: 2251319 - RNA, 21 nt, Human
aauuggguggggggcuucaua

SEQ ID NO: 2251320 - RNA, 18 nt, Human
aaugucaccaccuuccca

SEQ ID NO: 2251321 - RNA, 16 nt, Human
aaugucaccaccuucc

SEQ ID NO: 2251322 - RNA, 15 nt, Human
aaugucaccaccuuc

SEQ ID NO: 2251323 - RNA, 19 nt, Human
aauggucccauccaggcag

SEQ ID NO: 2251324 - RNA, 23 nt, Human
aaugucaccaccuucccagcucu

SEQ ID NO: 2251325 - RNA, 20 nt, Human
aaugucaccaccuucccagc

SEQ ID NO: 2251326 - RNA, 19 nt, Human
aaugucaccaccuucccag

SEQ ID NO: 2251327 - RNA, 16 nt, Human
aaugucacaggcaggu

SEQ ID NO: 2251328 - RNA, 19 nt, Human
aaugucacaggcaggucca

SEQ ID NO: 2251329 - RNA, 16 nt, Human
aauuguauuuuaguaa

SEQ ID NO: 2251330 - RNA, 23 nt, Human
aauuguaucuagugcagcugauu

SEQ ID NO: 2251331 - RNA, 20 nt, Human
aauuguaucuagugcagcug

SEQ ID NO: 2251332 - RNA, 12 nt, Human
aauuguauguua

SEQ ID NO: 2251333 - RNA, 22 nt, Human
aauuguauguuaaguuacuuca

SEQ ID NO: 2251334 - RNA, 13 nt, Human
aauuguaucuagu

SEQ ID NO: 2251335 - RNA, 22 nt, Human
aauuguaucguauagcuguauu

SEQ ID NO: 2251336 - RNA, 20 nt, Human
aauuguaucguauagcugua

SEQ ID NO: 2251337 - RNA, 21 nt, Human
aauuguaucguauagcuguau

SEQ ID NO: 2251338 - RNA, 24 nt, Human
aauuguaucauuugaacaacuagg

SEQ ID NO: 2251339 - RNA, 19 nt, Human
aauuguaucguauagcugu

SEQ ID NO: 2251340 - RNA, 18 nt, Human
aauuguaucauuugaaca

SEQ ID NO: 2251341 - RNA, 22 nt, Human
aauuguaucagaggccuauaau

SEQ ID NO: 2251342 - RNA, 17 nt, Human
aauuguaucagaggccu

SEQ ID NO: 2251343 - RNA, 20 nt, Human
aauuguaucagaggccuaua

SEQ ID NO: 2251344 - RNA, 21 nt, Human
aauuguaucagaggccuauaa

SEQ ID NO: 2251345 - RNA, 13 nt, Human
aauuguauauuca

SEQ ID NO: 2251346 - RNA, 14 nt, Human
aauuguauauucac

SEQ ID NO: 2251347 - RNA, 16 nt, Human
aauuguauauucacuu

SEQ ID NO: 2251348 - RNA, 17 nt, Human
aauuguauauucacuuu

SEQ ID NO: 2251349 - RNA, 17 nt, Human
aauuguaaaacugaggc

SEQ ID NO: 2251350 - RNA, 18 nt, Human
aauuguaaaauuguauag

SEQ ID NO: 2251351 - RNA, 21 nt, Human
aauuguaaaauuguauagaga

SEQ ID NO: 2251352 - RNA, 17 nt, Human
aauuguaaauugaauca

SEQ ID NO: 2251353 - RNA, 12 nt, Human
aauuguaaggaa

SEQ ID NO: 2251354 - RNA, 16 nt, Human
aauuguaaggaaugau

SEQ ID NO: 2251355 - RNA, 24 nt, Human
aauuguaaauugaaucaguauaaa

SEQ ID NO: 2251356 - RNA, 23 nt, Human
aauuguauagagauaugcagaag

SEQ ID NO: 2251357 - RNA, 12 nt, Human
aauuguauauuc

SEQ ID NO: 2251358 - RNA, 16 nt, Human
aauuguaacuguucuu

SEQ ID NO: 2251359 - RNA, 14 nt, Human
aauuguaacuguuc

SEQ ID NO: 2251360 - RNA, 21 nt, Human
aauuguggggaugaugaaaua

SEQ ID NO: 2251361 - RNA, 20 nt, Human
aauugugccgagaaaagcau

SEQ ID NO: 2251362 - RNA, 17 nt, Human
aauuuauuauggcacau

SEQ ID NO: 2251363 - RNA, 13 nt, Human
aauugugucugca

SEQ ID NO: 2251364 - RNA, 14 nt, Human
aauugugucugcag

SEQ ID NO: 2251365 - RNA, 16 nt, Human
aauugugggucuauuu

SEQ ID NO: 2251366 - RNA, 17 nt, Human
aauugugggucuauuuc

SEQ ID NO: 2251367 - RNA, 21 nt, Human
aauugugggucuauuucuagu

SEQ ID NO: 2251368 - RNA, 12 nt, Human
aauugugaaaaa

SEQ ID NO: 2251369 - RNA, 11 nt, Human
aauugugaugu

SEQ ID NO: 2251370 - RNA, 15 nt, Human
aauugugaugugucc

SEQ ID NO: 2251371 - RNA, 14 nt, Human
aauugugauguguc

SEQ ID NO: 2251372 - RNA, 13 nt, Human
aauuguccccagu

SEQ ID NO: 2251373 - RNA, 17 nt, Human
aauuguccguguucaua

SEQ ID NO: 2251374 - RNA, 18 nt, Human
aauugucccuuaaacaaa

SEQ ID NO: 2251375 - RNA, 16 nt, Human
aauugucccuuaaaca

SEQ ID NO: 2251376 - RNA, 11 nt, Human
aauugucccuu

SEQ ID NO: 2251377 - RNA, 14 nt, Human
aauuuauucaagaa

SEQ ID NO: 2251378 - RNA, 16 nt, Human
aauuuauuauuguucu

SEQ ID NO: 2251379 - RNA, 12 nt, Human
aauuuauucaau

SEQ ID NO: 2251380 - RNA, 16 nt, Human
aauuuauuauugaaau

SEQ ID NO: 2251381 - RNA, 17 nt, Human
aauuuauuauugaaauu

SEQ ID NO: 2251382 - RNA, 18 nt, Human
aauuuauuauugaaauug

SEQ ID NO: 2251383 - RNA, 21 nt, Human
aauuuauucaauuccucuggg

SEQ ID NO: 2251384 - RNA, 22 nt, Human
aauuuauuuauuaagauggauu

SEQ ID NO: 2251385 - RNA, 16 nt, Human
aauuuauuuauuaaga

SEQ ID NO: 2251386 - RNA, 16 nt, Human
aauuuauugcuugaua

SEQ ID NO: 2251387 - RNA, 17 nt, Human
aauuuauuuauuaagau

SEQ ID NO: 2251388 - RNA, 16 nt, Human
aauuuauuuccuaguu

SEQ ID NO: 2251389 - RNA, 19 nt, Human
aauuuauuuccuaguucug

SEQ ID NO: 2251390 - RNA, 22 nt, Human
aauuuauuuccuaguucuguag

SEQ ID NO: 2251391 - RNA, 20 nt, Human
aauuuauuuauacuauuuag

SEQ ID NO: 2251392 - RNA, 17 nt, Human
aauuuauuuauacuauu

SEQ ID NO: 2251393 - RNA, 20 nt, Human
aauuuauuuaugggauccug

SEQ ID NO: 2251394 - RNA, 23 nt, Human
aauuucagacucccauuccugaa

SEQ ID NO: 2251395 - RNA, 13 nt, Human
aauuucagacucc

SEQ ID NO: 2251396 - RNA, 20 nt, Human
aauuucaccuguaaaccuga

SEQ ID NO: 2251397 - RNA, 19 nt, Human
aauuucaccuguaaaccug

SEQ ID NO: 2251398 - RNA, 22 nt, Human
aauuucagguuuuguaaagaug

SEQ ID NO: 2251399 - RNA, 20 nt, Human
aauuucagguuuuguaaaga

SEQ ID NO: 2251400 - RNA, 15 nt, Human
aauuuauuuuugcau

SEQ ID NO: 2251401 - RNA, 12 nt, Human
aauuuauuuugu

SEQ ID NO: 2251402 - RNA, 17 nt, Human
aauuuauuuugucgaau

SEQ ID NO: 2251403 - RNA, 21 nt, Human
aauuuauuuugucgaauuuuu

SEQ ID NO: 2251404 - RNA, 12 nt, Human
aauuucaaaaug

SEQ ID NO: 2251405 - RNA, 19 nt, Human
aauuucaaaaauauaacuu

SEQ ID NO: 2251406 - RNA, 20 nt, Human
aauuuauuuuugcauggcac

SEQ ID NO: 2251407 - RNA, 15 nt, Human
aauuucaaaaauaua

SEQ ID NO: 2251408 - RNA, 16 nt, Human
aauuucaaaaauauaa

SEQ ID NO: 2251409 - RNA, 17 nt, Human
aauuucaaaaauauaac

SEQ ID NO: 2251410 - RNA, 14 nt, Human
aauuucacauuaau

SEQ ID NO: 2251411 - RNA, 16 nt, Human
aauuucaccuguaaac

SEQ ID NO: 2251412 - RNA, 16 nt, Human
aauuucaaaaugcuuu

SEQ ID NO: 2251413 - RNA, 21 nt, Human
aauuucgccguugaagaggaa

SEQ ID NO: 2251414 - RNA, 18 nt, Human
aauuucgccguugaagag

SEQ ID NO: 2251415 - RNA, 18 nt, Human
aauuuccuggugugaagg

SEQ ID NO: 2251416 - RNA, 22 nt, Human
aauuuccuggugugaagguccu

SEQ ID NO: 2251417 - RNA, 20 nt, Human
aauuuccuguuggauuuguu

SEQ ID NO: 2251418 - RNA, 21 nt, Human
aauuuccuguuggauuuguuu

SEQ ID NO: 2251419 - RNA, 16 nt, Human
aauuuccuuuauauuu

SEQ ID NO: 2251420 - RNA, 21 nt, Human
aauuuccuuuauauuuaguga

SEQ ID NO: 2251421 - RNA, 20 nt, Human
acccaugaugagcuccucuu

SEQ ID NO: 2251422 - RNA, 19 nt, Human
acccaucagaaggagaagg

SEQ ID NO: 2251423 - RNA, 17 nt, Human
acccauccccgcagugu

SEQ ID NO: 2251424 - RNA, 18 nt, Human
acccaugaugagcuccuc

SEQ ID NO: 2251425 - RNA, 13 nt, Human
acccaugcugccc

SEQ ID NO: 2251426 - RNA, 23 nt, Human
acccauauccuuacccuccuugg

SEQ ID NO: 2251427 - RNA, 14 nt, Human
acccauauccccuc

SEQ ID NO: 2251428 - RNA, 15 nt, Human
acccauauccccucu

SEQ ID NO: 2251429 - RNA, 19 nt, Human
acccauauccccucucccc

SEQ ID NO: 2251430 - RNA, 20 nt, Human
acccauauccccucuccccc

SEQ ID NO: 2251431 - RNA, 15 nt, Human
acccaucaacaaaaa

SEQ ID NO: 2251432 - RNA, 18 nt, Human
acccaucagaaggagaag

SEQ ID NO: 2251433 - RNA, 14 nt, Human
acccaucagaagga

SEQ ID NO: 2251434 - RNA, 18 nt, Human
acccaucacgccugugca

SEQ ID NO: 2251435 - RNA, 21 nt, Human
acccauauccccucucccccc

SEQ ID NO: 2251436 - RNA, 16 nt, Human
acccauagcuuccaug

SEQ ID NO: 2251437 - RNA, 11 nt, Human
acccauauccc

SEQ ID NO: 2251438 - RNA, 15 nt, Human
acccauagcuuccau

SEQ ID NO: 2251439 - RNA, 15 nt, Human
acccacccuccuuuc

SEQ ID NO: 2251440 - RNA, 20 nt, Human
acccaccgccacaauaaaga

SEQ ID NO: 2251441 - RNA, 15 nt, Human
acccaccgcccuugc

SEQ ID NO: 2251442 - RNA, 14 nt, Human
acccaccccugugc

SEQ ID NO: 2251443 - RNA, 15 nt, Human
acccaccccugugcu

SEQ ID NO: 2251444 - RNA, 16 nt, Human
acccaccccugugcuc

SEQ ID NO: 2251445 - RNA, 17 nt, Human
acccaccccugugcucc

SEQ ID NO: 2251446 - RNA, 15 nt, Human
acccaccaccaugcc

SEQ ID NO: 2251447 - RNA, 15 nt, Human
acccacccccaccca

SEQ ID NO: 2251448 - RNA, 16 nt, Human
acccacccagcaccca

SEQ ID NO: 2251449 - RNA, 12 nt, Human
acccaccccugu

SEQ ID NO: 2251450 - RNA, 13 nt, Human
acccaccccugug

SEQ ID NO: 2251451 - RNA, 17 nt, Human
acccacccccacccaag

SEQ ID NO: 2251452 - RNA, 18 nt, Human
acccacaggcccacagua

SEQ ID NO: 2251453 - RNA, 20 nt, Human
accaugaagagauuuuucau

SEQ ID NO: 2251454 - RNA, 13 nt, Human
acccacagggcua

SEQ ID NO: 2251455 - RNA, 15 nt, Human
acccacaugugacac

SEQ ID NO: 2251456 - RNA, 16 nt, Human
acccacaugugacaca

SEQ ID NO: 2251457 - RNA, 15 nt, Human
accaugaaacaaagc

SEQ ID NO: 2251458 - RNA, 21 nt, Human
accaucuuuuccucauuuuca

SEQ ID NO: 2251459 - RNA, 14 nt, Human
accaugaaacaaag

SEQ ID NO: 2251460 - RNA, 19 nt, Human
accaugaagagauuuuuca

SEQ ID NO: 2251461 - RNA, 14 nt, Human
accaugaagacagg

SEQ ID NO: 2251462 - RNA, 15 nt, Human
accaugaagacagga

SEQ ID NO: 2251463 - RNA, 18 nt, Human
accaugaacagaaaacau

SEQ ID NO: 2251464 - RNA, 23 nt, Human
accaugaacagaaaacauucuga

SEQ ID NO: 2251465 - RNA, 23 nt, Human
accauccacucuacccucccacc

SEQ ID NO: 2251466 - RNA, 22 nt, Human
accauccacucuacccucccac

SEQ ID NO: 2251467 - RNA, 23 nt, Human
accaucauugaaaucuuuuugcu

SEQ ID NO: 2251468 - RNA, 19 nt, Human
accaucauuggaaaugaaa

SEQ ID NO: 2251469 - RNA, 14 nt, Human
accaucucuuuacc

SEQ ID NO: 2251470 - RNA, 12 nt, Human
accaucauugaa

SEQ ID NO: 2251471 - RNA, 23 nt, Human
accaucagaaacacccucacacu

SEQ ID NO: 2251472 - RNA, 14 nt, Human
accaucagggacag

SEQ ID NO: 2251473 - RNA, 15 nt, Human
accaucagggacagg

SEQ ID NO: 2251474 - RNA, 15 nt, Human
accaucauugaaauc

SEQ ID NO: 2251475 - RNA, 20 nt, Human
accaucagaaacacccucac

SEQ ID NO: 2251476 - RNA, 15 nt, Human
accaucaagccacca

SEQ ID NO: 2251477 - RNA, 20 nt, Human
accauaguaccauuuauaca

SEQ ID NO: 2251478 - RNA, 17 nt, Human
accauaggucaccuuua

SEQ ID NO: 2251479 - RNA, 15 nt, Human
accauacugagggac

SEQ ID NO: 2251480 - RNA, 21 nt, Human
accauacuaauuauacccccu

SEQ ID NO: 2251481 - RNA, 14 nt, Human
accaucaagccacc

SEQ ID NO: 2251482 - RNA, 23 nt, Human
accauaguaccauuuauacaaau

SEQ ID NO: 2251483 - RNA, 21 nt, Human
accauaguaccauuuauacaa

SEQ ID NO: 2251484 - RNA, 16 nt, Human
accauacuaauuauac

SEQ ID NO: 2251485 - RNA, 13 nt, Human
accauacuaauua

SEQ ID NO: 2251486 - RNA, 16 nt, Human
acauuuacauguauua

SEQ ID NO: 2251487 - RNA, 21 nt, Human
acauuuacauguauuauuuca

SEQ ID NO: 2251488 - RNA, 14 nt, Human
acauuuacauguau

SEQ ID NO: 2251489 - RNA, 18 nt, Human
acauuuauaauguuugcu

SEQ ID NO: 2251490 - RNA, 22 nt, Human
acauuuaucaaucaguauaauu

SEQ ID NO: 2251491 - RNA, 20 nt, Human
acauuuauaauguuugcuau

SEQ ID NO: 2251492 - RNA, 15 nt, Human
acauuuauaauguuu

SEQ ID NO: 2251493 - RNA, 21 nt, Human
acauuuagagaacuguggccg

SEQ ID NO: 2251494 - RNA, 15 nt, Human
acauuucccugugcu

SEQ ID NO: 2251495 - RNA, 23 nt, Human
acauuuaucaaucaguauaauuc

SEQ ID NO: 2251496 - RNA, 14 nt, Human
acauuuaugauuua

SEQ ID NO: 2251497 - RNA, 15 nt, Human
acauuuaugauuuaa

SEQ ID NO: 2251498 - RNA, 17 nt, Human
acauuuaugauuuaaua

SEQ ID NO: 2251499 - RNA, 16 nt, Human
acauuuccuaaauaua

SEQ ID NO: 2251500 - RNA, 17 nt, Human
acauuuccuaaauauau

SEQ ID NO: 2251501 - RNA, 12 nt, Human
acaugugaaacc

SEQ ID NO: 2251502 - RNA, 23 nt, Human
acaugucuuuucuugcaugaggc

SEQ ID NO: 2251503 - RNA, 19 nt, Human
acaugccucucucaggcca

SEQ ID NO: 2251504 - RNA, 14 nt, Human
acaugugacacaua

SEQ ID NO: 2251505 - RNA, 23 nt, Human
acaugugaaaccuuuuuuaagau

SEQ ID NO: 2251506 - RNA, 12 nt, Human
acaugugacaca

SEQ ID NO: 2251507 - RNA, 20 nt, Human
acaugugaaaccuuuuuuaa

SEQ ID NO: 2251508 - RNA, 21 nt, Human
acaugugaaaccuuuuuuaag

SEQ ID NO: 2251509 - RNA, 13 nt, Human
acaugugaaaccu

SEQ ID NO: 2251510 - RNA, 14 nt, Human
acaugugaaaccuu

SEQ ID NO: 2251511 - RNA, 15 nt, Human
acaugugaaaccuuu

SEQ ID NO: 2251512 - RNA, 17 nt, Human
acaugugaaaccuuuuu

SEQ ID NO: 2251513 - RNA, 17 nt, Human
accaaggagaugaagca

SEQ ID NO: 2251514 - RNA, 16 nt, Human
accaaggcaaggcagg

SEQ ID NO: 2251515 - RNA, 17 nt, Human
accaaggcaaggcaggu

SEQ ID NO: 2251516 - RNA, 18 nt, Human
accaaggaccccucaccu

SEQ ID NO: 2251517 - RNA, 16 nt, Human
accaaggaccccucac

SEQ ID NO: 2251518 - RNA, 19 nt, Human
accaaggcugauuaaacca

SEQ ID NO: 2251519 - RNA, 16 nt, Human
accaagacucugaaau

SEQ ID NO: 2251520 - RNA, 20 nt, Human
accaagaagccuuuccugua

SEQ ID NO: 2251521 - RNA, 24 nt, Human
accaagaagccuuuccuguagccu

SEQ ID NO: 2251522 - RNA, 20 nt, Human
accaagagagaaagaaguag

SEQ ID NO: 2251523 - RNA, 15 nt, Human
accaagagagaaaga

SEQ ID NO: 2251524 - RNA, 13 nt, Human
accaagagagaaa

SEQ ID NO: 2251525 - RNA, 19 nt, Human
accaacuuucuguaaacuc

SEQ ID NO: 2251526 - RNA, 22 nt, Human
acauuucuccuuugauaaaaua

SEQ ID NO: 2251527 - RNA, 18 nt, Human
accaacuuucuguaaacu

SEQ ID NO: 2251528 - RNA, 23 nt, Human
acauuucucuaagagaacaaugu

SEQ ID NO: 2251529 - RNA, 16 nt, Human
accaagaagaugucuu

SEQ ID NO: 2251530 - RNA, 19 nt, Human
accaagaagccuuuccugu

SEQ ID NO: 2251531 - RNA, 11 nt, Human
accaagaagau

SEQ ID NO: 2251532 - RNA, 14 nt, Human
accaagaaagcagg

SEQ ID NO: 2251533 - RNA, 22 nt, Human
acauuuaugauuuaauaaaaua

SEQ ID NO: 2251534 - RNA, 19 nt, Human
acauuuaugauuuaauaaa

SEQ ID NO: 2251535 - RNA, 20 nt, Human
acauuuaugauuuaauaaaa

SEQ ID NO: 2251536 - RNA, 12 nt, Human
acauuucucaau

SEQ ID NO: 2251537 - RNA, 21 nt, Human
accacccuagucccuuccccu

SEQ ID NO: 2251538 - RNA, 20 nt, Human
accacccuagucccuucccc

SEQ ID NO: 2251539 - RNA, 15 nt, Human
accaccccuuccugu

SEQ ID NO: 2251540 - RNA, 13 nt, Human
accaccccugccu

SEQ ID NO: 2251541 - RNA, 14 nt, Human
accaccccugccuc

SEQ ID NO: 2251542 - RNA, 15 nt, Human
accaccccugccucc

SEQ ID NO: 2251543 - RNA, 19 nt, Human
accaccccugccuccaccc

SEQ ID NO: 2251544 - RNA, 20 nt, Human
accaccccugccuccacccu

SEQ ID NO: 2251545 - RNA, 22 nt, Human
accaccccugccuccacccucu

SEQ ID NO: 2251546 - RNA, 14 nt, Human
accaccccuuccug

SEQ ID NO: 2251547 - RNA, 20 nt, Human
accaaggcugauuaaaccaa

SEQ ID NO: 2251548 - RNA, 22 nt, Human
accaccccgccugcccucaugg

SEQ ID NO: 2251549 - RNA, 18 nt, Human
accaaggcaaggcaggug

SEQ ID NO: 2251550 - RNA, 19 nt, Human
accaaggcaaggcaggugc

SEQ ID NO: 2251551 - RNA, 20 nt, Human
accaaggcaaggcaggugcc

SEQ ID NO: 2251552 - RNA, 19 nt, Human
accaccuucccagcucucc

SEQ ID NO: 2251553 - RNA, 17 nt, Human
accaccuucccagcucu

SEQ ID NO: 2251554 - RNA, 16 nt, Human
accaccuucccagcuc

SEQ ID NO: 2251555 - RNA, 15 nt, Human
accaccuucccagcu

SEQ ID NO: 2251556 - RNA, 21 nt, Human
accaccuucccagcucucccu

SEQ ID NO: 2251557 - RNA, 20 nt, Human
accaccuucccagcucuccc

SEQ ID NO: 2251558 - RNA, 14 nt, Human
accaccuuucagau

SEQ ID NO: 2251559 - RNA, 14 nt, Human
accaccuucccagc

SEQ ID NO: 2251560 - RNA, 13 nt, Human
accaccuucccag

SEQ ID NO: 2251561 - RNA, 12 nt, Human
accaccugccca

SEQ ID NO: 2251562 - RNA, 23 nt, Human
accacccuccccucucuugcacc

SEQ ID NO: 2251563 - RNA, 18 nt, Human
accacccuccccucucuu

SEQ ID NO: 2251564 - RNA, 21 nt, Human
accacccuccccucucuugca

SEQ ID NO: 2251565 - RNA, 11 nt, Human
accacccuccc

SEQ ID NO: 2251566 - RNA, 13 nt, Human
accacccuccccu

SEQ ID NO: 2251567 - RNA, 14 nt, Human
accacccuccccuc

SEQ ID NO: 2251568 - RNA, 15 nt, Human
accacccuccccucu

SEQ ID NO: 2251569 - RNA, 16 nt, Human
accacccuccccucuc

SEQ ID NO: 2251570 - RNA, 17 nt, Human
accacccuccccucucu

SEQ ID NO: 2251571 - RNA, 16 nt, Human
accacgauguggcccu

SEQ ID NO: 2251572 - RNA, 17 nt, Human
accaccuuuuauuacau

SEQ ID NO: 2251573 - RNA, 22 nt, Human
accaccuucccagcucucccuc

SEQ ID NO: 2251574 - RNA, 14 nt, Human
accagcagaaaugc

SEQ ID NO: 2251575 - RNA, 12 nt, Human
accagcagagca

SEQ ID NO: 2251576 - RNA, 13 nt, Human
accagcagagcac

SEQ ID NO: 2251577 - RNA, 16 nt, Human
accagccccagugccc

SEQ ID NO: 2251578 - RNA, 17 nt, Human
accagccccagugccca

SEQ ID NO: 2251579 - RNA, 15 nt, Human
accagcagaucccag

SEQ ID NO: 2251580 - RNA, 19 nt, Human
accacgauguggcccuggc

SEQ ID NO: 2251581 - RNA, 18 nt, Human
accacgauguggcccugg

SEQ ID NO: 2251582 - RNA, 17 nt, Human
accacgauguggcccug

SEQ ID NO: 2251583 - RNA, 21 nt, Human
accagcagaucccagcucacg

SEQ ID NO: 2251584 - RNA, 19 nt, Human
accagcagaucccagcuca

SEQ ID NO: 2251585 - RNA, 18 nt, Human
accagccccagugcccac

SEQ ID NO: 2251586 - RNA, 19 nt, Human
accagccccagugcccaca

SEQ ID NO: 2251587 - RNA, 20 nt, Human
accagccccagugcccacag

SEQ ID NO: 2251588 - RNA, 11 nt, Human
accagccccug

SEQ ID NO: 2251589 - RNA, 12 nt, Human
accagccccugc

SEQ ID NO: 2251590 - RNA, 15 nt, Human
accagccccugcccc

SEQ ID NO: 2251591 - RNA, 16 nt, Human
accagcccggccugcu

SEQ ID NO: 2251592 - RNA, 21 nt, Human
accagcccggccugcucccag

SEQ ID NO: 2251593 - RNA, 16 nt, Human
accagccccugcccca

SEQ ID NO: 2251594 - RNA, 18 nt, Human
accagccccugccccagc

SEQ ID NO: 2251595 - RNA, 14 nt, Human
accagcccggccug

SEQ ID NO: 2251596 - RNA, 15 nt, Human
accagcccggccugc

SEQ ID NO: 2251597 - RNA, 12 nt, Human
acauaauuuuuu

SEQ ID NO: 2251598 - RNA, 18 nt, Human
acauaauuuuuuauucaa

SEQ ID NO: 2251599 - RNA, 21 nt, Human
acauaauuuuuuuuuuuuaac

SEQ ID NO: 2251600 - RNA, 20 nt, Human
acauaauucaggaagcagcu

SEQ ID NO: 2251601 - RNA, 22 nt, Human
acaucagcuggucaaacaaacu

SEQ ID NO: 2251602 - RNA, 22 nt, Human
acauacaauuauuuuuacaguu

SEQ ID NO: 2251603 - RNA, 16 nt, Human
acauacaauuauuuuu

SEQ ID NO: 2251604 - RNA, 23 nt, Human
acaucaguggcauggcuccaguc

SEQ ID NO: 2251605 - RNA, 22 nt, Human
acaucaguggcauggcuccagu

SEQ ID NO: 2251606 - RNA, 20 nt, Human
acaucaguggcauggcucca

SEQ ID NO: 2251607 - RNA, 14 nt, Human
acaucaggaguuca

SEQ ID NO: 2251608 - RNA, 20 nt, Human
acauaauuaaaguguccauu

SEQ ID NO: 2251609 - RNA, 15 nt, Human
acauaaguaauucaa

SEQ ID NO: 2251610 - RNA, 19 nt, Human
acauaauuaaauuuugagu

SEQ ID NO: 2251611 - RNA, 22 nt, Human
acauaagcggcguaaguuuaaa

SEQ ID NO: 2251612 - RNA, 15 nt, Human
acauaagauaaaugu

SEQ ID NO: 2251613 - RNA, 14 nt, Human
acauaagcucagaa

SEQ ID NO: 2251614 - RNA, 16 nt, Human
acauaagauaaaugug

SEQ ID NO: 2251615 - RNA, 14 nt, Human
acaugccaagcacu

SEQ ID NO: 2251616 - RNA, 18 nt, Human
acaugccaagcacugugc

SEQ ID NO: 2251617 - RNA, 14 nt, Human
acaugccacaagga

SEQ ID NO: 2251618 - RNA, 17 nt, Human
acaugcaaggucauuuu

SEQ ID NO: 2251619 - RNA, 18 nt, Human
acaugcaaggucauuuuu

SEQ ID NO: 2251620 - RNA, 23 nt, Human
acaugauuuccuugaauguggcu

SEQ ID NO: 2251621 - RNA, 15 nt, Human
acaugccucucucag

SEQ ID NO: 2251622 - RNA, 16 nt, Human
acaugccucucucagg

SEQ ID NO: 2251623 - RNA, 17 nt, Human
acaugccucucucaggc

SEQ ID NO: 2251624 - RNA, 18 nt, Human
acaugccucucucaggcc

SEQ ID NO: 2251625 - RNA, 17 nt, Human
acauccuccguccagcc

SEQ ID NO: 2251626 - RNA, 14 nt, Human
acauccuccgucca

SEQ ID NO: 2251627 - RNA, 13 nt, Human
acauccuccuccc

SEQ ID NO: 2251628 - RNA, 15 nt, Human
acauccuccucccac

SEQ ID NO: 2251629 - RNA, 21 nt, Human
acauccuccacguucugcuca

SEQ ID NO: 2251630 - RNA, 15 nt, Human
acauccuacaagaca

SEQ ID NO: 2251631 - RNA, 16 nt, Human
acaugcaaggucauuu

SEQ ID NO: 2251632 - RNA, 21 nt, Human
acaugauuuccuugaaugugg

SEQ ID NO: 2251633 - RNA, 13 nt, Human
acauccucuucug

SEQ ID NO: 2251634 - RNA, 15 nt, Human
acauccucuucugcu

SEQ ID NO: 2251635 - RNA, 20 nt, Human
acaucccuuaccugggaaag

SEQ ID NO: 2251636 - RNA, 20 nt, Human
acaucaguuacucugaaggg

SEQ ID NO: 2251637 - RNA, 15 nt, Human
acaucaguuuuaacg

SEQ ID NO: 2251638 - RNA, 19 nt, Human
acaucaucaaggcacugcc

SEQ ID NO: 2251639 - RNA, 18 nt, Human
acaucaguuacucugaag

SEQ ID NO: 2251640 - RNA, 15 nt, Human
acaucaguuacucug

SEQ ID NO: 2251641 - RNA, 20 nt, Human
acaucaucaaggcacugccu

SEQ ID NO: 2251642 - RNA, 21 nt, Human
acagggcugauaagcuaacac

SEQ ID NO: 2251643 - RNA, 13 nt, Human
acagggcuggccc

SEQ ID NO: 2251644 - RNA, 14 nt, Human
acagggcuggccca

SEQ ID NO: 2251645 - RNA, 15 nt, Human
acagggcuggcccag

SEQ ID NO: 2251646 - RNA, 16 nt, Human
acagggcuggcccagc

SEQ ID NO: 2251647 - RNA, 17 nt, Human
acagggcuggcccagcc

SEQ ID NO: 2251648 - RNA, 18 nt, Human
acagggcuggcccagccc

SEQ ID NO: 2251649 - RNA, 19 nt, Human
acagggcuggcccagcccu

SEQ ID NO: 2251650 - RNA, 20 nt, Human
acagggcuggcccagcccug

SEQ ID NO: 2251651 - RNA, 21 nt, Human
acagggcuggcccagcccugc

SEQ ID NO: 2251652 - RNA, 22 nt, Human
acagggcuggcccagcccugcu

SEQ ID NO: 2251653 - RNA, 23 nt, Human
acagggcuggcccagcccugcug

SEQ ID NO: 2251654 - RNA, 24 nt, Human
acagggcuggcccagcccugcugg

SEQ ID NO: 2251655 - RNA, 18 nt, Human
acagguggacacacaagg

SEQ ID NO: 2251656 - RNA, 16 nt, Human
acagguggacacacaa

SEQ ID NO: 2251657 - RNA, 15 nt, Human
acagguggcaggacc

SEQ ID NO: 2251658 - RNA, 16 nt, Human
acagguggcaggacca

SEQ ID NO: 2251659 - RNA, 19 nt, Human
acagguggcaggaccagga

SEQ ID NO: 2251660 - RNA, 20 nt, Human
acagguggcaggaccaggac

SEQ ID NO: 2251661 - RNA, 19 nt, Human
acaggucuccucuuaaaaa

SEQ ID NO: 2251662 - RNA, 16 nt, Human
acaggucuucaucgaa

SEQ ID NO: 2251663 - RNA, 21 nt, Human
acaggucuuuccuaaggcugc

SEQ ID NO: 2251664 - RNA, 14 nt, Human
acaggcaaugcugg

SEQ ID NO: 2251665 - RNA, 19 nt, Human
acaggcaagcaccuccugc

SEQ ID NO: 2251666 - RNA, 22 nt, Human
acagggcuaagagcuagcgcug

SEQ ID NO: 2251667 - RNA, 21 nt, Human
acagggccuuuggcaggugca

SEQ ID NO: 2251668 - RNA, 18 nt, Human
acagguuacaacagauuu

SEQ ID NO: 2251669 - RNA, 23 nt, Human
acagugagcuuggaaaggaccag

SEQ ID NO: 2251670 - RNA, 17 nt, Human
acagugaggugcccagc

SEQ ID NO: 2251671 - RNA, 22 nt, Human
acagugagucgaggacagggag

SEQ ID NO: 2251672 - RNA, 14 nt, Human
acagguguuuauac

SEQ ID NO: 2251673 - RNA, 12 nt, Human
acagguuacaac

SEQ ID NO: 2251674 - RNA, 13 nt, Human
acagguuacaaca

SEQ ID NO: 2251675 - RNA, 14 nt, Human
acagguuacaacag

SEQ ID NO: 2251676 - RNA, 15 nt, Human
acagguuacaacaga

SEQ ID NO: 2251677 - RNA, 17 nt, Human
acagugagccugaauuu

SEQ ID NO: 2251678 - RNA, 16 nt, Human
acagguuacaacagau

SEQ ID NO: 2251679 - RNA, 17 nt, Human
acagguuacaacagauu

SEQ ID NO: 2251680 - RNA, 21 nt, Human
acagugagccugaauuuuguu

SEQ ID NO: 2251681 - RNA, 18 nt, Human
acagugagccugaauuuu

SEQ ID NO: 2251682 - RNA, 19 nt, Human
acaggugugaaccaccaca

SEQ ID NO: 2251683 - RNA, 22 nt, Human
acaggugugagucaccaagccc

SEQ ID NO: 2251684 - RNA, 23 nt, Human
acaggugugagucaccaagccca

SEQ ID NO: 2251685 - RNA, 22 nt, Human
acaggugggcuucccaguggcu

SEQ ID NO: 2251686 - RNA, 21 nt, Human
acagguggcaggaccaggacu

SEQ ID NO: 2251687 - RNA, 20 nt, Human
acaggugggcuucccagugg

SEQ ID NO: 2251688 - RNA, 16 nt, Human
acagcugaggucucuu

SEQ ID NO: 2251689 - RNA, 15 nt, Human
acagcugcagagaca

SEQ ID NO: 2251690 - RNA, 17 nt, Human
acagcugcagagacaga

SEQ ID NO: 2251691 - RNA, 21 nt, Human
acagcugcagagacagagagg

SEQ ID NO: 2251692 - RNA, 22 nt, Human
acagcugaggucucuugaggga

SEQ ID NO: 2251693 - RNA, 20 nt, Human
acagaggagggcgugacuca

SEQ ID NO: 2251694 - RNA, 13 nt, Human
acagcucuguccu

SEQ ID NO: 2251695 - RNA, 16 nt, Human
acagcucuguccuggg

SEQ ID NO: 2251696 - RNA, 17 nt, Human
acagcucuguccuggga

SEQ ID NO: 2251697 - RNA, 16 nt, Human
acagcugccugcagua

SEQ ID NO: 2251698 - RNA, 13 nt, Human
acagcugccuggg

SEQ ID NO: 2251699 - RNA, 12 nt, Human
acagcugccugc

SEQ ID NO: 2251700 - RNA, 20 nt, Human
acaggcaagcaccuccugcc

SEQ ID NO: 2251701 - RNA, 23 nt, Human
acaggcaagcaccuccugccucg

SEQ ID NO: 2251702 - RNA, 15 nt, Human
acagcuccuucuguc

SEQ ID NO: 2251703 - RNA, 19 nt, Human
acagaggggguggccuccc

SEQ ID NO: 2251704 - RNA, 17 nt, Human
acagaggggguggccuc

SEQ ID NO: 2251705 - RNA, 18 nt, Human
acagaggggguggccucc

SEQ ID NO: 2251706 - RNA, 16 nt, Human
acagcuccuucugucc

SEQ ID NO: 2251707 - RNA, 18 nt, Human
acagcuccuucuguccua

SEQ ID NO: 2251708 - RNA, 23 nt, Human
acagcuccuucuguccuacucug

SEQ ID NO: 2251709 - RNA, 14 nt, Human
acagcucuguccug

SEQ ID NO: 2251710 - RNA, 24 nt, Human
acagugucuguaucggagacagug

SEQ ID NO: 2251711 - RNA, 23 nt, Human
acagugucuguaucggagacagu

SEQ ID NO: 2251712 - RNA, 15 nt, Human
acagugucugggcug

SEQ ID NO: 2251713 - RNA, 16 nt, Human
acagugucugggcuga

SEQ ID NO: 2251714 - RNA, 19 nt, Human
acagugucugggcugacug

SEQ ID NO: 2251715 - RNA, 21 nt, Human
acagugucugggcugacuggg

SEQ ID NO: 2251716 - RNA, 18 nt, Human
acaguguacagucuugua

SEQ ID NO: 2251717 - RNA, 22 nt, Human
acagugguuuuauacugaagga

SEQ ID NO: 2251718 - RNA, 23 nt, Human
acagugguggcagggccuagcug

SEQ ID NO: 2251719 - RNA, 20 nt, Human
acagugguuuuauacugaag

SEQ ID NO: 2251720 - RNA, 15 nt, Human
acaguguacagucuu

SEQ ID NO: 2251721 - RNA, 17 nt, Human
acaguguacagucuugu

SEQ ID NO: 2251722 - RNA, 12 nt, Human
acaguguacagu

SEQ ID NO: 2251723 - RNA, 13 nt, Human
acaguguacaguc

SEQ ID NO: 2251724 - RNA, 18 nt, Human
acagugguuuuauacuga

SEQ ID NO: 2251725 - RNA, 16 nt, Human
acagugguggcagggc

SEQ ID NO: 2251726 - RNA, 17 nt, Human
acagugguggcagggcc

SEQ ID NO: 2251727 - RNA, 15 nt, Human
acaguggguggugga

SEQ ID NO: 2251728 - RNA, 13 nt, Human
acagugguggcag

SEQ ID NO: 2251729 - RNA, 15 nt, Human
acagugguggcaggg

SEQ ID NO: 2251730 - RNA, 21 nt, Human
acagugggugccccccuugcc

SEQ ID NO: 2251731 - RNA, 14 nt, Human
acagugggugcccc

SEQ ID NO: 2251732 - RNA, 21 nt, Human
acagugcauauuccuuucuau

SEQ ID NO: 2251733 - RNA, 10 nt, Human
acagugauuu

SEQ ID NO: 2251734 - RNA, 13 nt, Human
acagugauuuuuu

SEQ ID NO: 2251735 - RNA, 20 nt, Human
acagugcauauuccuuucua

SEQ ID NO: 2251736 - RNA, 21 nt, Human
acagugauuaccagggacuga

SEQ ID NO: 2251737 - RNA, 23 nt, Human
acagugagucgaggacagggagg

SEQ ID NO: 2251738 - RNA, 20 nt, Human
acagugauuaccagggacug

SEQ ID NO: 2251739 - RNA, 20 nt, Human
aaggcaaagcacgaaauguu

SEQ ID NO: 2251740 - RNA, 20 nt, Human
aaggcaaacccaucaacaaa

SEQ ID NO: 2251741 - RNA, 15 nt, Human
aaggcaaacccauca

SEQ ID NO: 2251742 - RNA, 19 nt, Human
aaggcaaaauugcaaaucu

SEQ ID NO: 2251743 - RNA, 15 nt, Human
aaggcaaaauugcaa

SEQ ID NO: 2251744 - RNA, 14 nt, Human
aaggcaaaauugca

SEQ ID NO: 2251745 - RNA, 16 nt, Human
aaggcaaaugcccaag

SEQ ID NO: 2251746 - RNA, 16 nt, Human
aaggcaaaugacuuug

SEQ ID NO: 2251747 - RNA, 15 nt, Human
aaggcaaaugacuuu

SEQ ID NO: 2251748 - RNA, 14 nt, Human
aaggcaaaugacuu

SEQ ID NO: 2251749 - RNA, 17 nt, Human
aaggcaaaugcccaagg

SEQ ID NO: 2251750 - RNA, 21 nt, Human
aaggcacucuguuauuuagac

SEQ ID NO: 2251751 - RNA, 12 nt, Human
aaggcacugccu

SEQ ID NO: 2251752 - RNA, 13 nt, Human
aaggcacugccug

SEQ ID NO: 2251753 - RNA, 11 nt, Human
aaggcagccac

SEQ ID NO: 2251754 - RNA, 14 nt, Human
aaggcagccaccag

SEQ ID NO: 2251755 - RNA, 19 nt, Human
aaggcagaaagcaaaauua

SEQ ID NO: 2251756 - RNA, 17 nt, Human
aaggcagaaagcaaaau

SEQ ID NO: 2251757 - RNA, 16 nt, Human
aaggcagaaagcaaaa

SEQ ID NO: 2251758 - RNA, 15 nt, Human
aaggcagaaagcaaa

SEQ ID NO: 2251759 - RNA, 14 nt, Human
aaggcacugccuga

SEQ ID NO: 2251760 - RNA, 14 nt, Human
aaggcagaagcagc

SEQ ID NO: 2251761 - RNA, 21 nt, Human
aaggacggccuucaacugaaa

SEQ ID NO: 2251762 - RNA, 13 nt, Human
aaggacuaggguc

SEQ ID NO: 2251763 - RNA, 12 nt, Human
aaggcaaaauug

SEQ ID NO: 2251764 - RNA, 21 nt, Human
aaggacuacguuaagggaagg

SEQ ID NO: 2251765 - RNA, 15 nt, Human
aaggcaaaaauguaa

SEQ ID NO: 2251766 - RNA, 13 nt, Human
aaggaccuccuga

SEQ ID NO: 2251767 - RNA, 22 nt, Human
aaggacccggaggggccuggca

SEQ ID NO: 2251768 - RNA, 14 nt, Human
aaggacaauuucaa

SEQ ID NO: 2251769 - RNA, 14 nt, Human
aaggacacacuaau

SEQ ID NO: 2251770 - RNA, 18 nt, Human
aaggacacagaugaaaca

SEQ ID NO: 2251771 - RNA, 22 nt, Human
aaggacacagaugaaacacaaa

SEQ ID NO: 2251772 - RNA, 17 nt, Human
aaggacaaaaaugaacu

SEQ ID NO: 2251773 - RNA, 23 nt, Human
aaggacaaaaaugaacugaaguu

SEQ ID NO: 2251774 - RNA, 20 nt, Human
aaggaauucuaggcauccca

SEQ ID NO: 2251775 - RNA, 12 nt, Human
aaggaauuuuau

SEQ ID NO: 2251776 - RNA, 16 nt, Human
aagcugccucaaggaa

SEQ ID NO: 2251777 - RNA, 11 nt, Human
aagcuggaagc

SEQ ID NO: 2251778 - RNA, 21 nt, Human
aagcugcuuuaaaaaaauaca

SEQ ID NO: 2251779 - RNA, 14 nt, Human
aagcuggaagcaca

SEQ ID NO: 2251780 - RNA, 19 nt, Human
aagcuggaggacuagaacc

SEQ ID NO: 2251781 - RNA, 17 nt, Human
aaggaauauauggcaga

SEQ ID NO: 2251782 - RNA, 23 nt, Human
aagcuggaggacuagaaccugga

SEQ ID NO: 2251783 - RNA, 18 nt, Human
aaggaauauauggcagag

SEQ ID NO: 2251784 - RNA, 22 nt, Human
aaggaauauauggcagaguugu

SEQ ID NO: 2251785 - RNA, 16 nt, Human
aagcugcugacagugu

SEQ ID NO: 2251786 - RNA, 15 nt, Human
aagcugcccugccca

SEQ ID NO: 2251787 - RNA, 17 nt, Human
aaggaaucuccaguuuu

SEQ ID NO: 2251788 - RNA, 21 nt, Human
aaggaauguagcugguuuccu

SEQ ID NO: 2251789 - RNA, 15 nt, Human
aaggaauucuaggca

SEQ ID NO: 2251790 - RNA, 21 nt, Human
aaggaaucuccaguuuucagu

SEQ ID NO: 2251791 - RNA, 21 nt, Human
aaggaauaugggagaaauagu

SEQ ID NO: 2251792 - RNA, 20 nt, Human
aaggaauccacucccaggca

SEQ ID NO: 2251793 - RNA, 23 nt, Human
aaggaauauauggcagaguugua

SEQ ID NO: 2251794 - RNA, 21 nt, Human
aaggaauccacucccaggcag

SEQ ID NO: 2251795 - RNA, 22 nt, Human
aaggaauccacucccaggcagc

SEQ ID NO: 2251796 - RNA, 23 nt, Human
aaggaauccacucccaggcagcc

SEQ ID NO: 2251797 - RNA, 23 nt, Human
aaggaaugauuaauuaaaacaca

SEQ ID NO: 2251798 - RNA, 21 nt, Human
aagcgugagccacugcaccgg

SEQ ID NO: 2251799 - RNA, 18 nt, Human
aagcugcaucuagaggcu

SEQ ID NO: 2251800 - RNA, 17 nt, Human
aagcgugagccacugca

SEQ ID NO: 2251801 - RNA, 20 nt, Human
aagcgugagccacugcaccg

SEQ ID NO: 2251802 - RNA, 14 nt, Human
aagcugcugacagu

SEQ ID NO: 2251803 - RNA, 22 nt, Human
aagcugccagccgagauagcca

SEQ ID NO: 2251804 - RNA, 11 nt, Human
aagcugccagc

SEQ ID NO: 2251805 - RNA, 12 nt, Human
aagcugccagcc

SEQ ID NO: 2251806 - RNA, 11 nt, Human
aagccaccucu

SEQ ID NO: 2251807 - RNA, 13 nt, Human
aagccaccucucc

SEQ ID NO: 2251808 - RNA, 20 nt, Human
aagccaccucucccucaaca

SEQ ID NO: 2251809 - RNA, 19 nt, Human
aagccagauuuuccugaaa

SEQ ID NO: 2251810 - RNA, 21 nt, Human
aagccaccaacauacucccau

SEQ ID NO: 2251811 - RNA, 18 nt, Human
aagcagguucccaagcuc

SEQ ID NO: 2251812 - RNA, 14 nt, Human
aagccacugaagcu

SEQ ID NO: 2251813 - RNA, 13 nt, Human
aagccacugaagc

SEQ ID NO: 2251814 - RNA, 17 nt, Human
aagccacugaagcuggg

SEQ ID NO: 2251815 - RNA, 17 nt, Human
aagccaccucucccuca

SEQ ID NO: 2251816 - RNA, 15 nt, Human
aagccagcaggcucu

SEQ ID NO: 2251817 - RNA, 18 nt, Human
aagccagcaggcucucag

SEQ ID NO: 2251818 - RNA, 15 nt, Human
aagcgauucuucugc

SEQ ID NO: 2251819 - RNA, 14 nt, Human
aagcgauucuucug

SEQ ID NO: 2251820 - RNA, 16 nt, Human
aagcgauucuucugcu

SEQ ID NO: 2251821 - RNA, 15 nt, Human
aagggagaagaaagg

SEQ ID NO: 2251822 - RNA, 20 nt, Human
aagggauggaaaaggaagac

SEQ ID NO: 2251823 - RNA, 15 nt, Human
aagggauggaaaagg

SEQ ID NO: 2251824 - RNA, 15 nt, Human
aagggaucugguccu

SEQ ID NO: 2251825 - RNA, 19 nt, Human
aagggauauauaagaugga

SEQ ID NO: 2251826 - RNA, 20 nt, Human
aagggacuuggaagcuccgc

SEQ ID NO: 2251827 - RNA, 13 nt, Human
aagggagaaaaaa

SEQ ID NO: 2251828 - RNA, 12 nt, Human
aagggagaagaa

SEQ ID NO: 2251829 - RNA, 15 nt, Human
aagggacugagaaau

SEQ ID NO: 2251830 - RNA, 17 nt, Human
aagggacugagaaauuu

SEQ ID NO: 2251831 - RNA, 19 nt, Human
aagggauuacccaagcaaa

SEQ ID NO: 2251832 - RNA, 17 nt, Human
aagggauuuuagucaca

SEQ ID NO: 2251833 - RNA, 20 nt, Human
aagggauuuuagucacacgu

SEQ ID NO: 2251834 - RNA, 24 nt, Human
aagggauggaggucacacugguag

SEQ ID NO: 2251835 - RNA, 21 nt, Human
aagggauggaaaaggaagacu

SEQ ID NO: 2251836 - RNA, 17 nt, Human
aagggauuacccaagca

SEQ ID NO: 2251837 - RNA, 18 nt, Human
aagggauuacccaagcaa

SEQ ID NO: 2251838 - RNA, 17 nt, Human
aagggauggcaagaugu

SEQ ID NO: 2251839 - RNA, 14 nt, Human
aagggauggcaaga

SEQ ID NO: 2251840 - RNA, 22 nt, Human
aagggcaggaaggagagccugc

SEQ ID NO: 2251841 - RNA, 21 nt, Human
aagggcaggaaggagagccug

SEQ ID NO: 2251842 - RNA, 22 nt, Human
aagggcagggcaucuccugugc

SEQ ID NO: 2251843 - RNA, 15 nt, Human
aagggcagagucaca

SEQ ID NO: 2251844 - RNA, 18 nt, Human
aagggcagaacacuaacc

SEQ ID NO: 2251845 - RNA, 19 nt, Human
aagggcagaacacuaaccu

SEQ ID NO: 2251846 - RNA, 21 nt, Human
aagggcaauaccguguugguu

SEQ ID NO: 2251847 - RNA, 20 nt, Human
aagggcaacaauaaaauagc

SEQ ID NO: 2251848 - RNA, 22 nt, Human
aagggauuuuagucacacgugg

SEQ ID NO: 2251849 - RNA, 18 nt, Human
aagggcaaaauucccagg

SEQ ID NO: 2251850 - RNA, 15 nt, Human
aaguaggaaaaauaa

SEQ ID NO: 2251851 - RNA, 23 nt, Human
aaguagacuucauuuuuccuaac

SEQ ID NO: 2251852 - RNA, 19 nt, Human
aaguagacuucauuuuucc

SEQ ID NO: 2251853 - RNA, 17 nt, Human
aagguucucauaggaaa

SEQ ID NO: 2251854 - RNA, 21 nt, Human
aagguucucuccuccccaagg

SEQ ID NO: 2251855 - RNA, 12 nt, Human
aaguagaggagg

SEQ ID NO: 2251856 - RNA, 22 nt, Human
aagguuccaaucagaucuuuau

SEQ ID NO: 2251857 - RNA, 18 nt, Human
aagguuccaacuguauau

SEQ ID NO: 2251858 - RNA, 19 nt, Human
aagguuccaacuguauaua

SEQ ID NO: 2251859 - RNA, 23 nt, Human
aagguuccgcuuggagcagaggg

SEQ ID NO: 2251860 - RNA, 16 nt, Human
aagguucccucugaga

SEQ ID NO: 2251861 - RNA, 21 nt, Human
aagguuccaacuguauauauu

SEQ ID NO: 2251862 - RNA, 21 nt, Human
aagguucucagguguugccaa

SEQ ID NO: 2251863 - RNA, 17 nt, Human
aagguucacuaaagcag

SEQ ID NO: 2251864 - RNA, 20 nt, Human
aagguuauuuauuuaaaugu

SEQ ID NO: 2251865 - RNA, 22 nt, Human
aagguuauuuauuuaaaugucu

SEQ ID NO: 2251866 - RNA, 18 nt, Human
aagguuaccaagaagccu

SEQ ID NO: 2251867 - RNA, 17 nt, Human
aagguuauuuauuuaaa

SEQ ID NO: 2251868 - RNA, 22 nt, Human
aagguguucauucacuugcauu

SEQ ID NO: 2251869 - RNA, 17 nt, Human
aagguuaggauuuaaca

SEQ ID NO: 2251870 - RNA, 18 nt, Human
aagguuaggauuuaacag

SEQ ID NO: 2251871 - RNA, 23 nt, Human
aaggugggguauuuaccacagca

SEQ ID NO: 2251872 - RNA, 16 nt, Human
aagguggggacaggga

SEQ ID NO: 2251873 - RNA, 17 nt, Human
aaggugguaugugugug

SEQ ID NO: 2251874 - RNA, 21 nt, Human
aagguggggucuuugugagag

SEQ ID NO: 2251875 - RNA, 16 nt, Human
aaggugguaugugugu

SEQ ID NO: 2251876 - RNA, 21 nt, Human
aaggugggcugagcccuggca

SEQ ID NO: 2251877 - RNA, 20 nt, Human
aaggugggcugagcccuggc

SEQ ID NO: 2251878 - RNA, 16 nt, Human
aaggugaaggaauaua

SEQ ID NO: 2251879 - RNA, 18 nt, Human
aaggugaaggaauauaug

SEQ ID NO: 2251880 - RNA, 15 nt, Human
aaggugucuuccucc

SEQ ID NO: 2251881 - RNA, 16 nt, Human
aaggugucuuccuccc

SEQ ID NO: 2251882 - RNA, 20 nt, Human
aaggugucuuccucccaagu

SEQ ID NO: 2251883 - RNA, 18 nt, Human
aaggugucagaauaauaa

SEQ ID NO: 2251884 - RNA, 20 nt, Human
aaggugguauguguguguau

SEQ ID NO: 2251885 - RNA, 22 nt, Human
aagguggucugcucgggcccag

SEQ ID NO: 2251886 - RNA, 20 nt, Human
aagguggugggggugcagau

SEQ ID NO: 2251887 - RNA, 17 nt, Human
aagguguaacucuaauu

SEQ ID NO: 2251888 - RNA, 23 nt, Human
aaggucuggagaagcucccagga

SEQ ID NO: 2251889 - RNA, 14 nt, Human
aagggcauccuucu

SEQ ID NO: 2251890 - RNA, 17 nt, Human
aagggcauccuucugcc

SEQ ID NO: 2251891 - RNA, 16 nt, Human
aaggucuggccucagg

SEQ ID NO: 2251892 - RNA, 13 nt, Human
aaggucuuugguu

SEQ ID NO: 2251893 - RNA, 11 nt, Human
aaggugaagga

SEQ ID NO: 2251894 - RNA, 14 nt, Human
aaggugaaggaaua

SEQ ID NO: 2251895 - RNA, 15 nt, Human
aaggugaaggaauau

SEQ ID NO: 2251896 - RNA, 19 nt, Human
aaggucuuugguucagcua

SEQ ID NO: 2251897 - RNA, 13 nt, Human
aagauucuuuccc

SEQ ID NO: 2251898 - RNA, 16 nt, Human
aagauucuuucccaau

SEQ ID NO: 2251899 - RNA, 12 nt, Human
aagauugcugaa

SEQ ID NO: 2251900 - RNA, 17 nt, Human
aagauucuccugugcua

SEQ ID NO: 2251901 - RNA, 18 nt, Human
aagauucccagagacagg

SEQ ID NO: 2251902 - RNA, 15 nt, Human
aagauucccagagac

SEQ ID NO: 2251903 - RNA, 17 nt, Human
aagauucauccauuuau

SEQ ID NO: 2251904 - RNA, 19 nt, Human
aagauucauuuuuaaucau

SEQ ID NO: 2251905 - RNA, 20 nt, Human
aagauucauuuuuaaucaug

SEQ ID NO: 2251906 - RNA, 21 nt, Human
aagauucauuuuuaaucauga

SEQ ID NO: 2251907 - RNA, 14 nt, Human
aagauucccagaga

SEQ ID NO: 2251908 - RNA, 13 nt, Human
aagauucccagag

SEQ ID NO: 2251909 - RNA, 12 nt, Human
aagauucccaga

SEQ ID NO: 2251910 - RNA, 20 nt, Human
aagauucauauuuacuucuu

SEQ ID NO: 2251911 - RNA, 15 nt, Human
aagauucagguaugu

SEQ ID NO: 2251912 - RNA, 19 nt, Human
aagauucacaccugacucu

SEQ ID NO: 2251913 - RNA, 23 nt, Human
aagauucacaccugacucugaaa

SEQ ID NO: 2251914 - RNA, 17 nt, Human
aagauuacuuuuucuuu

SEQ ID NO: 2251915 - RNA, 11 nt, Human
aagauuagaag

SEQ ID NO: 2251916 - RNA, 13 nt, Human
aagauuagaagcu

SEQ ID NO: 2251917 - RNA, 14 nt, Human
aagauagcagggca

SEQ ID NO: 2251918 - RNA, 18 nt, Human
aagauuagaagcugaaaa

SEQ ID NO: 2251919 - RNA, 13 nt, Human
aagauuagaauga

SEQ ID NO: 2251920 - RNA, 18 nt, Human
aagauuagaaugaaaauu

SEQ ID NO: 2251921 - RNA, 17 nt, Human
aagauucaaucccagga

SEQ ID NO: 2251922 - RNA, 14 nt, Human
aagcagaggagggg

SEQ ID NO: 2251923 - RNA, 12 nt, Human
aagcagaggagg

SEQ ID NO: 2251924 - RNA, 21 nt, Human
aagcagaggaaggagaggaga

SEQ ID NO: 2251925 - RNA, 23 nt, Human
aagcagaauaaagcaauuuuccu

SEQ ID NO: 2251926 - RNA, 15 nt, Human
aagcagggacuugaa

SEQ ID NO: 2251927 - RNA, 20 nt, Human
aagcagaggaggggccgcug

SEQ ID NO: 2251928 - RNA, 15 nt, Human
aagcagaggaggggc

SEQ ID NO: 2251929 - RNA, 18 nt, Human
aagcagaugcaaagaggc

SEQ ID NO: 2251930 - RNA, 12 nt, Human
aagcagggagga

SEQ ID NO: 2251931 - RNA, 16 nt, Human
aagcagaugcaaagag

SEQ ID NO: 2251932 - RNA, 14 nt, Human
aagcagaugcaaag

SEQ ID NO: 2251933 - RNA, 22 nt, Human
aagcagaggaggggccgcugcc

SEQ ID NO: 2251934 - RNA, 17 nt, Human
aagcagggucugggcag

SEQ ID NO: 2251935 - RNA, 21 nt, Human
aagcaggggcuacaagaggga

SEQ ID NO: 2251936 - RNA, 22 nt, Human
aagcaggggcuacaagagggaa

SEQ ID NO: 2251937 - RNA, 17 nt, Human
aagcaggggaguaugca

SEQ ID NO: 2251938 - RNA, 18 nt, Human
aagcaggggaguaugcaa

SEQ ID NO: 2251939 - RNA, 19 nt, Human
aagcaggggaguaugcaaa

SEQ ID NO: 2251940 - RNA, 20 nt, Human
aagcaggggcuacaagaggg

SEQ ID NO: 2251941 - RNA, 19 nt, Human
aagccaccaacauacuccc

SEQ ID NO: 2251942 - RNA, 18 nt, Human
aagcacuuugggauucuu

SEQ ID NO: 2251943 - RNA, 20 nt, Human
aagcacuuggacucuugcuc

SEQ ID NO: 2251944 - RNA, 13 nt, Human
aagcagaaaauac

SEQ ID NO: 2251945 - RNA, 16 nt, Human
aagcacugugcucagg

SEQ ID NO: 2251946 - RNA, 15 nt, Human
aagcacugugcucag

SEQ ID NO: 2251947 - RNA, 19 nt, Human
aagcacuuggacucuugcu

SEQ ID NO: 2251948 - RNA, 20 nt, Human
aagcagaaaauacagcugga

SEQ ID NO: 2251949 - RNA, 12 nt, Human
aagcagaaauac

SEQ ID NO: 2251950 - RNA, 11 nt, Human
aagcagaauaa

SEQ ID NO: 2251951 - RNA, 12 nt, Human
aagcagaauaaa

SEQ ID NO: 2251952 - RNA, 13 nt, Human
aagcagaauaaag

SEQ ID NO: 2251953 - RNA, 14 nt, Human
aagcagaauaaagc

SEQ ID NO: 2251954 - RNA, 15 nt, Human
aagcagaauaaagca

SEQ ID NO: 2251955 - RNA, 16 nt, Human
aagcagaauaaagcaa

SEQ ID NO: 2251956 - RNA, 17 nt, Human
aagcagaauaaagcaau

SEQ ID NO: 2251957 - RNA, 18 nt, Human
aagcagaauaaagcaauu

SEQ ID NO: 2251958 - RNA, 19 nt, Human
aagcagaauaaagcaauuu

SEQ ID NO: 2251959 - RNA, 20 nt, Human
aagcagaauaaagcaauuuu

SEQ ID NO: 2251960 - RNA, 21 nt, Human
aagcagaauaaagcaauuuuc

SEQ ID NO: 2251961 - RNA, 22 nt, Human
aagcagaauaaagcaauuuucc

SEQ ID NO: 2251962 - RNA, 15 nt, Human
aagauugcugaaauu

SEQ ID NO: 2251963 - RNA, 13 nt, Human
aagauuuucagaa

SEQ ID NO: 2251964 - RNA, 19 nt, Human
aagauuuugaaauuuuuau

SEQ ID NO: 2251965 - RNA, 21 nt, Human
aagauuuugaaugcuuccuga

SEQ ID NO: 2251966 - RNA, 17 nt, Human
aagauuuugaaugcuuc

SEQ ID NO: 2251967 - RNA, 15 nt, Human
aagauuuugaaugcu

SEQ ID NO: 2251968 - RNA, 21 nt, Human
aagauuuuccuuuuuuauaca

SEQ ID NO: 2251969 - RNA, 12 nt, Human
aagauuuuccuu

SEQ ID NO: 2251970 - RNA, 18 nt, Human
aagauuuuccuuuuuuau

SEQ ID NO: 2251971 - RNA, 21 nt, Human
aagauuuuggaggagaaggac

SEQ ID NO: 2251972 - RNA, 23 nt, Human
aagauuuuggaggguccuccaca

SEQ ID NO: 2251973 - RNA, 13 nt, Human
aagauuuuucuca

SEQ ID NO: 2251974 - RNA, 14 nt, Human
aagauuuuucucaa

SEQ ID NO: 2251975 - RNA, 14 nt, Human
aagagagaaagaag

SEQ ID NO: 2251976 - RNA, 23 nt, Human
aagagagaaaauaaaaaguuaaa

SEQ ID NO: 2251977 - RNA, 21 nt, Human
aagagagaaagaaguaggcau

SEQ ID NO: 2251978 - RNA, 22 nt, Human
aagagagaaaauaaaaaguuaa

SEQ ID NO: 2251979 - RNA, 21 nt, Human
aagagagaaaauaaaaaguua

SEQ ID NO: 2251980 - RNA, 20 nt, Human
aagagagaaaauaaaaaguu

SEQ ID NO: 2251981 - RNA, 19 nt, Human
aagagagaaaauaaaaagu

SEQ ID NO: 2251982 - RNA, 19 nt, Human
aagagacaaacaccuccca

SEQ ID NO: 2251983 - RNA, 21 nt, Human
aagagacaaacaccucccagg

SEQ ID NO: 2251984 - RNA, 14 nt, Human
aagagacagucacc

SEQ ID NO: 2251985 - RNA, 20 nt, Human
aagagacagucaccccagga

SEQ ID NO: 2251986 - RNA, 21 nt, Human
aagagacagucaccccaggac

SEQ ID NO: 2251987 - RNA, 22 nt, Human
aagagacaggagggcaagggcc

SEQ ID NO: 2251988 - RNA, 13 nt, Human
aagagagaaugua

SEQ ID NO: 2251989 - RNA, 12 nt, Human
aagagagaaugu

SEQ ID NO: 2251990 - RNA, 15 nt, Human
aagagagauguuuug

SEQ ID NO: 2251991 - RNA, 15 nt, Human
aagagaggacacaaa

SEQ ID NO: 2251992 - RNA, 22 nt, Human
aagagagcuuaaugauaauauu

SEQ ID NO: 2251993 - RNA, 19 nt, Human
aagagaggagaggagagag

SEQ ID NO: 2251994 - RNA, 17 nt, Human
aagagaggagaggagag

SEQ ID NO: 2251995 - RNA, 18 nt, Human
aagagaggagaggagaga

SEQ ID NO: 2251996 - RNA, 20 nt, Human
aagagaauauuagcuuuacu

SEQ ID NO: 2251997 - RNA, 12 nt, Human
aagagaauauuu

SEQ ID NO: 2251998 - RNA, 13 nt, Human
aagagaauauuuu

SEQ ID NO: 2251999 - RNA, 14 nt, Human
aagagaaguuauuu

SEQ ID NO: 2252000 - RNA, 21 nt, Human
aagagaaguuauuuucuacag

SEQ ID NO: 2252001 - RNA, 18 nt, Human
aagagaauauuuuaagua

SEQ ID NO: 2252002 - RNA, 20 nt, Human
aagagaauauuuuaaguauu

SEQ ID NO: 2252003 - RNA, 22 nt, Human
aagagaauauuuuaaguauugc

SEQ ID NO: 2252004 - RNA, 19 nt, Human
aagacuuugggauaggaaa

SEQ ID NO: 2252005 - RNA, 16 nt, Human
aagagaaccgagcaaa

SEQ ID NO: 2252006 - RNA, 21 nt, Human
aagagaaccgagcaaagauca

SEQ ID NO: 2252007 - RNA, 22 nt, Human
aagagaaccgagcaaagaucaa

SEQ ID NO: 2252008 - RNA, 18 nt, Human
aagagaagggcagggcug

SEQ ID NO: 2252009 - RNA, 20 nt, Human
aagacuuugggauaggaaaa

SEQ ID NO: 2252010 - RNA, 15 nt, Human
aagacuuuuaugaua

SEQ ID NO: 2252011 - RNA, 20 nt, Human
aagagaacccacgaacauuc

SEQ ID NO: 2252012 - RNA, 15 nt, Human
aagagaacuuccaga

SEQ ID NO: 2252013 - RNA, 18 nt, Human
aagacauggagacuccug

SEQ ID NO: 2252014 - RNA, 21 nt, Human
aagacagggcugauaagcuaa

SEQ ID NO: 2252015 - RNA, 19 nt, Human
aagacauggggaggaagga

SEQ ID NO: 2252016 - RNA, 16 nt, Human
aagacauguagguguu

SEQ ID NO: 2252017 - RNA, 22 nt, Human
aagacaggaugggggcuggccu

SEQ ID NO: 2252018 - RNA, 19 nt, Human
aagacauggagacuccugc

SEQ ID NO: 2252019 - RNA, 13 nt, Human
aagacaugucugu

SEQ ID NO: 2252020 - RNA, 12 nt, Human
aagacaugucug

SEQ ID NO: 2252021 - RNA, 23 nt, Human
aagacagugaaagaaaauaacaa

SEQ ID NO: 2252022 - RNA, 13 nt, Human
aagacauugucaa

SEQ ID NO: 2252023 - RNA, 18 nt, Human
aagacauuaaaucuauga

SEQ ID NO: 2252024 - RNA, 13 nt, Human
aagacauguuuua

SEQ ID NO: 2252025 - RNA, 14 nt, Human
aagacauguuuuag

SEQ ID NO: 2252026 - RNA, 17 nt, Human
aagacauguuuuagaca

SEQ ID NO: 2252027 - RNA, 15 nt, Human
aagacauuaaaucua

SEQ ID NO: 2252028 - RNA, 16 nt, Human
aagacuuuggaaagag

SEQ ID NO: 2252029 - RNA, 21 nt, Human
aagacauucuuccaaaaagau

SEQ ID NO: 2252030 - RNA, 19 nt, Human
aagacaugucuguucuaca

SEQ ID NO: 2252031 - RNA, 17 nt, Human
aagacaugucuguucua

SEQ ID NO: 2252032 - RNA, 16 nt, Human
aagacaugucuguucu

SEQ ID NO: 2252033 - RNA, 22 nt, Human
aagacagcuucucauccugcag

SEQ ID NO: 2252034 - RNA, 23 nt, Human
aagacaggacagugcuucagccu

SEQ ID NO: 2252035 - RNA, 16 nt, Human
aacuuagcauguguug

SEQ ID NO: 2252036 - RNA, 17 nt, Human
aacuuagaauaaaauug

SEQ ID NO: 2252037 - RNA, 18 nt, Human
aacuuagaauaaaauugu

SEQ ID NO: 2252038 - RNA, 19 nt, Human
aacuuagaauaaaauugua

SEQ ID NO: 2252039 - RNA, 21 nt, Human
aacuuagaauaaaauuguaaa

SEQ ID NO: 2252040 - RNA, 14 nt, Human
aacuuacuuagugu

SEQ ID NO: 2252041 - RNA, 19 nt, Human
aacuuaccugggcauucuu

SEQ ID NO: 2252042 - RNA, 23 nt, Human
aacuuaccgugagcgacaaagau

SEQ ID NO: 2252043 - RNA, 16 nt, Human
aacuuagaauaaaauu

SEQ ID NO: 2252044 - RNA, 15 nt, Human
aacuuagaauaaaau

SEQ ID NO: 2252045 - RNA, 23 nt, Human
aacuuacauugugaaacuucugu

SEQ ID NO: 2252046 - RNA, 22 nt, Human
aacuuacauuguucaauuagaa

SEQ ID NO: 2252047 - RNA, 21 nt, Human
aacuuacauuguucaauuaga

SEQ ID NO: 2252048 - RNA, 20 nt, Human
aacuuacauuguucaauuag

SEQ ID NO: 2252049 - RNA, 19 nt, Human
aacuuacauuguucaauua

SEQ ID NO: 2252050 - RNA, 13 nt, Human
aacuuacacacaa

SEQ ID NO: 2252051 - RNA, 22 nt, Human
aacuguuuagggcccugauuug

SEQ ID NO: 2252052 - RNA, 19 nt, Human
aacuguuguauaaauuuau

SEQ ID NO: 2252053 - RNA, 15 nt, Human
aacuguugccagaga

SEQ ID NO: 2252054 - RNA, 16 nt, Human
aacuguuaugaaauaa

SEQ ID NO: 2252055 - RNA, 14 nt, Human
aacuguugauugca

SEQ ID NO: 2252056 - RNA, 18 nt, Human
aacuguugccagagaugg

SEQ ID NO: 2252057 - RNA, 17 nt, Human
aacuguugccagagaug

SEQ ID NO: 2252058 - RNA, 15 nt, Human
aacuguuguauaaau

SEQ ID NO: 2252059 - RNA, 14 nt, Human
aacuguuguauaaa

SEQ ID NO: 2252060 - RNA, 13 nt, Human
aacuguuguauaa

SEQ ID NO: 2252061 - RNA, 15 nt, Human
aaugcucagaccagc

SEQ ID NO: 2252062 - RNA, 17 nt, Human
aaugcuaggucucggac

SEQ ID NO: 2252063 - RNA, 16 nt, Human
aaugcucauaacggau

SEQ ID NO: 2252064 - RNA, 12 nt, Human
aaugcucaucug

SEQ ID NO: 2252065 - RNA, 20 nt, Human
aaugcucccccauccucccc

SEQ ID NO: 2252066 - RNA, 14 nt, Human
aaugcucccccauc

SEQ ID NO: 2252067 - RNA, 11 nt, Human
aaugcuccccc

SEQ ID NO: 2252068 - RNA, 20 nt, Human
aaugcuauuuuuuauuuuac

SEQ ID NO: 2252069 - RNA, 22 nt, Human
aaugcucccccauccuccccuu

SEQ ID NO: 2252070 - RNA, 21 nt, Human
aaugcucccccauccuccccu

SEQ ID NO: 2252071 - RNA, 11 nt, Human
aaugcucuagu

SEQ ID NO: 2252072 - RNA, 19 nt, Human
aaugcuccuuguuccuaga

SEQ ID NO: 2252073 - RNA, 14 nt, Human
aaugcucuccuuuc

SEQ ID NO: 2252074 - RNA, 13 nt, Human
aaugcucuccuuu

SEQ ID NO: 2252075 - RNA, 20 nt, Human
aaugcucuggggucuuuuua

SEQ ID NO: 2252076 - RNA, 23 nt, Human
aaugcucuuuacuucauggacuu

SEQ ID NO: 2252077 - RNA, 17 nt, Human
aaugggacuucuuuuca

SEQ ID NO: 2252078 - RNA, 18 nt, Human
aaugggacuucuuuucac

SEQ ID NO: 2252079 - RNA, 20 nt, Human
aaugggacuucuuuucacau

SEQ ID NO: 2252080 - RNA, 21 nt, Human
aaugggacuucuuuucacauu

SEQ ID NO: 2252081 - RNA, 21 nt, Human
aaugggagcugaggccacacu

SEQ ID NO: 2252082 - RNA, 17 nt, Human
aauggggccagauccag

SEQ ID NO: 2252083 - RNA, 18 nt, Human
aaugggcaaaacugaauu

SEQ ID NO: 2252084 - RNA, 12 nt, Human
aaugggcacagc

SEQ ID NO: 2252085 - RNA, 23 nt, Human
aaugggcacugggaugagccgcu

SEQ ID NO: 2252086 - RNA, 13 nt, Human
aaugggacacuaa

SEQ ID NO: 2252087 - RNA, 14 nt, Human
aaugggagcucaug

SEQ ID NO: 2252088 - RNA, 18 nt, Human
aaugguaugagcugaggg

SEQ ID NO: 2252089 - RNA, 16 nt, Human
aaugguauggaacucu

SEQ ID NO: 2252090 - RNA, 19 nt, Human
aaugguccaggagaaggcc

SEQ ID NO: 2252091 - RNA, 14 nt, Human
aaugguccaggaga

SEQ ID NO: 2252092 - RNA, 20 nt, Human
aauggucagcguugcauguc

SEQ ID NO: 2252093 - RNA, 14 nt, Human
aauggucagcguug

SEQ ID NO: 2252094 - RNA, 18 nt, Human
aauggucagcguugcaug

SEQ ID NO: 2252095 - RNA, 15 nt, Human
aaugucacaggcagg

SEQ ID NO: 2252096 - RNA, 13 nt, Human
aaugguccagggu

SEQ ID NO: 2252097 - RNA, 14 nt, Human
aaugguccaggguu

SEQ ID NO: 2252098 - RNA, 16 nt, Human
aaugguccaggguuga

SEQ ID NO: 2252099 - RNA, 17 nt, Human
aauggucccauccaggc

SEQ ID NO: 2252100 - RNA, 17 nt, Human
aaugggggugcauuuga

SEQ ID NO: 2252101 - RNA, 15 nt, Human
aaugggggugcauuu

SEQ ID NO: 2252102 - RNA, 18 nt, Human
aaugggguccuggccauc

SEQ ID NO: 2252103 - RNA, 17 nt, Human
aaugggguccuggccau

SEQ ID NO: 2252104 - RNA, 18 nt, Human
aauggggguagcagcugg

SEQ ID NO: 2252105 - RNA, 19 nt, Human
aauggggguagcagcugga

SEQ ID NO: 2252106 - RNA, 22 nt, Human
aauggggccagauccagccugg

SEQ ID NO: 2252107 - RNA, 20 nt, Human
aaugggggccucuucaaauu

SEQ ID NO: 2252108 - RNA, 12 nt, Human
aauggguaauau

SEQ ID NO: 2252109 - RNA, 16 nt, Human
aauggguaucuauauu

SEQ ID NO: 2252110 - RNA, 16 nt, Human
aauggguuuuucccug

SEQ ID NO: 2252111 - RNA, 15 nt, Human
aaugguaugagcuga

SEQ ID NO: 2252112 - RNA, 18 nt, Human
aaugcuaaagaaaaaguc

SEQ ID NO: 2252113 - RNA, 20 nt, Human
aaugcuaaagaaaaagucau

SEQ ID NO: 2252114 - RNA, 16 nt, Human
aaugcuacgugugauu

SEQ ID NO: 2252115 - RNA, 17 nt, Human
aaugcuacgugugauuu

SEQ ID NO: 2252116 - RNA, 19 nt, Human
aaugcuacgugugauuuuu

SEQ ID NO: 2252117 - RNA, 18 nt, Human
aaugcuagcucugagcca

SEQ ID NO: 2252118 - RNA, 23 nt, Human
aaugcuacgugugauuuuucugg

SEQ ID NO: 2252119 - RNA, 13 nt, Human
aaugcuacuuuau

SEQ ID NO: 2252120 - RNA, 23 nt, Human
aaugcgugcauaccacuuuuguu

SEQ ID NO: 2252121 - RNA, 21 nt, Human
aaugcgugcauaccacuuuug

SEQ ID NO: 2252122 - RNA, 17 nt, Human
aaugccugagugccugg

SEQ ID NO: 2252123 - RNA, 19 nt, Human
aaugccugagugccuggcc

SEQ ID NO: 2252124 - RNA, 16 nt, Human
aaugccugagugccug

SEQ ID NO: 2252125 - RNA, 14 nt, Human
aaugcgcaggcugg

SEQ ID NO: 2252126 - RNA, 15 nt, Human
aaugcgcaggcuggc

SEQ ID NO: 2252127 - RNA, 20 nt, Human
aaugcgcaggcuggcccugc

SEQ ID NO: 2252128 - RNA, 19 nt, Human
aaugcgcaggcuggcccug

SEQ ID NO: 2252129 - RNA, 18 nt, Human
aaugcgcaggcuggcccu

SEQ ID NO: 2252130 - RNA, 17 nt, Human
aaugcgcaggcuggccc

SEQ ID NO: 2252131 - RNA, 15 nt, Human
aaugccuccucccug

SEQ ID NO: 2252132 - RNA, 14 nt, Human
aaugccuccucccu

SEQ ID NO: 2252133 - RNA, 12 nt, Human
aaugccuccucc

SEQ ID NO: 2252134 - RNA, 21 nt, Human
aaugccucaguguauuuguau

SEQ ID NO: 2252135 - RNA, 23 nt, Human
aaugccucaguguauuuguauuu

SEQ ID NO: 2252136 - RNA, 20 nt, Human
aaugccucaaugugaccagg

SEQ ID NO: 2252137 - RNA, 15 nt, Human
aaugccucaguguau

SEQ ID NO: 2252138 - RNA, 20 nt, Human
aaugccucaguguauuugua

SEQ ID NO: 2252139 - RNA, 16 nt, Human
aaugcccuuaaaucau

SEQ ID NO: 2252140 - RNA, 22 nt, Human
aaugcccucaggggacuugaau

SEQ ID NO: 2252141 - RNA, 18 nt, Human
aaugcccuuacacuuacu

SEQ ID NO: 2252142 - RNA, 22 nt, Human
aaugcccuuacacuuacuguug

SEQ ID NO: 2252143 - RNA, 19 nt, Human
aaugcccguaaugcuuaga

SEQ ID NO: 2252144 - RNA, 18 nt, Human
aaugcccguaaugcuuag

SEQ ID NO: 2252145 - RNA, 18 nt, Human
aaucuccucuuuuaucuu

SEQ ID NO: 2252146 - RNA, 18 nt, Human
aaucucggcucacugcau

SEQ ID NO: 2252147 - RNA, 15 nt, Human
aaucuccucuuuuau

SEQ ID NO: 2252148 - RNA, 19 nt, Human
aaucucccgcugcugcugc

SEQ ID NO: 2252149 - RNA, 23 nt, Human
aaucucgcucugucgcccaggcu

SEQ ID NO: 2252150 - RNA, 17 nt, Human
aaucucccgcugcugcu

SEQ ID NO: 2252151 - RNA, 15 nt, Human
aaucuccaguauucu

SEQ ID NO: 2252152 - RNA, 12 nt, Human
aauccauguaag

SEQ ID NO: 2252153 - RNA, 16 nt, Human
aauccauguaagguau

SEQ ID NO: 2252154 - RNA, 17 nt, Human
aauccauguuaguuuuu

SEQ ID NO: 2252155 - RNA, 15 nt, Human
aauccaugcuugggu

SEQ ID NO: 2252156 - RNA, 22 nt, Human
aauccaucuaaauaccugcccu

SEQ ID NO: 2252157 - RNA, 23 nt, Human
aauccaucuaaauaccugcccug

SEQ ID NO: 2252158 - RNA, 14 nt, Human
aaucuggagaccag

SEQ ID NO: 2252159 - RNA, 20 nt, Human
aaucuggacuccucugucca

SEQ ID NO: 2252160 - RNA, 17 nt, Human
aaucuggacuccucugu

SEQ ID NO: 2252161 - RNA, 18 nt, Human
aaucuggacuccucuguc

SEQ ID NO: 2252162 - RNA, 15 nt, Human
aaucuggacuccucu

SEQ ID NO: 2252163 - RNA, 16 nt, Human
aaucuggacuccucug

SEQ ID NO: 2252164 - RNA, 24 nt, Human
aaucuggaccccaucugugaauaa

SEQ ID NO: 2252165 - RNA, 23 nt, Human
aaucuggaccccaucugugaaua

SEQ ID NO: 2252166 - RNA, 15 nt, Human
aaucucguuucaaaa

SEQ ID NO: 2252167 - RNA, 16 nt, Human
aaucucguuucaaaaa

SEQ ID NO: 2252168 - RNA, 18 nt, Human
aaucucguuucaaaaaca

SEQ ID NO: 2252169 - RNA, 19 nt, Human
aaucucguuucaaaaacac

SEQ ID NO: 2252170 - RNA, 18 nt, Human
aauccaccugccucggcc

SEQ ID NO: 2252171 - RNA, 19 nt, Human
aauccaccugccucggccu

SEQ ID NO: 2252172 - RNA, 12 nt, Human
aauccacccauc

SEQ ID NO: 2252173 - RNA, 18 nt, Human
aauccacaaucugacauu

SEQ ID NO: 2252174 - RNA, 22 nt, Human
aauccaagauauuuuaaaaucu

SEQ ID NO: 2252175 - RNA, 17 nt, Human
aauccaacccaugauga

SEQ ID NO: 2252176 - RNA, 20 nt, Human
aauccaaauggcgucuggaa

SEQ ID NO: 2252177 - RNA, 13 nt, Human
aauccaaauggcg

SEQ ID NO: 2252178 - RNA, 21 nt, Human
aauccaaacuuggauuuuuga

SEQ ID NO: 2252179 - RNA, 14 nt, Human
aauccaaacuugga

SEQ ID NO: 2252180 - RNA, 22 nt, Human
aauccagaauugaccuuuugac

SEQ ID NO: 2252181 - RNA, 21 nt, Human
aauccaucuaaauaccugccc

SEQ ID NO: 2252182 - RNA, 17 nt, Human
aauccauacauuugugu

SEQ ID NO: 2252183 - RNA, 17 nt, Human
aauccagaaagaaaaaa

SEQ ID NO: 2252184 - RNA, 13 nt, Human
aauccagaaagaa

SEQ ID NO: 2252185 - RNA, 23 nt, Human
aauccacccauccuaccaaugca

SEQ ID NO: 2252186 - RNA, 15 nt, Human
aauccacucccaggc

SEQ ID NO: 2252187 - RNA, 17 nt, Human
aauccacucccaggcag

SEQ ID NO: 2252188 - RNA, 18 nt, Human
aauccacucccaggcagc

SEQ ID NO: 2252189 - RNA, 16 nt, Human
aauccauacauuugug

SEQ ID NO: 2252190 - RNA, 18 nt, Human
aaugauacccugaauuug

SEQ ID NO: 2252191 - RNA, 18 nt, Human
aaugaacacucuuuugcu

SEQ ID NO: 2252192 - RNA, 15 nt, Human
aaugaacacucuuuu

SEQ ID NO: 2252193 - RNA, 21 nt, Human
aaugaacacucuuuugcuuua

SEQ ID NO: 2252194 - RNA, 15 nt, Human
aaugauaacuggaaa

SEQ ID NO: 2252195 - RNA, 16 nt, Human
aaugauaacuggaaac

SEQ ID NO: 2252196 - RNA, 17 nt, Human
aaugaaauuacuacaaa

SEQ ID NO: 2252197 - RNA, 14 nt, Human
aaugaaauuguaaa

SEQ ID NO: 2252198 - RNA, 23 nt, Human
aaugaaauuacuacaaaauuuga

SEQ ID NO: 2252199 - RNA, 14 nt, Human
aaugaacaaauuga

SEQ ID NO: 2252200 - RNA, 14 nt, Human
aaugauaacuggaa

SEQ ID NO: 2252201 - RNA, 21 nt, Human
aaugauguguacccaaacgug

SEQ ID NO: 2252202 - RNA, 12 nt, Human
aaugauuaauua

SEQ ID NO: 2252203 - RNA, 13 nt, Human
aaugauuaauuaa

SEQ ID NO: 2252204 - RNA, 15 nt, Human
aaugauagcuacugu

SEQ ID NO: 2252205 - RNA, 18 nt, Human
aaugauaguaagaaaagu

SEQ ID NO: 2252206 - RNA, 18 nt, Human
aaugauauagccagaaaa

SEQ ID NO: 2252207 - RNA, 17 nt, Human
aaugauauauggauaau

SEQ ID NO: 2252208 - RNA, 16 nt, Human
aaugaucauaagucua

SEQ ID NO: 2252209 - RNA, 23 nt, Human
aaugauguauguugaagccuuug

SEQ ID NO: 2252210 - RNA, 14 nt, Human
aaugauguccagaa

SEQ ID NO: 2252211 - RNA, 15 nt, Human
aaugauguccagaag

SEQ ID NO: 2252212 - RNA, 18 nt, Human
aaugauguccagaagaau

SEQ ID NO: 2252213 - RNA, 20 nt, Human
aaucauuuuacccuuggcuc

SEQ ID NO: 2252214 - RNA, 19 nt, Human
aaucauuuuauaugucaaa

SEQ ID NO: 2252215 - RNA, 20 nt, Human
aaucauuuuauaugucaaag

SEQ ID NO: 2252216 - RNA, 23 nt, Human
aaucauuuuauaugucaaagcag

SEQ ID NO: 2252217 - RNA, 19 nt, Human
aaucauuuugccucuuuuc

SEQ ID NO: 2252218 - RNA, 18 nt, Human
aaucauuuguucaaagcu

SEQ ID NO: 2252219 - RNA, 15 nt, Human
aaucauuuuaauuau

SEQ ID NO: 2252220 - RNA, 16 nt, Human
aaucauuuuaauuauu

SEQ ID NO: 2252221 - RNA, 17 nt, Human
aaucauuuuaauuauua

SEQ ID NO: 2252222 - RNA, 19 nt, Human
aaucauuuuaauuauuauu

SEQ ID NO: 2252223 - RNA, 20 nt, Human
aaucauuuuaauuauuauuc

SEQ ID NO: 2252224 - RNA, 22 nt, Human
aaucauuuuaauuauuauucuu

SEQ ID NO: 2252225 - RNA, 22 nt, Human
aaucauuucuugggcccuccug

SEQ ID NO: 2252226 - RNA, 21 nt, Human
aaucauuucuugggcccuccu

SEQ ID NO: 2252227 - RNA, 11 nt, Human
aaucauuuguu

SEQ ID NO: 2252228 - RNA, 14 nt, Human
aaucauuugcuuuu

SEQ ID NO: 2252229 - RNA, 22 nt, Human
aaucauuuggguuaauauggcu

SEQ ID NO: 2252230 - RNA, 22 nt, Human
aaucauuucugcaucagcugcu

SEQ ID NO: 2252231 - RNA, 18 nt, Human
aauauggaacuucuaaua

SEQ ID NO: 2252232 - RNA, 22 nt, Human
aaucaaauaugcaaagcacuga

SEQ ID NO: 2252233 - RNA, 16 nt, Human
aaucaaauaugcaaag

SEQ ID NO: 2252234 - RNA, 15 nt, Human
aaucaaauaugcaaa

SEQ ID NO: 2252235 - RNA, 14 nt, Human
aauaugcuggcugg

SEQ ID NO: 2252236 - RNA, 16 nt, Human
aauaugcuggcuggag

SEQ ID NO: 2252237 - RNA, 22 nt, Human
aauaugcugccaaauuuuggcc

SEQ ID NO: 2252238 - RNA, 19 nt, Human
aauaugcugccaaauuuug

SEQ ID NO: 2252239 - RNA, 14 nt, Human
aauaugcugccaaa

SEQ ID NO: 2252240 - RNA, 22 nt, Human
aauauagcuguacaaauauaag

SEQ ID NO: 2252241 - RNA, 18 nt, Human
aauauagcuguacaaaua

SEQ ID NO: 2252242 - RNA, 19 nt, Human
aauauagcuguacaaauau

SEQ ID NO: 2252243 - RNA, 20 nt, Human
aauauagcuguacaaauaua

SEQ ID NO: 2252244 - RNA, 21 nt, Human
aauauagcuguacaaauauaa

SEQ ID NO: 2252245 - RNA, 24 nt, Human
aauauggaacuuacauuguucaau

SEQ ID NO: 2252246 - RNA, 20 nt, Human
aauauggaacuuacauuguu

SEQ ID NO: 2252247 - RNA, 14 nt, Human
aauauggaacuucu

SEQ ID NO: 2252248 - RNA, 17 nt, Human
aauauggaacuucuaau

SEQ ID NO: 2252249 - RNA, 17 nt, Human
aauauggaacuuacauu

SEQ ID NO: 2252250 - RNA, 16 nt, Human
aauauggaacuuacau

SEQ ID NO: 2252251 - RNA, 15 nt, Human
aauauggaacuuaca

SEQ ID NO: 2252252 - RNA, 14 nt, Human
aauauggaacuuac

SEQ ID NO: 2252253 - RNA, 11 nt, Human
aauaugcuuac

SEQ ID NO: 2252254 - RNA, 10 nt, Human
aauaugcuua

SEQ ID NO: 2252255 - RNA, 20 nt, Human
aauauggaacuucuaauaua

SEQ ID NO: 2252256 - RNA, 13 nt, Human
aauauaaacacua

SEQ ID NO: 2252257 - RNA, 14 nt, Human
aauauaaacacuau

SEQ ID NO: 2252258 - RNA, 21 nt, Human
aauauaaagauggcugacuuu

SEQ ID NO: 2252259 - RNA, 13 nt, Human
aauauaacugccu

SEQ ID NO: 2252260 - RNA, 13 nt, Human
aauauagcuauuu

SEQ ID NO: 2252261 - RNA, 16 nt, Human
aauauagcuguacaaa

SEQ ID NO: 2252262 - RNA, 15 nt, Human
aauauagcuauuuuu

SEQ ID NO: 2252263 - RNA, 16 nt, Human
aauauaggaacuuaaa

SEQ ID NO: 2252264 - RNA, 17 nt, Human
aauauacuuguggacua

SEQ ID NO: 2252265 - RNA, 22 nt, Human
aauauacuuguggacuaaaaga

SEQ ID NO: 2252266 - RNA, 23 nt, Human
aauauacuuguggacuaaaagau

SEQ ID NO: 2252267 - RNA, 21 nt, Human
aauauagaucaguuauaagua

SEQ ID NO: 2252268 - RNA, 14 nt, Human
aauauagaaacacg

SEQ ID NO: 2252269 - RNA, 22 nt, Human
aauauagaaacacgaacuuuag

SEQ ID NO: 2252270 - RNA, 13 nt, Human
aauauagaaacac

SEQ ID NO: 2252271 - RNA, 17 nt, Human
aauagaaauggggaacu

SEQ ID NO: 2252272 - RNA, 16 nt, Human
aauagaaauaaguggu

SEQ ID NO: 2252273 - RNA, 16 nt, Human
aauagaaauuuccaga

SEQ ID NO: 2252274 - RNA, 15 nt, Human
aauagaagaacaucc

SEQ ID NO: 2252275 - RNA, 21 nt, Human
aauagaaacucaccauguaaa

SEQ ID NO: 2252276 - RNA, 22 nt, Human
aauagaaauaaaggaugugauu

SEQ ID NO: 2252277 - RNA, 13 nt, Human
aauagaaacucac

SEQ ID NO: 2252278 - RNA, 10 nt, Human
aauacuuguc

SEQ ID NO: 2252279 - RNA, 11 nt, Human
aauauaaaacu

SEQ ID NO: 2252280 - RNA, 22 nt, Human
aauaguuuuauuaauaaacauu

SEQ ID NO: 2252281 - RNA, 20 nt, Human
aauaguuuuauuaauaaaca

SEQ ID NO: 2252282 - RNA, 21 nt, Human
aauaguuuuauuaauaaacau

SEQ ID NO: 2252283 - RNA, 14 nt, Human
aauauaaaauauga

SEQ ID NO: 2252284 - RNA, 23 nt, Human
aauauaaaaggcaaauguguaca

SEQ ID NO: 2252285 - RNA, 14 nt, Human
aauauaaaacugcg

SEQ ID NO: 2252286 - RNA, 18 nt, Human
aauauaaaacugcguuaa

SEQ ID NO: 2252287 - RNA, 17 nt, Human
aauauaaaacuguacuu

SEQ ID NO: 2252288 - RNA, 14 nt, Human
aauauaaaaggcaa

SEQ ID NO: 2252289 - RNA, 23 nt, Human
aauauaaaauaugaagacauaaa

SEQ ID NO: 2252290 - RNA, 22 nt, Human
aauauaaaaggcaaauguguac

SEQ ID NO: 2252291 - RNA, 16 nt, Human
aauacgcacuacaugu

SEQ ID NO: 2252292 - RNA, 18 nt, Human
aauacgcacuacaugugg

SEQ ID NO: 2252293 - RNA, 21 nt, Human
aauaccugucccccugacaac

SEQ ID NO: 2252294 - RNA, 16 nt, Human
aauacuaccuugaaaa

SEQ ID NO: 2252295 - RNA, 15 nt, Human
aauacuaccuugaaa

SEQ ID NO: 2252296 - RNA, 14 nt, Human
aauacuaccuugaa

SEQ ID NO: 2252297 - RNA, 17 nt, Human
aauacuucucaaaccug

SEQ ID NO: 2252298 - RNA, 12 nt, Human
aauacuguuuga

SEQ ID NO: 2252299 - RNA, 23 nt, Human
aauacuucucaaaccuguuuaaa

SEQ ID NO: 2252300 - RNA, 21 nt, Human
aauacuucucaaaccuguuua

SEQ ID NO: 2252301 - RNA, 22 nt, Human
aauacuucucaaaccuguuuaa

SEQ ID NO: 2252302 - RNA, 11 nt, Human
aauaauaaauc

SEQ ID NO: 2252303 - RNA, 11 nt, Human
aauaauaauua

SEQ ID NO: 2252304 - RNA, 21 nt, Human
aauaauaauuauccagaguuu

SEQ ID NO: 2252305 - RNA, 20 nt, Human
aauaauacauugaauuagaa

SEQ ID NO: 2252306 - RNA, 18 nt, Human
aauaauaccuaagccuuc

SEQ ID NO: 2252307 - RNA, 14 nt, Human
aauaauacacuaau

SEQ ID NO: 2252308 - RNA, 12 nt, Human
aauaauauacuu

SEQ ID NO: 2252309 - RNA, 13 nt, Human
aauaauauacuug

SEQ ID NO: 2252310 - RNA, 16 nt, Human
aauaauauacuugugg

SEQ ID NO: 2252311 - RNA, 17 nt, Human
aauaauauauuuuaaau

SEQ ID NO: 2252312 - RNA, 13 nt, Human
aauaauauauguu

SEQ ID NO: 2252313 - RNA, 11 nt, Human
aauaauaugca

SEQ ID NO: 2252314 - RNA, 12 nt, Human
aauaauaugcau

SEQ ID NO: 2252315 - RNA, 13 nt, Human
aauaauaugcauu

SEQ ID NO: 2252316 - RNA, 15 nt, Human
aauaauaugcauugu

SEQ ID NO: 2252317 - RNA, 15 nt, Human
aauaauauauuuucu

SEQ ID NO: 2252318 - RNA, 17 nt, Human
aauaauauauuuucugu

SEQ ID NO: 2252319 - RNA, 19 nt, Human
aauaauauauuuucuguuu

SEQ ID NO: 2252320 - RNA, 17 nt, Human
aauaauaugcauuguca

SEQ ID NO: 2252321 - RNA, 14 nt, Human
aauaauauauguuu

SEQ ID NO: 2252322 - RNA, 12 nt, Human
aauaauguuuca

SEQ ID NO: 2252323 - RNA, 14 nt, Human
aauaauguuucaaa

SEQ ID NO: 2252324 - RNA, 19 nt, Human
aauaauguuucaaacauau

SEQ ID NO: 2252325 - RNA, 18 nt, Human
aauaaagccuucaaacuc

SEQ ID NO: 2252326 - RNA, 15 nt, Human
aauaaagccugcuuu

SEQ ID NO: 2252327 - RNA, 15 nt, Human
aauaaagcccuggga

SEQ ID NO: 2252328 - RNA, 12 nt, Human
aauaaacgauuu

SEQ ID NO: 2252329 - RNA, 15 nt, Human
aauaaacgauuuaau

SEQ ID NO: 2252330 - RNA, 20 nt, Human
aauaaaccucaaaaugucua

SEQ ID NO: 2252331 - RNA, 11 nt, Human
aauaaagcugu

SEQ ID NO: 2252332 - RNA, 19 nt, Human
aauaaagcuguguggcagu

SEQ ID NO: 2252333 - RNA, 14 nt, Human
aauaauaaauauuu

SEQ ID NO: 2252334 - RNA, 18 nt, Human
aauaauaaagaugcucuu

SEQ ID NO: 2252335 - RNA, 21 nt, Human
aauaauaaagaucauguaaaa

SEQ ID NO: 2252336 - RNA, 19 nt, Human
aauaauaaagaugcucuuu

SEQ ID NO: 2252337 - RNA, 21 nt, Human
aauaaacgauuuaauucucuu

SEQ ID NO: 2252338 - RNA, 16 nt, Human
aauaaaggaugugauu

SEQ ID NO: 2252339 - RNA, 13 nt, Human
aauaauaaagauc

SEQ ID NO: 2252340 - RNA, 16 nt, Human
aaguugcagugagcug

SEQ ID NO: 2252341 - RNA, 15 nt, Human
aauaaaauugcacuu

SEQ ID NO: 2252342 - RNA, 12 nt, Human
aauaaaauugua

SEQ ID NO: 2252343 - RNA, 14 nt, Human
aauaaaauuguaaa

SEQ ID NO: 2252344 - RNA, 11 nt, Human
aauaaaauuug

SEQ ID NO: 2252345 - RNA, 12 nt, Human
aauaaaauuugu

SEQ ID NO: 2252346 - RNA, 13 nt, Human
aauaaaauuuguu

SEQ ID NO: 2252347 - RNA, 14 nt, Human
aauaaaauuuguug

SEQ ID NO: 2252348 - RNA, 18 nt, Human
aaguugauggugaugaaa

SEQ ID NO: 2252349 - RNA, 14 nt, Human
aaguugaugcaauc

SEQ ID NO: 2252350 - RNA, 15 nt, Human
aaguugcacggcugc

SEQ ID NO: 2252351 - RNA, 16 nt, Human
aaguugcacggcugcu

SEQ ID NO: 2252352 - RNA, 18 nt, Human
aaguugcacggcugcuga

SEQ ID NO: 2252353 - RNA, 18 nt, Human
aaguugcacugauauuuu

SEQ ID NO: 2252354 - RNA, 20 nt, Human
aaguugcacugauauuuuac

SEQ ID NO: 2252355 - RNA, 22 nt, Human
aauaaaauuuuuuuucauguuu

SEQ ID NO: 2252356 - RNA, 13 nt, Human
aauaaacaaauaa

SEQ ID NO: 2252357 - RNA, 17 nt, Human
aauaaaccucaaaaugu

SEQ ID NO: 2252358 - RNA, 10 nt, Human
aauaaaccau

SEQ ID NO: 2252359 - RNA, 12 nt, Human
aauaaaauuuuu

SEQ ID NO: 2252360 - RNA, 19 nt, Human
aauaaaauuuuuuuucaug

SEQ ID NO: 2252361 - RNA, 18 nt, Human
aauaaaauuuuuuuucau

SEQ ID NO: 2252362 - RNA, 16 nt, Human
aauaaaauuuguugca

SEQ ID NO: 2252363 - RNA, 17 nt, Human
aauaaaauuuguugcau

SEQ ID NO: 2252364 - RNA, 15 nt, Human
aaguucuuaguugcu

SEQ ID NO: 2252365 - RNA, 19 nt, Human
aaguucuguacucaaaugu

SEQ ID NO: 2252366 - RNA, 19 nt, Human
aaguucuggaugcauuucu

SEQ ID NO: 2252367 - RNA, 22 nt, Human
aaguucuuaguugcuguauguc

SEQ ID NO: 2252368 - RNA, 20 nt, Human
aaguucuggaugcauuucuc

SEQ ID NO: 2252369 - RNA, 15 nt, Human
aaguucuucuccaau

SEQ ID NO: 2252370 - RNA, 22 nt, Human
aaguugauaugccuuuucccaa

SEQ ID NO: 2252371 - RNA, 19 nt, Human
aagugggggcagagggcag

SEQ ID NO: 2252372 - RNA, 18 nt, Human
aaguggggugcugggagg

SEQ ID NO: 2252373 - RNA, 20 nt, Human
aagugggguugcaaccacug

SEQ ID NO: 2252374 - RNA, 15 nt, Human
aaguggggcucgcca

SEQ ID NO: 2252375 - RNA, 13 nt, Human
aaguggggcucgc

SEQ ID NO: 2252376 - RNA, 14 nt, Human
aagugggugagaug

SEQ ID NO: 2252377 - RNA, 19 nt, Human
aagugggugagaugcugga

SEQ ID NO: 2252378 - RNA, 19 nt, Human
aaguggguuauucuggagu

SEQ ID NO: 2252379 - RNA, 21 nt, Human
aagugggccaggacaggcccg

SEQ ID NO: 2252380 - RNA, 16 nt, Human
aagugggcuugauucu

SEQ ID NO: 2252381 - RNA, 12 nt, Human
aagugggcuuga

SEQ ID NO: 2252382 - RNA, 16 nt, Human
aagugggccaggacag

SEQ ID NO: 2252383 - RNA, 22 nt, Human
aagugggcuugauucugcagua

SEQ ID NO: 2252384 - RNA, 15 nt, Human
aaguggggacagagc

SEQ ID NO: 2252385 - RNA, 18 nt, Human
aaguauacuguauuuuua

SEQ ID NO: 2252386 - RNA, 12 nt, Human
aaguauacugua

SEQ ID NO: 2252387 - RNA, 15 nt, Human
aaguauacauaaguu

SEQ ID NO: 2252388 - RNA, 20 nt, Human
aaguaguuuguauaacuucu

SEQ ID NO: 2252389 - RNA, 12 nt, Human
aaguaguuugua

SEQ ID NO: 2252390 - RNA, 13 nt, Human
aaguaggaaguaa

SEQ ID NO: 2252391 - RNA, 15 nt, Human
aaguagugugcaguu

SEQ ID NO: 2252392 - RNA, 23 nt, Human
aagugcguguguagaguuaagaa

SEQ ID NO: 2252393 - RNA, 13 nt, Human
aagugcugcauuu

SEQ ID NO: 2252394 - RNA, 14 nt, Human
aagugcugcauuua

SEQ ID NO: 2252395 - RNA, 16 nt, Human
aacaaacucucugaac

SEQ ID NO: 2252396 - RNA, 14 nt, Human
aacaaacuauuucu

SEQ ID NO: 2252397 - RNA, 15 nt, Human
aacaaacuauuucuu

SEQ ID NO: 2252398 - RNA, 22 nt, Human
aacaaaccuguuucugcagcca

SEQ ID NO: 2252399 - RNA, 12 nt, Human
aacaaauaugca

SEQ ID NO: 2252400 - RNA, 13 nt, Human
aacaaauaugcaa

SEQ ID NO: 2252401 - RNA, 13 nt, Human
aacaaaguuacua

SEQ ID NO: 2252402 - RNA, 18 nt, Human
aacaaaggguuuuaaugu

SEQ ID NO: 2252403 - RNA, 23 nt, Human
aacaaaguuacuagguaacuuca

SEQ ID NO: 2252404 - RNA, 16 nt, Human
aacaaagguugagaug

SEQ ID NO: 2252405 - RNA, 21 nt, Human
aacaaauuagguuuuguacaa

SEQ ID NO: 2252406 - RNA, 22 nt, Human
aacacaggcaaaauccuugcuu

SEQ ID NO: 2252407 - RNA, 14 nt, Human
aacaaaugugaagg

SEQ ID NO: 2252408 - RNA, 21 nt, Human
aacacauacaggaagguagaa

SEQ ID NO: 2252409 - RNA, 19 nt, Human
aacacagugccuucaauaa

SEQ ID NO: 2252410 - RNA, 16 nt, Human
aacacaguguuuuugu

SEQ ID NO: 2252411 - RNA, 19 nt, Human
aacaaauuagguuuuguac

SEQ ID NO: 2252412 - RNA, 20 nt, Human
aacaaauuagguuuuguaca

SEQ ID NO: 2252413 - RNA, 19 nt, Human
aacaccucugcacaagcug

SEQ ID NO: 2252414 - RNA, 17 nt, Human
aacacuaacaugauuug

SEQ ID NO: 2252415 - RNA, 23 nt, Human
aacaccucccaggagacaguuca

SEQ ID NO: 2252416 - RNA, 13 nt, Human
aacaccucccagg

SEQ ID NO: 2252417 - RNA, 18 nt, Human
aacacuaacuaugcaugg

SEQ ID NO: 2252418 - RNA, 16 nt, Human
aacaccuccucaugua

SEQ ID NO: 2252419 - RNA, 11 nt, Human
aacacuaaccu

SEQ ID NO: 2252420 - RNA, 18 nt, Human
aacacccucgaagcgcgc

SEQ ID NO: 2252421 - RNA, 19 nt, Human
aacaccuagcuuuauucuu

SEQ ID NO: 2252422 - RNA, 21 nt, Human
aacacccucacacugggacuu

SEQ ID NO: 2252423 - RNA, 16 nt, Human
aacacccuauauuuug

SEQ ID NO: 2252424 - RNA, 17 nt, Human
aacacccucacacuggg

SEQ ID NO: 2252425 - RNA, 22 nt, Human
aacacaguguuuuuguaaagug

SEQ ID NO: 2252426 - RNA, 18 nt, Human
aacacaguguuuuuguaa

SEQ ID NO: 2252427 - RNA, 19 nt, Human
aacacaguguuuuuguaaa

SEQ ID NO: 2252428 - RNA, 20 nt, Human
aacacaguguuuuuguaaag

SEQ ID NO: 2252429 - RNA, 21 nt, Human
aacacaguguuuuuguaaagu

SEQ ID NO: 2252430 - RNA, 12 nt, Human
aacacaucagcu

SEQ ID NO: 2252431 - RNA, 13 nt, Human
aacaaaauuucua

SEQ ID NO: 2252432 - RNA, 15 nt, Human
aacaaaauuucuauu

SEQ ID NO: 2252433 - RNA, 19 nt, Human
aacaaaauuuguuugaaau

SEQ ID NO: 2252434 - RNA, 16 nt, Human
aaauugguucuuuauu

SEQ ID NO: 2252435 - RNA, 22 nt, Human
aaauugguuggagaauuuaggu

SEQ ID NO: 2252436 - RNA, 20 nt, Human
aaauugguaucaagaaaguc

SEQ ID NO: 2252437 - RNA, 18 nt, Human
aaauugaugggauuuggu

SEQ ID NO: 2252438 - RNA, 14 nt, Human
aaauugauguguuu

SEQ ID NO: 2252439 - RNA, 17 nt, Human
aaauugagagaauggaa

SEQ ID NO: 2252440 - RNA, 13 nt, Human
aaauugagagaau

SEQ ID NO: 2252441 - RNA, 15 nt, Human
aaauugacauugcuu

SEQ ID NO: 2252442 - RNA, 22 nt, Human
aaauugacagaucaagcuguga

SEQ ID NO: 2252443 - RNA, 22 nt, Human
aaauugacacuuaaaaaugguu

SEQ ID NO: 2252444 - RNA, 14 nt, Human
aaauuaacuuuuau

SEQ ID NO: 2252445 - RNA, 13 nt, Human
aaauuaacuuuua

SEQ ID NO: 2252446 - RNA, 20 nt, Human
aaauuaaccauagauguaga

SEQ ID NO: 2252447 - RNA, 17 nt, Human
aaauuaacuugaguuuu

SEQ ID NO: 2252448 - RNA, 12 nt, Human
aaauuaacuuuu

SEQ ID NO: 2252449 - RNA, 22 nt, Human
aaauguuuuuuuuuaaagacuu

SEQ ID NO: 2252450 - RNA, 23 nt, Human
aaauguugaauaaaaauauguac

SEQ ID NO: 2252451 - RNA, 21 nt, Human
aaauuaaaaaaaaaaaacuuu

SEQ ID NO: 2252452 - RNA, 19 nt, Human
aaauuaaaaaaaaaaaacu

SEQ ID NO: 2252453 - RNA, 15 nt, Human
aaauguucuuugggg

SEQ ID NO: 2252454 - RNA, 21 nt, Human
aaauguugaaaagucaaacug

SEQ ID NO: 2252455 - RNA, 12 nt, Human
aaauguugaaua

SEQ ID NO: 2252456 - RNA, 15 nt, Human
aaauguugaauaaaa

SEQ ID NO: 2252457 - RNA, 18 nt, Human
aaauguuuuuuuuuaaag

SEQ ID NO: 2252458 - RNA, 21 nt, Human
aaauguuuuuuuuuaaagacu

SEQ ID NO: 2252459 - RNA, 20 nt, Human
aaauguucaucaaugaauga

SEQ ID NO: 2252460 - RNA, 20 nt, Human
aaaugcuagguuaauuccaa

SEQ ID NO: 2252461 - RNA, 18 nt, Human
aaaucuguuugaucccug

SEQ ID NO: 2252462 - RNA, 19 nt, Human
aaaucuguuugaucccugu

SEQ ID NO: 2252463 - RNA, 19 nt, Human
aaaucugugccugagaaca

SEQ ID NO: 2252464 - RNA, 14 nt, Human
aaaucuuaacuuga

SEQ ID NO: 2252465 - RNA, 18 nt, Human
aaaucugcuuuuuaaaga

SEQ ID NO: 2252466 - RNA, 20 nt, Human
aaaucugcuggaguuucaug

SEQ ID NO: 2252467 - RNA, 23 nt, Human
aaaucugcagaaggaaaaaugug

SEQ ID NO: 2252468 - RNA, 18 nt, Human
aaaucugacccagugccc

SEQ ID NO: 2252469 - RNA, 22 nt, Human
aaaucugcuggaguuucaugua

SEQ ID NO: 2252470 - RNA, 19 nt, Human
aaaucugugaugauccuca

SEQ ID NO: 2252471 - RNA, 23 nt, Human
aaaucugugaugauccucauaug

SEQ ID NO: 2252472 - RNA, 17 nt, Human
aaaucugaccaaaacaa

SEQ ID NO: 2252473 - RNA, 14 nt, Human
aaaucugacccagu

SEQ ID NO: 2252474 - RNA, 20 nt, Human
aaaucugacccagugccccc

SEQ ID NO: 2252475 - RNA, 13 nt, Human
aaaucugaagacc

SEQ ID NO: 2252476 - RNA, 11 nt, Human
aaaucugaaga

SEQ ID NO: 2252477 - RNA, 13 nt, Human
aaaucucuaauau

SEQ ID NO: 2252478 - RNA, 15 nt, Human
aaaucucuaauaugg

SEQ ID NO: 2252479 - RNA, 12 nt, Human
aaaucucuaaua

SEQ ID NO: 2252480 - RNA, 22 nt, Human
aaaucuccaaaauaaaacuuuu

SEQ ID NO: 2252481 - RNA, 16 nt, Human
aaauggacacugugcc

SEQ ID NO: 2252482 - RNA, 17 nt, Human
aaaugcugcgcccuucc

SEQ ID NO: 2252483 - RNA, 16 nt, Human
aaaugcugccugccug

SEQ ID NO: 2252484 - RNA, 19 nt, Human
aaauggacauaggacucaa

SEQ ID NO: 2252485 - RNA, 15 nt, Human
aaauggacguguuau

SEQ ID NO: 2252486 - RNA, 17 nt, Human
aaauggacguguuauga

SEQ ID NO: 2252487 - RNA, 15 nt, Human
aaaugcugaacauug

SEQ ID NO: 2252488 - RNA, 12 nt, Human
aaaugcugaaca

SEQ ID NO: 2252489 - RNA, 14 nt, Human
aaaugcuauuuuuu

SEQ ID NO: 2252490 - RNA, 14 nt, Human
aaauggacguguua

SEQ ID NO: 2252491 - RNA, 14 nt, Human
aaaugcugcauuuu

SEQ ID NO: 2252492 - RNA, 13 nt, Human
aaaugcugccugc

SEQ ID NO: 2252493 - RNA, 14 nt, Human
aaaugcugccugcc

SEQ ID NO: 2252494 - RNA, 21 nt, Human
aaccagggagccccuuugaug

SEQ ID NO: 2252495 - RNA, 16 nt, Human
aaccagggagacugca

SEQ ID NO: 2252496 - RNA, 21 nt, Human
aaccagguuuagacaguauga

SEQ ID NO: 2252497 - RNA, 19 nt, Human
aaccagggaagcugucccu

SEQ ID NO: 2252498 - RNA, 18 nt, Human
aaccagggaagcuguccc

SEQ ID NO: 2252499 - RNA, 14 nt, Human
aacauggacuugua

SEQ ID NO: 2252500 - RNA, 15 nt, Human
aacauggaaguacua

SEQ ID NO: 2252501 - RNA, 22 nt, Human
aacauggaacucauuccugccu

SEQ ID NO: 2252502 - RNA, 22 nt, Human
aacaucuguccugugaaagacu

SEQ ID NO: 2252503 - RNA, 16 nt, Human
aacaucugaaagccac

SEQ ID NO: 2252504 - RNA, 15 nt, Human
aacauccuuccuucc

SEQ ID NO: 2252505 - RNA, 21 nt, Human
aacaucugagaaaagcuuuga

SEQ ID NO: 2252506 - RNA, 17 nt, Human
aacaucuagcaaauguu

SEQ ID NO: 2252507 - RNA, 14 nt, Human
aacaucuauucucu

SEQ ID NO: 2252508 - RNA, 22 nt, Human
aacaugcuacacacugcauguu

SEQ ID NO: 2252509 - RNA, 18 nt, Human
aaccaguuucagguguuu

SEQ ID NO: 2252510 - RNA, 15 nt, Human
aaccauaaaaagcug

SEQ ID NO: 2252511 - RNA, 14 nt, Human
aaccaguuauguga

SEQ ID NO: 2252512 - RNA, 13 nt, Human
aaccaguuggcua

SEQ ID NO: 2252513 - RNA, 23 nt, Human
aaccaguuggcuaggggagcagg

SEQ ID NO: 2252514 - RNA, 19 nt, Human
aaccaguguuguggauuua

SEQ ID NO: 2252515 - RNA, 17 nt, Human
aaccaguguuguggauu

SEQ ID NO: 2252516 - RNA, 23 nt, Human
aacccuuaccccuuagccucccu

SEQ ID NO: 2252517 - RNA, 21 nt, Human
aacccuuaccccuuagccucc

SEQ ID NO: 2252518 - RNA, 20 nt, Human
aacccuuccccacugcacac

SEQ ID NO: 2252519 - RNA, 23 nt, Human
aacccuuaggacagggucccugc

SEQ ID NO: 2252520 - RNA, 13 nt, Human
aacccuucagugc

SEQ ID NO: 2252521 - RNA, 22 nt, Human
aacccuguuuuauacuguacuu

SEQ ID NO: 2252522 - RNA, 20 nt, Human
aacccuguuuuauacuguac

SEQ ID NO: 2252523 - RNA, 23 nt, Human
aacccuguuuuauacuguacuua

SEQ ID NO: 2252524 - RNA, 16 nt, Human
aacccuguuuuauacu

SEQ ID NO: 2252525 - RNA, 15 nt, Human
aacccuguuuuauac

SEQ ID NO: 2252526 - RNA, 18 nt, Human
aaccauaaacuucauggu

SEQ ID NO: 2252527 - RNA, 21 nt, Human
aaccauaccuuccuucccugg

SEQ ID NO: 2252528 - RNA, 13 nt, Human
aaccauaaacuuc

SEQ ID NO: 2252529 - RNA, 18 nt, Human
aaccauaacaacuucaua

SEQ ID NO: 2252530 - RNA, 11 nt, Human
aacccuucucc

SEQ ID NO: 2252531 - RNA, 18 nt, Human
aacccuucuccucuugua

SEQ ID NO: 2252532 - RNA, 20 nt, Human
aacccuucuccucuuguaaa

SEQ ID NO: 2252533 - RNA, 21 nt, Human
aacccuucuccucuuguaaau

SEQ ID NO: 2252534 - RNA, 13 nt, Human
aaccgaugcucca

SEQ ID NO: 2252535 - RNA, 22 nt, Human
aaccgagcaaagaucaaaauaa

SEQ ID NO: 2252536 - RNA, 20 nt, Human
aaccgaggggcucaggaaaa

SEQ ID NO: 2252537 - RNA, 21 nt, Human
aaccgaugcuccagccaaccc

SEQ ID NO: 2252538 - RNA, 17 nt, Human
aaccgaugcuccagcca

SEQ ID NO: 2252539 - RNA, 15 nt, Human
aaccgaugcuccagc

SEQ ID NO: 2252540 - RNA, 15 nt, Human
aaccgcaggaagcug

SEQ ID NO: 2252541 - RNA, 14 nt, Human
aaccgcaggaagcu

SEQ ID NO: 2252542 - RNA, 13 nt, Human
aaccgcaggaagc

SEQ ID NO: 2252543 - RNA, 18 nt, Human
aaccgcacucacccaugu

SEQ ID NO: 2252544 - RNA, 21 nt, Human
aaccgcaggaagcugcuccgu

SEQ ID NO: 2252545 - RNA, 21 nt, Human
aaccggauggcggacaccugg

SEQ ID NO: 2252546 - RNA, 14 nt, Human
aaccgcugaauaug

SEQ ID NO: 2252547 - RNA, 14 nt, Human
aacacuauauggca

SEQ ID NO: 2252548 - RNA, 18 nt, Human
aacacuauauggcagugu

SEQ ID NO: 2252549 - RNA, 14 nt, Human
aacacuagccagac

SEQ ID NO: 2252550 - RNA, 20 nt, Human
aacacuauauggcagugucu

SEQ ID NO: 2252551 - RNA, 15 nt, Human
aacacuauaaagguu

SEQ ID NO: 2252552 - RNA, 12 nt, Human
aacaggagaauu

SEQ ID NO: 2252553 - RNA, 21 nt, Human
aacaggagcugggauccuaag

SEQ ID NO: 2252554 - RNA, 14 nt, Human
aacaggaggacaau

SEQ ID NO: 2252555 - RNA, 19 nt, Human
aacaggagcugggauccua

SEQ ID NO: 2252556 - RNA, 17 nt, Human
aacaggagacaggaagg

SEQ ID NO: 2252557 - RNA, 20 nt, Human
aacaggaccacaaaaaugaa

SEQ ID NO: 2252558 - RNA, 20 nt, Human
aacaggaaucaagagcugcc

SEQ ID NO: 2252559 - RNA, 10 nt, Human
aacagcucag

SEQ ID NO: 2252560 - RNA, 14 nt, Human
aacaggaagaucuu

SEQ ID NO: 2252561 - RNA, 22 nt, Human
aacaggaagaucuuaaauuuug

SEQ ID NO: 2252562 - RNA, 10 nt, Human
aacaggaagc

SEQ ID NO: 2252563 - RNA, 19 nt, Human
aacagcuaugggagcccca

SEQ ID NO: 2252564 - RNA, 18 nt, Human
aacagcuaugggagcccc

SEQ ID NO: 2252565 - RNA, 23 nt, Human
aacagcguuuaagacuguaauga

SEQ ID NO: 2252566 - RNA, 22 nt, Human
aacaggaaaggcucgaaauaca

SEQ ID NO: 2252567 - RNA, 22 nt, Human
aacagcuaugggagccccaggg

SEQ ID NO: 2252568 - RNA, 18 nt, Human
aacagcucaagucuuccc

SEQ ID NO: 2252569 - RNA, 19 nt, Human
aacaggauuagacagucaa

SEQ ID NO: 2252570 - RNA, 22 nt, Human
aacaggaggacaauucaugaac

SEQ ID NO: 2252571 - RNA, 15 nt, Human
aacaucccuccuggg

SEQ ID NO: 2252572 - RNA, 16 nt, Human
aacaggauuagacagu

SEQ ID NO: 2252573 - RNA, 16 nt, Human
aacaggaggacaauuc

SEQ ID NO: 2252574 - RNA, 17 nt, Human
aacaggaggacaauuca

SEQ ID NO: 2252575 - RNA, 18 nt, Human
aacaggaggacaauucau

SEQ ID NO: 2252576 - RNA, 19 nt, Human
aacaggaggacaauucaug

SEQ ID NO: 2252577 - RNA, 19 nt, Human
aacauccuucaagaacucu

SEQ ID NO: 2252578 - RNA, 22 nt, Human
aacauccuaucaacaacaaggu

SEQ ID NO: 2252579 - RNA, 22 nt, Human
aacauccuuucuauugaaaaau

SEQ ID NO: 2252580 - RNA, 22 nt, Human
aacauccuacaagacacaguga

SEQ ID NO: 2252581 - RNA, 15 nt, Human
aacauccuacaagac

SEQ ID NO: 2252582 - RNA, 13 nt, Human
aacagcgcugggu

SEQ ID NO: 2252583 - RNA, 21 nt, Human
aacagauuugugaacucagcc

SEQ ID NO: 2252584 - RNA, 22 nt, Human
aacagauuugugaacucagcca

SEQ ID NO: 2252585 - RNA, 23 nt, Human
aacagauuugugaacucagccaa

SEQ ID NO: 2252586 - RNA, 16 nt, Human
aacagauuuugggguu

SEQ ID NO: 2252587 - RNA, 13 nt, Human
aacagauuuuuac

SEQ ID NO: 2252588 - RNA, 14 nt, Human
aacagauuuuuaca

SEQ ID NO: 2252589 - RNA, 17 nt, Human
aacagauuuuuacaaau

SEQ ID NO: 2252590 - RNA, 16 nt, Human
aacagcuaaugggaca

SEQ ID NO: 2252591 - RNA, 20 nt, Human
aacagcggcuggacuuggag

SEQ ID NO: 2252592 - RNA, 14 nt, Human
aacagcguuuaaga

SEQ ID NO: 2252593 - RNA, 13 nt, Human
aacagauuuguga

SEQ ID NO: 2252594 - RNA, 14 nt, Human
aacagauuugugaa

SEQ ID NO: 2252595 - RNA, 15 nt, Human
aacagauuugugaac

SEQ ID NO: 2252596 - RNA, 16 nt, Human
aacagauuugugaacu

SEQ ID NO: 2252597 - RNA, 18 nt, Human
aacagauuugugaacuca

SEQ ID NO: 2252598 - RNA, 18 nt, Human
aacuguucccaccugcug

SEQ ID NO: 2252599 - RNA, 15 nt, Human
aacuguucccaccug

SEQ ID NO: 2252600 - RNA, 13 nt, Human
aacuguucccacc

SEQ ID NO: 2252601 - RNA, 22 nt, Human
aacuguuauuuauaaucacuuu

SEQ ID NO: 2252602 - RNA, 20 nt, Human
aacuguuauuuauaaucacu

SEQ ID NO: 2252603 - RNA, 17 nt, Human
aacuguuauuuauaauc

SEQ ID NO: 2252604 - RNA, 16 nt, Human
aacuguuauuuauaau

SEQ ID NO: 2252605 - RNA, 15 nt, Human
aacuguuauuuauaa

SEQ ID NO: 2252606 - RNA, 22 nt, Human
aacugagcuccucugggcagga

SEQ ID NO: 2252607 - RNA, 19 nt, Human
aacuguguuucaaguucaa

SEQ ID NO: 2252608 - RNA, 22 nt, Human
aacuguguuucaaguucaaucc

SEQ ID NO: 2252609 - RNA, 19 nt, Human
aacuguuaaauugcugugu

SEQ ID NO: 2252610 - RNA, 14 nt, Human
aacuguuaugaaau

SEQ ID NO: 2252611 - RNA, 18 nt, Human
aacugagcuccucugggc

SEQ ID NO: 2252612 - RNA, 14 nt, Human
aacugagcuccucu

SEQ ID NO: 2252613 - RNA, 12 nt, Human
aacugaggaauu

SEQ ID NO: 2252614 - RNA, 21 nt, Human
aacugagcuuggaagcuucug

SEQ ID NO: 2252615 - RNA, 16 nt, Human
aacugaggaauuuucu

SEQ ID NO: 2252616 - RNA, 18 nt, Human
aacugaggaauuucaccu

SEQ ID NO: 2252617 - RNA, 13 nt, Human
aacugaggaauuu

SEQ ID NO: 2252618 - RNA, 17 nt, Human
aacugagcuuggaagcu

SEQ ID NO: 2252619 - RNA, 13 nt, Human
aacugagcuugga

SEQ ID NO: 2252620 - RNA, 23 nt, Human
aacugagaugugaacacaucagc

SEQ ID NO: 2252621 - RNA, 18 nt, Human
aacucaucauaaaauaaa

SEQ ID NO: 2252622 - RNA, 21 nt, Human
aacucaucccuaaugcugcag

SEQ ID NO: 2252623 - RNA, 22 nt, Human
aacucaucccuaaugcugcaga

SEQ ID NO: 2252624 - RNA, 17 nt, Human
aacucaucauaaaauaa

SEQ ID NO: 2252625 - RNA, 16 nt, Human
aacucaucauaaaaua

SEQ ID NO: 2252626 - RNA, 13 nt, Human
aacugaagccaga

SEQ ID NO: 2252627 - RNA, 21 nt, Human
aacugaagcagccucucccca

SEQ ID NO: 2252628 - RNA, 15 nt, Human
aacucaucauaaaau

SEQ ID NO: 2252629 - RNA, 14 nt, Human
aacucaucauaaaa

SEQ ID NO: 2252630 - RNA, 15 nt, Human
aacugaaggagaagg

SEQ ID NO: 2252631 - RNA, 13 nt, Human
aacugaaggagaa

SEQ ID NO: 2252632 - RNA, 14 nt, Human
aacugaagucugaa

SEQ ID NO: 2252633 - RNA, 16 nt, Human
aacugaagucugaaau

SEQ ID NO: 2252634 - RNA, 16 nt, Human
aacugaaguuucacau

SEQ ID NO: 2252635 - RNA, 15 nt, Human
aacugaagucugaaa

SEQ ID NO: 2252636 - RNA, 10 nt, Human
aacugaauaa

SEQ ID NO: 2252637 - RNA, 12 nt, Human
aacugaauaaau

SEQ ID NO: 2252638 - RNA, 22 nt, Human
aacugaauggaagguuuguaua

SEQ ID NO: 2252639 - RNA, 20 nt, Human
aacugaauguuuauuccuug

SEQ ID NO: 2252640 - RNA, 12 nt, Human
aacugaaugaga

SEQ ID NO: 2252641 - RNA, 23 nt, Human
aacugaaugaaacccccacacac

SEQ ID NO: 2252642 - RNA, 18 nt, Human
aacugaaugaaaccccca

SEQ ID NO: 2252643 - RNA, 13 nt, Human
aacgguuaaaacu

SEQ ID NO: 2252644 - RNA, 14 nt, Human
aacgguuaaaacug

SEQ ID NO: 2252645 - RNA, 17 nt, Human
aacgguaaauuucugug

SEQ ID NO: 2252646 - RNA, 12 nt, Human
aacggggagaaa

SEQ ID NO: 2252647 - RNA, 15 nt, Human
aacgggguccuucaa

SEQ ID NO: 2252648 - RNA, 18 nt, Human
aacggggcucuucucauu

SEQ ID NO: 2252649 - RNA, 17 nt, Human
aacgggcugcccugcca

SEQ ID NO: 2252650 - RNA, 16 nt, Human
aacggggcucuucuca

SEQ ID NO: 2252651 - RNA, 17 nt, Human
aacguaaccacggaaaa

SEQ ID NO: 2252652 - RNA, 15 nt, Human
aacucaaaauauuug

SEQ ID NO: 2252653 - RNA, 15 nt, Human
aacguauaaaagccu

SEQ ID NO: 2252654 - RNA, 16 nt, Human
aacgcguguguacacg

SEQ ID NO: 2252655 - RNA, 17 nt, Human
aacgcuaaagagcccuu

SEQ ID NO: 2252656 - RNA, 21 nt, Human
aacgcuaaagagcccuugccu

SEQ ID NO: 2252657 - RNA, 22 nt, Human
aacgcuaaagagcccuugccuc

SEQ ID NO: 2252658 - RNA, 17 nt, Human
aacucaccuaauguuua

SEQ ID NO: 2252659 - RNA, 23 nt, Human
aacucauacugugcuggagccac

SEQ ID NO: 2252660 - RNA, 22 nt, Human
aacucacccccaaggggcaguc

SEQ ID NO: 2252661 - RNA, 14 nt, Human
aacucaccuaacuc

SEQ ID NO: 2252662 - RNA, 18 nt, Human
aacucaccccagccccaa

SEQ ID NO: 2252663 - RNA, 16 nt, Human
aacucaccccagcccc

SEQ ID NO: 2252664 - RNA, 17 nt, Human
aacucaccccagcccca

SEQ ID NO: 2252665 - RNA, 22 nt, Human
aacucaaacugaggaauuucac

SEQ ID NO: 2252666 - RNA, 16 nt, Human
aacucaaaauauuugu

SEQ ID NO: 2252667 - RNA, 18 nt, Human
aacguaugcaugugaaga

SEQ ID NO: 2252668 - RNA, 21 nt, Human
aacguaugcaugugaagaaag

SEQ ID NO: 2252669 - RNA, 17 nt, Human
aacucaaacucuuaaaa

SEQ ID NO: 2252670 - RNA, 23 nt, Human
aacucaaauggggccagauccag

SEQ ID NO: 2252671 - RNA, 22 nt, Human
aacucaaauggggccagaucca

SEQ ID NO: 2252672 - RNA, 21 nt, Human
aacucaaauggggccagaucc

SEQ ID NO: 2252673 - RNA, 18 nt, Human
aacucaaauggggccaga

SEQ ID NO: 2252674 - RNA, 11 nt, Human
aacucaaaugc

SEQ ID NO: 2252675 - RNA, 22 nt, Human
aacucaaaugcuuggcuucuca

SEQ ID NO: 2252676 - RNA, 23 nt, Human
aacgacaaagccaaacucugcca

SEQ ID NO: 2252677 - RNA, 11 nt, Human
aacgaaugaag

SEQ ID NO: 2252678 - RNA, 23 nt, Human
aaccuuuuuuaagauuuuucuca

SEQ ID NO: 2252679 - RNA, 14 nt, Human
aacgacaauagcuu

SEQ ID NO: 2252680 - RNA, 18 nt, Human
aacgacugggcacugcca

SEQ ID NO: 2252681 - RNA, 23 nt, Human
aacgagaggggaagaguguacug

SEQ ID NO: 2252682 - RNA, 12 nt, Human
aacgaggaagcc

SEQ ID NO: 2252683 - RNA, 16 nt, Human
aacgagucaauccccu

SEQ ID NO: 2252684 - RNA, 17 nt, Human
aaccuuuuuuaagauuu

SEQ ID NO: 2252685 - RNA, 18 nt, Human
aaccuuuuuuaagauuuu

SEQ ID NO: 2252686 - RNA, 21 nt, Human
aaccuuuuuuaagauuuuucu

SEQ ID NO: 2252687 - RNA, 22 nt, Human
aaccuuuuuuaagauuuuucuc

SEQ ID NO: 2252688 - RNA, 16 nt, Human
aaacaggagacaggaa

SEQ ID NO: 2252689 - RNA, 17 nt, Human
aaacaggagacaggaag

SEQ ID NO: 2252690 - RNA, 18 nt, Human
aaacaggagacaggaagg

SEQ ID NO: 2252691 - RNA, 12 nt, Human
aaacaggagaga

SEQ ID NO: 2252692 - RNA, 11 nt, Human
aaacaggacca

SEQ ID NO: 2252693 - RNA, 15 nt, Human
aaacagcguuuaaga

SEQ ID NO: 2252694 - RNA, 17 nt, Human
aaacagcuaaugggaca

SEQ ID NO: 2252695 - RNA, 21 nt, Human
aaacaggcaguuggccagaga

SEQ ID NO: 2252696 - RNA, 11 nt, Human
aaacaggcagu

SEQ ID NO: 2252697 - RNA, 19 nt, Human
aaacagggcaucuccagga

SEQ ID NO: 2252698 - RNA, 13 nt, Human
aaacaggcccagc

SEQ ID NO: 2252699 - RNA, 14 nt, Human
aaacaggcccagca

SEQ ID NO: 2252700 - RNA, 15 nt, Human
aaacaggcccagcau

SEQ ID NO: 2252701 - RNA, 17 nt, Human
aaacagggcaucuccag

SEQ ID NO: 2252702 - RNA, 13 nt, Human
aaaauucuuggaa

SEQ ID NO: 2252703 - RNA, 20 nt, Human
aaaauucuguagguucugug

SEQ ID NO: 2252704 - RNA, 21 nt, Human
aaacagcauugcuuucugaaa

SEQ ID NO: 2252705 - RNA, 17 nt, Human
aaacagcauugcuuucu

SEQ ID NO: 2252706 - RNA, 16 nt, Human
aaacagcauugcuuuc

SEQ ID NO: 2252707 - RNA, 14 nt, Human
aaacagcauugcuu

SEQ ID NO: 2252708 - RNA, 14 nt, Human
aaacagcaguguuc

SEQ ID NO: 2252709 - RNA, 15 nt, Human
aaacagccucacaga

SEQ ID NO: 2252710 - RNA, 23 nt, Human
aaacagccgucagccaaauguaa

SEQ ID NO: 2252711 - RNA, 22 nt, Human
aaacagccgucagccaaaugua

SEQ ID NO: 2252712 - RNA, 18 nt, Human
aaacagcauugcuuucug

SEQ ID NO: 2252713 - RNA, 21 nt, Human
aaacagcgcuggguccacccc

SEQ ID NO: 2252714 - RNA, 21 nt, Human
aaaauucgaccugauuuacag

SEQ ID NO: 2252715 - RNA, 23 nt, Human
aaaauucgaccugauuuacaguu

SEQ ID NO: 2252716 - RNA, 20 nt, Human
aaaauucucagucaguaauu

SEQ ID NO: 2252717 - RNA, 16 nt, Human
aaaauucuacuguaug

SEQ ID NO: 2252718 - RNA, 15 nt, Human
aaaauucugaaugua

SEQ ID NO: 2252719 - RNA, 21 nt, Human
aaaauuccaucccaucaucuu

SEQ ID NO: 2252720 - RNA, 14 nt, Human
aaaauuccuauugu

SEQ ID NO: 2252721 - RNA, 17 nt, Human
aaaauuccuauugugau

SEQ ID NO: 2252722 - RNA, 22 nt, Human
aaaauuccuuuguguuucuauu

SEQ ID NO: 2252723 - RNA, 14 nt, Human
aaaauuaacacugc

SEQ ID NO: 2252724 - RNA, 17 nt, Human
aaaauuaaaucaaccuu

SEQ ID NO: 2252725 - RNA, 23 nt, Human
aaaauuaaucugggccagaauuu

SEQ ID NO: 2252726 - RNA, 13 nt, Human
aaaauuaagaaag

SEQ ID NO: 2252727 - RNA, 20 nt, Human
aaaauuaagaaaggauaaag

SEQ ID NO: 2252728 - RNA, 11 nt, Human
aaaauuaaagc

SEQ ID NO: 2252729 - RNA, 19 nt, Human
aaaauccauacauuugugu

SEQ ID NO: 2252730 - RNA, 22 nt, Human
aaaauuaacaugaauauuuagu

SEQ ID NO: 2252731 - RNA, 12 nt, Human
aaaauuaagaaa

SEQ ID NO: 2252732 - RNA, 15 nt, Human
aaaauuagccaagug

SEQ ID NO: 2252733 - RNA, 14 nt, Human
aaaauuagaaauug

SEQ ID NO: 2252734 - RNA, 20 nt, Human
aaaauuagaaauuggcugga

SEQ ID NO: 2252735 - RNA, 18 nt, Human
aaaauuagccgggcgugg

SEQ ID NO: 2252736 - RNA, 19 nt, Human
aaaauuaggauuucaugau

SEQ ID NO: 2252737 - RNA, 19 nt, Human
aaaauuauuucagaaaugu

SEQ ID NO: 2252738 - RNA, 21 nt, Human
aaaauuauuugaaaacauaua

SEQ ID NO: 2252739 - RNA, 14 nt, Human
aaaauuauuucaga

SEQ ID NO: 2252740 - RNA, 23 nt, Human
aaaauuauguuugccacuuugca

SEQ ID NO: 2252741 - RNA, 14 nt, Human
aaaauuauuugcau

SEQ ID NO: 2252742 - RNA, 13 nt, Human
aaaauuauuugca

SEQ ID NO: 2252743 - RNA, 17 nt, Human
aaaauuauuuuaaacaa

SEQ ID NO: 2252744 - RNA, 18 nt, Human
aaaauuauuuuaaacaaa

SEQ ID NO: 2252745 - RNA, 19 nt, Human
aaaauuauuuuaaacaaaa

SEQ ID NO: 2252746 - RNA, 13 nt, Human
aaaauuauuuugg

SEQ ID NO: 2252747 - RNA, 18 nt, Human
aaaauuauagaugggaau

SEQ ID NO: 2252748 - RNA, 22 nt, Human
aaaauuauagaugggaaugaag

SEQ ID NO: 2252749 - RNA, 14 nt, Human
aaaaucagccaauu

SEQ ID NO: 2252750 - RNA, 17 nt, Human
aaaaucagccaauuaug

SEQ ID NO: 2252751 - RNA, 18 nt, Human
aaaaucagccaauuaugu

SEQ ID NO: 2252752 - RNA, 19 nt, Human
aaaaucagccaauuauguu

SEQ ID NO: 2252753 - RNA, 20 nt, Human
aaaaucagccaauuauguua

SEQ ID NO: 2252754 - RNA, 21 nt, Human
aaaaucagccaauuauguuaa

SEQ ID NO: 2252755 - RNA, 19 nt, Human
aaaaucauuuuauauguca

SEQ ID NO: 2252756 - RNA, 20 nt, Human
aaaaucauuuuauaugucaa

SEQ ID NO: 2252757 - RNA, 22 nt, Human
aaaaucauuuuauaugucaaag

SEQ ID NO: 2252758 - RNA, 21 nt, Human
aaaauccacuuuaucuugaau

SEQ ID NO: 2252759 - RNA, 23 nt, Human
aaaauauuuuuuauauauacagu

SEQ ID NO: 2252760 - RNA, 20 nt, Human
aaaauauuuugucuaaaaug

SEQ ID NO: 2252761 - RNA, 20 nt, Human
aaaauauuuuuuauauauac

SEQ ID NO: 2252762 - RNA, 12 nt, Human
aaaauauuuugu

SEQ ID NO: 2252763 - RNA, 16 nt, Human
aaaauauuuugucuaa

SEQ ID NO: 2252764 - RNA, 18 nt, Human
aaaauauuuugucuaaaa

SEQ ID NO: 2252765 - RNA, 14 nt, Human
aaaauaaaaaguua

SEQ ID NO: 2252766 - RNA, 22 nt, Human
aaaauaaaaagugacacagcag

SEQ ID NO: 2252767 - RNA, 13 nt, Human
aaaauaaaaaguu

SEQ ID NO: 2252768 - RNA, 21 nt, Human
aaaauaaaaagcgggcacggg

SEQ ID NO: 2252769 - RNA, 20 nt, Human
aaaauaaaaagaucacuuuc

SEQ ID NO: 2252770 - RNA, 12 nt, Human
aaaauaaaaagu

SEQ ID NO: 2252771 - RNA, 17 nt, Human
aaaauaaaaagugacac

SEQ ID NO: 2252772 - RNA, 21 nt, Human
aaaauaaaaagugacacagca

SEQ ID NO: 2252773 - RNA, 11 nt, Human
aaaauaaaaac

SEQ ID NO: 2252774 - RNA, 17 nt, Human
aaaaguuugccagaagu

SEQ ID NO: 2252775 - RNA, 17 nt, Human
aaaauaaaaaacauaua

SEQ ID NO: 2252776 - RNA, 21 nt, Human
aaaauaaaaaaaagaaaaaag

SEQ ID NO: 2252777 - RNA, 15 nt, Human
aaaauaaaaaacacu

SEQ ID NO: 2252778 - RNA, 16 nt, Human
aaaaguuugccagaag

SEQ ID NO: 2252779 - RNA, 18 nt, Human
aaaaguuucaaugugauu

SEQ ID NO: 2252780 - RNA, 17 nt, Human
aaaaguuuuauuuuucu

SEQ ID NO: 2252781 - RNA, 12 nt, Human
aaaaguuucaau

SEQ ID NO: 2252782 - RNA, 13 nt, Human
aaaaguuucaaug

SEQ ID NO: 2252783 - RNA, 12 nt, Human
aaaaguuuccau

SEQ ID NO: 2252784 - RNA, 18 nt, Human
aaaauaaaaaaaagaaaa

SEQ ID NO: 2252785 - RNA, 17 nt, Human
aaaauaaaaaaaagaaa

SEQ ID NO: 2252786 - RNA, 16 nt, Human
aaaauaaaaaaaagaa

SEQ ID NO: 2252787 - RNA, 15 nt, Human
aaaauaaaaaaaaga

SEQ ID NO: 2252788 - RNA, 16 nt, Human
aaaaguuuacaagugu

SEQ ID NO: 2252789 - RNA, 22 nt, Human
aaaaguuuacaaguguauauca

SEQ ID NO: 2252790 - RNA, 13 nt, Human
aaaccccaucucu

SEQ ID NO: 2252791 - RNA, 17 nt, Human
aaaccccaucucuacaa

SEQ ID NO: 2252792 - RNA, 21 nt, Human
aaacccugucucuacuaaaaa

SEQ ID NO: 2252793 - RNA, 17 nt, Human
aaacccccuuugugcug

SEQ ID NO: 2252794 - RNA, 22 nt, Human
aaacccccacacacacacacau

SEQ ID NO: 2252795 - RNA, 16 nt, Human
aaacccccacacacac

SEQ ID NO: 2252796 - RNA, 15 nt, Human
aaacccccacacaca

SEQ ID NO: 2252797 - RNA, 18 nt, Human
aaacccagcucuggucca

SEQ ID NO: 2252798 - RNA, 17 nt, Human
aaacccaguugccaucu

SEQ ID NO: 2252799 - RNA, 16 nt, Human
aaacccuugaaaagac

SEQ ID NO: 2252800 - RNA, 12 nt, Human
aaacccugucuc

SEQ ID NO: 2252801 - RNA, 14 nt, Human
aaacccuucagugc

SEQ ID NO: 2252802 - RNA, 19 nt, Human
aaacccuugccaugugcua

SEQ ID NO: 2252803 - RNA, 17 nt, Human
aaacucuugaccucagg

SEQ ID NO: 2252804 - RNA, 16 nt, Human
aaacucuuuaacuucu

SEQ ID NO: 2252805 - RNA, 14 nt, Human
aaacucuuuaacuu

SEQ ID NO: 2252806 - RNA, 15 nt, Human
aaaccuaaaaaagau

SEQ ID NO: 2252807 - RNA, 17 nt, Human
aaaccuaaaaaagauau

SEQ ID NO: 2252808 - RNA, 19 nt, Human
aaaccuaaaaaagauauau

SEQ ID NO: 2252809 - RNA, 20 nt, Human
aaaccuaaguccuuuaugug

SEQ ID NO: 2252810 - RNA, 19 nt, Human
aaaccuaaguccuuuaugu

SEQ ID NO: 2252811 - RNA, 17 nt, Human
aaaccucaaaaugucua

SEQ ID NO: 2252812 - RNA, 22 nt, Human
aaaccucaaaaugucuaagaua

SEQ ID NO: 2252813 - RNA, 15 nt, Human
aaagaaaauaugcau

SEQ ID NO: 2252814 - RNA, 17 nt, Human
aaagaaaauaugcaucu

SEQ ID NO: 2252815 - RNA, 14 nt, Human
aaagaaaauaugca

SEQ ID NO: 2252816 - RNA, 13 nt, Human
aaagaaaauaugc

SEQ ID NO: 2252817 - RNA, 18 nt, Human
aaagaaaauucuuggaau

SEQ ID NO: 2252818 - RNA, 20 nt, Human
aaacugauuuuuuuuuccuu

SEQ ID NO: 2252819 - RNA, 19 nt, Human
aaacugaggaauuuucuuu

SEQ ID NO: 2252820 - RNA, 22 nt, Human
aaacugaagcagccucucccca

SEQ ID NO: 2252821 - RNA, 13 nt, Human
aaacucuuuuccc

SEQ ID NO: 2252822 - RNA, 12 nt, Human
aaacugaaaauc

SEQ ID NO: 2252823 - RNA, 13 nt, Human
aaacugaaaaucu

SEQ ID NO: 2252824 - RNA, 18 nt, Human
aaacugaagcagccucuc

SEQ ID NO: 2252825 - RNA, 21 nt, Human
aaacugaagcagccucucccc

SEQ ID NO: 2252826 - RNA, 14 nt, Human
aaacugaaaaucua

SEQ ID NO: 2252827 - RNA, 17 nt, Human
aaacugaaaaucuaaua

SEQ ID NO: 2252828 - RNA, 18 nt, Human
aaacugaaaaucuaauau

SEQ ID NO: 2252829 - RNA, 19 nt, Human
aaacugaaaaucuaauauu

SEQ ID NO: 2252830 - RNA, 13 nt, Human
aaacugauuuuuu

SEQ ID NO: 2252831 - RNA, 19 nt, Human
aaacugauuuuuuuuuccu

SEQ ID NO: 2252832 - RNA, 19 nt, Human
aaagaagacaacauuaaaa

SEQ ID NO: 2252833 - RNA, 17 nt, Human
aaagaagaacuugcaug

SEQ ID NO: 2252834 - RNA, 12 nt, Human
aaagaagacaug

SEQ ID NO: 2252835 - RNA, 14 nt, Human
aaagaagacauguu

SEQ ID NO: 2252836 - RNA, 15 nt, Human
aaagaagacauguuu

SEQ ID NO: 2252837 - RNA, 17 nt, Human
aaagaagaaacgucuau

SEQ ID NO: 2252838 - RNA, 19 nt, Human
aaagaggcugaggcuggca

SEQ ID NO: 2252839 - RNA, 12 nt, Human
aaagaggcugag

SEQ ID NO: 2252840 - RNA, 19 nt, Human
aaagaggcugaggccugga

SEQ ID NO: 2252841 - RNA, 20 nt, Human
aaagaggcugaggccuggac

SEQ ID NO: 2252842 - RNA, 21 nt, Human
aaagaggcugaggccuggacu

SEQ ID NO: 2252843 - RNA, 23 nt, Human
aaagaaacccgacagagggaaga

SEQ ID NO: 2252844 - RNA, 22 nt, Human
aaagaaccaaaaguuuuccuga

SEQ ID NO: 2252845 - RNA, 20 nt, Human
aaagaaacccgacagaggga

SEQ ID NO: 2252846 - RNA, 13 nt, Human
aaagaaacauuug

SEQ ID NO: 2252847 - RNA, 23 nt, Human
aaagaaccaacaaccucaacugc

SEQ ID NO: 2252848 - RNA, 19 nt, Human
aaagauaaucucucagcuu

SEQ ID NO: 2252849 - RNA, 22 nt, Human
aaagauaacaagaucuuucagg

SEQ ID NO: 2252850 - RNA, 21 nt, Human
aaagauacagaacucuuucaa

SEQ ID NO: 2252851 - RNA, 20 nt, Human
aaagauaacaagaucuuuca

SEQ ID NO: 2252852 - RNA, 21 nt, Human
aaagauaaauuauaucaauuu

SEQ ID NO: 2252853 - RNA, 16 nt, Human
aaagauaaauauuaua

SEQ ID NO: 2252854 - RNA, 15 nt, Human
aaagauacaguuacu

SEQ ID NO: 2252855 - RNA, 13 nt, Human
aaagauaaauauu

SEQ ID NO: 2252856 - RNA, 15 nt, Human
aaagauaaauauuau

SEQ ID NO: 2252857 - RNA, 14 nt, Human
aaagauaaauauua

SEQ ID NO: 2252858 - RNA, 15 nt, Human
aaagagggcuuccuc

SEQ ID NO: 2252859 - RNA, 19 nt, Human
aaagagggcuuccucuaga

SEQ ID NO: 2252860 - RNA, 13 nt, Human
aaagaggugugca

SEQ ID NO: 2252861 - RNA, 24 nt, Human
aaagaggugacugggcccugccuc

SEQ ID NO: 2252862 - RNA, 15 nt, Human
aaagugccacucauu

SEQ ID NO: 2252863 - RNA, 23 nt, Human
aaagugcagcuccguuuggcagu

SEQ ID NO: 2252864 - RNA, 15 nt, Human
aaagugauuaaacgu

SEQ ID NO: 2252865 - RNA, 12 nt, Human
aaagugauuucu

SEQ ID NO: 2252866 - RNA, 21 nt, Human
aaagugauaauuucuggaauu

SEQ ID NO: 2252867 - RNA, 23 nt, Human
aaagugaucaauaaaaugugauu

SEQ ID NO: 2252868 - RNA, 10 nt, Human
aaagugauua

SEQ ID NO: 2252869 - RNA, 19 nt, Human
aaagucaugcaaaggcugg

SEQ ID NO: 2252870 - RNA, 12 nt, Human
aaaguauuuucc

SEQ ID NO: 2252871 - RNA, 13 nt, Human
aaaguauuuuccu

SEQ ID NO: 2252872 - RNA, 14 nt, Human
aaaguauuuuccug

SEQ ID NO: 2252873 - RNA, 21 nt, Human
aaaguauuuuccuguaaaaaa

SEQ ID NO: 2252874 - RNA, 13 nt, Human
aaaggcuguggua

SEQ ID NO: 2252875 - RNA, 16 nt, Human
aaagucagguccaauu

SEQ ID NO: 2252876 - RNA, 18 nt, Human
aaagucaaaaggugccug

SEQ ID NO: 2252877 - RNA, 17 nt, Human
aaaguauuuuccuguaa

SEQ ID NO: 2252878 - RNA, 17 nt, Human
aaagucaauguuuucag

SEQ ID NO: 2252879 - RNA, 20 nt, Human
aaagucaaaaggugccugug

SEQ ID NO: 2252880 - RNA, 18 nt, Human
aaagucaauguuuucagu

SEQ ID NO: 2252881 - RNA, 12 nt, Human
aaauaaaacauu

SEQ ID NO: 2252882 - RNA, 23 nt, Human
aaauaaaaauuauuauugauuuu

SEQ ID NO: 2252883 - RNA, 16 nt, Human
aaauaaaaauucugaa

SEQ ID NO: 2252884 - RNA, 18 nt, Human
aaauaaaacauuuucaca

SEQ ID NO: 2252885 - RNA, 13 nt, Human
aaauaaaacauuu

SEQ ID NO: 2252886 - RNA, 15 nt, Human
aaauaaaacauuuua

SEQ ID NO: 2252887 - RNA, 22 nt, Human
aaauaaaacauuuucacacaau

SEQ ID NO: 2252888 - RNA, 14 nt, Human
aaauaaaaccagcu

SEQ ID NO: 2252889 - RNA, 15 nt, Human
aaauaaaaauggaua

SEQ ID NO: 2252890 - RNA, 20 nt, Human
aaauaaaaauauuguguugu

SEQ ID NO: 2252891 - RNA, 14 nt, Human
aaauaaaaccuuuc

SEQ ID NO: 2252892 - RNA, 13 nt, Human
aaauaaaaccuuu

SEQ ID NO: 2252893 - RNA, 12 nt, Human
aaauaaaaccuu

SEQ ID NO: 2252894 - RNA, 11 nt, Human
aaauaaaaccu

SEQ ID NO: 2252895 - RNA, 15 nt, Human
aaauaaaaccuuuca

SEQ ID NO: 2252896 - RNA, 18 nt, Human
aaauaaaauuuguugcau

SEQ ID NO: 2252897 - RNA, 18 nt, Human
aaauaaacaaauaacaau

SEQ ID NO: 2252898 - RNA, 19 nt, Human
aaauaaaauuuguugcaua

SEQ ID NO: 2252899 - RNA, 23 nt, Human
aaauaaaacauuuuaaauggaca

SEQ ID NO: 2252900 - RNA, 13 nt, Human
aaauaaacacugu

SEQ ID NO: 2252901 - RNA, 19 nt, Human
aaauaaaccucaaaauguc

SEQ ID NO: 2252902 - RNA, 12 nt, Human
aaauaaauuguu

SEQ ID NO: 2252903 - RNA, 22 nt, Human
aaauaaauuguauauucacuuu

SEQ ID NO: 2252904 - RNA, 20 nt, Human
aaauaaauuguauauucacu

SEQ ID NO: 2252905 - RNA, 21 nt, Human
aaauaaauuguauauucacuu

SEQ ID NO: 2252906 - RNA, 13 nt, Human
aaauaaauuguuu

SEQ ID NO: 2252907 - RNA, 15 nt, Human
aaauaaauuguuuga

SEQ ID NO: 2252908 - RNA, 11 nt, Human
aaauaaauuau

SEQ ID NO: 2252909 - RNA, 12 nt, Human
aaauaaacacug

SEQ ID NO: 2252910 - RNA, 15 nt, Human
aaauaaauguaucau

SEQ ID NO: 2252911 - RNA, 14 nt, Human
aaauaaauuguaua

SEQ ID NO: 2252912 - RNA, 15 nt, Human
aaauaaauuguauau

SEQ ID NO: 2252913 - RNA, 18 nt, Human
aaauaaauuguauauuca

SEQ ID NO: 2252914 - RNA, 19 nt, Human
aaauaaauuguauauucac

SEQ ID NO: 2252915 - RNA, 13 nt, Human
aaauaaauuguau

SEQ ID NO: 2252916 - RNA, 16 nt, Human
aaauaaauguaucaua

SEQ ID NO: 2252917 - RNA, 21 nt, Human
aaauaaauguaucauagaaau

SEQ ID NO: 2252918 - RNA, 15 nt, Human
aaagccccaugcugg

SEQ ID NO: 2252919 - RNA, 17 nt, Human
aaagcccauucauucca

SEQ ID NO: 2252920 - RNA, 17 nt, Human
aaagccccaugcuggag

SEQ ID NO: 2252921 - RNA, 18 nt, Human
aaagccccaugcuggagc

SEQ ID NO: 2252922 - RNA, 19 nt, Human
aaagccccaugcuggagcc

SEQ ID NO: 2252923 - RNA, 20 nt, Human
aaagccccaugcuggagccu

SEQ ID NO: 2252924 - RNA, 16 nt, Human
aaagcccauucauucc

SEQ ID NO: 2252925 - RNA, 23 nt, Human
aaagcccaagggaucugguccua

SEQ ID NO: 2252926 - RNA, 15 nt, Human
aaagcccagagacag

SEQ ID NO: 2252927 - RNA, 18 nt, Human
aaagcccaagggaucugg

SEQ ID NO: 2252928 - RNA, 16 nt, Human
aaagcccaaccuccug

SEQ ID NO: 2252929 - RNA, 18 nt, Human
aaagcccaaagugguaua

SEQ ID NO: 2252930 - RNA, 15 nt, Human
aaagccaagaggcug

SEQ ID NO: 2252931 - RNA, 21 nt, Human
aaaggcauaagacccuaagcc

SEQ ID NO: 2252932 - RNA, 15 nt, Human
aaaggcauauugcuu

SEQ ID NO: 2252933 - RNA, 17 nt, Human
aaaggcauauugcuuuu

SEQ ID NO: 2252934 - RNA, 21 nt, Human
aaagccccaugcuggagccug

SEQ ID NO: 2252935 - RNA, 19 nt, Human
aaaggcagaagcaacccaa

SEQ ID NO: 2252936 - RNA, 21 nt, Human
aaaggcucagucucaggagca

SEQ ID NO: 2252937 - RNA, 19 nt, Human
aaaggcucagucucaggag

SEQ ID NO: 2252938 - RNA, 21 nt, Human
aaaggcuccaggagcagccac

SEQ ID NO: 2252939 - RNA, 20 nt, Human
aaaggcucugaaagccagcu

SEQ ID NO: 2252940 - RNA, 19 nt, Human
aaaggcucgauuuuguauc

SEQ ID NO: 2252941 - RNA, 23 nt, Human
aaaggcucgauuuuguaucugca

SEQ ID NO: 2252942 - RNA, 17 nt, Human
aaaggccaaaccucugu

SEQ ID NO: 2252943 - RNA, 16 nt, Human
aaaggcucgauuuugu

SEQ ID NO: 2252944 - RNA, 17 nt, Human
aaaggcucgauuuugua

SEQ ID NO: 2252945 - RNA, 18 nt, Human
aaaggcucgauuuuguau

SEQ ID NO: 2252946 - RNA, 22 nt, Human
aaaggcuccaggagcagccaca

SEQ ID NO: 2252947 - RNA, 18 nt, Human
aaaggcauucucugaaga

SEQ ID NO: 2252948 - RNA, 16 nt, Human
aaaggcauucucugaa

SEQ ID NO: 2252949 - RNA, 15 nt, Human
aaaggccaaaccucu

SEQ ID NO: 2252950 - RNA, 14 nt, Human
aaaggccaaaccuc

SEQ ID NO: 2252951 - RNA, 19 nt, Human
aaaggcuagguacacagcu

SEQ ID NO: 2252952 - RNA, 14 nt, Human
aaaggcuccaggag

SEQ ID NO: 2252953 - RNA, 14 nt, Human
aaaggcuaccuuug

SEQ ID NO: 2252954 - RNA, 17 nt, Human
aaaggcuaccuuuguau

SEQ ID NO: 2252955 - RNA, 17 nt, Human
aaagcauuuacuuugaa

SEQ ID NO: 2252956 - RNA, 16 nt, Human
aaagcauuuacuuuga

SEQ ID NO: 2252957 - RNA, 15 nt, Human
aaagcauuuauaaau

SEQ ID NO: 2252958 - RNA, 13 nt, Human
aaagcauuugaau

SEQ ID NO: 2252959 - RNA, 14 nt, Human
aaagcauuugaaug

SEQ ID NO: 2252960 - RNA, 15 nt, Human
aaagcauuugaaugc

SEQ ID NO: 2252961 - RNA, 20 nt, Human
aaagcauuguaaaugugcuu

SEQ ID NO: 2252962 - RNA, 19 nt, Human
aaagcauuguaaaugugcu

SEQ ID NO: 2252963 - RNA, 23 nt, Human
aaagccaacagucaaaacagaga

SEQ ID NO: 2252964 - RNA, 20 nt, Human
aaagccaaaucaaaauaugu

SEQ ID NO: 2252965 - RNA, 17 nt, Human
aaagccaaacucugcca

SEQ ID NO: 2252966 - RNA, 12 nt, Human
aaagcauuuaua

SEQ ID NO: 2252967 - RNA, 15 nt, Human
aaagccaaagcuagg

SEQ ID NO: 2252968 - RNA, 23 nt, Human
aaagcauuugaaugcauuuuguu

SEQ ID NO: 2252969 - RNA, 17 nt, Human
aaagcauuugaaugcau

SEQ ID NO: 2252970 - RNA, 19 nt, Human
aaagcauuugaaugcauuu

SEQ ID NO: 2252971 - RNA, 20 nt, Human
aaagcauuugaaugcauuuu

SEQ ID NO: 2252972 - RNA, 22 nt, Human
aaagcauuugaaugcauuuugu

SEQ ID NO: 2252973 - RNA, 17 nt, Human
agcugaggcaauucuaa

SEQ ID NO: 2252974 - RNA, 15 nt, Human
agcugaggcagcagu

SEQ ID NO: 2252975 - RNA, 17 nt, Human
agcugaggccacacuca

SEQ ID NO: 2252976 - RNA, 13 nt, Human
agcugaggccaca

SEQ ID NO: 2252977 - RNA, 17 nt, Human
agcugaggcagcagugu

SEQ ID NO: 2252978 - RNA, 16 nt, Human
agcugaggcagcagug

SEQ ID NO: 2252979 - RNA, 17 nt, Human
agcugagcgccaggaug

SEQ ID NO: 2252980 - RNA, 15 nt, Human
agcugagcgccagga

SEQ ID NO: 2252981 - RNA, 14 nt, Human
agcugagcgccagg

SEQ ID NO: 2252982 - RNA, 12 nt, Human
agcugagcgcca

SEQ ID NO: 2252983 - RNA, 13 nt, Human
agcugagccucuc

SEQ ID NO: 2252984 - RNA, 14 nt, Human
agcugagccucuca

SEQ ID NO: 2252985 - RNA, 18 nt, Human
agcugaauacauucugcu

SEQ ID NO: 2252986 - RNA, 15 nt, Human
agcugaauacauucu

SEQ ID NO: 2252987 - RNA, 16 nt, Human
agcugaagauuuugga

SEQ ID NO: 2252988 - RNA, 17 nt, Human
agcugaagugcauccaa

SEQ ID NO: 2252989 - RNA, 15 nt, Human
agcugaaccugggua

SEQ ID NO: 2252990 - RNA, 19 nt, Human
agcugaacccauuuugagu

SEQ ID NO: 2252991 - RNA, 22 nt, Human
agcugaacagccaaaugcaugg

SEQ ID NO: 2252992 - RNA, 23 nt, Human
agcugaacaauaggcuguuccca

SEQ ID NO: 2252993 - RNA, 12 nt, Human
agcuccuguggc

SEQ ID NO: 2252994 - RNA, 13 nt, Human
agcuccuguggcc

SEQ ID NO: 2252995 - RNA, 15 nt, Human
agcuccuguccuccc

SEQ ID NO: 2252996 - RNA, 16 nt, Human
agcuccuguccuccca

SEQ ID NO: 2252997 - RNA, 17 nt, Human
agcuccuguccucccau

SEQ ID NO: 2252998 - RNA, 21 nt, Human
agcuccuguccucccaucccc

SEQ ID NO: 2252999 - RNA, 15 nt, Human
agcuccuguggcccc

SEQ ID NO: 2253000 - RNA, 16 nt, Human
agcuccuguggcccca

SEQ ID NO: 2253001 - RNA, 19 nt, Human
agcuccuguggccccaccc

SEQ ID NO: 2253002 - RNA, 22 nt, Human
agcuccuguggccccacccugg

SEQ ID NO: 2253003 - RNA, 19 nt, Human
agcuccccucggagaagag

SEQ ID NO: 2253004 - RNA, 17 nt, Human
agcuccccucggagaag

SEQ ID NO: 2253005 - RNA, 20 nt, Human
agcuccccucggagaagagc

SEQ ID NO: 2253006 - RNA, 19 nt, Human
agcuccccuccucuccccu

SEQ ID NO: 2253007 - RNA, 14 nt, Human
agcuccccuccucu

SEQ ID NO: 2253008 - RNA, 13 nt, Human
agcuccccuccuc

SEQ ID NO: 2253009 - RNA, 16 nt, Human
agcugguugagguuuc

SEQ ID NO: 2253010 - RNA, 21 nt, Human
agcugguuuccucauuccuga

SEQ ID NO: 2253011 - RNA, 15 nt, Human
agcugguuggagagc

SEQ ID NO: 2253012 - RNA, 15 nt, Human
agcugguuuccucau

SEQ ID NO: 2253013 - RNA, 22 nt, Human
agcugguuuuuagcggagacgg

SEQ ID NO: 2253014 - RNA, 18 nt, Human
agcuggucccacucaguc

SEQ ID NO: 2253015 - RNA, 19 nt, Human
agcuggucccacucagucc

SEQ ID NO: 2253016 - RNA, 13 nt, Human
agcugcugacagu

SEQ ID NO: 2253017 - RNA, 14 nt, Human
agcugcugacagug

SEQ ID NO: 2253018 - RNA, 16 nt, Human
agcuggucccacucag

SEQ ID NO: 2253019 - RNA, 17 nt, Human
agcuggucccacucagu

SEQ ID NO: 2253020 - RNA, 12 nt, Human
agcugcugacag

SEQ ID NO: 2253021 - RNA, 15 nt, Human
agcugcgggcugggu

SEQ ID NO: 2253022 - RNA, 19 nt, Human
agcugcgguccacccagga

SEQ ID NO: 2253023 - RNA, 20 nt, Human
agcugcgguccacccaggag

SEQ ID NO: 2253024 - RNA, 13 nt, Human
agcugcgguccac

SEQ ID NO: 2253025 - RNA, 16 nt, Human
agcugcgguccaccca

SEQ ID NO: 2253026 - RNA, 17 nt, Human
agcugcgguccacccag

SEQ ID NO: 2253027 - RNA, 18 nt, Human
agcugcgguccacccagg

SEQ ID NO: 2253028 - RNA, 15 nt, Human
agcucagcccacccc

SEQ ID NO: 2253029 - RNA, 14 nt, Human
agcucagcccaccc

SEQ ID NO: 2253030 - RNA, 11 nt, Human
agcucagccca

SEQ ID NO: 2253031 - RNA, 16 nt, Human
agcucagcauuuccac

SEQ ID NO: 2253032 - RNA, 21 nt, Human
agcucagcccaccccccucau

SEQ ID NO: 2253033 - RNA, 20 nt, Human
agcucagcccaccccccuca

SEQ ID NO: 2253034 - RNA, 19 nt, Human
agcucagcccaccccccuc

SEQ ID NO: 2253035 - RNA, 16 nt, Human
agcucagcccaccccc

SEQ ID NO: 2253036 - RNA, 22 nt, Human
agcucagcccaccccccucauu

SEQ ID NO: 2253037 - RNA, 12 nt, Human
agcucagcgcca

SEQ ID NO: 2253038 - RNA, 21 nt, Human
agcuccccgcuucugccugca

SEQ ID NO: 2253039 - RNA, 20 nt, Human
agcucagacccccacucuca

SEQ ID NO: 2253040 - RNA, 14 nt, Human
agcucagagagggc

SEQ ID NO: 2253041 - RNA, 18 nt, Human
agcucagacccccacucu

SEQ ID NO: 2253042 - RNA, 17 nt, Human
agcucagacccccacuc

SEQ ID NO: 2253043 - RNA, 16 nt, Human
agcucagacccccacu

SEQ ID NO: 2253044 - RNA, 15 nt, Human
agcucagacccccac

SEQ ID NO: 2253045 - RNA, 16 nt, Human
agcucagaauccaagu

SEQ ID NO: 2253046 - RNA, 22 nt, Human
agcucagaauccaagugaacac

SEQ ID NO: 2253047 - RNA, 14 nt, Human
agcucagagagggu

SEQ ID NO: 2253048 - RNA, 18 nt, Human
agcucagagaggguggga

SEQ ID NO: 2253049 - RNA, 22 nt, Human
agcucagaggcgcacugugacc

SEQ ID NO: 2253050 - RNA, 21 nt, Human
agcucagagagggcaggcaug

SEQ ID NO: 2253051 - RNA, 19 nt, Human
agcucagaggcgcacugug

SEQ ID NO: 2253052 - RNA, 16 nt, Human
agcucagagagggcag

SEQ ID NO: 2253053 - RNA, 17 nt, Human
agcucagagagggcagg

SEQ ID NO: 2253054 - RNA, 16 nt, Human
agcucacgucacacuu

SEQ ID NO: 2253055 - RNA, 13 nt, Human
agcucacgucaca

SEQ ID NO: 2253056 - RNA, 22 nt, Human
agcucaccuguugcuuacaauu

SEQ ID NO: 2253057 - RNA, 23 nt, Human
agcucaccuguugcuuacaauuu

SEQ ID NO: 2253058 - RNA, 13 nt, Human
agcucacuacccu

SEQ ID NO: 2253059 - RNA, 13 nt, Human
agcucacuucugg

SEQ ID NO: 2253060 - RNA, 23 nt, Human
agcucacuucugggcuucaucug

SEQ ID NO: 2253061 - RNA, 15 nt, Human
agcucagaaggcucu

SEQ ID NO: 2253062 - RNA, 16 nt, Human
agcucagaaggcucuu

SEQ ID NO: 2253063 - RNA, 19 nt, Human
agcucagaaggcucuucug

SEQ ID NO: 2253064 - RNA, 23 nt, Human
agcucagaaggcucuucugacua

SEQ ID NO: 2253065 - RNA, 12 nt, Human
agcucagagagg

SEQ ID NO: 2253066 - RNA, 19 nt, Human
agcucaccagccccagugc

SEQ ID NO: 2253067 - RNA, 20 nt, Human
agcucaccagccccagugcc

SEQ ID NO: 2253068 - RNA, 12 nt, Human
agcucaccucuc

SEQ ID NO: 2253069 - RNA, 21 nt, Human
agcucacccaauaaacauuaa

SEQ ID NO: 2253070 - RNA, 14 nt, Human
agcucaccccccac

SEQ ID NO: 2253071 - RNA, 15 nt, Human
agcucaccccccaca

SEQ ID NO: 2253072 - RNA, 15 nt, Human
agcucaccucucccu

SEQ ID NO: 2253073 - RNA, 18 nt, Human
agcucaccucucccuugg

SEQ ID NO: 2253074 - RNA, 19 nt, Human
agcucaccucucccuugga

SEQ ID NO: 2253075 - RNA, 17 nt, Human
agcucaccccccacacu

SEQ ID NO: 2253076 - RNA, 21 nt, Human
agcucaccccccacacucacu

SEQ ID NO: 2253077 - RNA, 13 nt, Human
agcucaccccugg

SEQ ID NO: 2253078 - RNA, 16 nt, Human
agcucaccuguugcuu

SEQ ID NO: 2253079 - RNA, 17 nt, Human
agcucaccuguugcuua

SEQ ID NO: 2253080 - RNA, 18 nt, Human
agcucaccuguugcuuac

SEQ ID NO: 2253081 - RNA, 19 nt, Human
agcucaccuguugcuuaca

SEQ ID NO: 2253082 - RNA, 21 nt, Human
agcucaccuguugcuuacaau

SEQ ID NO: 2253083 - RNA, 16 nt, Human
agcucaaaggcacagu

SEQ ID NO: 2253084 - RNA, 15 nt, Human
agcucaaaggcacag

SEQ ID NO: 2253085 - RNA, 13 nt, Human
agcucaaaggcac

SEQ ID NO: 2253086 - RNA, 22 nt, Human
agcucaaagcguggacaggugu

SEQ ID NO: 2253087 - RNA, 22 nt, Human
agcuaauuugcauuaaauucac

SEQ ID NO: 2253088 - RNA, 20 nt, Human
agcuaauuugcauuaaauuc

SEQ ID NO: 2253089 - RNA, 23 nt, Human
agcuaauguaauaacugugaagu

SEQ ID NO: 2253090 - RNA, 19 nt, Human
agcuaauucuuugaccugu

SEQ ID NO: 2253091 - RNA, 14 nt, Human
agcuaauuugcauu

SEQ ID NO: 2253092 - RNA, 13 nt, Human
agcuaauuugcau

SEQ ID NO: 2253093 - RNA, 18 nt, Human
agcucaagucuucccuga

SEQ ID NO: 2253094 - RNA, 20 nt, Human
agcucaagcaggaaguucaa

SEQ ID NO: 2253095 - RNA, 23 nt, Human
agcucaagucuucccugaucaag

SEQ ID NO: 2253096 - RNA, 19 nt, Human
agcucaaggaaaggccuga

SEQ ID NO: 2253097 - RNA, 16 nt, Human
agcucaccagccccag

SEQ ID NO: 2253098 - RNA, 14 nt, Human
agcucaauggacug

SEQ ID NO: 2253099 - RNA, 21 nt, Human
agcguuugaggggcuggccuu

SEQ ID NO: 2253100 - RNA, 14 nt, Human
agcguugcaugucg

SEQ ID NO: 2253101 - RNA, 16 nt, Human
agcuaaaaugauuuua

SEQ ID NO: 2253102 - RNA, 20 nt, Human
agcuaaaaugauuuuaucug

SEQ ID NO: 2253103 - RNA, 15 nt, Human
agcuaaaaugauuuu

SEQ ID NO: 2253104 - RNA, 15 nt, Human
agcuaaaaccugagc

SEQ ID NO: 2253105 - RNA, 21 nt, Human
agcuaaucagcauucucacuc

SEQ ID NO: 2253106 - RNA, 16 nt, Human
agcuaaucagcauucu

SEQ ID NO: 2253107 - RNA, 16 nt, Human
agcgagagucugucuc

SEQ ID NO: 2253108 - RNA, 21 nt, Human
agcgacuccguuggccacucc

SEQ ID NO: 2253109 - RNA, 19 nt, Human
agcgacuccguuggccacu

SEQ ID NO: 2253110 - RNA, 20 nt, Human
agcgacuccguuggccacuc

SEQ ID NO: 2253111 - RNA, 13 nt, Human
agcgagcccuggu

SEQ ID NO: 2253112 - RNA, 19 nt, Human
agcgagcccugguggcagu

SEQ ID NO: 2253113 - RNA, 19 nt, Human
agcgaggaggcuccagagg

SEQ ID NO: 2253114 - RNA, 15 nt, Human
agcgaggaggcucca

SEQ ID NO: 2253115 - RNA, 20 nt, Human
agcgaggagaugcuccuugg

SEQ ID NO: 2253116 - RNA, 18 nt, Human
agcgaugaauuuggagac

SEQ ID NO: 2253117 - RNA, 19 nt, Human
agcgaugaauuuggagacu

SEQ ID NO: 2253118 - RNA, 18 nt, Human
agcgauggucucagaaac

SEQ ID NO: 2253119 - RNA, 16 nt, Human
agcgauguaugcagcu

SEQ ID NO: 2253120 - RNA, 18 nt, Human
agcgauguaugcagcuau

SEQ ID NO: 2253121 - RNA, 19 nt, Human
agcgauuauuaucuaaagu

SEQ ID NO: 2253122 - RNA, 23 nt, Human
agcgauuauuaucuaaagugugu

SEQ ID NO: 2253123 - RNA, 21 nt, Human
agcgaguuguggaaagccucu

SEQ ID NO: 2253124 - RNA, 14 nt, Human
agcgaguuguggaa

SEQ ID NO: 2253125 - RNA, 22 nt, Human
agcgaggucaacagagaaggca

SEQ ID NO: 2253126 - RNA, 19 nt, Human
agcgaggucaacagagaag

SEQ ID NO: 2253127 - RNA, 23 nt, Human
agcgaggucaacagagaaggcag

SEQ ID NO: 2253128 - RNA, 18 nt, Human
agcgaggucaacagagaa

SEQ ID NO: 2253129 - RNA, 21 nt, Human
agcgaccaccccugccuccac

SEQ ID NO: 2253130 - RNA, 14 nt, Human
agcgaccgcccccu

SEQ ID NO: 2253131 - RNA, 15 nt, Human
agcgaccgcccccuc

SEQ ID NO: 2253132 - RNA, 16 nt, Human
agcgaccgcccccucc

SEQ ID NO: 2253133 - RNA, 17 nt, Human
agcgaccgcccccuccu

SEQ ID NO: 2253134 - RNA, 22 nt, Human
agcgaccuuccucauccacccc

SEQ ID NO: 2253135 - RNA, 16 nt, Human
agcgacuccguuggcc

SEQ ID NO: 2253136 - RNA, 17 nt, Human
agcgacuccguuggcca

SEQ ID NO: 2253137 - RNA, 17 nt, Human
agcgacagugagacucu

SEQ ID NO: 2253138 - RNA, 23 nt, Human
agccuuuucccucuuuggcuccc

SEQ ID NO: 2253139 - RNA, 21 nt, Human
agcgacauagcccaucccugc

SEQ ID NO: 2253140 - RNA, 19 nt, Human
agcgacauagcccaucccu

SEQ ID NO: 2253141 - RNA, 17 nt, Human
agcgaccaccccugccu

SEQ ID NO: 2253142 - RNA, 19 nt, Human
agcgaccaccccugccucc

SEQ ID NO: 2253143 - RNA, 20 nt, Human
agcgaccaccccugccucca

SEQ ID NO: 2253144 - RNA, 15 nt, Human
agccuuuggaaacag

SEQ ID NO: 2253145 - RNA, 14 nt, Human
agccuggggcuggc

SEQ ID NO: 2253146 - RNA, 18 nt, Human
agccuuuggaugaccaga

SEQ ID NO: 2253147 - RNA, 20 nt, Human
agccuuuggaugaccagaac

SEQ ID NO: 2253148 - RNA, 18 nt, Human
agccuuugguucuggcca

SEQ ID NO: 2253149 - RNA, 23 nt, Human
agccuuuggcucuggagacagcc

SEQ ID NO: 2253150 - RNA, 16 nt, Human
agccuuuggcucugga

SEQ ID NO: 2253151 - RNA, 17 nt, Human
agccuuuggcucuggag

SEQ ID NO: 2253152 - RNA, 18 nt, Human
agccuuuggcucuggaga

SEQ ID NO: 2253153 - RNA, 21 nt, Human
agccuuuggcucuggagacag

SEQ ID NO: 2253154 - RNA, 18 nt, Human
agccuuuucccucuuugg

SEQ ID NO: 2253155 - RNA, 19 nt, Human
agccuuugguucuggccag

SEQ ID NO: 2253156 - RNA, 14 nt, Human
agccugggcgacag

SEQ ID NO: 2253157 - RNA, 21 nt, Human
agccugggcagccaggcugcc

SEQ ID NO: 2253158 - RNA, 15 nt, Human
agccugggcgacaga

SEQ ID NO: 2253159 - RNA, 20 nt, Human
agccuggcuucuggagcccu

SEQ ID NO: 2253160 - RNA, 19 nt, Human
agccuggcuucuggagccc

SEQ ID NO: 2253161 - RNA, 18 nt, Human
agccuggcuucuggagcc

SEQ ID NO: 2253162 - RNA, 15 nt, Human
agccuggcuucugga

SEQ ID NO: 2253163 - RNA, 23 nt, Human
agccuggcuucuggagcccuugg

SEQ ID NO: 2253164 - RNA, 21 nt, Human
agccuggcuucuggagcccuu

SEQ ID NO: 2253165 - RNA, 20 nt, Human
agccugggcagccaggcugc

SEQ ID NO: 2253166 - RNA, 19 nt, Human
agccugggcagccaggcug

SEQ ID NO: 2253167 - RNA, 12 nt, Human
agccugggaggu

SEQ ID NO: 2253168 - RNA, 14 nt, Human
agccccaugcugga

SEQ ID NO: 2253169 - RNA, 13 nt, Human
agccuggcuccaa

SEQ ID NO: 2253170 - RNA, 20 nt, Human
agccuggcuccaaacccucg

SEQ ID NO: 2253171 - RNA, 22 nt, Human
agcccucccugccccucccuuc

SEQ ID NO: 2253172 - RNA, 23 nt, Human
agcccucccugccccucccuuca

SEQ ID NO: 2253173 - RNA, 15 nt, Human
agcccucccugcccc

SEQ ID NO: 2253174 - RNA, 16 nt, Human
agcccucccugccccu

SEQ ID NO: 2253175 - RNA, 17 nt, Human
agcccucccugccccuc

SEQ ID NO: 2253176 - RNA, 19 nt, Human
agcccucccugccccuccc

SEQ ID NO: 2253177 - RNA, 14 nt, Human
agccuggcuucugg

SEQ ID NO: 2253178 - RNA, 11 nt, Human
agccuggcucu

SEQ ID NO: 2253179 - RNA, 12 nt, Human
agccuggcucuu

SEQ ID NO: 2253180 - RNA, 18 nt, Human
agccuggcuucaaauugu

SEQ ID NO: 2253181 - RNA, 17 nt, Human
agccuggcuucaaauug

SEQ ID NO: 2253182 - RNA, 22 nt, Human
agccuggcuccaaacccucgag

SEQ ID NO: 2253183 - RNA, 20 nt, Human
agccuggcucccacaggcag

SEQ ID NO: 2253184 - RNA, 21 nt, Human
agccuggcucccacaggcagc

SEQ ID NO: 2253185 - RNA, 22 nt, Human
agccuggcucccacaggcagcu

SEQ ID NO: 2253186 - RNA, 23 nt, Human
agccuggcucccacaggcagcuu

SEQ ID NO: 2253187 - RNA, 20 nt, Human
agcuucaccccaaucccagc

SEQ ID NO: 2253188 - RNA, 18 nt, Human
agcuucaccccaauccca

SEQ ID NO: 2253189 - RNA, 18 nt, Human
agcuucacuguaaaauaa

SEQ ID NO: 2253190 - RNA, 21 nt, Human
agcuucaccccaaucccagcu

SEQ ID NO: 2253191 - RNA, 19 nt, Human
agcuucauggcagaaggca

SEQ ID NO: 2253192 - RNA, 18 nt, Human
agcuucauuuccuguguc

SEQ ID NO: 2253193 - RNA, 12 nt, Human
agcuuauuuaau

SEQ ID NO: 2253194 - RNA, 13 nt, Human
agcuucugccacu

SEQ ID NO: 2253195 - RNA, 18 nt, Human
agcuucugaggcgcugcu

SEQ ID NO: 2253196 - RNA, 13 nt, Human
agcuucugcuggg

SEQ ID NO: 2253197 - RNA, 14 nt, Human
agcuucugcugggc

SEQ ID NO: 2253198 - RNA, 15 nt, Human
agcuucugcugggcu

SEQ ID NO: 2253199 - RNA, 16 nt, Human
agcuucugcugggcug

SEQ ID NO: 2253200 - RNA, 17 nt, Human
agcuucugcugggcugg

SEQ ID NO: 2253201 - RNA, 18 nt, Human
agcuucugcugggcuggg

SEQ ID NO: 2253202 - RNA, 19 nt, Human
agcuucugcuuuucugccc

SEQ ID NO: 2253203 - RNA, 23 nt, Human
agcuuuguuuguugucagcugaa

SEQ ID NO: 2253204 - RNA, 16 nt, Human
agcuuuuaaacccuau

SEQ ID NO: 2253205 - RNA, 12 nt, Human
agcuucugcuuu

SEQ ID NO: 2253206 - RNA, 17 nt, Human
agcuucugcuuuucugc

SEQ ID NO: 2253207 - RNA, 14 nt, Human
agcuucucugugaa

SEQ ID NO: 2253208 - RNA, 13 nt, Human
agcuucucuguga

SEQ ID NO: 2253209 - RNA, 21 nt, Human
agcuucuccugugugauugac

SEQ ID NO: 2253210 - RNA, 16 nt, Human
agcuucuccuguguga

SEQ ID NO: 2253211 - RNA, 12 nt, Human
agcuucuccugu

SEQ ID NO: 2253212 - RNA, 23 nt, Human
agcuucuccaggcucuuuggggu

SEQ ID NO: 2253213 - RNA, 14 nt, Human
agcuucuccaggcu

SEQ ID NO: 2253214 - RNA, 15 nt, Human
agcuucuccaggcuc

SEQ ID NO: 2253215 - RNA, 19 nt, Human
agcuucauuuccugugucu

SEQ ID NO: 2253216 - RNA, 12 nt, Human
agcuucuccagg

SEQ ID NO: 2253217 - RNA, 20 nt, Human
agcuucauuugugucaaugg

SEQ ID NO: 2253218 - RNA, 15 nt, Human
agcuucaccagagca

SEQ ID NO: 2253219 - RNA, 13 nt, Human
agcuucauuugug

SEQ ID NO: 2253220 - RNA, 17 nt, Human
agcuucauuugugucaa

SEQ ID NO: 2253221 - RNA, 19 nt, Human
agcuucauuugugucaaug

SEQ ID NO: 2253222 - RNA, 22 nt, Human
agcugguuuccucauuccugaa

SEQ ID NO: 2253223 - RNA, 15 nt, Human
agcuguaaaaagaga

SEQ ID NO: 2253224 - RNA, 19 nt, Human
agcuguaaaaagagagaaa

SEQ ID NO: 2253225 - RNA, 14 nt, Human
agcuguaaaccaga

SEQ ID NO: 2253226 - RNA, 16 nt, Human
agcuguaaaccagaga

SEQ ID NO: 2253227 - RNA, 18 nt, Human
agcuguaagaagagacug

SEQ ID NO: 2253228 - RNA, 17 nt, Human
agcuguaagaagagacu

SEQ ID NO: 2253229 - RNA, 17 nt, Human
agcuguaaaccagagag

SEQ ID NO: 2253230 - RNA, 15 nt, Human
agcuuuuaugugaaa

SEQ ID NO: 2253231 - RNA, 23 nt, Human
aggaaauugagauuagagggagg

SEQ ID NO: 2253232 - RNA, 12 nt, Human
aggaacaaggca

SEQ ID NO: 2253233 - RNA, 13 nt, Human
aggaacaaggcaa

SEQ ID NO: 2253234 - RNA, 16 nt, Human
aggaacaaggcaaggc

SEQ ID NO: 2253235 - RNA, 17 nt, Human
aggaacaaggcaaggcu

SEQ ID NO: 2253236 - RNA, 19 nt, Human
aggaacaaggcaaggcugu

SEQ ID NO: 2253237 - RNA, 19 nt, Human
aggaaccuccuccacacca

SEQ ID NO: 2253238 - RNA, 22 nt, Human
aggaacugcugggcuuggcagc

SEQ ID NO: 2253239 - RNA, 21 nt, Human
aggaacuuaaauaaugugaaa

SEQ ID NO: 2253240 - RNA, 19 nt, Human
aggaacccuuacaguagga

SEQ ID NO: 2253241 - RNA, 20 nt, Human
aggaacaaggcaaggcuguc

SEQ ID NO: 2253242 - RNA, 23 nt, Human
aggaacaaggcaaggcugucaau

SEQ ID NO: 2253243 - RNA, 16 nt, Human
aggaaccauaaucaau

SEQ ID NO: 2253244 - RNA, 17 nt, Human
aggaaccacaccacauc

SEQ ID NO: 2253245 - RNA, 15 nt, Human
aggaaccacaccaca

SEQ ID NO: 2253246 - RNA, 15 nt, Human
aggaaccaaagcgaa

SEQ ID NO: 2253247 - RNA, 13 nt, Human
aggaaccaaagcg

SEQ ID NO: 2253248 - RNA, 21 nt, Human
aggaauaaauaaaaauggaua

SEQ ID NO: 2253249 - RNA, 14 nt, Human
aggaauaaggccuu

SEQ ID NO: 2253250 - RNA, 20 nt, Human
aggaauaaauugcuccuuga

SEQ ID NO: 2253251 - RNA, 19 nt, Human
aggaauaaauaaaaaugga

SEQ ID NO: 2253252 - RNA, 13 nt, Human
aggaauaaauaaa

SEQ ID NO: 2253253 - RNA, 19 nt, Human
aggaauaaauugcuccuug

SEQ ID NO: 2253254 - RNA, 17 nt, Human
aggaaguguaacagcug

SEQ ID NO: 2253255 - RNA, 18 nt, Human
aggaaguguaacagcuga

SEQ ID NO: 2253256 - RNA, 16 nt, Human
aggaaguguaacagcu

SEQ ID NO: 2253257 - RNA, 14 nt, Human
aggaagugaagaau

SEQ ID NO: 2253258 - RNA, 22 nt, Human
aggaauaccugucccccugaca

SEQ ID NO: 2253259 - RNA, 18 nt, Human
aggaauaauuauuuauuu

SEQ ID NO: 2253260 - RNA, 22 nt, Human
aggaauaauuauuuauuuaaua

SEQ ID NO: 2253261 - RNA, 15 nt, Human
aggaauaaugggcuu

SEQ ID NO: 2253262 - RNA, 23 nt, Human
aggaauaaugggcuuagagcagu

SEQ ID NO: 2253263 - RNA, 16 nt, Human
aggaauaauuauuuau

SEQ ID NO: 2253264 - RNA, 17 nt, Human
aggaauaauuauuuauu

SEQ ID NO: 2253265 - RNA, 15 nt, Human
aggaauaccuguccc

SEQ ID NO: 2253266 - RNA, 18 nt, Human
aggaauaccugucccccu

SEQ ID NO: 2253267 - RNA, 15 nt, Human
aggaaggcugagagg

SEQ ID NO: 2253268 - RNA, 22 nt, Human
aggaaggcugagaggagagaga

SEQ ID NO: 2253269 - RNA, 15 nt, Human
aggaacuguccagag

SEQ ID NO: 2253270 - RNA, 16 nt, Human
aggaacuguccagaga

SEQ ID NO: 2253271 - RNA, 17 nt, Human
aggaacuguccagagag

SEQ ID NO: 2253272 - RNA, 17 nt, Human
aggaagggcaggaagga

SEQ ID NO: 2253273 - RNA, 12 nt, Human
aggaagggcaaa

SEQ ID NO: 2253274 - RNA, 16 nt, Human
aggaagggaccaaggc

SEQ ID NO: 2253275 - RNA, 17 nt, Human
aggaagggaccaaggca

SEQ ID NO: 2253276 - RNA, 23 nt, Human
aggaagggaccaaggcaaggcag

SEQ ID NO: 2253277 - RNA, 20 nt, Human
aggaacuguccagagagcaa

SEQ ID NO: 2253278 - RNA, 18 nt, Human
aggaacuguccagagagc

SEQ ID NO: 2253279 - RNA, 19 nt, Human
aggaacuguccagagagca

SEQ ID NO: 2253280 - RNA, 17 nt, Human
aggaagugaaaauaggu

SEQ ID NO: 2253281 - RNA, 18 nt, Human
aggaagucuaggagcugg

SEQ ID NO: 2253282 - RNA, 17 nt, Human
aggaagucuaggagcug

SEQ ID NO: 2253283 - RNA, 14 nt, Human
aggaaguaggaagu

SEQ ID NO: 2253284 - RNA, 18 nt, Human
aggaagucaaagcaagga

SEQ ID NO: 2253285 - RNA, 15 nt, Human
aggaaguaggaagua

SEQ ID NO: 2253286 - RNA, 20 nt, Human
aggaaggggccagaggcucg

SEQ ID NO: 2253287 - RNA, 18 nt, Human
aggaaggggccagaggcu

SEQ ID NO: 2253288 - RNA, 16 nt, Human
aggaaggggccagagg

SEQ ID NO: 2253289 - RNA, 18 nt, Human
aggaagggcauccuucug

SEQ ID NO: 2253290 - RNA, 20 nt, Human
aggaagggcauccuucugcc

SEQ ID NO: 2253291 - RNA, 16 nt, Human
aggaccuguggccaag

SEQ ID NO: 2253292 - RNA, 17 nt, Human
aggaccuggcugccaua

SEQ ID NO: 2253293 - RNA, 12 nt, Human
aggagagaagaa

SEQ ID NO: 2253294 - RNA, 13 nt, Human
aggagagaagaau

SEQ ID NO: 2253295 - RNA, 14 nt, Human
aggagagaagaaug

SEQ ID NO: 2253296 - RNA, 14 nt, Human
aggaccugccugua

SEQ ID NO: 2253297 - RNA, 13 nt, Human
aggaccugccugu

SEQ ID NO: 2253298 - RNA, 16 nt, Human
aggaccuggcugccau

SEQ ID NO: 2253299 - RNA, 13 nt, Human
aggaccuggcugc

SEQ ID NO: 2253300 - RNA, 19 nt, Human
aggaccugggaccuccccu

SEQ ID NO: 2253301 - RNA, 17 nt, Human
aggagagagcagcuucu

SEQ ID NO: 2253302 - RNA, 21 nt, Human
aggagagagaaagccaggcag

SEQ ID NO: 2253303 - RNA, 22 nt, Human
aggagagagaaagccaggcagg

SEQ ID NO: 2253304 - RNA, 12 nt, Human
aggagagagaaa

SEQ ID NO: 2253305 - RNA, 14 nt, Human
aggagagagaaagc

SEQ ID NO: 2253306 - RNA, 18 nt, Human
aggagagagaaagccagg

SEQ ID NO: 2253307 - RNA, 19 nt, Human
aggagagagaaagccaggc

SEQ ID NO: 2253308 - RNA, 21 nt, Human
aggagagaaggggaggagggc

SEQ ID NO: 2253309 - RNA, 11 nt, Human
aggagagagaa

SEQ ID NO: 2253310 - RNA, 17 nt, Human
aggagagaaggggagga

SEQ ID NO: 2253311 - RNA, 15 nt, Human
aggagagaagaauga

SEQ ID NO: 2253312 - RNA, 11 nt, Human
aggagagaccg

SEQ ID NO: 2253313 - RNA, 15 nt, Human
aggagaggagagggg

SEQ ID NO: 2253314 - RNA, 20 nt, Human
aggagagagcagcuucugcc

SEQ ID NO: 2253315 - RNA, 10 nt, Human
aggagagagg

SEQ ID NO: 2253316 - RNA, 13 nt, Human
aggagagaggcag

SEQ ID NO: 2253317 - RNA, 14 nt, Human
aggagagaggcaga

SEQ ID NO: 2253318 - RNA, 18 nt, Human
aggagagaggcagagagc

SEQ ID NO: 2253319 - RNA, 13 nt, Human
aggagaggaugag

SEQ ID NO: 2253320 - RNA, 15 nt, Human
aggagaggaugagag

SEQ ID NO: 2253321 - RNA, 17 nt, Human
aggagaggaugagagcc

SEQ ID NO: 2253322 - RNA, 19 nt, Human
aggacccugaaggggccau

SEQ ID NO: 2253323 - RNA, 15 nt, Human
aggacccugaagggg

SEQ ID NO: 2253324 - RNA, 21 nt, Human
aggacccggaggggccuggca

SEQ ID NO: 2253325 - RNA, 22 nt, Human
aggacccggaggggccuggcag

SEQ ID NO: 2253326 - RNA, 21 nt, Human
aggaccaggacucccuccuca

SEQ ID NO: 2253327 - RNA, 19 nt, Human
aggaccaggacucccuccu

SEQ ID NO: 2253328 - RNA, 23 nt, Human
aggaccaggacuauagcccaggu

SEQ ID NO: 2253329 - RNA, 13 nt, Human
aggaccaggcaau

SEQ ID NO: 2253330 - RNA, 18 nt, Human
aggaccagggcagggcca

SEQ ID NO: 2253331 - RNA, 18 nt, Human
aggaccaggacucccucc

SEQ ID NO: 2253332 - RNA, 17 nt, Human
aggaccaggacucccuc

SEQ ID NO: 2253333 - RNA, 16 nt, Human
aggaccaggacucccu

SEQ ID NO: 2253334 - RNA, 13 nt, Human
aggaccaggacuc

SEQ ID NO: 2253335 - RNA, 18 nt, Human
aggacccggaggggccug

SEQ ID NO: 2253336 - RNA, 20 nt, Human
aggacccggaggggccuggc

SEQ ID NO: 2253337 - RNA, 19 nt, Human
aggaccagucaaccugggc

SEQ ID NO: 2253338 - RNA, 20 nt, Human
aggaccagucaaccugggca

SEQ ID NO: 2253339 - RNA, 12 nt, Human
aggaccaggacu

SEQ ID NO: 2253340 - RNA, 19 nt, Human
aggaccagcuggggcgugg

SEQ ID NO: 2253341 - RNA, 22 nt, Human
aggaccaggacuauagcccagg

SEQ ID NO: 2253342 - RNA, 13 nt, Human
aggaccagcuggg

SEQ ID NO: 2253343 - RNA, 14 nt, Human
aggaccagcugggg

SEQ ID NO: 2253344 - RNA, 15 nt, Human
aggaccagcuggggc

SEQ ID NO: 2253345 - RNA, 24 nt, Human
aggaccagcucaggacagaugcca

SEQ ID NO: 2253346 - RNA, 15 nt, Human
aggaaucagacuuca

SEQ ID NO: 2253347 - RNA, 22 nt, Human
aggaaucagcaagaagauccua

SEQ ID NO: 2253348 - RNA, 21 nt, Human
aggaaucaugucaggccugug

SEQ ID NO: 2253349 - RNA, 22 nt, Human
aggaaucaugucaggccugugu

SEQ ID NO: 2253350 - RNA, 23 nt, Human
aggaaucaugucaggccugugug

SEQ ID NO: 2253351 - RNA, 16 nt, Human
aggaaucaagagcugc

SEQ ID NO: 2253352 - RNA, 20 nt, Human
aggaauauuuuccaaagagu

SEQ ID NO: 2253353 - RNA, 15 nt, Human
aggaauauuuuccaa

SEQ ID NO: 2253354 - RNA, 16 nt, Human
aggaauauuuuccaaa

SEQ ID NO: 2253355 - RNA, 17 nt, Human
aggaaucaagagcugcc

SEQ ID NO: 2253356 - RNA, 19 nt, Human
aggaaucaagagcugcccu

SEQ ID NO: 2253357 - RNA, 20 nt, Human
aggaaucaagagcugcccuc

SEQ ID NO: 2253358 - RNA, 15 nt, Human
aggaaucacucuugu

SEQ ID NO: 2253359 - RNA, 21 nt, Human
aggaaucaagagcugcccucc

SEQ ID NO: 2253360 - RNA, 16 nt, Human
aggaaucacucuugug

SEQ ID NO: 2253361 - RNA, 18 nt, Human
aggaaucacucuugugga

SEQ ID NO: 2253362 - RNA, 20 nt, Human
aggaauaugacggaagaaca

SEQ ID NO: 2253363 - RNA, 12 nt, Human
aggaauauaugg

SEQ ID NO: 2253364 - RNA, 17 nt, Human
aggaauauauggcagag

SEQ ID NO: 2253365 - RNA, 17 nt, Human
aggaauaguugagcccc

SEQ ID NO: 2253366 - RNA, 21 nt, Human
aggaauaguugagccccaagu

SEQ ID NO: 2253367 - RNA, 22 nt, Human
aggaauaugacggaagaacaua

SEQ ID NO: 2253368 - RNA, 23 nt, Human
aggaauauauggcagaguuguaa

SEQ ID NO: 2253369 - RNA, 18 nt, Human
aggaauaugggagaaaua

SEQ ID NO: 2253370 - RNA, 19 nt, Human
agggucagacgccugagga

SEQ ID NO: 2253371 - RNA, 20 nt, Human
agggucaacaucuuuuacau

SEQ ID NO: 2253372 - RNA, 21 nt, Human
aggguauggacuaucugucug

SEQ ID NO: 2253373 - RNA, 22 nt, Human
aggggccuggagauccuccugc

SEQ ID NO: 2253374 - RNA, 12 nt, Human
agggucccuggu

SEQ ID NO: 2253375 - RNA, 14 nt, Human
agggucccuggugg

SEQ ID NO: 2253376 - RNA, 13 nt, Human
aggguauuccaga

SEQ ID NO: 2253377 - RNA, 21 nt, Human
aggguaucuggugacuuuccu

SEQ ID NO: 2253378 - RNA, 13 nt, Human
aggggccuggcag

SEQ ID NO: 2253379 - RNA, 12 nt, Human
aggggccuggca

SEQ ID NO: 2253380 - RNA, 18 nt, Human
aggggccuggagauccuc

SEQ ID NO: 2253381 - RNA, 21 nt, Human
aggggccuggagauccuccug

SEQ ID NO: 2253382 - RNA, 16 nt, Human
aggguccuggcuccug

SEQ ID NO: 2253383 - RNA, 22 nt, Human
aggguccuucccucuccccaag

SEQ ID NO: 2253384 - RNA, 18 nt, Human
aggguccuuuaguaccug

SEQ ID NO: 2253385 - RNA, 14 nt, Human
aggguccuggcucc

SEQ ID NO: 2253386 - RNA, 15 nt, Human
aggguccuccacaau

SEQ ID NO: 2253387 - RNA, 22 nt, Human
agggucggaacccaagcuuaga

SEQ ID NO: 2253388 - RNA, 23 nt, Human
agggucggggaggaaauaccaaa

SEQ ID NO: 2253389 - RNA, 17 nt, Human
agggucggaacccaagc

SEQ ID NO: 2253390 - RNA, 20 nt, Human
aggguccuuuaguaccugaa

SEQ ID NO: 2253391 - RNA, 16 nt, Human
agggucccugguggca

SEQ ID NO: 2253392 - RNA, 17 nt, Human
agggucccugguggcag

SEQ ID NO: 2253393 - RNA, 20 nt, Human
agggucccugguggcagcuc

SEQ ID NO: 2253394 - RNA, 22 nt, Human
agggucccugguggcagcucac

SEQ ID NO: 2253395 - RNA, 20 nt, Human
agggcgaacgacaauagcuu

SEQ ID NO: 2253396 - RNA, 23 nt, Human
agggccuugcccagagaugccuc

SEQ ID NO: 2253397 - RNA, 21 nt, Human
agggcgaccccgucacagccu

SEQ ID NO: 2253398 - RNA, 13 nt, Human
agggcgagacucc

SEQ ID NO: 2253399 - RNA, 19 nt, Human
agggccuugcccagagaug

SEQ ID NO: 2253400 - RNA, 18 nt, Human
agggccuugcccagagau

SEQ ID NO: 2253401 - RNA, 15 nt, Human
aggggcagcuucuau

SEQ ID NO: 2253402 - RNA, 13 nt, Human
agggcgaggggag

SEQ ID NO: 2253403 - RNA, 23 nt, Human
agggcgaggggaggguggcaggu

SEQ ID NO: 2253404 - RNA, 18 nt, Human
aggggcaggaggaagggg

SEQ ID NO: 2253405 - RNA, 13 nt, Human
aggggcaggcaca

SEQ ID NO: 2253406 - RNA, 14 nt, Human
aggggcaggcacag

SEQ ID NO: 2253407 - RNA, 16 nt, Human
aggggcaggcacagca

SEQ ID NO: 2253408 - RNA, 17 nt, Human
aggggcaggcacagcac

SEQ ID NO: 2253409 - RNA, 13 nt, Human
aggggcaggagga

SEQ ID NO: 2253410 - RNA, 12 nt, Human
aggggcaggagg

SEQ ID NO: 2253411 - RNA, 17 nt, Human
agggccuugcccagaga

SEQ ID NO: 2253412 - RNA, 16 nt, Human
agggccuugcccagag

SEQ ID NO: 2253413 - RNA, 15 nt, Human
agggccuugcccaga

SEQ ID NO: 2253414 - RNA, 14 nt, Human
agggccuugcccag

SEQ ID NO: 2253415 - RNA, 12 nt, Human
agggccuugccc

SEQ ID NO: 2253416 - RNA, 18 nt, Human
agggccugugggagccug

SEQ ID NO: 2253417 - RNA, 19 nt, Human
agggccugugggagccugc

SEQ ID NO: 2253418 - RNA, 17 nt, Human
agggccuggucccuggg

SEQ ID NO: 2253419 - RNA, 12 nt, Human
agggccuguggg

SEQ ID NO: 2253420 - RNA, 21 nt, Human
agggccuggucccugggagga

SEQ ID NO: 2253421 - RNA, 22 nt, Human
agggccuggguuuucauguuuu

SEQ ID NO: 2253422 - RNA, 14 nt, Human
agggccuggccuga

SEQ ID NO: 2253423 - RNA, 19 nt, Human
agggccuggaagacagaga

SEQ ID NO: 2253424 - RNA, 21 nt, Human
aggggcccgagcagaagcagg

SEQ ID NO: 2253425 - RNA, 21 nt, Human
aggggccccugcuucuccagc

SEQ ID NO: 2253426 - RNA, 16 nt, Human
aggggccccugcuucu

SEQ ID NO: 2253427 - RNA, 20 nt, Human
aggggccccugcuucuccag

SEQ ID NO: 2253428 - RNA, 13 nt, Human
aggggccccugcu

SEQ ID NO: 2253429 - RNA, 17 nt, Human
aggggccccguguccug

SEQ ID NO: 2253430 - RNA, 18 nt, Human
aggggccccguguccugc

SEQ ID NO: 2253431 - RNA, 20 nt, Human
aggggccccguguccugccu

SEQ ID NO: 2253432 - RNA, 16 nt, Human
aggggccccuccagcu

SEQ ID NO: 2253433 - RNA, 13 nt, Human
aggggccuggaga

SEQ ID NO: 2253434 - RNA, 14 nt, Human
aggggccuggagau

SEQ ID NO: 2253435 - RNA, 15 nt, Human
aggggcccgcuugcc

SEQ ID NO: 2253436 - RNA, 16 nt, Human
aggggcagucuggagg

SEQ ID NO: 2253437 - RNA, 15 nt, Human
aggggcagucuggag

SEQ ID NO: 2253438 - RNA, 13 nt, Human
aggggcaggcuga

SEQ ID NO: 2253439 - RNA, 23 nt, Human
aggggcagguaaacuccuguccu

SEQ ID NO: 2253440 - RNA, 15 nt, Human
aggggcaggcccugc

SEQ ID NO: 2253441 - RNA, 19 nt, Human
aggggcaggcccugcacug

SEQ ID NO: 2253442 - RNA, 23 nt, Human
aggggcaggcccugcacuguccu

SEQ ID NO: 2253443 - RNA, 12 nt, Human
aggggcaggcug

SEQ ID NO: 2253444 - RNA, 14 nt, Human
aggggcaucugccc

SEQ ID NO: 2253445 - RNA, 18 nt, Human
aggggcagucuggagggg

SEQ ID NO: 2253446 - RNA, 17 nt, Human
aggggcagucuggaggg

SEQ ID NO: 2253447 - RNA, 15 nt, Human
aggggcaucugcccc

SEQ ID NO: 2253448 - RNA, 20 nt, Human
aggggcagucuggaggggca

SEQ ID NO: 2253449 - RNA, 22 nt, Human
aggggcccaaauucuuucagug

SEQ ID NO: 2253450 - RNA, 19 nt, Human
aggggcccaguccuggccu

SEQ ID NO: 2253451 - RNA, 19 nt, Human
aggggcccacagggaaccc

SEQ ID NO: 2253452 - RNA, 21 nt, Human
aggggcccacagggaacccug

SEQ ID NO: 2253453 - RNA, 17 nt, Human
aggggcccaaggcggcc

SEQ ID NO: 2253454 - RNA, 20 nt, Human
aggggcccaaggcggccccu

SEQ ID NO: 2253455 - RNA, 22 nt, Human
aggggcccaaggcggccccucc

SEQ ID NO: 2253456 - RNA, 14 nt, Human
aggggcccacaggg

SEQ ID NO: 2253457 - RNA, 23 nt, Human
agggccugcaggaccugccugua

SEQ ID NO: 2253458 - RNA, 22 nt, Human
agggccugcaggaccugccugu

SEQ ID NO: 2253459 - RNA, 20 nt, Human
agggccugcaggaccugccu

SEQ ID NO: 2253460 - RNA, 15 nt, Human
agggccugcaaggga

SEQ ID NO: 2253461 - RNA, 12 nt, Human
agggccuggccu

SEQ ID NO: 2253462 - RNA, 13 nt, Human
agggccuggccug

SEQ ID NO: 2253463 - RNA, 14 nt, Human
agggccugcaaggg

SEQ ID NO: 2253464 - RNA, 22 nt, Human
agggccugagccuggccagccu

SEQ ID NO: 2253465 - RNA, 14 nt, Human
agggcaagggccau

SEQ ID NO: 2253466 - RNA, 16 nt, Human
agggccugaggucugg

SEQ ID NO: 2253467 - RNA, 21 nt, Human
agggccugaggucuggcugcu

SEQ ID NO: 2253468 - RNA, 22 nt, Human
agggccugaggucuggcugcuu

SEQ ID NO: 2253469 - RNA, 20 nt, Human
agggccugagccuggccagc

SEQ ID NO: 2253470 - RNA, 22 nt, Human
agggcaagggccaugcugaagg

SEQ ID NO: 2253471 - RNA, 18 nt, Human
agggccugagccuggcca

SEQ ID NO: 2253472 - RNA, 13 nt, Human
agggcaagggcca

SEQ ID NO: 2253473 - RNA, 22 nt, Human
agggcaacaauacaugcugcua

SEQ ID NO: 2253474 - RNA, 20 nt, Human
agggcaacaauaaaauagca

SEQ ID NO: 2253475 - RNA, 15 nt, Human
agggauuagggagag

SEQ ID NO: 2253476 - RNA, 20 nt, Human
agggauuagggagagaagau

SEQ ID NO: 2253477 - RNA, 19 nt, Human
agggauuacccaagcaaaa

SEQ ID NO: 2253478 - RNA, 19 nt, Human
agggauuuuagucacacgu

SEQ ID NO: 2253479 - RNA, 19 nt, Human
agggauuaaccucugcacu

SEQ ID NO: 2253480 - RNA, 17 nt, Human
agggauuacccaagcaa

SEQ ID NO: 2253481 - RNA, 18 nt, Human
agggauuacccaagcaaa

SEQ ID NO: 2253482 - RNA, 22 nt, Human
agggaucacagggccccagaag

SEQ ID NO: 2253483 - RNA, 17 nt, Human
agggaucacagggcccc

SEQ ID NO: 2253484 - RNA, 15 nt, Human
agggaucccucaucu

SEQ ID NO: 2253485 - RNA, 15 nt, Human
agggaucacagggcc

SEQ ID NO: 2253486 - RNA, 14 nt, Human
agggaucacagggc

SEQ ID NO: 2253487 - RNA, 13 nt, Human
agggaucacaggg

SEQ ID NO: 2253488 - RNA, 22 nt, Human
agggaucaaccagcuaagaaaa

SEQ ID NO: 2253489 - RNA, 22 nt, Human
agggaucccucaucugucccuc

SEQ ID NO: 2253490 - RNA, 14 nt, Human
agggaugguguuca

SEQ ID NO: 2253491 - RNA, 19 nt, Human
agggaucccucaucugucc

SEQ ID NO: 2253492 - RNA, 16 nt, Human
agggaucccucaucug

SEQ ID NO: 2253493 - RNA, 18 nt, Human
agggauguucuggcccuc

SEQ ID NO: 2253494 - RNA, 17 nt, Human
agggauuaaccucugca

SEQ ID NO: 2253495 - RNA, 18 nt, Human
agggauuaaccucugcac

SEQ ID NO: 2253496 - RNA, 22 nt, Human
agggaugugaauugccugcaga

SEQ ID NO: 2253497 - RNA, 23 nt, Human
agggaugugaauugccugcagag

SEQ ID NO: 2253498 - RNA, 16 nt, Human
agggaugguguucaaa

SEQ ID NO: 2253499 - RNA, 12 nt, Human
agggacuuaaaa

SEQ ID NO: 2253500 - RNA, 17 nt, Human
agggacuuaaaaaacuu

SEQ ID NO: 2253501 - RNA, 13 nt, Human
agggacuuaaaaa

SEQ ID NO: 2253502 - RNA, 21 nt, Human
aggcguccgcgcgccagcaca

SEQ ID NO: 2253503 - RNA, 22 nt, Human
agggauagcacugagcaaagca

SEQ ID NO: 2253504 - RNA, 16 nt, Human
agggauagaggggggc

SEQ ID NO: 2253505 - RNA, 13 nt, Human
agggauagagggg

SEQ ID NO: 2253506 - RNA, 18 nt, Human
agggauauauaagaugga

SEQ ID NO: 2253507 - RNA, 17 nt, Human
agggauagcacugagca

SEQ ID NO: 2253508 - RNA, 21 nt, Human
agggaucaaccagcuaagaaa

SEQ ID NO: 2253509 - RNA, 16 nt, Human
agggauacccauccca

SEQ ID NO: 2253510 - RNA, 22 nt, Human
aggucucaacccuuuugucugc

SEQ ID NO: 2253511 - RNA, 13 nt, Human
aggucucacgggc

SEQ ID NO: 2253512 - RNA, 17 nt, Human
aggucucccacguggga

SEQ ID NO: 2253513 - RNA, 12 nt, Human
aggucuccucca

SEQ ID NO: 2253514 - RNA, 13 nt, Human
aggucuccuccac

SEQ ID NO: 2253515 - RNA, 15 nt, Human
aggucuccuccaccg

SEQ ID NO: 2253516 - RNA, 11 nt, Human
aggucugugcu

SEQ ID NO: 2253517 - RNA, 14 nt, Human
aggucugugcugag

SEQ ID NO: 2253518 - RNA, 23 nt, Human
aggucuccucuuaaaaaauaaaa

SEQ ID NO: 2253519 - RNA, 23 nt, Human
aggucuggagaagcucccaggaa

SEQ ID NO: 2253520 - RNA, 16 nt, Human
aggucuggccucaggu

SEQ ID NO: 2253521 - RNA, 16 nt, Human
aggucuggcugcuugc

SEQ ID NO: 2253522 - RNA, 17 nt, Human
aggucuccucuuaaaaa

SEQ ID NO: 2253523 - RNA, 15 nt, Human
aggucuccucuuaaa

SEQ ID NO: 2253524 - RNA, 14 nt, Human
aggucuccucuuaa

SEQ ID NO: 2253525 - RNA, 13 nt, Human
aggucuccucuua

SEQ ID NO: 2253526 - RNA, 12 nt, Human
aggucuccucuu

SEQ ID NO: 2253527 - RNA, 11 nt, Human
aggucuccucu

SEQ ID NO: 2253528 - RNA, 18 nt, Human
aggucuccuccaccgcca

SEQ ID NO: 2253529 - RNA, 23 nt, Human
aggucuccuccaccgccauggcu

SEQ ID NO: 2253530 - RNA, 21 nt, Human
agguccucuacuuaaugagau

SEQ ID NO: 2253531 - RNA, 15 nt, Human
agguccucagagaau

SEQ ID NO: 2253532 - RNA, 20 nt, Human
agguccucugauacccagag

SEQ ID NO: 2253533 - RNA, 13 nt, Human
agguccucuguca

SEQ ID NO: 2253534 - RNA, 19 nt, Human
agguccucugucagucaca

SEQ ID NO: 2253535 - RNA, 14 nt, Human
agguccucugucag

SEQ ID NO: 2253536 - RNA, 22 nt, Human
aggucgguagguucagccaagg

SEQ ID NO: 2253537 - RNA, 22 nt, Human
aggucuaggaacauacuucagc

SEQ ID NO: 2253538 - RNA, 23 nt, Human
agguccucugucagucacagcca

SEQ ID NO: 2253539 - RNA, 15 nt, Human
agguacuaaauaccu

SEQ ID NO: 2253540 - RNA, 23 nt, Human
aggucccuaauaaagcugugugg

SEQ ID NO: 2253541 - RNA, 14 nt, Human
aggucccuuguuuc

SEQ ID NO: 2253542 - RNA, 12 nt, Human
agguacuauuau

SEQ ID NO: 2253543 - RNA, 14 nt, Human
agguacucuccugg

SEQ ID NO: 2253544 - RNA, 13 nt, Human
agguacucuccug

SEQ ID NO: 2253545 - RNA, 16 nt, Human
agguaacaggcagaua

SEQ ID NO: 2253546 - RNA, 22 nt, Human
agguacgaaaagaggggaagag

SEQ ID NO: 2253547 - RNA, 13 nt, Human
agguaacaggcag

SEQ ID NO: 2253548 - RNA, 14 nt, Human
agguaacaggcaga

SEQ ID NO: 2253549 - RNA, 14 nt, Human
aggguuuguggcug

SEQ ID NO: 2253550 - RNA, 16 nt, Human
aggguuuuaauguaga

SEQ ID NO: 2253551 - RNA, 17 nt, Human
aggguuuuaauguagau

SEQ ID NO: 2253552 - RNA, 22 nt, Human
aggguuuugccauguuggccag

SEQ ID NO: 2253553 - RNA, 19 nt, Human
aggguuuuccacccuggaa

SEQ ID NO: 2253554 - RNA, 23 nt, Human
agguaacagaacagcuucagguu

SEQ ID NO: 2253555 - RNA, 18 nt, Human
aggguuuuccacccugga

SEQ ID NO: 2253556 - RNA, 15 nt, Human
aggguuuuccacccu

SEQ ID NO: 2253557 - RNA, 23 nt, Human
aggguuuugccauguuggccagg

SEQ ID NO: 2253558 - RNA, 23 nt, Human
agggucuagggagagacccuugu

SEQ ID NO: 2253559 - RNA, 19 nt, Human
agggucuagggagagaccc

SEQ ID NO: 2253560 - RNA, 16 nt, Human
agggucuagggagaga

SEQ ID NO: 2253561 - RNA, 15 nt, Human
agggucuagggagag

SEQ ID NO: 2253562 - RNA, 20 nt, Human
agggucucacuauguugccc

SEQ ID NO: 2253563 - RNA, 23 nt, Human
aggccagggucacugaaggccug

SEQ ID NO: 2253564 - RNA, 15 nt, Human
aggccaggccagcug

SEQ ID NO: 2253565 - RNA, 13 nt, Human
aggccaggccagc

SEQ ID NO: 2253566 - RNA, 15 nt, Human
aggccaggcccucug

SEQ ID NO: 2253567 - RNA, 21 nt, Human
aggccauccuucccugucugc

SEQ ID NO: 2253568 - RNA, 16 nt, Human
aggccauaaaacaggu

SEQ ID NO: 2253569 - RNA, 21 nt, Human
aggccaucaucaguggagcca

SEQ ID NO: 2253570 - RNA, 19 nt, Human
aggccaggccaccaggaug

SEQ ID NO: 2253571 - RNA, 21 nt, Human
aggccaguaagggaaauagaa

SEQ ID NO: 2253572 - RNA, 15 nt, Human
aggccaggugcaggu

SEQ ID NO: 2253573 - RNA, 14 nt, Human
aggccaggugcagu

SEQ ID NO: 2253574 - RNA, 21 nt, Human
aggccaugauucgcccaaagc

SEQ ID NO: 2253575 - RNA, 19 nt, Human
aggccaugauucgcccaaa

SEQ ID NO: 2253576 - RNA, 13 nt, Human
aggccaugaaaaa

SEQ ID NO: 2253577 - RNA, 19 nt, Human
aggccaugaaaaaaaugau

SEQ ID NO: 2253578 - RNA, 15 nt, Human
aggccaucuuccagg

SEQ ID NO: 2253579 - RNA, 18 nt, Human
aggccaucuuccaggugg

SEQ ID NO: 2253580 - RNA, 19 nt, Human
aggccaucuuccagguggg

SEQ ID NO: 2253581 - RNA, 22 nt, Human
aggccaucugggcuccuccagg

SEQ ID NO: 2253582 - RNA, 21 nt, Human
aggccaucugggcuccuccag

SEQ ID NO: 2253583 - RNA, 15 nt, Human
aggccauggcagaau

SEQ ID NO: 2253584 - RNA, 17 nt, Human
aggccauggagagcugg

SEQ ID NO: 2253585 - RNA, 18 nt, Human
aggccauggagagcugga

SEQ ID NO: 2253586 - RNA, 21 nt, Human
aggccauggagagcuggagcc

SEQ ID NO: 2253587 - RNA, 22 nt, Human
aggccauggagagcuggagccu

SEQ ID NO: 2253588 - RNA, 16 nt, Human
aggccauggagagcug

SEQ ID NO: 2253589 - RNA, 21 nt, Human
aggccaggaguuugagaccag

SEQ ID NO: 2253590 - RNA, 14 nt, Human
aggccaggccacca

SEQ ID NO: 2253591 - RNA, 16 nt, Human
aggccaggccaccagg

SEQ ID NO: 2253592 - RNA, 17 nt, Human
aggccaggccaccagga

SEQ ID NO: 2253593 - RNA, 18 nt, Human
aggccaggccaccaggau

SEQ ID NO: 2253594 - RNA, 11 nt, Human
aggccaggagu

SEQ ID NO: 2253595 - RNA, 13 nt, Human
aggccaggcccuc

SEQ ID NO: 2253596 - RNA, 14 nt, Human
aggccaggcccucu

SEQ ID NO: 2253597 - RNA, 20 nt, Human
aggccagcuggcagcagagu

SEQ ID NO: 2253598 - RNA, 19 nt, Human
aggccagcuggcagcagag

SEQ ID NO: 2253599 - RNA, 18 nt, Human
aggccagcuggcagcaga

SEQ ID NO: 2253600 - RNA, 17 nt, Human
aggccagcuggcagcag

SEQ ID NO: 2253601 - RNA, 16 nt, Human
aggccagcuggcagca

SEQ ID NO: 2253602 - RNA, 15 nt, Human
aggccagcuggcagc

SEQ ID NO: 2253603 - RNA, 14 nt, Human
aggccagcuggcag

SEQ ID NO: 2253604 - RNA, 14 nt, Human
aggcauguccugga

SEQ ID NO: 2253605 - RNA, 23 nt, Human
aggccagcugcuugggcuucauc

SEQ ID NO: 2253606 - RNA, 19 nt, Human
aggcauuccccaggaggcc

SEQ ID NO: 2253607 - RNA, 20 nt, Human
aggcauuccccaggaggcca

SEQ ID NO: 2253608 - RNA, 17 nt, Human
aggccgcuguucaccca

SEQ ID NO: 2253609 - RNA, 21 nt, Human
aggccgcuagaggccugagga

SEQ ID NO: 2253610 - RNA, 18 nt, Human
aggccgcuagaggccuga

SEQ ID NO: 2253611 - RNA, 20 nt, Human
aggccgcuagaggccugagg

SEQ ID NO: 2253612 - RNA, 20 nt, Human
aggccgcuguucacccacag

SEQ ID NO: 2253613 - RNA, 19 nt, Human
aggccggcgagcccugugg

SEQ ID NO: 2253614 - RNA, 18 nt, Human
aggccgccccagccucug

SEQ ID NO: 2253615 - RNA, 14 nt, Human
aggccgcuagaggc

SEQ ID NO: 2253616 - RNA, 17 nt, Human
aggccgcuagaggccug

SEQ ID NO: 2253617 - RNA, 19 nt, Human
aggccgccccagccucuga

SEQ ID NO: 2253618 - RNA, 14 nt, Human
aggccgccccagcc

SEQ ID NO: 2253619 - RNA, 22 nt, Human
aggccgcagcucuugcccuucc

SEQ ID NO: 2253620 - RNA, 19 nt, Human
aggcccuuccucuccacug

SEQ ID NO: 2253621 - RNA, 21 nt, Human
aggccgcagcucuugcccuuc

SEQ ID NO: 2253622 - RNA, 22 nt, Human
aggcccuuccucuccacugccu

SEQ ID NO: 2253623 - RNA, 12 nt, Human
aggcccuucucu

SEQ ID NO: 2253624 - RNA, 21 nt, Human
aggcccuggccuccccugcca

SEQ ID NO: 2253625 - RNA, 22 nt, Human
aggcccuggccuccccugccac

SEQ ID NO: 2253626 - RNA, 23 nt, Human
aggcccuggccuccccugccacc

SEQ ID NO: 2253627 - RNA, 13 nt, Human
aggcccugucugu

SEQ ID NO: 2253628 - RNA, 14 nt, Human
aggcccugucugua

SEQ ID NO: 2253629 - RNA, 15 nt, Human
aggcccuucucucca

SEQ ID NO: 2253630 - RNA, 19 nt, Human
aggcccuucucuccagccc

SEQ ID NO: 2253631 - RNA, 15 nt, Human
aggcccucuggagug

SEQ ID NO: 2253632 - RNA, 13 nt, Human
aggcccucuggag

SEQ ID NO: 2253633 - RNA, 22 nt, Human
aggcccucuggaguggccacua

SEQ ID NO: 2253634 - RNA, 21 nt, Human
aggcccucuggaguggccacu

SEQ ID NO: 2253635 - RNA, 20 nt, Human
aggcccucuggaguggccac

SEQ ID NO: 2253636 - RNA, 13 nt, Human
aggcccugcacug

SEQ ID NO: 2253637 - RNA, 15 nt, Human
aggcccugcacuguc

SEQ ID NO: 2253638 - RNA, 16 nt, Human
aggcccugcacugucc

SEQ ID NO: 2253639 - RNA, 17 nt, Human
aggcccugcacuguccu

SEQ ID NO: 2253640 - RNA, 18 nt, Human
aggcccugcacuguccug

SEQ ID NO: 2253641 - RNA, 19 nt, Human
aggcccugcacuguccugc

SEQ ID NO: 2253642 - RNA, 21 nt, Human
aggcccugcacuguccugcuc

SEQ ID NO: 2253643 - RNA, 22 nt, Human
aggcccugcacuguccugcucc

SEQ ID NO: 2253644 - RNA, 23 nt, Human
aggcccugcacuguccugcucca

SEQ ID NO: 2253645 - RNA, 24 nt, Human
aggcccugcacuguccugcuccac

SEQ ID NO: 2253646 - RNA, 14 nt, Human
aggcccuggccucc

SEQ ID NO: 2253647 - RNA, 15 nt, Human
aggcccuggccuccc

SEQ ID NO: 2253648 - RNA, 21 nt, Human
aggcccucugcccacucccug

SEQ ID NO: 2253649 - RNA, 21 nt, Human
aggccaugggcacugugggua

SEQ ID NO: 2253650 - RNA, 22 nt, Human
aggcccucugcccacucccugc

SEQ ID NO: 2253651 - RNA, 23 nt, Human
aggcccucugcccacucccugca

SEQ ID NO: 2253652 - RNA, 14 nt, Human
aggcacgaacccac

SEQ ID NO: 2253653 - RNA, 19 nt, Human
aggcaccuuaguggcuuuu

SEQ ID NO: 2253654 - RNA, 14 nt, Human
aggcaccugcaggu

SEQ ID NO: 2253655 - RNA, 18 nt, Human
aggcaccugcagguuggg

SEQ ID NO: 2253656 - RNA, 21 nt, Human
aggcaccugcagguugggcca

SEQ ID NO: 2253657 - RNA, 14 nt, Human
aggcaccugcauuu

SEQ ID NO: 2253658 - RNA, 21 nt, Human
aggagaggcaacauccaaaau

SEQ ID NO: 2253659 - RNA, 18 nt, Human
aggagaggggaagggcca

SEQ ID NO: 2253660 - RNA, 19 nt, Human
aggagaggggaagggccag

SEQ ID NO: 2253661 - RNA, 23 nt, Human
aggagaggaugagagcccagagg

SEQ ID NO: 2253662 - RNA, 20 nt, Human
aggagaggcaacauccaaaa

SEQ ID NO: 2253663 - RNA, 18 nt, Human
aggagaggaugagagccc

SEQ ID NO: 2253664 - RNA, 19 nt, Human
aggagaggaugagagccca

SEQ ID NO: 2253665 - RNA, 20 nt, Human
aggagaggaugagagcccag

SEQ ID NO: 2253666 - RNA, 21 nt, Human
aggagaggaugagagcccaga

SEQ ID NO: 2253667 - RNA, 22 nt, Human
aggagaggggaagggccagucu

SEQ ID NO: 2253668 - RNA, 21 nt, Human
aggcacgaacccaccugcuga

SEQ ID NO: 2253669 - RNA, 13 nt, Human
aggcacuagccuu

SEQ ID NO: 2253670 - RNA, 15 nt, Human
aggcacuagccuuug

SEQ ID NO: 2253671 - RNA, 20 nt, Human
aggcacgaacccaccugcug

SEQ ID NO: 2253672 - RNA, 19 nt, Human
aggcacgaacccaccugcu

SEQ ID NO: 2253673 - RNA, 18 nt, Human
aggcacgaacccaccugc

SEQ ID NO: 2253674 - RNA, 17 nt, Human
aggcacgaacccaccug

SEQ ID NO: 2253675 - RNA, 23 nt, Human
aggcacuagccuuuggcucugga

SEQ ID NO: 2253676 - RNA, 16 nt, Human
aggcacucuguuauuu

SEQ ID NO: 2253677 - RNA, 20 nt, Human
aggcacucuguuauuuagac

SEQ ID NO: 2253678 - RNA, 22 nt, Human
aggcagacuucccugaauguau

SEQ ID NO: 2253679 - RNA, 19 nt, Human
aggcacucuguuauuuaga

SEQ ID NO: 2253680 - RNA, 9 nt, Human
aggcagaga

SEQ ID NO: 2253681 - RNA, 23 nt, Human
aggcacugagauaccagcgagga

SEQ ID NO: 2253682 - RNA, 17 nt, Human
aggcacugaagugcuua

SEQ ID NO: 2253683 - RNA, 13 nt, Human
aggcagagaaaga

SEQ ID NO: 2253684 - RNA, 15 nt, Human
aggcagagaaagaag

SEQ ID NO: 2253685 - RNA, 17 nt, Human
aggcagagaaagaagag

SEQ ID NO: 2253686 - RNA, 18 nt, Human
aggcagagaaagaagaga

SEQ ID NO: 2253687 - RNA, 19 nt, Human
aggcagagaaagaagagac

SEQ ID NO: 2253688 - RNA, 21 nt, Human
aggcagagaaagaagagacag

SEQ ID NO: 2253689 - RNA, 22 nt, Human
aggcagagaaagaagagacagg

SEQ ID NO: 2253690 - RNA, 21 nt, Human
aggcagaucugugccccaugc

SEQ ID NO: 2253691 - RNA, 20 nt, Human
aggcagaucugugccccaug

SEQ ID NO: 2253692 - RNA, 16 nt, Human
aggcagaucugugccc

SEQ ID NO: 2253693 - RNA, 15 nt, Human
aggcagaucugugcc

SEQ ID NO: 2253694 - RNA, 17 nt, Human
aggcagauccaggacua

SEQ ID NO: 2253695 - RNA, 14 nt, Human
aggcagagaaucau

SEQ ID NO: 2253696 - RNA, 22 nt, Human
aggcagagaaucauacuuagca

SEQ ID NO: 2253697 - RNA, 11 nt, Human
aggcagagagc

SEQ ID NO: 2253698 - RNA, 13 nt, Human
aggcagagagcgg

SEQ ID NO: 2253699 - RNA, 20 nt, Human
aggcagagagcggucucagg

SEQ ID NO: 2253700 - RNA, 13 nt, Human
aggcagaggacag

SEQ ID NO: 2253701 - RNA, 15 nt, Human
aggcaugguggccca

SEQ ID NO: 2253702 - RNA, 16 nt, Human
aggcauggcccugggg

SEQ ID NO: 2253703 - RNA, 21 nt, Human
aggcauggcccugggguccca

SEQ ID NO: 2253704 - RNA, 14 nt, Human
aggcauggcccugg

SEQ ID NO: 2253705 - RNA, 15 nt, Human
aggcauggcccuggg

SEQ ID NO: 2253706 - RNA, 12 nt, Human
aggcauguccug

SEQ ID NO: 2253707 - RNA, 12 nt, Human
aggcauggugga

SEQ ID NO: 2253708 - RNA, 17 nt, Human
aggcaugugaugagagg

SEQ ID NO: 2253709 - RNA, 12 nt, Human
aggcagcauuua

SEQ ID NO: 2253710 - RNA, 12 nt, Human
aggcauggcccu

SEQ ID NO: 2253711 - RNA, 13 nt, Human
aggcauggcccug

SEQ ID NO: 2253712 - RNA, 23 nt, Human
aggcagcagugugaggccagggc

SEQ ID NO: 2253713 - RNA, 22 nt, Human
aggcagcagugugaggccaggg

SEQ ID NO: 2253714 - RNA, 20 nt, Human
aggcagcagugugaggccag

SEQ ID NO: 2253715 - RNA, 19 nt, Human
aggcagcagugugaggcca

SEQ ID NO: 2253716 - RNA, 23 nt, Human
aggcagaucugugccccaugccu

SEQ ID NO: 2253717 - RNA, 22 nt, Human
aggcagaucugugccccaugcc

SEQ ID NO: 2253718 - RNA, 15 nt, Human
aggcagauugaaaag

SEQ ID NO: 2253719 - RNA, 16 nt, Human
aggcagauugaaaagg

SEQ ID NO: 2253720 - RNA, 17 nt, Human
aggcagauugaaaagga

SEQ ID NO: 2253721 - RNA, 17 nt, Human
aggcauguucucugagg

SEQ ID NO: 2253722 - RNA, 21 nt, Human
aggcaugugaugagaggaaau

SEQ ID NO: 2253723 - RNA, 19 nt, Human
aggcaugugaugagaggaa

SEQ ID NO: 2253724 - RNA, 20 nt, Human
aggcaugugaugagaggaaa

SEQ ID NO: 2253725 - RNA, 18 nt, Human
aggcauguucucugagga

SEQ ID NO: 2253726 - RNA, 19 nt, Human
aggcauguucucugaggac

SEQ ID NO: 2253727 - RNA, 18 nt, Human
aggcauuccccaggaggc

SEQ ID NO: 2253728 - RNA, 17 nt, Human
aggcauuccccaggagg

SEQ ID NO: 2253729 - RNA, 14 nt, Human
aggcggugggcacc

SEQ ID NO: 2253730 - RNA, 21 nt, Human
aggcggugggcacccacccug

SEQ ID NO: 2253731 - RNA, 19 nt, Human
aggcgucaacgugcauuuu

SEQ ID NO: 2253732 - RNA, 21 nt, Human
aggcuaaagcccagagacagc

SEQ ID NO: 2253733 - RNA, 18 nt, Human
aggcuaaagcccagagac

SEQ ID NO: 2253734 - RNA, 19 nt, Human
aggcuaaggcaggaaaauu

SEQ ID NO: 2253735 - RNA, 14 nt, Human
aggcgggccagcca

SEQ ID NO: 2253736 - RNA, 15 nt, Human
aggcgggccagccag

SEQ ID NO: 2253737 - RNA, 16 nt, Human
aggcgggccagccagg

SEQ ID NO: 2253738 - RNA, 17 nt, Human
aggcgggccagccaggc

SEQ ID NO: 2253739 - RNA, 21 nt, Human
aggcgggccagccaggcgggc

SEQ ID NO: 2253740 - RNA, 23 nt, Human
aggcgggccagccaggcgggcuc

SEQ ID NO: 2253741 - RNA, 15 nt, Human
aggcgggcggucagg

SEQ ID NO: 2253742 - RNA, 14 nt, Human
aggcgggcucaagg

SEQ ID NO: 2253743 - RNA, 21 nt, Human
aggcgggaaaagcagcccuug

SEQ ID NO: 2253744 - RNA, 16 nt, Human
aggcggccccucccgc

SEQ ID NO: 2253745 - RNA, 15 nt, Human
aggcgggaaggaggg

SEQ ID NO: 2253746 - RNA, 14 nt, Human
aggcgggaaggagg

SEQ ID NO: 2253747 - RNA, 14 nt, Human
aggcgggaguggag

SEQ ID NO: 2253748 - RNA, 12 nt, Human
aggcgggccagc

SEQ ID NO: 2253749 - RNA, 13 nt, Human
aggcgggccagcc

SEQ ID NO: 2253750 - RNA, 20 nt, Human
aggccggcgagcccugugga

SEQ ID NO: 2253751 - RNA, 22 nt, Human
aggcuggucucaaacuccugac

SEQ ID NO: 2253752 - RNA, 17 nt, Human
aggcugaggcagaagaa

SEQ ID NO: 2253753 - RNA, 23 nt, Human
aggcuggucucgaacuccugacc

SEQ ID NO: 2253754 - RNA, 20 nt, Human
aggcuggugcuguggccagg

SEQ ID NO: 2253755 - RNA, 20 nt, Human
aggcuguaucccaugagccu

SEQ ID NO: 2253756 - RNA, 21 nt, Human
aggcuguaucccaugagccuc

SEQ ID NO: 2253757 - RNA, 22 nt, Human
aggcuguaucccaugagccuca

SEQ ID NO: 2253758 - RNA, 14 nt, Human
aggcugguggccca

SEQ ID NO: 2253759 - RNA, 13 nt, Human
aggcugguggccc

SEQ ID NO: 2253760 - RNA, 22 nt, Human
aggcuggugcuguggccagggu

SEQ ID NO: 2253761 - RNA, 23 nt, Human
aggcuggugcuguggccagggug

SEQ ID NO: 2253762 - RNA, 17 nt, Human
aggcuuagucacugaga

SEQ ID NO: 2253763 - RNA, 15 nt, Human
aggcugguggcccag

SEQ ID NO: 2253764 - RNA, 15 nt, Human
aggcuuagcuuugcu

SEQ ID NO: 2253765 - RNA, 19 nt, Human
aggcuuagcuuugcucugc

SEQ ID NO: 2253766 - RNA, 20 nt, Human
aggcuuagcuuugcucugcc

SEQ ID NO: 2253767 - RNA, 23 nt, Human
agggacugccagucccccugccc

SEQ ID NO: 2253768 - RNA, 15 nt, Human
agggacuggaaccag

SEQ ID NO: 2253769 - RNA, 18 nt, Human
agggacuggaaccaggga

SEQ ID NO: 2253770 - RNA, 15 nt, Human
agggacugaggggag

SEQ ID NO: 2253771 - RNA, 23 nt, Human
agggaccccugcccuugucccac

SEQ ID NO: 2253772 - RNA, 15 nt, Human
agggacccuccacca

SEQ ID NO: 2253773 - RNA, 15 nt, Human
agggaccccugcccu

SEQ ID NO: 2253774 - RNA, 15 nt, Human
agggaccccuccucc

SEQ ID NO: 2253775 - RNA, 13 nt, Human
agggaccccuccu

SEQ ID NO: 2253776 - RNA, 14 nt, Human
agggaccccuccuc

SEQ ID NO: 2253777 - RNA, 20 nt, Human
agggaccagccaagagggcu

SEQ ID NO: 2253778 - RNA, 12 nt, Human
agggaccccucc

SEQ ID NO: 2253779 - RNA, 15 nt, Human
agggaccagccaaga

SEQ ID NO: 2253780 - RNA, 14 nt, Human
agggaccagccaag

SEQ ID NO: 2253781 - RNA, 14 nt, Human
agggaccacagcaa

SEQ ID NO: 2253782 - RNA, 23 nt, Human
agggaccacagcaaggcaccugc

SEQ ID NO: 2253783 - RNA, 18 nt, Human
agggaccacacccuguac

SEQ ID NO: 2253784 - RNA, 23 nt, Human
agggaccaaggcaaggcaggugc

SEQ ID NO: 2253785 - RNA, 13 nt, Human
agggaccacagca

SEQ ID NO: 2253786 - RNA, 18 nt, Human
aggcuuagucacugagac

SEQ ID NO: 2253787 - RNA, 12 nt, Human
agggaccaaggc

SEQ ID NO: 2253788 - RNA, 13 nt, Human
agggaccaaggca

SEQ ID NO: 2253789 - RNA, 17 nt, Human
agggaccaaggcaaggc

SEQ ID NO: 2253790 - RNA, 21 nt, Human
agggaccaaggcaaggcaggu

SEQ ID NO: 2253791 - RNA, 19 nt, Human
aggcugaggcaggagaaug

SEQ ID NO: 2253792 - RNA, 15 nt, Human
aggcugaggcaggag

SEQ ID NO: 2253793 - RNA, 14 nt, Human
aggcugaggcagga

SEQ ID NO: 2253794 - RNA, 16 nt, Human
aggcugagacugcggg

SEQ ID NO: 2253795 - RNA, 15 nt, Human
aggcugagacaggag

SEQ ID NO: 2253796 - RNA, 18 nt, Human
aggcugagacaggagaau

SEQ ID NO: 2253797 - RNA, 17 nt, Human
aggcugagacugcggga

SEQ ID NO: 2253798 - RNA, 15 nt, Human
aggcugaggcagaag

SEQ ID NO: 2253799 - RNA, 22 nt, Human
aggcugaccuugaacuccuggg

SEQ ID NO: 2253800 - RNA, 16 nt, Human
aggcugagaacacugu

SEQ ID NO: 2253801 - RNA, 19 nt, Human
aggcugagaacacugugaa

SEQ ID NO: 2253802 - RNA, 13 nt, Human
aggcugagacagg

SEQ ID NO: 2253803 - RNA, 14 nt, Human
aggcugagacagga

SEQ ID NO: 2253804 - RNA, 21 nt, Human
aggcugaccacagcacagcca

SEQ ID NO: 2253805 - RNA, 18 nt, Human
aggcugaccacagcacag

SEQ ID NO: 2253806 - RNA, 17 nt, Human
aggcugaccacagcaca

SEQ ID NO: 2253807 - RNA, 16 nt, Human
aggcugaccacagcac

SEQ ID NO: 2253808 - RNA, 21 nt, Human
aggcugaggcggguggaucac

SEQ ID NO: 2253809 - RNA, 11 nt, Human
aggcugaggcg

SEQ ID NO: 2253810 - RNA, 16 nt, Human
aggcugaggccuggac

SEQ ID NO: 2253811 - RNA, 17 nt, Human
aggcugaggccuggacu

SEQ ID NO: 2253812 - RNA, 17 nt, Human
aggcugaggcaggagga

SEQ ID NO: 2253813 - RNA, 13 nt, Human
aggcugaggccug

SEQ ID NO: 2253814 - RNA, 14 nt, Human
aggcugaggccugg

SEQ ID NO: 2253815 - RNA, 15 nt, Human
aggcugaggccugga

SEQ ID NO: 2253816 - RNA, 18 nt, Human
aggcuggguucugauccu

SEQ ID NO: 2253817 - RNA, 17 nt, Human
aggcugaggcuggcaca

SEQ ID NO: 2253818 - RNA, 16 nt, Human
aggcugaggcuggcac

SEQ ID NO: 2253819 - RNA, 15 nt, Human
aggcugaggcuggca

SEQ ID NO: 2253820 - RNA, 14 nt, Human
aggcugaggcuggc

SEQ ID NO: 2253821 - RNA, 19 nt, Human
aggcuacacugacacuggu

SEQ ID NO: 2253822 - RNA, 22 nt, Human
aggcuacaauuuucucccagga

SEQ ID NO: 2253823 - RNA, 23 nt, Human
aggcuacaauuuucucccaggaa

SEQ ID NO: 2253824 - RNA, 13 nt, Human
aggcuacacugac

SEQ ID NO: 2253825 - RNA, 18 nt, Human
aggcuacacugacacugg

SEQ ID NO: 2253826 - RNA, 19 nt, Human
aggcuacaauuuucuccca

SEQ ID NO: 2253827 - RNA, 18 nt, Human
aggcuacaauuuucuccc

SEQ ID NO: 2253828 - RNA, 19 nt, Human
aggcuaaauuacucaggaa

SEQ ID NO: 2253829 - RNA, 15 nt, Human
aggcuaaggcgugga

SEQ ID NO: 2253830 - RNA, 18 nt, Human
aggcuaaggcguggagcu

SEQ ID NO: 2253831 - RNA, 19 nt, Human
aggcuaaggcguggagcug

SEQ ID NO: 2253832 - RNA, 23 nt, Human
aggcuaaggcguggagcugccug

SEQ ID NO: 2253833 - RNA, 20 nt, Human
aggcuaaggcguggagcugc

SEQ ID NO: 2253834 - RNA, 22 nt, Human
aggcugaccaagagagaaagaa

SEQ ID NO: 2253835 - RNA, 20 nt, Human
aggcugaccaagagagaaag

SEQ ID NO: 2253836 - RNA, 19 nt, Human
aggcugaccaagagagaaa

SEQ ID NO: 2253837 - RNA, 18 nt, Human
aggcugaccaagagagaa

SEQ ID NO: 2253838 - RNA, 14 nt, Human
aggcugaccacagc

SEQ ID NO: 2253839 - RNA, 13 nt, Human
aggcugaccacag

SEQ ID NO: 2253840 - RNA, 15 nt, Human
aggcuaccuuuguau

SEQ ID NO: 2253841 - RNA, 14 nt, Human
aggcuaccuuugua

SEQ ID NO: 2253842 - RNA, 13 nt, Human
aggcuaccuuugu

SEQ ID NO: 2253843 - RNA, 23 nt, Human
agcaaaaucauggaaugguuaua

SEQ ID NO: 2253844 - RNA, 13 nt, Human
agcaaacacauua

SEQ ID NO: 2253845 - RNA, 20 nt, Human
agcaaaaucauggaaugguu

SEQ ID NO: 2253846 - RNA, 13 nt, Human
agcaaacagagga

SEQ ID NO: 2253847 - RNA, 19 nt, Human
agcaaacuaacuugacuuu

SEQ ID NO: 2253848 - RNA, 23 nt, Human
agcaaagccccaugcuggagccu

SEQ ID NO: 2253849 - RNA, 13 nt, Human
agcaaacuaagcc

SEQ ID NO: 2253850 - RNA, 21 nt, Human
agcaaagccccaugcuggagc

SEQ ID NO: 2253851 - RNA, 22 nt, Human
agcaaagccccaugcuggagcc

SEQ ID NO: 2253852 - RNA, 18 nt, Human
agcaaaagaugcuucuca

SEQ ID NO: 2253853 - RNA, 21 nt, Human
agcaaaaccaaauauuccaga

SEQ ID NO: 2253854 - RNA, 18 nt, Human
agcaaaagggugucugag

SEQ ID NO: 2253855 - RNA, 21 nt, Human
agcaaaagggugucugagccc

SEQ ID NO: 2253856 - RNA, 21 nt, Human
agcaaaauaauuuuaaacaaa

SEQ ID NO: 2253857 - RNA, 24 nt, Human
agcaaaauuuuuucucuaggaaau

SEQ ID NO: 2253858 - RNA, 19 nt, Human
agauugaaaacuuuucuca

SEQ ID NO: 2253859 - RNA, 20 nt, Human
agauugaaaacuuuucucag

SEQ ID NO: 2253860 - RNA, 19 nt, Human
agauucuuuccugaggcug

SEQ ID NO: 2253861 - RNA, 21 nt, Human
agauucuuuccugaggcuggg

SEQ ID NO: 2253862 - RNA, 17 nt, Human
agcaaaacuccaucuca

SEQ ID NO: 2253863 - RNA, 23 nt, Human
agauugcaacaggcugggcuuca

SEQ ID NO: 2253864 - RNA, 20 nt, Human
agauugcaacaggcugggcu

SEQ ID NO: 2253865 - RNA, 21 nt, Human
agauugcaacaggcugggcuu

SEQ ID NO: 2253866 - RNA, 23 nt, Human
agcaaagcugaugacaacuuccc

SEQ ID NO: 2253867 - RNA, 21 nt, Human
agcaaagcugaugacaacuuc

SEQ ID NO: 2253868 - RNA, 20 nt, Human
agcaaaggagauuggaagga

SEQ ID NO: 2253869 - RNA, 17 nt, Human
agcaaauguuaugcaua

SEQ ID NO: 2253870 - RNA, 15 nt, Human
agcaaaugugaccug

SEQ ID NO: 2253871 - RNA, 16 nt, Human
agcaaauguggcuccu

SEQ ID NO: 2253872 - RNA, 20 nt, Human
agcaaaugucuuccuggauu

SEQ ID NO: 2253873 - RNA, 17 nt, Human
agcaaaugucuuccugg

SEQ ID NO: 2253874 - RNA, 17 nt, Human
agauucugaaacauugc

SEQ ID NO: 2253875 - RNA, 15 nt, Human
agauucuccugugcu

SEQ ID NO: 2253876 - RNA, 17 nt, Human
agauguaaaagguauua

SEQ ID NO: 2253877 - RNA, 18 nt, Human
agaugguuugagccugag

SEQ ID NO: 2253878 - RNA, 22 nt, Human
agaugguuuuauaaucugauuu

SEQ ID NO: 2253879 - RNA, 16 nt, Human
agauguagaggagaaa

SEQ ID NO: 2253880 - RNA, 19 nt, Human
agauguagauaaacucaga

SEQ ID NO: 2253881 - RNA, 15 nt, Human
agauguagauuuauu

SEQ ID NO: 2253882 - RNA, 21 nt, Human
agauguagcaaaacgcaugga

SEQ ID NO: 2253883 - RNA, 18 nt, Human
agauguagauuuauuuca

SEQ ID NO: 2253884 - RNA, 19 nt, Human
agauguagaggagaaacug

SEQ ID NO: 2253885 - RNA, 13 nt, Human
agaugggugggga

SEQ ID NO: 2253886 - RNA, 23 nt, Human
agaugaugaaaauauuuaaaggc

SEQ ID NO: 2253887 - RNA, 19 nt, Human
agaugguauauuugguacu

SEQ ID NO: 2253888 - RNA, 19 nt, Human
agauggucacgcaccuggg

SEQ ID NO: 2253889 - RNA, 21 nt, Human
agauggucacgcaccugggug

SEQ ID NO: 2253890 - RNA, 14 nt, Human
agauggugcugaga

SEQ ID NO: 2253891 - RNA, 15 nt, Human
agauggugaaauuua

SEQ ID NO: 2253892 - RNA, 17 nt, Human
agauggugcugagaagc

SEQ ID NO: 2253893 - RNA, 14 nt, Human
agaugguggcagua

SEQ ID NO: 2253894 - RNA, 13 nt, Human
agaugauccauga

SEQ ID NO: 2253895 - RNA, 13 nt, Human
agaugaucauuug

SEQ ID NO: 2253896 - RNA, 16 nt, Human
agaugaucuacucaga

SEQ ID NO: 2253897 - RNA, 18 nt, Human
agaugaugaaaauauuua

SEQ ID NO: 2253898 - RNA, 20 nt, Human
agaugauacauccaaagcag

SEQ ID NO: 2253899 - RNA, 16 nt, Human
agaugauacauccaaa

SEQ ID NO: 2253900 - RNA, 14 nt, Human
agaugagugagcau

SEQ ID NO: 2253901 - RNA, 19 nt, Human
agaugaaguuuuacauugu

SEQ ID NO: 2253902 - RNA, 22 nt, Human
agaugaauacaaacaauggaaa

SEQ ID NO: 2253903 - RNA, 16 nt, Human
agaugaauacaaacaa

SEQ ID NO: 2253904 - RNA, 21 nt, Human
agaugaguaaaggaguaagaa

SEQ ID NO: 2253905 - RNA, 21 nt, Human
agagugcaagccccugcucca

SEQ ID NO: 2253906 - RNA, 18 nt, Human
agagugcauugugagggu

SEQ ID NO: 2253907 - RNA, 12 nt, Human
agagugcccaga

SEQ ID NO: 2253908 - RNA, 13 nt, Human
agagugcccagaa

SEQ ID NO: 2253909 - RNA, 21 nt, Human
agagugcgccgagucugucuc

SEQ ID NO: 2253910 - RNA, 17 nt, Human
agagugcgccgagucug

SEQ ID NO: 2253911 - RNA, 22 nt, Human
agaguggaaugcuuccuagaag

SEQ ID NO: 2253912 - RNA, 22 nt, Human
agagugcaacaguagcauagga

SEQ ID NO: 2253913 - RNA, 17 nt, Human
agagugcaacaguagca

SEQ ID NO: 2253914 - RNA, 13 nt, Human
agagugcaacagu

SEQ ID NO: 2253915 - RNA, 22 nt, Human
agagugauagucuuuugcuuuu

SEQ ID NO: 2253916 - RNA, 17 nt, Human
agagugauaauacaagu

SEQ ID NO: 2253917 - RNA, 20 nt, Human
agagugauagucuuuugcuu

SEQ ID NO: 2253918 - RNA, 12 nt, Human
agagggggugga

SEQ ID NO: 2253919 - RNA, 19 nt, Human
agaggggguggaggggugu

SEQ ID NO: 2253920 - RNA, 12 nt, Human
agaguggccugg

SEQ ID NO: 2253921 - RNA, 11 nt, Human
agaguggccug

SEQ ID NO: 2253922 - RNA, 19 nt, Human
agaugaagcaaacacauua

SEQ ID NO: 2253923 - RNA, 20 nt, Human
agaugaagagugagagggca

SEQ ID NO: 2253924 - RNA, 15 nt, Human
agaugaaguuuuaca

SEQ ID NO: 2253925 - RNA, 18 nt, Human
agaugaagcaaacacauu

SEQ ID NO: 2253926 - RNA, 17 nt, Human
agaugaagcaaacacau

SEQ ID NO: 2253927 - RNA, 16 nt, Human
agaugaaggagaggca

SEQ ID NO: 2253928 - RNA, 19 nt, Human
agaugaagagugagagggc

SEQ ID NO: 2253929 - RNA, 19 nt, Human
agaugaacucuuagaaaug

SEQ ID NO: 2253930 - RNA, 17 nt, Human
agaugaagagugagagg

SEQ ID NO: 2253931 - RNA, 17 nt, Human
agaucuguccucagccu

SEQ ID NO: 2253932 - RNA, 15 nt, Human
agaucuguccucagc

SEQ ID NO: 2253933 - RNA, 18 nt, Human
agaucuguccucagccuu

SEQ ID NO: 2253934 - RNA, 18 nt, Human
agaucugguuuugcuauu

SEQ ID NO: 2253935 - RNA, 20 nt, Human
agaucuggaaccucagccug

SEQ ID NO: 2253936 - RNA, 19 nt, Human
agaucuggaaccucagccu

SEQ ID NO: 2253937 - RNA, 17 nt, Human
agaucuggaaccucagc

SEQ ID NO: 2253938 - RNA, 15 nt, Human
agaucuggaaccuca

SEQ ID NO: 2253939 - RNA, 14 nt, Human
agaucuguccucag

SEQ ID NO: 2253940 - RNA, 15 nt, Human
agaucugguuuugcu

SEQ ID NO: 2253941 - RNA, 17 nt, Human
agaucugguuuugcuau

SEQ ID NO: 2253942 - RNA, 17 nt, Human
agaucuggacuuggcaa

SEQ ID NO: 2253943 - RNA, 12 nt, Human
agaucugguuuu

SEQ ID NO: 2253944 - RNA, 14 nt, Human
agaucuggaaccuc

SEQ ID NO: 2253945 - RNA, 13 nt, Human
agaucuggaaccu

SEQ ID NO: 2253946 - RNA, 20 nt, Human
agcacacacuuuugguuaag

SEQ ID NO: 2253947 - RNA, 14 nt, Human
agcacacacuuuug

SEQ ID NO: 2253948 - RNA, 12 nt, Human
agcacagacccu

SEQ ID NO: 2253949 - RNA, 14 nt, Human
agcacagacccugc

SEQ ID NO: 2253950 - RNA, 15 nt, Human
agcacagacccugcc

SEQ ID NO: 2253951 - RNA, 16 nt, Human
agcaaugucugugcua

SEQ ID NO: 2253952 - RNA, 14 nt, Human
agcaaugucugugc

SEQ ID NO: 2253953 - RNA, 15 nt, Human
agcaaugucugugcu

SEQ ID NO: 2253954 - RNA, 14 nt, Human
agcaauuccaaccu

SEQ ID NO: 2253955 - RNA, 19 nt, Human
agcacaacuuuaagaggac

SEQ ID NO: 2253956 - RNA, 11 nt, Human
agcacaagaag

SEQ ID NO: 2253957 - RNA, 12 nt, Human
agcacaagaagc

SEQ ID NO: 2253958 - RNA, 13 nt, Human
agcacaagaagcg

SEQ ID NO: 2253959 - RNA, 18 nt, Human
agcacaagaagcgugaga

SEQ ID NO: 2253960 - RNA, 15 nt, Human
agcaaugccugccca

SEQ ID NO: 2253961 - RNA, 13 nt, Human
agcaaugucugug

SEQ ID NO: 2253962 - RNA, 21 nt, Human
agcaaugcccguaaugcuuag

SEQ ID NO: 2253963 - RNA, 21 nt, Human
agcaauggacgguccgcagaa

SEQ ID NO: 2253964 - RNA, 20 nt, Human
agcaaugacaucucaggggc

SEQ ID NO: 2253965 - RNA, 21 nt, Human
agcaaugacaucucaggggcc

SEQ ID NO: 2253966 - RNA, 18 nt, Human
agcaaugauguccagaag

SEQ ID NO: 2253967 - RNA, 19 nt, Human
agcaaugauguccagaaga

SEQ ID NO: 2253968 - RNA, 20 nt, Human
agcaaugauguccagaagaa

SEQ ID NO: 2253969 - RNA, 23 nt, Human
agcaaugauguccagaagaauau

SEQ ID NO: 2253970 - RNA, 13 nt, Human
agcaaugcauuuu

SEQ ID NO: 2253971 - RNA, 20 nt, Human
agcaaugcccguaaugcuua

SEQ ID NO: 2253972 - RNA, 18 nt, Human
agcaaugacaucucaggg

SEQ ID NO: 2253973 - RNA, 19 nt, Human
agcaaugacaucucagggg

SEQ ID NO: 2253974 - RNA, 18 nt, Human
agcagcccuccucacccc

SEQ ID NO: 2253975 - RNA, 15 nt, Human
agcagcccuggaguc

SEQ ID NO: 2253976 - RNA, 16 nt, Human
agcagcccuggaguca

SEQ ID NO: 2253977 - RNA, 17 nt, Human
agcagcccuggagucau

SEQ ID NO: 2253978 - RNA, 19 nt, Human
agcagcccuggagucaugc

SEQ ID NO: 2253979 - RNA, 13 nt, Human
agcagcccuuggc

SEQ ID NO: 2253980 - RNA, 22 nt, Human
agcagcccuuggccagaaguca

SEQ ID NO: 2253981 - RNA, 16 nt, Human
agcagcccuuggccag

SEQ ID NO: 2253982 - RNA, 20 nt, Human
agcagccucagaacaaagug

SEQ ID NO: 2253983 - RNA, 15 nt, Human
agcagccucucccca

SEQ ID NO: 2253984 - RNA, 23 nt, Human
agcagcccuccucaccccgucug

SEQ ID NO: 2253985 - RNA, 17 nt, Human
agcagcccuccucaccc

SEQ ID NO: 2253986 - RNA, 16 nt, Human
agcagcccuccucacc

SEQ ID NO: 2253987 - RNA, 17 nt, Human
agcacuuggagccaagg

SEQ ID NO: 2253988 - RNA, 14 nt, Human
agcacuuggagcca

SEQ ID NO: 2253989 - RNA, 13 nt, Human
agcacuugcugua

SEQ ID NO: 2253990 - RNA, 22 nt, Human
agcacuugcaaccgucuguuau

SEQ ID NO: 2253991 - RNA, 13 nt, Human
agcacuuggacuc

SEQ ID NO: 2253992 - RNA, 18 nt, Human
agcacuuggacucuugcu

SEQ ID NO: 2253993 - RNA, 20 nt, Human
agcacuuggacucuugcucu

SEQ ID NO: 2253994 - RNA, 21 nt, Human
agcacuuggacucuugcucuu

SEQ ID NO: 2253995 - RNA, 16 nt, Human
agcagcuuuaaacaaa

SEQ ID NO: 2253996 - RNA, 17 nt, Human
agcagcuucugccacuu

SEQ ID NO: 2253997 - RNA, 20 nt, Human
agcagcuucugccacuuccc

SEQ ID NO: 2253998 - RNA, 22 nt, Human
agcagcuucugccacuucccag

SEQ ID NO: 2253999 - RNA, 17 nt, Human
agcagcuuuaaacaaau

SEQ ID NO: 2254000 - RNA, 19 nt, Human
agcagcuuuaaacucaggg

SEQ ID NO: 2254001 - RNA, 20 nt, Human
agcagcuuuaaacucaggga

SEQ ID NO: 2254002 - RNA, 12 nt, Human
agcagcuuccag

SEQ ID NO: 2254003 - RNA, 14 nt, Human
agcagcuuccagau

SEQ ID NO: 2254004 - RNA, 16 nt, Human
agcagcuuccagauug

SEQ ID NO: 2254005 - RNA, 15 nt, Human
agcagcuucugccac

SEQ ID NO: 2254006 - RNA, 16 nt, Human
agcagcuucugccacu

SEQ ID NO: 2254007 - RNA, 21 nt, Human
agcagccucuccccaggucca

SEQ ID NO: 2254008 - RNA, 18 nt, Human
agcagccucuccccaggu

SEQ ID NO: 2254009 - RNA, 20 nt, Human
agcagccucuccccaggucc

SEQ ID NO: 2254010 - RNA, 19 nt, Human
agcagccugagcaacucuu

SEQ ID NO: 2254011 - RNA, 13 nt, Human
agcagccugagca

SEQ ID NO: 2254012 - RNA, 16 nt, Human
agcagcuucaccagag

SEQ ID NO: 2254013 - RNA, 18 nt, Human
agcagcuucaccagagca

SEQ ID NO: 2254014 - RNA, 16 nt, Human
agcagcuucaguuguu

SEQ ID NO: 2254015 - RNA, 17 nt, Human
agcagcuucaguuguuu

SEQ ID NO: 2254016 - RNA, 21 nt, Human
agcacgauuucuguuuagaua

SEQ ID NO: 2254017 - RNA, 19 nt, Human
agcacgauuucuguuuaga

SEQ ID NO: 2254018 - RNA, 17 nt, Human
agcacgauuucuguuua

SEQ ID NO: 2254019 - RNA, 16 nt, Human
agcacagacccugccc

SEQ ID NO: 2254020 - RNA, 15 nt, Human
agcacuuauuuaaug

SEQ ID NO: 2254021 - RNA, 13 nt, Human
agcacuuaagaga

SEQ ID NO: 2254022 - RNA, 15 nt, Human
agcacuuaagagaau

SEQ ID NO: 2254023 - RNA, 17 nt, Human
agcacuuaagagaauau

SEQ ID NO: 2254024 - RNA, 18 nt, Human
agcacuuaagagaauauu

SEQ ID NO: 2254025 - RNA, 17 nt, Human
agcacggacucuuacug

SEQ ID NO: 2254026 - RNA, 20 nt, Human
agcacggccaacaaagcugu

SEQ ID NO: 2254027 - RNA, 12 nt, Human
agcacuuaagag

SEQ ID NO: 2254028 - RNA, 16 nt, Human
agccccacccaggagg

SEQ ID NO: 2254029 - RNA, 15 nt, Human
agccccacccaggag

SEQ ID NO: 2254030 - RNA, 13 nt, Human
agccccacccagg

SEQ ID NO: 2254031 - RNA, 12 nt, Human
agccccacccag

SEQ ID NO: 2254032 - RNA, 15 nt, Human
agccccauccucugu

SEQ ID NO: 2254033 - RNA, 17 nt, Human
agccccauccucuguac

SEQ ID NO: 2254034 - RNA, 23 nt, Human
agccccauccucuguacagagcc

SEQ ID NO: 2254035 - RNA, 20 nt, Human
agccccacccaggagggagg

SEQ ID NO: 2254036 - RNA, 17 nt, Human
agccccauucugccugc

SEQ ID NO: 2254037 - RNA, 18 nt, Human
agccccauucugccugcc

SEQ ID NO: 2254038 - RNA, 19 nt, Human
agccccauucugccugccc

SEQ ID NO: 2254039 - RNA, 12 nt, Human
agcccucccugc

SEQ ID NO: 2254040 - RNA, 13 nt, Human
agcccucccugcc

SEQ ID NO: 2254041 - RNA, 21 nt, Human
agcccuccccauggagccagc

SEQ ID NO: 2254042 - RNA, 20 nt, Human
agcccuccccauggagccag

SEQ ID NO: 2254043 - RNA, 19 nt, Human
agcccuccccauggagcca

SEQ ID NO: 2254044 - RNA, 12 nt, Human
agcccuccccau

SEQ ID NO: 2254045 - RNA, 20 nt, Human
agccccacagcccacguccu

SEQ ID NO: 2254046 - RNA, 23 nt, Human
agcccuccaucuaaacugccccc

SEQ ID NO: 2254047 - RNA, 21 nt, Human
agcccuccaucuaaacugccc

SEQ ID NO: 2254048 - RNA, 17 nt, Human
agcccgggcucugccuc

SEQ ID NO: 2254049 - RNA, 18 nt, Human
agcccgggcucugccucc

SEQ ID NO: 2254050 - RNA, 20 nt, Human
agcccgggcucugccuccca

SEQ ID NO: 2254051 - RNA, 21 nt, Human
agcccgggcucugccucccau

SEQ ID NO: 2254052 - RNA, 15 nt, Human
agccccacacggagg

SEQ ID NO: 2254053 - RNA, 20 nt, Human
agccccacacuggggugccg

SEQ ID NO: 2254054 - RNA, 11 nt, Human
agccccacagc

SEQ ID NO: 2254055 - RNA, 15 nt, Human
agccccaaguccuga

SEQ ID NO: 2254056 - RNA, 19 nt, Human
agccccaaguccugaagag

SEQ ID NO: 2254057 - RNA, 13 nt, Human
agccccacagccc

SEQ ID NO: 2254058 - RNA, 12 nt, Human
agccccacagcc

SEQ ID NO: 2254059 - RNA, 14 nt, Human
agccccacagccca

SEQ ID NO: 2254060 - RNA, 15 nt, Human
agccccacagcccac

SEQ ID NO: 2254061 - RNA, 16 nt, Human
agccccacagcccacg

SEQ ID NO: 2254062 - RNA, 17 nt, Human
agccccacagcccacgu

SEQ ID NO: 2254063 - RNA, 18 nt, Human
agccccacagcccacguc

SEQ ID NO: 2254064 - RNA, 14 nt, Human
agccccaaguccug

SEQ ID NO: 2254065 - RNA, 23 nt, Human
agccccaaagucaauuaaaggcu

SEQ ID NO: 2254066 - RNA, 13 nt, Human
agcauccuggcac

SEQ ID NO: 2254067 - RNA, 22 nt, Human
agcaggaagcauucagagagca

SEQ ID NO: 2254068 - RNA, 21 nt, Human
agcaggaagcauucagagagc

SEQ ID NO: 2254069 - RNA, 23 nt, Human
agcaggaaaugaaaaugucuugu

SEQ ID NO: 2254070 - RNA, 22 nt, Human
agcagcuuuaaacucagggaca

SEQ ID NO: 2254071 - RNA, 21 nt, Human
agcagcuuuuuuuuccccccu

SEQ ID NO: 2254072 - RNA, 21 nt, Human
agcaggaaaugaaaaugucuu

SEQ ID NO: 2254073 - RNA, 15 nt, Human
agcaggaaaugaaaa

SEQ ID NO: 2254074 - RNA, 20 nt, Human
agccagcagccagcucucag

SEQ ID NO: 2254075 - RNA, 15 nt, Human
agcccaauauuauaa

SEQ ID NO: 2254076 - RNA, 16 nt, Human
agcccaauauuauaau

SEQ ID NO: 2254077 - RNA, 20 nt, Human
agcccaauauuauaauuuuu

SEQ ID NO: 2254078 - RNA, 16 nt, Human
agcccaaugaaaugaa

SEQ ID NO: 2254079 - RNA, 22 nt, Human
agccagcagacauugucagcaa

SEQ ID NO: 2254080 - RNA, 16 nt, Human
agcccacaaagccuua

SEQ ID NO: 2254081 - RNA, 17 nt, Human
agcccacaaagccuuau

SEQ ID NO: 2254082 - RNA, 15 nt, Human
agcccacacuugaga

SEQ ID NO: 2254083 - RNA, 23 nt, Human
agcccacacuugagaggaugaau

SEQ ID NO: 2254084 - RNA, 16 nt, Human
agccagcagccagcuc

SEQ ID NO: 2254085 - RNA, 14 nt, Human
agccagcagccagc

SEQ ID NO: 2254086 - RNA, 16 nt, Human
agcccaauaaaccucu

SEQ ID NO: 2254087 - RNA, 16 nt, Human
agccagcaggcucuca

SEQ ID NO: 2254088 - RNA, 17 nt, Human
agcccacacuugagagg

SEQ ID NO: 2254089 - RNA, 16 nt, Human
agcccaccccccucau

SEQ ID NO: 2254090 - RNA, 14 nt, Human
agcccaccccccuc

SEQ ID NO: 2254091 - RNA, 13 nt, Human
agcccaccccccu

SEQ ID NO: 2254092 - RNA, 15 nt, Human
agcccaccccucaac

SEQ ID NO: 2254093 - RNA, 16 nt, Human
agcccaccuuggcuca

SEQ ID NO: 2254094 - RNA, 14 nt, Human
agcccaccuuggcu

SEQ ID NO: 2254095 - RNA, 22 nt, Human
agcccacguccugucagugccg

SEQ ID NO: 2254096 - RNA, 19 nt, Human
agcccacguccugucagug

SEQ ID NO: 2254097 - RNA, 21 nt, Human
agcccacguccugucagugcc

SEQ ID NO: 2254098 - RNA, 14 nt, Human
agcccacguccugu

SEQ ID NO: 2254099 - RNA, 15 nt, Human
agcccacguccuguc

SEQ ID NO: 2254100 - RNA, 17 nt, Human
agcccacguccugucag

SEQ ID NO: 2254101 - RNA, 14 nt, Human
agcccacucugcuc

SEQ ID NO: 2254102 - RNA, 13 nt, Human
agcccacucugcu

SEQ ID NO: 2254103 - RNA, 15 nt, Human
agcccacucugcucg

SEQ ID NO: 2254104 - RNA, 23 nt, Human
agcccacgcccccacuggugaca

SEQ ID NO: 2254105 - RNA, 14 nt, Human
agcccacgccccca

SEQ ID NO: 2254106 - RNA, 20 nt, Human
agcccacgcccccacuggug

SEQ ID NO: 2254107 - RNA, 15 nt, Human
agcccacgcccccac

SEQ ID NO: 2254108 - RNA, 13 nt, Human
agccagcagccag

SEQ ID NO: 2254109 - RNA, 11 nt, Human
agccagcagcc

SEQ ID NO: 2254110 - RNA, 14 nt, Human
agccagcaggcucu

SEQ ID NO: 2254111 - RNA, 17 nt, Human
agccagaggagagagga

SEQ ID NO: 2254112 - RNA, 18 nt, Human
agccagaggagagaggac

SEQ ID NO: 2254113 - RNA, 23 nt, Human
agccaagcuccuugggaggcccc

SEQ ID NO: 2254114 - RNA, 17 nt, Human
agccaagcuccuuggga

SEQ ID NO: 2254115 - RNA, 15 nt, Human
agccaagcuccuugg

SEQ ID NO: 2254116 - RNA, 21 nt, Human
agccaagcuagaauucccucu

SEQ ID NO: 2254117 - RNA, 13 nt, Human
agccagaggagag

SEQ ID NO: 2254118 - RNA, 15 nt, Human
agccagaggagagag

SEQ ID NO: 2254119 - RNA, 16 nt, Human
agccaagcagccaagc

SEQ ID NO: 2254120 - RNA, 13 nt, Human
agccaagcagcca

SEQ ID NO: 2254121 - RNA, 18 nt, Human
agccaagcacaguggugg

SEQ ID NO: 2254122 - RNA, 21 nt, Human
agccaagcacagugguggcag

SEQ ID NO: 2254123 - RNA, 13 nt, Human
agccaagcacagu

SEQ ID NO: 2254124 - RNA, 14 nt, Human
agccaagcacagug

SEQ ID NO: 2254125 - RNA, 16 nt, Human
agccaagcacaguggu

SEQ ID NO: 2254126 - RNA, 17 nt, Human
agccaagcacaguggug

SEQ ID NO: 2254127 - RNA, 19 nt, Human
agccaagauugcgccauug

SEQ ID NO: 2254128 - RNA, 12 nt, Human
agccaaagccaa

SEQ ID NO: 2254129 - RNA, 19 nt, Human
agccaagaucgcgccacug

SEQ ID NO: 2254130 - RNA, 15 nt, Human
agccaaagauaaucu

SEQ ID NO: 2254131 - RNA, 12 nt, Human
agccaaagaaaa

SEQ ID NO: 2254132 - RNA, 11 nt, Human
agccaaagagu

SEQ ID NO: 2254133 - RNA, 16 nt, Human
agccaaagcuaggccu

SEQ ID NO: 2254134 - RNA, 18 nt, Human
agccaaagcuaggccugg

SEQ ID NO: 2254135 - RNA, 14 nt, Human
agcauccuggcacc

SEQ ID NO: 2254136 - RNA, 17 nt, Human
agcauccuggcacccgg

SEQ ID NO: 2254137 - RNA, 15 nt, Human
agccaaacucugcca

SEQ ID NO: 2254138 - RNA, 14 nt, Human
agccaaacucugcc

SEQ ID NO: 2254139 - RNA, 13 nt, Human
agccaaagaaaaa

SEQ ID NO: 2254140 - RNA, 16 nt, Human
agccaaaccucuguga

SEQ ID NO: 2254141 - RNA, 17 nt, Human
acuuuccuccuggcaga

SEQ ID NO: 2254142 - RNA, 21 nt, Human
acuuuccucuuagucgagcca

SEQ ID NO: 2254143 - RNA, 21 nt, Human
acuuuccucuuuggucuacac

SEQ ID NO: 2254144 - RNA, 19 nt, Human
acuuuccuccugaggcuuu

SEQ ID NO: 2254145 - RNA, 13 nt, Human
agaagacacugau

SEQ ID NO: 2254146 - RNA, 14 nt, Human
agaagacaccagag

SEQ ID NO: 2254147 - RNA, 15 nt, Human
agaagacaccagagc

SEQ ID NO: 2254148 - RNA, 16 nt, Human
agaagacaccagagca

SEQ ID NO: 2254149 - RNA, 17 nt, Human
agaagacaccagagcag

SEQ ID NO: 2254150 - RNA, 18 nt, Human
agaagacaccagagcaga

SEQ ID NO: 2254151 - RNA, 19 nt, Human
agaagacaccagagcagau

SEQ ID NO: 2254152 - RNA, 22 nt, Human
agaagacaccagagcagaugca

SEQ ID NO: 2254153 - RNA, 16 nt, Human
agaagacaugaaccaa

SEQ ID NO: 2254154 - RNA, 14 nt, Human
agaagacauggaga

SEQ ID NO: 2254155 - RNA, 15 nt, Human
agaagacaugaacca

SEQ ID NO: 2254156 - RNA, 12 nt, Human
agaagacacugc

SEQ ID NO: 2254157 - RNA, 23 nt, Human
agaagacaccagagcagaugcag

SEQ ID NO: 2254158 - RNA, 12 nt, Human
agaagacaugaa

SEQ ID NO: 2254159 - RNA, 21 nt, Human
agaagacacugaugggcaacc

SEQ ID NO: 2254160 - RNA, 22 nt, Human
agaagagaguccauauuucaau

SEQ ID NO: 2254161 - RNA, 22 nt, Human
agaagagaggagaggagagagg

SEQ ID NO: 2254162 - RNA, 15 nt, Human
agaagagaggagagg

SEQ ID NO: 2254163 - RNA, 16 nt, Human
agaagagaggagagga

SEQ ID NO: 2254164 - RNA, 20 nt, Human
agaagagaggagaggagaga

SEQ ID NO: 2254165 - RNA, 21 nt, Human
agaagagaggagaggagagag

SEQ ID NO: 2254166 - RNA, 21 nt, Human
agaagagauugugguuucauu

SEQ ID NO: 2254167 - RNA, 21 nt, Human
agaagagcuguucacagccag

SEQ ID NO: 2254168 - RNA, 22 nt, Human
agaagagcuguucacagccaga

SEQ ID NO: 2254169 - RNA, 15 nt, Human
agaagagagaaauag

SEQ ID NO: 2254170 - RNA, 15 nt, Human
agaagagagaucaaa

SEQ ID NO: 2254171 - RNA, 13 nt, Human
agaagagaggaga

SEQ ID NO: 2254172 - RNA, 18 nt, Human
agaagagacucuuugcau

SEQ ID NO: 2254173 - RNA, 20 nt, Human
agaagacucuaccagacugu

SEQ ID NO: 2254174 - RNA, 12 nt, Human
agaagagacagg

SEQ ID NO: 2254175 - RNA, 18 nt, Human
agaagacugcauuauauu

SEQ ID NO: 2254176 - RNA, 21 nt, Human
agaagaccacaaaaauugacu

SEQ ID NO: 2254177 - RNA, 17 nt, Human
agaagacauguuuuaga

SEQ ID NO: 2254178 - RNA, 19 nt, Human
agaagacauguuuuagaca

SEQ ID NO: 2254179 - RNA, 14 nt, Human
agaagacucuacca

SEQ ID NO: 2254180 - RNA, 14 nt, Human
agaagacccuucuc

SEQ ID NO: 2254181 - RNA, 19 nt, Human
agaagacucuaccagacug

SEQ ID NO: 2254182 - RNA, 16 nt, Human
agaagacauggagacu

SEQ ID NO: 2254183 - RNA, 19 nt, Human
agaagacauggagacuccu

SEQ ID NO: 2254184 - RNA, 20 nt, Human
agaagacauggagacuccug

SEQ ID NO: 2254185 - RNA, 22 nt, Human
agaagacauggagacuccugcc

SEQ ID NO: 2254186 - RNA, 13 nt, Human
agaagacauguuu

SEQ ID NO: 2254187 - RNA, 14 nt, Human
agaagacauguuuu

SEQ ID NO: 2254188 - RNA, 15 nt, Human
agaagacauguuuua

SEQ ID NO: 2254189 - RNA, 16 nt, Human
agaagacauguuuuag

SEQ ID NO: 2254190 - RNA, 17 nt, Human
agaagguuuguguuuuu

SEQ ID NO: 2254191 - RNA, 19 nt, Human
agaagguuuguguuuuucu

SEQ ID NO: 2254192 - RNA, 20 nt, Human
agaagguuuguguuuuucug

SEQ ID NO: 2254193 - RNA, 18 nt, Human
agaagguuucagaaagaa

SEQ ID NO: 2254194 - RNA, 20 nt, Human
agaagguuaccaagaagccu

SEQ ID NO: 2254195 - RNA, 20 nt, Human
agaagguugcucuagauuga

SEQ ID NO: 2254196 - RNA, 16 nt, Human
agaagguugcucuaga

SEQ ID NO: 2254197 - RNA, 14 nt, Human
agaaguaacuuacu

SEQ ID NO: 2254198 - RNA, 21 nt, Human
agaaguacugcccuuuugugu

SEQ ID NO: 2254199 - RNA, 13 nt, Human
agaaguauacaua

SEQ ID NO: 2254200 - RNA, 17 nt, Human
agaaguaggcaugaggg

SEQ ID NO: 2254201 - RNA, 19 nt, Human
agaaguagauuaagagcca

SEQ ID NO: 2254202 - RNA, 21 nt, Human
agaaguaggcaugagggauca

SEQ ID NO: 2254203 - RNA, 13 nt, Human
agaaguagauuaa

SEQ ID NO: 2254204 - RNA, 20 nt, Human
agaaguagauuaagagccau

SEQ ID NO: 2254205 - RNA, 14 nt, Human
agaaguauuauaaa

SEQ ID NO: 2254206 - RNA, 19 nt, Human
agaaguauuauaaauuaug

SEQ ID NO: 2254207 - RNA, 17 nt, Human
agaagggggccaugagg

SEQ ID NO: 2254208 - RNA, 13 nt, Human
agaaggggguggu

SEQ ID NO: 2254209 - RNA, 20 nt, Human
agaaggggguggugucucca

SEQ ID NO: 2254210 - RNA, 13 nt, Human
agaagauagcagg

SEQ ID NO: 2254211 - RNA, 20 nt, Human
agaagagaugggcuuguuuu

SEQ ID NO: 2254212 - RNA, 17 nt, Human
agaagaggcuggugcug

SEQ ID NO: 2254213 - RNA, 22 nt, Human
agaagaggcuggugcuguggcc

SEQ ID NO: 2254214 - RNA, 22 nt, Human
agaagagaugggcuuguuuucu

SEQ ID NO: 2254215 - RNA, 24 nt, Human
agaagagggccugugggagccugc

SEQ ID NO: 2254216 - RNA, 15 nt, Human
agaagagggguuuuu

SEQ ID NO: 2254217 - RNA, 12 nt, Human
agaagagggaga

SEQ ID NO: 2254218 - RNA, 14 nt, Human
agaagagggccugu

SEQ ID NO: 2254219 - RNA, 16 nt, Human
agaagagggccugugg

SEQ ID NO: 2254220 - RNA, 18 nt, Human
agaagagggccuguggga

SEQ ID NO: 2254221 - RNA, 21 nt, Human
agaagguccuuaaugauccgu

SEQ ID NO: 2254222 - RNA, 20 nt, Human
agaaggucggaggcuuggga

SEQ ID NO: 2254223 - RNA, 20 nt, Human
agaagguccuuaaugauccg

SEQ ID NO: 2254224 - RNA, 14 nt, Human
agaagguccuuaau

SEQ ID NO: 2254225 - RNA, 21 nt, Human
agaaggugccucaagaauuuc

SEQ ID NO: 2254226 - RNA, 22 nt, Human
agaagguggguuuucaucaaga

SEQ ID NO: 2254227 - RNA, 18 nt, Human
agaagguuaccaagaagc

SEQ ID NO: 2254228 - RNA, 20 nt, Human
agaaggguuuuccacccugg

SEQ ID NO: 2254229 - RNA, 19 nt, Human
agaaggguuauauuuuacu

SEQ ID NO: 2254230 - RNA, 16 nt, Human
agaaggguuauauuuu

SEQ ID NO: 2254231 - RNA, 23 nt, Human
agaaggguccuucccucucccca

SEQ ID NO: 2254232 - RNA, 20 nt, Human
agaaggguccuucccucucc

SEQ ID NO: 2254233 - RNA, 18 nt, Human
agaaggguccuucccucu

SEQ ID NO: 2254234 - RNA, 15 nt, Human
agaaggguccuuccc

SEQ ID NO: 2254235 - RNA, 22 nt, Human
agaaggguuuuccacccuggaa

SEQ ID NO: 2254236 - RNA, 21 nt, Human
agaaggguuuuccacccugga

SEQ ID NO: 2254237 - RNA, 23 nt, Human
agaaggguuuuccacccuggaau

SEQ ID NO: 2254238 - RNA, 21 nt, Human
agaagguauuccuuuugugua

SEQ ID NO: 2254239 - RNA, 16 nt, Human
agaagugaaugcuggg

SEQ ID NO: 2254240 - RNA, 17 nt, Human
agaagucaugaagccca

SEQ ID NO: 2254241 - RNA, 21 nt, Human
agaagugaaaaucuacacucc

SEQ ID NO: 2254242 - RNA, 13 nt, Human
agaagucaugaag

SEQ ID NO: 2254243 - RNA, 22 nt, Human
agaagucagagagggugacaag

SEQ ID NO: 2254244 - RNA, 16 nt, Human
agaaguauuauaaauu

SEQ ID NO: 2254245 - RNA, 14 nt, Human
agaagucaaaguaa

SEQ ID NO: 2254246 - RNA, 18 nt, Human
agaaugaaagggcccaga

SEQ ID NO: 2254247 - RNA, 17 nt, Human
agaagugaaugcuggga

SEQ ID NO: 2254248 - RNA, 19 nt, Human
agaagugaaugcugggacu

SEQ ID NO: 2254249 - RNA, 21 nt, Human
agaagugaaugcugggacuca

SEQ ID NO: 2254250 - RNA, 12 nt, Human
agaagugacagg

SEQ ID NO: 2254251 - RNA, 20 nt, Human
agaaugaaauugcugaaaga

SEQ ID NO: 2254252 - RNA, 20 nt, Human
agaaugaaauacuguuugag

SEQ ID NO: 2254253 - RNA, 19 nt, Human
agaaugaaauacuguuuga

SEQ ID NO: 2254254 - RNA, 16 nt, Human
agaaugaaauacuguu

SEQ ID NO: 2254255 - RNA, 13 nt, Human
agaagugacaggg

SEQ ID NO: 2254256 - RNA, 14 nt, Human
agaagugacaggga

SEQ ID NO: 2254257 - RNA, 17 nt, Human
agaagugacagggaagc

SEQ ID NO: 2254258 - RNA, 14 nt, Human
agaaugagagugug

SEQ ID NO: 2254259 - RNA, 17 nt, Human
agaaugauuaugaauua

SEQ ID NO: 2254260 - RNA, 19 nt, Human
agaaugcacaaacagaggc

SEQ ID NO: 2254261 - RNA, 22 nt, Human
agaaugcacaaacagaggccgc

SEQ ID NO: 2254262 - RNA, 15 nt, Human
agaaugaacaaauug

SEQ ID NO: 2254263 - RNA, 16 nt, Human
agaagugacagggaag

SEQ ID NO: 2254264 - RNA, 17 nt, Human
agaaugagagacacacu

SEQ ID NO: 2254265 - RNA, 22 nt, Human
agaaugagagacacacugaaga

SEQ ID NO: 2254266 - RNA, 18 nt, Human
agaaugcugguuuuccua

SEQ ID NO: 2254267 - RNA, 13 nt, Human
agaaugcugguuu

SEQ ID NO: 2254268 - RNA, 13 nt, Human
agaaugcuguaca

SEQ ID NO: 2254269 - RNA, 22 nt, Human
agaaugcugcaggacuugagaa

SEQ ID NO: 2254270 - RNA, 12 nt, Human
agaaugcugaaa

SEQ ID NO: 2254271 - RNA, 17 nt, Human
agaaugcugaaaccaag

SEQ ID NO: 2254272 - RNA, 14 nt, Human
agaaugauuucaug

SEQ ID NO: 2254273 - RNA, 13 nt, Human
agaaugauuucau

SEQ ID NO: 2254274 - RNA, 21 nt, Human
agaaugagccuacgcugaaga

SEQ ID NO: 2254275 - RNA, 16 nt, Human
agaaugauuuuuagau

SEQ ID NO: 2254276 - RNA, 11 nt, Human
agaaugcugaa

SEQ ID NO: 2254277 - RNA, 15 nt, Human
agaaugcuguacauc

SEQ ID NO: 2254278 - RNA, 14 nt, Human
agaaugcuguacau

SEQ ID NO: 2254279 - RNA, 20 nt, Human
agaaugcuguacaucuauuu

SEQ ID NO: 2254280 - RNA, 17 nt, Human
agaaugggaauauuuua

SEQ ID NO: 2254281 - RNA, 13 nt, Human
agaccagcucuuc

SEQ ID NO: 2254282 - RNA, 12 nt, Human
agaccagcucuu

SEQ ID NO: 2254283 - RNA, 15 nt, Human
agaccagccuggcca

SEQ ID NO: 2254284 - RNA, 13 nt, Human
agaccagccuggc

SEQ ID NO: 2254285 - RNA, 14 nt, Human
agaccagccuggcc

SEQ ID NO: 2254286 - RNA, 12 nt, Human
agaccagccugg

SEQ ID NO: 2254287 - RNA, 19 nt, Human
agacccaaaaggcagaagc

SEQ ID NO: 2254288 - RNA, 17 nt, Human
agacccaaaaggcagaa

SEQ ID NO: 2254289 - RNA, 17 nt, Human
agacccagcccucaucc

SEQ ID NO: 2254290 - RNA, 16 nt, Human
agacccaaggaggaaa

SEQ ID NO: 2254291 - RNA, 14 nt, Human
agacccaaggagga

SEQ ID NO: 2254292 - RNA, 17 nt, Human
agacgaugucuucauac

SEQ ID NO: 2254293 - RNA, 19 nt, Human
agacccagcccucaucccg

SEQ ID NO: 2254294 - RNA, 18 nt, Human
agacccagcccucauccc

SEQ ID NO: 2254295 - RNA, 16 nt, Human
agacgaugucuucaua

SEQ ID NO: 2254296 - RNA, 19 nt, Human
agacgaugucuucauaccu

SEQ ID NO: 2254297 - RNA, 15 nt, Human
agacgccaccauucc

SEQ ID NO: 2254298 - RNA, 17 nt, Human
agacgccaccauuccug

SEQ ID NO: 2254299 - RNA, 20 nt, Human
agacgccaccauuccuggaa

SEQ ID NO: 2254300 - RNA, 15 nt, Human
agacgccugaggaac

SEQ ID NO: 2254301 - RNA, 15 nt, Human
agacgccugagcuca

SEQ ID NO: 2254302 - RNA, 13 nt, Human
agacgccugagga

SEQ ID NO: 2254303 - RNA, 20 nt, Human
agacgccggggacagaggcc

SEQ ID NO: 2254304 - RNA, 22 nt, Human
agacgccggggacagaggccug

SEQ ID NO: 2254305 - RNA, 16 nt, Human
agaccagacuguggag

SEQ ID NO: 2254306 - RNA, 17 nt, Human
agaccagacuguggaga

SEQ ID NO: 2254307 - RNA, 18 nt, Human
agaccagacuguggagaa

SEQ ID NO: 2254308 - RNA, 22 nt, Human
agaccagacuguggagaaauaa

SEQ ID NO: 2254309 - RNA, 15 nt, Human
agaccacguuucuaa

SEQ ID NO: 2254310 - RNA, 18 nt, Human
agacagccacauugggca

SEQ ID NO: 2254311 - RNA, 14 nt, Human
agaccagacugugg

SEQ ID NO: 2254312 - RNA, 16 nt, Human
agacagcagcucaggc

SEQ ID NO: 2254313 - RNA, 22 nt, Human
agacagccaacuauggccugug

SEQ ID NO: 2254314 - RNA, 14 nt, Human
agacagcagcucag

SEQ ID NO: 2254315 - RNA, 12 nt, Human
agacagcagcuc

SEQ ID NO: 2254316 - RNA, 19 nt, Human
agacagaugccccagagcu

SEQ ID NO: 2254317 - RNA, 16 nt, Human
agacagaugccccaga

SEQ ID NO: 2254318 - RNA, 15 nt, Human
agacagaugccccag

SEQ ID NO: 2254319 - RNA, 14 nt, Human
agacagaugcccca

SEQ ID NO: 2254320 - RNA, 22 nt, Human
agacagauacuccuccaagguu

SEQ ID NO: 2254321 - RNA, 21 nt, Human
agacagagucucacuguugcc

SEQ ID NO: 2254322 - RNA, 12 nt, Human
agacagagcugg

SEQ ID NO: 2254323 - RNA, 21 nt, Human
agacagagcugguugggaaga

SEQ ID NO: 2254324 - RNA, 15 nt, Human
agacagagcucacaa

SEQ ID NO: 2254325 - RNA, 13 nt, Human
agacagagcuaca

SEQ ID NO: 2254326 - RNA, 11 nt, Human
agacagagucu

SEQ ID NO: 2254327 - RNA, 19 nt, Human
agacagagucucacuguug

SEQ ID NO: 2254328 - RNA, 20 nt, Human
agacagagucucacuguugc

SEQ ID NO: 2254329 - RNA, 18 nt, Human
agacaaauggaggaauau

SEQ ID NO: 2254330 - RNA, 14 nt, Human
agacaaauggagga

SEQ ID NO: 2254331 - RNA, 18 nt, Human
agacaaaugcugcgcccu

SEQ ID NO: 2254332 - RNA, 15 nt, Human
agacagagcuacaca

SEQ ID NO: 2254333 - RNA, 22 nt, Human
agacaaugacuuacuguacaug

SEQ ID NO: 2254334 - RNA, 21 nt, Human
agacaaugacuuacuguacau

SEQ ID NO: 2254335 - RNA, 17 nt, Human
agacaaaccagaagcaa

SEQ ID NO: 2254336 - RNA, 19 nt, Human
agacaaacaccucccagga

SEQ ID NO: 2254337 - RNA, 16 nt, Human
agacaaaccagaagca

SEQ ID NO: 2254338 - RNA, 18 nt, Human
agacaaagguuuuccucu

SEQ ID NO: 2254339 - RNA, 18 nt, Human
agacaaauacucaugugu

SEQ ID NO: 2254340 - RNA, 20 nt, Human
agacaaauacucauguguau

SEQ ID NO: 2254341 - RNA, 13 nt, Human
agacaaauacuca

SEQ ID NO: 2254342 - RNA, 14 nt, Human
agacaaauacucau

SEQ ID NO: 2254343 - RNA, 17 nt, Human
agacaaauacucaugug

SEQ ID NO: 2254344 - RNA, 12 nt, Human
agacaaauauuu

SEQ ID NO: 2254345 - RNA, 15 nt, Human
agacaaauauuugga

SEQ ID NO: 2254346 - RNA, 16 nt, Human
agacaaaucaaagcag

SEQ ID NO: 2254347 - RNA, 16 nt, Human
agacaaauauuuggag

SEQ ID NO: 2254348 - RNA, 23 nt, Human
agacaaaucuaugccacucagaa

SEQ ID NO: 2254349 - RNA, 20 nt, Human
agacaaugacuuacuguaca

SEQ ID NO: 2254350 - RNA, 15 nt, Human
agagagagaggacag

SEQ ID NO: 2254351 - RNA, 15 nt, Human
agagagagagagaga

SEQ ID NO: 2254352 - RNA, 15 nt, Human
agagagagagagagg

SEQ ID NO: 2254353 - RNA, 13 nt, Human
agagagagagagg

SEQ ID NO: 2254354 - RNA, 14 nt, Human
agagagagaggaca

SEQ ID NO: 2254355 - RNA, 14 nt, Human
agagagaguguuug

SEQ ID NO: 2254356 - RNA, 20 nt, Human
agagaggccuuuuggaaugu

SEQ ID NO: 2254357 - RNA, 14 nt, Human
agagaggccuuuug

SEQ ID NO: 2254358 - RNA, 15 nt, Human
agagagggagaagaa

SEQ ID NO: 2254359 - RNA, 16 nt, Human
agagagggagaagaag

SEQ ID NO: 2254360 - RNA, 19 nt, Human
agagagggagaagaaguca

SEQ ID NO: 2254361 - RNA, 16 nt, Human
agagaggccuuguccc

SEQ ID NO: 2254362 - RNA, 18 nt, Human
agagagggaggcaagccc

SEQ ID NO: 2254363 - RNA, 17 nt, Human
agagagggaggcaagcc

SEQ ID NO: 2254364 - RNA, 17 nt, Human
agagagggagguaugga

SEQ ID NO: 2254365 - RNA, 15 nt, Human
agagagggcagaggg

SEQ ID NO: 2254366 - RNA, 15 nt, Human
agagagggcaggcau

SEQ ID NO: 2254367 - RNA, 14 nt, Human
agagagggcaggca

SEQ ID NO: 2254368 - RNA, 15 nt, Human
agagagggcuuuaau

SEQ ID NO: 2254369 - RNA, 14 nt, Human
agagagggggccac

SEQ ID NO: 2254370 - RNA, 16 nt, Human
agagagggggccaccu

SEQ ID NO: 2254371 - RNA, 19 nt, Human
agagagggggccaccuccc

SEQ ID NO: 2254372 - RNA, 22 nt, Human
agagaggggaauaauagaagaa

SEQ ID NO: 2254373 - RNA, 19 nt, Human
agagagggguacauuuccc

SEQ ID NO: 2254374 - RNA, 13 nt, Human
agagccagggucu

SEQ ID NO: 2254375 - RNA, 13 nt, Human
agagcccaccuug

SEQ ID NO: 2254376 - RNA, 19 nt, Human
agagccauggacucuacac

SEQ ID NO: 2254377 - RNA, 16 nt, Human
agagccaugcugggaa

SEQ ID NO: 2254378 - RNA, 20 nt, Human
agagccauauaaguuugaag

SEQ ID NO: 2254379 - RNA, 22 nt, Human
agagccauauaaguuugaagga

SEQ ID NO: 2254380 - RNA, 19 nt, Human
agagccauauaaguuugaa

SEQ ID NO: 2254381 - RNA, 11 nt, Human
agacuggaggg

SEQ ID NO: 2254382 - RNA, 18 nt, Human
agacuggagcaucugacu

SEQ ID NO: 2254383 - RNA, 15 nt, Human
agacuggagcaucug

SEQ ID NO: 2254384 - RNA, 16 nt, Human
agacuggagcaucuga

SEQ ID NO: 2254385 - RNA, 14 nt, Human
agacuggagcaucu

SEQ ID NO: 2254386 - RNA, 21 nt, Human
agacuggaagcuaauuugcau

SEQ ID NO: 2254387 - RNA, 11 nt, Human
agacuggaagg

SEQ ID NO: 2254388 - RNA, 17 nt, Human
agacugcuucccauccu

SEQ ID NO: 2254389 - RNA, 21 nt, Human
agacugcuucccauccuaccc

SEQ ID NO: 2254390 - RNA, 22 nt, Human
agacugcuucccauccuacccu

SEQ ID NO: 2254391 - RNA, 23 nt, Human
agacugcuucccauccuacccuc

SEQ ID NO: 2254392 - RNA, 20 nt, Human
agacuggaagcuaauuugca

SEQ ID NO: 2254393 - RNA, 13 nt, Human
agagagagaagug

SEQ ID NO: 2254394 - RNA, 17 nt, Human
agagagagagacagaga

SEQ ID NO: 2254395 - RNA, 16 nt, Human
agagagaccacuuuuc

SEQ ID NO: 2254396 - RNA, 16 nt, Human
agacuggauacugccc

SEQ ID NO: 2254397 - RNA, 15 nt, Human
agacuggauacugcc

SEQ ID NO: 2254398 - RNA, 23 nt, Human
agacuggaggggacgcugguaga

SEQ ID NO: 2254399 - RNA, 13 nt, Human
agacuggagggga

SEQ ID NO: 2254400 - RNA, 15 nt, Human
agagagaagugcccc

SEQ ID NO: 2254401 - RNA, 11 nt, Human
agagagaagcc

SEQ ID NO: 2254402 - RNA, 19 nt, Human
agagagaagugccccugcu

SEQ ID NO: 2254403 - RNA, 14 nt, Human
agagcccuugccuc

SEQ ID NO: 2254404 - RNA, 16 nt, Human
agagccgggaagcgau

SEQ ID NO: 2254405 - RNA, 13 nt, Human
agagccgggaagc

SEQ ID NO: 2254406 - RNA, 17 nt, Human
agagccauuuugugaau

SEQ ID NO: 2254407 - RNA, 19 nt, Human
agagcccuugccuccccau

SEQ ID NO: 2254408 - RNA, 15 nt, Human
agagcccuucauuug

SEQ ID NO: 2254409 - RNA, 16 nt, Human
agagccauuuugugaa

SEQ ID NO: 2254410 - RNA, 18 nt, Human
agagccauguagaagcug

SEQ ID NO: 2254411 - RNA, 20 nt, Human
agagccauguagaagcugca

SEQ ID NO: 2254412 - RNA, 17 nt, Human
agagccgugaugccucc

SEQ ID NO: 2254413 - RNA, 15 nt, Human
agagccugagaguga

SEQ ID NO: 2254414 - RNA, 22 nt, Human
agagccucccucaauucccccu

SEQ ID NO: 2254415 - RNA, 13 nt, Human
agacugagcucaa

SEQ ID NO: 2254416 - RNA, 19 nt, Human
agacugcugggacuggcca

SEQ ID NO: 2254417 - RNA, 22 nt, Human
agacugaguacguugugcauuu

SEQ ID NO: 2254418 - RNA, 22 nt, Human
agacugcugggacuggccaggu

SEQ ID NO: 2254419 - RNA, 20 nt, Human
agacugcugggacuggccag

SEQ ID NO: 2254420 - RNA, 17 nt, Human
agacugagcaccugcuu

SEQ ID NO: 2254421 - RNA, 19 nt, Human
agacugcuuccaauuuucu

SEQ ID NO: 2254422 - RNA, 14 nt, Human
agacugcuucccau

SEQ ID NO: 2254423 - RNA, 16 nt, Human
agacugcuucccaucc

SEQ ID NO: 2254424 - RNA, 20 nt, Human
agacugcuguguuugagcuc

SEQ ID NO: 2254425 - RNA, 16 nt, Human
agacugagcaccugcu

SEQ ID NO: 2254426 - RNA, 22 nt, Human
agacugaccaauauuguacagu

SEQ ID NO: 2254427 - RNA, 20 nt, Human
agacugaguacguugugcau

SEQ ID NO: 2254428 - RNA, 16 nt, Human
agacucuguggggccu

SEQ ID NO: 2254429 - RNA, 18 nt, Human
agacucugucucagucca

SEQ ID NO: 2254430 - RNA, 18 nt, Human
agacucugucucaaaaaa

SEQ ID NO: 2254431 - RNA, 13 nt, Human
agacucugucuca

SEQ ID NO: 2254432 - RNA, 16 nt, Human
agacgcugugcugccc

SEQ ID NO: 2254433 - RNA, 12 nt, Human
agagggggccac

SEQ ID NO: 2254434 - RNA, 14 nt, Human
agaggggggcugcc

SEQ ID NO: 2254435 - RNA, 22 nt, Human
agaggggggaagaucaggucau

SEQ ID NO: 2254436 - RNA, 12 nt, Human
agagggcuuccu

SEQ ID NO: 2254437 - RNA, 17 nt, Human
agaggggguggccuccc

SEQ ID NO: 2254438 - RNA, 19 nt, Human
agaggggguggccucccaa

SEQ ID NO: 2254439 - RNA, 16 nt, Human
agaggagugacugagc

SEQ ID NO: 2254440 - RNA, 14 nt, Human
agaggagugcuugu

SEQ ID NO: 2254441 - RNA, 12 nt, Human
agaggaguucaa

SEQ ID NO: 2254442 - RNA, 13 nt, Human
agaggaguucaau

SEQ ID NO: 2254443 - RNA, 15 nt, Human
agagggccuguggga

SEQ ID NO: 2254444 - RNA, 16 nt, Human
agagggccugugggag

SEQ ID NO: 2254445 - RNA, 19 nt, Human
agagggccugugggagccu

SEQ ID NO: 2254446 - RNA, 13 nt, Human
agagggccugcaa

SEQ ID NO: 2254447 - RNA, 16 nt, Human
agagggccugcaaggg

SEQ ID NO: 2254448 - RNA, 23 nt, Human
agaggaaucagacuucacacugc

SEQ ID NO: 2254449 - RNA, 14 nt, Human
agaggacuuuucuu

SEQ ID NO: 2254450 - RNA, 21 nt, Human
agaggacuuuucuuuguggcu

SEQ ID NO: 2254451 - RNA, 22 nt, Human
agaggacuuuucuuuguggcuu

SEQ ID NO: 2254452 - RNA, 17 nt, Human
agaggagggaugcugcc

SEQ ID NO: 2254453 - RNA, 21 nt, Human
agaggagcgggaccuguggcu

SEQ ID NO: 2254454 - RNA, 19 nt, Human
agaggagggcgugacucac

SEQ ID NO: 2254455 - RNA, 23 nt, Human
agaggagggcagcagaagggggu

SEQ ID NO: 2254456 - RNA, 21 nt, Human
agaggagggcgugacucaccc

SEQ ID NO: 2254457 - RNA, 12 nt, Human
agaggaggggcc

SEQ ID NO: 2254458 - RNA, 18 nt, Human
agaggaggggccgcugcc

SEQ ID NO: 2254459 - RNA, 14 nt, Human
agaggaggggccgc

SEQ ID NO: 2254460 - RNA, 14 nt, Human
agaggagucagaga

SEQ ID NO: 2254461 - RNA, 20 nt, Human
agaggaguacaggugaagca

SEQ ID NO: 2254462 - RNA, 22 nt, Human
agaggaggggccgcugccaccc

SEQ ID NO: 2254463 - RNA, 20 nt, Human
agaggaggggccgcugccac

SEQ ID NO: 2254464 - RNA, 23 nt, Human
agaggacuuuucuuuguggcuuc

SEQ ID NO: 2254465 - RNA, 23 nt, Human
agaggagggagcaucagugcccu

SEQ ID NO: 2254466 - RNA, 19 nt, Human
agaggagcgggaccugugg

SEQ ID NO: 2254467 - RNA, 20 nt, Human
agaggagcgggaccuguggc

SEQ ID NO: 2254468 - RNA, 24 nt, Human
agaggaaucagacuucacacugca

SEQ ID NO: 2254469 - RNA, 22 nt, Human
agaggaaucacucuuguggaug

SEQ ID NO: 2254470 - RNA, 23 nt, Human
agaggaaggggccagaggcucgu

SEQ ID NO: 2254471 - RNA, 13 nt, Human
agaggaaugaagu

SEQ ID NO: 2254472 - RNA, 20 nt, Human
agaggaaggggccagaggcu

SEQ ID NO: 2254473 - RNA, 18 nt, Human
agaggaaggggccagagg

SEQ ID NO: 2254474 - RNA, 16 nt, Human
agaggaaggggccaga

SEQ ID NO: 2254475 - RNA, 19 nt, Human
auccuucccugucugccag

SEQ ID NO: 2254476 - RNA, 22 nt, Human
auccuucccugucugccagggc

SEQ ID NO: 2254477 - RNA, 20 nt, Human
auccuucaagaacucugggc

SEQ ID NO: 2254478 - RNA, 16 nt, Human
auccuugagucaaaaa

SEQ ID NO: 2254479 - RNA, 22 nt, Human
auccuuguauaaaaaaaauagu

SEQ ID NO: 2254480 - RNA, 15 nt, Human
auccucacugggugg

SEQ ID NO: 2254481 - RNA, 15 nt, Human
auccucaauccagcu

SEQ ID NO: 2254482 - RNA, 12 nt, Human
auccucaaucca

SEQ ID NO: 2254483 - RNA, 17 nt, Human
auccucauacccacccc

SEQ ID NO: 2254484 - RNA, 14 nt, Human
auccucacugggug

SEQ ID NO: 2254485 - RNA, 13 nt, Human
auccuuacaaguu

SEQ ID NO: 2254486 - RNA, 19 nt, Human
aucgcccuccacaucccug

SEQ ID NO: 2254487 - RNA, 22 nt, Human
aucgcaucauugcacucuagcc

SEQ ID NO: 2254488 - RNA, 14 nt, Human
auccuuuccagcau

SEQ ID NO: 2254489 - RNA, 17 nt, Human
auccuuuccagcaugag

SEQ ID NO: 2254490 - RNA, 17 nt, Human
auccuuuaaauccuucc

SEQ ID NO: 2254491 - RNA, 12 nt, Human
auccuuguuuca

SEQ ID NO: 2254492 - RNA, 13 nt, Human
auccuuguuucaa

SEQ ID NO: 2254493 - RNA, 14 nt, Human
auccuuguuucaaa

SEQ ID NO: 2254494 - RNA, 16 nt, Human
auccuuguuucaaaca

SEQ ID NO: 2254495 - RNA, 23 nt, Human
auccuuguuucaaacacaaaugc

SEQ ID NO: 2254496 - RNA, 20 nt, Human
aucgcggcggagcuggcccc

SEQ ID NO: 2254497 - RNA, 22 nt, Human
aucgcggcggagcuggccccgc

SEQ ID NO: 2254498 - RNA, 23 nt, Human
aucgcgccacuacacuccagccu

SEQ ID NO: 2254499 - RNA, 12 nt, Human
aucgccuuuccc

SEQ ID NO: 2254500 - RNA, 21 nt, Human
auccacucuacccucccaccc

SEQ ID NO: 2254501 - RNA, 20 nt, Human
auccacucuacccucccacc

SEQ ID NO: 2254502 - RNA, 19 nt, Human
auccacucuacccucccac

SEQ ID NO: 2254503 - RNA, 18 nt, Human
auccacucuacccuccca

SEQ ID NO: 2254504 - RNA, 19 nt, Human
auccagacccggcugcgug

SEQ ID NO: 2254505 - RNA, 21 nt, Human
auccaccugucucagccuccc

SEQ ID NO: 2254506 - RNA, 18 nt, Human
auccaccugucucagccu

SEQ ID NO: 2254507 - RNA, 13 nt, Human
auccaccugucuc

SEQ ID NO: 2254508 - RNA, 16 nt, Human
auccacucuacccucc

SEQ ID NO: 2254509 - RNA, 19 nt, Human
auccacuagugcaaaucau

SEQ ID NO: 2254510 - RNA, 21 nt, Human
auccacuagugcaaaucauag

SEQ ID NO: 2254511 - RNA, 13 nt, Human
auccacucgccuu

SEQ ID NO: 2254512 - RNA, 10 nt, Human
auccaccucc

SEQ ID NO: 2254513 - RNA, 12 nt, Human
auccaccuccau

SEQ ID NO: 2254514 - RNA, 14 nt, Human
auccaccuccaucu

SEQ ID NO: 2254515 - RNA, 22 nt, Human
auccaccuccaucuucuuugca

SEQ ID NO: 2254516 - RNA, 13 nt, Human
auccaccuccuuc

SEQ ID NO: 2254517 - RNA, 14 nt, Human
auccaccuccuucu

SEQ ID NO: 2254518 - RNA, 15 nt, Human
auccaccuccuucuc

SEQ ID NO: 2254519 - RNA, 16 nt, Human
aucccauucugcguca

SEQ ID NO: 2254520 - RNA, 13 nt, Human
auccccacccuug

SEQ ID NO: 2254521 - RNA, 15 nt, Human
auccccaccugucuu

SEQ ID NO: 2254522 - RNA, 14 nt, Human
auccccacccuggg

SEQ ID NO: 2254523 - RNA, 16 nt, Human
auccccacccugggcu

SEQ ID NO: 2254524 - RNA, 22 nt, Human
auccccaauaauugcagaacua

SEQ ID NO: 2254525 - RNA, 11 nt, Human
auccccacccu

SEQ ID NO: 2254526 - RNA, 21 nt, Human
auccccaauaauugcagaacu

SEQ ID NO: 2254527 - RNA, 19 nt, Human
auccccaauaauugcagaa

SEQ ID NO: 2254528 - RNA, 18 nt, Human
auccccaagccuggcaag

SEQ ID NO: 2254529 - RNA, 12 nt, Human
auccccaauaau

SEQ ID NO: 2254530 - RNA, 16 nt, Human
auccccaagugugaac

SEQ ID NO: 2254531 - RNA, 14 nt, Human
auccccaaguguga

SEQ ID NO: 2254532 - RNA, 13 nt, Human
aucccauguaaca

SEQ ID NO: 2254533 - RNA, 16 nt, Human
aucccauguaacagaa

SEQ ID NO: 2254534 - RNA, 18 nt, Human
aucccauguaacagaaag

SEQ ID NO: 2254535 - RNA, 19 nt, Human
aucccauguaacagaaagg

SEQ ID NO: 2254536 - RNA, 23 nt, Human
aucccauguaacagaaagggcaa

SEQ ID NO: 2254537 - RNA, 15 nt, Human
aucccauguauuuau

SEQ ID NO: 2254538 - RNA, 19 nt, Human
aucccaugagccucagcau

SEQ ID NO: 2254539 - RNA, 16 nt, Human
auccacucccaggcag

SEQ ID NO: 2254540 - RNA, 21 nt, Human
aucccuacccccuaagagcca

SEQ ID NO: 2254541 - RNA, 14 nt, Human
aucccuacccccua

SEQ ID NO: 2254542 - RNA, 22 nt, Human
aucccuacccccuaagagccau

SEQ ID NO: 2254543 - RNA, 13 nt, Human
aucccuacaugua

SEQ ID NO: 2254544 - RNA, 14 nt, Human
aucccuacauguau

SEQ ID NO: 2254545 - RNA, 15 nt, Human
aucccuacauguauu

SEQ ID NO: 2254546 - RNA, 18 nt, Human
aucccuacauguauugca

SEQ ID NO: 2254547 - RNA, 19 nt, Human
auccucaguuuuugugaaa

SEQ ID NO: 2254548 - RNA, 21 nt, Human
auccccaggggucccagccac

SEQ ID NO: 2254549 - RNA, 19 nt, Human
auccccaggggucccagcc

SEQ ID NO: 2254550 - RNA, 15 nt, Human
aucccggcugcccuu

SEQ ID NO: 2254551 - RNA, 17 nt, Human
auccccaccugucuuca

SEQ ID NO: 2254552 - RNA, 23 nt, Human
auccccaggggucccagccaccc

SEQ ID NO: 2254553 - RNA, 13 nt, Human
aucccguguucuc

SEQ ID NO: 2254554 - RNA, 16 nt, Human
aucccguguucuccuu

SEQ ID NO: 2254555 - RNA, 12 nt, Human
aucccuacaugu

SEQ ID NO: 2254556 - RNA, 16 nt, Human
aucccuaaugcugcag

SEQ ID NO: 2254557 - RNA, 18 nt, Human
aucccuaaugugugccau

SEQ ID NO: 2254558 - RNA, 14 nt, Human
aucaugaaauaugc

SEQ ID NO: 2254559 - RNA, 20 nt, Human
aucaggaaauauauaugugu

SEQ ID NO: 2254560 - RNA, 21 nt, Human
aucaggaaauauauaugugug

SEQ ID NO: 2254561 - RNA, 12 nt, Human
aucaccucaggc

SEQ ID NO: 2254562 - RNA, 16 nt, Human
aucagcuguuugucau

SEQ ID NO: 2254563 - RNA, 21 nt, Human
aucagcuucuauccuugacuu

SEQ ID NO: 2254564 - RNA, 18 nt, Human
aucaugaaauaugcaucu

SEQ ID NO: 2254565 - RNA, 16 nt, Human
aucaugaaauuacuua

SEQ ID NO: 2254566 - RNA, 15 nt, Human
aucaugaaauaugca

SEQ ID NO: 2254567 - RNA, 16 nt, Human
aucaugaaauaugcau

SEQ ID NO: 2254568 - RNA, 18 nt, Human
aucaugaagauauuuuuc

SEQ ID NO: 2254569 - RNA, 14 nt, Human
aucaccuauuucca

SEQ ID NO: 2254570 - RNA, 22 nt, Human
aucaccuauuuccauucaacaa

SEQ ID NO: 2254571 - RNA, 15 nt, Human
aucaccuauuuccau

SEQ ID NO: 2254572 - RNA, 13 nt, Human
aucagcuuauugu

SEQ ID NO: 2254573 - RNA, 22 nt, Human
aucagcuugcccuguuaaaaga

SEQ ID NO: 2254574 - RNA, 14 nt, Human
aucaugucuggcua

SEQ ID NO: 2254575 - RNA, 19 nt, Human
aucauguaguaucaaauau

SEQ ID NO: 2254576 - RNA, 21 nt, Human
aucauguaguaucaaauauua

SEQ ID NO: 2254577 - RNA, 19 nt, Human
aucaugucaggccugugug

SEQ ID NO: 2254578 - RNA, 18 nt, Human
aucaugucaggccugugu

SEQ ID NO: 2254579 - RNA, 12 nt, Human
aucaugucccca

SEQ ID NO: 2254580 - RNA, 20 nt, Human
aucauguccccaaaccugca

SEQ ID NO: 2254581 - RNA, 17 nt, Human
aucaugaauuaguuuua

SEQ ID NO: 2254582 - RNA, 15 nt, Human
aucauguacauuucu

SEQ ID NO: 2254583 - RNA, 15 nt, Human
aucaugaauguguaa

SEQ ID NO: 2254584 - RNA, 18 nt, Human
aucaugaauguguaacac

SEQ ID NO: 2254585 - RNA, 17 nt, Human
aucauguaguaucaaau

SEQ ID NO: 2254586 - RNA, 18 nt, Human
aucauguaguaucaaaua

SEQ ID NO: 2254587 - RNA, 12 nt, Human
aucaugugaaau

SEQ ID NO: 2254588 - RNA, 14 nt, Human
aucauguccccaaa

SEQ ID NO: 2254589 - RNA, 14 nt, Human
aucaaagccacacu

SEQ ID NO: 2254590 - RNA, 12 nt, Human
aucaaagcaaug

SEQ ID NO: 2254591 - RNA, 15 nt, Human
aucaaagcaaugcau

SEQ ID NO: 2254592 - RNA, 16 nt, Human
aucaaagcaaugcauu

SEQ ID NO: 2254593 - RNA, 16 nt, Human
aucaaagccacacucu

SEQ ID NO: 2254594 - RNA, 21 nt, Human
aucaaaggaaaauaguaaugu

SEQ ID NO: 2254595 - RNA, 14 nt, Human
aucaaauacuuuaa

SEQ ID NO: 2254596 - RNA, 17 nt, Human
aucaaagcaaugcauuu

SEQ ID NO: 2254597 - RNA, 23 nt, Human
aucaaagcacuuggacucuugcu

SEQ ID NO: 2254598 - RNA, 21 nt, Human
aucaaauagaaccacuaugaa

SEQ ID NO: 2254599 - RNA, 20 nt, Human
aucaaauagaaccacuauga

SEQ ID NO: 2254600 - RNA, 15 nt, Human
aucaaauacuuuaaa

SEQ ID NO: 2254601 - RNA, 20 nt, Human
aucaaauacuuuaaaggaaa

SEQ ID NO: 2254602 - RNA, 21 nt, Human
aucaaauacuuuaaaggaaaa

SEQ ID NO: 2254603 - RNA, 22 nt, Human
aucaaauacuuuaaaggaaaaa

SEQ ID NO: 2254604 - RNA, 14 nt, Human
aucaaauauauuca

SEQ ID NO: 2254605 - RNA, 13 nt, Human
aucaaaaugcuuu

SEQ ID NO: 2254606 - RNA, 22 nt, Human
aucaaaaugcuuuuuauuucug

SEQ ID NO: 2254607 - RNA, 12 nt, Human
aucaaaaugcuu

SEQ ID NO: 2254608 - RNA, 23 nt, Human
aucaaagagguuuuaaaaaaauc

SEQ ID NO: 2254609 - RNA, 20 nt, Human
aucaaagagguuuuaaaaaa

SEQ ID NO: 2254610 - RNA, 15 nt, Human
aucaaaauaaaaagu

SEQ ID NO: 2254611 - RNA, 18 nt, Human
aucaaaauaaaaagugac

SEQ ID NO: 2254612 - RNA, 14 nt, Human
aucaaaauaaaaag

SEQ ID NO: 2254613 - RNA, 21 nt, Human
auauuuccuuaaacugugugg

SEQ ID NO: 2254614 - RNA, 21 nt, Human
auauuucccuccccuggggac

SEQ ID NO: 2254615 - RNA, 21 nt, Human
auauuucccugaaggaaccaa

SEQ ID NO: 2254616 - RNA, 20 nt, Human
aucacaggguugggcccaga

SEQ ID NO: 2254617 - RNA, 19 nt, Human
aucacaggguugggcccag

SEQ ID NO: 2254618 - RNA, 18 nt, Human
aucacaggguugggccca

SEQ ID NO: 2254619 - RNA, 22 nt, Human
aucacagggccccagaaggcag

SEQ ID NO: 2254620 - RNA, 14 nt, Human
aucacagaggcuuc

SEQ ID NO: 2254621 - RNA, 14 nt, Human
aucacagcagcuuc

SEQ ID NO: 2254622 - RNA, 16 nt, Human
aucacagggccccaga

SEQ ID NO: 2254623 - RNA, 12 nt, Human
aucacagggccc

SEQ ID NO: 2254624 - RNA, 15 nt, Human
aucacagaggcuucu

SEQ ID NO: 2254625 - RNA, 18 nt, Human
aucacagagacauuccuc

SEQ ID NO: 2254626 - RNA, 22 nt, Human
aucacagagacauuccuccgag

SEQ ID NO: 2254627 - RNA, 14 nt, Human
aucacagagacauu

SEQ ID NO: 2254628 - RNA, 15 nt, Human
aucacagagacauuc

SEQ ID NO: 2254629 - RNA, 16 nt, Human
aucacagagacauucc

SEQ ID NO: 2254630 - RNA, 17 nt, Human
aucacagagacauuccu

SEQ ID NO: 2254631 - RNA, 13 nt, Human
aucacagccucug

SEQ ID NO: 2254632 - RNA, 11 nt, Human
aucacacacac

SEQ ID NO: 2254633 - RNA, 18 nt, Human
aucacacuucugugagac

SEQ ID NO: 2254634 - RNA, 16 nt, Human
aucacacuucugugag

SEQ ID NO: 2254635 - RNA, 14 nt, Human
aucacacuucugug

SEQ ID NO: 2254636 - RNA, 22 nt, Human
aucaaauauauucagccuggcu

SEQ ID NO: 2254637 - RNA, 14 nt, Human
aucaaauaugcaaa

SEQ ID NO: 2254638 - RNA, 21 nt, Human
aucacagggccccagaaggca

SEQ ID NO: 2254639 - RNA, 15 nt, Human
aucacagucuaauuu

SEQ ID NO: 2254640 - RNA, 23 nt, Human
aucacaggguugggcccagaucu

SEQ ID NO: 2254641 - RNA, 15 nt, Human
aucacaguuuugguu

SEQ ID NO: 2254642 - RNA, 18 nt, Human
aucacagucuaauuuuua

SEQ ID NO: 2254643 - RNA, 19 nt, Human
aucacagucuaauuuuuau

SEQ ID NO: 2254644 - RNA, 12 nt, Human
aucacauccugg

SEQ ID NO: 2254645 - RNA, 21 nt, Human
aucacaguuuugguugcuuua

SEQ ID NO: 2254646 - RNA, 22 nt, Human
aucacaguuuugguugcuuuaa

SEQ ID NO: 2254647 - RNA, 13 nt, Human
aucaccagacagg

SEQ ID NO: 2254648 - RNA, 20 nt, Human
aucaccaacgucugugccau

SEQ ID NO: 2254649 - RNA, 22 nt, Human
aucacagucuaauuuuuauuca

SEQ ID NO: 2254650 - RNA, 11 nt, Human
aucacauguau

SEQ ID NO: 2254651 - RNA, 20 nt, Human
aucaccgagaguagccgaga

SEQ ID NO: 2254652 - RNA, 22 nt, Human
aucaccgacgcgucuccuguuu

SEQ ID NO: 2254653 - RNA, 20 nt, Human
aucaccgacgcgucuccugu

SEQ ID NO: 2254654 - RNA, 22 nt, Human
aucaccgugggcucccugacug

SEQ ID NO: 2254655 - RNA, 20 nt, Human
aucaccgugggcucccugac

SEQ ID NO: 2254656 - RNA, 19 nt, Human
aucaccgugggcucccuga

SEQ ID NO: 2254657 - RNA, 21 nt, Human
aucaccagcccggccugcucc

SEQ ID NO: 2254658 - RNA, 23 nt, Human
aucaccagagagggacugacacc

SEQ ID NO: 2254659 - RNA, 15 nt, Human
aucaccagcccggcc

SEQ ID NO: 2254660 - RNA, 13 nt, Human
aucaccacaguuu

SEQ ID NO: 2254661 - RNA, 19 nt, Human
aucaccacaguaaguuccu

SEQ ID NO: 2254662 - RNA, 13 nt, Human
aucacauguaugu

SEQ ID NO: 2254663 - RNA, 13 nt, Human
aucaccagaauaa

SEQ ID NO: 2254664 - RNA, 16 nt, Human
aucaccagaauaaacc

SEQ ID NO: 2254665 - RNA, 12 nt, Human
aucaccagagag

SEQ ID NO: 2254666 - RNA, 19 nt, Human
aucuucaaagcuugaagau

SEQ ID NO: 2254667 - RNA, 15 nt, Human
aucuucaaagcuuga

SEQ ID NO: 2254668 - RNA, 15 nt, Human
aucuucaauggcuuu

SEQ ID NO: 2254669 - RNA, 23 nt, Human
aucuuauuuucauguauaugugu

SEQ ID NO: 2254670 - RNA, 16 nt, Human
aucuuauuuucaugua

SEQ ID NO: 2254671 - RNA, 13 nt, Human
aucuuauucacau

SEQ ID NO: 2254672 - RNA, 22 nt, Human
aucuuauuagggagaaaauuca

SEQ ID NO: 2254673 - RNA, 21 nt, Human
aucuuauuagggagaaaauuc

SEQ ID NO: 2254674 - RNA, 22 nt, Human
aucugggugcaugaucuugagc

SEQ ID NO: 2254675 - RNA, 16 nt, Human
aucuggggcucuggga

SEQ ID NO: 2254676 - RNA, 15 nt, Human
aucugggggagugga

SEQ ID NO: 2254677 - RNA, 16 nt, Human
aucugggggaguggaa

SEQ ID NO: 2254678 - RNA, 17 nt, Human
aucugggggaguggaau

SEQ ID NO: 2254679 - RNA, 18 nt, Human
aucugggggccucuucug

SEQ ID NO: 2254680 - RNA, 18 nt, Human
aucugggugcaugaucuu

SEQ ID NO: 2254681 - RNA, 18 nt, Human
aucugggggaguggaaua

SEQ ID NO: 2254682 - RNA, 14 nt, Human
aucuggguccuugc

SEQ ID NO: 2254683 - RNA, 18 nt, Human
aucuggguccuugcaccc

SEQ ID NO: 2254684 - RNA, 21 nt, Human
aucugggugcaugaucuugag

SEQ ID NO: 2254685 - RNA, 18 nt, Human
aucuggguagcuguaagg

SEQ ID NO: 2254686 - RNA, 17 nt, Human
aucuggguagcuguaag

SEQ ID NO: 2254687 - RNA, 15 nt, Human
aucuggguagcugua

SEQ ID NO: 2254688 - RNA, 14 nt, Human
aucuggguagcugu

SEQ ID NO: 2254689 - RNA, 17 nt, Human
aucucucuuuaauauaa

SEQ ID NO: 2254690 - RNA, 13 nt, Human
aucucugaagcau

SEQ ID NO: 2254691 - RNA, 20 nt, Human
aucucuccuccaagacacug

SEQ ID NO: 2254692 - RNA, 19 nt, Human
aucucucgguuccacgucc

SEQ ID NO: 2254693 - RNA, 20 nt, Human
aucucucgguuccacguccc

SEQ ID NO: 2254694 - RNA, 16 nt, Human
aucucugaagcauguu

SEQ ID NO: 2254695 - RNA, 17 nt, Human
aucucugaagcauguuu

SEQ ID NO: 2254696 - RNA, 19 nt, Human
aucucugaagcauguuuca

SEQ ID NO: 2254697 - RNA, 20 nt, Human
aucucugaagcauguuucau

SEQ ID NO: 2254698 - RNA, 22 nt, Human
aucuggacuccucuguccaggc

SEQ ID NO: 2254699 - RNA, 16 nt, Human
aucucugcuuuggaaa

SEQ ID NO: 2254700 - RNA, 22 nt, Human
aucucugcaggaaauggcugug

SEQ ID NO: 2254701 - RNA, 21 nt, Human
aucucugcaaucuucucagaa

SEQ ID NO: 2254702 - RNA, 18 nt, Human
aucucugcaaucuucuca

SEQ ID NO: 2254703 - RNA, 17 nt, Human
aucuggauaggagccug

SEQ ID NO: 2254704 - RNA, 18 nt, Human
aucuggauaggagccugc

SEQ ID NO: 2254705 - RNA, 20 nt, Human
aucuggauaggagccugcug

SEQ ID NO: 2254706 - RNA, 21 nt, Human
aucuggauaggagccugcugg

SEQ ID NO: 2254707 - RNA, 22 nt, Human
aucuggauaggagccugcuggu

SEQ ID NO: 2254708 - RNA, 16 nt, Human
aucuggcaacaucuuu

SEQ ID NO: 2254709 - RNA, 15 nt, Human
aucuggagagcuaga

SEQ ID NO: 2254710 - RNA, 20 nt, Human
aucuggagagcuagaaccug

SEQ ID NO: 2254711 - RNA, 22 nt, Human
aucuggagagcuagaaccugga

SEQ ID NO: 2254712 - RNA, 23 nt, Human
aucuggagagcuagaaccuggag

SEQ ID NO: 2254713 - RNA, 22 nt, Human
aucuggagaccagggagccuuu

SEQ ID NO: 2254714 - RNA, 21 nt, Human
aucuggagaccagggagccuu

SEQ ID NO: 2254715 - RNA, 20 nt, Human
aucuggagaccagggagccu

SEQ ID NO: 2254716 - RNA, 20 nt, Human
aucucugcacccuggggccu

SEQ ID NO: 2254717 - RNA, 23 nt, Human
aucucugcacccuggggccugga

SEQ ID NO: 2254718 - RNA, 21 nt, Human
aucuucccuagaggguuccug

SEQ ID NO: 2254719 - RNA, 20 nt, Human
aucuucccagcagggccacu

SEQ ID NO: 2254720 - RNA, 23 nt, Human
aucuucccagcagggccacuccc

SEQ ID NO: 2254721 - RNA, 22 nt, Human
aucuucccuagaggguuccugu

SEQ ID NO: 2254722 - RNA, 14 nt, Human
aucuucccucuccc

SEQ ID NO: 2254723 - RNA, 17 nt, Human
aucuuccagaaguguga

SEQ ID NO: 2254724 - RNA, 18 nt, Human
aucuuccagaagugugau

SEQ ID NO: 2254725 - RNA, 19 nt, Human
aucuuccagaagugugauu

SEQ ID NO: 2254726 - RNA, 11 nt, Human
aucuucccagc

SEQ ID NO: 2254727 - RNA, 18 nt, Human
aucuuccaggugggguga

SEQ ID NO: 2254728 - RNA, 21 nt, Human
aucuucuaaacccaauccaaa

SEQ ID NO: 2254729 - RNA, 13 nt, Human
aucuauuuaagua

SEQ ID NO: 2254730 - RNA, 19 nt, Human
aucuauuggguucauuauu

SEQ ID NO: 2254731 - RNA, 17 nt, Human
aucuauuggguucauua

SEQ ID NO: 2254732 - RNA, 16 nt, Human
aucuauuggguucauu

SEQ ID NO: 2254733 - RNA, 22 nt, Human
aucuauuggguucauuauugga

SEQ ID NO: 2254734 - RNA, 15 nt, Human
aucuauuucugagaa

SEQ ID NO: 2254735 - RNA, 15 nt, Human
aucuauuucuaugag

SEQ ID NO: 2254736 - RNA, 13 nt, Human
aucuauauauaau

SEQ ID NO: 2254737 - RNA, 16 nt, Human
aucuauagaacugaau

SEQ ID NO: 2254738 - RNA, 14 nt, Human
aucuauauauaauu

SEQ ID NO: 2254739 - RNA, 15 nt, Human
aucuauauauaauuc

SEQ ID NO: 2254740 - RNA, 19 nt, Human
aucuauauauaauucugua

SEQ ID NO: 2254741 - RNA, 20 nt, Human
aucuauauauaauucuguac

SEQ ID NO: 2254742 - RNA, 15 nt, Human
aucuauauaugugua

SEQ ID NO: 2254743 - RNA, 16 nt, Human
aucuauauauguguau

SEQ ID NO: 2254744 - RNA, 17 nt, Human
aucuauauauguguaug

SEQ ID NO: 2254745 - RNA, 15 nt, Human
aucuauauuuaacaa

SEQ ID NO: 2254746 - RNA, 22 nt, Human
aucuauauguacuugucaaaga

SEQ ID NO: 2254747 - RNA, 23 nt, Human
aucuauauguacuugucaaagaa

SEQ ID NO: 2254748 - RNA, 18 nt, Human
aucuauauauguguaugu

SEQ ID NO: 2254749 - RNA, 19 nt, Human
aucuauauauguguaugua

SEQ ID NO: 2254750 - RNA, 16 nt, Human
aucuauauguacuugu

SEQ ID NO: 2254751 - RNA, 21 nt, Human
aucuauauguacuugucaaag

SEQ ID NO: 2254752 - RNA, 15 nt, Human
aucucucccuccccu

SEQ ID NO: 2254753 - RNA, 14 nt, Human
aucucucccucccc

SEQ ID NO: 2254754 - RNA, 23 nt, Human
aucucucccuccccugccauuuu

SEQ ID NO: 2254755 - RNA, 12 nt, Human
aucucuccucca

SEQ ID NO: 2254756 - RNA, 11 nt, Human
aucucucccuc

SEQ ID NO: 2254757 - RNA, 22 nt, Human
aucucucaggagcacaggcagc

SEQ ID NO: 2254758 - RNA, 23 nt, Human
aucucucaggagcacaggcagcu

SEQ ID NO: 2254759 - RNA, 17 nt, Human
aucucuauuuaauauuu

SEQ ID NO: 2254760 - RNA, 20 nt, Human
aucuccugccuuccuccugg

SEQ ID NO: 2254761 - RNA, 19 nt, Human
aucucuauuuaauauuuau

SEQ ID NO: 2254762 - RNA, 18 nt, Human
aucucuauuuaauauuua

SEQ ID NO: 2254763 - RNA, 17 nt, Human
aucucucagaagggagg

SEQ ID NO: 2254764 - RNA, 13 nt, Human
aucucucaggagc

SEQ ID NO: 2254765 - RNA, 14 nt, Human
aucucucaggagca

SEQ ID NO: 2254766 - RNA, 16 nt, Human
aucucucaggagcaca

SEQ ID NO: 2254767 - RNA, 17 nt, Human
aucucucaggagcacag

SEQ ID NO: 2254768 - RNA, 18 nt, Human
aucucucaggagcacagg

SEQ ID NO: 2254769 - RNA, 21 nt, Human
aucucucaggagcacaggcag

SEQ ID NO: 2254770 - RNA, 20 nt, Human
aucuccucgcaagcugggua

SEQ ID NO: 2254771 - RNA, 19 nt, Human
aucuccucaaguccccaag

SEQ ID NO: 2254772 - RNA, 17 nt, Human
aucuccugccuuccucc

SEQ ID NO: 2254773 - RNA, 16 nt, Human
aucuccugccuuccuc

SEQ ID NO: 2254774 - RNA, 14 nt, Human
aucuauuucugaga

SEQ ID NO: 2254775 - RNA, 14 nt, Human
aucuauuuuggauu

SEQ ID NO: 2254776 - RNA, 16 nt, Human
aucuauacauaucuuu

SEQ ID NO: 2254777 - RNA, 13 nt, Human
aucuauaaagaag

SEQ ID NO: 2254778 - RNA, 16 nt, Human
aucuauaaagaagaac

SEQ ID NO: 2254779 - RNA, 17 nt, Human
aucuagugcagcugauu

SEQ ID NO: 2254780 - RNA, 15 nt, Human
aucuagugcagcuga

SEQ ID NO: 2254781 - RNA, 14 nt, Human
aucuagugcagcug

SEQ ID NO: 2254782 - RNA, 13 nt, Human
aucuagugcagcu

SEQ ID NO: 2254783 - RNA, 22 nt, Human
aucuagugcagcugauuuuaac

SEQ ID NO: 2254784 - RNA, 19 nt, Human
aucuagugcagcugauuuu

SEQ ID NO: 2254785 - RNA, 18 nt, Human
aucuagugcagcugauuu

SEQ ID NO: 2254786 - RNA, 21 nt, Human
aucuagugcagcugauuuuaa

SEQ ID NO: 2254787 - RNA, 12 nt, Human
aucuagguuuaa

SEQ ID NO: 2254788 - RNA, 13 nt, Human
aucuagguuuaac

SEQ ID NO: 2254789 - RNA, 14 nt, Human
aucuagguuuaacu

SEQ ID NO: 2254790 - RNA, 20 nt, Human
aucuaggugaggauugauua

SEQ ID NO: 2254791 - RNA, 22 nt, Human
aucuagguuuaacucagaucac

SEQ ID NO: 2254792 - RNA, 16 nt, Human
aucuagguuuaacuca

SEQ ID NO: 2254793 - RNA, 17 nt, Human
aucuagguuuaacucag

SEQ ID NO: 2254794 - RNA, 18 nt, Human
aucuagguuuaacucaga

SEQ ID NO: 2254795 - RNA, 19 nt, Human
aucuagguuuaacucagau

SEQ ID NO: 2254796 - RNA, 20 nt, Human
augaaaaugcaacaacaugu

SEQ ID NO: 2254797 - RNA, 19 nt, Human
augaaaaugucagaaacca

SEQ ID NO: 2254798 - RNA, 13 nt, Human
augaaaaugucuu

SEQ ID NO: 2254799 - RNA, 15 nt, Human
augaaaaugucagaa

SEQ ID NO: 2254800 - RNA, 13 nt, Human
augaaaaugucag

SEQ ID NO: 2254801 - RNA, 12 nt, Human
augaaaauguca

SEQ ID NO: 2254802 - RNA, 21 nt, Human
augaaguacucauacauguua

SEQ ID NO: 2254803 - RNA, 15 nt, Human
augaaaaugucuugu

SEQ ID NO: 2254804 - RNA, 23 nt, Human
augaaguguguuuccuucagugc

SEQ ID NO: 2254805 - RNA, 19 nt, Human
augaaguguguuuccuuca

SEQ ID NO: 2254806 - RNA, 14 nt, Human
augaagucucugaa

SEQ ID NO: 2254807 - RNA, 14 nt, Human
augaaaaugucuug

SEQ ID NO: 2254808 - RNA, 14 nt, Human
augaaguauauaau

SEQ ID NO: 2254809 - RNA, 16 nt, Human
augaaguauauaaugg

SEQ ID NO: 2254810 - RNA, 18 nt, Human
augaagucguugugaggg

SEQ ID NO: 2254811 - RNA, 17 nt, Human
augaaguauauaauggu

SEQ ID NO: 2254812 - RNA, 20 nt, Human
augaaguccaagcauuuaga

SEQ ID NO: 2254813 - RNA, 23 nt, Human
augaaguccaagcauuuagaugu

SEQ ID NO: 2254814 - RNA, 15 nt, Human
augaaguuguaggua

SEQ ID NO: 2254815 - RNA, 18 nt, Human
augaaguguuagauagaa

SEQ ID NO: 2254816 - RNA, 15 nt, Human
augaaguguuagaua

SEQ ID NO: 2254817 - RNA, 15 nt, Human
augaccacacuccag

SEQ ID NO: 2254818 - RNA, 18 nt, Human
augaccacacuccagcug

SEQ ID NO: 2254819 - RNA, 19 nt, Human
augaaguuuccuuggcugg

SEQ ID NO: 2254820 - RNA, 17 nt, Human
augaccauacugaggga

SEQ ID NO: 2254821 - RNA, 19 nt, Human
augaccaguaauugugaaa

SEQ ID NO: 2254822 - RNA, 13 nt, Human
augacccaaagac

SEQ ID NO: 2254823 - RNA, 15 nt, Human
augacccaaagacca

SEQ ID NO: 2254824 - RNA, 16 nt, Human
augacccaaagaccaa

SEQ ID NO: 2254825 - RNA, 12 nt, Human
augacccacccc

SEQ ID NO: 2254826 - RNA, 21 nt, Human
augacggaagaacauagaacu

SEQ ID NO: 2254827 - RNA, 19 nt, Human
augacggaagaacauagaa

SEQ ID NO: 2254828 - RNA, 16 nt, Human
augacgguauuaugcu

SEQ ID NO: 2254829 - RNA, 17 nt, Human
augacgguauuaugcuu

SEQ ID NO: 2254830 - RNA, 16 nt, Human
augacggaagaacaua

SEQ ID NO: 2254831 - RNA, 16 nt, Human
augacccaggcugggc

SEQ ID NO: 2254832 - RNA, 19 nt, Human
augacccaccccugugcuc

SEQ ID NO: 2254833 - RNA, 15 nt, Human
augacccaggcuggg

SEQ ID NO: 2254834 - RNA, 14 nt, Human
augacccaggcugg

SEQ ID NO: 2254835 - RNA, 12 nt, Human
augacccaggcu

SEQ ID NO: 2254836 - RNA, 13 nt, Human
augacccaccccu

SEQ ID NO: 2254837 - RNA, 14 nt, Human
augacccaccccug

SEQ ID NO: 2254838 - RNA, 16 nt, Human
augacccaccccugug

SEQ ID NO: 2254839 - RNA, 17 nt, Human
augacccaccccugugc

SEQ ID NO: 2254840 - RNA, 18 nt, Human
augacuaaagagagaaug

SEQ ID NO: 2254841 - RNA, 17 nt, Human
augacuaaagagagaau

SEQ ID NO: 2254842 - RNA, 16 nt, Human
augacuaaagagagaa

SEQ ID NO: 2254843 - RNA, 15 nt, Human
augacuaaagagaga

SEQ ID NO: 2254844 - RNA, 14 nt, Human
augacuaaagagag

SEQ ID NO: 2254845 - RNA, 13 nt, Human
augacuaaagaga

SEQ ID NO: 2254846 - RNA, 12 nt, Human
augacuaaagag

SEQ ID NO: 2254847 - RNA, 11 nt, Human
augacuaaaga

SEQ ID NO: 2254848 - RNA, 23 nt, Human
augacuaaaaauauuauaacuua

SEQ ID NO: 2254849 - RNA, 16 nt, Human
augacuaaaaauauua

SEQ ID NO: 2254850 - RNA, 14 nt, Human
augacuaaaaauau

SEQ ID NO: 2254851 - RNA, 20 nt, Human
augacgguauuaugcuucuu

SEQ ID NO: 2254852 - RNA, 16 nt, Human
augagggaucacaggg

SEQ ID NO: 2254853 - RNA, 14 nt, Human
augagggacuggaa

SEQ ID NO: 2254854 - RNA, 18 nt, Human
augacuguuuuuguagug

SEQ ID NO: 2254855 - RNA, 17 nt, Human
augacuguuuuuguagu

SEQ ID NO: 2254856 - RNA, 13 nt, Human
augagggacugga

SEQ ID NO: 2254857 - RNA, 20 nt, Human
augagggacuggaaccaggg

SEQ ID NO: 2254858 - RNA, 15 nt, Human
augaggggcccgagc

SEQ ID NO: 2254859 - RNA, 13 nt, Human
augaggggagggg

SEQ ID NO: 2254860 - RNA, 14 nt, Human
augaggggaggggg

SEQ ID NO: 2254861 - RNA, 20 nt, Human
augaggguaucaaauaaaau

SEQ ID NO: 2254862 - RNA, 19 nt, Human
augaggggacauuuuggug

SEQ ID NO: 2254863 - RNA, 11 nt, Human
augagggccac

SEQ ID NO: 2254864 - RNA, 20 nt, Human
augagggucuugguuccagc

SEQ ID NO: 2254865 - RNA, 13 nt, Human
augagggucuugg

SEQ ID NO: 2254866 - RNA, 22 nt, Human
augacugcuccccagcccuggc

SEQ ID NO: 2254867 - RNA, 23 nt, Human
augacugcuccccagcccuggcu

SEQ ID NO: 2254868 - RNA, 17 nt, Human
augacugugauuuucag

SEQ ID NO: 2254869 - RNA, 13 nt, Human
augacuguagaau

SEQ ID NO: 2254870 - RNA, 17 nt, Human
augacuguagaauuugu

SEQ ID NO: 2254871 - RNA, 13 nt, Human
augacugcacaug

SEQ ID NO: 2254872 - RNA, 21 nt, Human
augacugcuccccagcccugg

SEQ ID NO: 2254873 - RNA, 23 nt, Human
augacuaaagagagaauguagau

SEQ ID NO: 2254874 - RNA, 20 nt, Human
augacuaaagagagaaugua

SEQ ID NO: 2254875 - RNA, 19 nt, Human
augacuaaagagagaaugu

SEQ ID NO: 2254876 - RNA, 21 nt, Human
augacuaaagagagaauguag

SEQ ID NO: 2254877 - RNA, 22 nt, Human
augaggcauuuguuugaacuga

SEQ ID NO: 2254878 - RNA, 21 nt, Human
augaggcauuuguuugaacug

SEQ ID NO: 2254879 - RNA, 14 nt, Human
augaggcauuuguu

SEQ ID NO: 2254880 - RNA, 13 nt, Human
augaggcauuugu

SEQ ID NO: 2254881 - RNA, 22 nt, Human
augaaaaauuuaagcauuguuu

SEQ ID NO: 2254882 - RNA, 16 nt, Human
augaaaacacauuuuu

SEQ ID NO: 2254883 - RNA, 16 nt, Human
augaaaauauuuaaag

SEQ ID NO: 2254884 - RNA, 14 nt, Human
augaaaauauuuaa

SEQ ID NO: 2254885 - RNA, 13 nt, Human
augaaaauauuua

SEQ ID NO: 2254886 - RNA, 12 nt, Human
augaaaauauuu

SEQ ID NO: 2254887 - RNA, 15 nt, Human
augaaaacacauuuu

SEQ ID NO: 2254888 - RNA, 14 nt, Human
augaaaacacauuu

SEQ ID NO: 2254889 - RNA, 20 nt, Human
auguauugugucuuuugcau

SEQ ID NO: 2254890 - RNA, 22 nt, Human
auguauugugucuuuugcauga

SEQ ID NO: 2254891 - RNA, 19 nt, Human
auguauugugucuuuugca

SEQ ID NO: 2254892 - RNA, 21 nt, Human
auguauuguaaacauguguuu

SEQ ID NO: 2254893 - RNA, 12 nt, Human
auguauuguacc

SEQ ID NO: 2254894 - RNA, 13 nt, Human
auguauuguaccu

SEQ ID NO: 2254895 - RNA, 15 nt, Human
auguauuguaccuuu

SEQ ID NO: 2254896 - RNA, 21 nt, Human
auguacaaaaucgauuggcuu

SEQ ID NO: 2254897 - RNA, 11 nt, Human
auguaauuguu

SEQ ID NO: 2254898 - RNA, 11 nt, Human
auguauuguaa

SEQ ID NO: 2254899 - RNA, 19 nt, Human
auguauuguaaacaugugu

SEQ ID NO: 2254900 - RNA, 20 nt, Human
auguauuguaaacauguguu

SEQ ID NO: 2254901 - RNA, 13 nt, Human
augucacaggcag

SEQ ID NO: 2254902 - RNA, 21 nt, Human
augucaaucagccuaguugau

SEQ ID NO: 2254903 - RNA, 17 nt, Human
auguauuuauaaauaua

SEQ ID NO: 2254904 - RNA, 14 nt, Human
auguauuuauauuu

SEQ ID NO: 2254905 - RNA, 16 nt, Human
auguauuuauuuaaaa

SEQ ID NO: 2254906 - RNA, 22 nt, Human
auguauuuauuuaaaagauuca

SEQ ID NO: 2254907 - RNA, 18 nt, Human
auguauuuauuuaaaaga

SEQ ID NO: 2254908 - RNA, 19 nt, Human
auguauuuauuuaaaagau

SEQ ID NO: 2254909 - RNA, 15 nt, Human
auguaauugaauaaa

SEQ ID NO: 2254910 - RNA, 20 nt, Human
auguaauuguuugucuuuaa

SEQ ID NO: 2254911 - RNA, 14 nt, Human
auguaacugcugaa

SEQ ID NO: 2254912 - RNA, 13 nt, Human
auguaacugcuga

SEQ ID NO: 2254913 - RNA, 15 nt, Human
augguccgguguccu

SEQ ID NO: 2254914 - RNA, 20 nt, Human
auguaaauuuuguaugaaaa

SEQ ID NO: 2254915 - RNA, 23 nt, Human
auguaacugcauugagaacugca

SEQ ID NO: 2254916 - RNA, 20 nt, Human
auguaacugcauugagaacu

SEQ ID NO: 2254917 - RNA, 14 nt, Human
auguaacuagaauu

SEQ ID NO: 2254918 - RNA, 13 nt, Human
auguaacagucug

SEQ ID NO: 2254919 - RNA, 16 nt, Human
auguaacagucugauc

SEQ ID NO: 2254920 - RNA, 13 nt, Human
auguaacagaaag

SEQ ID NO: 2254921 - RNA, 14 nt, Human
auguaacagaaagg

SEQ ID NO: 2254922 - RNA, 21 nt, Human
auguaacagccaggaguguua

SEQ ID NO: 2254923 - RNA, 16 nt, Human
augugaaaaucaaaua

SEQ ID NO: 2254924 - RNA, 22 nt, Human
augucuuuuuuuuaaugugcug

SEQ ID NO: 2254925 - RNA, 20 nt, Human
augucuuuuuaagcuuauuu

SEQ ID NO: 2254926 - RNA, 18 nt, Human
augucuuuuuuuuaaugu

SEQ ID NO: 2254927 - RNA, 17 nt, Human
augucuuuuuuuuaaug

SEQ ID NO: 2254928 - RNA, 23 nt, Human
augucuuuuuaagcuuauuuaau

SEQ ID NO: 2254929 - RNA, 18 nt, Human
augucuuuuuaagcuuau

SEQ ID NO: 2254930 - RNA, 16 nt, Human
augucuuuugaauauu

SEQ ID NO: 2254931 - RNA, 16 nt, Human
augucuuuuuaagcuu

SEQ ID NO: 2254932 - RNA, 22 nt, Human
augucaccguggaccuuccugc

SEQ ID NO: 2254933 - RNA, 23 nt, Human
augucaccguggaccuuccugcc

SEQ ID NO: 2254934 - RNA, 14 nt, Human
augugaaacauguu

SEQ ID NO: 2254935 - RNA, 14 nt, Human
augugaaaucauuc

SEQ ID NO: 2254936 - RNA, 21 nt, Human
augugaaaaugguccaggaga

SEQ ID NO: 2254937 - RNA, 19 nt, Human
augucuuuuuuuuaaugug

SEQ ID NO: 2254938 - RNA, 18 nt, Human
augugaaaaucaaauaca

SEQ ID NO: 2254939 - RNA, 20 nt, Human
augucaccggauccugggug

SEQ ID NO: 2254940 - RNA, 19 nt, Human
augucaccggauccugggu

SEQ ID NO: 2254941 - RNA, 20 nt, Human
augucaccguggaccuuccu

SEQ ID NO: 2254942 - RNA, 21 nt, Human
augucaccguggaccuuccug

SEQ ID NO: 2254943 - RNA, 23 nt, Human
augucaccaccuucccagcucuc

SEQ ID NO: 2254944 - RNA, 20 nt, Human
augucaccaccuucccagcu

SEQ ID NO: 2254945 - RNA, 19 nt, Human
augucaccaccuucccagc

SEQ ID NO: 2254946 - RNA, 18 nt, Human
augucaccaccuucccag

SEQ ID NO: 2254947 - RNA, 16 nt, Human
augucaccaccuuccc

SEQ ID NO: 2254948 - RNA, 15 nt, Human
augucaccaccuucc

SEQ ID NO: 2254949 - RNA, 13 nt, Human
augucaccaccuu

SEQ ID NO: 2254950 - RNA, 14 nt, Human
augucacagggcca

SEQ ID NO: 2254951 - RNA, 19 nt, Human
augucaauuucuguguugc

SEQ ID NO: 2254952 - RNA, 12 nt, Human
augucacagggc

SEQ ID NO: 2254953 - RNA, 13 nt, Human
augucacagggcc

SEQ ID NO: 2254954 - RNA, 19 nt, Human
augucacaggcagguccag

SEQ ID NO: 2254955 - RNA, 21 nt, Human
auguauuuauuuaaaagauuc

SEQ ID NO: 2254956 - RNA, 16 nt, Human
augucaauuucugugu

SEQ ID NO: 2254957 - RNA, 17 nt, Human
augugaaaucauucauu

SEQ ID NO: 2254958 - RNA, 18 nt, Human
augugaaaucauucauuu

SEQ ID NO: 2254959 - RNA, 16 nt, Human
augugaacagcggcug

SEQ ID NO: 2254960 - RNA, 22 nt, Human
augugaaaaugguccaggagaa

SEQ ID NO: 2254961 - RNA, 15 nt, Human
augugaacacaucag

SEQ ID NO: 2254962 - RNA, 14 nt, Human
augguaauuguugc

SEQ ID NO: 2254963 - RNA, 23 nt, Human
augguaaaaguuacuuauucuag

SEQ ID NO: 2254964 - RNA, 14 nt, Human
auggguugcauuug

SEQ ID NO: 2254965 - RNA, 16 nt, Human
auggguuggugcuucu

SEQ ID NO: 2254966 - RNA, 22 nt, Human
auggguuuuucccuguacagua

SEQ ID NO: 2254967 - RNA, 13 nt, Human
auggguguguguu

SEQ ID NO: 2254968 - RNA, 12 nt, Human
augggugugugu

SEQ ID NO: 2254969 - RNA, 19 nt, Human
auggguguguguuugugug

SEQ ID NO: 2254970 - RNA, 22 nt, Human
auggguuagggaaaacauucca

SEQ ID NO: 2254971 - RNA, 20 nt, Human
augggugcuuggaggaagga

SEQ ID NO: 2254972 - RNA, 21 nt, Human
augggugcuuggaggaaggaa

SEQ ID NO: 2254973 - RNA, 23 nt, Human
augggugcuuggaggaaggaaac

SEQ ID NO: 2254974 - RNA, 19 nt, Human
augguacuagggggaagug

SEQ ID NO: 2254975 - RNA, 17 nt, Human
augguacccccuucugg

SEQ ID NO: 2254976 - RNA, 14 nt, Human
augguacccccuuc

SEQ ID NO: 2254977 - RNA, 15 nt, Human
augguacccccuucu

SEQ ID NO: 2254978 - RNA, 13 nt, Human
augguacuauuua

SEQ ID NO: 2254979 - RNA, 15 nt, Human
augguaccagauaaa

SEQ ID NO: 2254980 - RNA, 18 nt, Human
augguaggcauuuccuau

SEQ ID NO: 2254981 - RNA, 17 nt, Human
augguaggcauuuccua

SEQ ID NO: 2254982 - RNA, 20 nt, Human
augguagccaguugaauuua

SEQ ID NO: 2254983 - RNA, 13 nt, Human
auggucccaucca

SEQ ID NO: 2254984 - RNA, 14 nt, Human
auggucccauccag

SEQ ID NO: 2254985 - RNA, 15 nt, Human
auggucccauccagg

SEQ ID NO: 2254986 - RNA, 17 nt, Human
auggucccauccaggca

SEQ ID NO: 2254987 - RNA, 18 nt, Human
auggucccauccaggcag

SEQ ID NO: 2254988 - RNA, 19 nt, Human
auggucccauccaggcagu

SEQ ID NO: 2254989 - RNA, 20 nt, Human
auggucccauccaggcaguc

SEQ ID NO: 2254990 - RNA, 16 nt, Human
auggucccaucugcag

SEQ ID NO: 2254991 - RNA, 19 nt, Human
augguccaggagaaggcca

SEQ ID NO: 2254992 - RNA, 18 nt, Human
augguccaggagaaggcc

SEQ ID NO: 2254993 - RNA, 16 nt, Human
augguccaggagaagg

SEQ ID NO: 2254994 - RNA, 13 nt, Human
augguccaggaga

SEQ ID NO: 2254995 - RNA, 13 nt, Human
auguguaaguauu

SEQ ID NO: 2254996 - RNA, 15 nt, Human
auguguagccugugc

SEQ ID NO: 2254997 - RNA, 14 nt, Human
auguguagccugug

SEQ ID NO: 2254998 - RNA, 16 nt, Human
auguguagccugugca

SEQ ID NO: 2254999 - RNA, 17 nt, Human
auguguagccugugcau

SEQ ID NO: 2255000 - RNA, 23 nt, Human
auguguagccugugcauguaugu

SEQ ID NO: 2255001 - RNA, 18 nt, Human
auguguaucggaugcuuu

SEQ ID NO: 2255002 - RNA, 15 nt, Human
auguuccacuaaccc

SEQ ID NO: 2255003 - RNA, 14 nt, Human
auguuccacuaacc

SEQ ID NO: 2255004 - RNA, 16 nt, Human
auguuccuagugaaag

SEQ ID NO: 2255005 - RNA, 15 nt, Human
auguuccuagugaaa

SEQ ID NO: 2255006 - RNA, 15 nt, Human
auguguaaaauguga

SEQ ID NO: 2255007 - RNA, 22 nt, Human
auguguaacacagugccuucaa

SEQ ID NO: 2255008 - RNA, 15 nt, Human
auguguaaggugaac

SEQ ID NO: 2255009 - RNA, 21 nt, Human
auguucugugccuguaaacau

SEQ ID NO: 2255010 - RNA, 15 nt, Human
auguucugggacaca

SEQ ID NO: 2255011 - RNA, 17 nt, Human
auguucucugaggacac

SEQ ID NO: 2255012 - RNA, 14 nt, Human
auguucugggacac

SEQ ID NO: 2255013 - RNA, 16 nt, Human
auguucucucuucucc

SEQ ID NO: 2255014 - RNA, 17 nt, Human
auguuccuagugaaaga

SEQ ID NO: 2255015 - RNA, 17 nt, Human
auguucucucuucucca

SEQ ID NO: 2255016 - RNA, 13 nt, Human
auguucucugagg

SEQ ID NO: 2255017 - RNA, 20 nt, Human
auguuucgugaaguauacug

SEQ ID NO: 2255018 - RNA, 22 nt, Human
auguuucgcugauauauguguu

SEQ ID NO: 2255019 - RNA, 20 nt, Human
auguuuccucuaguucuuug

SEQ ID NO: 2255020 - RNA, 23 nt, Human
auguuucgugaaguauacuguau

SEQ ID NO: 2255021 - RNA, 12 nt, Human
auguuucucugg

SEQ ID NO: 2255022 - RNA, 19 nt, Human
auguuucucuggccccaag

SEQ ID NO: 2255023 - RNA, 17 nt, Human
auguuucucuggcccca

SEQ ID NO: 2255024 - RNA, 22 nt, Human
auguuucugcaguagucucugu

SEQ ID NO: 2255025 - RNA, 14 nt, Human
auguucuuaauucu

SEQ ID NO: 2255026 - RNA, 14 nt, Human
auguuuccucuagu

SEQ ID NO: 2255027 - RNA, 15 nt, Human
auguuugccucugcc

SEQ ID NO: 2255028 - RNA, 17 nt, Human
auguuugccucugccuc

SEQ ID NO: 2255029 - RNA, 18 nt, Human
auguuucuuaaaugggcu

SEQ ID NO: 2255030 - RNA, 15 nt, Human
auguuucuucuaggu

SEQ ID NO: 2255031 - RNA, 23 nt, Human
auguuucugcaguagucucugug

SEQ ID NO: 2255032 - RNA, 14 nt, Human
auguuugccucugc

SEQ ID NO: 2255033 - RNA, 15 nt, Human
augaucuuuucaagu

SEQ ID NO: 2255034 - RNA, 20 nt, Human
augaucuuucuuuccuuucu

SEQ ID NO: 2255035 - RNA, 19 nt, Human
augaugaaaauauuuaaag

SEQ ID NO: 2255036 - RNA, 18 nt, Human
augaugaaaugaggucag

SEQ ID NO: 2255037 - RNA, 15 nt, Human
augaugaaugagaau

SEQ ID NO: 2255038 - RNA, 12 nt, Human
augaugaaugag

SEQ ID NO: 2255039 - RNA, 23 nt, Human
augaugaaaugaggucagagccu

SEQ ID NO: 2255040 - RNA, 15 nt, Human
augaugauccuaggc

SEQ ID NO: 2255041 - RNA, 18 nt, Human
augaugaucuuuaaaaua

SEQ ID NO: 2255042 - RNA, 20 nt, Human
augaugauguggaagaacuu

SEQ ID NO: 2255043 - RNA, 22 nt, Human
augaugauccggauuuaauuug

SEQ ID NO: 2255044 - RNA, 15 nt, Human
augaugaugggaauu

SEQ ID NO: 2255045 - RNA, 15 nt, Human
augauggagucaggu

SEQ ID NO: 2255046 - RNA, 18 nt, Human
augaugaugggaauugug

SEQ ID NO: 2255047 - RNA, 21 nt, Human
augaugaucuuuaaaauacac

SEQ ID NO: 2255048 - RNA, 19 nt, Human
augauggcaauuuuguaac

SEQ ID NO: 2255049 - RNA, 19 nt, Human
augauggaugccaauauua

SEQ ID NO: 2255050 - RNA, 15 nt, Human
augauggaugccaau

SEQ ID NO: 2255051 - RNA, 16 nt, Human
augauggguguuuuua

SEQ ID NO: 2255052 - RNA, 16 nt, Human
augaugggucaguugu

SEQ ID NO: 2255053 - RNA, 16 nt, Human
augauggugcugaccu

SEQ ID NO: 2255054 - RNA, 18 nt, Human
augaugguugcaaaagac

SEQ ID NO: 2255055 - RNA, 20 nt, Human
augauguaaguuuaccuaug

SEQ ID NO: 2255056 - RNA, 18 nt, Human
augcacaaacagaggccg

SEQ ID NO: 2255057 - RNA, 12 nt, Human
augauguauauu

SEQ ID NO: 2255058 - RNA, 21 nt, Human
augauguagugccucuuucau

SEQ ID NO: 2255059 - RNA, 13 nt, Human
augauguauauuu

SEQ ID NO: 2255060 - RNA, 23 nt, Human
augcacaaauucugucucuggau

SEQ ID NO: 2255061 - RNA, 15 nt, Human
augcacaaauucugu

SEQ ID NO: 2255062 - RNA, 22 nt, Human
augcacaaauucugucucugga

SEQ ID NO: 2255063 - RNA, 18 nt, Human
augaucuuugcagacagg

SEQ ID NO: 2255064 - RNA, 19 nt, Human
augaucuuugcagacaggc

SEQ ID NO: 2255065 - RNA, 21 nt, Human
augaucuuugcagacaggcaa

SEQ ID NO: 2255066 - RNA, 15 nt, Human
augaugaaaauauuu

SEQ ID NO: 2255067 - RNA, 13 nt, Human
augaugaaaauau

SEQ ID NO: 2255068 - RNA, 15 nt, Human
augaucuugugacau

SEQ ID NO: 2255069 - RNA, 14 nt, Human
augaucuugugaca

SEQ ID NO: 2255070 - RNA, 17 nt, Human
augaucuuugcagacag

SEQ ID NO: 2255071 - RNA, 16 nt, Human
augaucuuuaaaauac

SEQ ID NO: 2255072 - RNA, 16 nt, Human
augccugcggaguugu

SEQ ID NO: 2255073 - RNA, 21 nt, Human
augccugauugccaagcucag

SEQ ID NO: 2255074 - RNA, 19 nt, Human
augccugccccaaacaaau

SEQ ID NO: 2255075 - RNA, 19 nt, Human
augccugagugccuggcca

SEQ ID NO: 2255076 - RNA, 20 nt, Human
augccugagugccuggccaa

SEQ ID NO: 2255077 - RNA, 19 nt, Human
augccuggauggggcugca

SEQ ID NO: 2255078 - RNA, 18 nt, Human
augccuguccagccuggg

SEQ ID NO: 2255079 - RNA, 17 nt, Human
augccuguccagccugg

SEQ ID NO: 2255080 - RNA, 20 nt, Human
augccuggauggggcugcac

SEQ ID NO: 2255081 - RNA, 16 nt, Human
augcauuaaaagaaaa

SEQ ID NO: 2255082 - RNA, 15 nt, Human
augcauuaaaagaaa

SEQ ID NO: 2255083 - RNA, 17 nt, Human
augcaugugaagaaagg

SEQ ID NO: 2255084 - RNA, 16 nt, Human
augcaugugaagaaag

SEQ ID NO: 2255085 - RNA, 19 nt, Human
augcauguuuuccagcucc

SEQ ID NO: 2255086 - RNA, 20 nt, Human
augcauuaaaagaaaauaaa

SEQ ID NO: 2255087 - RNA, 17 nt, Human
augcauuaaaagaaaau

SEQ ID NO: 2255088 - RNA, 21 nt, Human
augcauuauaggaucauuugu

SEQ ID NO: 2255089 - RNA, 17 nt, Human
augccugaggguggaga

SEQ ID NO: 2255090 - RNA, 16 nt, Human
augccugagugccugg

SEQ ID NO: 2255091 - RNA, 21 nt, Human
augcauucuugguuggcuggc

SEQ ID NO: 2255092 - RNA, 22 nt, Human
augcauuauaggaucauuuguu

SEQ ID NO: 2255093 - RNA, 20 nt, Human
augcauguuuuccagcuccu

SEQ ID NO: 2255094 - RNA, 21 nt, Human
augcacacagugcuuuccgug

SEQ ID NO: 2255095 - RNA, 14 nt, Human
augcacacaaaaca

SEQ ID NO: 2255096 - RNA, 15 nt, Human
augcacacaaaacaa

SEQ ID NO: 2255097 - RNA, 22 nt, Human
augcacacaaaacaacccuaga

SEQ ID NO: 2255098 - RNA, 15 nt, Human
augcacacauuuuuu

SEQ ID NO: 2255099 - RNA, 14 nt, Human
augcacacauuuuu

SEQ ID NO: 2255100 - RNA, 13 nt, Human
augcacacauuuu

SEQ ID NO: 2255101 - RNA, 17 nt, Human
augcauguccuguaaag

SEQ ID NO: 2255102 - RNA, 13 nt, Human
augcaugugaaga

SEQ ID NO: 2255103 - RNA, 14 nt, Human
augcaugugaagaa

SEQ ID NO: 2255104 - RNA, 22 nt, Human
augcacagaguuguuacauuuu

SEQ ID NO: 2255105 - RNA, 21 nt, Human
augcacagaguuguuacauuu

SEQ ID NO: 2255106 - RNA, 19 nt, Human
augcacagaguuguuacau

SEQ ID NO: 2255107 - RNA, 21 nt, Human
augccuuuaaaucugugauga

SEQ ID NO: 2255108 - RNA, 20 nt, Human
augccuuuaaaucugugaug

SEQ ID NO: 2255109 - RNA, 17 nt, Human
augccuuuaaaguauga

SEQ ID NO: 2255110 - RNA, 21 nt, Human
augccuuuaaaguaugaaucu

SEQ ID NO: 2255111 - RNA, 22 nt, Human
augccuuuaaaguaugaaucua

SEQ ID NO: 2255112 - RNA, 20 nt, Human
augccuucuuauugcuuuua

SEQ ID NO: 2255113 - RNA, 15 nt, Human
augccuucuccagac

SEQ ID NO: 2255114 - RNA, 14 nt, Human
augccuucuuauug

SEQ ID NO: 2255115 - RNA, 19 nt, Human
augccuuccagcacccugc

SEQ ID NO: 2255116 - RNA, 16 nt, Human
augccuuccccugggc

SEQ ID NO: 2255117 - RNA, 18 nt, Human
augccuuccagcacccug

SEQ ID NO: 2255118 - RNA, 18 nt, Human
augccuuacucuucuuga

SEQ ID NO: 2255119 - RNA, 16 nt, Human
augccuuacucuucuu

SEQ ID NO: 2255120 - RNA, 18 nt, Human
augcuuuaggauguacag

SEQ ID NO: 2255121 - RNA, 19 nt, Human
augcugcgcccuuccccag

SEQ ID NO: 2255122 - RNA, 19 nt, Human
augcugcuaauucaaagcu

SEQ ID NO: 2255123 - RNA, 13 nt, Human
augcuuguguuau

SEQ ID NO: 2255124 - RNA, 13 nt, Human
augcuuuaaacau

SEQ ID NO: 2255125 - RNA, 15 nt, Human
augcuuguacauaau

SEQ ID NO: 2255126 - RNA, 16 nt, Human
augcuuguacauaaug

SEQ ID NO: 2255127 - RNA, 19 nt, Human
auggaggcacacagcugca

SEQ ID NO: 2255128 - RNA, 12 nt, Human
auggaggccugu

SEQ ID NO: 2255129 - RNA, 17 nt, Human
auggaggcagaauccug

SEQ ID NO: 2255130 - RNA, 15 nt, Human
auggaggccuguccu

SEQ ID NO: 2255131 - RNA, 16 nt, Human
auggagggaauaauac

SEQ ID NO: 2255132 - RNA, 22 nt, Human
auggaggggugguccugacuca

SEQ ID NO: 2255133 - RNA, 20 nt, Human
auggaggggugguccugacu

SEQ ID NO: 2255134 - RNA, 18 nt, Human
auggaggggugguccuga

SEQ ID NO: 2255135 - RNA, 20 nt, Human
auggaguccagggaagagaa

SEQ ID NO: 2255136 - RNA, 24 nt, Human
auggagguuucauacucuagauuu

SEQ ID NO: 2255137 - RNA, 15 nt, Human
auggcugugccucug

SEQ ID NO: 2255138 - RNA, 16 nt, Human
auggcugugccucugc

SEQ ID NO: 2255139 - RNA, 17 nt, Human
auggcugugccucugcc

SEQ ID NO: 2255140 - RNA, 16 nt, Human
auggauccuggaggau

SEQ ID NO: 2255141 - RNA, 15 nt, Human
auggcuggccacugc

SEQ ID NO: 2255142 - RNA, 16 nt, Human
auggcuggccacugca

SEQ ID NO: 2255143 - RNA, 21 nt, Human
auggcuggccacugcacagag

SEQ ID NO: 2255144 - RNA, 22 nt, Human
auggcuggccacugcacagagc

SEQ ID NO: 2255145 - RNA, 23 nt, Human
auggcuggccacugcacagagcu

SEQ ID NO: 2255146 - RNA, 21 nt, Human
auggcugggaacugcagaccu

SEQ ID NO: 2255147 - RNA, 22 nt, Human
auggcugggaacugcagaccug

SEQ ID NO: 2255148 - RNA, 23 nt, Human
auggcugggaacugcagaccugu

SEQ ID NO: 2255149 - RNA, 20 nt, Human
auggcugucucaaaccaagc

SEQ ID NO: 2255150 - RNA, 13 nt, Human
auggcugugagga

SEQ ID NO: 2255151 - RNA, 14 nt, Human
auggcugugaggau

SEQ ID NO: 2255152 - RNA, 15 nt, Human
auggcugugaggaug

SEQ ID NO: 2255153 - RNA, 22 nt, Human
auggauauaguuuuacuuuuaa

SEQ ID NO: 2255154 - RNA, 18 nt, Human
auggauaggcacaggaaa

SEQ ID NO: 2255155 - RNA, 17 nt, Human
auggauaggcacaggaa

SEQ ID NO: 2255156 - RNA, 21 nt, Human
auggauaaugccggugagaau

SEQ ID NO: 2255157 - RNA, 22 nt, Human
auggauaaugccggugagaaua

SEQ ID NO: 2255158 - RNA, 18 nt, Human
auggauaaccuauaugau

SEQ ID NO: 2255159 - RNA, 19 nt, Human
auggauaaccuauaugauu

SEQ ID NO: 2255160 - RNA, 17 nt, Human
auggcuuuugugcauua

SEQ ID NO: 2255161 - RNA, 16 nt, Human
auggcuuuugugcauu

SEQ ID NO: 2255162 - RNA, 18 nt, Human
auggcuuuugugcauuau

SEQ ID NO: 2255163 - RNA, 17 nt, Human
auggcuuugugauucaa

SEQ ID NO: 2255164 - RNA, 19 nt, Human
augcugacuguacuccucc

SEQ ID NO: 2255165 - RNA, 22 nt, Human
augcugacauucaccugcccca

SEQ ID NO: 2255166 - RNA, 20 nt, Human
augcugacuguacuccuccc

SEQ ID NO: 2255167 - RNA, 21 nt, Human
augcugacuguacuccuccca

SEQ ID NO: 2255168 - RNA, 20 nt, Human
augcugacauucaccugccc

SEQ ID NO: 2255169 - RNA, 19 nt, Human
augcugacauucaccugcc

SEQ ID NO: 2255170 - RNA, 23 nt, Human
augcugaauauacagcaggugcu

SEQ ID NO: 2255171 - RNA, 21 nt, Human
augcugagauuacagguguga

SEQ ID NO: 2255172 - RNA, 14 nt, Human
augcugaggccugg

SEQ ID NO: 2255173 - RNA, 15 nt, Human
augcugaggccuggg

SEQ ID NO: 2255174 - RNA, 17 nt, Human
augcugaggccugggcc

SEQ ID NO: 2255175 - RNA, 18 nt, Human
augcugaggccugggccg

SEQ ID NO: 2255176 - RNA, 22 nt, Human
augcugaggccugggccgcugc

SEQ ID NO: 2255177 - RNA, 14 nt, Human
augcugauguccuc

SEQ ID NO: 2255178 - RNA, 22 nt, Human
augcugaguauguuaagcucuu

SEQ ID NO: 2255179 - RNA, 14 nt, Human
augcugagucuccc

SEQ ID NO: 2255180 - RNA, 18 nt, Human
augcugagucucccaagg

SEQ ID NO: 2255181 - RNA, 16 nt, Human
augcugauguccucac

SEQ ID NO: 2255182 - RNA, 12 nt, Human
augcugauguuc

SEQ ID NO: 2255183 - RNA, 15 nt, Human
augcugauguucagu

SEQ ID NO: 2255184 - RNA, 13 nt, Human
augcugccugagu

SEQ ID NO: 2255185 - RNA, 11 nt, Human
augcugccugc

SEQ ID NO: 2255186 - RNA, 13 nt, Human
augcugccugccu

SEQ ID NO: 2255187 - RNA, 12 nt, Human
augcugccugag

SEQ ID NO: 2255188 - RNA, 19 nt, Human
augcugccuaggcugaccu

SEQ ID NO: 2255189 - RNA, 17 nt, Human
augcugccuaggcugac

SEQ ID NO: 2255190 - RNA, 18 nt, Human
augcugcgcccuucccca

SEQ ID NO: 2255191 - RNA, 16 nt, Human
augcugcgcccuuccc

SEQ ID NO: 2255192 - RNA, 14 nt, Human
augcugccugccug

SEQ ID NO: 2255193 - RNA, 15 nt, Human
augcugccugccugu

SEQ ID NO: 2255194 - RNA, 17 nt, Human
augcugccugccugucu

SEQ ID NO: 2255195 - RNA, 18 nt, Human
augcugccugccugucug

SEQ ID NO: 2255196 - RNA, 12 nt, Human
augcugccucca

SEQ ID NO: 2255197 - RNA, 15 nt, Human
augcugccuccagaa

SEQ ID NO: 2255198 - RNA, 16 nt, Human
augcugcccugugagu

SEQ ID NO: 2255199 - RNA, 13 nt, Human
augcugcccugug

SEQ ID NO: 2255200 - RNA, 16 nt, Human
augcugauguucagug

SEQ ID NO: 2255201 - RNA, 17 nt, Human
augcugauguucagugu

SEQ ID NO: 2255202 - RNA, 18 nt, Human
augcugauguucagugua

SEQ ID NO: 2255203 - RNA, 19 nt, Human
augcugauguucaguguaa

SEQ ID NO: 2255204 - RNA, 20 nt, Human
augcugauguucaguguaau

SEQ ID NO: 2255205 - RNA, 14 nt, Human
augcugcccuguga

SEQ ID NO: 2255206 - RNA, 15 nt, Human
augcugcccugugag

SEQ ID NO: 2255207 - RNA, 14 nt, Human
agugucaggaggaa

SEQ ID NO: 2255208 - RNA, 21 nt, Human
agugucacuuaccuagauuua

SEQ ID NO: 2255209 - RNA, 19 nt, Human
agugucacuuaccuagauu

SEQ ID NO: 2255210 - RNA, 19 nt, Human
agugucauuuaugaaaaga

SEQ ID NO: 2255211 - RNA, 16 nt, Human
agugucaucagaagau

SEQ ID NO: 2255212 - RNA, 20 nt, Human
agugucaucagaagauaacu

SEQ ID NO: 2255213 - RNA, 22 nt, Human
agugucaaguugugcuuguuua

SEQ ID NO: 2255214 - RNA, 20 nt, Human
agugucauauguaggugucu

SEQ ID NO: 2255215 - RNA, 18 nt, Human
agugucucaguccaccug

SEQ ID NO: 2255216 - RNA, 15 nt, Human
agugucucacacugg

SEQ ID NO: 2255217 - RNA, 14 nt, Human
agugucuaaaaaca

SEQ ID NO: 2255218 - RNA, 14 nt, Human
aguguccaaagcag

SEQ ID NO: 2255219 - RNA, 22 nt, Human
agugucucggagggauuccccu

SEQ ID NO: 2255220 - RNA, 12 nt, Human
agugucuggcug

SEQ ID NO: 2255221 - RNA, 20 nt, Human
agugggccaggacaggcccg

SEQ ID NO: 2255222 - RNA, 19 nt, Human
agugggccaggacaggccc

SEQ ID NO: 2255223 - RNA, 16 nt, Human
agugggccaggacagg

SEQ ID NO: 2255224 - RNA, 15 nt, Human
agugggccaggacag

SEQ ID NO: 2255225 - RNA, 13 nt, Human
agugggccaggac

SEQ ID NO: 2255226 - RNA, 20 nt, Human
agugggaucugucacaccag

SEQ ID NO: 2255227 - RNA, 22 nt, Human
agugggaggggcaggcugacau

SEQ ID NO: 2255228 - RNA, 18 nt, Human
agugggaggggcaggcug

SEQ ID NO: 2255229 - RNA, 19 nt, Human
agugggaggggcaggcuga

SEQ ID NO: 2255230 - RNA, 14 nt, Human
agugggccagugug

SEQ ID NO: 2255231 - RNA, 18 nt, Human
agugucaaguugugcuug

SEQ ID NO: 2255232 - RNA, 19 nt, Human
agugucaaguugugcuugu

SEQ ID NO: 2255233 - RNA, 20 nt, Human
agugucaaguugugcuuguu

SEQ ID NO: 2255234 - RNA, 21 nt, Human
agugggccaggacaggcccgg

SEQ ID NO: 2255235 - RNA, 19 nt, Human
agugucaaugcagccccca

SEQ ID NO: 2255236 - RNA, 17 nt, Human
aguggcuuuaaugaaua

SEQ ID NO: 2255237 - RNA, 19 nt, Human
aguggcuuuuuuccuccug

SEQ ID NO: 2255238 - RNA, 21 nt, Human
aguggcuuuuuuccuccugug

SEQ ID NO: 2255239 - RNA, 23 nt, Human
aguggccuggccaggagcucuuc

SEQ ID NO: 2255240 - RNA, 22 nt, Human
aguggccuggccaggagcucuu

SEQ ID NO: 2255241 - RNA, 20 nt, Human
aguggccuggccaggagcuc

SEQ ID NO: 2255242 - RNA, 19 nt, Human
aguggccuggccaggagcu

SEQ ID NO: 2255243 - RNA, 18 nt, Human
aguggccuggccaggagc

SEQ ID NO: 2255244 - RNA, 15 nt, Human
aguggccuggccagg

SEQ ID NO: 2255245 - RNA, 14 nt, Human
aguggccuggccag

SEQ ID NO: 2255246 - RNA, 13 nt, Human
aguggccuggcca

SEQ ID NO: 2255247 - RNA, 23 nt, Human
aguggccucuuugucuaaaacaa

SEQ ID NO: 2255248 - RNA, 21 nt, Human
aguggccucuuugucuaaaac

SEQ ID NO: 2255249 - RNA, 15 nt, Human
aguggccucuuuguc

SEQ ID NO: 2255250 - RNA, 14 nt, Human
aguggccucuuugu

SEQ ID NO: 2255251 - RNA, 17 nt, Human
agugggacagagucugg

SEQ ID NO: 2255252 - RNA, 16 nt, Human
agugggaggcgcgagc

SEQ ID NO: 2255253 - RNA, 11 nt, Human
agugggagggg

SEQ ID NO: 2255254 - RNA, 12 nt, Human
agugggaggggc

SEQ ID NO: 2255255 - RNA, 13 nt, Human
agugggaggggca

SEQ ID NO: 2255256 - RNA, 14 nt, Human
agugggaggggcag

SEQ ID NO: 2255257 - RNA, 15 nt, Human
agugggaggggcagg

SEQ ID NO: 2255258 - RNA, 16 nt, Human
agugggaggggcaggc

SEQ ID NO: 2255259 - RNA, 17 nt, Human
agugggaggggcaggcu

SEQ ID NO: 2255260 - RNA, 15 nt, Human
agugggacagagucu

SEQ ID NO: 2255261 - RNA, 20 nt, Human
agugggaacgugacugcccc

SEQ ID NO: 2255262 - RNA, 19 nt, Human
agugggacagggcauggcc

SEQ ID NO: 2255263 - RNA, 21 nt, Human
agugggacagggcauggccag

SEQ ID NO: 2255264 - RNA, 22 nt, Human
agugucugugugcaagugugug

SEQ ID NO: 2255265 - RNA, 13 nt, Human
agugucugugugc

SEQ ID NO: 2255266 - RNA, 22 nt, Human
agugucugucccgggguccugu

SEQ ID NO: 2255267 - RNA, 22 nt, Human
agugucuguaucggagacagug

SEQ ID NO: 2255268 - RNA, 19 nt, Human
agugucugggcugacuggg

SEQ ID NO: 2255269 - RNA, 22 nt, Human
agugucucaguccaccugagcu

SEQ ID NO: 2255270 - RNA, 19 nt, Human
agugucucaguccaccuga

SEQ ID NO: 2255271 - RNA, 16 nt, Human
agugucuggcacacag

SEQ ID NO: 2255272 - RNA, 14 nt, Human
agugucugggcuga

SEQ ID NO: 2255273 - RNA, 14 nt, Human
agugucuggcugca

SEQ ID NO: 2255274 - RNA, 13 nt, Human
agugucuggcugc

SEQ ID NO: 2255275 - RNA, 21 nt, Human
agugaugcugugcuaugaauu

SEQ ID NO: 2255276 - RNA, 21 nt, Human
agugaucuccauauguuacac

SEQ ID NO: 2255277 - RNA, 14 nt, Human
agugaucuccauau

SEQ ID NO: 2255278 - RNA, 13 nt, Human
agugaucuccaua

SEQ ID NO: 2255279 - RNA, 16 nt, Human
agugauccuuacaagu

SEQ ID NO: 2255280 - RNA, 14 nt, Human
agugauucuccugc

SEQ ID NO: 2255281 - RNA, 21 nt, Human
agugauucucaugccucagcc

SEQ ID NO: 2255282 - RNA, 20 nt, Human
agugccuuaccuccugccca

SEQ ID NO: 2255283 - RNA, 19 nt, Human
agugccuuaccuccugccc

SEQ ID NO: 2255284 - RNA, 18 nt, Human
agugccuuaccuccugcc

SEQ ID NO: 2255285 - RNA, 17 nt, Human
agugccuuaccuccugc

SEQ ID NO: 2255286 - RNA, 16 nt, Human
agugccuuaccuccug

SEQ ID NO: 2255287 - RNA, 14 nt, Human
agugauggagcaga

SEQ ID NO: 2255288 - RNA, 18 nt, Human
agugauggagcagagcaa

SEQ ID NO: 2255289 - RNA, 18 nt, Human
agugccuuacacaauggu

SEQ ID NO: 2255290 - RNA, 15 nt, Human
agugauucuccugcc

SEQ ID NO: 2255291 - RNA, 17 nt, Human
agugauucuccugccuc

SEQ ID NO: 2255292 - RNA, 14 nt, Human
agugauccucccac

SEQ ID NO: 2255293 - RNA, 15 nt, Human
agugauccucccacc

SEQ ID NO: 2255294 - RNA, 18 nt, Human
agugauccucccaccuca

SEQ ID NO: 2255295 - RNA, 24 nt, Human
agugauccucccaccucagccucc

SEQ ID NO: 2255296 - RNA, 21 nt, Human
aguggccucaacccucccuca

SEQ ID NO: 2255297 - RNA, 20 nt, Human
aguggccucaacccucccuc

SEQ ID NO: 2255298 - RNA, 15 nt, Human
aguggccucaacccu

SEQ ID NO: 2255299 - RNA, 22 nt, Human
aguggccucaacccucccucag

SEQ ID NO: 2255300 - RNA, 14 nt, Human
agugcugaacagug

SEQ ID NO: 2255301 - RNA, 15 nt, Human
agugcugaacagugg

SEQ ID NO: 2255302 - RNA, 21 nt, Human
agugcucugaucccucuacag

SEQ ID NO: 2255303 - RNA, 17 nt, Human
agugcucugaucccucu

SEQ ID NO: 2255304 - RNA, 16 nt, Human
agugcucugaucccuc

SEQ ID NO: 2255305 - RNA, 20 nt, Human
agugcucgcuuucuauguag

SEQ ID NO: 2255306 - RNA, 12 nt, Human
agugcucugaua

SEQ ID NO: 2255307 - RNA, 11 nt, Human
agugcucugau

SEQ ID NO: 2255308 - RNA, 12 nt, Human
agugcucgcuuu

SEQ ID NO: 2255309 - RNA, 18 nt, Human
agugcucgcuuucuaugu

SEQ ID NO: 2255310 - RNA, 22 nt, Human
agugcucgcuguugcugaauag

SEQ ID NO: 2255311 - RNA, 23 nt, Human
agugcucgcuguugcugaauagg

SEQ ID NO: 2255312 - RNA, 18 nt, Human
agugcuaauuuugaaaaa

SEQ ID NO: 2255313 - RNA, 20 nt, Human
agugcuaauuuugaaaaacu

SEQ ID NO: 2255314 - RNA, 19 nt, Human
agugcuaagugugaacugg

SEQ ID NO: 2255315 - RNA, 22 nt, Human
agugcuaagugugaacuggacc

SEQ ID NO: 2255316 - RNA, 15 nt, Human
agugcucgcuguugc

SEQ ID NO: 2255317 - RNA, 16 nt, Human
agugcucgcuguugcu

SEQ ID NO: 2255318 - RNA, 17 nt, Human
agugcucgcuguugcug

SEQ ID NO: 2255319 - RNA, 18 nt, Human
agugcucgcuguugcuga

SEQ ID NO: 2255320 - RNA, 19 nt, Human
agugcucgcuguugcugaa

SEQ ID NO: 2255321 - RNA, 20 nt, Human
agugcucgcuguugcugaau

SEQ ID NO: 2255322 - RNA, 22 nt, Human
agugccuuaccuccugcccagg

SEQ ID NO: 2255323 - RNA, 21 nt, Human
agugccuuaccuccugcccag

SEQ ID NO: 2255324 - RNA, 23 nt, Human
agugccuuaccuccugcccagga

SEQ ID NO: 2255325 - RNA, 14 nt, Human
agugcuaaguguga

SEQ ID NO: 2255326 - RNA, 16 nt, Human
agugccuuauggaaca

SEQ ID NO: 2255327 - RNA, 15 nt, Human
agugcuaauuuugaa

SEQ ID NO: 2255328 - RNA, 15 nt, Human
agugcuaagugugaa

SEQ ID NO: 2255329 - RNA, 16 nt, Human
agugcuaagugugaac

SEQ ID NO: 2255330 - RNA, 17 nt, Human
agugcuaagugugaacu

SEQ ID NO: 2255331 - RNA, 18 nt, Human
agugcuaagugugaacug

SEQ ID NO: 2255332 - RNA, 10 nt, Human
agugccuuau

SEQ ID NO: 2255333 - RNA, 13 nt, Human
agugccuuaugga

SEQ ID NO: 2255334 - RNA, 14 nt, Human
agugccuuauggaa

SEQ ID NO: 2255335 - RNA, 15 nt, Human
agugccuuauggaac

SEQ ID NO: 2255336 - RNA, 13 nt, Human
aguucagcuuggg

SEQ ID NO: 2255337 - RNA, 18 nt, Human
aguucagcaccacccuag

SEQ ID NO: 2255338 - RNA, 17 nt, Human
aguucagcaccacccua

SEQ ID NO: 2255339 - RNA, 15 nt, Human
aguucagcaccaccc

SEQ ID NO: 2255340 - RNA, 16 nt, Human
aguucaggagucccaa

SEQ ID NO: 2255341 - RNA, 14 nt, Human
aguucagcuugggg

SEQ ID NO: 2255342 - RNA, 20 nt, Human
aguucaggagucccaaggaa

SEQ ID NO: 2255343 - RNA, 19 nt, Human
aguucaggagucccaagga

SEQ ID NO: 2255344 - RNA, 21 nt, Human
aguucaggagucccaaggaaa

SEQ ID NO: 2255345 - RNA, 18 nt, Human
aguucagguaacaggcag

SEQ ID NO: 2255346 - RNA, 13 nt, Human
aguucaucuugaa

SEQ ID NO: 2255347 - RNA, 15 nt, Human
aguucaucuugaauu

SEQ ID NO: 2255348 - RNA, 19 nt, Human
aguucaucuugaauuguaa

SEQ ID NO: 2255349 - RNA, 18 nt, Human
aguugugaccuuaguguu

SEQ ID NO: 2255350 - RNA, 18 nt, Human
aguugugcacauggcuua

SEQ ID NO: 2255351 - RNA, 22 nt, Human
aguugugaguuuaccuuguaua

SEQ ID NO: 2255352 - RNA, 14 nt, Human
aguugugcuuguuu

SEQ ID NO: 2255353 - RNA, 21 nt, Human
aguugugccuuuuauagcuau

SEQ ID NO: 2255354 - RNA, 22 nt, Human
aguugugccuuuuauagcuauu

SEQ ID NO: 2255355 - RNA, 21 nt, Human
aguugugaccuuaguguuucu

SEQ ID NO: 2255356 - RNA, 15 nt, Human
aguugugccuuuuau

SEQ ID NO: 2255357 - RNA, 18 nt, Human
aguugugccuuuuauagc

SEQ ID NO: 2255358 - RNA, 19 nt, Human
aguugugccuuuuauagcu

SEQ ID NO: 2255359 - RNA, 13 nt, Human
aguugucuugucc

SEQ ID NO: 2255360 - RNA, 13 nt, Human
aguugucuaaaca

SEQ ID NO: 2255361 - RNA, 21 nt, Human
aguugagccccaaguccugaa

SEQ ID NO: 2255362 - RNA, 21 nt, Human
aguugagccagcagacauugu

SEQ ID NO: 2255363 - RNA, 11 nt, Human
aguugagcccc

SEQ ID NO: 2255364 - RNA, 12 nt, Human
aguugagcccca

SEQ ID NO: 2255365 - RNA, 16 nt, Human
aguugagccccaaguc

SEQ ID NO: 2255366 - RNA, 20 nt, Human
aguugagucgucaucacuuu

SEQ ID NO: 2255367 - RNA, 17 nt, Human
aguugagugauagagcu

SEQ ID NO: 2255368 - RNA, 16 nt, Human
aguugauacuacaguu

SEQ ID NO: 2255369 - RNA, 22 nt, Human
aguugacuugacagaacacugu

SEQ ID NO: 2255370 - RNA, 15 nt, Human
aguugagccagcaga

SEQ ID NO: 2255371 - RNA, 16 nt, Human
aguugagccagcagac

SEQ ID NO: 2255372 - RNA, 19 nt, Human
aguugagccagcagacauu

SEQ ID NO: 2255373 - RNA, 20 nt, Human
aguugagccagcagacauug

SEQ ID NO: 2255374 - RNA, 17 nt, Human
aguugacaugagauuua

SEQ ID NO: 2255375 - RNA, 13 nt, Human
aguugacagcagg

SEQ ID NO: 2255376 - RNA, 22 nt, Human
aguugacaaaaagcucuuacac

SEQ ID NO: 2255377 - RNA, 22 nt, Human
aguucaucuugaauuguaagga

SEQ ID NO: 2255378 - RNA, 18 nt, Human
aguugaaaagacuccaaa

SEQ ID NO: 2255379 - RNA, 20 nt, Human
aguugaaaagacuccaaaga

SEQ ID NO: 2255380 - RNA, 19 nt, Human
aguugaaaagacuccaaag

SEQ ID NO: 2255381 - RNA, 13 nt, Human
aguaagaaaauau

SEQ ID NO: 2255382 - RNA, 23 nt, Human
aguaaccaucacugguugcacuu

SEQ ID NO: 2255383 - RNA, 14 nt, Human
aguaaccauuugca

SEQ ID NO: 2255384 - RNA, 21 nt, Human
aguaagaaagugaagcaaauc

SEQ ID NO: 2255385 - RNA, 23 nt, Human
aguaagaaaauauuuugucuaaa

SEQ ID NO: 2255386 - RNA, 17 nt, Human
aguaagaaccuugccug

SEQ ID NO: 2255387 - RNA, 20 nt, Human
aguaagaaagugaagcaaau

SEQ ID NO: 2255388 - RNA, 14 nt, Human
aguaagaaaauauu

SEQ ID NO: 2255389 - RNA, 16 nt, Human
aguaagaaaauauuuu

SEQ ID NO: 2255390 - RNA, 17 nt, Human
aguaacaugaggggaca

SEQ ID NO: 2255391 - RNA, 23 nt, Human
aguaacaggaaaccacuuaucac

SEQ ID NO: 2255392 - RNA, 14 nt, Human
aguaagagcuggug

SEQ ID NO: 2255393 - RNA, 12 nt, Human
aguaagagcugg

SEQ ID NO: 2255394 - RNA, 16 nt, Human
aguaagaagacaugaa

SEQ ID NO: 2255395 - RNA, 15 nt, Human
aguaagaagacauga

SEQ ID NO: 2255396 - RNA, 14 nt, Human
aguaagaagacaug

SEQ ID NO: 2255397 - RNA, 19 nt, Human
aguaagagcuggugucuga

SEQ ID NO: 2255398 - RNA, 14 nt, Human
aguacguugugcau

SEQ ID NO: 2255399 - RNA, 15 nt, Human
aguacguugugcauu

SEQ ID NO: 2255400 - RNA, 14 nt, Human
aguaaauauuucag

SEQ ID NO: 2255401 - RNA, 16 nt, Human
aggucuguucuuucca

SEQ ID NO: 2255402 - RNA, 15 nt, Human
aggucuguucuuucc

SEQ ID NO: 2255403 - RNA, 13 nt, Human
aggucuguucuuu

SEQ ID NO: 2255404 - RNA, 18 nt, Human
aguaaaugggggugcauu

SEQ ID NO: 2255405 - RNA, 19 nt, Human
aguaacaaugaagauaaaa

SEQ ID NO: 2255406 - RNA, 22 nt, Human
aguaaauggcuuauccagcugg

SEQ ID NO: 2255407 - RNA, 15 nt, Human
aguaaaucuuuuaca

SEQ ID NO: 2255408 - RNA, 23 nt, Human
aguaaaugcuagguuaauuccaa

SEQ ID NO: 2255409 - RNA, 11 nt, Human
aguaaaugcua

SEQ ID NO: 2255410 - RNA, 22 nt, Human
aguaaaugcuagguuaauucca

SEQ ID NO: 2255411 - RNA, 20 nt, Human
aguacuggcugauggaguaa

SEQ ID NO: 2255412 - RNA, 16 nt, Human
aguacuguguacagaa

SEQ ID NO: 2255413 - RNA, 14 nt, Human
aguacuauguauca

SEQ ID NO: 2255414 - RNA, 12 nt, Human
aguacuauguau

SEQ ID NO: 2255415 - RNA, 17 nt, Human
aguacuucuccacccug

SEQ ID NO: 2255416 - RNA, 12 nt, Human
aguacuucuuuu

SEQ ID NO: 2255417 - RNA, 22 nt, Human
aguacuucuccacccugcucuc

SEQ ID NO: 2255418 - RNA, 22 nt, Human
aguaagcccuugaagauaucuu

SEQ ID NO: 2255419 - RNA, 18 nt, Human
aguacguugugcauuugg

SEQ ID NO: 2255420 - RNA, 17 nt, Human
aguacguugugcauuug

SEQ ID NO: 2255421 - RNA, 16 nt, Human
aguacguugugcauuu

SEQ ID NO: 2255422 - RNA, 23 nt, Human
aguacuaacuccuaggaaaauac

SEQ ID NO: 2255423 - RNA, 14 nt, Human
aguacuauaauuua

SEQ ID NO: 2255424 - RNA, 19 nt, Human
aguacuacaguccucccau

SEQ ID NO: 2255425 - RNA, 22 nt, Human
aguacuacaguccucccaucuc

SEQ ID NO: 2255426 - RNA, 16 nt, Human
agucacaagagcccag

SEQ ID NO: 2255427 - RNA, 22 nt, Human
agucacacaguauuacuucugc

SEQ ID NO: 2255428 - RNA, 23 nt, Human
agucaauguuuucaguucucuug

SEQ ID NO: 2255429 - RNA, 14 nt, Human
agucaaugugcagu

SEQ ID NO: 2255430 - RNA, 15 nt, Human
agucaaugugcagug

SEQ ID NO: 2255431 - RNA, 18 nt, Human
agucaaaaggugccugug

SEQ ID NO: 2255432 - RNA, 18 nt, Human
agucaauccccucauuca

SEQ ID NO: 2255433 - RNA, 14 nt, Human
agucaaaacagaga

SEQ ID NO: 2255434 - RNA, 20 nt, Human
aguauuuuuuuaucuuggga

SEQ ID NO: 2255435 - RNA, 17 nt, Human
agucaaaaggugccugu

SEQ ID NO: 2255436 - RNA, 16 nt, Human
agucaaaaggugccug

SEQ ID NO: 2255437 - RNA, 15 nt, Human
agucaaaaggugccu

SEQ ID NO: 2255438 - RNA, 16 nt, Human
agucaaaacucaaaug

SEQ ID NO: 2255439 - RNA, 21 nt, Human
agucaaaacagagaugugaua

SEQ ID NO: 2255440 - RNA, 17 nt, Human
agucaaaacuacaaauc

SEQ ID NO: 2255441 - RNA, 17 nt, Human
aguaugaggcauuuguu

SEQ ID NO: 2255442 - RNA, 23 nt, Human
aguaugaggcauuuguuugaacu

SEQ ID NO: 2255443 - RNA, 22 nt, Human
aguaucuauauauguguaugua

SEQ ID NO: 2255444 - RNA, 23 nt, Human
aguaucuauauauguguauguac

SEQ ID NO: 2255445 - RNA, 16 nt, Human
aguaucuaacauguau

SEQ ID NO: 2255446 - RNA, 17 nt, Human
aguaucuauauaugugu

SEQ ID NO: 2255447 - RNA, 18 nt, Human
aguaucuauauaugugua

SEQ ID NO: 2255448 - RNA, 19 nt, Human
aguaucuauauauguguau

SEQ ID NO: 2255449 - RNA, 23 nt, Human
aguauccuccagguuuuucaauu

SEQ ID NO: 2255450 - RNA, 21 nt, Human
aguauccuccagguuuuucaa

SEQ ID NO: 2255451 - RNA, 22 nt, Human
aguauccuccagguuuuucaau

SEQ ID NO: 2255452 - RNA, 21 nt, Human
aguaugaggcauuuguuugaa

SEQ ID NO: 2255453 - RNA, 20 nt, Human
aguaugaggcauuuguuuga

SEQ ID NO: 2255454 - RNA, 14 nt, Human
aguauccacuuugc

SEQ ID NO: 2255455 - RNA, 13 nt, Human
aguauccuccagg

SEQ ID NO: 2255456 - RNA, 14 nt, Human
aguauccuccaggu

SEQ ID NO: 2255457 - RNA, 15 nt, Human
aguauccuccagguu

SEQ ID NO: 2255458 - RNA, 16 nt, Human
aguauccuccagguuu

SEQ ID NO: 2255459 - RNA, 17 nt, Human
aguauccuccagguuuu

SEQ ID NO: 2255460 - RNA, 19 nt, Human
aguauccuccagguuuuuc

SEQ ID NO: 2255461 - RNA, 20 nt, Human
aguauccuccagguuuuuca

SEQ ID NO: 2255462 - RNA, 23 nt, Human
aguacuugggagaccuguaauca

SEQ ID NO: 2255463 - RNA, 11 nt, Human
aguacuugaaa

SEQ ID NO: 2255464 - RNA, 19 nt, Human
aguacuugaaaucuaggau

SEQ ID NO: 2255465 - RNA, 11 nt, Human
aguccuuccac

SEQ ID NO: 2255466 - RNA, 17 nt, Human
aguccuucaccucacug

SEQ ID NO: 2255467 - RNA, 14 nt, Human
aguccuugaaaaua

SEQ ID NO: 2255468 - RNA, 23 nt, Human
aguccuuaccucuuccggagaug

SEQ ID NO: 2255469 - RNA, 16 nt, Human
aguccuucaccucacu

SEQ ID NO: 2255470 - RNA, 21 nt, Human
aguccuuaccucuuccggaga

SEQ ID NO: 2255471 - RNA, 17 nt, Human
aguccuuaccucuuccg

SEQ ID NO: 2255472 - RNA, 15 nt, Human
aguccuuaccucuuc

SEQ ID NO: 2255473 - RNA, 23 nt, Human
aguccugcacaguuuucuggcug

SEQ ID NO: 2255474 - RNA, 19 nt, Human
aguccuuaccagcagagca

SEQ ID NO: 2255475 - RNA, 15 nt, Human
aguccuugcaagaau

SEQ ID NO: 2255476 - RNA, 16 nt, Human
aguccuugaaaauauu

SEQ ID NO: 2255477 - RNA, 17 nt, Human
aguccuugaaaauauuu

SEQ ID NO: 2255478 - RNA, 22 nt, Human
aguccuugaaaauauuuuuuau

SEQ ID NO: 2255479 - RNA, 16 nt, Human
agucugaauuuuuaaa

SEQ ID NO: 2255480 - RNA, 12 nt, Human
agucugugugaa

SEQ ID NO: 2255481 - RNA, 11 nt, Human
agucuguguga

SEQ ID NO: 2255482 - RNA, 14 nt, Human
agucuguggaucag

SEQ ID NO: 2255483 - RNA, 17 nt, Human
agucuguggaucagaga

SEQ ID NO: 2255484 - RNA, 22 nt, Human
agucugauccaggaggccgggg

SEQ ID NO: 2255485 - RNA, 21 nt, Human
agucugugagauucauucaug

SEQ ID NO: 2255486 - RNA, 15 nt, Human
agucugauccaggag

SEQ ID NO: 2255487 - RNA, 20 nt, Human
agucugugccacguguuugu

SEQ ID NO: 2255488 - RNA, 16 nt, Human
agucugaguaaaaucu

SEQ ID NO: 2255489 - RNA, 15 nt, Human
agugaauuugaauga

SEQ ID NO: 2255490 - RNA, 14 nt, Human
agugaauuugaaug

SEQ ID NO: 2255491 - RNA, 13 nt, Human
agugaauuugaau

SEQ ID NO: 2255492 - RNA, 21 nt, Human
agugaauugugaccaaguuau

SEQ ID NO: 2255493 - RNA, 16 nt, Human
agugaauuuuucucua

SEQ ID NO: 2255494 - RNA, 15 nt, Human
agugaauuuuucucu

SEQ ID NO: 2255495 - RNA, 20 nt, Human
agugaauuugaaugaaaaau

SEQ ID NO: 2255496 - RNA, 20 nt, Human
agugaauuuuucucuaacuc

SEQ ID NO: 2255497 - RNA, 17 nt, Human
agugaauuuuucucuaa

SEQ ID NO: 2255498 - RNA, 23 nt, Human
agugaauuuuucucuaacucaga

SEQ ID NO: 2255499 - RNA, 19 nt, Human
agugaauuugaaugaaaaa

SEQ ID NO: 2255500 - RNA, 17 nt, Human
agugaccucagcuuuga

SEQ ID NO: 2255501 - RNA, 21 nt, Human
agucugugugaugaacuuucu

SEQ ID NO: 2255502 - RNA, 22 nt, Human
agucugugugaugaacuuucuc

SEQ ID NO: 2255503 - RNA, 15 nt, Human
agucugugugaaggu

SEQ ID NO: 2255504 - RNA, 18 nt, Human
agucugugugaugaacuu

SEQ ID NO: 2255505 - RNA, 19 nt, Human
agucugugugaugaacuuu

SEQ ID NO: 2255506 - RNA, 12 nt, Human
agucuguuuuau

SEQ ID NO: 2255507 - RNA, 15 nt, Human
agugaaugcugggac

SEQ ID NO: 2255508 - RNA, 19 nt, Human
agugaaugcugggacucag

SEQ ID NO: 2255509 - RNA, 20 nt, Human
agugaauucuugaaggaaaa

SEQ ID NO: 2255510 - RNA, 14 nt, Human
agugacgugcaccu

SEQ ID NO: 2255511 - RNA, 15 nt, Human
agugaccugaggaag

SEQ ID NO: 2255512 - RNA, 14 nt, Human
agugaccugaggaa

SEQ ID NO: 2255513 - RNA, 18 nt, Human
agugaccucagcuuugau

SEQ ID NO: 2255514 - RNA, 17 nt, Human
agugaccugaggaagcg

SEQ ID NO: 2255515 - RNA, 16 nt, Human
agugaccugaggaagc

SEQ ID NO: 2255516 - RNA, 18 nt, Human
agugaccugaggaagcgu

SEQ ID NO: 2255517 - RNA, 19 nt, Human
aguccaagaggguccuuua

SEQ ID NO: 2255518 - RNA, 12 nt, Human
aguccugaagag

SEQ ID NO: 2255519 - RNA, 13 nt, Human
aguccugaagagg

SEQ ID NO: 2255520 - RNA, 14 nt, Human
aguccugaagaggc

SEQ ID NO: 2255521 - RNA, 19 nt, Human
aguccugaagaggcgggcc

SEQ ID NO: 2255522 - RNA, 22 nt, Human
aguccucuuuucugagaggacu

SEQ ID NO: 2255523 - RNA, 20 nt, Human
aguccugcacaguuuucugg

SEQ ID NO: 2255524 - RNA, 20 nt, Human
aguccugaucagagccgugg

SEQ ID NO: 2255525 - RNA, 23 nt, Human
aguccugaagaggcgggccagcc

SEQ ID NO: 2255526 - RNA, 21 nt, Human
aguccugaagaggcgggccag

SEQ ID NO: 2255527 - RNA, 22 nt, Human
aguccugaagaggcgggccagc

SEQ ID NO: 2255528 - RNA, 20 nt, Human
aguccuuaccagcagagcac

SEQ ID NO: 2255529 - RNA, 18 nt, Human
aguccaacguggggcagc

SEQ ID NO: 2255530 - RNA, 19 nt, Human
aguccaaauguuuacaggg

SEQ ID NO: 2255531 - RNA, 23 nt, Human
aguccaaauguccuccagaagcc

SEQ ID NO: 2255532 - RNA, 19 nt, Human
aguccaaauguccuccaga

SEQ ID NO: 2255533 - RNA, 19 nt, Human
aguccaacguggggcagca

SEQ ID NO: 2255534 - RNA, 20 nt, Human
aguccaacguggggcagcac

SEQ ID NO: 2255535 - RNA, 22 nt, Human
aguccaacguggggcagcacag

SEQ ID NO: 2255536 - RNA, 23 nt, Human
aguccaacguggggcagcacaga

SEQ ID NO: 2255537 - RNA, 19 nt, Human
aguccucuuuucugagagg

SEQ ID NO: 2255538 - RNA, 11 nt, Human
aguccaagcau

SEQ ID NO: 2255539 - RNA, 19 nt, Human
agucaugcguuuaaucaca

SEQ ID NO: 2255540 - RNA, 16 nt, Human
agucaugcauaaauau

SEQ ID NO: 2255541 - RNA, 17 nt, Human
agucaugcauaaauaug

SEQ ID NO: 2255542 - RNA, 19 nt, Human
agucaugcauaaauaugca

SEQ ID NO: 2255543 - RNA, 20 nt, Human
agucaugcauaaauaugcag

SEQ ID NO: 2255544 - RNA, 17 nt, Human
agucaugcaaaggcugg

SEQ ID NO: 2255545 - RNA, 18 nt, Human
agucaugcaaaggcuggg

SEQ ID NO: 2255546 - RNA, 19 nt, Human
agucaugcaaaggcuggga

SEQ ID NO: 2255547 - RNA, 20 nt, Human
agucaugcaaaggcugggac

SEQ ID NO: 2255548 - RNA, 13 nt, Human
agucaugcauaaa

SEQ ID NO: 2255549 - RNA, 14 nt, Human
agucaugcauaaau

SEQ ID NO: 2255550 - RNA, 23 nt, Human
agucaugaucucccugccgccuc

SEQ ID NO: 2255551 - RNA, 20 nt, Human
agucaugaucucccugccgc

SEQ ID NO: 2255552 - RNA, 19 nt, Human
agucaugaucucccugccg

SEQ ID NO: 2255553 - RNA, 18 nt, Human
agucaugaucucccugcc

SEQ ID NO: 2255554 - RNA, 17 nt, Human
agucaugaucucccugc

SEQ ID NO: 2255555 - RNA, 16 nt, Human
agucaugaucucccug

SEQ ID NO: 2255556 - RNA, 15 nt, Human
agucaugaucucccu

SEQ ID NO: 2255557 - RNA, 21 nt, Human
agucaugaucucccugccgcc

SEQ ID NO: 2255558 - RNA, 16 nt, Human
aguccaaauguccucc

SEQ ID NO: 2255559 - RNA, 14 nt, Human
agucauuuuuguuu

SEQ ID NO: 2255560 - RNA, 13 nt, Human
agucaugugcauu

SEQ ID NO: 2255561 - RNA, 12 nt, Human
agucaugugacc

SEQ ID NO: 2255562 - RNA, 13 nt, Human
agucauguuccuu

SEQ ID NO: 2255563 - RNA, 15 nt, Human
agucauguuccuuca

SEQ ID NO: 2255564 - RNA, 19 nt, Human
agucauguuccuucaagau

SEQ ID NO: 2255565 - RNA, 21 nt, Human
agucaugcauaaauaugcagu

SEQ ID NO: 2255566 - RNA, 22 nt, Human
agucaugcauaaauaugcagug

SEQ ID NO: 2255567 - RNA, 12 nt, Human
agucauggcugu

SEQ ID NO: 2255568 - RNA, 13 nt, Human
agucauggcugug

SEQ ID NO: 2255569 - RNA, 20 nt, Human
agucauguaagcugaaaaua

SEQ ID NO: 2255570 - RNA, 22 nt, Human
agucaugagcugagcagggaga

SEQ ID NO: 2255571 - RNA, 16 nt, Human
agucaugagcugagca

SEQ ID NO: 2255572 - RNA, 14 nt, Human
agucaugagcugag

SEQ ID NO: 2255573 - RNA, 22 nt, Human
auaaagcaacuguuaugaaaua

SEQ ID NO: 2255574 - RNA, 10 nt, Human
auaaagcaau

SEQ ID NO: 2255575 - RNA, 11 nt, Human
auaaagcaauu

SEQ ID NO: 2255576 - RNA, 20 nt, Human
auaaagauuucuugaguuuu

SEQ ID NO: 2255577 - RNA, 15 nt, Human
auaaagauguuaaaa

SEQ ID NO: 2255578 - RNA, 12 nt, Human
auaaagcaauuu

SEQ ID NO: 2255579 - RNA, 13 nt, Human
auaaagcaauuuu

SEQ ID NO: 2255580 - RNA, 14 nt, Human
auaaagcaauuuuc

SEQ ID NO: 2255581 - RNA, 15 nt, Human
auaaagcaauuuucc

SEQ ID NO: 2255582 - RNA, 16 nt, Human
auaaagcaauuuuccu

SEQ ID NO: 2255583 - RNA, 17 nt, Human
auaaagcaauuuuccuu

SEQ ID NO: 2255584 - RNA, 18 nt, Human
auaaagcaauuuuccuug

SEQ ID NO: 2255585 - RNA, 16 nt, Human
auaaauuguauauuca

SEQ ID NO: 2255586 - RNA, 17 nt, Human
auaaauuguauauucac

SEQ ID NO: 2255587 - RNA, 18 nt, Human
auaaauuguauauucacu

SEQ ID NO: 2255588 - RNA, 19 nt, Human
auaaauuguauauucacuu

SEQ ID NO: 2255589 - RNA, 20 nt, Human
auaaauuugguucuaauaga

SEQ ID NO: 2255590 - RNA, 19 nt, Human
auaacaagaucuuucagga

SEQ ID NO: 2255591 - RNA, 17 nt, Human
auaacaagaucuuucag

SEQ ID NO: 2255592 - RNA, 19 nt, Human
auaaauuuauuuacugcua

SEQ ID NO: 2255593 - RNA, 15 nt, Human
auaaauuuauuuacu

SEQ ID NO: 2255594 - RNA, 14 nt, Human
auaaauuuauuuac

SEQ ID NO: 2255595 - RNA, 17 nt, Human
auaaauuguuugaccau

SEQ ID NO: 2255596 - RNA, 19 nt, Human
auaaagcaauuuuccuuga

SEQ ID NO: 2255597 - RNA, 14 nt, Human
auaaauuguauauu

SEQ ID NO: 2255598 - RNA, 13 nt, Human
auaaauuguuuga

SEQ ID NO: 2255599 - RNA, 15 nt, Human
auaaauuguuugacc

SEQ ID NO: 2255600 - RNA, 14 nt, Human
auaacaaugaaagu

SEQ ID NO: 2255601 - RNA, 15 nt, Human
auaacaaugcuguau

SEQ ID NO: 2255602 - RNA, 17 nt, Human
auaacaaugcuguauuu

SEQ ID NO: 2255603 - RNA, 19 nt, Human
auaacaaugcuguauuuua

SEQ ID NO: 2255604 - RNA, 20 nt, Human
auaacaaugcuguauuuuaa

SEQ ID NO: 2255605 - RNA, 21 nt, Human
auaacaaugcuguauuuuaaa

SEQ ID NO: 2255606 - RNA, 16 nt, Human
auaacaaugugcucuc

SEQ ID NO: 2255607 - RNA, 17 nt, Human
auaacaagguccaagau

SEQ ID NO: 2255608 - RNA, 21 nt, Human
auaacaagguccaagauaccu

SEQ ID NO: 2255609 - RNA, 13 nt, Human
auaacaauguuaa

SEQ ID NO: 2255610 - RNA, 14 nt, Human
auaacaauguuaag

SEQ ID NO: 2255611 - RNA, 16 nt, Human
auaacaauguuaagga

SEQ ID NO: 2255612 - RNA, 18 nt, Human
auaacaauguuaaggaaa

SEQ ID NO: 2255613 - RNA, 18 nt, Human
auaacauguaauuaagua

SEQ ID NO: 2255614 - RNA, 13 nt, Human
auaacauguaauu

SEQ ID NO: 2255615 - RNA, 14 nt, Human
auaacacaauauga

SEQ ID NO: 2255616 - RNA, 13 nt, Human
auaacacacagcu

SEQ ID NO: 2255617 - RNA, 22 nt, Human
auaacaauguuaaggaaacucu

SEQ ID NO: 2255618 - RNA, 15 nt, Human
auaacaauuguuugg

SEQ ID NO: 2255619 - RNA, 15 nt, Human
auaacaauuccucua

SEQ ID NO: 2255620 - RNA, 14 nt, Human
auaacaauuccucu

SEQ ID NO: 2255621 - RNA, 12 nt, Human
auaacauguaau

SEQ ID NO: 2255622 - RNA, 11 nt, Human
auaacacacau

SEQ ID NO: 2255623 - RNA, 14 nt, Human
auaacacacagcua

SEQ ID NO: 2255624 - RNA, 23 nt, Human
auaacacacagcuaacacacagc

SEQ ID NO: 2255625 - RNA, 20 nt, Human
auaacauguaauuaaguacu

SEQ ID NO: 2255626 - RNA, 20 nt, Human
auaaaacauuuucacacaau

SEQ ID NO: 2255627 - RNA, 18 nt, Human
auaaaacauuuucacaca

SEQ ID NO: 2255628 - RNA, 11 nt, Human
auaaaacauuu

SEQ ID NO: 2255629 - RNA, 13 nt, Human
auaaaacauuuua

SEQ ID NO: 2255630 - RNA, 18 nt, Human
auaaaacauuuuaaaugg

SEQ ID NO: 2255631 - RNA, 19 nt, Human
auaaaacauuuuaaaugga

SEQ ID NO: 2255632 - RNA, 21 nt, Human
auaaaaaggcaccuauaaaac

SEQ ID NO: 2255633 - RNA, 22 nt, Human
auaaaacauuaagaaaaucaua

SEQ ID NO: 2255634 - RNA, 13 nt, Human
auaaaacauuaau

SEQ ID NO: 2255635 - RNA, 12 nt, Human
auaaaaaggcac

SEQ ID NO: 2255636 - RNA, 11 nt, Human
auaaaaaggca

SEQ ID NO: 2255637 - RNA, 21 nt, Human
auaaaaagcuuccaugauucu

SEQ ID NO: 2255638 - RNA, 17 nt, Human
auaaaaagcuuccauga

SEQ ID NO: 2255639 - RNA, 13 nt, Human
auaaaaagcaaaa

SEQ ID NO: 2255640 - RNA, 12 nt, Human
auaaaaagcuga

SEQ ID NO: 2255641 - RNA, 16 nt, Human
auaaaaagcaaaacaa

SEQ ID NO: 2255642 - RNA, 22 nt, Human
auaaaaagccugcaauuucaua

SEQ ID NO: 2255643 - RNA, 17 nt, Human
auaaaacuuugcugcca

SEQ ID NO: 2255644 - RNA, 20 nt, Human
auaaagaugaucuacucaga

SEQ ID NO: 2255645 - RNA, 18 nt, Human
auaaagauggcugacuuu

SEQ ID NO: 2255646 - RNA, 15 nt, Human
auaaagaugcucuuu

SEQ ID NO: 2255647 - RNA, 14 nt, Human
auaaagaugcucuu

SEQ ID NO: 2255648 - RNA, 15 nt, Human
auaaaacuggcuuug

SEQ ID NO: 2255649 - RNA, 23 nt, Human
auaaagaugaucuacucagaaau

SEQ ID NO: 2255650 - RNA, 22 nt, Human
auaaaaccuuucaaauuucaca

SEQ ID NO: 2255651 - RNA, 21 nt, Human
auaaaaccuuucaaauuucac

SEQ ID NO: 2255652 - RNA, 20 nt, Human
auaaaaccuuucaaauuuca

SEQ ID NO: 2255653 - RNA, 15 nt, Human
auaaaaccuuucaaa

SEQ ID NO: 2255654 - RNA, 14 nt, Human
auaaaaccuuucaa

SEQ ID NO: 2255655 - RNA, 13 nt, Human
auaaaaccuuuca

SEQ ID NO: 2255656 - RNA, 11 nt, Human
auaaaaccuuu

SEQ ID NO: 2255657 - RNA, 12 nt, Human
auaaaacccuua

SEQ ID NO: 2255658 - RNA, 23 nt, Human
auaaaacauuuuaaauggacaga

SEQ ID NO: 2255659 - RNA, 14 nt, Human
aguuugcuauuaga

SEQ ID NO: 2255660 - RNA, 20 nt, Human
aguuugcacuguaugcugga

SEQ ID NO: 2255661 - RNA, 11 nt, Human
aguuugcuuag

SEQ ID NO: 2255662 - RNA, 11 nt, Human
aguuugcugua

SEQ ID NO: 2255663 - RNA, 18 nt, Human
aguuugcuguacuagaga

SEQ ID NO: 2255664 - RNA, 23 nt, Human
aguuugauuauucagugucacug

SEQ ID NO: 2255665 - RNA, 23 nt, Human
aguuugauuaaauucuugcaaag

SEQ ID NO: 2255666 - RNA, 18 nt, Human
aguuugauuauucagugu

SEQ ID NO: 2255667 - RNA, 17 nt, Human
aguuugauuauucagug

SEQ ID NO: 2255668 - RNA, 14 nt, Human
aguuugauuauuca

SEQ ID NO: 2255669 - RNA, 14 nt, Human
aguuugagcugccu

SEQ ID NO: 2255670 - RNA, 15 nt, Human
aguuugagcugccuu

SEQ ID NO: 2255671 - RNA, 18 nt, Human
aguuuggcaaacucucca

SEQ ID NO: 2255672 - RNA, 12 nt, Human
auaaaaagcaaa

SEQ ID NO: 2255673 - RNA, 17 nt, Human
aguuuggcaauaguuug

SEQ ID NO: 2255674 - RNA, 16 nt, Human
aguuuggcaauaguuu

SEQ ID NO: 2255675 - RNA, 20 nt, Human
auaaaaagccugcaauuuca

SEQ ID NO: 2255676 - RNA, 16 nt, Human
aguuuggcaaacucuc

SEQ ID NO: 2255677 - RNA, 18 nt, Human
aguuuggauucuuaugua

SEQ ID NO: 2255678 - RNA, 14 nt, Human
aguuugcuuagaaa

SEQ ID NO: 2255679 - RNA, 13 nt, Human
aguuugcuuagaa

SEQ ID NO: 2255680 - RNA, 21 nt, Human
aguuugaaggaggugagggau

SEQ ID NO: 2255681 - RNA, 12 nt, Human
aguuugaauguu

SEQ ID NO: 2255682 - RNA, 14 nt, Human
aguuugaauguuaa

SEQ ID NO: 2255683 - RNA, 15 nt, Human
aguuugaauguuaaa

SEQ ID NO: 2255684 - RNA, 15 nt, Human
aguuugaacuucaua

SEQ ID NO: 2255685 - RNA, 15 nt, Human
aguuugaaggaaaca

SEQ ID NO: 2255686 - RNA, 16 nt, Human
aguuugaaggaaacag

SEQ ID NO: 2255687 - RNA, 18 nt, Human
aguuugaaggaaacaguu

SEQ ID NO: 2255688 - RNA, 13 nt, Human
aguuucuuuggga

SEQ ID NO: 2255689 - RNA, 18 nt, Human
aguuucuuuccugccuuc

SEQ ID NO: 2255690 - RNA, 19 nt, Human
aguuucuuuccugccuucu

SEQ ID NO: 2255691 - RNA, 21 nt, Human
aguuucuuuccugccuucuuc

SEQ ID NO: 2255692 - RNA, 23 nt, Human
aguuucuuuccugccuucuucuu

SEQ ID NO: 2255693 - RNA, 23 nt, Human
aguuguuacuaacuaaacucucu

SEQ ID NO: 2255694 - RNA, 17 nt, Human
aguuucuuagcuuuuua

SEQ ID NO: 2255695 - RNA, 23 nt, Human
aguugugccuuuuauagcuauua

SEQ ID NO: 2255696 - RNA, 19 nt, Human
aguugugcuuguuuacagc

SEQ ID NO: 2255697 - RNA, 18 nt, Human
aguuguuacuaacuaaac

SEQ ID NO: 2255698 - RNA, 19 nt, Human
aguuguuacuaacuaaacu

SEQ ID NO: 2255699 - RNA, 20 nt, Human
aguuguuacuaacuaaacuc

SEQ ID NO: 2255700 - RNA, 22 nt, Human
aguuguuacuaacuaaacucuc

SEQ ID NO: 2255701 - RNA, 22 nt, Human
aguuguuacauuuuuaagugcu

SEQ ID NO: 2255702 - RNA, 20 nt, Human
aguuguuacauuuuuaagug

SEQ ID NO: 2255703 - RNA, 19 nt, Human
aguuguuacauuuuuaagu

SEQ ID NO: 2255704 - RNA, 19 nt, Human
aguuugagaucagccuggg

SEQ ID NO: 2255705 - RNA, 18 nt, Human
aguuugagaucagccugg

SEQ ID NO: 2255706 - RNA, 20 nt, Human
aguuugagaucagccugggc

SEQ ID NO: 2255707 - RNA, 16 nt, Human
aguuugauuaaauucu

SEQ ID NO: 2255708 - RNA, 16 nt, Human
aguuugaauguuaaau

SEQ ID NO: 2255709 - RNA, 21 nt, Human
aguuugaauguuaaauaaauu

SEQ ID NO: 2255710 - RNA, 22 nt, Human
aguuugauuaaauucuugcaaa

SEQ ID NO: 2255711 - RNA, 20 nt, Human
aguuugauuaaauucuugca

SEQ ID NO: 2255712 - RNA, 18 nt, Human
aguuugauuaaauucuug

SEQ ID NO: 2255713 - RNA, 17 nt, Human
aguuugauuaaauucuu

SEQ ID NO: 2255714 - RNA, 22 nt, Human
auaauguuuaauauugagaaag

SEQ ID NO: 2255715 - RNA, 15 nt, Human
auacaauaucaucca

SEQ ID NO: 2255716 - RNA, 19 nt, Human
auaauguuuaauauugaga

SEQ ID NO: 2255717 - RNA, 19 nt, Human
auaauguuguuauuuaaag

SEQ ID NO: 2255718 - RNA, 18 nt, Human
auaauguuucaaacauau

SEQ ID NO: 2255719 - RNA, 22 nt, Human
auacacuuacacuuuaugcaca

SEQ ID NO: 2255720 - RNA, 13 nt, Human
auacacuuacacu

SEQ ID NO: 2255721 - RNA, 17 nt, Human
auacaaugcugugcccu

SEQ ID NO: 2255722 - RNA, 14 nt, Human
auacaaugcugugc

SEQ ID NO: 2255723 - RNA, 18 nt, Human
auacccauagcuuccaug

SEQ ID NO: 2255724 - RNA, 13 nt, Human
auaccccccucug

SEQ ID NO: 2255725 - RNA, 23 nt, Human
auacagaaagauggaugugcuuu

SEQ ID NO: 2255726 - RNA, 15 nt, Human
auacccaugaacuua

SEQ ID NO: 2255727 - RNA, 19 nt, Human
auacccccugcaaagccca

SEQ ID NO: 2255728 - RNA, 17 nt, Human
auacccccugcaaagcc

SEQ ID NO: 2255729 - RNA, 17 nt, Human
auacccacccccaccca

SEQ ID NO: 2255730 - RNA, 22 nt, Human
auacacuuauuggaacucugcu

SEQ ID NO: 2255731 - RNA, 13 nt, Human
auacccaccccca

SEQ ID NO: 2255732 - RNA, 14 nt, Human
auacccacccccac

SEQ ID NO: 2255733 - RNA, 16 nt, Human
auacccacccccaccc

SEQ ID NO: 2255734 - RNA, 21 nt, Human
auacccccugcaaagcccagc

SEQ ID NO: 2255735 - RNA, 14 nt, Human
auaccugucccccu

SEQ ID NO: 2255736 - RNA, 15 nt, Human
auaccugucccccug

SEQ ID NO: 2255737 - RNA, 16 nt, Human
auaccugucccccuga

SEQ ID NO: 2255738 - RNA, 20 nt, Human
auacccccugcaaagcccag

SEQ ID NO: 2255739 - RNA, 16 nt, Human
auaccccaucauucau

SEQ ID NO: 2255740 - RNA, 19 nt, Human
auaauguaaacaauaucag

SEQ ID NO: 2255741 - RNA, 14 nt, Human
auaauguuguuauu

SEQ ID NO: 2255742 - RNA, 13 nt, Human
auaauguuucaaa

SEQ ID NO: 2255743 - RNA, 14 nt, Human
auaaugguugacug

SEQ ID NO: 2255744 - RNA, 18 nt, Human
auaauggucccauccagg

SEQ ID NO: 2255745 - RNA, 20 nt, Human
auaauggucccauccaggca

SEQ ID NO: 2255746 - RNA, 17 nt, Human
auaaugguaccagauaa

SEQ ID NO: 2255747 - RNA, 18 nt, Human
auaaugguaccagauaaa

SEQ ID NO: 2255748 - RNA, 19 nt, Human
auaaugguaccagauaaaa

SEQ ID NO: 2255749 - RNA, 17 nt, Human
auaauggucccauccag

SEQ ID NO: 2255750 - RNA, 18 nt, Human
auaaugguugacuggguu

SEQ ID NO: 2255751 - RNA, 22 nt, Human
auaauggucccauccaggcagu

SEQ ID NO: 2255752 - RNA, 14 nt, Human
auaaugguuucaaa

SEQ ID NO: 2255753 - RNA, 15 nt, Human
auaauguaaauaaag

SEQ ID NO: 2255754 - RNA, 21 nt, Human
auaagguaccuuucacauaga

SEQ ID NO: 2255755 - RNA, 19 nt, Human
auaaugggguccuggccau

SEQ ID NO: 2255756 - RNA, 15 nt, Human
auaaugguaccagau

SEQ ID NO: 2255757 - RNA, 13 nt, Human
auaauggucagag

SEQ ID NO: 2255758 - RNA, 15 nt, Human
auaagggcagaguca

SEQ ID NO: 2255759 - RNA, 13 nt, Human
auaagggcagagu

SEQ ID NO: 2255760 - RNA, 18 nt, Human
auaaggguaucuggugac

SEQ ID NO: 2255761 - RNA, 21 nt, Human
auaagccuccauuuaguucuu

SEQ ID NO: 2255762 - RNA, 17 nt, Human
auaaggccuuaauaugu

SEQ ID NO: 2255763 - RNA, 18 nt, Human
auaaggccuuaauauguu

SEQ ID NO: 2255764 - RNA, 22 nt, Human
auaagccagacaucaacagaua

SEQ ID NO: 2255765 - RNA, 21 nt, Human
auaagccagacaucaacagau

SEQ ID NO: 2255766 - RNA, 17 nt, Human
auauaauauauuugugu

SEQ ID NO: 2255767 - RNA, 20 nt, Human
auauaauauauuuguguauu

SEQ ID NO: 2255768 - RNA, 23 nt, Human
auauaauaugcacacagugcuuu

SEQ ID NO: 2255769 - RNA, 14 nt, Human
auauacaauuauau

SEQ ID NO: 2255770 - RNA, 16 nt, Human
auauacaauaacauaa

SEQ ID NO: 2255771 - RNA, 18 nt, Human
auauacaauaacauaauu

SEQ ID NO: 2255772 - RNA, 21 nt, Human
auauacaaccugcuugggugg

SEQ ID NO: 2255773 - RNA, 15 nt, Human
auauaaugguuucaa

SEQ ID NO: 2255774 - RNA, 18 nt, Human
auauaaugguuucaaaga

SEQ ID NO: 2255775 - RNA, 21 nt, Human
auauaaugguuucaaagauuc

SEQ ID NO: 2255776 - RNA, 18 nt, Human
auaguacucuuuguagca

SEQ ID NO: 2255777 - RNA, 14 nt, Human
auaguacuggcaug

SEQ ID NO: 2255778 - RNA, 19 nt, Human
auaguaccauuuauacaaa

SEQ ID NO: 2255779 - RNA, 14 nt, Human
auaguaccauuuau

SEQ ID NO: 2255780 - RNA, 17 nt, Human
auaguaccaaucauuuu

SEQ ID NO: 2255781 - RNA, 16 nt, Human
auaguagcauacauuu

SEQ ID NO: 2255782 - RNA, 14 nt, Human
auauaaguuugaag

SEQ ID NO: 2255783 - RNA, 15 nt, Human
auaguagcauacauu

SEQ ID NO: 2255784 - RNA, 21 nt, Human
auaguaccauuuauacaaauu

SEQ ID NO: 2255785 - RNA, 17 nt, Human
auauaaguuugaaggaa

SEQ ID NO: 2255786 - RNA, 19 nt, Human
auauaaguuugaaggaaac

SEQ ID NO: 2255787 - RNA, 21 nt, Human
auauaaguuugaaggaaacag

SEQ ID NO: 2255788 - RNA, 18 nt, Human
auauaauaaagcuacuga

SEQ ID NO: 2255789 - RNA, 21 nt, Human
auauaauaaagcuacugauuu

SEQ ID NO: 2255790 - RNA, 21 nt, Human
auauaauaaauguacauuaau

SEQ ID NO: 2255791 - RNA, 16 nt, Human
auagguuuuguuugcu

SEQ ID NO: 2255792 - RNA, 17 nt, Human
auagguuuuguuugcua

SEQ ID NO: 2255793 - RNA, 19 nt, Human
auagguuuuguuugcuauc

SEQ ID NO: 2255794 - RNA, 13 nt, Human
auaguaaaaauaa

SEQ ID NO: 2255795 - RNA, 18 nt, Human
auaguaaaagauaacaag

SEQ ID NO: 2255796 - RNA, 16 nt, Human
auaguaaaauucuacu

SEQ ID NO: 2255797 - RNA, 21 nt, Human
auagguuuuguuugcuaucuu

SEQ ID NO: 2255798 - RNA, 22 nt, Human
auagguuuuguuugcuaucuua

SEQ ID NO: 2255799 - RNA, 14 nt, Human
auaguaaaaauaaa

SEQ ID NO: 2255800 - RNA, 14 nt, Human
auaguaauucucag

SEQ ID NO: 2255801 - RNA, 21 nt, Human
auaguaacuucuuauggaauu

SEQ ID NO: 2255802 - RNA, 19 nt, Human
auaguaacuucuuauggaa

SEQ ID NO: 2255803 - RNA, 16 nt, Human
auaguaaccuggguaa

SEQ ID NO: 2255804 - RNA, 18 nt, Human
auagccgggcaugguggc

SEQ ID NO: 2255805 - RNA, 14 nt, Human
auagccgggcaugg

SEQ ID NO: 2255806 - RNA, 12 nt, Human
auagccuauauu

SEQ ID NO: 2255807 - RNA, 16 nt, Human
auagccuauauuuaca

SEQ ID NO: 2255808 - RNA, 19 nt, Human
auagccuauauuuacagug

SEQ ID NO: 2255809 - RNA, 15 nt, Human
auagccuaggugaca

SEQ ID NO: 2255810 - RNA, 17 nt, Human
auagccuaggugacaga

SEQ ID NO: 2255811 - RNA, 13 nt, Human
auauacacacagc

SEQ ID NO: 2255812 - RNA, 15 nt, Human
auauacagcucagaa

SEQ ID NO: 2255813 - RNA, 19 nt, Human
auauacacaggauccuauu

SEQ ID NO: 2255814 - RNA, 14 nt, Human
auauacaguaacuu

SEQ ID NO: 2255815 - RNA, 16 nt, Human
auauacaguaacuuua

SEQ ID NO: 2255816 - RNA, 17 nt, Human
auauacaguaacuuuau

SEQ ID NO: 2255817 - RNA, 22 nt, Human
auauacaguaacuuuaugugua

SEQ ID NO: 2255818 - RNA, 23 nt, Human
auauacaguaacuuuauguguaa

SEQ ID NO: 2255819 - RNA, 22 nt, Human
auagaaagccaaaucaaaauau

SEQ ID NO: 2255820 - RNA, 21 nt, Human
auagaaacucaccauguaaaa

SEQ ID NO: 2255821 - RNA, 19 nt, Human
auagaaauaagugguuauu

SEQ ID NO: 2255822 - RNA, 20 nt, Human
auagaaauaaauagcuauau

SEQ ID NO: 2255823 - RNA, 22 nt, Human
auagaaauaaaggaugugauug

SEQ ID NO: 2255824 - RNA, 15 nt, Human
auagcacagacccug

SEQ ID NO: 2255825 - RNA, 15 nt, Human
auagcacugagcaaa

SEQ ID NO: 2255826 - RNA, 14 nt, Human
auagcaccagggcu

SEQ ID NO: 2255827 - RNA, 16 nt, Human
auagcagacaguguuu

SEQ ID NO: 2255828 - RNA, 17 nt, Human
auagcacagacccugcc

SEQ ID NO: 2255829 - RNA, 18 nt, Human
auagcacagacccugccc

SEQ ID NO: 2255830 - RNA, 14 nt, Human
auagcagauuuuaa

SEQ ID NO: 2255831 - RNA, 11 nt, Human
auagcacuuuc

SEQ ID NO: 2255832 - RNA, 22 nt, Human
auagcagauuuuaauuuugaau

SEQ ID NO: 2255833 - RNA, 13 nt, Human
auagcauguaaug

SEQ ID NO: 2255834 - RNA, 19 nt, Human
auagcaugacauuucuuug

SEQ ID NO: 2255835 - RNA, 15 nt, Human
auagcagcuuauuca

SEQ ID NO: 2255836 - RNA, 21 nt, Human
auagcauuaacuaaucuauug

SEQ ID NO: 2255837 - RNA, 15 nt, Human
auagcauuaacuaau

SEQ ID NO: 2255838 - RNA, 13 nt, Human
auagcauuaacua

SEQ ID NO: 2255839 - RNA, 18 nt, Human
auagcauguauugugucu

SEQ ID NO: 2255840 - RNA, 22 nt, Human
auagcauguauugugucuuuug

SEQ ID NO: 2255841 - RNA, 10 nt, Human
auagcaugua

SEQ ID NO: 2255842 - RNA, 14 nt, Human
auagcauguauugu

SEQ ID NO: 2255843 - RNA, 15 nt, Human
auagcauguauugug

SEQ ID NO: 2255844 - RNA, 16 nt, Human
auagcauguauugugu

SEQ ID NO: 2255845 - RNA, 23 nt, Human
auagcauguauugugucuuuugc

SEQ ID NO: 2255846 - RNA, 18 nt, Human
auagcauuuuugauuuau

SEQ ID NO: 2255847 - RNA, 19 nt, Human
auagcauuuuugauuuaug

SEQ ID NO: 2255848 - RNA, 21 nt, Human
auagcauuuuugauuuaugca

SEQ ID NO: 2255849 - RNA, 16 nt, Human
auagcauugugaacug

SEQ ID NO: 2255850 - RNA, 15 nt, Human
auagcauugugaacu

SEQ ID NO: 2255851 - RNA, 16 nt, Human
auagcauucucuauca

SEQ ID NO: 2255852 - RNA, 13 nt, Human
auacuugagacug

SEQ ID NO: 2255853 - RNA, 23 nt, Human
auacuugaagggccagagccagg

SEQ ID NO: 2255854 - RNA, 17 nt, Human
auacuugucuuguucac

SEQ ID NO: 2255855 - RNA, 18 nt, Human
auacuugucaauauuuaa

SEQ ID NO: 2255856 - RNA, 13 nt, Human
auacuuguggacu

SEQ ID NO: 2255857 - RNA, 14 nt, Human
auacuuguggacua

SEQ ID NO: 2255858 - RNA, 20 nt, Human
auacuuguggacuaaaagau

SEQ ID NO: 2255859 - RNA, 21 nt, Human
auacuuguggacuaaaagaua

SEQ ID NO: 2255860 - RNA, 12 nt, Human
auacuuuacaug

SEQ ID NO: 2255861 - RNA, 23 nt, Human
auacuuuaaaggaaaaaauguug

SEQ ID NO: 2255862 - RNA, 15 nt, Human
auacuuuagugaacg

SEQ ID NO: 2255863 - RNA, 23 nt, Human
auacuuuagugaacguggacucc

SEQ ID NO: 2255864 - RNA, 14 nt, Human
auacuuuaaaggaa

SEQ ID NO: 2255865 - RNA, 15 nt, Human
auacuuuaaaggaaa

SEQ ID NO: 2255866 - RNA, 16 nt, Human
auacuuuaaaggaaaa

SEQ ID NO: 2255867 - RNA, 13 nt, Human
auacuuugucuga

SEQ ID NO: 2255868 - RNA, 21 nt, Human
auacuuucauccugacucugc

SEQ ID NO: 2255869 - RNA, 18 nt, Human
auauuuccauauggauuu

SEQ ID NO: 2255870 - RNA, 21 nt, Human
auauuuccauauggauuuucu

SEQ ID NO: 2255871 - RNA, 19 nt, Human
auauuuaugucuauuuaag

SEQ ID NO: 2255872 - RNA, 19 nt, Human
auauuucccugaaggaacc

SEQ ID NO: 2255873 - RNA, 20 nt, Human
auauuuauguagaugugcau

SEQ ID NO: 2255874 - RNA, 18 nt, Human
auauuuaugucuauuuaa

SEQ ID NO: 2255875 - RNA, 14 nt, Human
auauuuauguagau

SEQ ID NO: 2255876 - RNA, 19 nt, Human
auauuuauggggggagaac

SEQ ID NO: 2255877 - RNA, 21 nt, Human
auauuuaugucuauuuaagcc

SEQ ID NO: 2255878 - RNA, 15 nt, Human
auauuuauauuucac

SEQ ID NO: 2255879 - RNA, 14 nt, Human
auauuuauauuuca

SEQ ID NO: 2255880 - RNA, 15 nt, Human
auauuuauauauuua

SEQ ID NO: 2255881 - RNA, 15 nt, Human
auauuuauauauauu

SEQ ID NO: 2255882 - RNA, 15 nt, Human
auauuuauagucaca

SEQ ID NO: 2255883 - RNA, 23 nt, Human
auauuuauaacucaucauaaaau

SEQ ID NO: 2255884 - RNA, 22 nt, Human
auauuuauaacucaucauaaaa

SEQ ID NO: 2255885 - RNA, 21 nt, Human
auauuuauaacucaucauaaa

SEQ ID NO: 2255886 - RNA, 20 nt, Human
auauuuauaacucaucauaa

SEQ ID NO: 2255887 - RNA, 17 nt, Human
auauuuauaacucauca

SEQ ID NO: 2255888 - RNA, 23 nt, Human
auauucagugcuguggccugggc

SEQ ID NO: 2255889 - RNA, 18 nt, Human
auauucaugcuucuuccu

SEQ ID NO: 2255890 - RNA, 20 nt, Human
auauucaugcuucuuccuua

SEQ ID NO: 2255891 - RNA, 16 nt, Human
auauucauuguauaaa

SEQ ID NO: 2255892 - RNA, 15 nt, Human
auauucauuguauaa

SEQ ID NO: 2255893 - RNA, 14 nt, Human
auauucauuguaua

SEQ ID NO: 2255894 - RNA, 22 nt, Human
auauucauguaaacaaaauuua

SEQ ID NO: 2255895 - RNA, 14 nt, Human
auauucauguaaac

SEQ ID NO: 2255896 - RNA, 19 nt, Human
auauucauguaaacaaaau

SEQ ID NO: 2255897 - RNA, 22 nt, Human
auauucagugcuguggccuggg

SEQ ID NO: 2255898 - RNA, 19 nt, Human
auauucaggaagcucaggg

SEQ ID NO: 2255899 - RNA, 20 nt, Human
auauucaacucauaagacuu

SEQ ID NO: 2255900 - RNA, 23 nt, Human
auauggcagaguuguaaauauau

SEQ ID NO: 2255901 - RNA, 22 nt, Human
auauggcagaguuguaaauaua

SEQ ID NO: 2255902 - RNA, 14 nt, Human
auauuauuuuaugu

SEQ ID NO: 2255903 - RNA, 14 nt, Human
auauuauguuaaaa

SEQ ID NO: 2255904 - RNA, 15 nt, Human
auauuauuuuauguu

SEQ ID NO: 2255905 - RNA, 22 nt, Human
auauuauuuuauguugcauaga

SEQ ID NO: 2255906 - RNA, 20 nt, Human
auaugcagugauauggcaga

SEQ ID NO: 2255907 - RNA, 16 nt, Human
auaugcaguuuuccuu

SEQ ID NO: 2255908 - RNA, 20 nt, Human
auaugcucugcauguuacau

SEQ ID NO: 2255909 - RNA, 18 nt, Human
auauggaugauucagaaa

SEQ ID NO: 2255910 - RNA, 16 nt, Human
auauggacucugcaca

SEQ ID NO: 2255911 - RNA, 11 nt, Human
auauggagccc

SEQ ID NO: 2255912 - RNA, 22 nt, Human
auaugcugccaaauuuuggcca

SEQ ID NO: 2255913 - RNA, 12 nt, Human
auaugcugcuca

SEQ ID NO: 2255914 - RNA, 18 nt, Human
auaugcugccaaauuuug

SEQ ID NO: 2255915 - RNA, 15 nt, Human
auauggacucugcac

SEQ ID NO: 2255916 - RNA, 13 nt, Human
auauggccacagu

SEQ ID NO: 2255917 - RNA, 17 nt, Human
auauuauguguuuccau

SEQ ID NO: 2255918 - RNA, 13 nt, Human
auauuauguuaaa

SEQ ID NO: 2255919 - RNA, 22 nt, Human
auauggauuuucuauuguuacu

SEQ ID NO: 2255920 - RNA, 23 nt, Human
auauggauuuucuauuguuacuc

SEQ ID NO: 2255921 - RNA, 16 nt, Human
auauggcaaaaauggc

SEQ ID NO: 2255922 - RNA, 13 nt, Human
auauggcaagaaa

SEQ ID NO: 2255923 - RNA, 15 nt, Human
auauggcaagaaagc

SEQ ID NO: 2255924 - RNA, 17 nt, Human
auauggcaagaaagcug

SEQ ID NO: 2255925 - RNA, 18 nt, Human
auauggcaagaaagcugg

SEQ ID NO: 2255926 - RNA, 19 nt, Human
auauggcaagaaagcuggu

SEQ ID NO: 2255927 - RNA, 12 nt, Human
auauggcagaag

SEQ ID NO: 2255928 - RNA, 15 nt, Human
auauggcagaagaca

SEQ ID NO: 2255929 - RNA, 17 nt, Human
auauggcagaagacacc

SEQ ID NO: 2255930 - RNA, 16 nt, Human
auauggcagaguugua

SEQ ID NO: 2255931 - RNA, 17 nt, Human
auauggcagaguuguaa

SEQ ID NO: 2255932 - RNA, 18 nt, Human
auauggcagaguuguaaa

SEQ ID NO: 2255933 - RNA, 19 nt, Human
auauggcagaguuguaaau

SEQ ID NO: 2255934 - RNA, 20 nt, Human
auauggcagaguuguaaaua

SEQ ID NO: 2255935 - RNA, 17 nt, Human
auaugcucugcauguua

SEQ ID NO: 2255936 - RNA, 16 nt, Human
auaugcucugcauguu

SEQ ID NO: 2255937 - RNA, 21 nt, Human
auaucaucagcauaccuuuau

SEQ ID NO: 2255938 - RNA, 21 nt, Human
auaugcaccuugugucuguac

SEQ ID NO: 2255939 - RNA, 19 nt, Human
auaugcaccuugugucugu

SEQ ID NO: 2255940 - RNA, 20 nt, Human
auaugcaccuugugucugua

SEQ ID NO: 2255941 - RNA, 17 nt, Human
auaugcagauuuugccc

SEQ ID NO: 2255942 - RNA, 14 nt, Human
auaugcacuuauaa

SEQ ID NO: 2255943 - RNA, 13 nt, Human
auaugcacuuaua

SEQ ID NO: 2255944 - RNA, 19 nt, Human
auaucaguuacucagcccu

SEQ ID NO: 2255945 - RNA, 18 nt, Human
auaucaguuacucagccc

SEQ ID NO: 2255946 - RNA, 17 nt, Human
auaucaguuacucagcc

SEQ ID NO: 2255947 - RNA, 21 nt, Human
auaucagccugagucuccugu

SEQ ID NO: 2255948 - RNA, 14 nt, Human
auaucagccugagu

SEQ ID NO: 2255949 - RNA, 20 nt, Human
auaucagccugagucuccug

SEQ ID NO: 2255950 - RNA, 22 nt, Human
auaucagccugagucuccugug

SEQ ID NO: 2255951 - RNA, 23 nt, Human
auaucaguuacucagcccugggc

SEQ ID NO: 2255952 - RNA, 21 nt, Human
auaucaguuacucagcccugg

SEQ ID NO: 2255953 - RNA, 20 nt, Human
auaucaguuacucagcccug

SEQ ID NO: 2255954 - RNA, 13 nt, Human
auaucaguuugcu

SEQ ID NO: 2255955 - RNA, 22 nt, Human
auaucaguuacucagcccuggg

SEQ ID NO: 2255956 - RNA, 14 nt, Human
auaucauauuggua

SEQ ID NO: 2255957 - RNA, 19 nt, Human
auaucauauugguauucac

SEQ ID NO: 2255958 - RNA, 13 nt, Human
auaucaucaguau

SEQ ID NO: 2255959 - RNA, 18 nt, Human
auaucaucagcauaccuu

SEQ ID NO: 2255960 - RNA, 20 nt, Human
auaucaucagcauaccuuua

SEQ ID NO: 2255961 - RNA, 22 nt, Human
auaugcacacauuuuuuaaaug

SEQ ID NO: 2255962 - RNA, 15 nt, Human
auaugcaccuugugu

SEQ ID NO: 2255963 - RNA, 17 nt, Human
auaugcaccuugugucu

SEQ ID NO: 2255964 - RNA, 14 nt, Human
auauauuuuuugua

SEQ ID NO: 2255965 - RNA, 20 nt, Human
auauauuuuugguugucaau

SEQ ID NO: 2255966 - RNA, 21 nt, Human
auauauuuuucacaguuuuuc

SEQ ID NO: 2255967 - RNA, 15 nt, Human
auauauuuuugguug

SEQ ID NO: 2255968 - RNA, 15 nt, Human
auauauuuuucacag

SEQ ID NO: 2255969 - RNA, 14 nt, Human
auauauuuuucaca

SEQ ID NO: 2255970 - RNA, 14 nt, Human
auaucagcaagucu

SEQ ID NO: 2255971 - RNA, 12 nt, Human
auaucagccuga

SEQ ID NO: 2255972 - RNA, 15 nt, Human
auauauuuuuauauu

SEQ ID NO: 2255973 - RNA, 21 nt, Human
auauauuuuuauauuuaguua

SEQ ID NO: 2255974 - RNA, 22 nt, Human
cacaguggaaagacagcuucuc

SEQ ID NO: 2255975 - RNA, 22 nt, Human
cacagugcuuuccguggcacug

SEQ ID NO: 2255976 - RNA, 19 nt, Human
cacagugccuucaauaaau

SEQ ID NO: 2255977 - RNA, 13 nt, Human
cacagugcugucu

SEQ ID NO: 2255978 - RNA, 17 nt, Human
cacagugccuucaauaa

SEQ ID NO: 2255979 - RNA, 18 nt, Human
cacagugccuucaauaaa

SEQ ID NO: 2255980 - RNA, 21 nt, Human
cacaggcccuuccucuccacu

SEQ ID NO: 2255981 - RNA, 17 nt, Human
cacagugcaucucagcc

SEQ ID NO: 2255982 - RNA, 18 nt, Human
cacagugcaucucagccc

SEQ ID NO: 2255983 - RNA, 19 nt, Human
cacagugcaucucagccca

SEQ ID NO: 2255984 - RNA, 19 nt, Human
cacaguguugcccaggcug

SEQ ID NO: 2255985 - RNA, 14 nt, Human
cacaguguugccca

SEQ ID NO: 2255986 - RNA, 16 nt, Human
cacaguguguuuguga

SEQ ID NO: 2255987 - RNA, 13 nt, Human
cacaguguguuug

SEQ ID NO: 2255988 - RNA, 10 nt, Human
cacaguguuu

SEQ ID NO: 2255989 - RNA, 23 nt, Human
cacaguguuaaaugaaauuguaa

SEQ ID NO: 2255990 - RNA, 17 nt, Human
cacaguguuggcgagag

SEQ ID NO: 2255991 - RNA, 16 nt, Human
cacaguguuuuuguaa

SEQ ID NO: 2255992 - RNA, 17 nt, Human
cacaguguuuuuguaaa

SEQ ID NO: 2255993 - RNA, 19 nt, Human
cacaguguuuuuguaaagu

SEQ ID NO: 2255994 - RNA, 22 nt, Human
cacaguguuuuuguaaagugug

SEQ ID NO: 2255995 - RNA, 17 nt, Human
cacaguucaauucucau

SEQ ID NO: 2255996 - RNA, 20 nt, Human
cacagcuuuaucaccagaga

SEQ ID NO: 2255997 - RNA, 15 nt, Human
cacaggcccuuccuc

SEQ ID NO: 2255998 - RNA, 13 nt, Human
cacaggaaaccag

SEQ ID NO: 2255999 - RNA, 16 nt, Human
cacaggcccuuccucu

SEQ ID NO: 2256000 - RNA, 17 nt, Human
cacaggcccuuccucuc

SEQ ID NO: 2256001 - RNA, 18 nt, Human
cacaggcccuuccucucc

SEQ ID NO: 2256002 - RNA, 19 nt, Human
cacaggcccuuccucucca

SEQ ID NO: 2256003 - RNA, 22 nt, Human
cacagcuugaccugaggcugug

SEQ ID NO: 2256004 - RNA, 20 nt, Human
cacagcuugaccugaggcug

SEQ ID NO: 2256005 - RNA, 21 nt, Human
cacagcuugaccugaggcugu

SEQ ID NO: 2256006 - RNA, 23 nt, Human
cacagcuuccccucucuccuccu

SEQ ID NO: 2256007 - RNA, 18 nt, Human
cacagcuugaccugaggc

SEQ ID NO: 2256008 - RNA, 19 nt, Human
cacagcuugaccugaggcu

SEQ ID NO: 2256009 - RNA, 22 nt, Human
cacagcuuccccucucuccucc

SEQ ID NO: 2256010 - RNA, 16 nt, Human
cacagcuuccccucuc

SEQ ID NO: 2256011 - RNA, 12 nt, Human
cacagcugcugg

SEQ ID NO: 2256012 - RNA, 22 nt, Human
cacagcugcucaauaaaguaca

SEQ ID NO: 2256013 - RNA, 12 nt, Human
cacagcugcuca

SEQ ID NO: 2256014 - RNA, 20 nt, Human
cacaguucaguggcagggcu

SEQ ID NO: 2256015 - RNA, 23 nt, Human
cacaguguuuuuguaaagugugg

SEQ ID NO: 2256016 - RNA, 21 nt, Human
cacaguucaguggcagggcuc

SEQ ID NO: 2256017 - RNA, 21 nt, Human
cacaaaggaccucagcugcuu

SEQ ID NO: 2256018 - RNA, 20 nt, Human
cacaaagccuuaucaagugu

SEQ ID NO: 2256019 - RNA, 18 nt, Human
cacaaaggaccucagcug

SEQ ID NO: 2256020 - RNA, 18 nt, Human
cacaagaaaugaaagcag

SEQ ID NO: 2256021 - RNA, 20 nt, Human
cacaaaauucgaccugauuu

SEQ ID NO: 2256022 - RNA, 13 nt, Human
cacaaagccuuau

SEQ ID NO: 2256023 - RNA, 13 nt, Human
cacaaaggagagc

SEQ ID NO: 2256024 - RNA, 20 nt, Human
cacaaguggugguaacccug

SEQ ID NO: 2256025 - RNA, 14 nt, Human
cacaagugguggua

SEQ ID NO: 2256026 - RNA, 14 nt, Human
cacaaguuguguuu

SEQ ID NO: 2256027 - RNA, 18 nt, Human
cacaauaaaaauguuuaa

SEQ ID NO: 2256028 - RNA, 21 nt, Human
cacaaguggugguaacccugg

SEQ ID NO: 2256029 - RNA, 21 nt, Human
cacaagaaaugaaagcaggga

SEQ ID NO: 2256030 - RNA, 20 nt, Human
cacaagaaaugaaagcaggg

SEQ ID NO: 2256031 - RNA, 13 nt, Human
cacaauacaauaa

SEQ ID NO: 2256032 - RNA, 15 nt, Human
cacaauaauuuucua

SEQ ID NO: 2256033 - RNA, 12 nt, Human
cacaauaugaau

SEQ ID NO: 2256034 - RNA, 21 nt, Human
cacaauaaggucaaugccaga

SEQ ID NO: 2256035 - RNA, 20 nt, Human
cacaauggcuaauucccaga

SEQ ID NO: 2256036 - RNA, 22 nt, Human
cacaaugaaaugcucuccuuuc

SEQ ID NO: 2256037 - RNA, 19 nt, Human
cacaaucuuaaggggcagc

SEQ ID NO: 2256038 - RNA, 20 nt, Human
cacaaucuuaaggggcagcu

SEQ ID NO: 2256039 - RNA, 11 nt, Human
cacaauauuuu

SEQ ID NO: 2256040 - RNA, 15 nt, Human
cacaauauugaacuu

SEQ ID NO: 2256041 - RNA, 19 nt, Human
cacaaucugacauucucag

SEQ ID NO: 2256042 - RNA, 18 nt, Human
cacaaucuuaaggggcag

SEQ ID NO: 2256043 - RNA, 15 nt, Human
cacacacacacacag

SEQ ID NO: 2256044 - RNA, 16 nt, Human
cacacacacacacagc

SEQ ID NO: 2256045 - RNA, 15 nt, Human
cacacacacacacaa

SEQ ID NO: 2256046 - RNA, 15 nt, Human
cacacacacacacac

SEQ ID NO: 2256047 - RNA, 13 nt, Human
cacacacacacac

SEQ ID NO: 2256048 - RNA, 14 nt, Human
cacacacacacaca

SEQ ID NO: 2256049 - RNA, 18 nt, Human
cacacaaagguauaauuu

SEQ ID NO: 2256050 - RNA, 13 nt, Human
cacacaaagguau

SEQ ID NO: 2256051 - RNA, 21 nt, Human
cacacaaaauguacccaguau

SEQ ID NO: 2256052 - RNA, 13 nt, Human
cacacaaaacaac

SEQ ID NO: 2256053 - RNA, 21 nt, Human
cacaauggcuaauucccagag

SEQ ID NO: 2256054 - RNA, 13 nt, Human
cacacacacagga

SEQ ID NO: 2256055 - RNA, 12 nt, Human
cacacacacagg

SEQ ID NO: 2256056 - RNA, 15 nt, Human
cacacacacagccac

SEQ ID NO: 2256057 - RNA, 14 nt, Human
cacacacacagcca

SEQ ID NO: 2256058 - RNA, 13 nt, Human
cacacacacagcc

SEQ ID NO: 2256059 - RNA, 12 nt, Human
cacacacacagc

SEQ ID NO: 2256060 - RNA, 15 nt, Human
cacacacacagaaaa

SEQ ID NO: 2256061 - RNA, 14 nt, Human
cacacacacagaaa

SEQ ID NO: 2256062 - RNA, 13 nt, Human
cacacacacagaa

SEQ ID NO: 2256063 - RNA, 14 nt, Human
cacacacacaggag

SEQ ID NO: 2256064 - RNA, 13 nt, Human
cacacacacaugc

SEQ ID NO: 2256065 - RNA, 12 nt, Human
cacacacacaug

SEQ ID NO: 2256066 - RNA, 15 nt, Human
cacacacacaugcau

SEQ ID NO: 2256067 - RNA, 14 nt, Human
cacacacacaugca

SEQ ID NO: 2256068 - RNA, 13 nt, Human
cacacacacccac

SEQ ID NO: 2256069 - RNA, 13 nt, Human
cacacacacgcac

SEQ ID NO: 2256070 - RNA, 16 nt, Human
cacacacacacaggag

SEQ ID NO: 2256071 - RNA, 13 nt, Human
cacacacacacau

SEQ ID NO: 2256072 - RNA, 15 nt, Human
cacacacacacaugc

SEQ ID NO: 2256073 - RNA, 14 nt, Human
cacacacacacaug

SEQ ID NO: 2256074 - RNA, 12 nt, Human
cacacacacaga

SEQ ID NO: 2256075 - RNA, 11 nt, Human
cacacacacag

SEQ ID NO: 2256076 - RNA, 16 nt, Human
cacacacacacaugca

SEQ ID NO: 2256077 - RNA, 13 nt, Human
cacacacacacuc

SEQ ID NO: 2256078 - RNA, 14 nt, Human
cacacacacacagg

SEQ ID NO: 2256079 - RNA, 14 nt, Human
cacacacacacacu

SEQ ID NO: 2256080 - RNA, 16 nt, Human
cacacacacacagcca

SEQ ID NO: 2256081 - RNA, 15 nt, Human
cacacacacacagcc

SEQ ID NO: 2256082 - RNA, 14 nt, Human
cacacacacacagc

SEQ ID NO: 2256083 - RNA, 13 nt, Human
cacacacacacag

SEQ ID NO: 2256084 - RNA, 16 nt, Human
cacacacacacacaug

SEQ ID NO: 2256085 - RNA, 16 nt, Human
cacacacacacacagg

SEQ ID NO: 2256086 - RNA, 15 nt, Human
cacacacacacacau

SEQ ID NO: 2256087 - RNA, 13 nt, Human
cacacacacucua

SEQ ID NO: 2256088 - RNA, 14 nt, Human
cacacacacgcacg

SEQ ID NO: 2256089 - RNA, 14 nt, Human
cacacacacucacu

SEQ ID NO: 2256090 - RNA, 13 nt, Human
cacacacagaaaa

SEQ ID NO: 2256091 - RNA, 11 nt, Human
cacacacagaa

SEQ ID NO: 2256092 - RNA, 19 nt, Human
cacacacagaaaauauacu

SEQ ID NO: 2256093 - RNA, 16 nt, Human
cacacacagaaaauau

SEQ ID NO: 2256094 - RNA, 15 nt, Human
cacacacagaaaaua

SEQ ID NO: 2256095 - RNA, 14 nt, Human
cacacacagaaaau

SEQ ID NO: 2256096 - RNA, 14 nt, Human
cacacacagaggaa

SEQ ID NO: 2256097 - RNA, 12 nt, Human
cacacacagagg

SEQ ID NO: 2256098 - RNA, 23 nt, Human
cacacacagaaaauauacuguaa

SEQ ID NO: 2256099 - RNA, 21 nt, Human
cacacacagaaaauauacugu

SEQ ID NO: 2256100 - RNA, 20 nt, Human
cacacacagaaaauauacug

SEQ ID NO: 2256101 - RNA, 14 nt, Human
cacacacagccaca

SEQ ID NO: 2256102 - RNA, 13 nt, Human
cacacacagccac

SEQ ID NO: 2256103 - RNA, 12 nt, Human
cacacacagcca

SEQ ID NO: 2256104 - RNA, 11 nt, Human
cacacacagcc

SEQ ID NO: 2256105 - RNA, 19 nt, Human
cacacaccuguagucccag

SEQ ID NO: 2256106 - RNA, 14 nt, Human
cacacacgcacgca

SEQ ID NO: 2256107 - RNA, 15 nt, Human
cacacacgcacgcac

SEQ ID NO: 2256108 - RNA, 16 nt, Human
cacacacgcacgcaca

SEQ ID NO: 2256109 - RNA, 20 nt, Human
cacacaccuguagucccagc

SEQ ID NO: 2256110 - RNA, 15 nt, Human
cacacaccuguaguc

SEQ ID NO: 2256111 - RNA, 23 nt, Human
cacacacagaggaagagcaggca

SEQ ID NO: 2256112 - RNA, 11 nt, Human
cacacaccugu

SEQ ID NO: 2256113 - RNA, 13 nt, Human
cacacaccuguag

SEQ ID NO: 2256114 - RNA, 16 nt, Human
cacacacagccacaca

SEQ ID NO: 2256115 - RNA, 15 nt, Human
cacacacagccacac

SEQ ID NO: 2256116 - RNA, 12 nt, Human
cacacacucacu

SEQ ID NO: 2256117 - RNA, 19 nt, Human
cacacacgcacgcacacac

SEQ ID NO: 2256118 - RNA, 17 nt, Human
cacacacgcacgcacac

SEQ ID NO: 2256119 - RNA, 18 nt, Human
cacacacgcacgcacaca

SEQ ID NO: 2256120 - RNA, 23 nt, Human
cacacacgcacgcacacacacaa

SEQ ID NO: 2256121 - RNA, 17 nt, Human
cacacacgcgugcacac

SEQ ID NO: 2256122 - RNA, 12 nt, Human
caauuaaacgga

SEQ ID NO: 2256123 - RNA, 23 nt, Human
caauuaaaaaaaaagaucuguuu

SEQ ID NO: 2256124 - RNA, 13 nt, Human
caauuaaacggau

SEQ ID NO: 2256125 - RNA, 17 nt, Human
caauuacugguccaaaa

SEQ ID NO: 2256126 - RNA, 18 nt, Human
caauuacaggaaguacug

SEQ ID NO: 2256127 - RNA, 23 nt, Human
caauuaggaaguguaacagcuga

SEQ ID NO: 2256128 - RNA, 20 nt, Human
caauuaggaaguguaacagc

SEQ ID NO: 2256129 - RNA, 16 nt, Human
caauuaggaaguguaa

SEQ ID NO: 2256130 - RNA, 13 nt, Human
caauuccaccugc

SEQ ID NO: 2256131 - RNA, 15 nt, Human
caauuaggaagugua

SEQ ID NO: 2256132 - RNA, 21 nt, Human
caauuagcaauugacugucac

SEQ ID NO: 2256133 - RNA, 13 nt, Human
caauuccugggcc

SEQ ID NO: 2256134 - RNA, 16 nt, Human
caauuccugggcccca

SEQ ID NO: 2256135 - RNA, 20 nt, Human
caauuccguagccagcugcu

SEQ ID NO: 2256136 - RNA, 12 nt, Human
caauuccugggc

SEQ ID NO: 2256137 - RNA, 15 nt, Human
caauuccucugggaa

SEQ ID NO: 2256138 - RNA, 13 nt, Human
caauuccucuggg

SEQ ID NO: 2256139 - RNA, 14 nt, Human
caauuccucuggga

SEQ ID NO: 2256140 - RNA, 22 nt, Human
caauuaggaaguguaacagcug

SEQ ID NO: 2256141 - RNA, 11 nt, Human
caauuccccuc

SEQ ID NO: 2256142 - RNA, 12 nt, Human
caauuccccucu

SEQ ID NO: 2256143 - RNA, 13 nt, Human
caauuccccucug

SEQ ID NO: 2256144 - RNA, 15 nt, Human
caauucccugcuguc

SEQ ID NO: 2256145 - RNA, 21 nt, Human
caauuccguagccagcugcuc

SEQ ID NO: 2256146 - RNA, 14 nt, Human
caauuccccucugc

SEQ ID NO: 2256147 - RNA, 17 nt, Human
caauuccccucugcugc

SEQ ID NO: 2256148 - RNA, 22 nt, Human
cacaaaauaaccaauccuggac

SEQ ID NO: 2256149 - RNA, 21 nt, Human
caauuuuuuuaauuuuguauu

SEQ ID NO: 2256150 - RNA, 22 nt, Human
caauuuuuuuaauuuuguauuu

SEQ ID NO: 2256151 - RNA, 21 nt, Human
caauuuuuuaucaugcauguc

SEQ ID NO: 2256152 - RNA, 17 nt, Human
caauuuuuuuaauuuug

SEQ ID NO: 2256153 - RNA, 19 nt, Human
caauuuuugguugaauaaa

SEQ ID NO: 2256154 - RNA, 18 nt, Human
caauuuuugguugaauaa

SEQ ID NO: 2256155 - RNA, 13 nt, Human
caauuuuugccuu

SEQ ID NO: 2256156 - RNA, 14 nt, Human
caauuuuugccuuc

SEQ ID NO: 2256157 - RNA, 15 nt, Human
caauuuuugccuuca

SEQ ID NO: 2256158 - RNA, 16 nt, Human
caauuuuugccuucau

SEQ ID NO: 2256159 - RNA, 22 nt, Human
caauuuuucuuauuucauuucu

SEQ ID NO: 2256160 - RNA, 18 nt, Human
cacaaagcccuuccaugu

SEQ ID NO: 2256161 - RNA, 15 nt, Human
cacaaacagaggccg

SEQ ID NO: 2256162 - RNA, 14 nt, Human
cacaaacagaggcc

SEQ ID NO: 2256163 - RNA, 16 nt, Human
cacaaaauugggaaag

SEQ ID NO: 2256164 - RNA, 15 nt, Human
cacaaaaucugucca

SEQ ID NO: 2256165 - RNA, 13 nt, Human
cacaaacagaggc

SEQ ID NO: 2256166 - RNA, 20 nt, Human
caauguuuaugcaaggaagg

SEQ ID NO: 2256167 - RNA, 23 nt, Human
caauguuuaugcaaggaaggaaa

SEQ ID NO: 2256168 - RNA, 13 nt, Human
caauguuucuuuu

SEQ ID NO: 2256169 - RNA, 17 nt, Human
caauguuucuucuaggu

SEQ ID NO: 2256170 - RNA, 22 nt, Human
caauguuuuccuuugucaucau

SEQ ID NO: 2256171 - RNA, 13 nt, Human
caauguuuuccuu

SEQ ID NO: 2256172 - RNA, 20 nt, Human
caauguuuuccuuugucauc

SEQ ID NO: 2256173 - RNA, 18 nt, Human
caauguuucuuuuaucac

SEQ ID NO: 2256174 - RNA, 16 nt, Human
caauguuucuuuuauc

SEQ ID NO: 2256175 - RNA, 17 nt, Human
caauuacaggaaguacu

SEQ ID NO: 2256176 - RNA, 21 nt, Human
caaugugguugcaaggccgcu

SEQ ID NO: 2256177 - RNA, 23 nt, Human
caaugugcuacugauuguuucau

SEQ ID NO: 2256178 - RNA, 21 nt, Human
caauguggccuaaaaaugcaa

SEQ ID NO: 2256179 - RNA, 13 nt, Human
caauauccuuugc

SEQ ID NO: 2256180 - RNA, 15 nt, Human
caauauccuuugccu

SEQ ID NO: 2256181 - RNA, 20 nt, Human
caauauccuuugccucaagg

SEQ ID NO: 2256182 - RNA, 12 nt, Human
caauauccuuug

SEQ ID NO: 2256183 - RNA, 16 nt, Human
caauaguuugcauaga

SEQ ID NO: 2256184 - RNA, 21 nt, Human
caauaucuuuuuuuuaauaaa

SEQ ID NO: 2256185 - RNA, 13 nt, Human
caaugugccccca

SEQ ID NO: 2256186 - RNA, 16 nt, Human
caaugugcuacugauu

SEQ ID NO: 2256187 - RNA, 17 nt, Human
caaugugaccaggggug

SEQ ID NO: 2256188 - RNA, 23 nt, Human
caauguggcaaggaaaaacaggu

SEQ ID NO: 2256189 - RNA, 13 nt, Human
caaugugcucucg

SEQ ID NO: 2256190 - RNA, 19 nt, Human
caaugugaaucagacccua

SEQ ID NO: 2256191 - RNA, 13 nt, Human
caaugugaccagg

SEQ ID NO: 2256192 - RNA, 18 nt, Human
caaugugaaucagacccu

SEQ ID NO: 2256193 - RNA, 14 nt, Human
caaugugaaucaga

SEQ ID NO: 2256194 - RNA, 22 nt, Human
caaugugacuuaaugccacuaa

SEQ ID NO: 2256195 - RNA, 22 nt, Human
caaugugaaaagaaaaaugagc

SEQ ID NO: 2256196 - RNA, 14 nt, Human
caaugugaacuuua

SEQ ID NO: 2256197 - RNA, 21 nt, Human
caaugugaacuuuauuaaaua

SEQ ID NO: 2256198 - RNA, 19 nt, Human
caaugugaacuuuauuaaa

SEQ ID NO: 2256199 - RNA, 18 nt, Human
caaugugaacuuuauuaa

SEQ ID NO: 2256200 - RNA, 15 nt, Human
caaugugaacuuuau

SEQ ID NO: 2256201 - RNA, 18 nt, Human
cacagcugcagagacaga

SEQ ID NO: 2256202 - RNA, 19 nt, Human
cacagcugcagagacagag

SEQ ID NO: 2256203 - RNA, 19 nt, Human
cacagcugagagacuuuua

SEQ ID NO: 2256204 - RNA, 23 nt, Human
cacagcccugucagugcagcccg

SEQ ID NO: 2256205 - RNA, 18 nt, Human
cacagcugagagacuuuu

SEQ ID NO: 2256206 - RNA, 21 nt, Human
cacagcucuucuccaggcugu

SEQ ID NO: 2256207 - RNA, 18 nt, Human
cacagcccugucagugca

SEQ ID NO: 2256208 - RNA, 12 nt, Human
cacagcccuguc

SEQ ID NO: 2256209 - RNA, 14 nt, Human
cacagcccugucag

SEQ ID NO: 2256210 - RNA, 21 nt, Human
cacagcccugucagugcagcc

SEQ ID NO: 2256211 - RNA, 21 nt, Human
cacagccgauucaccugagca

SEQ ID NO: 2256212 - RNA, 20 nt, Human
cacagccgauucaccugagc

SEQ ID NO: 2256213 - RNA, 11 nt, Human
cacagcccucc

SEQ ID NO: 2256214 - RNA, 12 nt, Human
cacagcccuccc

SEQ ID NO: 2256215 - RNA, 14 nt, Human
cacagcccucccgc

SEQ ID NO: 2256216 - RNA, 11 nt, Human
cacagcccugu

SEQ ID NO: 2256217 - RNA, 10 nt, Human
cacagcccug

SEQ ID NO: 2256218 - RNA, 13 nt, Human
cacagcccuguca

SEQ ID NO: 2256219 - RNA, 15 nt, Human
cacagcccucccgcc

SEQ ID NO: 2256220 - RNA, 17 nt, Human
cacagcccucccgcccc

SEQ ID NO: 2256221 - RNA, 18 nt, Human
cacagcccucccgccccu

SEQ ID NO: 2256222 - RNA, 20 nt, Human
cacagcccucccgccccuuc

SEQ ID NO: 2256223 - RNA, 18 nt, Human
cacagccagacuggcaca

SEQ ID NO: 2256224 - RNA, 17 nt, Human
cacagccagacuggcac

SEQ ID NO: 2256225 - RNA, 22 nt, Human
cacagauuugagcucagcccug

SEQ ID NO: 2256226 - RNA, 18 nt, Human
cacagauuugagcucagc

SEQ ID NO: 2256227 - RNA, 17 nt, Human
cacagauuugagcucag

SEQ ID NO: 2256228 - RNA, 16 nt, Human
cacagauuugagcuca

SEQ ID NO: 2256229 - RNA, 19 nt, Human
cacagcaguugaaaagacu

SEQ ID NO: 2256230 - RNA, 22 nt, Human
cacagcagcuucaccagagcau

SEQ ID NO: 2256231 - RNA, 21 nt, Human
cacagcagcuucaccagagca

SEQ ID NO: 2256232 - RNA, 13 nt, Human
cacagccaccccu

SEQ ID NO: 2256233 - RNA, 23 nt, Human
cacagccacacacacagaaaaua

SEQ ID NO: 2256234 - RNA, 22 nt, Human
cacagccacacacacagaaaau

SEQ ID NO: 2256235 - RNA, 21 nt, Human
cacagccacacacacagaaaa

SEQ ID NO: 2256236 - RNA, 20 nt, Human
cacagccacacacacagaaa

SEQ ID NO: 2256237 - RNA, 19 nt, Human
cacagccacacacacagaa

SEQ ID NO: 2256238 - RNA, 18 nt, Human
cacagccacacacacaga

SEQ ID NO: 2256239 - RNA, 17 nt, Human
cacagccacacacacag

SEQ ID NO: 2256240 - RNA, 21 nt, Human
cacagcaguugaaaagacucc

SEQ ID NO: 2256241 - RNA, 13 nt, Human
cacagaggcugcc

SEQ ID NO: 2256242 - RNA, 16 nt, Human
cacagaggaagagcag

SEQ ID NO: 2256243 - RNA, 15 nt, Human
cacagaggaagagca

SEQ ID NO: 2256244 - RNA, 17 nt, Human
cacagaggaagagcagg

SEQ ID NO: 2256245 - RNA, 18 nt, Human
cacagaggcuucuucaga

SEQ ID NO: 2256246 - RNA, 21 nt, Human
cacagaguuguuacauuuuua

SEQ ID NO: 2256247 - RNA, 22 nt, Human
cacagaguuguuacauuuuuaa

SEQ ID NO: 2256248 - RNA, 14 nt, Human
cacagaucacagcu

SEQ ID NO: 2256249 - RNA, 19 nt, Human
cacagaucacagcuucagc

SEQ ID NO: 2256250 - RNA, 22 nt, Human
cacagaucacagcuucagccag

SEQ ID NO: 2256251 - RNA, 17 nt, Human
cacagaugaaacacaaa

SEQ ID NO: 2256252 - RNA, 18 nt, Human
cacagaguggucuuucug

SEQ ID NO: 2256253 - RNA, 17 nt, Human
cacagauggauuugccu

SEQ ID NO: 2256254 - RNA, 11 nt, Human
cacagaugccu

SEQ ID NO: 2256255 - RNA, 12 nt, Human
cacagauggauu

SEQ ID NO: 2256256 - RNA, 23 nt, Human
cacagaugggugcuuggaggaag

SEQ ID NO: 2256257 - RNA, 19 nt, Human
cacagagaaaguacuucuc

SEQ ID NO: 2256258 - RNA, 20 nt, Human
cacagagaaaguacuucucc

SEQ ID NO: 2256259 - RNA, 21 nt, Human
cacagagaaaguacuucucca

SEQ ID NO: 2256260 - RNA, 13 nt, Human
cacagaggaagag

SEQ ID NO: 2256261 - RNA, 18 nt, Human
cacagagcucuccagcuc

SEQ ID NO: 2256262 - RNA, 21 nt, Human
cacagagcucuccagcuccaa

SEQ ID NO: 2256263 - RNA, 14 nt, Human
cacagagcucucca

SEQ ID NO: 2256264 - RNA, 16 nt, Human
cacagagcucuccagc

SEQ ID NO: 2256265 - RNA, 17 nt, Human
cacagagcucuccagcu

SEQ ID NO: 2256266 - RNA, 12 nt, Human
cacagagaaagu

SEQ ID NO: 2256267 - RNA, 13 nt, Human
cacacugaagaag

SEQ ID NO: 2256268 - RNA, 17 nt, Human
cacacuccaucagcuua

SEQ ID NO: 2256269 - RNA, 15 nt, Human
cacacuccaucagcu

SEQ ID NO: 2256270 - RNA, 14 nt, Human
cacacuccaucagc

SEQ ID NO: 2256271 - RNA, 22 nt, Human
cacacuccaagauauggacaca

SEQ ID NO: 2256272 - RNA, 17 nt, Human
cacacuccccugcacug

SEQ ID NO: 2256273 - RNA, 16 nt, Human
cacacucgcccgccca

SEQ ID NO: 2256274 - RNA, 14 nt, Human
cacacuccagcugg

SEQ ID NO: 2256275 - RNA, 16 nt, Human
cacacuccaagauaug

SEQ ID NO: 2256276 - RNA, 15 nt, Human
cacacacgugagaau

SEQ ID NO: 2256277 - RNA, 15 nt, Human
cacacacucacugcg

SEQ ID NO: 2256278 - RNA, 22 nt, Human
cacaguucaguggcagggcuca

SEQ ID NO: 2256279 - RNA, 23 nt, Human
caaggagaugaagcaaacacauu

SEQ ID NO: 2256280 - RNA, 13 nt, Human
caaggagaugaag

SEQ ID NO: 2256281 - RNA, 13 nt, Human
caaggagaggagg

SEQ ID NO: 2256282 - RNA, 14 nt, Human
caaggagaggaggc

SEQ ID NO: 2256283 - RNA, 15 nt, Human
caaggagaggaggca

SEQ ID NO: 2256284 - RNA, 18 nt, Human
caaggagaggaggcaacu

SEQ ID NO: 2256285 - RNA, 16 nt, Human
caaggagauuuacaac

SEQ ID NO: 2256286 - RNA, 18 nt, Human
caaggauccugagccaga

SEQ ID NO: 2256287 - RNA, 19 nt, Human
caaggauccugagccagau

SEQ ID NO: 2256288 - RNA, 22 nt, Human
caaggcugcagugagccgagau

SEQ ID NO: 2256289 - RNA, 17 nt, Human
caaggcugcagugagcc

SEQ ID NO: 2256290 - RNA, 22 nt, Human
caaggauccugagccagauuuc

SEQ ID NO: 2256291 - RNA, 20 nt, Human
caaggauccugagccagauu

SEQ ID NO: 2256292 - RNA, 22 nt, Human
caagcuggucccacucagucca

SEQ ID NO: 2256293 - RNA, 23 nt, Human
caagcuggucccacucaguccau

SEQ ID NO: 2256294 - RNA, 18 nt, Human
caaggaaaaaauaacaau

SEQ ID NO: 2256295 - RNA, 19 nt, Human
caaggagaaacagagacag

SEQ ID NO: 2256296 - RNA, 20 nt, Human
caaggagacacaacaacucc

SEQ ID NO: 2256297 - RNA, 20 nt, Human
caaggagaaacagagacagg

SEQ ID NO: 2256298 - RNA, 18 nt, Human
caaggagaaacagagaca

SEQ ID NO: 2256299 - RNA, 16 nt, Human
caaggagaaacagaga

SEQ ID NO: 2256300 - RNA, 14 nt, Human
caaggagaaacaga

SEQ ID NO: 2256301 - RNA, 18 nt, Human
caagcugugagacagugg

SEQ ID NO: 2256302 - RNA, 14 nt, Human
caagcuggaagcac

SEQ ID NO: 2256303 - RNA, 18 nt, Human
caagcuggaagcacaugu

SEQ ID NO: 2256304 - RNA, 14 nt, Human
caagcugugagaca

SEQ ID NO: 2256305 - RNA, 20 nt, Human
caaggaaaaaauaacaauga

SEQ ID NO: 2256306 - RNA, 20 nt, Human
caagcgaggucaacagagaa

SEQ ID NO: 2256307 - RNA, 17 nt, Human
caagcgaggucaacaga

SEQ ID NO: 2256308 - RNA, 17 nt, Human
caagccuuggcucuacc

SEQ ID NO: 2256309 - RNA, 21 nt, Human
caagccuguaaucccagcuac

SEQ ID NO: 2256310 - RNA, 18 nt, Human
caagccuguaaucccagc

SEQ ID NO: 2256311 - RNA, 12 nt, Human
caagccugguca

SEQ ID NO: 2256312 - RNA, 18 nt, Human
caagccuggucagcccaa

SEQ ID NO: 2256313 - RNA, 17 nt, Human
caagccuggucagccca

SEQ ID NO: 2256314 - RNA, 16 nt, Human
caagccuggucagccc

SEQ ID NO: 2256315 - RNA, 15 nt, Human
caagccuggucagcc

SEQ ID NO: 2256316 - RNA, 15 nt, Human
caagaggcugaggca

SEQ ID NO: 2256317 - RNA, 22 nt, Human
caagaguuuauuuccaaauaaa

SEQ ID NO: 2256318 - RNA, 15 nt, Human
caagauaacugagaa

SEQ ID NO: 2256319 - RNA, 16 nt, Human
caagauaacugagaau

SEQ ID NO: 2256320 - RNA, 16 nt, Human
caagauaccuaaaaga

SEQ ID NO: 2256321 - RNA, 22 nt, Human
caagcugcacccucaggcaggu

SEQ ID NO: 2256322 - RNA, 14 nt, Human
caagcugcaucuag

SEQ ID NO: 2256323 - RNA, 12 nt, Human
caagcuggaagc

SEQ ID NO: 2256324 - RNA, 13 nt, Human
caagcuggaagca

SEQ ID NO: 2256325 - RNA, 21 nt, Human
caagcuggucccacucagucc

SEQ ID NO: 2256326 - RNA, 15 nt, Human
caagcgauucuucug

SEQ ID NO: 2256327 - RNA, 17 nt, Human
caagcgauucuucugcu

SEQ ID NO: 2256328 - RNA, 21 nt, Human
caagcugcacccucaggcagg

SEQ ID NO: 2256329 - RNA, 18 nt, Human
caagcgauucuucugcuu

SEQ ID NO: 2256330 - RNA, 19 nt, Human
caauagauauuuaccuuuu

SEQ ID NO: 2256331 - RNA, 23 nt, Human
caauagaaacucaccauguaaaa

SEQ ID NO: 2256332 - RNA, 23 nt, Human
caauagaaggauguacauuucca

SEQ ID NO: 2256333 - RNA, 18 nt, Human
caauacucauaaugugaa

SEQ ID NO: 2256334 - RNA, 22 nt, Human
caauacucauaaugugaagugu

SEQ ID NO: 2256335 - RNA, 17 nt, Human
caauacucauaauguga

SEQ ID NO: 2256336 - RNA, 23 nt, Human
caauacccuuugaauuggacaau

SEQ ID NO: 2256337 - RNA, 22 nt, Human
caauacccaaauccucuccagc

SEQ ID NO: 2256338 - RNA, 23 nt, Human
caauacccaaauccucuccagcu

SEQ ID NO: 2256339 - RNA, 18 nt, Human
caauaauaauaccucccu

SEQ ID NO: 2256340 - RNA, 20 nt, Human
caauacccaaauccucucca

SEQ ID NO: 2256341 - RNA, 19 nt, Human
caauaauaaauauuuuugc

SEQ ID NO: 2256342 - RNA, 13 nt, Human
caauaagccuugu

SEQ ID NO: 2256343 - RNA, 17 nt, Human
caauaaggucaaugcca

SEQ ID NO: 2256344 - RNA, 18 nt, Human
caauaaggucaaugccag

SEQ ID NO: 2256345 - RNA, 22 nt, Human
caauaacuacuguguuccuggc

SEQ ID NO: 2256346 - RNA, 19 nt, Human
caauaagcaucaaacucuu

SEQ ID NO: 2256347 - RNA, 12 nt, Human
caauaagccuug

SEQ ID NO: 2256348 - RNA, 18 nt, Human
caauaagcaucaaacucu

SEQ ID NO: 2256349 - RNA, 20 nt, Human
caauaagaauuuagggagaa

SEQ ID NO: 2256350 - RNA, 21 nt, Human
caauaacuacuguguuccugg

SEQ ID NO: 2256351 - RNA, 20 nt, Human
caauaacuacuguguuccug

SEQ ID NO: 2256352 - RNA, 19 nt, Human
caauaacuacuguguuccu

SEQ ID NO: 2256353 - RNA, 18 nt, Human
caauaacuacuguguucc

SEQ ID NO: 2256354 - RNA, 17 nt, Human
caauaacuacuguguuc

SEQ ID NO: 2256355 - RNA, 16 nt, Human
caauaacuacuguguu

SEQ ID NO: 2256356 - RNA, 15 nt, Human
caauaacuacugugu

SEQ ID NO: 2256357 - RNA, 14 nt, Human
caauaacuacugug

SEQ ID NO: 2256358 - RNA, 13 nt, Human
caauaacacuguc

SEQ ID NO: 2256359 - RNA, 15 nt, Human
caauaacacacagcu

SEQ ID NO: 2256360 - RNA, 19 nt, Human
caauagcagacaguguuuu

SEQ ID NO: 2256361 - RNA, 19 nt, Human
caauagcaacguagcuucu

SEQ ID NO: 2256362 - RNA, 15 nt, Human
caauaggaaaaacug

SEQ ID NO: 2256363 - RNA, 16 nt, Human
caauaggaaaaacuga

SEQ ID NO: 2256364 - RNA, 17 nt, Human
caauaggaaaaacugau

SEQ ID NO: 2256365 - RNA, 23 nt, Human
caauaguguguucugauuagaaa

SEQ ID NO: 2256366 - RNA, 18 nt, Human
caauauaaaacuguacuu

SEQ ID NO: 2256367 - RNA, 17 nt, Human
caauaguguguucugau

SEQ ID NO: 2256368 - RNA, 16 nt, Human
caauaguguguucuga

SEQ ID NO: 2256369 - RNA, 15 nt, Human
caauaguguguucug

SEQ ID NO: 2256370 - RNA, 14 nt, Human
caauaguguguucu

SEQ ID NO: 2256371 - RNA, 16 nt, Human
caauagucaagaaaaa

SEQ ID NO: 2256372 - RNA, 16 nt, Human
caauagugggcccucc

SEQ ID NO: 2256373 - RNA, 17 nt, Human
caauagucaaauugugu

SEQ ID NO: 2256374 - RNA, 19 nt, Human
caauagucaaauuguguga

SEQ ID NO: 2256375 - RNA, 18 nt, Human
caaggcugggggaagaag

SEQ ID NO: 2256376 - RNA, 16 nt, Human
caaggcugcuuagaau

SEQ ID NO: 2256377 - RNA, 17 nt, Human
caaggcugcgucuggag

SEQ ID NO: 2256378 - RNA, 18 nt, Human
caaggcugcgucuggagg

SEQ ID NO: 2256379 - RNA, 18 nt, Human
caaggcugcgguuuguug

SEQ ID NO: 2256380 - RNA, 14 nt, Human
caaggcugcgucug

SEQ ID NO: 2256381 - RNA, 15 nt, Human
caagggaaaagucuc

SEQ ID NO: 2256382 - RNA, 21 nt, Human
caagggaaaggggugcuuuua

SEQ ID NO: 2256383 - RNA, 18 nt, Human
caagggaauguaacugcu

SEQ ID NO: 2256384 - RNA, 16 nt, Human
caagggucuagggaga

SEQ ID NO: 2256385 - RNA, 21 nt, Human
caagggugaugggaaagcauu

SEQ ID NO: 2256386 - RNA, 16 nt, Human
caagggaaaagucucu

SEQ ID NO: 2256387 - RNA, 12 nt, Human
caagggaaaggg

SEQ ID NO: 2256388 - RNA, 14 nt, Human
caagggaaaggggu

SEQ ID NO: 2256389 - RNA, 16 nt, Human
caagggaaaggggugc

SEQ ID NO: 2256390 - RNA, 20 nt, Human
caagggaaaggggugcuuuu

SEQ ID NO: 2256391 - RNA, 19 nt, Human
caaggguagggugggccuu

SEQ ID NO: 2256392 - RNA, 15 nt, Human
caagggaaccugugu

SEQ ID NO: 2256393 - RNA, 16 nt, Human
caagggaaccuguguc

SEQ ID NO: 2256394 - RNA, 18 nt, Human
caauaaaucugacccagu

SEQ ID NO: 2256395 - RNA, 17 nt, Human
caauaaaucugacccag

SEQ ID NO: 2256396 - RNA, 12 nt, Human
caauaaaugaau

SEQ ID NO: 2256397 - RNA, 20 nt, Human
caauaaaucugacccagugc

SEQ ID NO: 2256398 - RNA, 23 nt, Human
caauaaaugguauagcaaauguu

SEQ ID NO: 2256399 - RNA, 18 nt, Human
caauaaaugguauagcaa

SEQ ID NO: 2256400 - RNA, 17 nt, Human
caauaaaugugcuuaug

SEQ ID NO: 2256401 - RNA, 16 nt, Human
caauaaaugucuguug

SEQ ID NO: 2256402 - RNA, 14 nt, Human
caauaaaugucugu

SEQ ID NO: 2256403 - RNA, 15 nt, Human
caauaaaugucuguu

SEQ ID NO: 2256404 - RNA, 21 nt, Human
caaggguggcaucccaguggc

SEQ ID NO: 2256405 - RNA, 16 nt, Human
caauaaaguauuuaau

SEQ ID NO: 2256406 - RNA, 17 nt, Human
caauaaaguauuuaauu

SEQ ID NO: 2256407 - RNA, 16 nt, Human
caaggguggcauccca

SEQ ID NO: 2256408 - RNA, 17 nt, Human
caagggucuagggagag

SEQ ID NO: 2256409 - RNA, 19 nt, Human
caaggguucagagacucag

SEQ ID NO: 2256410 - RNA, 23 nt, Human
caagggugaugggaaagcauugu

SEQ ID NO: 2256411 - RNA, 20 nt, Human
caauaaaguauuuaauuagu

SEQ ID NO: 2256412 - RNA, 22 nt, Human
caauaaaguauuuaauuagugc

SEQ ID NO: 2256413 - RNA, 18 nt, Human
caauaggaaaaacugauu

SEQ ID NO: 2256414 - RNA, 17 nt, Human
caacacugugcccuggu

SEQ ID NO: 2256415 - RNA, 19 nt, Human
caaauuuggggguuucuca

SEQ ID NO: 2256416 - RNA, 17 nt, Human
caaauuugucuugccuu

SEQ ID NO: 2256417 - RNA, 22 nt, Human
caaauuugucuugccuuauuaa

SEQ ID NO: 2256418 - RNA, 17 nt, Human
caaauuugauugauuug

SEQ ID NO: 2256419 - RNA, 19 nt, Human
caaauuugaaaauaauugu

SEQ ID NO: 2256420 - RNA, 14 nt, Human
caaauuugauugau

SEQ ID NO: 2256421 - RNA, 22 nt, Human
caaauuucuaaaucuccaaaau

SEQ ID NO: 2256422 - RNA, 15 nt, Human
caaauuucuaaaucu

SEQ ID NO: 2256423 - RNA, 18 nt, Human
caaauuacuuugugaaua

SEQ ID NO: 2256424 - RNA, 11 nt, Human
caaauuagaaa

SEQ ID NO: 2256425 - RNA, 21 nt, Human
caaauuacuuugugaauagaa

SEQ ID NO: 2256426 - RNA, 18 nt, Human
caaauuaauuggcagcag

SEQ ID NO: 2256427 - RNA, 19 nt, Human
caaauuaauuggcagcaga

SEQ ID NO: 2256428 - RNA, 20 nt, Human
caaauuaauuggcagcagau

SEQ ID NO: 2256429 - RNA, 20 nt, Human
caaauuagguuuuguacaau

SEQ ID NO: 2256430 - RNA, 19 nt, Human
caaauuagguuuuguacaa

SEQ ID NO: 2256431 - RNA, 18 nt, Human
caaauuagguuuuguaca

SEQ ID NO: 2256432 - RNA, 18 nt, Human
caaauuagaagacauuua

SEQ ID NO: 2256433 - RNA, 21 nt, Human
caaauuagguuuuguacaauu

SEQ ID NO: 2256434 - RNA, 22 nt, Human
caaauuagaaaauguuauuuaa

SEQ ID NO: 2256435 - RNA, 15 nt, Human
caaauuagaagacau

SEQ ID NO: 2256436 - RNA, 19 nt, Human
caaauuagaagacauuuau

SEQ ID NO: 2256437 - RNA, 19 nt, Human
caaauuagaaaauguuauu

SEQ ID NO: 2256438 - RNA, 18 nt, Human
caaauuagaaaauguuau

SEQ ID NO: 2256439 - RNA, 13 nt, Human
caaauuagaaaau

SEQ ID NO: 2256440 - RNA, 12 nt, Human
caaauuagaaaa

SEQ ID NO: 2256441 - RNA, 15 nt, Human
caacagaagaacugu

SEQ ID NO: 2256442 - RNA, 16 nt, Human
caacagaagcuucaga

SEQ ID NO: 2256443 - RNA, 12 nt, Human
caacagaagcag

SEQ ID NO: 2256444 - RNA, 22 nt, Human
caacacugugcccugguggaga

SEQ ID NO: 2256445 - RNA, 18 nt, Human
caacacugugcccuggug

SEQ ID NO: 2256446 - RNA, 19 nt, Human
caacacugugcccuggugg

SEQ ID NO: 2256447 - RNA, 23 nt, Human
caacacugugcccugguggagaa

SEQ ID NO: 2256448 - RNA, 17 nt, Human
caacagagaaggcagga

SEQ ID NO: 2256449 - RNA, 17 nt, Human
caacagaagcuucagaa

SEQ ID NO: 2256450 - RNA, 18 nt, Human
caacagagaaggcaggaa

SEQ ID NO: 2256451 - RNA, 12 nt, Human
caacagaagugg

SEQ ID NO: 2256452 - RNA, 23 nt, Human
caacagaagucaugaagcccaag

SEQ ID NO: 2256453 - RNA, 22 nt, Human
caacagaagucaugaagcccaa

SEQ ID NO: 2256454 - RNA, 20 nt, Human
caacagaagucaugaagccc

SEQ ID NO: 2256455 - RNA, 15 nt, Human
caacagaagcuucca

SEQ ID NO: 2256456 - RNA, 23 nt, Human
caacagagugagacccugucucu

SEQ ID NO: 2256457 - RNA, 19 nt, Human
caacagagugagacccugu

SEQ ID NO: 2256458 - RNA, 17 nt, Human
caacagauacuggaagu

SEQ ID NO: 2256459 - RNA, 14 nt, Human
caacagauacugga

SEQ ID NO: 2256460 - RNA, 17 nt, Human
caacagaucaauuugua

SEQ ID NO: 2256461 - RNA, 23 nt, Human
caacagaucuggaaccucagccu

SEQ ID NO: 2256462 - RNA, 17 nt, Human
caacagaucuggaaccu

SEQ ID NO: 2256463 - RNA, 14 nt, Human
caacagaucuggaa

SEQ ID NO: 2256464 - RNA, 13 nt, Human
caacagaucugga

SEQ ID NO: 2256465 - RNA, 14 nt, Human
caacagauuuguga

SEQ ID NO: 2256466 - RNA, 23 nt, Human
caacagaugcuuuucugucucug

SEQ ID NO: 2256467 - RNA, 15 nt, Human
caacagaugcuuuuc

SEQ ID NO: 2256468 - RNA, 21 nt, Human
caacagaugcuuuucugucuc

SEQ ID NO: 2256469 - RNA, 20 nt, Human
caacagauuugugaacucag

SEQ ID NO: 2256470 - RNA, 23 nt, Human
caacagauuugugaacucagcca

SEQ ID NO: 2256471 - RNA, 15 nt, Human
caacagauuugugaa

SEQ ID NO: 2256472 - RNA, 16 nt, Human
caacagauuugugaac

SEQ ID NO: 2256473 - RNA, 17 nt, Human
caacagauuugugaacu

SEQ ID NO: 2256474 - RNA, 19 nt, Human
caacagauuugugaacuca

SEQ ID NO: 2256475 - RNA, 16 nt, Human
caaccuggucacagga

SEQ ID NO: 2256476 - RNA, 16 nt, Human
caaccuucuguggcuc

SEQ ID NO: 2256477 - RNA, 20 nt, Human
caaccuggggggcaguggug

SEQ ID NO: 2256478 - RNA, 11 nt, Human
caaccuggaga

SEQ ID NO: 2256479 - RNA, 13 nt, Human
caaccugggucca

SEQ ID NO: 2256480 - RNA, 14 nt, Human
caaccuggguccaa

SEQ ID NO: 2256481 - RNA, 16 nt, Human
caaccuggguccaaau

SEQ ID NO: 2256482 - RNA, 17 nt, Human
caaccuggguccaaaua

SEQ ID NO: 2256483 - RNA, 18 nt, Human
caaccuggguccaaauaa

SEQ ID NO: 2256484 - RNA, 17 nt, Human
caaccuucuguggcuca

SEQ ID NO: 2256485 - RNA, 19 nt, Human
caaccuucuguggcucaca

SEQ ID NO: 2256486 - RNA, 20 nt, Human
caaccuucuguggcucacag

SEQ ID NO: 2256487 - RNA, 16 nt, Human
caaccuugagacagcu

SEQ ID NO: 2256488 - RNA, 19 nt, Human
caaccuggguccaaauaaa

SEQ ID NO: 2256489 - RNA, 20 nt, Human
caaccuggguccaaauaaaa

SEQ ID NO: 2256490 - RNA, 20 nt, Human
caacauacucccaucuguga

SEQ ID NO: 2256491 - RNA, 21 nt, Human
caaccugcucuccucuugcca

SEQ ID NO: 2256492 - RNA, 23 nt, Human
caaccugcucuccucuugccacu

SEQ ID NO: 2256493 - RNA, 18 nt, Human
caaccugcucuccucuug

SEQ ID NO: 2256494 - RNA, 22 nt, Human
caacaggagcugggauccuaag

SEQ ID NO: 2256495 - RNA, 14 nt, Human
caacaggaggacaa

SEQ ID NO: 2256496 - RNA, 15 nt, Human
caacaggaggacaau

SEQ ID NO: 2256497 - RNA, 16 nt, Human
caacaggaggacaauu

SEQ ID NO: 2256498 - RNA, 17 nt, Human
caacaggaggacaauuc

SEQ ID NO: 2256499 - RNA, 19 nt, Human
caacaggaggacaauucau

SEQ ID NO: 2256500 - RNA, 22 nt, Human
caacaggaggacaauucaugaa

SEQ ID NO: 2256501 - RNA, 23 nt, Human
caacaggaggacaauucaugaac

SEQ ID NO: 2256502 - RNA, 12 nt, Human
caacaggcuggg

SEQ ID NO: 2256503 - RNA, 17 nt, Human
caacauacucccaucug

SEQ ID NO: 2256504 - RNA, 19 nt, Human
caacauacucccaucugug

SEQ ID NO: 2256505 - RNA, 21 nt, Human
caacaggagcugggauccuaa

SEQ ID NO: 2256506 - RNA, 15 nt, Human
caacaggagcuggga

SEQ ID NO: 2256507 - RNA, 14 nt, Human
caacaggagcuggg

SEQ ID NO: 2256508 - RNA, 15 nt, Human
caacaggagaauuuu

SEQ ID NO: 2256509 - RNA, 19 nt, Human
caacaggaaucaagagcug

SEQ ID NO: 2256510 - RNA, 21 nt, Human
caacaggaaucaagagcugcc

SEQ ID NO: 2256511 - RNA, 23 nt, Human
caacaggaaucaagagcugcccu

SEQ ID NO: 2256512 - RNA, 23 nt, Human
caacagcuccccauuacccucag

SEQ ID NO: 2256513 - RNA, 22 nt, Human
caacagcucaagucuucccuga

SEQ ID NO: 2256514 - RNA, 15 nt, Human
caacagcucaagucu

SEQ ID NO: 2256515 - RNA, 23 nt, Human
caacagcgacauagcccaucccu

SEQ ID NO: 2256516 - RNA, 21 nt, Human
caacagcgacauagcccaucc

SEQ ID NO: 2256517 - RNA, 17 nt, Human
caacagcaaaucacgac

SEQ ID NO: 2256518 - RNA, 12 nt, Human
caacagcacugg

SEQ ID NO: 2256519 - RNA, 15 nt, Human
caacagcacuggcuc

SEQ ID NO: 2256520 - RNA, 22 nt, Human
caacagcacuggcucucuccag

SEQ ID NO: 2256521 - RNA, 15 nt, Human
caaagaaauuaugug

SEQ ID NO: 2256522 - RNA, 11 nt, Human
caaagaagaaa

SEQ ID NO: 2256523 - RNA, 19 nt, Human
caaagaaggaaaaggcagg

SEQ ID NO: 2256524 - RNA, 14 nt, Human
caaagaagacaugu

SEQ ID NO: 2256525 - RNA, 16 nt, Human
caaagaagacauguuu

SEQ ID NO: 2256526 - RNA, 14 nt, Human
caaagaagacaaca

SEQ ID NO: 2256527 - RNA, 13 nt, Human
caaagaagacaug

SEQ ID NO: 2256528 - RNA, 17 nt, Human
caaagaaggaauucuag

SEQ ID NO: 2256529 - RNA, 20 nt, Human
caaagaagacauguuuuaga

SEQ ID NO: 2256530 - RNA, 16 nt, Human
caaagagagaaaauaa

SEQ ID NO: 2256531 - RNA, 14 nt, Human
caaagagacuggag

SEQ ID NO: 2256532 - RNA, 15 nt, Human
caaagagaaaacuua

SEQ ID NO: 2256533 - RNA, 19 nt, Human
caaagagagaaaauaaaga

SEQ ID NO: 2256534 - RNA, 16 nt, Human
caaagagacuggagca

SEQ ID NO: 2256535 - RNA, 17 nt, Human
caaagagacuggagcau

SEQ ID NO: 2256536 - RNA, 18 nt, Human
caaagagacuggagcauc

SEQ ID NO: 2256537 - RNA, 13 nt, Human
caaagagccugga

SEQ ID NO: 2256538 - RNA, 15 nt, Human
caaagagccuggaga

SEQ ID NO: 2256539 - RNA, 16 nt, Human
caaagagccuggagaa

SEQ ID NO: 2256540 - RNA, 17 nt, Human
caaagagccuggagaag

SEQ ID NO: 2256541 - RNA, 18 nt, Human
caaagagccuggagaagc

SEQ ID NO: 2256542 - RNA, 13 nt, Human
caaagugcuggga

SEQ ID NO: 2256543 - RNA, 19 nt, Human
caaagugcugggauuacaa

SEQ ID NO: 2256544 - RNA, 15 nt, Human
caaauaaaaauauug

SEQ ID NO: 2256545 - RNA, 20 nt, Human
caaaguucccuacuuccugu

SEQ ID NO: 2256546 - RNA, 21 nt, Human
caaaguuacuagguaacuuca

SEQ ID NO: 2256547 - RNA, 16 nt, Human
caaaguuacuagguaa

SEQ ID NO: 2256548 - RNA, 16 nt, Human
caaaguuaacagauuu

SEQ ID NO: 2256549 - RNA, 16 nt, Human
caaauaaaaauauugu

SEQ ID NO: 2256550 - RNA, 18 nt, Human
caaauaaaaauauugugu

SEQ ID NO: 2256551 - RNA, 23 nt, Human
caaauaaaauaaaaauaaaaaca

SEQ ID NO: 2256552 - RNA, 10 nt, Human
caaauaaaau

SEQ ID NO: 2256553 - RNA, 11 nt, Human
caaauaaacac

SEQ ID NO: 2256554 - RNA, 12 nt, Human
caaauaaacacu

SEQ ID NO: 2256555 - RNA, 13 nt, Human
caaauaaacacug

SEQ ID NO: 2256556 - RNA, 14 nt, Human
caaauaaacacugu

SEQ ID NO: 2256557 - RNA, 15 nt, Human
caaauaaacacugug

SEQ ID NO: 2256558 - RNA, 23 nt, Human
caaagugcugggauuacaagcgu

SEQ ID NO: 2256559 - RNA, 18 nt, Human
caaagugcugggauuaca

SEQ ID NO: 2256560 - RNA, 12 nt, Human
caaaguguguau

SEQ ID NO: 2256561 - RNA, 13 nt, Human
caaaguguguauu

SEQ ID NO: 2256562 - RNA, 14 nt, Human
caaaguguguauua

SEQ ID NO: 2256563 - RNA, 17 nt, Human
caaaguguguauuaaaa

SEQ ID NO: 2256564 - RNA, 11 nt, Human
caaaguguuaa

SEQ ID NO: 2256565 - RNA, 15 nt, Human
caaaguuaacagauu

SEQ ID NO: 2256566 - RNA, 21 nt, Human
caaauguuaugcauaaaguca

SEQ ID NO: 2256567 - RNA, 22 nt, Human
caaauggcgucuggaaguccaa

SEQ ID NO: 2256568 - RNA, 18 nt, Human
caaauguucaucaaugaa

SEQ ID NO: 2256569 - RNA, 13 nt, Human
caaauguuaugca

SEQ ID NO: 2256570 - RNA, 21 nt, Human
caaauggcgucuggaagucca

SEQ ID NO: 2256571 - RNA, 19 nt, Human
caaauggcgucuggaaguc

SEQ ID NO: 2256572 - RNA, 14 nt, Human
caaauguucaucaa

SEQ ID NO: 2256573 - RNA, 14 nt, Human
caaauggaggaaua

SEQ ID NO: 2256574 - RNA, 18 nt, Human
caaauggcgucuggaagu

SEQ ID NO: 2256575 - RNA, 15 nt, Human
caaauggaagacaca

SEQ ID NO: 2256576 - RNA, 19 nt, Human
caaauggaagacacauuga

SEQ ID NO: 2256577 - RNA, 23 nt, Human
caaauggaaaugggcagagcaga

SEQ ID NO: 2256578 - RNA, 16 nt, Human
caaaucaauuacuggu

SEQ ID NO: 2256579 - RNA, 17 nt, Human
caaaucaauacacuagu

SEQ ID NO: 2256580 - RNA, 12 nt, Human
caaauaugcaaa

SEQ ID NO: 2256581 - RNA, 17 nt, Human
caaauaaagucccaggu

SEQ ID NO: 2256582 - RNA, 18 nt, Human
caaauaaacucuaaacau

SEQ ID NO: 2256583 - RNA, 20 nt, Human
caaauaaacacuguguaagc

SEQ ID NO: 2256584 - RNA, 17 nt, Human
caaauaaacucuaaaca

SEQ ID NO: 2256585 - RNA, 23 nt, Human
caaauauauucagccuggcuuca

SEQ ID NO: 2256586 - RNA, 14 nt, Human
caaaucaagcuuca

SEQ ID NO: 2256587 - RNA, 15 nt, Human
caaaucaagcuucag

SEQ ID NO: 2256588 - RNA, 14 nt, Human
caaaucaauacacu

SEQ ID NO: 2256589 - RNA, 15 nt, Human
caaaucaauacacua

SEQ ID NO: 2256590 - RNA, 13 nt, Human
caaaucaaagcag

SEQ ID NO: 2256591 - RNA, 17 nt, Human
caaauauuuuuuuguag

SEQ ID NO: 2256592 - RNA, 14 nt, Human
caaaucaaagcaga

SEQ ID NO: 2256593 - RNA, 15 nt, Human
caaaucaaagcagau

SEQ ID NO: 2256594 - RNA, 13 nt, Human
caaauauuuggag

SEQ ID NO: 2256595 - RNA, 15 nt, Human
caaauauuuuuuugu

SEQ ID NO: 2256596 - RNA, 14 nt, Human
caaauaugcaaagc

SEQ ID NO: 2256597 - RNA, 20 nt, Human
caaauauuuauuuucuuucu

SEQ ID NO: 2256598 - RNA, 13 nt, Human
caaauaugcaaag

SEQ ID NO: 2256599 - RNA, 12 nt, Human
caagagcugagg

SEQ ID NO: 2256600 - RNA, 18 nt, Human
caagagcgaaacuccguc

SEQ ID NO: 2256601 - RNA, 13 nt, Human
caagagcugcccu

SEQ ID NO: 2256602 - RNA, 14 nt, Human
caagagcugcccuc

SEQ ID NO: 2256603 - RNA, 23 nt, Human
caagagccuugguguccaccugg

SEQ ID NO: 2256604 - RNA, 19 nt, Human
caagagcccagcagggccu

SEQ ID NO: 2256605 - RNA, 13 nt, Human
caagagcccagca

SEQ ID NO: 2256606 - RNA, 21 nt, Human
caagagccauguagaagcugc

SEQ ID NO: 2256607 - RNA, 22 nt, Human
caagagccuugguguccaccug

SEQ ID NO: 2256608 - RNA, 17 nt, Human
caagagcuuaacagugu

SEQ ID NO: 2256609 - RNA, 20 nt, Human
caagagcugcccuccuuguc

SEQ ID NO: 2256610 - RNA, 16 nt, Human
caagagcugcccuccu

SEQ ID NO: 2256611 - RNA, 18 nt, Human
caagagcugcccuccuug

SEQ ID NO: 2256612 - RNA, 17 nt, Human
caagagcagccuguggc

SEQ ID NO: 2256613 - RNA, 16 nt, Human
caagagcagccugugg

SEQ ID NO: 2256614 - RNA, 15 nt, Human
caagagcagccugug

SEQ ID NO: 2256615 - RNA, 14 nt, Human
caagagcagccugu

SEQ ID NO: 2256616 - RNA, 16 nt, Human
caagagcagaggcagc

SEQ ID NO: 2256617 - RNA, 15 nt, Human
caagagcagaggcag

SEQ ID NO: 2256618 - RNA, 15 nt, Human
caagagauuuaauua

SEQ ID NO: 2256619 - RNA, 13 nt, Human
caagagcacacuu

SEQ ID NO: 2256620 - RNA, 14 nt, Human
caagagcacacuug

SEQ ID NO: 2256621 - RNA, 20 nt, Human
caagagcagccuguggcauc

SEQ ID NO: 2256622 - RNA, 18 nt, Human
caagagcagccuguggca

SEQ ID NO: 2256623 - RNA, 21 nt, Human
caagagcagccuguggcaucu

SEQ ID NO: 2256624 - RNA, 16 nt, Human
caagagcacacuuggc

SEQ ID NO: 2256625 - RNA, 20 nt, Human
caagagccauguagaagcug

SEQ ID NO: 2256626 - RNA, 13 nt, Human
caagagagaaaga

SEQ ID NO: 2256627 - RNA, 12 nt, Human
caagagacucug

SEQ ID NO: 2256628 - RNA, 22 nt, Human
caagagaauugcuugaacccag

SEQ ID NO: 2256629 - RNA, 13 nt, Human
caagagacaugcu

SEQ ID NO: 2256630 - RNA, 23 nt, Human
caagagaugaagagugagagggc

SEQ ID NO: 2256631 - RNA, 16 nt, Human
caagagaugggaauga

SEQ ID NO: 2256632 - RNA, 17 nt, Human
caagagagaaagaagua

SEQ ID NO: 2256633 - RNA, 14 nt, Human
caagagagaaagaa

SEQ ID NO: 2256634 - RNA, 15 nt, Human
caagagagauguuuu

SEQ ID NO: 2256635 - RNA, 13 nt, Human
caagagagauguu

SEQ ID NO: 2256636 - RNA, 21 nt, Human
caagaccuucuccuucaccuu

SEQ ID NO: 2256637 - RNA, 23 nt, Human
caagaccuucuccuucaccuuug

SEQ ID NO: 2256638 - RNA, 13 nt, Human
caagacgcugugc

SEQ ID NO: 2256639 - RNA, 15 nt, Human
caagacgcugugcug

SEQ ID NO: 2256640 - RNA, 12 nt, Human
caacguggggca

SEQ ID NO: 2256641 - RNA, 15 nt, Human
caacguggggcagca

SEQ ID NO: 2256642 - RNA, 17 nt, Human
caacguggggcagcaca

SEQ ID NO: 2256643 - RNA, 17 nt, Human
caacguggcccagagaa

SEQ ID NO: 2256644 - RNA, 19 nt, Human
caacguggcccagagaagc

SEQ ID NO: 2256645 - RNA, 20 nt, Human
caacguggcccagagaagcc

SEQ ID NO: 2256646 - RNA, 21 nt, Human
caacguggcccagagaagcca

SEQ ID NO: 2256647 - RNA, 13 nt, Human
caacguggcccag

SEQ ID NO: 2256648 - RNA, 14 nt, Human
caacguggcccaga

SEQ ID NO: 2256649 - RNA, 18 nt, Human
caacgugcauugugcuuc

SEQ ID NO: 2256650 - RNA, 13 nt, Human
caacgacaaagcc

SEQ ID NO: 2256651 - RNA, 18 nt, Human
caacguggggcagcacag

SEQ ID NO: 2256652 - RNA, 18 nt, Human
caacuuggcuuccuuucu

SEQ ID NO: 2256653 - RNA, 12 nt, Human
caacuugggaac

SEQ ID NO: 2256654 - RNA, 19 nt, Human
caacuuggcuuccuuucuu

SEQ ID NO: 2256655 - RNA, 12 nt, Human
caacuuggcuuu

SEQ ID NO: 2256656 - RNA, 13 nt, Human
caacuuggcuuuc

SEQ ID NO: 2256657 - RNA, 17 nt, Human
caacuuggcuuucccgg

SEQ ID NO: 2256658 - RNA, 16 nt, Human
caacuuguaaaugugg

SEQ ID NO: 2256659 - RNA, 13 nt, Human
caacuuguaaaua

SEQ ID NO: 2256660 - RNA, 16 nt, Human
caacuuguaaauacac

SEQ ID NO: 2256661 - RNA, 22 nt, Human
caacuuguaaauacaccaccuc

SEQ ID NO: 2256662 - RNA, 22 nt, Human
caacuugucuuuuucuggacug

SEQ ID NO: 2256663 - RNA, 19 nt, Human
caacuugucuuuuucugga

SEQ ID NO: 2256664 - RNA, 13 nt, Human
caagaagaccaga

SEQ ID NO: 2256665 - RNA, 21 nt, Human
caagaagaccagacuguggag

SEQ ID NO: 2256666 - RNA, 18 nt, Human
caagaagaucacgcuccc

SEQ ID NO: 2256667 - RNA, 21 nt, Human
caagaagaucacgcuccccgc

SEQ ID NO: 2256668 - RNA, 13 nt, Human
caagaagcaggcu

SEQ ID NO: 2256669 - RNA, 14 nt, Human
caagaagcaggcua

SEQ ID NO: 2256670 - RNA, 19 nt, Human
caagaagaucacgcucccc

SEQ ID NO: 2256671 - RNA, 20 nt, Human
caagaagaucacgcuccccg

SEQ ID NO: 2256672 - RNA, 23 nt, Human
caagaagaucacgcuccccgccu

SEQ ID NO: 2256673 - RNA, 14 nt, Human
caagaagcccagga

SEQ ID NO: 2256674 - RNA, 20 nt, Human
caagaagcaggcuacacuga

SEQ ID NO: 2256675 - RNA, 13 nt, Human
caagaagcccagg

SEQ ID NO: 2256676 - RNA, 17 nt, Human
caacuugucuuuuucug

SEQ ID NO: 2256677 - RNA, 23 nt, Human
caacuuguauuaaagacagaggc

SEQ ID NO: 2256678 - RNA, 15 nt, Human
caagaaaugaaagca

SEQ ID NO: 2256679 - RNA, 19 nt, Human
caagaaaugaaagcaggga

SEQ ID NO: 2256680 - RNA, 17 nt, Human
caagaaaugaaagcagg

SEQ ID NO: 2256681 - RNA, 13 nt, Human
caacuaacaagaa

SEQ ID NO: 2256682 - RNA, 15 nt, Human
caagauauggacaca

SEQ ID NO: 2256683 - RNA, 20 nt, Human
caaaccucuguucaguguaa

SEQ ID NO: 2256684 - RNA, 15 nt, Human
caaacagaggccgcc

SEQ ID NO: 2256685 - RNA, 13 nt, Human
caaacagaggccg

SEQ ID NO: 2256686 - RNA, 15 nt, Human
caaacaccuggacuu

SEQ ID NO: 2256687 - RNA, 12 nt, Human
caaacaccuucc

SEQ ID NO: 2256688 - RNA, 15 nt, Human
caaacaccucccagg

SEQ ID NO: 2256689 - RNA, 14 nt, Human
caaacaccucccag

SEQ ID NO: 2256690 - RNA, 20 nt, Human
caaacacugcaggcaucaca

SEQ ID NO: 2256691 - RNA, 14 nt, Human
caaacaccuuccag

SEQ ID NO: 2256692 - RNA, 21 nt, Human
caaacaccuuccagcuccugu

SEQ ID NO: 2256693 - RNA, 16 nt, Human
caaacaaagccagaag

SEQ ID NO: 2256694 - RNA, 14 nt, Human
caaacaaagccaga

SEQ ID NO: 2256695 - RNA, 13 nt, Human
caaacaaagccag

SEQ ID NO: 2256696 - RNA, 15 nt, Human
caaacaaaauuucua

SEQ ID NO: 2256697 - RNA, 18 nt, Human
caaacaaaauuucuauua

SEQ ID NO: 2256698 - RNA, 14 nt, Human
caaacaaaauuucu

SEQ ID NO: 2256699 - RNA, 20 nt, Human
caaacaaaaagguucucagg

SEQ ID NO: 2256700 - RNA, 21 nt, Human
caaacaaaaagguucucaggu

SEQ ID NO: 2256701 - RNA, 14 nt, Human
caaacaaauaugca

SEQ ID NO: 2256702 - RNA, 15 nt, Human
caaacaaauaugcaa

SEQ ID NO: 2256703 - RNA, 20 nt, Human
caaacaaagccagaagcuga

SEQ ID NO: 2256704 - RNA, 17 nt, Human
caaacaaauaugcaaaa

SEQ ID NO: 2256705 - RNA, 24 nt, Human
caaacaauaguaauucucaggcca

SEQ ID NO: 2256706 - RNA, 14 nt, Human
caaaauuuuauucc

SEQ ID NO: 2256707 - RNA, 13 nt, Human
caaaauuuuauuc

SEQ ID NO: 2256708 - RNA, 21 nt, Human
caaaauuuuauagcucaguuu

SEQ ID NO: 2256709 - RNA, 13 nt, Human
caaaauuuguuug

SEQ ID NO: 2256710 - RNA, 18 nt, Human
caaaauuuuauuccuaua

SEQ ID NO: 2256711 - RNA, 23 nt, Human
caaaauuuuauagcucaguuuau

SEQ ID NO: 2256712 - RNA, 16 nt, Human
caaacaaaaagguucu

SEQ ID NO: 2256713 - RNA, 19 nt, Human
caaaauuuccaguaccuuu

SEQ ID NO: 2256714 - RNA, 18 nt, Human
caaaauuuccaguaccuu

SEQ ID NO: 2256715 - RNA, 17 nt, Human
caaaauuuccaguaccu

SEQ ID NO: 2256716 - RNA, 15 nt, Human
caaaauuuccaguac

SEQ ID NO: 2256717 - RNA, 14 nt, Human
caaaauuuccagua

SEQ ID NO: 2256718 - RNA, 19 nt, Human
caaaaugaggaauguauau

SEQ ID NO: 2256719 - RNA, 20 nt, Human
caaaaugaggaauguauaug

SEQ ID NO: 2256720 - RNA, 14 nt, Human
caaaauuugaaauu

SEQ ID NO: 2256721 - RNA, 11 nt, Human
caaaauuuguu

SEQ ID NO: 2256722 - RNA, 19 nt, Human
caaaauuugaugccaggac

SEQ ID NO: 2256723 - RNA, 12 nt, Human
caaaauuugaaa

SEQ ID NO: 2256724 - RNA, 20 nt, Human
caaaauuuccaguaccuuug

SEQ ID NO: 2256725 - RNA, 14 nt, Human
caaaauuucuauua

SEQ ID NO: 2256726 - RNA, 21 nt, Human
caaaaucuguccaaaggaggc

SEQ ID NO: 2256727 - RNA, 13 nt, Human
caaaaucugucca

SEQ ID NO: 2256728 - RNA, 21 nt, Human
caaaaugagcccuguccugcc

SEQ ID NO: 2256729 - RNA, 22 nt, Human
caaaaugagagggcaguguuuc

SEQ ID NO: 2256730 - RNA, 17 nt, Human
caaaaugaggaauguau

SEQ ID NO: 2256731 - RNA, 18 nt, Human
caaaaugaggaauguaua

SEQ ID NO: 2256732 - RNA, 11 nt, Human
caaaaugaaac

SEQ ID NO: 2256733 - RNA, 22 nt, Human
caaaaugaaacgcaaccaccac

SEQ ID NO: 2256734 - RNA, 14 nt, Human
caaacucucugaac

SEQ ID NO: 2256735 - RNA, 16 nt, Human
caaacucugccagcca

SEQ ID NO: 2256736 - RNA, 17 nt, Human
caaacucuugaccucag

SEQ ID NO: 2256737 - RNA, 19 nt, Human
caaacucuugaccucaggu

SEQ ID NO: 2256738 - RNA, 20 nt, Human
caaacucuugaccucaggug

SEQ ID NO: 2256739 - RNA, 16 nt, Human
caaaccuugaugugcc

SEQ ID NO: 2256740 - RNA, 21 nt, Human
caaaccuguuuaaauauuuca

SEQ ID NO: 2256741 - RNA, 22 nt, Human
caaaccuguuuaaauauuucaa

SEQ ID NO: 2256742 - RNA, 20 nt, Human
caaaccuuuauuuuagaauu

SEQ ID NO: 2256743 - RNA, 18 nt, Human
caaaccuuuauuuuagaa

SEQ ID NO: 2256744 - RNA, 12 nt, Human
caaaccugccug

SEQ ID NO: 2256745 - RNA, 23 nt, Human
caaaccucuguucaguguaaaua

SEQ ID NO: 2256746 - RNA, 19 nt, Human
caaaccugcaagggcuccc

SEQ ID NO: 2256747 - RNA, 20 nt, Human
caaaccugaccccugcucag

SEQ ID NO: 2256748 - RNA, 19 nt, Human
caaaccugaccccugcuca

SEQ ID NO: 2256749 - RNA, 16 nt, Human
caaaccugccuggguu

SEQ ID NO: 2256750 - RNA, 19 nt, Human
caaaccuguuuaaauauuu

SEQ ID NO: 2256751 - RNA, 21 nt, Human
caaaccugcaagggcucccca

SEQ ID NO: 2256752 - RNA, 13 nt, Human
caaaccugccugg

SEQ ID NO: 2256753 - RNA, 14 nt, Human
caaaccugccuggg

SEQ ID NO: 2256754 - RNA, 15 nt, Human
caaaccugccugggu

SEQ ID NO: 2256755 - RNA, 22 nt, Human
caaacugaaugaaacccccaca

SEQ ID NO: 2256756 - RNA, 17 nt, Human
caaacugacucuuaaga

SEQ ID NO: 2256757 - RNA, 21 nt, Human
caaacugacucuuaagaagac

SEQ ID NO: 2256758 - RNA, 15 nt, Human
caaacugaagccaga

SEQ ID NO: 2256759 - RNA, 21 nt, Human
caaacugaaugaaacccccac

SEQ ID NO: 2256760 - RNA, 14 nt, Human
caaacugaagccag

SEQ ID NO: 2256761 - RNA, 23 nt, Human
caaacugaagcagccucucccca

SEQ ID NO: 2256762 - RNA, 16 nt, Human
caaacugacucuuaag

SEQ ID NO: 2256763 - RNA, 21 nt, Human
caaacucuugaccucagguga

SEQ ID NO: 2256764 - RNA, 17 nt, Human
caaacugaagcagccuc

SEQ ID NO: 2256765 - RNA, 12 nt, Human
caaacucugcug

SEQ ID NO: 2256766 - RNA, 13 nt, Human
caaacucugcugu

SEQ ID NO: 2256767 - RNA, 18 nt, Human
caaacucugcugucuaac

SEQ ID NO: 2256768 - RNA, 21 nt, Human
caaaacgguuuuacugcagcu

SEQ ID NO: 2256769 - RNA, 15 nt, Human
caaaacgguuuuacu

SEQ ID NO: 2256770 - RNA, 23 nt, Human
caaaacgcauggaguguguauug

SEQ ID NO: 2256771 - RNA, 19 nt, Human
caaaacgcauggagugugu

SEQ ID NO: 2256772 - RNA, 18 nt, Human
auuuuauuuuauuaugca

SEQ ID NO: 2256773 - RNA, 13 nt, Human
caaaacggggcag

SEQ ID NO: 2256774 - RNA, 13 nt, Human
caaaacgucuuau

SEQ ID NO: 2256775 - RNA, 14 nt, Human
caaaacgucuuauu

SEQ ID NO: 2256776 - RNA, 15 nt, Human
caaaacgucuuauug

SEQ ID NO: 2256777 - RNA, 21 nt, Human
caaaacucauuuccuauguaa

SEQ ID NO: 2256778 - RNA, 16 nt, Human
caaaacuccugucuuu

SEQ ID NO: 2256779 - RNA, 20 nt, Human
caaaacucaaaugcuuggcu

SEQ ID NO: 2256780 - RNA, 21 nt, Human
caaaacuccugccccuguucu

SEQ ID NO: 2256781 - RNA, 15 nt, Human
caaaacucuccucug

SEQ ID NO: 2256782 - RNA, 16 nt, Human
caaaacucuccucugc

SEQ ID NO: 2256783 - RNA, 14 nt, Human
caaaaguuucucuu

SEQ ID NO: 2256784 - RNA, 18 nt, Human
caaaaguuucauccuuuu

SEQ ID NO: 2256785 - RNA, 15 nt, Human
caaaaguucugacuu

SEQ ID NO: 2256786 - RNA, 17 nt, Human
caaaaguucugacuuga

SEQ ID NO: 2256787 - RNA, 18 nt, Human
caaaaguucugacuugac

SEQ ID NO: 2256788 - RNA, 23 nt, Human
caaaacucuccucugcugcuggc

SEQ ID NO: 2256789 - RNA, 17 nt, Human
caaaaguuagcugagcg

SEQ ID NO: 2256790 - RNA, 19 nt, Human
caaaacucuccucugcugc

SEQ ID NO: 2256791 - RNA, 11 nt, Human
caaaacucuac

SEQ ID NO: 2256792 - RNA, 19 nt, Human
caaaacucuacuuaaucca

SEQ ID NO: 2256793 - RNA, 14 nt, Human
caaaacugcacugu

SEQ ID NO: 2256794 - RNA, 18 nt, Human
caaaacugcacugucaag

SEQ ID NO: 2256795 - RNA, 17 nt, Human
caaaacugcacugucaa

SEQ ID NO: 2256796 - RNA, 15 nt, Human
caaaauaaaaaccaa

SEQ ID NO: 2256797 - RNA, 11 nt, Human
caaaauaaaaa

SEQ ID NO: 2256798 - RNA, 15 nt, Human
caaaaguuuuccuga

SEQ ID NO: 2256799 - RNA, 17 nt, Human
caaaaguuuuccugaga

SEQ ID NO: 2256800 - RNA, 16 nt, Human
caaaauaaaacuuuuu

SEQ ID NO: 2256801 - RNA, 14 nt, Human
caaaauaaauguug

SEQ ID NO: 2256802 - RNA, 15 nt, Human
caaaauaagaaaaga

SEQ ID NO: 2256803 - RNA, 14 nt, Human
caaaauaagaaaag

SEQ ID NO: 2256804 - RNA, 20 nt, Human
caaaauaaaacuuuuuaaaa

SEQ ID NO: 2256805 - RNA, 18 nt, Human
caaaauaagaaaagaugu

SEQ ID NO: 2256806 - RNA, 16 nt, Human
caaaauaagaaaagau

SEQ ID NO: 2256807 - RNA, 18 nt, Human
caaaauaauuuuaagaaa

SEQ ID NO: 2256808 - RNA, 22 nt, Human
caaaauaauuuuaagaaaucaa

SEQ ID NO: 2256809 - RNA, 22 nt, Human
caaaauaagaaaagauguagau

SEQ ID NO: 2256810 - RNA, 19 nt, Human
caaaauauguugaugaaaa

SEQ ID NO: 2256811 - RNA, 15 nt, Human
caaaauagcauuugu

SEQ ID NO: 2256812 - RNA, 16 nt, Human
caaaauagcauuuguu

SEQ ID NO: 2256813 - RNA, 13 nt, Human
caaaauagaagcu

SEQ ID NO: 2256814 - RNA, 13 nt, Human
caaaauagagaau

SEQ ID NO: 2256815 - RNA, 14 nt, Human
caaaauauguucuu

SEQ ID NO: 2256816 - RNA, 23 nt, Human
caaaauauuaugcaaacuacugu

SEQ ID NO: 2256817 - RNA, 16 nt, Human
caaaauauuuguacau

SEQ ID NO: 2256818 - RNA, 17 nt, Human
caaaauauuuuuauaga

SEQ ID NO: 2256819 - RNA, 17 nt, Human
caaaauauuuguacaua

SEQ ID NO: 2256820 - RNA, 12 nt, Human
caaaauauuuuc

SEQ ID NO: 2256821 - RNA, 16 nt, Human
caaaaucauuuuaaug

SEQ ID NO: 2256822 - RNA, 19 nt, Human
caaaaucauuuuauauguc

SEQ ID NO: 2256823 - RNA, 23 nt, Human
caaaaucauggaaugguuauaaa

SEQ ID NO: 2256824 - RNA, 16 nt, Human
caaaauccuugcuuau

SEQ ID NO: 2256825 - RNA, 16 nt, Human
caaaauccccuucuca

SEQ ID NO: 2256826 - RNA, 23 nt, Human
caaaaucauuuuauaugucaaag

SEQ ID NO: 2256827 - RNA, 22 nt, Human
caaaaucauuuuauaugucaaa

SEQ ID NO: 2256828 - RNA, 21 nt, Human
caaaaucgaugcagugcuucc

SEQ ID NO: 2256829 - RNA, 20 nt, Human
caaaauccuugcuuaugaca

SEQ ID NO: 2256830 - RNA, 12 nt, Human
caaaauccccuu

SEQ ID NO: 2256831 - RNA, 18 nt, Human
caaaaucgauuggcuuua

SEQ ID NO: 2256832 - RNA, 17 nt, Human
caaacugaggaauuuca

SEQ ID NO: 2256833 - RNA, 13 nt, Human
caacaggcugggc

SEQ ID NO: 2256834 - RNA, 20 nt, Human
uguuuaacuuaaucaauuaa

SEQ ID NO: 2256835 - RNA, 21 nt, Human
uguuuaaguguuguaaauauu

SEQ ID NO: 2256836 - RNA, 14 nt, Human
uguuuaagaugggc

SEQ ID NO: 2256837 - RNA, 20 nt, Human
uguuuaauauugagaaagaa

SEQ ID NO: 2256838 - RNA, 23 nt, Human
uguuuaauacucauccuuguaua

SEQ ID NO: 2256839 - RNA, 16 nt, Human
uguuuaauauugagaa

SEQ ID NO: 2256840 - RNA, 12 nt, Human
uguuuacagugu

SEQ ID NO: 2256841 - RNA, 21 nt, Human
uguuuacaucaguuuuaacga

SEQ ID NO: 2256842 - RNA, 12 nt, Human
uguuuacauauc

SEQ ID NO: 2256843 - RNA, 14 nt, Human
uguuuacaucaguu

SEQ ID NO: 2256844 - RNA, 12 nt, Human
uguuuaaauaaa

SEQ ID NO: 2256845 - RNA, 12 nt, Human
uguuuaaagaga

SEQ ID NO: 2256846 - RNA, 17 nt, Human
uguuuaaagagagguua

SEQ ID NO: 2256847 - RNA, 21 nt, Human
uguuuaaagagagguuauaga

SEQ ID NO: 2256848 - RNA, 12 nt, Human
uguuuaagagac

SEQ ID NO: 2256849 - RNA, 14 nt, Human
uguuuaaauaaagu

SEQ ID NO: 2256850 - RNA, 15 nt, Human
uguuuaaauaaagua

SEQ ID NO: 2256851 - RNA, 17 nt, Human
uguuuaaauaaaguauc

SEQ ID NO: 2256852 - RNA, 20 nt, Human
uguuuaaauaaaguaucaug

SEQ ID NO: 2256853 - RNA, 22 nt, Human
uguuuaaauaaaguaucaugca

SEQ ID NO: 2256854 - RNA, 11 nt, Human
uguuuaaauau

SEQ ID NO: 2256855 - RNA, 19 nt, Human
uguuuaacuuaaucaauua

SEQ ID NO: 2256856 - RNA, 15 nt, Human
uguuggcuaaugaag

SEQ ID NO: 2256857 - RNA, 23 nt, Human
uguuggcguggggccuuugucag

SEQ ID NO: 2256858 - RNA, 17 nt, Human
uguuggcugggggccuc

SEQ ID NO: 2256859 - RNA, 15 nt, Human
uguuggccucugcaa

SEQ ID NO: 2256860 - RNA, 16 nt, Human
uguuggccuccggccu

SEQ ID NO: 2256861 - RNA, 17 nt, Human
uguuggccuccggccuc

SEQ ID NO: 2256862 - RNA, 20 nt, Human
uguuggcgagaggaggggcc

SEQ ID NO: 2256863 - RNA, 20 nt, Human
uguuggccuccggccucccc

SEQ ID NO: 2256864 - RNA, 15 nt, Human
uguuggcgagaggag

SEQ ID NO: 2256865 - RNA, 18 nt, Human
uguuggcaggcuggccag

SEQ ID NO: 2256866 - RNA, 21 nt, Human
uguuggcaggcuggccagucc

SEQ ID NO: 2256867 - RNA, 21 nt, Human
uguuggcagugagugagccug

SEQ ID NO: 2256868 - RNA, 22 nt, Human
uguuggcugggaacucaccugg

SEQ ID NO: 2256869 - RNA, 19 nt, Human
uguugggaaacuuggcucg

SEQ ID NO: 2256870 - RNA, 14 nt, Human
uguugggacugcua

SEQ ID NO: 2256871 - RNA, 19 nt, Human
uguugggacugcuaaauaa

SEQ ID NO: 2256872 - RNA, 19 nt, Human
uguuggcugggggccucag

SEQ ID NO: 2256873 - RNA, 18 nt, Human
uguuuaaaaucauuucug

SEQ ID NO: 2256874 - RNA, 17 nt, Human
uguuuaaaaucauuucu

SEQ ID NO: 2256875 - RNA, 20 nt, Human
uguuggauuuuugucuugug

SEQ ID NO: 2256876 - RNA, 18 nt, Human
uguuggcacauccuaugc

SEQ ID NO: 2256877 - RNA, 18 nt, Human
uguuggacccgcucugga

SEQ ID NO: 2256878 - RNA, 19 nt, Human
uguuggacccgcucuggac

SEQ ID NO: 2256879 - RNA, 13 nt, Human
uguuggacccgcu

SEQ ID NO: 2256880 - RNA, 18 nt, Human
uguuggcacaugccugua

SEQ ID NO: 2256881 - RNA, 19 nt, Human
uguuggcacauccuaugca

SEQ ID NO: 2256882 - RNA, 15 nt, Human
uguuggcacucacag

SEQ ID NO: 2256883 - RNA, 23 nt, Human
uguuggcacucacagaccuggag

SEQ ID NO: 2256884 - RNA, 21 nt, Human
uguuggcacucacagaccugg

SEQ ID NO: 2256885 - RNA, 22 nt, Human
uguuggcacucacagaccugga

SEQ ID NO: 2256886 - RNA, 19 nt, Human
uguuggagaagaacugaaa

SEQ ID NO: 2256887 - RNA, 20 nt, Human
uguuggagaagaacugaaau

SEQ ID NO: 2256888 - RNA, 15 nt, Human
uguuggccaaagcca

SEQ ID NO: 2256889 - RNA, 14 nt, Human
uguuggcagcauaa

SEQ ID NO: 2256890 - RNA, 12 nt, Human
uguuggcaggcu

SEQ ID NO: 2256891 - RNA, 14 nt, Human
uguuggcagccucu

SEQ ID NO: 2256892 - RNA, 15 nt, Human
uguuggccaggcugg

SEQ ID NO: 2256893 - RNA, 16 nt, Human
uguuggccaggcuggu

SEQ ID NO: 2256894 - RNA, 16 nt, Human
uguugauuauuagcca

SEQ ID NO: 2256895 - RNA, 11 nt, Human
uguugauuauu

SEQ ID NO: 2256896 - RNA, 20 nt, Human
uguugauugcaggaauaagg

SEQ ID NO: 2256897 - RNA, 12 nt, Human
uguugauugcua

SEQ ID NO: 2256898 - RNA, 13 nt, Human
uguugauugcuaa

SEQ ID NO: 2256899 - RNA, 16 nt, Human
uguugaucccaagaca

SEQ ID NO: 2256900 - RNA, 12 nt, Human
uguugaucccaa

SEQ ID NO: 2256901 - RNA, 16 nt, Human
uguugaugcuuucguc

SEQ ID NO: 2256902 - RNA, 14 nt, Human
uguuggagaagaac

SEQ ID NO: 2256903 - RNA, 12 nt, Human
uguuggaaugaa

SEQ ID NO: 2256904 - RNA, 14 nt, Human
uguugauugcuaaa

SEQ ID NO: 2256905 - RNA, 15 nt, Human
uguugauugcuaaau

SEQ ID NO: 2256906 - RNA, 21 nt, Human
uguuggaaaagaauacagaaa

SEQ ID NO: 2256907 - RNA, 16 nt, Human
uguuggagaagaacug

SEQ ID NO: 2256908 - RNA, 17 nt, Human
uguuggagaagaacuga

SEQ ID NO: 2256909 - RNA, 12 nt, Human
uguucuggcucu

SEQ ID NO: 2256910 - RNA, 13 nt, Human
uguucuggcucuu

SEQ ID NO: 2256911 - RNA, 16 nt, Human
uguucuggcucuucca

SEQ ID NO: 2256912 - RNA, 13 nt, Human
uguucucugcccu

SEQ ID NO: 2256913 - RNA, 14 nt, Human
uguucucugcccuc

SEQ ID NO: 2256914 - RNA, 15 nt, Human
uguucucugcccucc

SEQ ID NO: 2256915 - RNA, 16 nt, Human
uguucucugcccucca

SEQ ID NO: 2256916 - RNA, 19 nt, Human
uguucaucauccuaagcua

SEQ ID NO: 2256917 - RNA, 23 nt, Human
uguucauagcccaguagaccuug

SEQ ID NO: 2256918 - RNA, 19 nt, Human
uguucauagcccaguagac

SEQ ID NO: 2256919 - RNA, 20 nt, Human
uguucauagcccaguagacc

SEQ ID NO: 2256920 - RNA, 11 nt, Human
uguucauccca

SEQ ID NO: 2256921 - RNA, 19 nt, Human
uguucaucccaugauguag

SEQ ID NO: 2256922 - RNA, 14 nt, Human
uguucaucuguaac

SEQ ID NO: 2256923 - RNA, 15 nt, Human
uguucaucuguaacu

SEQ ID NO: 2256924 - RNA, 21 nt, Human
uguucaucuguaacucuaaaa

SEQ ID NO: 2256925 - RNA, 21 nt, Human
uguucuccuuuuccucucucc

SEQ ID NO: 2256926 - RNA, 15 nt, Human
uguucucuaucauuu

SEQ ID NO: 2256927 - RNA, 18 nt, Human
uguucucuaucauuuaau

SEQ ID NO: 2256928 - RNA, 20 nt, Human
uguucucuaucauuuaauaa

SEQ ID NO: 2256929 - RNA, 15 nt, Human
uguucucucccaggg

SEQ ID NO: 2256930 - RNA, 16 nt, Human
uguucucucuucucca

SEQ ID NO: 2256931 - RNA, 15 nt, Human
uguucucucuucucc

SEQ ID NO: 2256932 - RNA, 14 nt, Human
uguucuuuuuauug

SEQ ID NO: 2256933 - RNA, 17 nt, Human
uguucuuuuuauugaau

SEQ ID NO: 2256934 - RNA, 23 nt, Human
uguugaaaaaaaaguuucagaga

SEQ ID NO: 2256935 - RNA, 16 nt, Human
uguucuuuugucccag

SEQ ID NO: 2256936 - RNA, 15 nt, Human
uguucuggcccucac

SEQ ID NO: 2256937 - RNA, 13 nt, Human
uguucuggcccuc

SEQ ID NO: 2256938 - RNA, 13 nt, Human
uguucuuugggga

SEQ ID NO: 2256939 - RNA, 23 nt, Human
uguucuuucuggcuaugcauuug

SEQ ID NO: 2256940 - RNA, 15 nt, Human
uguucugcuuuccuc

SEQ ID NO: 2256941 - RNA, 21 nt, Human
uguucuggcucuuccaggcug

SEQ ID NO: 2256942 - RNA, 17 nt, Human
uguucuggcucuuccag

SEQ ID NO: 2256943 - RNA, 20 nt, Human
uguucuggcucuuccaggcu

SEQ ID NO: 2256944 - RNA, 14 nt, Human
uguugacaugugcu

SEQ ID NO: 2256945 - RNA, 17 nt, Human
uguugacauccaagcuu

SEQ ID NO: 2256946 - RNA, 19 nt, Human
uguugacauccaagcuucc

SEQ ID NO: 2256947 - RNA, 16 nt, Human
uguugacgaagucucu

SEQ ID NO: 2256948 - RNA, 18 nt, Human
uguugacgaagucucuuu

SEQ ID NO: 2256949 - RNA, 22 nt, Human
uguugagaaucccaaauuugau

SEQ ID NO: 2256950 - RNA, 13 nt, Human
uguugacuuauuu

SEQ ID NO: 2256951 - RNA, 20 nt, Human
uguugacuuauuuucucugu

SEQ ID NO: 2256952 - RNA, 21 nt, Human
uguugacuuauuuucucugug

SEQ ID NO: 2256953 - RNA, 22 nt, Human
uguugacuuauuuucucugugu

SEQ ID NO: 2256954 - RNA, 22 nt, Human
uguugaaugcccacaggcaaau

SEQ ID NO: 2256955 - RNA, 18 nt, Human
uguugaauacuuuuuaca

SEQ ID NO: 2256956 - RNA, 13 nt, Human
uguugaauacuuu

SEQ ID NO: 2256957 - RNA, 15 nt, Human
uguugaagccuuugu

SEQ ID NO: 2256958 - RNA, 16 nt, Human
uguugacacaggucuu

SEQ ID NO: 2256959 - RNA, 17 nt, Human
uguugacaguucauaug

SEQ ID NO: 2256960 - RNA, 16 nt, Human
uguugacaguucugaa

SEQ ID NO: 2256961 - RNA, 20 nt, Human
uguugacaugggacauuugc

SEQ ID NO: 2256962 - RNA, 17 nt, Human
uguucagauugcuuuga

SEQ ID NO: 2256963 - RNA, 22 nt, Human
uguucagaagguugcucuagau

SEQ ID NO: 2256964 - RNA, 13 nt, Human
uguucagcacugu

SEQ ID NO: 2256965 - RNA, 14 nt, Human
uguucagcacuguc

SEQ ID NO: 2256966 - RNA, 18 nt, Human
uguucagaagguugcucu

SEQ ID NO: 2256967 - RNA, 13 nt, Human
uguucacuguccc

SEQ ID NO: 2256968 - RNA, 17 nt, Human
uguucacuuuugacaaa

SEQ ID NO: 2256969 - RNA, 15 nt, Human
uguuagucauuugcu

SEQ ID NO: 2256970 - RNA, 19 nt, Human
uguucacuuuuccucccuc

SEQ ID NO: 2256971 - RNA, 16 nt, Human
uguucacuuuuccucc

SEQ ID NO: 2256972 - RNA, 14 nt, Human
uguuagugcaaauu

SEQ ID NO: 2256973 - RNA, 13 nt, Human
uguuaguaacaug

SEQ ID NO: 2256974 - RNA, 16 nt, Human
uguuaggccuggcaca

SEQ ID NO: 2256975 - RNA, 20 nt, Human
uguuaggccuggcacagugu

SEQ ID NO: 2256976 - RNA, 21 nt, Human
uguuaggccuggcacaguguc

SEQ ID NO: 2256977 - RNA, 17 nt, Human
uguuaguaugaggcauu

SEQ ID NO: 2256978 - RNA, 20 nt, Human
uguuaguaugaggcauuugu

SEQ ID NO: 2256979 - RNA, 19 nt, Human
uguuaguaugaggcauuug

SEQ ID NO: 2256980 - RNA, 20 nt, Human
uguucagcuccagcucacca

SEQ ID NO: 2256981 - RNA, 18 nt, Human
uguucagauugcuuugau

SEQ ID NO: 2256982 - RNA, 18 nt, Human
uguucagcacugucccuu

SEQ ID NO: 2256983 - RNA, 15 nt, Human
uguucagcacugucc

SEQ ID NO: 2256984 - RNA, 17 nt, Human
uguucagcacugucccu

SEQ ID NO: 2256985 - RNA, 21 nt, Human
uguucagcuccagcucaccag

SEQ ID NO: 2256986 - RNA, 22 nt, Human
uguucagcuccagcucaccagc

SEQ ID NO: 2256987 - RNA, 12 nt, Human
uguucauacauu

SEQ ID NO: 2256988 - RNA, 18 nt, Human
uguucauagacccucuca

SEQ ID NO: 2256989 - RNA, 14 nt, Human
uguucauagcccag

SEQ ID NO: 2256990 - RNA, 15 nt, Human
uguucauagcccagu

SEQ ID NO: 2256991 - RNA, 17 nt, Human
uguucauaaauaaaguu

SEQ ID NO: 2256992 - RNA, 17 nt, Human
uguuagccccauaauuu

SEQ ID NO: 2256993 - RNA, 14 nt, Human
uguuagcuguuauu

SEQ ID NO: 2256994 - RNA, 16 nt, Human
uguuaggaaaauuuca

SEQ ID NO: 2256995 - RNA, 20 nt, Human
uguuacugaucaugcauugu

SEQ ID NO: 2256996 - RNA, 13 nt, Human
uguuacugaucau

SEQ ID NO: 2256997 - RNA, 15 nt, Human
uguuacugaccagca

SEQ ID NO: 2256998 - RNA, 14 nt, Human
uguuacugaucaug

SEQ ID NO: 2256999 - RNA, 12 nt, Human
uguuacuguaau

SEQ ID NO: 2257000 - RNA, 14 nt, Human
uguuagcagacagg

SEQ ID NO: 2257001 - RNA, 14 nt, Human
uguuacuguaauuc

SEQ ID NO: 2257002 - RNA, 20 nt, Human
uguuacucugguucuuuguu

SEQ ID NO: 2257003 - RNA, 13 nt, Human
uguuacucugguu

SEQ ID NO: 2257004 - RNA, 15 nt, Human
uguuacucugguucu

SEQ ID NO: 2257005 - RNA, 17 nt, Human
uguuacucugguucuuu

SEQ ID NO: 2257006 - RNA, 15 nt, Human
uguuacuaucugcuu

SEQ ID NO: 2257007 - RNA, 17 nt, Human
uguuacuaacuaaacuc

SEQ ID NO: 2257008 - RNA, 18 nt, Human
uguuacuaacuaaacucu

SEQ ID NO: 2257009 - RNA, 16 nt, Human
uguuacuaucugcuuu

SEQ ID NO: 2257010 - RNA, 14 nt, Human
uguuacuaaguuuu

SEQ ID NO: 2257011 - RNA, 23 nt, Human
uguuaccugaaaacacugugcac

SEQ ID NO: 2257012 - RNA, 21 nt, Human
uguuaccugaucaaugacaga

SEQ ID NO: 2257013 - RNA, 17 nt, Human
uguuacuaaagaaaaua

SEQ ID NO: 2257014 - RNA, 13 nt, Human
uguuacuaacuaa

SEQ ID NO: 2257015 - RNA, 14 nt, Human
uguuacuaacuaaa

SEQ ID NO: 2257016 - RNA, 20 nt, Human
uguuaccuaauuagagcaga

SEQ ID NO: 2257017 - RNA, 18 nt, Human
uguuacccuccuguaaau

SEQ ID NO: 2257018 - RNA, 15 nt, Human
uguuaccugaaaaca

SEQ ID NO: 2257019 - RNA, 16 nt, Human
uguuaccuacuuugac

SEQ ID NO: 2257020 - RNA, 22 nt, Human
uguuaccugaaaacacugugca

SEQ ID NO: 2257021 - RNA, 16 nt, Human
uguuaccugaaaacac

SEQ ID NO: 2257022 - RNA, 14 nt, Human
uguuaaaauaacua

SEQ ID NO: 2257023 - RNA, 15 nt, Human
uguuaaaauguauuc

SEQ ID NO: 2257024 - RNA, 23 nt, Human
uguuaaaauguauucuuaaauuc

SEQ ID NO: 2257025 - RNA, 21 nt, Human
uguuacccaguaacucaucug

SEQ ID NO: 2257026 - RNA, 13 nt, Human
uguguuuuugaaa

SEQ ID NO: 2257027 - RNA, 21 nt, Human
uguguuuuugcuaucacacag

SEQ ID NO: 2257028 - RNA, 12 nt, Human
uguuaaaauaac

SEQ ID NO: 2257029 - RNA, 21 nt, Human
uguuaaaagaugaaaauauuu

SEQ ID NO: 2257030 - RNA, 16 nt, Human
uguguggacugugaug

SEQ ID NO: 2257031 - RNA, 19 nt, Human
uguguggacugugaugcca

SEQ ID NO: 2257032 - RNA, 17 nt, Human
uguguggacucaagucc

SEQ ID NO: 2257033 - RNA, 18 nt, Human
ugugugcucuucuucuuu

SEQ ID NO: 2257034 - RNA, 11 nt, Human
uguguggccug

SEQ ID NO: 2257035 - RNA, 15 nt, Human
ugugugggagugugu

SEQ ID NO: 2257036 - RNA, 14 nt, Human
ugugugggagugug

SEQ ID NO: 2257037 - RNA, 19 nt, Human
ugugugcacguacacacac

SEQ ID NO: 2257038 - RNA, 21 nt, Human
ugugugauugacagcuuugcu

SEQ ID NO: 2257039 - RNA, 19 nt, Human
ugugugauugacagcuuug

SEQ ID NO: 2257040 - RNA, 18 nt, Human
ugugugauugacagcuuu

SEQ ID NO: 2257041 - RNA, 15 nt, Human
ugugugauugacagc

SEQ ID NO: 2257042 - RNA, 16 nt, Human
ugugugauugaaucug

SEQ ID NO: 2257043 - RNA, 14 nt, Human
ugugugaugugcau

SEQ ID NO: 2257044 - RNA, 23 nt, Human
ugugugcaccuuaccaacuuucu

SEQ ID NO: 2257045 - RNA, 22 nt, Human
ugugugcaacaggguauggacu

SEQ ID NO: 2257046 - RNA, 17 nt, Human
ugugugcaccuuaccaa

SEQ ID NO: 2257047 - RNA, 22 nt, Human
ugugugcaccuuaccaacuuuc

SEQ ID NO: 2257048 - RNA, 15 nt, Human
ugugugcuuauguau

SEQ ID NO: 2257049 - RNA, 13 nt, Human
ugugugcucucca

SEQ ID NO: 2257050 - RNA, 23 nt, Human
ugugugaagaucacguuccuucc

SEQ ID NO: 2257051 - RNA, 19 nt, Human
uguguaugugcgugugugc

SEQ ID NO: 2257052 - RNA, 20 nt, Human
ugugugaaauaccagugugg

SEQ ID NO: 2257053 - RNA, 14 nt, Human
uguguaugugcgug

SEQ ID NO: 2257054 - RNA, 16 nt, Human
ugugugaugaacuuuc

SEQ ID NO: 2257055 - RNA, 17 nt, Human
ugugugaugaacuuucu

SEQ ID NO: 2257056 - RNA, 21 nt, Human
ugugugaaagguacuucaaau

SEQ ID NO: 2257057 - RNA, 22 nt, Human
ugugugaaagguacuucaaauc

SEQ ID NO: 2257058 - RNA, 14 nt, Human
uguguaugggcaaa

SEQ ID NO: 2257059 - RNA, 18 nt, Human
uguguaugcgugugugug

SEQ ID NO: 2257060 - RNA, 22 nt, Human
uguguauccauuaucaugugua

SEQ ID NO: 2257061 - RNA, 23 nt, Human
uguguauccauuaucauguguaa

SEQ ID NO: 2257062 - RNA, 24 nt, Human
uguguauccauuaucauguguaau

SEQ ID NO: 2257063 - RNA, 21 nt, Human
uguguaucguaaccagccaga

SEQ ID NO: 2257064 - RNA, 12 nt, Human
uguguauguggg

SEQ ID NO: 2257065 - RNA, 11 nt, Human
uguguaugugg

SEQ ID NO: 2257066 - RNA, 14 nt, Human
uguguuuuuauugu

SEQ ID NO: 2257067 - RNA, 19 nt, Human
uguguuuuuauuguuaacu

SEQ ID NO: 2257068 - RNA, 20 nt, Human
uguguuuuuaauaaagacag

SEQ ID NO: 2257069 - RNA, 18 nt, Human
uguguuuuucauaaagca

SEQ ID NO: 2257070 - RNA, 15 nt, Human
uguguuuuuaauaaa

SEQ ID NO: 2257071 - RNA, 15 nt, Human
uguguuuuucauaaa

SEQ ID NO: 2257072 - RNA, 11 nt, Human
uguguuuccuu

SEQ ID NO: 2257073 - RNA, 12 nt, Human
uguguuuccaca

SEQ ID NO: 2257074 - RNA, 13 nt, Human
uguguuucacuuu

SEQ ID NO: 2257075 - RNA, 20 nt, Human
uguguuucuaugugacaauu

SEQ ID NO: 2257076 - RNA, 15 nt, Human
uguguuucuguauaa

SEQ ID NO: 2257077 - RNA, 13 nt, Human
uguguuuugcaag

SEQ ID NO: 2257078 - RNA, 19 nt, Human
uguguuuugcaagccagau

SEQ ID NO: 2257079 - RNA, 20 nt, Human
ugugugugcuuauguaugag

SEQ ID NO: 2257080 - RNA, 19 nt, Human
ugugugugcuuauguauga

SEQ ID NO: 2257081 - RNA, 15 nt, Human
uguguuucaaguuca

SEQ ID NO: 2257082 - RNA, 16 nt, Human
uguguuuauugucaaa

SEQ ID NO: 2257083 - RNA, 22 nt, Human
ugugugucuaggcaggaccugu

SEQ ID NO: 2257084 - RNA, 22 nt, Human
uguguggguggauauaaauaua

SEQ ID NO: 2257085 - RNA, 16 nt, Human
ugugugucuuaauuau

SEQ ID NO: 2257086 - RNA, 17 nt, Human
ugugugugaaaaugugu

SEQ ID NO: 2257087 - RNA, 20 nt, Human
ugugugugaaugaacacucu

SEQ ID NO: 2257088 - RNA, 16 nt, Human
ugugugugaaugaaca

SEQ ID NO: 2257089 - RNA, 13 nt, Human
ugugugggucuau

SEQ ID NO: 2257090 - RNA, 16 nt, Human
ugugugggagugugua

SEQ ID NO: 2257091 - RNA, 20 nt, Human
uguguggguggauauaaaua

SEQ ID NO: 2257092 - RNA, 21 nt, Human
uguguggguggauauaaauau

SEQ ID NO: 2257093 - RNA, 23 nt, Human
uguguggguggauauaaauauau

SEQ ID NO: 2257094 - RNA, 16 nt, Human
uguuuccugcaggcca

SEQ ID NO: 2257095 - RNA, 19 nt, Human
uguuucugacucugagcua

SEQ ID NO: 2257096 - RNA, 12 nt, Human
uguuucugacuc

SEQ ID NO: 2257097 - RNA, 12 nt, Human
uguuucugcagu

SEQ ID NO: 2257098 - RNA, 22 nt, Human
uguuucugcaguagucucugug

SEQ ID NO: 2257099 - RNA, 21 nt, Human
uguuucugcaguagucucugu

SEQ ID NO: 2257100 - RNA, 15 nt, Human
uguuuccuggcacug

SEQ ID NO: 2257101 - RNA, 11 nt, Human
uguuuccugag

SEQ ID NO: 2257102 - RNA, 23 nt, Human
uguuuccuagcacacacuuuugg

SEQ ID NO: 2257103 - RNA, 20 nt, Human
uguuucccuuucacuggcau

SEQ ID NO: 2257104 - RNA, 14 nt, Human
uguuuccucuaguu

SEQ ID NO: 2257105 - RNA, 23 nt, Human
uguuuacuuaaagauuuaucaaa

SEQ ID NO: 2257106 - RNA, 22 nt, Human
uguuucccauaauuuucuucau

SEQ ID NO: 2257107 - RNA, 14 nt, Human
uguuucccauaauu

SEQ ID NO: 2257108 - RNA, 19 nt, Human
uguuuccauauuuuauagg

SEQ ID NO: 2257109 - RNA, 12 nt, Human
uguuuacugaaa

SEQ ID NO: 2257110 - RNA, 15 nt, Human
uguuuacuuaaagau

SEQ ID NO: 2257111 - RNA, 16 nt, Human
uguuuacuuaaagauu

SEQ ID NO: 2257112 - RNA, 17 nt, Human
uguuuacuuaaagauuu

SEQ ID NO: 2257113 - RNA, 18 nt, Human
uguuuacuuaaagauuua

SEQ ID NO: 2257114 - RNA, 19 nt, Human
uguuuacuuaaagauuuau

SEQ ID NO: 2257115 - RNA, 19 nt, Human
uguuuacuagggaucccuc

SEQ ID NO: 2257116 - RNA, 13 nt, Human
uguuuacuaggga

SEQ ID NO: 2257117 - RNA, 11 nt, Human
uguuugugugu

SEQ ID NO: 2257118 - RNA, 13 nt, Human
uguuugugugugu

SEQ ID NO: 2257119 - RNA, 14 nt, Human
uguuugugugagag

SEQ ID NO: 2257120 - RNA, 19 nt, Human
uguuugugcuucuaauauu

SEQ ID NO: 2257121 - RNA, 14 nt, Human
uguuuguguauuua

SEQ ID NO: 2257122 - RNA, 12 nt, Human
uguuuguuaugg

SEQ ID NO: 2257123 - RNA, 15 nt, Human
uguuuguucaucugu

SEQ ID NO: 2257124 - RNA, 22 nt, Human
uguuuuaaauuuauuucaaaaa

SEQ ID NO: 2257125 - RNA, 11 nt, Human
uguuuuaacaa

SEQ ID NO: 2257126 - RNA, 16 nt, Human
uguuuuaagaggcagg

SEQ ID NO: 2257127 - RNA, 12 nt, Human
uguuuguggccu

SEQ ID NO: 2257128 - RNA, 14 nt, Human
uguuugugcuucua

SEQ ID NO: 2257129 - RNA, 15 nt, Human
uguuugugcuucuaa

SEQ ID NO: 2257130 - RNA, 15 nt, Human
uguuugugcuguggu

SEQ ID NO: 2257131 - RNA, 12 nt, Human
uguuugugcuuc

SEQ ID NO: 2257132 - RNA, 13 nt, Human
uguuugugcuucu

SEQ ID NO: 2257133 - RNA, 14 nt, Human
uguuuguggccuca

SEQ ID NO: 2257134 - RNA, 13 nt, Human
uguuuguggccuc

SEQ ID NO: 2257135 - RNA, 15 nt, Human
uguuuguggccucag

SEQ ID NO: 2257136 - RNA, 12 nt, Human
uguuuguguauu

SEQ ID NO: 2257137 - RNA, 14 nt, Human
uguuucugucagga

SEQ ID NO: 2257138 - RNA, 12 nt, Human
uguuuuuaacuc

SEQ ID NO: 2257139 - RNA, 14 nt, Human
uguuuuuaagcugu

SEQ ID NO: 2257140 - RNA, 19 nt, Human
uguuuuuaaaaguuucaau

SEQ ID NO: 2257141 - RNA, 20 nt, Human
uguuuuuaaaaaucauaaac

SEQ ID NO: 2257142 - RNA, 17 nt, Human
uguuuuuaaaaaucaua

SEQ ID NO: 2257143 - RNA, 23 nt, Human
uguuuuaauuuaaacaccuccuc

SEQ ID NO: 2257144 - RNA, 14 nt, Human
uguuuuaauuccau

SEQ ID NO: 2257145 - RNA, 16 nt, Human
uguuuuaauuccauga

SEQ ID NO: 2257146 - RNA, 22 nt, Human
uguuuuaauuuaaacaccuccu

SEQ ID NO: 2257147 - RNA, 17 nt, Human
uguuuuaagaggcaggg

SEQ ID NO: 2257148 - RNA, 19 nt, Human
uguuuuaaggaugcuugua

SEQ ID NO: 2257149 - RNA, 14 nt, Human
uguuuuaacaaaaa

SEQ ID NO: 2257150 - RNA, 13 nt, Human
uguuuuaacaaaa

SEQ ID NO: 2257151 - RNA, 23 nt, Human
uguuuuaaggaugcuuguacaua

SEQ ID NO: 2257152 - RNA, 22 nt, Human
uguuuuaaggaugcuuguacau

SEQ ID NO: 2257153 - RNA, 15 nt, Human
uguuuuuaagcuguu

SEQ ID NO: 2257154 - RNA, 17 nt, Human
uguuuuuaagcuguuuc

SEQ ID NO: 2257155 - RNA, 20 nt, Human
uguuuuuaagcuguuuccau

SEQ ID NO: 2257156 - RNA, 22 nt, Human
uguuuuuaagcuguuuccauag

SEQ ID NO: 2257157 - RNA, 13 nt, Human
uguuuuuacccau

SEQ ID NO: 2257158 - RNA, 22 nt, Human
uguuuuuacccauauccccucu

SEQ ID NO: 2257159 - RNA, 13 nt, Human
uguuuuugaaaua

SEQ ID NO: 2257160 - RNA, 16 nt, Human
uguuuuugcacauguu

SEQ ID NO: 2257161 - RNA, 20 nt, Human
uguuuuugaaggcagaaagc

SEQ ID NO: 2257162 - RNA, 18 nt, Human
uguuuuugaaggcagaaa

SEQ ID NO: 2257163 - RNA, 16 nt, Human
uguuuuugaaggcaga

SEQ ID NO: 2257164 - RNA, 12 nt, Human
uguuuuucuggg

SEQ ID NO: 2257165 - RNA, 12 nt, Human
uguuuuuguaaa

SEQ ID NO: 2257166 - RNA, 15 nt, Human
uguuuuuguaaagug

SEQ ID NO: 2257167 - RNA, 22 nt, Human
uuaaaaaaaaaccugagcccca

SEQ ID NO: 2257168 - RNA, 13 nt, Human
uuaaaaaaaaaga

SEQ ID NO: 2257169 - RNA, 20 nt, Human
uuaaacuaaggcccucuuga

SEQ ID NO: 2257170 - RNA, 14 nt, Human
uuaaacgugcagac

SEQ ID NO: 2257171 - RNA, 18 nt, Human
uuaaacguaugcauguga

SEQ ID NO: 2257172 - RNA, 20 nt, Human
uuaaacguaugcaugugaag

SEQ ID NO: 2257173 - RNA, 17 nt, Human
uuaaacuagcauaucug

SEQ ID NO: 2257174 - RNA, 19 nt, Human
uuaaacuagcauaucugcc

SEQ ID NO: 2257175 - RNA, 18 nt, Human
uuaaaauacacacucaaa

SEQ ID NO: 2257176 - RNA, 23 nt, Human
uuaaacggauuauuuuuucagac

SEQ ID NO: 2257177 - RNA, 16 nt, Human
uuaaacguaugcaugu

SEQ ID NO: 2257178 - RNA, 20 nt, Human
uuaaacuucucugaagggag

SEQ ID NO: 2257179 - RNA, 17 nt, Human
uuaaacuucucugaagg

SEQ ID NO: 2257180 - RNA, 18 nt, Human
uuaaacuucucugaaggg

SEQ ID NO: 2257181 - RNA, 14 nt, Human
uuaaacuucucuga

SEQ ID NO: 2257182 - RNA, 15 nt, Human
uuaaacuucucugaa

SEQ ID NO: 2257183 - RNA, 22 nt, Human
uuaaacuuaaucuaaauggaac

SEQ ID NO: 2257184 - RNA, 23 nt, Human
uuaaacuagcauaucugccuuua

SEQ ID NO: 2257185 - RNA, 13 nt, Human
uuaaacucaggga

SEQ ID NO: 2257186 - RNA, 14 nt, Human
uuaaacucagggac

SEQ ID NO: 2257187 - RNA, 21 nt, Human
uuaaacuagcauaucugccuu

SEQ ID NO: 2257188 - RNA, 22 nt, Human
uuaaacuagcauaucugccuuu

SEQ ID NO: 2257189 - RNA, 22 nt, Human
uuaaacuaggagaaccaaaucu

SEQ ID NO: 2257190 - RNA, 14 nt, Human
uuaaaacuuuaauc

SEQ ID NO: 2257191 - RNA, 16 nt, Human
uuaaaaguuucaaugu

SEQ ID NO: 2257192 - RNA, 17 nt, Human
uuaaaaguuucaaugug

SEQ ID NO: 2257193 - RNA, 20 nt, Human
uuaaaacugaagucugaaau

SEQ ID NO: 2257194 - RNA, 21 nt, Human
uuaaaacugaagucugaaauu

SEQ ID NO: 2257195 - RNA, 15 nt, Human
uuaaaacuuguaauu

SEQ ID NO: 2257196 - RNA, 15 nt, Human
uuaaaauaacuagug

SEQ ID NO: 2257197 - RNA, 20 nt, Human
uuaaaauaagcacugugcua

SEQ ID NO: 2257198 - RNA, 12 nt, Human
uuaaaauaauau

SEQ ID NO: 2257199 - RNA, 16 nt, Human
uuaaaauaaaaauucu

SEQ ID NO: 2257200 - RNA, 19 nt, Human
uuaaaaguuucaaugugau

SEQ ID NO: 2257201 - RNA, 22 nt, Human
uuaaaaguuucaaugugauucu

SEQ ID NO: 2257202 - RNA, 20 nt, Human
uuaaaauaaaaauucugaau

SEQ ID NO: 2257203 - RNA, 14 nt, Human
uuaaaacccaagug

SEQ ID NO: 2257204 - RNA, 18 nt, Human
uuaaaaaaaaagaucugu

SEQ ID NO: 2257205 - RNA, 16 nt, Human
uuaaaaaaaaaggcau

SEQ ID NO: 2257206 - RNA, 19 nt, Human
uguuuuuguauuuuuaaug

SEQ ID NO: 2257207 - RNA, 14 nt, Human
uuaaaaaaaacaaa

SEQ ID NO: 2257208 - RNA, 15 nt, Human
uuaaaaaaaacaaaa

SEQ ID NO: 2257209 - RNA, 18 nt, Human
uuaaaaaaaacaaaaaga

SEQ ID NO: 2257210 - RNA, 14 nt, Human
uuaaaacugaaguc

SEQ ID NO: 2257211 - RNA, 22 nt, Human
uuaaaaaaaacaaaaagaacaa

SEQ ID NO: 2257212 - RNA, 16 nt, Human
uuaaaacugaagucug

SEQ ID NO: 2257213 - RNA, 17 nt, Human
uuaaaacugaagucuga

SEQ ID NO: 2257214 - RNA, 18 nt, Human
uuaaaacugaagucugaa

SEQ ID NO: 2257215 - RNA, 19 nt, Human
uuaaaacugaagucugaaa

SEQ ID NO: 2257216 - RNA, 19 nt, Human
uuaaaaaaaacaaaaagaa

SEQ ID NO: 2257217 - RNA, 21 nt, Human
uuaaaaaaaacaaaaagaaca

SEQ ID NO: 2257218 - RNA, 14 nt, Human
uuaaauauuuacau

SEQ ID NO: 2257219 - RNA, 18 nt, Human
uuaaauauuuacauauga

SEQ ID NO: 2257220 - RNA, 17 nt, Human
uuaaauauuuacauaug

SEQ ID NO: 2257221 - RNA, 21 nt, Human
uuaaauauguuagcaaagagu

SEQ ID NO: 2257222 - RNA, 13 nt, Human
uuaaagccuccuc

SEQ ID NO: 2257223 - RNA, 15 nt, Human
uuaaauauuucaaga

SEQ ID NO: 2257224 - RNA, 22 nt, Human
uuaaauauuucaagacauuaaa

SEQ ID NO: 2257225 - RNA, 22 nt, Human
uuaaauaucaguagaaacucua

SEQ ID NO: 2257226 - RNA, 15 nt, Human
uuaaagaaaacccac

SEQ ID NO: 2257227 - RNA, 21 nt, Human
uuaaagcagagggacuuugua

SEQ ID NO: 2257228 - RNA, 16 nt, Human
uuaaacucagggacag

SEQ ID NO: 2257229 - RNA, 20 nt, Human
uuaaagcauuuacuuugaau

SEQ ID NO: 2257230 - RNA, 17 nt, Human
uuaaagcauuuacuuug

SEQ ID NO: 2257231 - RNA, 15 nt, Human
uuaaagcauuuacuu

SEQ ID NO: 2257232 - RNA, 22 nt, Human
uuaaagcagagggacuuuguau

SEQ ID NO: 2257233 - RNA, 18 nt, Human
uuaaagcagugcuucuca

SEQ ID NO: 2257234 - RNA, 23 nt, Human
uuaaaugagaaggaauuugaguu

SEQ ID NO: 2257235 - RNA, 12 nt, Human
uuaaaugagaag

SEQ ID NO: 2257236 - RNA, 11 nt, Human
uuaaaugcacc

SEQ ID NO: 2257237 - RNA, 14 nt, Human
uuaaaugcccagcc

SEQ ID NO: 2257238 - RNA, 15 nt, Human
uuaaaugcccagccc

SEQ ID NO: 2257239 - RNA, 16 nt, Human
uuaaaugcccagcccc

SEQ ID NO: 2257240 - RNA, 15 nt, Human
uuaaaugaaagcaug

SEQ ID NO: 2257241 - RNA, 14 nt, Human
uuaaaugaaauugu

SEQ ID NO: 2257242 - RNA, 23 nt, Human
uuaaaugaaauuguaaaaccugu

SEQ ID NO: 2257243 - RNA, 20 nt, Human
uuaaaucccauucauaacuu

SEQ ID NO: 2257244 - RNA, 18 nt, Human
uuaaauauuucaagacau

SEQ ID NO: 2257245 - RNA, 16 nt, Human
uuaaaucucauugcuu

SEQ ID NO: 2257246 - RNA, 16 nt, Human
uuaaaucuaugaagua

SEQ ID NO: 2257247 - RNA, 21 nt, Human
uuaaaucuaugaaguauauaa

SEQ ID NO: 2257248 - RNA, 14 nt, Human
uuaaaucugugaug

SEQ ID NO: 2257249 - RNA, 15 nt, Human
uuaaaucugugauga

SEQ ID NO: 2257250 - RNA, 16 nt, Human
uuaaaucugugaugau

SEQ ID NO: 2257251 - RNA, 17 nt, Human
uuaaugauaaguaaaug

SEQ ID NO: 2257252 - RNA, 20 nt, Human
uuaauuaaugaaauaucugu

SEQ ID NO: 2257253 - RNA, 13 nt, Human
uuaauuaaaugca

SEQ ID NO: 2257254 - RNA, 14 nt, Human
uuaauuaaaugcuc

SEQ ID NO: 2257255 - RNA, 19 nt, Human
uuaaugacagagccagugg

SEQ ID NO: 2257256 - RNA, 16 nt, Human
uuaaugauaaguaaau

SEQ ID NO: 2257257 - RNA, 22 nt, Human
uuaauuaaaacacaacaucuuu

SEQ ID NO: 2257258 - RNA, 16 nt, Human
uuaaugaaguuugaau

SEQ ID NO: 2257259 - RNA, 17 nt, Human
uuaaugaaguuugaaug

SEQ ID NO: 2257260 - RNA, 15 nt, Human
uuaaugaaguuugaa

SEQ ID NO: 2257261 - RNA, 18 nt, Human
uuaaugaaguuugaaugu

SEQ ID NO: 2257262 - RNA, 22 nt, Human
uuaaugaaguuugaauguuaaa

SEQ ID NO: 2257263 - RNA, 23 nt, Human
uuaaugaaguuugaauguuaaau

SEQ ID NO: 2257264 - RNA, 23 nt, Human
uuaaugacacuuguccccaaauc

SEQ ID NO: 2257265 - RNA, 19 nt, Human
uuaaugacacuugucccca

SEQ ID NO: 2257266 - RNA, 14 nt, Human
uuaaugacacuugu

SEQ ID NO: 2257267 - RNA, 21 nt, Human
uuacaacagauuugugaacuc

SEQ ID NO: 2257268 - RNA, 18 nt, Human
uuacaacagauuugugaa

SEQ ID NO: 2257269 - RNA, 19 nt, Human
uuacaacagauuugugaac

SEQ ID NO: 2257270 - RNA, 13 nt, Human
uuacaacagauuu

SEQ ID NO: 2257271 - RNA, 15 nt, Human
uuacaacagauuugu

SEQ ID NO: 2257272 - RNA, 16 nt, Human
uuacaacagauuugug

SEQ ID NO: 2257273 - RNA, 17 nt, Human
uuacaacagauuuguga

SEQ ID NO: 2257274 - RNA, 20 nt, Human
uuaauuagggguugcuaaga

SEQ ID NO: 2257275 - RNA, 19 nt, Human
uuaauuagggguugcuaag

SEQ ID NO: 2257276 - RNA, 19 nt, Human
uuaauuagccagugaaaaa

SEQ ID NO: 2257277 - RNA, 16 nt, Human
uuaauuaccaaccugu

SEQ ID NO: 2257278 - RNA, 13 nt, Human
uuaauuagugcua

SEQ ID NO: 2257279 - RNA, 14 nt, Human
uuaauuagugcuaa

SEQ ID NO: 2257280 - RNA, 15 nt, Human
uuacacauuuuucag

SEQ ID NO: 2257281 - RNA, 17 nt, Human
uuacacaucuucaacag

SEQ ID NO: 2257282 - RNA, 18 nt, Human
uuacacaucucagacccu

SEQ ID NO: 2257283 - RNA, 17 nt, Human
uuacaagaaaaaaugaa

SEQ ID NO: 2257284 - RNA, 19 nt, Human
uuacacacgugcaauuugu

SEQ ID NO: 2257285 - RNA, 23 nt, Human
uuacacacgugcaauuuguuugu

SEQ ID NO: 2257286 - RNA, 23 nt, Human
uuacaacugccucgaaacacaga

SEQ ID NO: 2257287 - RNA, 22 nt, Human
uuacaacugccucgaaacacag

SEQ ID NO: 2257288 - RNA, 17 nt, Human
uuacacauuuuucagau

SEQ ID NO: 2257289 - RNA, 23 nt, Human
uuacacauuuuucagauauaaaa

SEQ ID NO: 2257290 - RNA, 23 nt, Human
uuacacguggaggaaugcucccc

SEQ ID NO: 2257291 - RNA, 21 nt, Human
uuacaccagccucgucuucau

SEQ ID NO: 2257292 - RNA, 14 nt, Human
uuacacucuuugua

SEQ ID NO: 2257293 - RNA, 14 nt, Human
uuacacuguauuug

SEQ ID NO: 2257294 - RNA, 17 nt, Human
uuacacuguauuuguau

SEQ ID NO: 2257295 - RNA, 13 nt, Human
uuacacugggaga

SEQ ID NO: 2257296 - RNA, 21 nt, Human
uuacacuggaggagagaagaa

SEQ ID NO: 2257297 - RNA, 22 nt, Human
uuacacuggaggagagaagaau

SEQ ID NO: 2257298 - RNA, 15 nt, Human
uuacacucuuuguaa

SEQ ID NO: 2257299 - RNA, 20 nt, Human
uuacacuuuaugcacaaaau

SEQ ID NO: 2257300 - RNA, 13 nt, Human
uuacacuuuaugc

SEQ ID NO: 2257301 - RNA, 23 nt, Human
uuacacuuuaugccggaugugcu

SEQ ID NO: 2257302 - RNA, 14 nt, Human
uuacacuuacuguu

SEQ ID NO: 2257303 - RNA, 15 nt, Human
uuacacuuacuguug

SEQ ID NO: 2257304 - RNA, 14 nt, Human
uuacagaaaguggu

SEQ ID NO: 2257305 - RNA, 19 nt, Human
uuacagaaaguggugcuca

SEQ ID NO: 2257306 - RNA, 22 nt, Human
uuacagaaaguggugcucaguu

SEQ ID NO: 2257307 - RNA, 13 nt, Human
uuacauuguucaa

SEQ ID NO: 2257308 - RNA, 15 nt, Human
uuacauugucauuua

SEQ ID NO: 2257309 - RNA, 17 nt, Human
uuacauuguuugucugu

SEQ ID NO: 2257310 - RNA, 12 nt, Human
uuacauuguaaa

SEQ ID NO: 2257311 - RNA, 13 nt, Human
uuacauuguaaau

SEQ ID NO: 2257312 - RNA, 13 nt, Human
uuacauucugaau

SEQ ID NO: 2257313 - RNA, 13 nt, Human
uuacauucaguug

SEQ ID NO: 2257314 - RNA, 19 nt, Human
uuacauuauuaucaacaau

SEQ ID NO: 2257315 - RNA, 20 nt, Human
uuacagaacacgcuuucaca

SEQ ID NO: 2257316 - RNA, 21 nt, Human
uuacagaaaguggugcucagu

SEQ ID NO: 2257317 - RNA, 17 nt, Human
uuacauuuuuaagugcu

SEQ ID NO: 2257318 - RNA, 12 nt, Human
uuacauuuuuaa

SEQ ID NO: 2257319 - RNA, 17 nt, Human
uuacauuuccaaaugaa

SEQ ID NO: 2257320 - RNA, 16 nt, Human
uuacauuuccaaauga

SEQ ID NO: 2257321 - RNA, 16 nt, Human
uuacauuguucaauua

SEQ ID NO: 2257322 - RNA, 20 nt, Human
uuacauuuguauaaaauaau

SEQ ID NO: 2257323 - RNA, 19 nt, Human
uuaauacuauaaauaauau

SEQ ID NO: 2257324 - RNA, 17 nt, Human
uuaauacuaccuugaaa

SEQ ID NO: 2257325 - RNA, 15 nt, Human
uuaauacuaccuuga

SEQ ID NO: 2257326 - RNA, 15 nt, Human
uuaauaccacagcuu

SEQ ID NO: 2257327 - RNA, 22 nt, Human
uuaauacucauccuuguauaaa

SEQ ID NO: 2257328 - RNA, 20 nt, Human
uuaauacucauccuuguaua

SEQ ID NO: 2257329 - RNA, 21 nt, Human
uuaauacucauccuuguauaa

SEQ ID NO: 2257330 - RNA, 17 nt, Human
uuaauaaguuucacuga

SEQ ID NO: 2257331 - RNA, 14 nt, Human
uuaauaauauacuu

SEQ ID NO: 2257332 - RNA, 16 nt, Human
uuaauaauauacuugu

SEQ ID NO: 2257333 - RNA, 18 nt, Human
uuaauaauauacuugugg

SEQ ID NO: 2257334 - RNA, 24 nt, Human
uuaauaaucagcaagaauuugauc

SEQ ID NO: 2257335 - RNA, 21 nt, Human
uuaauaauauacuuguggacu

SEQ ID NO: 2257336 - RNA, 19 nt, Human
uuaauagaauauaauuauc

SEQ ID NO: 2257337 - RNA, 11 nt, Human
uuaauauuaaa

SEQ ID NO: 2257338 - RNA, 20 nt, Human
uuaagcauuggguggguaaa

SEQ ID NO: 2257339 - RNA, 23 nt, Human
uuaagcauuguuugcuuauuguu

SEQ ID NO: 2257340 - RNA, 22 nt, Human
uuaagcauuguuugcuuauugu

SEQ ID NO: 2257341 - RNA, 19 nt, Human
uuaagcauuguuugcuuau

SEQ ID NO: 2257342 - RNA, 14 nt, Human
uuaagcauuguuug

SEQ ID NO: 2257343 - RNA, 12 nt, Human
uuaagcauuguu

SEQ ID NO: 2257344 - RNA, 18 nt, Human
uuaagcauuaccacucag

SEQ ID NO: 2257345 - RNA, 13 nt, Human
uuaagcauuacca

SEQ ID NO: 2257346 - RNA, 16 nt, Human
uuaagcagaagcauua

SEQ ID NO: 2257347 - RNA, 17 nt, Human
uuaagcacuacauaaac

SEQ ID NO: 2257348 - RNA, 20 nt, Human
uuaagcacuacauaaacuga

SEQ ID NO: 2257349 - RNA, 22 nt, Human
uuaagcacuacauaaacugacu

SEQ ID NO: 2257350 - RNA, 15 nt, Human
uuaagcagaagcauu

SEQ ID NO: 2257351 - RNA, 21 nt, Human
uuaagauuuuucucaaaguuu

SEQ ID NO: 2257352 - RNA, 14 nt, Human
uuaagcacuacaua

SEQ ID NO: 2257353 - RNA, 13 nt, Human
uuaauaacauuac

SEQ ID NO: 2257354 - RNA, 21 nt, Human
uuaagccucauauuuaaagac

SEQ ID NO: 2257355 - RNA, 15 nt, Human
uuaauaacauuaccu

SEQ ID NO: 2257356 - RNA, 16 nt, Human
uuaauaacauuaccuu

SEQ ID NO: 2257357 - RNA, 17 nt, Human
uuaauaacauuaccuua

SEQ ID NO: 2257358 - RNA, 20 nt, Human
uuaauaacauuaccuuacug

SEQ ID NO: 2257359 - RNA, 21 nt, Human
uuaauaacauuaccuuacugu

SEQ ID NO: 2257360 - RNA, 15 nt, Human
uuaauaaguuucacu

SEQ ID NO: 2257361 - RNA, 14 nt, Human
uuaauaauaaauuc

SEQ ID NO: 2257362 - RNA, 23 nt, Human
uuaauaauaaauucccuggccuu

SEQ ID NO: 2257363 - RNA, 19 nt, Human
uuaagccucauauuuaaag

SEQ ID NO: 2257364 - RNA, 16 nt, Human
uuaagccaucuuggua

SEQ ID NO: 2257365 - RNA, 13 nt, Human
uuaagcccugagg

SEQ ID NO: 2257366 - RNA, 21 nt, Human
uuaagccacuuaaaauguuca

SEQ ID NO: 2257367 - RNA, 18 nt, Human
uuaagccaucuugguaaa

SEQ ID NO: 2257368 - RNA, 16 nt, Human
uuaacuuuaaguuuca

SEQ ID NO: 2257369 - RNA, 18 nt, Human
uuaacuuuaucacauuau

SEQ ID NO: 2257370 - RNA, 23 nt, Human
uuaacuuuaucacauuauuugca

SEQ ID NO: 2257371 - RNA, 14 nt, Human
uuaacuuuuauaaa

SEQ ID NO: 2257372 - RNA, 12 nt, Human
uuaagaguaaaa

SEQ ID NO: 2257373 - RNA, 20 nt, Human
uuaagaguagcaaguucuag

SEQ ID NO: 2257374 - RNA, 12 nt, Human
uuaagagugaaa

SEQ ID NO: 2257375 - RNA, 21 nt, Human
uuaagagugggggagagcagg

SEQ ID NO: 2257376 - RNA, 19 nt, Human
uuaagauaauaauauaugu

SEQ ID NO: 2257377 - RNA, 23 nt, Human
uuaagauggauucucagauauuu

SEQ ID NO: 2257378 - RNA, 22 nt, Human
uuaagauggauucucagauauu

SEQ ID NO: 2257379 - RNA, 21 nt, Human
uuaagauggauucucagauau

SEQ ID NO: 2257380 - RNA, 18 nt, Human
uuaagauggauucucaga

SEQ ID NO: 2257381 - RNA, 17 nt, Human
uuaagauggauucucag

SEQ ID NO: 2257382 - RNA, 14 nt, Human
uuaagauggauucu

SEQ ID NO: 2257383 - RNA, 14 nt, Human
uuaagauaugaugu

SEQ ID NO: 2257384 - RNA, 21 nt, Human
uuaagauaauaguuuacaugu

SEQ ID NO: 2257385 - RNA, 14 nt, Human
uuaagauaauuaua

SEQ ID NO: 2257386 - RNA, 16 nt, Human
uuaagauaauuauaau

SEQ ID NO: 2257387 - RNA, 14 nt, Human
uuaagauuuuucuc

SEQ ID NO: 2257388 - RNA, 15 nt, Human
uuaagauuuuucuca

SEQ ID NO: 2257389 - RNA, 16 nt, Human
uuaagauuuuucucaa

SEQ ID NO: 2257390 - RNA, 17 nt, Human
uuaagauuuuucucaaa

SEQ ID NO: 2257391 - RNA, 20 nt, Human
uuaagauuuuucucaaaguu

SEQ ID NO: 2257392 - RNA, 22 nt, Human
uuaagauuuuucucaaaguuuu

SEQ ID NO: 2257393 - RNA, 16 nt, Human
uuaacuuuaagacuga

SEQ ID NO: 2257394 - RNA, 15 nt, Human
uuaacuugaguuuua

SEQ ID NO: 2257395 - RNA, 13 nt, Human
uuaacuuuuauaa

SEQ ID NO: 2257396 - RNA, 12 nt, Human
uuaacuuuuaua

SEQ ID NO: 2257397 - RNA, 13 nt, Human
uuaaaugcccagc

SEQ ID NO: 2257398 - RNA, 18 nt, Human
uuaaaugucuaauguauu

SEQ ID NO: 2257399 - RNA, 19 nt, Human
uuaaaugucuaauguauuu

SEQ ID NO: 2257400 - RNA, 22 nt, Human
uuaaaugucuaauguauuuuau

SEQ ID NO: 2257401 - RNA, 18 nt, Human
uuaaaugucuucuguauu

SEQ ID NO: 2257402 - RNA, 14 nt, Human
uuaaaugucuaaug

SEQ ID NO: 2257403 - RNA, 17 nt, Human
uuaaaugucuaauguau

SEQ ID NO: 2257404 - RNA, 13 nt, Human
uguggcggugccu

SEQ ID NO: 2257405 - RNA, 19 nt, Human
uguggcgccgucuccaggg

SEQ ID NO: 2257406 - RNA, 23 nt, Human
uguggcgccgucuccaggggcug

SEQ ID NO: 2257407 - RNA, 10 nt, Human
uguggcucac

SEQ ID NO: 2257408 - RNA, 16 nt, Human
uguggcucacgugugu

SEQ ID NO: 2257409 - RNA, 22 nt, Human
uguggcucacgugagagugucu

SEQ ID NO: 2257410 - RNA, 14 nt, Human
uguggcuccccucu

SEQ ID NO: 2257411 - RNA, 13 nt, Human
uguggcuccccuc

SEQ ID NO: 2257412 - RNA, 13 nt, Human
ugugggagcagcg

SEQ ID NO: 2257413 - RNA, 15 nt, Human
ugugggaguguguaa

SEQ ID NO: 2257414 - RNA, 14 nt, Human
ugugggagugugua

SEQ ID NO: 2257415 - RNA, 13 nt, Human
uguggccucagaa

SEQ ID NO: 2257416 - RNA, 11 nt, Human
uguggccugca

SEQ ID NO: 2257417 - RNA, 15 nt, Human
uguggccugggccuc

SEQ ID NO: 2257418 - RNA, 17 nt, Human
uguggccugcacaguga

SEQ ID NO: 2257419 - RNA, 16 nt, Human
uguggccugggccucc

SEQ ID NO: 2257420 - RNA, 13 nt, Human
uguggccuguggc

SEQ ID NO: 2257421 - RNA, 15 nt, Human
uguggccuguggccu

SEQ ID NO: 2257422 - RNA, 16 nt, Human
uguggccuguggccug

SEQ ID NO: 2257423 - RNA, 20 nt, Human
uguggccuuccauuuauaug

SEQ ID NO: 2257424 - RNA, 18 nt, Human
uguggcgccgucuccagg

SEQ ID NO: 2257425 - RNA, 17 nt, Human
uguggccuguggccugu

SEQ ID NO: 2257426 - RNA, 23 nt, Human
uguggcgcagcauauucaggaag

SEQ ID NO: 2257427 - RNA, 18 nt, Human
uguggaagggacuaggag

SEQ ID NO: 2257428 - RNA, 15 nt, Human
uguggaagggacuag

SEQ ID NO: 2257429 - RNA, 14 nt, Human
uguggaagggacua

SEQ ID NO: 2257430 - RNA, 14 nt, Human
uguggaagcaaaaa

SEQ ID NO: 2257431 - RNA, 18 nt, Human
uguggacacagcucuucu

SEQ ID NO: 2257432 - RNA, 15 nt, Human
uguggaagugugggu

SEQ ID NO: 2257433 - RNA, 17 nt, Human
uguggaaucuggaguga

SEQ ID NO: 2257434 - RNA, 18 nt, Human
uguggaaucuggagugag

SEQ ID NO: 2257435 - RNA, 11 nt, Human
uguggccucag

SEQ ID NO: 2257436 - RNA, 10 nt, Human
uguggccuca

SEQ ID NO: 2257437 - RNA, 19 nt, Human
uguggacuaaaagauauaa

SEQ ID NO: 2257438 - RNA, 15 nt, Human
uguggacuaaaagau

SEQ ID NO: 2257439 - RNA, 16 nt, Human
uguggacuaaaagaua

SEQ ID NO: 2257440 - RNA, 19 nt, Human
uguggacacagcucuucuc

SEQ ID NO: 2257441 - RNA, 17 nt, Human
uguggaccacugcauga

SEQ ID NO: 2257442 - RNA, 19 nt, Human
uguggaccacugcaugagc

SEQ ID NO: 2257443 - RNA, 22 nt, Human
uguguaaucauuucuugggccc

SEQ ID NO: 2257444 - RNA, 21 nt, Human
uguguaaucauuucuugggcc

SEQ ID NO: 2257445 - RNA, 19 nt, Human
uguguaaucaauaaacgau

SEQ ID NO: 2257446 - RNA, 20 nt, Human
uguguaaucaauaaacgauu

SEQ ID NO: 2257447 - RNA, 23 nt, Human
uguguaaucauuucuugggcccu

SEQ ID NO: 2257448 - RNA, 18 nt, Human
uguguaauuuaaaauugu

SEQ ID NO: 2257449 - RNA, 11 nt, Human
uguguaauuua

SEQ ID NO: 2257450 - RNA, 22 nt, Human
ugugggcuaguugggcuuccuc

SEQ ID NO: 2257451 - RNA, 22 nt, Human
ugugggcgugagaccugccccu

SEQ ID NO: 2257452 - RNA, 15 nt, Human
uguguaaucaauaaa

SEQ ID NO: 2257453 - RNA, 21 nt, Human
uguguaauagaaaacugaaaa

SEQ ID NO: 2257454 - RNA, 21 nt, Human
ugugggccucaaggacuugaa

SEQ ID NO: 2257455 - RNA, 19 nt, Human
ugugggccucaaggacuug

SEQ ID NO: 2257456 - RNA, 21 nt, Human
ugugggcgugagaccugcccc

SEQ ID NO: 2257457 - RNA, 20 nt, Human
ugugggcgugagaccugccc

SEQ ID NO: 2257458 - RNA, 16 nt, Human
ugugggcaggaaguga

SEQ ID NO: 2257459 - RNA, 21 nt, Human
ugugggagggagcagacagga

SEQ ID NO: 2257460 - RNA, 22 nt, Human
ugugggauguucagcacugucc

SEQ ID NO: 2257461 - RNA, 13 nt, Human
ugugggagggagc

SEQ ID NO: 2257462 - RNA, 19 nt, Human
ugugggauguucagcacug

SEQ ID NO: 2257463 - RNA, 19 nt, Human
uguguacaguguguaaagu

SEQ ID NO: 2257464 - RNA, 21 nt, Human
uguguacagaugaaugauaaa

SEQ ID NO: 2257465 - RNA, 10 nt, Human
uguguacagg

SEQ ID NO: 2257466 - RNA, 23 nt, Human
uguguacagaauucugcuaccuc

SEQ ID NO: 2257467 - RNA, 22 nt, Human
uguguacacgggacugacgcaa

SEQ ID NO: 2257468 - RNA, 18 nt, Human
uguguacagaugaaugau

SEQ ID NO: 2257469 - RNA, 21 nt, Human
uguguacagaauucugcuacc

SEQ ID NO: 2257470 - RNA, 19 nt, Human
uguguacaaagaaauaaca

SEQ ID NO: 2257471 - RNA, 14 nt, Human
uguguacaaagaaa

SEQ ID NO: 2257472 - RNA, 16 nt, Human
uguguaauuuuguucu

SEQ ID NO: 2257473 - RNA, 23 nt, Human
uguguaauuuaaaauugugaugu

SEQ ID NO: 2257474 - RNA, 22 nt, Human
uguguaauuuaaaauugugaug

SEQ ID NO: 2257475 - RNA, 19 nt, Human
uguguaauuuaaaauugug

SEQ ID NO: 2257476 - RNA, 17 nt, Human
uguguagcuuugcucuu

SEQ ID NO: 2257477 - RNA, 14 nt, Human
uguguagcuuugcu

SEQ ID NO: 2257478 - RNA, 12 nt, Human
uguguagggcgg

SEQ ID NO: 2257479 - RNA, 15 nt, Human
uguguagccugugca

SEQ ID NO: 2257480 - RNA, 16 nt, Human
uguguagccugugcau

SEQ ID NO: 2257481 - RNA, 17 nt, Human
uguguacauaacugaaa

SEQ ID NO: 2257482 - RNA, 14 nt, Human
uguguagccugugc

SEQ ID NO: 2257483 - RNA, 15 nt, Human
uguguacauaacuga

SEQ ID NO: 2257484 - RNA, 23 nt, Human
uguguagccugugcauguauguc

SEQ ID NO: 2257485 - RNA, 15 nt, Human
ugugcaugugugugc

SEQ ID NO: 2257486 - RNA, 22 nt, Human
ugugcagacucaauaaaaucau

SEQ ID NO: 2257487 - RNA, 14 nt, Human
ugugcaugugugug

SEQ ID NO: 2257488 - RNA, 21 nt, Human
ugugcauucuuuuaaaagaca

SEQ ID NO: 2257489 - RNA, 22 nt, Human
ugugcauucuuuuaaaagacaa

SEQ ID NO: 2257490 - RNA, 23 nt, Human
ugugcauucuuuuaaaagacaag

SEQ ID NO: 2257491 - RNA, 23 nt, Human
ugugcauuaucuagauacuguau

SEQ ID NO: 2257492 - RNA, 21 nt, Human
ugugcauuaucuagauacugu

SEQ ID NO: 2257493 - RNA, 20 nt, Human
ugugcauuaucuagauacug

SEQ ID NO: 2257494 - RNA, 23 nt, Human
ugugcauuuggugguuucagaaa

SEQ ID NO: 2257495 - RNA, 14 nt, Human
ugugccuucgucuu

SEQ ID NO: 2257496 - RNA, 23 nt, Human
ugugccuucgucuuucccauggg

SEQ ID NO: 2257497 - RNA, 17 nt, Human
ugugccuuggugugcug

SEQ ID NO: 2257498 - RNA, 16 nt, Human
ugugccuucuuuugau

SEQ ID NO: 2257499 - RNA, 14 nt, Human
ugugcauugcugug

SEQ ID NO: 2257500 - RNA, 15 nt, Human
ugugccuuuuauagc

SEQ ID NO: 2257501 - RNA, 19 nt, Human
ugugcagacucaauaaaau

SEQ ID NO: 2257502 - RNA, 18 nt, Human
ugugcagacucaauaaaa

SEQ ID NO: 2257503 - RNA, 17 nt, Human
ugugcagaaaacauugu

SEQ ID NO: 2257504 - RNA, 19 nt, Human
ugugcagaaaacauuguuc

SEQ ID NO: 2257505 - RNA, 21 nt, Human
ugugcacugucacuuugcucu

SEQ ID NO: 2257506 - RNA, 14 nt, Human
ugugcagaaaacau

SEQ ID NO: 2257507 - RNA, 15 nt, Human
ugugcagaaaacauu

SEQ ID NO: 2257508 - RNA, 16 nt, Human
ugugcagaaaacauug

SEQ ID NO: 2257509 - RNA, 14 nt, Human
ugugcauuaucuag

SEQ ID NO: 2257510 - RNA, 19 nt, Human
ugugcauuaucuagauacu

SEQ ID NO: 2257511 - RNA, 16 nt, Human
ugugcauuaucuagau

SEQ ID NO: 2257512 - RNA, 23 nt, Human
ugugcacuaaggggcccggccag

SEQ ID NO: 2257513 - RNA, 17 nt, Human
ugugcacugucacuuug

SEQ ID NO: 2257514 - RNA, 21 nt, Human
ugugcacugcccauggacagg

SEQ ID NO: 2257515 - RNA, 14 nt, Human
ugugcacugucacu

SEQ ID NO: 2257516 - RNA, 17 nt, Human
ugugcacuaaggggccc

SEQ ID NO: 2257517 - RNA, 16 nt, Human
ugugcacuaaggggcc

SEQ ID NO: 2257518 - RNA, 13 nt, Human
ugugcacugccca

SEQ ID NO: 2257519 - RNA, 12 nt, Human
ugugcacuaagg

SEQ ID NO: 2257520 - RNA, 19 nt, Human
ugugcacguggcauguggc

SEQ ID NO: 2257521 - RNA, 14 nt, Human
ugugcacguacaca

SEQ ID NO: 2257522 - RNA, 21 nt, Human
ugugcacaucugugucuuguu

SEQ ID NO: 2257523 - RNA, 13 nt, Human
ugugcacaucuuc

SEQ ID NO: 2257524 - RNA, 20 nt, Human
ugugcacaucucugcuugag

SEQ ID NO: 2257525 - RNA, 17 nt, Human
ugugcuuugcauuccua

SEQ ID NO: 2257526 - RNA, 19 nt, Human
uguggaaauuaagaagaaa

SEQ ID NO: 2257527 - RNA, 18 nt, Human
ugugcuuuccagcucacc

SEQ ID NO: 2257528 - RNA, 20 nt, Human
ugugcuuuccagcucacccc

SEQ ID NO: 2257529 - RNA, 16 nt, Human
ugugcuuucccugaac

SEQ ID NO: 2257530 - RNA, 22 nt, Human
ugugcuuucccugaacugggac

SEQ ID NO: 2257531 - RNA, 11 nt, Human
ugugcuuucua

SEQ ID NO: 2257532 - RNA, 15 nt, Human
ugugcuuucuauugu

SEQ ID NO: 2257533 - RNA, 17 nt, Human
ugugcuuucuauuguac

SEQ ID NO: 2257534 - RNA, 20 nt, Human
ugugcuuugacucaccuguu

SEQ ID NO: 2257535 - RNA, 19 nt, Human
ugugcuuuaugcugaaaca

SEQ ID NO: 2257536 - RNA, 14 nt, Human
ugugcuuuccagcu

SEQ ID NO: 2257537 - RNA, 15 nt, Human
ugugcuuuccagcuc

SEQ ID NO: 2257538 - RNA, 16 nt, Human
ugugcuuuccagcuca

SEQ ID NO: 2257539 - RNA, 20 nt, Human
ugugcuuuaugcugaaacag

SEQ ID NO: 2257540 - RNA, 18 nt, Human
ugugcuuuaugcugaaac

SEQ ID NO: 2257541 - RNA, 17 nt, Human
ugugcuuuaugcugaaa

SEQ ID NO: 2257542 - RNA, 13 nt, Human
ugugcuuuaugcu

SEQ ID NO: 2257543 - RNA, 14 nt, Human
ugugcuuuagcuug

SEQ ID NO: 2257544 - RNA, 23 nt, Human
ugugcuuguuuacagcacuacuc

SEQ ID NO: 2257545 - RNA, 14 nt, Human
ugugcuuguuuaca

SEQ ID NO: 2257546 - RNA, 14 nt, Human
ugugcuuguuaacu

SEQ ID NO: 2257547 - RNA, 17 nt, Human
ugugcucaggagcccug

SEQ ID NO: 2257548 - RNA, 15 nt, Human
ugugcucaggagccc

SEQ ID NO: 2257549 - RNA, 16 nt, Human
ugugcucaggagcccu

SEQ ID NO: 2257550 - RNA, 14 nt, Human
ugugcgccuacagg

SEQ ID NO: 2257551 - RNA, 16 nt, Human
ugugccuuuuauagcu

SEQ ID NO: 2257552 - RNA, 18 nt, Human
ugugccuuuuauagcuau

SEQ ID NO: 2257553 - RNA, 16 nt, Human
ugugccuuuugccauc

SEQ ID NO: 2257554 - RNA, 19 nt, Human
ugugcgccuacaggaguga

SEQ ID NO: 2257555 - RNA, 19 nt, Human
ugugcuaguaauuggaaag

SEQ ID NO: 2257556 - RNA, 15 nt, Human
ugugcuaugaauuuu

SEQ ID NO: 2257557 - RNA, 14 nt, Human
ugugcuaugaauuu

SEQ ID NO: 2257558 - RNA, 20 nt, Human
ugugcuagggaaacuucccg

SEQ ID NO: 2257559 - RNA, 16 nt, Human
ugugcucaaaauuuga

SEQ ID NO: 2257560 - RNA, 20 nt, Human
ugugcucaaaauuugaagaa

SEQ ID NO: 2257561 - RNA, 18 nt, Human
ugugcucaggacucagaa

SEQ ID NO: 2257562 - RNA, 16 nt, Human
ugugcuacuuugccuu

SEQ ID NO: 2257563 - RNA, 13 nt, Human
ugugcuauacugc

SEQ ID NO: 2257564 - RNA, 15 nt, Human
ugugcuacuuugccu

SEQ ID NO: 2257565 - RNA, 13 nt, Human
ugugcuagaugug

SEQ ID NO: 2257566 - RNA, 21 nt, Human
ugugcuauacugcauacuuuu

SEQ ID NO: 2257567 - RNA, 20 nt, Human
ugugcuauacugcauacuuu

SEQ ID NO: 2257568 - RNA, 18 nt, Human
ugugcuauacugcauacu

SEQ ID NO: 2257569 - RNA, 22 nt, Human
ugugaauugccugcagagagaa

SEQ ID NO: 2257570 - RNA, 15 nt, Human
ugugacauguuuuau

SEQ ID NO: 2257571 - RNA, 18 nt, Human
ugugaauugccugcagag

SEQ ID NO: 2257572 - RNA, 17 nt, Human
ugugacauuuauauauu

SEQ ID NO: 2257573 - RNA, 18 nt, Human
ugugacauuuauauauug

SEQ ID NO: 2257574 - RNA, 14 nt, Human
ugugaauucagauu

SEQ ID NO: 2257575 - RNA, 20 nt, Human
ugugaauuagcucacuuggu

SEQ ID NO: 2257576 - RNA, 13 nt, Human
ugugaauucagau

SEQ ID NO: 2257577 - RNA, 20 nt, Human
ugugaaguuagaauuccuuc

SEQ ID NO: 2257578 - RNA, 19 nt, Human
ugugaauggauuggauuau

SEQ ID NO: 2257579 - RNA, 21 nt, Human
ugugaauguugugauguauuc

SEQ ID NO: 2257580 - RNA, 22 nt, Human
ugugaauggauuggauuauuua

SEQ ID NO: 2257581 - RNA, 16 nt, Human
ugugaaugggaaaaga

SEQ ID NO: 2257582 - RNA, 23 nt, Human
ugugaaguccuucaccucacuga

SEQ ID NO: 2257583 - RNA, 18 nt, Human
ugugaagugaaugaaaca

SEQ ID NO: 2257584 - RNA, 18 nt, Human
ugugaaguguuaauacua

SEQ ID NO: 2257585 - RNA, 13 nt, Human
ugugaaguuagaa

SEQ ID NO: 2257586 - RNA, 14 nt, Human
ugugaaguuagaau

SEQ ID NO: 2257587 - RNA, 15 nt, Human
ugugaaguuagaauu

SEQ ID NO: 2257588 - RNA, 13 nt, Human
ugugaggagcugc

SEQ ID NO: 2257589 - RNA, 16 nt, Human
ugugaccaaugucuug

SEQ ID NO: 2257590 - RNA, 12 nt, Human
ugugaggaagcc

SEQ ID NO: 2257591 - RNA, 20 nt, Human
ugugaggaagccgcuggggc

SEQ ID NO: 2257592 - RNA, 20 nt, Human
ugugaggagcugcuggcuug

SEQ ID NO: 2257593 - RNA, 18 nt, Human
ugugaggagcugcuggcu

SEQ ID NO: 2257594 - RNA, 17 nt, Human
ugugaggagcugcuggc

SEQ ID NO: 2257595 - RNA, 14 nt, Human
ugugaggagcugcu

SEQ ID NO: 2257596 - RNA, 18 nt, Human
ugugaggcaggggcggag

SEQ ID NO: 2257597 - RNA, 13 nt, Human
ugugaggcagggg

SEQ ID NO: 2257598 - RNA, 13 nt, Human
ugugaggccaggg

SEQ ID NO: 2257599 - RNA, 13 nt, Human
ugugaccaaguua

SEQ ID NO: 2257600 - RNA, 12 nt, Human
ugugaggcaggg

SEQ ID NO: 2257601 - RNA, 15 nt, Human
ugugaccaaugucuu

SEQ ID NO: 2257602 - RNA, 13 nt, Human
ugugaggaagccg

SEQ ID NO: 2257603 - RNA, 18 nt, Human
ugugaggaagccgcuggg

SEQ ID NO: 2257604 - RNA, 23 nt, Human
ugugaggcccaugguugagaaau

SEQ ID NO: 2257605 - RNA, 13 nt, Human
ugugaggccccug

SEQ ID NO: 2257606 - RNA, 22 nt, Human
ugugaggccagggcagagugag

SEQ ID NO: 2257607 - RNA, 14 nt, Human
ugugaggccccugg

SEQ ID NO: 2257608 - RNA, 22 nt, Human
ugugaggccccuggacaagcag

SEQ ID NO: 2257609 - RNA, 14 nt, Human
ugugaggccuggcc

SEQ ID NO: 2257610 - RNA, 18 nt, Human
ugugaggccuggccaggc

SEQ ID NO: 2257611 - RNA, 17 nt, Human
ugugaggccagggcaga

SEQ ID NO: 2257612 - RNA, 16 nt, Human
ugugaggccagggcag

SEQ ID NO: 2257613 - RNA, 15 nt, Human
ugugaggccagggca

SEQ ID NO: 2257614 - RNA, 14 nt, Human
ugugaggccagggc

SEQ ID NO: 2257615 - RNA, 15 nt, Human
ugugagucaccaagc

SEQ ID NO: 2257616 - RNA, 17 nt, Human
ugugagucaccaagccc

SEQ ID NO: 2257617 - RNA, 19 nt, Human
ugugagucaccaagcccag

SEQ ID NO: 2257618 - RNA, 21 nt, Human
ugugagucaccaagcccaguu

SEQ ID NO: 2257619 - RNA, 14 nt, Human
ugugagugugugca

SEQ ID NO: 2257620 - RNA, 23 nt, Human
ugugaguguguccaagugugugu

SEQ ID NO: 2257621 - RNA, 20 nt, Human
ugugaguguguccaagugug

SEQ ID NO: 2257622 - RNA, 20 nt, Human
ugugaguguaagugugagua

SEQ ID NO: 2257623 - RNA, 16 nt, Human
ugugaguguaagugug

SEQ ID NO: 2257624 - RNA, 14 nt, Human
ugugaggcuguccu

SEQ ID NO: 2257625 - RNA, 16 nt, Human
ugugaguuuaaagcaa

SEQ ID NO: 2257626 - RNA, 21 nt, Human
ugugaguuuaccuuguauacu

SEQ ID NO: 2257627 - RNA, 16 nt, Human
ugugauauaagugugu

SEQ ID NO: 2257628 - RNA, 14 nt, Human
ugugauauuaacag

SEQ ID NO: 2257629 - RNA, 16 nt, Human
ugugauauauaagugu

SEQ ID NO: 2257630 - RNA, 15 nt, Human
ugugauauggagccc

SEQ ID NO: 2257631 - RNA, 19 nt, Human
ugugaguuuaccuuguaua

SEQ ID NO: 2257632 - RNA, 13 nt, Human
ugugauauauaag

SEQ ID NO: 2257633 - RNA, 14 nt, Human
ugugauauauaagu

SEQ ID NO: 2257634 - RNA, 15 nt, Human
ugugauauauaagug

SEQ ID NO: 2257635 - RNA, 22 nt, Human
ugugcacacacaccacacauac

SEQ ID NO: 2257636 - RNA, 19 nt, Human
ugugcacacacaccacaca

SEQ ID NO: 2257637 - RNA, 19 nt, Human
ugugcacaucucugcuuga

SEQ ID NO: 2257638 - RNA, 15 nt, Human
ugugcacaucucugc

SEQ ID NO: 2257639 - RNA, 14 nt, Human
ugugcacaucucug

SEQ ID NO: 2257640 - RNA, 13 nt, Human
ugugcacaucucu

SEQ ID NO: 2257641 - RNA, 20 nt, Human
ugugcacaucugugucuugu

SEQ ID NO: 2257642 - RNA, 17 nt, Human
ugugcacaucugugucu

SEQ ID NO: 2257643 - RNA, 20 nt, Human
ugugaucaggcuauguaugg

SEQ ID NO: 2257644 - RNA, 20 nt, Human
ugugcacaauucuguuuuag

SEQ ID NO: 2257645 - RNA, 15 nt, Human
ugugaucagaccaua

SEQ ID NO: 2257646 - RNA, 18 nt, Human
uguccucagguggccaug

SEQ ID NO: 2257647 - RNA, 19 nt, Human
uguccucagguggccaugc

SEQ ID NO: 2257648 - RNA, 10 nt, Human
uguccuccuc

SEQ ID NO: 2257649 - RNA, 11 nt, Human
uguccuccucg

SEQ ID NO: 2257650 - RNA, 21 nt, Human
uguccuccucggaucaccgag

SEQ ID NO: 2257651 - RNA, 14 nt, Human
uguccucagguggc

SEQ ID NO: 2257652 - RNA, 14 nt, Human
uguccucagcuucu

SEQ ID NO: 2257653 - RNA, 22 nt, Human
uguccucagccuugccagagau

SEQ ID NO: 2257654 - RNA, 21 nt, Human
uguccucagccuugccagaga

SEQ ID NO: 2257655 - RNA, 20 nt, Human
uguccucagccuugccagag

SEQ ID NO: 2257656 - RNA, 17 nt, Human
uguccucagccuugcca

SEQ ID NO: 2257657 - RNA, 23 nt, Human
uguccucuucugcaucuugggga

SEQ ID NO: 2257658 - RNA, 15 nt, Human
uguccucuugcucaa

SEQ ID NO: 2257659 - RNA, 23 nt, Human
uguccucuugcucaaaaaucugu

SEQ ID NO: 2257660 - RNA, 21 nt, Human
uguccuccugguggguccagg

SEQ ID NO: 2257661 - RNA, 19 nt, Human
uguccucuucugcaucuug

SEQ ID NO: 2257662 - RNA, 12 nt, Human
uguccuccuggu

SEQ ID NO: 2257663 - RNA, 19 nt, Human
uguccucucuggcugggga

SEQ ID NO: 2257664 - RNA, 12 nt, Human
uguccugaccac

SEQ ID NO: 2257665 - RNA, 14 nt, Human
uguccugaccaccc

SEQ ID NO: 2257666 - RNA, 15 nt, Human
uguccugaccacccu

SEQ ID NO: 2257667 - RNA, 19 nt, Human
ugucugaagucacugcaca

SEQ ID NO: 2257668 - RNA, 22 nt, Human
ugucugaaggacacuuccugcc

SEQ ID NO: 2257669 - RNA, 23 nt, Human
ugucugaaggacacuuccugccu

SEQ ID NO: 2257670 - RNA, 17 nt, Human
ugucugaagucacugca

SEQ ID NO: 2257671 - RNA, 18 nt, Human
ugucugaagucacugcac

SEQ ID NO: 2257672 - RNA, 16 nt, Human
ugucugaagucacugc

SEQ ID NO: 2257673 - RNA, 17 nt, Human
ugucugaaggacacuuc

SEQ ID NO: 2257674 - RNA, 18 nt, Human
ugucugaaggacacuucc

SEQ ID NO: 2257675 - RNA, 19 nt, Human
ugucugaaggacacuuccu

SEQ ID NO: 2257676 - RNA, 15 nt, Human
ugucuggauucccag

SEQ ID NO: 2257677 - RNA, 19 nt, Human
ugucuggauucccaggaug

SEQ ID NO: 2257678 - RNA, 19 nt, Human
ugucugcuuucuccauugu

SEQ ID NO: 2257679 - RNA, 15 nt, Human
ugucugguuuuaaca

SEQ ID NO: 2257680 - RNA, 15 nt, Human
ugucuggccaggccu

SEQ ID NO: 2257681 - RNA, 16 nt, Human
ugucugguuuuaacaa

SEQ ID NO: 2257682 - RNA, 23 nt, Human
ugucuuuuucuggacugaagccu

SEQ ID NO: 2257683 - RNA, 17 nt, Human
ugucuuuuucuggacug

SEQ ID NO: 2257684 - RNA, 14 nt, Human
ugucuuuugcauga

SEQ ID NO: 2257685 - RNA, 14 nt, Human
ugucuuuugaauau

SEQ ID NO: 2257686 - RNA, 12 nt, Human
ugucuuuugcau

SEQ ID NO: 2257687 - RNA, 23 nt, Human
ugugaaaagaaaaaugagccugg

SEQ ID NO: 2257688 - RNA, 13 nt, Human
ugucuuuugaaua

SEQ ID NO: 2257689 - RNA, 23 nt, Human
ugucuuuucuugcaugaggcuag

SEQ ID NO: 2257690 - RNA, 20 nt, Human
ugucuuuuucuggacugaag

SEQ ID NO: 2257691 - RNA, 17 nt, Human
ugugaaaaucaaauaca

SEQ ID NO: 2257692 - RNA, 13 nt, Human
ugugaaaaugggu

SEQ ID NO: 2257693 - RNA, 14 nt, Human
ugugaaaauggguu

SEQ ID NO: 2257694 - RNA, 16 nt, Human
ugugaaaaugugugug

SEQ ID NO: 2257695 - RNA, 22 nt, Human
ugugaaaaugguccaggagaag

SEQ ID NO: 2257696 - RNA, 18 nt, Human
ugugaaaaugguccagga

SEQ ID NO: 2257697 - RNA, 17 nt, Human
ugugaaaaugugugugu

SEQ ID NO: 2257698 - RNA, 14 nt, Human
ugugaaggacccuu

SEQ ID NO: 2257699 - RNA, 13 nt, Human
ugugaaggacccu

SEQ ID NO: 2257700 - RNA, 15 nt, Human
ugucuuucugagcac

SEQ ID NO: 2257701 - RNA, 16 nt, Human
ugucugucccgggguc

SEQ ID NO: 2257702 - RNA, 21 nt, Human
ugucugucccgggguccugug

SEQ ID NO: 2257703 - RNA, 12 nt, Human
ugucuuucugag

SEQ ID NO: 2257704 - RNA, 14 nt, Human
ugucuuuggacccu

SEQ ID NO: 2257705 - RNA, 16 nt, Human
ugucuuuggacccuga

SEQ ID NO: 2257706 - RNA, 21 nt, Human
ugucuuuucuugcaugaggcu

SEQ ID NO: 2257707 - RNA, 23 nt, Human
ugucuguagcuccucaacucacc

SEQ ID NO: 2257708 - RNA, 17 nt, Human
ugucuguagcuccucaa

SEQ ID NO: 2257709 - RNA, 19 nt, Human
ugucuguagagggcccugg

SEQ ID NO: 2257710 - RNA, 20 nt, Human
ugucuguagagggcccuggu

SEQ ID NO: 2257711 - RNA, 21 nt, Human
ugucuguagagggcccuggug

SEQ ID NO: 2257712 - RNA, 23 nt, Human
ugucuguagagggcccugguguu

SEQ ID NO: 2257713 - RNA, 13 nt, Human
ugucuuuccuaga

SEQ ID NO: 2257714 - RNA, 19 nt, Human
ugucugucucuccaucugu

SEQ ID NO: 2257715 - RNA, 21 nt, Human
ugucuuuccacuccuccuagc

SEQ ID NO: 2257716 - RNA, 13 nt, Human
ugucuguacacgu

SEQ ID NO: 2257717 - RNA, 15 nt, Human
ugucuguacacgugu

SEQ ID NO: 2257718 - RNA, 22 nt, Human
ugucugguuuuaacaauuuccu

SEQ ID NO: 2257719 - RNA, 19 nt, Human
ugucuguacacguguccug

SEQ ID NO: 2257720 - RNA, 20 nt, Human
ugucuguacacguguccugu

SEQ ID NO: 2257721 - RNA, 21 nt, Human
ugucuguacacguguccugua

SEQ ID NO: 2257722 - RNA, 16 nt, Human
ugucuguagagggccc

SEQ ID NO: 2257723 - RNA, 16 nt, Human
uguauuuucuuucucu

SEQ ID NO: 2257724 - RNA, 23 nt, Human
uguauuuuccaagugugcauauu

SEQ ID NO: 2257725 - RNA, 17 nt, Human
ugucacacacuuuggcu

SEQ ID NO: 2257726 - RNA, 12 nt, Human
ugucacaggcag

SEQ ID NO: 2257727 - RNA, 14 nt, Human
ugucacaccagcca

SEQ ID NO: 2257728 - RNA, 15 nt, Human
ugucacaccagccau

SEQ ID NO: 2257729 - RNA, 14 nt, Human
uguauuuuguauug

SEQ ID NO: 2257730 - RNA, 15 nt, Human
ugucacacagggcag

SEQ ID NO: 2257731 - RNA, 13 nt, Human
ugucacaccagcc

SEQ ID NO: 2257732 - RNA, 19 nt, Human
ugucaccaccuucccagcu

SEQ ID NO: 2257733 - RNA, 18 nt, Human
ugucaccaccuucccagc

SEQ ID NO: 2257734 - RNA, 16 nt, Human
ugucaccaccuuccca

SEQ ID NO: 2257735 - RNA, 19 nt, Human
ugucaccggauccugggug

SEQ ID NO: 2257736 - RNA, 18 nt, Human
ugucaccggauccugggu

SEQ ID NO: 2257737 - RNA, 18 nt, Human
ugucacccuccaccucuu

SEQ ID NO: 2257738 - RNA, 22 nt, Human
ugucacccuccaccucuucacc

SEQ ID NO: 2257739 - RNA, 22 nt, Human
ugucacccuuaggccagcacca

SEQ ID NO: 2257740 - RNA, 23 nt, Human
ugucaccaccuucccagcucucc

SEQ ID NO: 2257741 - RNA, 21 nt, Human
ugucaccaccuucccagcucu

SEQ ID NO: 2257742 - RNA, 13 nt, Human
uguauuuaaauau

SEQ ID NO: 2257743 - RNA, 17 nt, Human
uguauuuaugugugagg

SEQ ID NO: 2257744 - RNA, 13 nt, Human
uguauuuauucaa

SEQ ID NO: 2257745 - RNA, 14 nt, Human
uguauuuauucaau

SEQ ID NO: 2257746 - RNA, 17 nt, Human
uguauuuauucaauaaa

SEQ ID NO: 2257747 - RNA, 19 nt, Human
uguauuuauucaauaaagu

SEQ ID NO: 2257748 - RNA, 15 nt, Human
uguauuuauuuaaaa

SEQ ID NO: 2257749 - RNA, 22 nt, Human
uguauuuauucaauaaaguauu

SEQ ID NO: 2257750 - RNA, 14 nt, Human
uguauuuauuccau

SEQ ID NO: 2257751 - RNA, 23 nt, Human
uguauuuauuccauauucaugua

SEQ ID NO: 2257752 - RNA, 20 nt, Human
uguauuuauuuaguauuuau

SEQ ID NO: 2257753 - RNA, 16 nt, Human
uguauuuauuuaaaag

SEQ ID NO: 2257754 - RNA, 18 nt, Human
uguauuuauuuaaaagau

SEQ ID NO: 2257755 - RNA, 20 nt, Human
uguauuuauuuaaaagauuc

SEQ ID NO: 2257756 - RNA, 18 nt, Human
uguauuuuauuuagacaa

SEQ ID NO: 2257757 - RNA, 19 nt, Human
uguauuuuauuuagacaag

SEQ ID NO: 2257758 - RNA, 13 nt, Human
uguauuuuauugu

SEQ ID NO: 2257759 - RNA, 14 nt, Human
uguauuuuauugua

SEQ ID NO: 2257760 - RNA, 21 nt, Human
uguauuuuauuguaacagaca

SEQ ID NO: 2257761 - RNA, 22 nt, Human
uguauuuuauuuagacaagaga

SEQ ID NO: 2257762 - RNA, 10 nt, Human
uguauuuucc

SEQ ID NO: 2257763 - RNA, 12 nt, Human
uguauuuuccaa

SEQ ID NO: 2257764 - RNA, 17 nt, Human
uguauuuuccaagugug

SEQ ID NO: 2257765 - RNA, 18 nt, Human
uguauuuuccaagugugc

SEQ ID NO: 2257766 - RNA, 20 nt, Human
uguauuuuccaagugugcau

SEQ ID NO: 2257767 - RNA, 21 nt, Human
uguauuuuccaagugugcaua

SEQ ID NO: 2257768 - RNA, 22 nt, Human
uguauuuuccaagugugcauau

SEQ ID NO: 2257769 - RNA, 15 nt, Human
uguauuuccagugca

SEQ ID NO: 2257770 - RNA, 20 nt, Human
uguauuuauuuuccucccca

SEQ ID NO: 2257771 - RNA, 19 nt, Human
uguauuuauuuuccucccc

SEQ ID NO: 2257772 - RNA, 18 nt, Human
uguauuuauuuuccuccc

SEQ ID NO: 2257773 - RNA, 23 nt, Human
uguauuuccccaacauguaauaa

SEQ ID NO: 2257774 - RNA, 14 nt, Human
uguauuguucccag

SEQ ID NO: 2257775 - RNA, 13 nt, Human
uguauuguuccca

SEQ ID NO: 2257776 - RNA, 12 nt, Human
uguauuguuccc

SEQ ID NO: 2257777 - RNA, 20 nt, Human
uguauugugucuuuugcaug

SEQ ID NO: 2257778 - RNA, 19 nt, Human
uguauuguucccagugaca

SEQ ID NO: 2257779 - RNA, 15 nt, Human
uguauuguucccagu

SEQ ID NO: 2257780 - RNA, 18 nt, Human
uguauugugucuuuugca

SEQ ID NO: 2257781 - RNA, 19 nt, Human
uguauugugucuuuugcau

SEQ ID NO: 2257782 - RNA, 21 nt, Human
uguauugugucuuuugcauga

SEQ ID NO: 2257783 - RNA, 22 nt, Human
uguauucuuugauguuaacaca

SEQ ID NO: 2257784 - RNA, 19 nt, Human
uguauucuuugauguuaac

SEQ ID NO: 2257785 - RNA, 21 nt, Human
uguauucuuugauguuaacac

SEQ ID NO: 2257786 - RNA, 21 nt, Human
uguauucuuaaauucauuuua

SEQ ID NO: 2257787 - RNA, 16 nt, Human
uguauucuuugauguu

SEQ ID NO: 2257788 - RNA, 17 nt, Human
uguauucuuugauguua

SEQ ID NO: 2257789 - RNA, 18 nt, Human
uguauucuuugauguuaa

SEQ ID NO: 2257790 - RNA, 16 nt, Human
uguauucuuaaauuca

SEQ ID NO: 2257791 - RNA, 18 nt, Human
uguaugauguguugugau

SEQ ID NO: 2257792 - RNA, 21 nt, Human
uguauucucugagcugugcag

SEQ ID NO: 2257793 - RNA, 20 nt, Human
uguauucucugagcugugca

SEQ ID NO: 2257794 - RNA, 19 nt, Human
uguauucucugagcugugc

SEQ ID NO: 2257795 - RNA, 14 nt, Human
uguauucucugagc

SEQ ID NO: 2257796 - RNA, 22 nt, Human
uguauucucuccuguaccucuu

SEQ ID NO: 2257797 - RNA, 13 nt, Human
uguauucucugag

SEQ ID NO: 2257798 - RNA, 19 nt, Human
uguaguuuuucuucaacau

SEQ ID NO: 2257799 - RNA, 20 nt, Human
uguaguuuuaucacauguau

SEQ ID NO: 2257800 - RNA, 13 nt, Human
uguauaaaaauag

SEQ ID NO: 2257801 - RNA, 17 nt, Human
uguauaaaaaaaauagu

SEQ ID NO: 2257802 - RNA, 19 nt, Human
uguaguuuaccucuuuaaa

SEQ ID NO: 2257803 - RNA, 22 nt, Human
uguaguuuuaucacauguaugu

SEQ ID NO: 2257804 - RNA, 21 nt, Human
uguaguugcguggacucugca

SEQ ID NO: 2257805 - RNA, 19 nt, Human
uguaguucuugucugauug

SEQ ID NO: 2257806 - RNA, 15 nt, Human
uguaguugcguggac

SEQ ID NO: 2257807 - RNA, 20 nt, Human
uguaguugcguggacucugc

SEQ ID NO: 2257808 - RNA, 14 nt, Human
uguaguugaacuga

SEQ ID NO: 2257809 - RNA, 20 nt, Human
uguaguugaacugauaguua

SEQ ID NO: 2257810 - RNA, 22 nt, Human
uguaguugcaauagaacagaga

SEQ ID NO: 2257811 - RNA, 13 nt, Human
uguaugauguguu

SEQ ID NO: 2257812 - RNA, 15 nt, Human
uguaugauucccagc

SEQ ID NO: 2257813 - RNA, 22 nt, Human
uguauaaaagggacugagaaau

SEQ ID NO: 2257814 - RNA, 16 nt, Human
ugucacgauugucauc

SEQ ID NO: 2257815 - RNA, 13 nt, Human
ugucaucugugca

SEQ ID NO: 2257816 - RNA, 14 nt, Human
ugucaccugugcuu

SEQ ID NO: 2257817 - RNA, 23 nt, Human
ugucaccgugagcagcuuuggaa

SEQ ID NO: 2257818 - RNA, 18 nt, Human
ugucaccguggaccuucc

SEQ ID NO: 2257819 - RNA, 22 nt, Human
ugucaccgugagcagcuuugga

SEQ ID NO: 2257820 - RNA, 16 nt, Human
ugucaccgugagcagc

SEQ ID NO: 2257821 - RNA, 19 nt, Human
ugucaccguggaccuuccu

SEQ ID NO: 2257822 - RNA, 20 nt, Human
ugucaccguggaccuuccug

SEQ ID NO: 2257823 - RNA, 21 nt, Human
ugucaccguggaccuuccugc

SEQ ID NO: 2257824 - RNA, 22 nt, Human
ugucaccguggaccuuccugcc

SEQ ID NO: 2257825 - RNA, 13 nt, Human
ugucaccugaaga

SEQ ID NO: 2257826 - RNA, 18 nt, Human
ugucauuaaaauaaauaa

SEQ ID NO: 2257827 - RNA, 16 nt, Human
ugucauuuauauagau

SEQ ID NO: 2257828 - RNA, 13 nt, Human
ugucauuaaaaua

SEQ ID NO: 2257829 - RNA, 23 nt, Human
ugucaucuuucuucuauuuuauu

SEQ ID NO: 2257830 - RNA, 12 nt, Human
ugucaugaacau

SEQ ID NO: 2257831 - RNA, 16 nt, Human
ugucaugaacauguuc

SEQ ID NO: 2257832 - RNA, 16 nt, Human
ugucaugaauucuuau

SEQ ID NO: 2257833 - RNA, 19 nt, Human
ugucaugaauucuuaugcu

SEQ ID NO: 2257834 - RNA, 21 nt, Human
ugucaugaauucuuaugcuua

SEQ ID NO: 2257835 - RNA, 14 nt, Human
ugucaugccccccu

SEQ ID NO: 2257836 - RNA, 15 nt, Human
ugucaugccccccuc

SEQ ID NO: 2257837 - RNA, 16 nt, Human
ugucaugccccccuca

SEQ ID NO: 2257838 - RNA, 17 nt, Human
ugucaugccccccucaa

SEQ ID NO: 2257839 - RNA, 23 nt, Human
ugucaugccccccucaaaccucc

SEQ ID NO: 2257840 - RNA, 19 nt, Human
uguccagggcccugagcuc

SEQ ID NO: 2257841 - RNA, 17 nt, Human
uguccagggcccugagc

SEQ ID NO: 2257842 - RNA, 17 nt, Human
ugucauuucauuuccua

SEQ ID NO: 2257843 - RNA, 16 nt, Human
ugucauuucauuuccu

SEQ ID NO: 2257844 - RNA, 19 nt, Human
ugucauuugagcagggcuc

SEQ ID NO: 2257845 - RNA, 16 nt, Human
ugucauuugagcaggg

SEQ ID NO: 2257846 - RNA, 14 nt, Human
ugucauuucauuuc

SEQ ID NO: 2257847 - RNA, 16 nt, Human
ugucccaacuuguaaa

SEQ ID NO: 2257848 - RNA, 23 nt, Human
uguccaguggguagguuggacug

SEQ ID NO: 2257849 - RNA, 13 nt, Human
uguccagugccca

SEQ ID NO: 2257850 - RNA, 14 nt, Human
uguccagugcccau

SEQ ID NO: 2257851 - RNA, 15 nt, Human
uguccagugcccauu

SEQ ID NO: 2257852 - RNA, 16 nt, Human
uguccagugcccauuc

SEQ ID NO: 2257853 - RNA, 17 nt, Human
uguccagugcccauucc

SEQ ID NO: 2257854 - RNA, 18 nt, Human
uguccagugcccauuccu

SEQ ID NO: 2257855 - RNA, 23 nt, Human
uguccagugcccauuccucaccu

SEQ ID NO: 2257856 - RNA, 17 nt, Human
uguccaguucccagaag

SEQ ID NO: 2257857 - RNA, 12 nt, Human
uguccuacucug

SEQ ID NO: 2257858 - RNA, 17 nt, Human
uguccuacucuguguca

SEQ ID NO: 2257859 - RNA, 16 nt, Human
uguccucagccuugcc

SEQ ID NO: 2257860 - RNA, 13 nt, Human
uguccucagccuu

SEQ ID NO: 2257861 - RNA, 12 nt, Human
uguccucagccu

SEQ ID NO: 2257862 - RNA, 18 nt, Human
ugucccccucuguccagg

SEQ ID NO: 2257863 - RNA, 20 nt, Human
ugucccccuaauauuaggga

SEQ ID NO: 2257864 - RNA, 16 nt, Human
uguccccgacccuugc

SEQ ID NO: 2257865 - RNA, 20 nt, Human
uguccuacccacccuccuuu

SEQ ID NO: 2257866 - RNA, 17 nt, Human
uguccccgacccuugcc

SEQ ID NO: 2257867 - RNA, 19 nt, Human
uguccccaguuugcagaaa

SEQ ID NO: 2257868 - RNA, 13 nt, Human
uguccccaccgca

SEQ ID NO: 2257869 - RNA, 23 nt, Human
ugucccaccucuucucuuccugu

SEQ ID NO: 2257870 - RNA, 13 nt, Human
ugucccccagcuc

SEQ ID NO: 2257871 - RNA, 15 nt, Human
ugucccccagcucug

SEQ ID NO: 2257872 - RNA, 16 nt, Human
ugucccccagcucugg

SEQ ID NO: 2257873 - RNA, 17 nt, Human
ugucccccagcucuggu

SEQ ID NO: 2257874 - RNA, 19 nt, Human
uguccccaccgcagacagg

SEQ ID NO: 2257875 - RNA, 22 nt, Human
uguccccaccgcagacaggacc

SEQ ID NO: 2257876 - RNA, 13 nt, Human
ugucccaccagcu

SEQ ID NO: 2257877 - RNA, 18 nt, Human
uguccaugcgcucagggc

SEQ ID NO: 2257878 - RNA, 17 nt, Human
ugucccacccccacccc

SEQ ID NO: 2257879 - RNA, 18 nt, Human
ugucccacccccaccccc

SEQ ID NO: 2257880 - RNA, 22 nt, Human
ugucccacccccacccccagcu

SEQ ID NO: 2257881 - RNA, 12 nt, Human
ugucccaccucu

SEQ ID NO: 2257882 - RNA, 13 nt, Human
ugucccaccucuu

SEQ ID NO: 2257883 - RNA, 21 nt, Human
ugucccaccucuucucuuccu

SEQ ID NO: 2257884 - RNA, 22 nt, Human
ugucccaccucuucucuuccug

SEQ ID NO: 2257885 - RNA, 23 nt, Human
ugucccacccccacccccagcuc

SEQ ID NO: 2257886 - RNA, 18 nt, Human
uguccccaccgcagacag

SEQ ID NO: 2257887 - RNA, 21 nt, Human
uguagccuuccuccacauccu

SEQ ID NO: 2257888 - RNA, 17 nt, Human
uguagccuugcccggau

SEQ ID NO: 2257889 - RNA, 16 nt, Human
uguagccuugcccgga

SEQ ID NO: 2257890 - RNA, 14 nt, Human
uguagcugguuucc

SEQ ID NO: 2257891 - RNA, 14 nt, Human
uguaguuaggaaau

SEQ ID NO: 2257892 - RNA, 13 nt, Human
uguaguuaggaaa

SEQ ID NO: 2257893 - RNA, 12 nt, Human
uguaguuaggaa

SEQ ID NO: 2257894 - RNA, 13 nt, Human
uguaguuaaugau

SEQ ID NO: 2257895 - RNA, 23 nt, Human
uguaguuaggaaauaaaaccuuu

SEQ ID NO: 2257896 - RNA, 15 nt, Human
uguaguuaggaaaua

SEQ ID NO: 2257897 - RNA, 22 nt, Human
uguaguguuggagaagaacuga

SEQ ID NO: 2257898 - RNA, 22 nt, Human
uguagcccacucugcucgccuu

SEQ ID NO: 2257899 - RNA, 17 nt, Human
uguagcccacucugcuc

SEQ ID NO: 2257900 - RNA, 16 nt, Human
uguagcccacucugcu

SEQ ID NO: 2257901 - RNA, 18 nt, Human
uguagcccccuggccucu

SEQ ID NO: 2257902 - RNA, 17 nt, Human
uguagcccccuggccuc

SEQ ID NO: 2257903 - RNA, 16 nt, Human
uguagcccccuggccu

SEQ ID NO: 2257904 - RNA, 22 nt, Human
uguagccaugaccuuacauuuc

SEQ ID NO: 2257905 - RNA, 11 nt, Human
uguagccaugg

SEQ ID NO: 2257906 - RNA, 15 nt, Human
uguagccaugggacc

SEQ ID NO: 2257907 - RNA, 16 nt, Human
uguagccaugggacca

SEQ ID NO: 2257908 - RNA, 14 nt, Human
uguagcccacacuu

SEQ ID NO: 2257909 - RNA, 16 nt, Human
uguagcccacacuuga

SEQ ID NO: 2257910 - RNA, 22 nt, Human
uguagccucgccgucugugaau

SEQ ID NO: 2257911 - RNA, 13 nt, Human
uguagccugugca

SEQ ID NO: 2257912 - RNA, 14 nt, Human
uguagccugugcau

SEQ ID NO: 2257913 - RNA, 15 nt, Human
uguagccugugcaug

SEQ ID NO: 2257914 - RNA, 22 nt, Human
uguagccugugcauguaugucu

SEQ ID NO: 2257915 - RNA, 15 nt, Human
uguagccuuccucca

SEQ ID NO: 2257916 - RNA, 23 nt, Human
uguagccuggauauuauucuugu

SEQ ID NO: 2257917 - RNA, 16 nt, Human
uguagccugugcaugu

SEQ ID NO: 2257918 - RNA, 20 nt, Human
uguagccugugcauguaugu

SEQ ID NO: 2257919 - RNA, 18 nt, Human
uguagccccucuccugga

SEQ ID NO: 2257920 - RNA, 20 nt, Human
uguagcccccuggccucugu

SEQ ID NO: 2257921 - RNA, 19 nt, Human
uguagcccccuggccucug

SEQ ID NO: 2257922 - RNA, 12 nt, Human
uguacugggggu

SEQ ID NO: 2257923 - RNA, 12 nt, Human
uguacuguaguu

SEQ ID NO: 2257924 - RNA, 13 nt, Human
uguacuggggguu

SEQ ID NO: 2257925 - RNA, 18 nt, Human
uguacuguaaagagaccu

SEQ ID NO: 2257926 - RNA, 16 nt, Human
uguacuguaguuuuuc

SEQ ID NO: 2257927 - RNA, 15 nt, Human
uguacuguucugugu

SEQ ID NO: 2257928 - RNA, 23 nt, Human
uguacuguucucuucuugaacac

SEQ ID NO: 2257929 - RNA, 19 nt, Human
uguacugcauaugaaagga

SEQ ID NO: 2257930 - RNA, 15 nt, Human
uguaccuuuuaacac

SEQ ID NO: 2257931 - RNA, 14 nt, Human
uguaccucugccuc

SEQ ID NO: 2257932 - RNA, 21 nt, Human
uguaccuuuugaggagcccca

SEQ ID NO: 2257933 - RNA, 22 nt, Human
uguaccuuuuaacaccugaugu

SEQ ID NO: 2257934 - RNA, 23 nt, Human
uguaccuuuuaacaccugaugug

SEQ ID NO: 2257935 - RNA, 15 nt, Human
uguacgucugacagg

SEQ ID NO: 2257936 - RNA, 22 nt, Human
uguaccuuuugaggagccccag

SEQ ID NO: 2257937 - RNA, 11 nt, Human
uguagcaguga

SEQ ID NO: 2257938 - RNA, 16 nt, Human
uguagauuuauuucau

SEQ ID NO: 2257939 - RNA, 15 nt, Human
uguagauuuauuuca

SEQ ID NO: 2257940 - RNA, 10 nt, Human
uguagccaag

SEQ ID NO: 2257941 - RNA, 18 nt, Human
uguagcauuucuugaugu

SEQ ID NO: 2257942 - RNA, 23 nt, Human
uguagcagugagaaaaagcuccu

SEQ ID NO: 2257943 - RNA, 16 nt, Human
uguagcaucuucugga

SEQ ID NO: 2257944 - RNA, 17 nt, Human
uguagcauuucuugaug

SEQ ID NO: 2257945 - RNA, 21 nt, Human
uguagauauugugaaguacau

SEQ ID NO: 2257946 - RNA, 19 nt, Human
uguagauauugugaaguac

SEQ ID NO: 2257947 - RNA, 18 nt, Human
uguagaucagagcagcag

SEQ ID NO: 2257948 - RNA, 22 nt, Human
uguagauauugugaaguacaua

SEQ ID NO: 2257949 - RNA, 16 nt, Human
uguacuguucuguguc

SEQ ID NO: 2257950 - RNA, 19 nt, Human
uguacuguucugugucuuu

SEQ ID NO: 2257951 - RNA, 11 nt, Human
uguagaugaaa

SEQ ID NO: 2257952 - RNA, 13 nt, Human
uguagaugaaaaa

SEQ ID NO: 2257953 - RNA, 19 nt, Human
uguagaugaaaaagcaugu

SEQ ID NO: 2257954 - RNA, 20 nt, Human
uguagaugaaaaagcaugua

SEQ ID NO: 2257955 - RNA, 21 nt, Human
uguagaugaaaaagcauguac

SEQ ID NO: 2257956 - RNA, 23 nt, Human
uguagaugaaaaagcauguacag

SEQ ID NO: 2257957 - RNA, 15 nt, Human
uguagauucugugga

SEQ ID NO: 2257958 - RNA, 22 nt, Human
uguagaugaaaaagcauguaca

SEQ ID NO: 2257959 - RNA, 20 nt, Human
uguaaucccagcuacucggg

SEQ ID NO: 2257960 - RNA, 23 nt, Human
uguaaucccagcuacucaggagg

SEQ ID NO: 2257961 - RNA, 22 nt, Human
uguaaucccagcuacuugggag

SEQ ID NO: 2257962 - RNA, 16 nt, Human
uguaauccgaaucucu

SEQ ID NO: 2257963 - RNA, 21 nt, Human
uguaaucccagcuacucagga

SEQ ID NO: 2257964 - RNA, 20 nt, Human
uguaaucccagcuacucagg

SEQ ID NO: 2257965 - RNA, 20 nt, Human
uguaaucaauguuucuucua

SEQ ID NO: 2257966 - RNA, 14 nt, Human
uguaaucacagcua

SEQ ID NO: 2257967 - RNA, 13 nt, Human
uguaaucaauaaa

SEQ ID NO: 2257968 - RNA, 14 nt, Human
uguaaucaauaaac

SEQ ID NO: 2257969 - RNA, 15 nt, Human
uguaaucaauaaacg

SEQ ID NO: 2257970 - RNA, 14 nt, Human
uguaaucaauguuu

SEQ ID NO: 2257971 - RNA, 16 nt, Human
uguaaucaauaaacga

SEQ ID NO: 2257972 - RNA, 18 nt, Human
uguaaucaauaaacgauu

SEQ ID NO: 2257973 - RNA, 17 nt, Human
uguaauauaaagauguu

SEQ ID NO: 2257974 - RNA, 21 nt, Human
uguaaucguuauguguguaua

SEQ ID NO: 2257975 - RNA, 16 nt, Human
uguaaucuauguauau

SEQ ID NO: 2257976 - RNA, 17 nt, Human
uguaaucucguuucaaa

SEQ ID NO: 2257977 - RNA, 18 nt, Human
uguaaucucguuucaaaa

SEQ ID NO: 2257978 - RNA, 19 nt, Human
uguaaucguuaugugugua

SEQ ID NO: 2257979 - RNA, 18 nt, Human
uguaaucguuaugugugu

SEQ ID NO: 2257980 - RNA, 16 nt, Human
uguaaucguuaugugu

SEQ ID NO: 2257981 - RNA, 17 nt, Human
uguaaucccagcuacuu

SEQ ID NO: 2257982 - RNA, 15 nt, Human
uguaaucuugaauug

SEQ ID NO: 2257983 - RNA, 19 nt, Human
uguaaucucguuucaaaaa

SEQ ID NO: 2257984 - RNA, 13 nt, Human
uguaauguuacug

SEQ ID NO: 2257985 - RNA, 14 nt, Human
uguaauguuacuga

SEQ ID NO: 2257986 - RNA, 23 nt, Human
uguaaugucaccaccuucccagc

SEQ ID NO: 2257987 - RNA, 21 nt, Human
uguaaucuugaauuguaacug

SEQ ID NO: 2257988 - RNA, 16 nt, Human
uggucacacacugaug

SEQ ID NO: 2257989 - RNA, 15 nt, Human
uggucacacacugau

SEQ ID NO: 2257990 - RNA, 14 nt, Human
uggucacacacuga

SEQ ID NO: 2257991 - RNA, 22 nt, Human
uggucaauccgaaguaugaggg

SEQ ID NO: 2257992 - RNA, 22 nt, Human
uggucaagauuuugaaugcuuc

SEQ ID NO: 2257993 - RNA, 22 nt, Human
ugguauuguauuuauucaauaa

SEQ ID NO: 2257994 - RNA, 19 nt, Human
ugguauuguauuuauucaa

SEQ ID NO: 2257995 - RNA, 13 nt, Human
uggucacagccuc

SEQ ID NO: 2257996 - RNA, 14 nt, Human
uggucacagccucc

SEQ ID NO: 2257997 - RNA, 15 nt, Human
uggucacagccuccu

SEQ ID NO: 2257998 - RNA, 16 nt, Human
uggucacagccuccuc

SEQ ID NO: 2257999 - RNA, 17 nt, Human
uggucacagccuccucu

SEQ ID NO: 2258000 - RNA, 18 nt, Human
uggucacagccuccucug

SEQ ID NO: 2258001 - RNA, 14 nt, Human
uguaaguuucaggu

SEQ ID NO: 2258002 - RNA, 15 nt, Human
uggucacagcggagg

SEQ ID NO: 2258003 - RNA, 21 nt, Human
uggucacagcggaggugugga

SEQ ID NO: 2258004 - RNA, 12 nt, Human
uguaauaaauau

SEQ ID NO: 2258005 - RNA, 13 nt, Human
uguaauaaacuuu

SEQ ID NO: 2258006 - RNA, 15 nt, Human
uguaauaaacuuuaa

SEQ ID NO: 2258007 - RNA, 18 nt, Human
uguaauagaaaacugaaa

SEQ ID NO: 2258008 - RNA, 20 nt, Human
uguaauagaaaacugaaaau

SEQ ID NO: 2258009 - RNA, 16 nt, Human
uguaauagaaaacuga

SEQ ID NO: 2258010 - RNA, 17 nt, Human
uguaauaaacuuuaaua

SEQ ID NO: 2258011 - RNA, 20 nt, Human
uguaauaaaaaguauauguu

SEQ ID NO: 2258012 - RNA, 23 nt, Human
uguaaguuucaggugacauguga

SEQ ID NO: 2258013 - RNA, 15 nt, Human
uguaaguuucaggug

SEQ ID NO: 2258014 - RNA, 16 nt, Human
uguaaguuucagguga

SEQ ID NO: 2258015 - RNA, 18 nt, Human
uguaaguuucaggugaca

SEQ ID NO: 2258016 - RNA, 19 nt, Human
uguaaguuucaggugacau

SEQ ID NO: 2258017 - RNA, 20 nt, Human
uguaaguuucaggugacaug

SEQ ID NO: 2258018 - RNA, 21 nt, Human
uguaaguuucaggugacaugu

SEQ ID NO: 2258019 - RNA, 17 nt, Human
uguacagucuuguauua

SEQ ID NO: 2258020 - RNA, 21 nt, Human
uguacagucuuguauuaaguu

SEQ ID NO: 2258021 - RNA, 18 nt, Human
uguacagagcccacgccc

SEQ ID NO: 2258022 - RNA, 19 nt, Human
uguacaguguguaaagugu

SEQ ID NO: 2258023 - RNA, 11 nt, Human
uguacaguguu

SEQ ID NO: 2258024 - RNA, 17 nt, Human
uguacaguguguaaagu

SEQ ID NO: 2258025 - RNA, 16 nt, Human
uguacaguguucuguu

SEQ ID NO: 2258026 - RNA, 20 nt, Human
uguacaguguucuguuuaau

SEQ ID NO: 2258027 - RNA, 13 nt, Human
uguacaguguucu

SEQ ID NO: 2258028 - RNA, 15 nt, Human
uguacaguuugcugu

SEQ ID NO: 2258029 - RNA, 20 nt, Human
uguacaguucaguuccucuu

SEQ ID NO: 2258030 - RNA, 16 nt, Human
uguacaguuugcugua

SEQ ID NO: 2258031 - RNA, 13 nt, Human
uguacaguuuguu

SEQ ID NO: 2258032 - RNA, 17 nt, Human
uguacaguuauuuaugc

SEQ ID NO: 2258033 - RNA, 14 nt, Human
uguacaguucaguu

SEQ ID NO: 2258034 - RNA, 14 nt, Human
uguacaguuuguuu

SEQ ID NO: 2258035 - RNA, 16 nt, Human
uguacaguuuguuuac

SEQ ID NO: 2258036 - RNA, 17 nt, Human
uguacaguuuguuuaca

SEQ ID NO: 2258037 - RNA, 22 nt, Human
uguacaguuuguuuacacacgu

SEQ ID NO: 2258038 - RNA, 16 nt, Human
uguaccgcaaugugac

SEQ ID NO: 2258039 - RNA, 23 nt, Human
uguacaauugaacuuaaauaaau

SEQ ID NO: 2258040 - RNA, 22 nt, Human
uguacaauugaacuuaaauaaa

SEQ ID NO: 2258041 - RNA, 13 nt, Human
uguacagagccca

SEQ ID NO: 2258042 - RNA, 15 nt, Human
uguacaauauuuaaa

SEQ ID NO: 2258043 - RNA, 14 nt, Human
uguacaauauuuaa

SEQ ID NO: 2258044 - RNA, 17 nt, Human
uguacaauauuuaaaau

SEQ ID NO: 2258045 - RNA, 18 nt, Human
uguacaaugacuuuauug

SEQ ID NO: 2258046 - RNA, 16 nt, Human
uguacagagcccacgc

SEQ ID NO: 2258047 - RNA, 17 nt, Human
uguacagagcccacgcc

SEQ ID NO: 2258048 - RNA, 17 nt, Human
uguaauuaaguacuaug

SEQ ID NO: 2258049 - RNA, 22 nt, Human
uguaauguuacugaucaugcau

SEQ ID NO: 2258050 - RNA, 19 nt, Human
uguaauguuacugaucaug

SEQ ID NO: 2258051 - RNA, 17 nt, Human
uguaauguuacugauca

SEQ ID NO: 2258052 - RNA, 16 nt, Human
uguaauguuacugauc

SEQ ID NO: 2258053 - RNA, 23 nt, Human
uguacaaggacagccccuccucc

SEQ ID NO: 2258054 - RNA, 13 nt, Human
uguaauaaauaug

SEQ ID NO: 2258055 - RNA, 20 nt, Human
uguacaaggacagccccucc

SEQ ID NO: 2258056 - RNA, 16 nt, Human
uguacaaggacagccc

SEQ ID NO: 2258057 - RNA, 21 nt, Human
ugcuaaagaaaaagucaucca

SEQ ID NO: 2258058 - RNA, 22 nt, Human
ugcuaaagaaaaagucauccaa

SEQ ID NO: 2258059 - RNA, 17 nt, Human
ugcuaaauaaaauuugu

SEQ ID NO: 2258060 - RNA, 21 nt, Human
ugcuaaauaaaauuuguugca

SEQ ID NO: 2258061 - RNA, 22 nt, Human
ugcuaaauaaaauuuguugcau

SEQ ID NO: 2258062 - RNA, 23 nt, Human
ugcuaaauaaaauuuguugcaua

SEQ ID NO: 2258063 - RNA, 22 nt, Human
ugcuaaauggucgcccaggaga

SEQ ID NO: 2258064 - RNA, 11 nt, Human
ugcuaaaugua

SEQ ID NO: 2258065 - RNA, 14 nt, Human
ugcuaaauguaaca

SEQ ID NO: 2258066 - RNA, 21 nt, Human
ugcuaaauggucgcccaggag

SEQ ID NO: 2258067 - RNA, 20 nt, Human
ugcuaaauggucgcccagga

SEQ ID NO: 2258068 - RNA, 15 nt, Human
ugcuaaaugugaaug

SEQ ID NO: 2258069 - RNA, 15 nt, Human
ugcuaaauuuucagu

SEQ ID NO: 2258070 - RNA, 13 nt, Human
ugcuaacaucuaa

SEQ ID NO: 2258071 - RNA, 22 nt, Human
ugcuaagacucaguggggaggg

SEQ ID NO: 2258072 - RNA, 16 nt, Human
ugcuaacaucuaaaaa

SEQ ID NO: 2258073 - RNA, 13 nt, Human
ugcuaagaugcuc

SEQ ID NO: 2258074 - RNA, 19 nt, Human
ugcuaaauguaacagucug

SEQ ID NO: 2258075 - RNA, 20 nt, Human
ugcuaaauguaacagucuga

SEQ ID NO: 2258076 - RNA, 15 nt, Human
ugcuaaauguaacag

SEQ ID NO: 2258077 - RNA, 16 nt, Human
ugcuaaauguaacagu

SEQ ID NO: 2258078 - RNA, 17 nt, Human
ugcuaaauguaacaguc

SEQ ID NO: 2258079 - RNA, 18 nt, Human
ugcuaaauguaacagucu

SEQ ID NO: 2258080 - RNA, 21 nt, Human
ugcuaaauuuucaguagggcu

SEQ ID NO: 2258081 - RNA, 14 nt, Human
ugcgccuacaggag

SEQ ID NO: 2258082 - RNA, 16 nt, Human
ugcgccuacaggagug

SEQ ID NO: 2258083 - RNA, 22 nt, Human
ugcgccuacaggagugagcacu

SEQ ID NO: 2258084 - RNA, 19 nt, Human
ugcguccacgagcuguuua

SEQ ID NO: 2258085 - RNA, 16 nt, Human
ugcgaucuucagagca

SEQ ID NO: 2258086 - RNA, 17 nt, Human
ugcgaucuucagagcag

SEQ ID NO: 2258087 - RNA, 14 nt, Human
ugcgugaaacacac

SEQ ID NO: 2258088 - RNA, 20 nt, Human
ugcgucuggaggggccccug

SEQ ID NO: 2258089 - RNA, 21 nt, Human
ugcgucuggaggggccccugc

SEQ ID NO: 2258090 - RNA, 22 nt, Human
ugcgucuggaggggccccugcu

SEQ ID NO: 2258091 - RNA, 23 nt, Human
ugcgucuggaggggccccugcuu

SEQ ID NO: 2258092 - RNA, 23 nt, Human
ugcguccuccucaccucaugccc

SEQ ID NO: 2258093 - RNA, 15 nt, Human
ugcgucuggaggggc

SEQ ID NO: 2258094 - RNA, 14 nt, Human
ugcguccuccucac

SEQ ID NO: 2258095 - RNA, 16 nt, Human
ugcguccuccucaccu

SEQ ID NO: 2258096 - RNA, 19 nt, Human
ugcguccuccucaccucau

SEQ ID NO: 2258097 - RNA, 22 nt, Human
ugcguccuccucaccucaugcc

SEQ ID NO: 2258098 - RNA, 22 nt, Human
ugcgugaaacacaccaggcugu

SEQ ID NO: 2258099 - RNA, 14 nt, Human
ugcgugacaauaaa

SEQ ID NO: 2258100 - RNA, 15 nt, Human
ugcgugacaauaaaa

SEQ ID NO: 2258101 - RNA, 17 nt, Human
ugcgugacaauaaaaca

SEQ ID NO: 2258102 - RNA, 22 nt, Human
ugcgugacaauaaaacauuaau

SEQ ID NO: 2258103 - RNA, 21 nt, Human
ugcgagugugugcaugugugu

SEQ ID NO: 2258104 - RNA, 19 nt, Human
ugcgagugugugcaugugu

SEQ ID NO: 2258105 - RNA, 22 nt, Human
ugcgagugugugcaugugugug

SEQ ID NO: 2258106 - RNA, 14 nt, Human
ugcgaucuggguuc

SEQ ID NO: 2258107 - RNA, 14 nt, Human
ugccuugaagccac

SEQ ID NO: 2258108 - RNA, 21 nt, Human
ugccuugaaccacuucccuca

SEQ ID NO: 2258109 - RNA, 15 nt, Human
ugccuugaaccacuu

SEQ ID NO: 2258110 - RNA, 17 nt, Human
ugccuugaaccacuucc

SEQ ID NO: 2258111 - RNA, 19 nt, Human
ugccuugaaccacuucccu

SEQ ID NO: 2258112 - RNA, 17 nt, Human
ugcgagugugugcaugu

SEQ ID NO: 2258113 - RNA, 13 nt, Human
ugcgagugugugc

SEQ ID NO: 2258114 - RNA, 20 nt, Human
ugcgagugcucauuucagga

SEQ ID NO: 2258115 - RNA, 15 nt, Human
ugccuugaagccacu

SEQ ID NO: 2258116 - RNA, 23 nt, Human
ugccuugaauauccccucccagu

SEQ ID NO: 2258117 - RNA, 15 nt, Human
ugcgaucuggguuca

SEQ ID NO: 2258118 - RNA, 19 nt, Human
ugcgaucuggguucacugc

SEQ ID NO: 2258119 - RNA, 20 nt, Human
ugcgaucuggguucacugca

SEQ ID NO: 2258120 - RNA, 21 nt, Human
ugcgaucuggguucacugcaa

SEQ ID NO: 2258121 - RNA, 23 nt, Human
ugccuucuucggggaacuccugg

SEQ ID NO: 2258122 - RNA, 22 nt, Human
ugccuucuucggggaacuccug

SEQ ID NO: 2258123 - RNA, 12 nt, Human
ugccuucuucuu

SEQ ID NO: 2258124 - RNA, 19 nt, Human
ugccuucuucuuuuugcug

SEQ ID NO: 2258125 - RNA, 21 nt, Human
ugccuucuucggggaacuccu

SEQ ID NO: 2258126 - RNA, 16 nt, Human
ugccuucuucacccag

SEQ ID NO: 2258127 - RNA, 16 nt, Human
ugccuucuaaaggugu

SEQ ID NO: 2258128 - RNA, 14 nt, Human
ugccuucuucaccc

SEQ ID NO: 2258129 - RNA, 16 nt, Human
ugccuucuuuugauua

SEQ ID NO: 2258130 - RNA, 20 nt, Human
ugccuucuucuuuuugcugu

SEQ ID NO: 2258131 - RNA, 21 nt, Human
ugccuucuucuuuuugcuguu

SEQ ID NO: 2258132 - RNA, 22 nt, Human
ugccuucuucuuuuugcuguug

SEQ ID NO: 2258133 - RNA, 15 nt, Human
ugccuucucaacucc

SEQ ID NO: 2258134 - RNA, 17 nt, Human
ugccuucuucacccagc

SEQ ID NO: 2258135 - RNA, 20 nt, Human
ugccuucgcuucuugccucu

SEQ ID NO: 2258136 - RNA, 21 nt, Human
ugccuucgcuucuugccucug

SEQ ID NO: 2258137 - RNA, 22 nt, Human
ugccuucgcuucuugccucugu

SEQ ID NO: 2258138 - RNA, 23 nt, Human
ugccuucgcuucuugccucugug

SEQ ID NO: 2258139 - RNA, 15 nt, Human
ugccuucuaaaggug

SEQ ID NO: 2258140 - RNA, 16 nt, Human
ugccuucuacuuuuaa

SEQ ID NO: 2258141 - RNA, 20 nt, Human
ugccuucgucuuucccaugg

SEQ ID NO: 2258142 - RNA, 16 nt, Human
ugccugugaggcaggg

SEQ ID NO: 2258143 - RNA, 18 nt, Human
ugccugucuguuacacug

SEQ ID NO: 2258144 - RNA, 14 nt, Human
ugccugugaggcag

SEQ ID NO: 2258145 - RNA, 21 nt, Human
ugccugugaacugaacucuga

SEQ ID NO: 2258146 - RNA, 18 nt, Human
ugccugugaacugaacuc

SEQ ID NO: 2258147 - RNA, 17 nt, Human
ugccugugaacugaacu

SEQ ID NO: 2258148 - RNA, 20 nt, Human
ugccucgaacuggcugcaaa

SEQ ID NO: 2258149 - RNA, 18 nt, Human
ugccucgaacuggcugca

SEQ ID NO: 2258150 - RNA, 19 nt, Human
ugccucgaacuggcugcaa

SEQ ID NO: 2258151 - RNA, 14 nt, Human
ugccccuggcucug

SEQ ID NO: 2258152 - RNA, 18 nt, Human
ugccccuguucucuucca

SEQ ID NO: 2258153 - RNA, 19 nt, Human
ugccccuucccaucucuuc

SEQ ID NO: 2258154 - RNA, 21 nt, Human
ugccccuucccaucucuuccu

SEQ ID NO: 2258155 - RNA, 23 nt, Human
ugccucgaaacacagaaaccuuu

SEQ ID NO: 2258156 - RNA, 18 nt, Human
ugccccuggcagccccug

SEQ ID NO: 2258157 - RNA, 17 nt, Human
ugccccucccugcuuca

SEQ ID NO: 2258158 - RNA, 15 nt, Human
ugccccucccugcuu

SEQ ID NO: 2258159 - RNA, 13 nt, Human
ugccccuggcugg

SEQ ID NO: 2258160 - RNA, 18 nt, Human
ugccucucaucaacugaa

SEQ ID NO: 2258161 - RNA, 21 nt, Human
ugccucucaucaacugaauga

SEQ ID NO: 2258162 - RNA, 18 nt, Human
ugccucucccuggcccuc

SEQ ID NO: 2258163 - RNA, 16 nt, Human
ugccucuccuuuguau

SEQ ID NO: 2258164 - RNA, 17 nt, Human
ugccucuccuuuguaua

SEQ ID NO: 2258165 - RNA, 15 nt, Human
ugccucuucugggag

SEQ ID NO: 2258166 - RNA, 20 nt, Human
ugccucuccuuuguauauua

SEQ ID NO: 2258167 - RNA, 9 nt, Human
ugccucucu

SEQ ID NO: 2258168 - RNA, 14 nt, Human
ugccucuuuccugu

SEQ ID NO: 2258169 - RNA, 16 nt, Human
ugccucuuucauccac

SEQ ID NO: 2258170 - RNA, 17 nt, Human
ugccucuuucauccacu

SEQ ID NO: 2258171 - RNA, 15 nt, Human
ugccucuuucaucca

SEQ ID NO: 2258172 - RNA, 13 nt, Human
ugccucuucuggg

SEQ ID NO: 2258173 - RNA, 16 nt, Human
ugccucuucugugggu

SEQ ID NO: 2258174 - RNA, 21 nt, Human
ugccucuucugggagggcagc

SEQ ID NO: 2258175 - RNA, 20 nt, Human
ugccucuucugggagggcag

SEQ ID NO: 2258176 - RNA, 19 nt, Human
ugccucuucugggagggca

SEQ ID NO: 2258177 - RNA, 16 nt, Human
ugccucuucugggagg

SEQ ID NO: 2258178 - RNA, 18 nt, Human
ugccucuuuccuguuguu

SEQ ID NO: 2258179 - RNA, 13 nt, Human
ugccugaacaucc

SEQ ID NO: 2258180 - RNA, 14 nt, Human
ugccugaacauccu

SEQ ID NO: 2258181 - RNA, 17 nt, Human
ugccugaacauccuucc

SEQ ID NO: 2258182 - RNA, 20 nt, Human
ugccugaacauccuuccuuc

SEQ ID NO: 2258183 - RNA, 21 nt, Human
ugccugaacauccuuccuucc

SEQ ID NO: 2258184 - RNA, 13 nt, Human
ugccugaagaaca

SEQ ID NO: 2258185 - RNA, 16 nt, Human
ugccugaaccuuccau

SEQ ID NO: 2258186 - RNA, 22 nt, Human
ugccugaacauccuuccuuccc

SEQ ID NO: 2258187 - RNA, 22 nt, Human
ugccugggaguuuuguauucau

SEQ ID NO: 2258188 - RNA, 19 nt, Human
ugccuggugcacugugucu

SEQ ID NO: 2258189 - RNA, 22 nt, Human
ugccugggcucccuugugcgug

SEQ ID NO: 2258190 - RNA, 16 nt, Human
ugccugggaauguauu

SEQ ID NO: 2258191 - RNA, 15 nt, Human
ugccugggaauguau

SEQ ID NO: 2258192 - RNA, 18 nt, Human
ugccugggcagaaggaag

SEQ ID NO: 2258193 - RNA, 14 nt, Human
ugccugggaaugua

SEQ ID NO: 2258194 - RNA, 16 nt, Human
ugccuggcucagagcc

SEQ ID NO: 2258195 - RNA, 22 nt, Human
ugccuggcuucgcaaaauguuu

SEQ ID NO: 2258196 - RNA, 11 nt, Human
ugccuggcuca

SEQ ID NO: 2258197 - RNA, 13 nt, Human
ugccuggcucaga

SEQ ID NO: 2258198 - RNA, 15 nt, Human
ugccuggcucagagc

SEQ ID NO: 2258199 - RNA, 21 nt, Human
ugccugggaucccucauccuc

SEQ ID NO: 2258200 - RNA, 11 nt, Human
ugccugagcuu

SEQ ID NO: 2258201 - RNA, 19 nt, Human
ugccugagaggcaggcaua

SEQ ID NO: 2258202 - RNA, 14 nt, Human
ugccugagggcccc

SEQ ID NO: 2258203 - RNA, 15 nt, Human
ugccugagaggcagg

SEQ ID NO: 2258204 - RNA, 16 nt, Human
ugccugagaggcaggc

SEQ ID NO: 2258205 - RNA, 17 nt, Human
ugccugagaggcaggca

SEQ ID NO: 2258206 - RNA, 18 nt, Human
ugccugagaggcaggcau

SEQ ID NO: 2258207 - RNA, 18 nt, Human
ugccugacauuuggagug

SEQ ID NO: 2258208 - RNA, 23 nt, Human
ugccugacccuacuucuuuugcu

SEQ ID NO: 2258209 - RNA, 13 nt, Human
ugccugagaggca

SEQ ID NO: 2258210 - RNA, 14 nt, Human
ugccugagaggcag

SEQ ID NO: 2258211 - RNA, 19 nt, Human
ugccugagggcgaggggag

SEQ ID NO: 2258212 - RNA, 15 nt, Human
ugccuggcggggugg

SEQ ID NO: 2258213 - RNA, 15 nt, Human
ugccugagggccccu

SEQ ID NO: 2258214 - RNA, 16 nt, Human
ugccugagggccccuc

SEQ ID NO: 2258215 - RNA, 17 nt, Human
ugccugagggccccucu

SEQ ID NO: 2258216 - RNA, 19 nt, Human
ugccugagggccccucugc

SEQ ID NO: 2258217 - RNA, 20 nt, Human
ugccugagggccccucugcc

SEQ ID NO: 2258218 - RNA, 21 nt, Human
ugccugagggccccucugccc

SEQ ID NO: 2258219 - RNA, 22 nt, Human
ugccugagggccccucugccca

SEQ ID NO: 2258220 - RNA, 23 nt, Human
ugccugagggccccucugcccag

SEQ ID NO: 2258221 - RNA, 14 nt, Human
ugccugguggcagc

SEQ ID NO: 2258222 - RNA, 15 nt, Human
ugccugguggcagcu

SEQ ID NO: 2258223 - RNA, 16 nt, Human
ugccugguggcagcug

SEQ ID NO: 2258224 - RNA, 18 nt, Human
ugccuguaaucacagcua

SEQ ID NO: 2258225 - RNA, 15 nt, Human
ugccuguaacuugag

SEQ ID NO: 2258226 - RNA, 11 nt, Human
ugccuguaauc

SEQ ID NO: 2258227 - RNA, 19 nt, Human
ugccuguaaucccagcacu

SEQ ID NO: 2258228 - RNA, 15 nt, Human
ugccuguaaacauag

SEQ ID NO: 2258229 - RNA, 23 nt, Human
ugccuguagcccacucugcucgc

SEQ ID NO: 2258230 - RNA, 20 nt, Human
ugccuguagcccacucugcu

SEQ ID NO: 2258231 - RNA, 18 nt, Human
ugccuguagcccacucug

SEQ ID NO: 2258232 - RNA, 19 nt, Human
ugccuguacucgcuugugc

SEQ ID NO: 2258233 - RNA, 22 nt, Human
ugccuguacucgcuugugcaga

SEQ ID NO: 2258234 - RNA, 13 nt, Human
ugccuguaguuag

SEQ ID NO: 2258235 - RNA, 15 nt, Human
ugccuguagcaguga

SEQ ID NO: 2258236 - RNA, 23 nt, Human
ugccugucuccuuugcaggcuca

SEQ ID NO: 2258237 - RNA, 22 nt, Human
ugccugucuccuuugcaggcuc

SEQ ID NO: 2258238 - RNA, 14 nt, Human
ugccugugaacuga

SEQ ID NO: 2258239 - RNA, 18 nt, Human
ugccugucugucucucca

SEQ ID NO: 2258240 - RNA, 14 nt, Human
ugccugucugaagc

SEQ ID NO: 2258241 - RNA, 21 nt, Human
ugccugucugucucuccaucu

SEQ ID NO: 2258242 - RNA, 19 nt, Human
ugcugcaccaacccagccg

SEQ ID NO: 2258243 - RNA, 15 nt, Human
ugcugcaugccuggu

SEQ ID NO: 2258244 - RNA, 23 nt, Human
ugcugcaguugccagucaccccg

SEQ ID NO: 2258245 - RNA, 18 nt, Human
ugcugcaguugccaguca

SEQ ID NO: 2258246 - RNA, 15 nt, Human
ugcugcaaggccuuu

SEQ ID NO: 2258247 - RNA, 20 nt, Human
ugcugcaaggccuuucugug

SEQ ID NO: 2258248 - RNA, 23 nt, Human
ugcugcaaggccuuucugugugu

SEQ ID NO: 2258249 - RNA, 14 nt, Human
ugcugcaccaaccc

SEQ ID NO: 2258250 - RNA, 17 nt, Human
ugcugcaccaacccagc

SEQ ID NO: 2258251 - RNA, 18 nt, Human
ugcugcaccaacccagcc

SEQ ID NO: 2258252 - RNA, 20 nt, Human
ugcugcaccaacccagccgc

SEQ ID NO: 2258253 - RNA, 15 nt, Human
ugcugcgcccuuccc

SEQ ID NO: 2258254 - RNA, 20 nt, Human
ugcugcgcccuuaccuuccc

SEQ ID NO: 2258255 - RNA, 17 nt, Human
ugcugcgcccugggcuc

SEQ ID NO: 2258256 - RNA, 16 nt, Human
ugcugcgcccuuaccu

SEQ ID NO: 2258257 - RNA, 20 nt, Human
ugcugccuucuggauucuug

SEQ ID NO: 2258258 - RNA, 14 nt, Human
ugcugcgugccugu

SEQ ID NO: 2258259 - RNA, 17 nt, Human
ugcugcuaaucuucagg

SEQ ID NO: 2258260 - RNA, 22 nt, Human
ugcugcuaaucuucagggcacu

SEQ ID NO: 2258261 - RNA, 21 nt, Human
ugcugcuaaucuucagggcac

SEQ ID NO: 2258262 - RNA, 14 nt, Human
ugcugcuacccucc

SEQ ID NO: 2258263 - RNA, 15 nt, Human
ugcugcuacccuccc

SEQ ID NO: 2258264 - RNA, 17 nt, Human
ugcugcuacccucccug

SEQ ID NO: 2258265 - RNA, 18 nt, Human
ugcugcuacccucccugc

SEQ ID NO: 2258266 - RNA, 19 nt, Human
ugcugcuacccucccugcu

SEQ ID NO: 2258267 - RNA, 20 nt, Human
ugcugcuacccucccugcug

SEQ ID NO: 2258268 - RNA, 21 nt, Human
ugcugcuacccucccugcugu

SEQ ID NO: 2258269 - RNA, 22 nt, Human
ugcugcuacccucccugcuguc

SEQ ID NO: 2258270 - RNA, 23 nt, Human
ugcugcuacccucccugcugucc

SEQ ID NO: 2258271 - RNA, 13 nt, Human
ugcugcuggcugg

SEQ ID NO: 2258272 - RNA, 23 nt, Human
ugcugcuggacaguaucacuguc

SEQ ID NO: 2258273 - RNA, 13 nt, Human
ugcugcuggacag

SEQ ID NO: 2258274 - RNA, 15 nt, Human
ugcugcuacuuaauu

SEQ ID NO: 2258275 - RNA, 20 nt, Human
ugcugcuuuuccuuggggca

SEQ ID NO: 2258276 - RNA, 20 nt, Human
ugcugcuuuuugagguggca

SEQ ID NO: 2258277 - RNA, 17 nt, Human
ugcugcuuuuccuuggg

SEQ ID NO: 2258278 - RNA, 22 nt, Human
ugcugcuuuuugagguggcacu

SEQ ID NO: 2258279 - RNA, 23 nt, Human
ugcugcuuuuugagguggcacuu

SEQ ID NO: 2258280 - RNA, 17 nt, Human
ugcuggaauaaguucaa

SEQ ID NO: 2258281 - RNA, 16 nt, Human
ugcuggaauucuaaca

SEQ ID NO: 2258282 - RNA, 21 nt, Human
ugcugcuuuccccugugggga

SEQ ID NO: 2258283 - RNA, 23 nt, Human
ugcugcuuuccccuguggggauc

SEQ ID NO: 2258284 - RNA, 16 nt, Human
ugcugcuuuccccugu

SEQ ID NO: 2258285 - RNA, 17 nt, Human
ugcugcuuuccccugug

SEQ ID NO: 2258286 - RNA, 18 nt, Human
ugcugcuuuccccugugg

SEQ ID NO: 2258287 - RNA, 19 nt, Human
ugcugcuuuccccuguggg

SEQ ID NO: 2258288 - RNA, 13 nt, Human
ugcugcugucccu

SEQ ID NO: 2258289 - RNA, 14 nt, Human
ugcugcuguguuuu

SEQ ID NO: 2258290 - RNA, 20 nt, Human
ugcugcuuagacauaacaaa

SEQ ID NO: 2258291 - RNA, 15 nt, Human
ugcugcuuuccccug

SEQ ID NO: 2258292 - RNA, 15 nt, Human
ugcugacagcugacc

SEQ ID NO: 2258293 - RNA, 15 nt, Human
ugcugacagcugcuc

SEQ ID NO: 2258294 - RNA, 14 nt, Human
ugcugacagcugcu

SEQ ID NO: 2258295 - RNA, 18 nt, Human
ugcugacagcugcuccua

SEQ ID NO: 2258296 - RNA, 17 nt, Human
ugcugacagcugcuccu

SEQ ID NO: 2258297 - RNA, 16 nt, Human
ugcugacagcugcucc

SEQ ID NO: 2258298 - RNA, 13 nt, Human
ugcugauggugca

SEQ ID NO: 2258299 - RNA, 15 nt, Human
ugcugauggugcaau

SEQ ID NO: 2258300 - RNA, 17 nt, Human
ugcugauggugcaauga

SEQ ID NO: 2258301 - RNA, 13 nt, Human
ugcugcaaaccug

SEQ ID NO: 2258302 - RNA, 13 nt, Human
ugcugcaaggccu

SEQ ID NO: 2258303 - RNA, 20 nt, Human
ugcugcaaaccugaccccug

SEQ ID NO: 2258304 - RNA, 14 nt, Human
ugcugcaaaccuga

SEQ ID NO: 2258305 - RNA, 18 nt, Human
ugcugauggugcaaugac

SEQ ID NO: 2258306 - RNA, 18 nt, Human
ugcugauuuggugaccaa

SEQ ID NO: 2258307 - RNA, 22 nt, Human
ugcugacagacacaggcccggc

SEQ ID NO: 2258308 - RNA, 23 nt, Human
ugcugacagacacaggcccggcu

SEQ ID NO: 2258309 - RNA, 13 nt, Human
ugcugaaggcucg

SEQ ID NO: 2258310 - RNA, 21 nt, Human
ugcugaaggcucgagcaugcc

SEQ ID NO: 2258311 - RNA, 23 nt, Human
ugcugaaggaauaaauugcuccu

SEQ ID NO: 2258312 - RNA, 12 nt, Human
ugcugaaggcuc

SEQ ID NO: 2258313 - RNA, 14 nt, Human
ugcugaagcugccu

SEQ ID NO: 2258314 - RNA, 21 nt, Human
ugcugaacauugcauauaacu

SEQ ID NO: 2258315 - RNA, 20 nt, Human
ugcugaacaaaaaauaaaaa

SEQ ID NO: 2258316 - RNA, 16 nt, Human
ugcugaacaccuugug

SEQ ID NO: 2258317 - RNA, 21 nt, Human
ugcugaacaccuuguggaagc

SEQ ID NO: 2258318 - RNA, 19 nt, Human
ugcugaacauugcauauaa

SEQ ID NO: 2258319 - RNA, 14 nt, Human
ugcugaacagugga

SEQ ID NO: 2258320 - RNA, 22 nt, Human
ugcucagggaaaagcagcucuc

SEQ ID NO: 2258321 - RNA, 21 nt, Human
ugcucagggaaaagcagcucu

SEQ ID NO: 2258322 - RNA, 19 nt, Human
ugcucaggggcguguggcu

SEQ ID NO: 2258323 - RNA, 14 nt, Human
ugcucagggcugac

SEQ ID NO: 2258324 - RNA, 17 nt, Human
ugcucagcucugggcca

SEQ ID NO: 2258325 - RNA, 21 nt, Human
ugcucagcccuggaggugcca

SEQ ID NO: 2258326 - RNA, 23 nt, Human
ugcucagcccuggaggugccagc

SEQ ID NO: 2258327 - RNA, 14 nt, Human
ugcucagcccugga

SEQ ID NO: 2258328 - RNA, 15 nt, Human
ugcucagcccuggag

SEQ ID NO: 2258329 - RNA, 16 nt, Human
ugcucagcccuggagg

SEQ ID NO: 2258330 - RNA, 20 nt, Human
ugcucagcccuggaggugcc

SEQ ID NO: 2258331 - RNA, 12 nt, Human
ugcucagcagcu

SEQ ID NO: 2258332 - RNA, 11 nt, Human
ugcucagcccu

SEQ ID NO: 2258333 - RNA, 12 nt, Human
ugcucagcccug

SEQ ID NO: 2258334 - RNA, 13 nt, Human
ugcucagcccugg

SEQ ID NO: 2258335 - RNA, 22 nt, Human
ugcucagcccugacuggugcua

SEQ ID NO: 2258336 - RNA, 13 nt, Human
ugcucagcccuga

SEQ ID NO: 2258337 - RNA, 17 nt, Human
ugcucagcccugacugg

SEQ ID NO: 2258338 - RNA, 20 nt, Human
ugcucagggucaauuucuuu

SEQ ID NO: 2258339 - RNA, 16 nt, Human
ugcucagggucaauuu

SEQ ID NO: 2258340 - RNA, 17 nt, Human
ugcucaguaauuugagg

SEQ ID NO: 2258341 - RNA, 16 nt, Human
ugcucagucucccuuu

SEQ ID NO: 2258342 - RNA, 14 nt, Human
ugcuccucucccca

SEQ ID NO: 2258343 - RNA, 19 nt, Human
ugcucagugucuggcugca

SEQ ID NO: 2258344 - RNA, 23 nt, Human
ugcuccuccuuggugccuggccu

SEQ ID NO: 2258345 - RNA, 14 nt, Human
ugcucagucucccu

SEQ ID NO: 2258346 - RNA, 11 nt, Human
ugcuccucucc

SEQ ID NO: 2258347 - RNA, 12 nt, Human
ugcuccucucca

SEQ ID NO: 2258348 - RNA, 13 nt, Human
ugcuccucuccag

SEQ ID NO: 2258349 - RNA, 17 nt, Human
ugcucagaccagcucuu

SEQ ID NO: 2258350 - RNA, 15 nt, Human
ugcucacaccccauu

SEQ ID NO: 2258351 - RNA, 13 nt, Human
ugcucacagucuc

SEQ ID NO: 2258352 - RNA, 16 nt, Human
ugcucagaccagcucu

SEQ ID NO: 2258353 - RNA, 17 nt, Human
ugcucagagcaguguuu

SEQ ID NO: 2258354 - RNA, 15 nt, Human
ugcucacauaucugu

SEQ ID NO: 2258355 - RNA, 16 nt, Human
ugcucacauaucuguc

SEQ ID NO: 2258356 - RNA, 18 nt, Human
ugcucaaugacucucugg

SEQ ID NO: 2258357 - RNA, 14 nt, Human
ugcucacaccccau

SEQ ID NO: 2258358 - RNA, 21 nt, Human
ugcucaauaaaugauucuuag

SEQ ID NO: 2258359 - RNA, 18 nt, Human
ugcuaagccccagcaagc

SEQ ID NO: 2258360 - RNA, 15 nt, Human
ugcucaagaagacau

SEQ ID NO: 2258361 - RNA, 22 nt, Human
ugcucaagaagacauggagacu

SEQ ID NO: 2258362 - RNA, 15 nt, Human
ugcuaagccccagca

SEQ ID NO: 2258363 - RNA, 16 nt, Human
ugcuaagaugcucuau

SEQ ID NO: 2258364 - RNA, 15 nt, Human
ugcuaagcauuccaa

SEQ ID NO: 2258365 - RNA, 19 nt, Human
ugcuaagcauuccaacuau

SEQ ID NO: 2258366 - RNA, 18 nt, Human
ugcugaacaaaaaauaaa

SEQ ID NO: 2258367 - RNA, 15 nt, Human
ugcugaacaaaaaau

SEQ ID NO: 2258368 - RNA, 20 nt, Human
ugcugaaagcccaaguaggg

SEQ ID NO: 2258369 - RNA, 17 nt, Human
ugcugaaauuuuauaug

SEQ ID NO: 2258370 - RNA, 17 nt, Human
ugcugaaacaggagaga

SEQ ID NO: 2258371 - RNA, 16 nt, Human
ugcugaaaccaagggg

SEQ ID NO: 2258372 - RNA, 15 nt, Human
ugcugaaacaggaga

SEQ ID NO: 2258373 - RNA, 15 nt, Human
ugcucuccccugccc

SEQ ID NO: 2258374 - RNA, 18 nt, Human
ugcucuccuuccuggagc

SEQ ID NO: 2258375 - RNA, 23 nt, Human
ugcucuccuuccuggagcccaga

SEQ ID NO: 2258376 - RNA, 22 nt, Human
ugcucuccucuugccacugccu

SEQ ID NO: 2258377 - RNA, 12 nt, Human
ugcucuccuucc

SEQ ID NO: 2258378 - RNA, 17 nt, Human
ugcucuccuuccuggag

SEQ ID NO: 2258379 - RNA, 13 nt, Human
ugcucuccccugc

SEQ ID NO: 2258380 - RNA, 12 nt, Human
ugcucuccccug

SEQ ID NO: 2258381 - RNA, 20 nt, Human
ugcucuccaagucucagugg

SEQ ID NO: 2258382 - RNA, 18 nt, Human
ugcucuccaagucucagu

SEQ ID NO: 2258383 - RNA, 19 nt, Human
ugcucuccaagucucagug

SEQ ID NO: 2258384 - RNA, 17 nt, Human
ugcucuccaagcccagu

SEQ ID NO: 2258385 - RNA, 16 nt, Human
ugcucuccucuugcca

SEQ ID NO: 2258386 - RNA, 14 nt, Human
ugcucuccccugcc

SEQ ID NO: 2258387 - RNA, 14 nt, Human
ugcucuccucuugc

SEQ ID NO: 2258388 - RNA, 18 nt, Human
ugcucuccucuugccacu

SEQ ID NO: 2258389 - RNA, 21 nt, Human
ugcucuccucuugccacugcc

SEQ ID NO: 2258390 - RNA, 18 nt, Human
ugcucgcuguugcugaau

SEQ ID NO: 2258391 - RNA, 15 nt, Human
ugcucgcuguugcug

SEQ ID NO: 2258392 - RNA, 17 nt, Human
ugcucgcuguugcugaa

SEQ ID NO: 2258393 - RNA, 14 nt, Human
ugcucgcccugcgg

SEQ ID NO: 2258394 - RNA, 13 nt, Human
ugcucgcccugcg

SEQ ID NO: 2258395 - RNA, 13 nt, Human
ugcucgcuguugc

SEQ ID NO: 2258396 - RNA, 14 nt, Human
ugcucgcuguugcu

SEQ ID NO: 2258397 - RNA, 21 nt, Human
ugcucuauuguagcauuucuu

SEQ ID NO: 2258398 - RNA, 12 nt, Human
ugcucuauugua

SEQ ID NO: 2258399 - RNA, 21 nt, Human
ugcucuaucuugcucuguaau

SEQ ID NO: 2258400 - RNA, 14 nt, Human
ugcucuaucuugcu

SEQ ID NO: 2258401 - RNA, 20 nt, Human
ugcucuaucuugcucuguaa

SEQ ID NO: 2258402 - RNA, 20 nt, Human
ugcucuaugugcuuguaaaa

SEQ ID NO: 2258403 - RNA, 23 nt, Human
ugcucgauuauucccuguacaau

SEQ ID NO: 2258404 - RNA, 17 nt, Human
ugcucgagacacaguga

SEQ ID NO: 2258405 - RNA, 23 nt, Human
ugcuccuuguuccuagaguagag

SEQ ID NO: 2258406 - RNA, 16 nt, Human
ugcucgccccagcagg

SEQ ID NO: 2258407 - RNA, 14 nt, Human
ugcucgccccagca

SEQ ID NO: 2258408 - RNA, 18 nt, Human
ugcuccuuucuuguuuua

SEQ ID NO: 2258409 - RNA, 17 nt, Human
ugcuccucuccccagca

SEQ ID NO: 2258410 - RNA, 18 nt, Human
ugcuccucuccccagcaa

SEQ ID NO: 2258411 - RNA, 16 nt, Human
ugcuccuuguuccuag

SEQ ID NO: 2258412 - RNA, 17 nt, Human
ugcuccuuguuccuaga

SEQ ID NO: 2258413 - RNA, 16 nt, Human
ugcuccucuccaggca

SEQ ID NO: 2258414 - RNA, 14 nt, Human
ugcuccucuccagg

SEQ ID NO: 2258415 - RNA, 15 nt, Human
ugcuccucuccaggc

SEQ ID NO: 2258416 - RNA, 17 nt, Human
ugcauauauacauauau

SEQ ID NO: 2258417 - RNA, 13 nt, Human
ugcauauccugag

SEQ ID NO: 2258418 - RNA, 21 nt, Human
ugcauauaacuuauauuguaa

SEQ ID NO: 2258419 - RNA, 20 nt, Human
ugcauauaacuuauauugua

SEQ ID NO: 2258420 - RNA, 22 nt, Human
ugcauauaacuuauauuguaag

SEQ ID NO: 2258421 - RNA, 15 nt, Human
ugcaguugccaguca

SEQ ID NO: 2258422 - RNA, 14 nt, Human
ugcaguucugcagc

SEQ ID NO: 2258423 - RNA, 16 nt, Human
ugcaguugacagcagg

SEQ ID NO: 2258424 - RNA, 17 nt, Human
ugcaguugacagcaggu

SEQ ID NO: 2258425 - RNA, 13 nt, Human
ugcaguugccagu

SEQ ID NO: 2258426 - RNA, 14 nt, Human
ugcaguugccaguc

SEQ ID NO: 2258427 - RNA, 19 nt, Human
ugcaguucugaagaagaug

SEQ ID NO: 2258428 - RNA, 22 nt, Human
ugcaguucugaagaagauggua

SEQ ID NO: 2258429 - RNA, 22 nt, Human
ugcagugguaugaucacggcuc

SEQ ID NO: 2258430 - RNA, 17 nt, Human
ugcaguggcucacgccu

SEQ ID NO: 2258431 - RNA, 21 nt, Human
ugcagugcucgcuguugcuga

SEQ ID NO: 2258432 - RNA, 22 nt, Human
ugcagugcucgcuguugcugaa

SEQ ID NO: 2258433 - RNA, 23 nt, Human
ugcagugcucgcuguugcugaau

SEQ ID NO: 2258434 - RNA, 15 nt, Human
ugcaguucugaagaa

SEQ ID NO: 2258435 - RNA, 16 nt, Human
ugcaguucugaagaag

SEQ ID NO: 2258436 - RNA, 17 nt, Human
ugcaguucugaagaaga

SEQ ID NO: 2258437 - RNA, 18 nt, Human
ugcaguucugaagaagau

SEQ ID NO: 2258438 - RNA, 15 nt, Human
ugcaggccaggccag

SEQ ID NO: 2258439 - RNA, 21 nt, Human
ugcaggccaagagcagaggca

SEQ ID NO: 2258440 - RNA, 20 nt, Human
ugcaggccaagagcagaggc

SEQ ID NO: 2258441 - RNA, 16 nt, Human
ugcaggcaucacagcu

SEQ ID NO: 2258442 - RNA, 21 nt, Human
ugcaggcaugcaugugcuugu

SEQ ID NO: 2258443 - RNA, 10 nt, Human
ugcaggcccc

SEQ ID NO: 2258444 - RNA, 12 nt, Human
ugcaggcccugg

SEQ ID NO: 2258445 - RNA, 15 nt, Human
ugcaggcccuggccu

SEQ ID NO: 2258446 - RNA, 16 nt, Human
ugcaggcccuggccuc

SEQ ID NO: 2258447 - RNA, 20 nt, Human
ugcaggcccuggccuccccu

SEQ ID NO: 2258448 - RNA, 23 nt, Human
ugcagugauauggcagaagacac

SEQ ID NO: 2258449 - RNA, 21 nt, Human
ugcagugauauggcagaagac

SEQ ID NO: 2258450 - RNA, 22 nt, Human
ugcagugauauggcagaagaca

SEQ ID NO: 2258451 - RNA, 16 nt, Human
ugcagugccccuagcu

SEQ ID NO: 2258452 - RNA, 17 nt, Human
ugcagugccccuagcuu

SEQ ID NO: 2258453 - RNA, 19 nt, Human
ugcaggccccgcuugucca

SEQ ID NO: 2258454 - RNA, 17 nt, Human
ugcagugauauggcaga

SEQ ID NO: 2258455 - RNA, 20 nt, Human
ugcagugauauggcagaaga

SEQ ID NO: 2258456 - RNA, 17 nt, Human
ugcaggcccuggccucc

SEQ ID NO: 2258457 - RNA, 19 nt, Human
ugcaggcccuggccucccc

SEQ ID NO: 2258458 - RNA, 16 nt, Human
ugcagugcuuccaagg

SEQ ID NO: 2258459 - RNA, 17 nt, Human
ugcagugcucgcuguug

SEQ ID NO: 2258460 - RNA, 12 nt, Human
ugcagugccuug

SEQ ID NO: 2258461 - RNA, 23 nt, Human
ugcagugccuuggggaauuuccu

SEQ ID NO: 2258462 - RNA, 19 nt, Human
ugcagugcucgcuguugcu

SEQ ID NO: 2258463 - RNA, 20 nt, Human
ugcagugcucgcuguugcug

SEQ ID NO: 2258464 - RNA, 14 nt, Human
ugcagcagaggcac

SEQ ID NO: 2258465 - RNA, 20 nt, Human
ugcagcagcgguggccucuu

SEQ ID NO: 2258466 - RNA, 14 nt, Human
ugcagcagggaugc

SEQ ID NO: 2258467 - RNA, 21 nt, Human
ugcagcaggaucuagaggggg

SEQ ID NO: 2258468 - RNA, 22 nt, Human
ugcagcagugagucucuucaga

SEQ ID NO: 2258469 - RNA, 18 nt, Human
ugcagcagugagucucuu

SEQ ID NO: 2258470 - RNA, 22 nt, Human
ugcagcagggaugcccuggagg

SEQ ID NO: 2258471 - RNA, 19 nt, Human
ugcagcagggaugcccugg

SEQ ID NO: 2258472 - RNA, 18 nt, Human
ugcagcagggaugcccug

SEQ ID NO: 2258473 - RNA, 17 nt, Human
ugcagcagggaugcccu

SEQ ID NO: 2258474 - RNA, 16 nt, Human
ugcagcagggaugccc

SEQ ID NO: 2258475 - RNA, 22 nt, Human
ugcagcaugaccugugaccagc

SEQ ID NO: 2258476 - RNA, 19 nt, Human
ugcagcaugaccugugacc

SEQ ID NO: 2258477 - RNA, 17 nt, Human
ugcagcaugaccuguga

SEQ ID NO: 2258478 - RNA, 13 nt, Human
ugcagcaugaccu

SEQ ID NO: 2258479 - RNA, 20 nt, Human
ugcagcauaugaggaugcag

SEQ ID NO: 2258480 - RNA, 17 nt, Human
ugcagcauaugaggaug

SEQ ID NO: 2258481 - RNA, 15 nt, Human
ugcagcauaugagga

SEQ ID NO: 2258482 - RNA, 23 nt, Human
ugcagcaugaccugugaccagca

SEQ ID NO: 2258483 - RNA, 16 nt, Human
ugcaggcaccuuagug

SEQ ID NO: 2258484 - RNA, 19 nt, Human
ugcaggcaccuuaguggcu

SEQ ID NO: 2258485 - RNA, 21 nt, Human
ugcaggcaccuuaguggcuuu

SEQ ID NO: 2258486 - RNA, 23 nt, Human
ugcaggcacucaaugcagccaga

SEQ ID NO: 2258487 - RNA, 12 nt, Human
ugcaggcagaca

SEQ ID NO: 2258488 - RNA, 13 nt, Human
ugcaggcagacac

SEQ ID NO: 2258489 - RNA, 14 nt, Human
ugcaggcagacacg

SEQ ID NO: 2258490 - RNA, 15 nt, Human
ugcaggcagccaggc

SEQ ID NO: 2258491 - RNA, 13 nt, Human
ugcaggcagccag

SEQ ID NO: 2258492 - RNA, 14 nt, Human
ugcaggcagccagg

SEQ ID NO: 2258493 - RNA, 20 nt, Human
ugcacuuucuauccucugua

SEQ ID NO: 2258494 - RNA, 12 nt, Human
ugcacuuuguuc

SEQ ID NO: 2258495 - RNA, 14 nt, Human
ugcacuuuguucug

SEQ ID NO: 2258496 - RNA, 20 nt, Human
ugcacuggaguccagucucu

SEQ ID NO: 2258497 - RNA, 19 nt, Human
ugcacuggaguccagucuc

SEQ ID NO: 2258498 - RNA, 18 nt, Human
ugcacuggaguccagucu

SEQ ID NO: 2258499 - RNA, 15 nt, Human
ugcacuggaguccag

SEQ ID NO: 2258500 - RNA, 21 nt, Human
ugcacuggaguccagucucuu

SEQ ID NO: 2258501 - RNA, 16 nt, Human
ugcacuguaugcugga

SEQ ID NO: 2258502 - RNA, 15 nt, Human
ugcacuguaugcugg

SEQ ID NO: 2258503 - RNA, 21 nt, Human
ugcacuugugauuauuuauua

SEQ ID NO: 2258504 - RNA, 16 nt, Human
ugcacuggggagcccg

SEQ ID NO: 2258505 - RNA, 20 nt, Human
ugcacuggggagcccgucuc

SEQ ID NO: 2258506 - RNA, 18 nt, Human
ugcagcagcgguggccuc

SEQ ID NO: 2258507 - RNA, 16 nt, Human
ugcagcagaggcacug

SEQ ID NO: 2258508 - RNA, 13 nt, Human
ugcagcagaggca

SEQ ID NO: 2258509 - RNA, 20 nt, Human
ugcagcacucacacaggacc

SEQ ID NO: 2258510 - RNA, 17 nt, Human
ugcagcacucacacagg

SEQ ID NO: 2258511 - RNA, 23 nt, Human
ugcagcaauaaagcagcguuucu

SEQ ID NO: 2258512 - RNA, 20 nt, Human
ugcagcaauaaagcagcguu

SEQ ID NO: 2258513 - RNA, 13 nt, Human
ugcagaggggaaa

SEQ ID NO: 2258514 - RNA, 13 nt, Human
ugcagaggggcag

SEQ ID NO: 2258515 - RNA, 17 nt, Human
ugcagaggccagaggcc

SEQ ID NO: 2258516 - RNA, 11 nt, Human
ugcagagcugc

SEQ ID NO: 2258517 - RNA, 14 nt, Human
ugcagaggccagag

SEQ ID NO: 2258518 - RNA, 15 nt, Human
ugcagaggccagagg

SEQ ID NO: 2258519 - RNA, 21 nt, Human
ugcagagcaggaaacaugacu

SEQ ID NO: 2258520 - RNA, 15 nt, Human
ugcagagcugaagau

SEQ ID NO: 2258521 - RNA, 22 nt, Human
ugcagagcagugggccuggcca

SEQ ID NO: 2258522 - RNA, 15 nt, Human
ugcacgcccaugugu

SEQ ID NO: 2258523 - RNA, 22 nt, Human
ugcacgcccaugugugagugug

SEQ ID NO: 2258524 - RNA, 19 nt, Human
ugcacgcccaugugugagu

SEQ ID NO: 2258525 - RNA, 17 nt, Human
ugcacgcccauguguga

SEQ ID NO: 2258526 - RNA, 13 nt, Human
ugcacggcugcug

SEQ ID NO: 2258527 - RNA, 14 nt, Human
ugcacggcugcuga

SEQ ID NO: 2258528 - RNA, 15 nt, Human
ugcacggcugcugag

SEQ ID NO: 2258529 - RNA, 15 nt, Human
ugcacugagcagagu

SEQ ID NO: 2258530 - RNA, 17 nt, Human
ugcacugagcagagucu

SEQ ID NO: 2258531 - RNA, 12 nt, Human
ugcacugagggc

SEQ ID NO: 2258532 - RNA, 14 nt, Human
ugcacugagggcca

SEQ ID NO: 2258533 - RNA, 14 nt, Human
ugcacugaugcugc

SEQ ID NO: 2258534 - RNA, 22 nt, Human
ugcacugauauaucaugaguga

SEQ ID NO: 2258535 - RNA, 15 nt, Human
ugcacugagggccac

SEQ ID NO: 2258536 - RNA, 16 nt, Human
ugcacugagggccaca

SEQ ID NO: 2258537 - RNA, 17 nt, Human
ugcacugagggccacac

SEQ ID NO: 2258538 - RNA, 19 nt, Human
ugcacugagggccacacua

SEQ ID NO: 2258539 - RNA, 22 nt, Human
ugcacugaugcugccccucauc

SEQ ID NO: 2258540 - RNA, 21 nt, Human
ugcacugaugcugccccucau

SEQ ID NO: 2258541 - RNA, 17 nt, Human
ugcacugaugcugcccc

SEQ ID NO: 2258542 - RNA, 16 nt, Human
ugcacugaugcugccc

SEQ ID NO: 2258543 - RNA, 21 nt, Human
ugcacugcccauggacaggcu

SEQ ID NO: 2258544 - RNA, 19 nt, Human
ugcacugcccauggacagg

SEQ ID NO: 2258545 - RNA, 17 nt, Human
ugcaccgggccacagag

SEQ ID NO: 2258546 - RNA, 22 nt, Human
ugcaccgggccacagagaaagu

SEQ ID NO: 2258547 - RNA, 20 nt, Human
ugaguccccuguuuguuucu

SEQ ID NO: 2258548 - RNA, 14 nt, Human
ugcaccgggccaca

SEQ ID NO: 2258549 - RNA, 15 nt, Human
ugcaccgggccacag

SEQ ID NO: 2258550 - RNA, 19 nt, Human
ugaguccccuguuuguuuc

SEQ ID NO: 2258551 - RNA, 23 nt, Human
ugcaccggcuggccuggccccuc

SEQ ID NO: 2258552 - RNA, 12 nt, Human
ugcauauguaug

SEQ ID NO: 2258553 - RNA, 17 nt, Human
ugcauauguugaauacu

SEQ ID NO: 2258554 - RNA, 15 nt, Human
ugcauauguugaaua

SEQ ID NO: 2258555 - RNA, 21 nt, Human
ugcauauuuauaaaaauaaaa

SEQ ID NO: 2258556 - RNA, 15 nt, Human
ugcauauguaugacu

SEQ ID NO: 2258557 - RNA, 13 nt, Human
ugcauauguugaa

SEQ ID NO: 2258558 - RNA, 17 nt, Human
ugcauauccugagccau

SEQ ID NO: 2258559 - RNA, 16 nt, Human
ugcauauccugagcca

SEQ ID NO: 2258560 - RNA, 18 nt, Human
ugcauauccugagccauc

SEQ ID NO: 2258561 - RNA, 20 nt, Human
ugcauauuuauaaaaauaaa

SEQ ID NO: 2258562 - RNA, 18 nt, Human
ugccaaauauaaauaaaa

SEQ ID NO: 2258563 - RNA, 17 nt, Human
ugccaaauauaaauaaa

SEQ ID NO: 2258564 - RNA, 13 nt, Human
ugccaccaggaga

SEQ ID NO: 2258565 - RNA, 12 nt, Human
ugccaccaggag

SEQ ID NO: 2258566 - RNA, 18 nt, Human
ugccaccagagaccgucc

SEQ ID NO: 2258567 - RNA, 19 nt, Human
ugccaccagagaccguccu

SEQ ID NO: 2258568 - RNA, 21 nt, Human
ugccaccagagaccguccuca

SEQ ID NO: 2258569 - RNA, 22 nt, Human
ugccaccagagaccguccucac

SEQ ID NO: 2258570 - RNA, 17 nt, Human
ugccaccaggagaacca

SEQ ID NO: 2258571 - RNA, 14 nt, Human
ugccaccaggagaa

SEQ ID NO: 2258572 - RNA, 22 nt, Human
ugccaccaggagaaccacuaca

SEQ ID NO: 2258573 - RNA, 13 nt, Human
ugccaccaggcca

SEQ ID NO: 2258574 - RNA, 19 nt, Human
ugcaucaagaugugacaug

SEQ ID NO: 2258575 - RNA, 16 nt, Human
ugccaaauauguccug

SEQ ID NO: 2258576 - RNA, 14 nt, Human
ugcaucaagaugug

SEQ ID NO: 2258577 - RNA, 22 nt, Human
ugccaaauauaaauaaaaauaa

SEQ ID NO: 2258578 - RNA, 19 nt, Human
ugccaaauauaaauaaaaa

SEQ ID NO: 2258579 - RNA, 15 nt, Human
ugccacuagggcucu

SEQ ID NO: 2258580 - RNA, 11 nt, Human
ugccacucaca

SEQ ID NO: 2258581 - RNA, 15 nt, Human
ugccacucacacagc

SEQ ID NO: 2258582 - RNA, 16 nt, Human
ugccacucacacagcc

SEQ ID NO: 2258583 - RNA, 18 nt, Human
ugccacucacacagccag

SEQ ID NO: 2258584 - RNA, 19 nt, Human
ugccacucacacagccagg

SEQ ID NO: 2258585 - RNA, 20 nt, Human
ugccacucacacagccaggu

SEQ ID NO: 2258586 - RNA, 12 nt, Human
ugccaggcaggg

SEQ ID NO: 2258587 - RNA, 18 nt, Human
ugccaggauggaaugaug

SEQ ID NO: 2258588 - RNA, 10 nt, Human
ugccaggcau

SEQ ID NO: 2258589 - RNA, 15 nt, Human
ugccaggcaggggug

SEQ ID NO: 2258590 - RNA, 16 nt, Human
ugccaggcaggggugg

SEQ ID NO: 2258591 - RNA, 17 nt, Human
ugccaggcagggguggg

SEQ ID NO: 2258592 - RNA, 18 nt, Human
ugccaggcaggggugggg

SEQ ID NO: 2258593 - RNA, 18 nt, Human
ugccagguuuuuggucug

SEQ ID NO: 2258594 - RNA, 19 nt, Human
ugccagguuuuuggucuga

SEQ ID NO: 2258595 - RNA, 22 nt, Human
ugccagguuuuuggucugaccc

SEQ ID NO: 2258596 - RNA, 18 nt, Human
ugccaccauggccagcca

SEQ ID NO: 2258597 - RNA, 15 nt, Human
ugccaccauccugcu

SEQ ID NO: 2258598 - RNA, 19 nt, Human
ugccaccauccugcugcug

SEQ ID NO: 2258599 - RNA, 17 nt, Human
ugccacccaccagggcg

SEQ ID NO: 2258600 - RNA, 12 nt, Human
ugccacccacca

SEQ ID NO: 2258601 - RNA, 16 nt, Human
ugccacccaccucccu

SEQ ID NO: 2258602 - RNA, 13 nt, Human
ugccacccaccuc

SEQ ID NO: 2258603 - RNA, 14 nt, Human
ugccaccaggccac

SEQ ID NO: 2258604 - RNA, 17 nt, Human
ugccaccaggccaccuc

SEQ ID NO: 2258605 - RNA, 18 nt, Human
ugccaccaggccaccucc

SEQ ID NO: 2258606 - RNA, 23 nt, Human
ugccaccagagaccguccucacc

SEQ ID NO: 2258607 - RNA, 16 nt, Human
ugccaccagucacugu

SEQ ID NO: 2258608 - RNA, 13 nt, Human
ugccacccuaccu

SEQ ID NO: 2258609 - RNA, 17 nt, Human
ugccacccucaugcugu

SEQ ID NO: 2258610 - RNA, 16 nt, Human
ugccacccucaugcug

SEQ ID NO: 2258611 - RNA, 14 nt, Human
ugccacccuaccug

SEQ ID NO: 2258612 - RNA, 13 nt, Human
ugccacccugggc

SEQ ID NO: 2258613 - RNA, 14 nt, Human
ugccacccugggcu

SEQ ID NO: 2258614 - RNA, 15 nt, Human
ugccacccugggcuc

SEQ ID NO: 2258615 - RNA, 17 nt, Human
ugccacccugggcucug

SEQ ID NO: 2258616 - RNA, 18 nt, Human
ugccacccugggcucugu

SEQ ID NO: 2258617 - RNA, 19 nt, Human
ugccacccugggcucugug

SEQ ID NO: 2258618 - RNA, 20 nt, Human
ugccacccugggcucugugg

SEQ ID NO: 2258619 - RNA, 21 nt, Human
ugccacccugggcucuguggg

SEQ ID NO: 2258620 - RNA, 19 nt, Human
ugccacccuggggagaaag

SEQ ID NO: 2258621 - RNA, 20 nt, Human
ugccacuaaauugacacuua

SEQ ID NO: 2258622 - RNA, 22 nt, Human
ugccacuacggaauaguuggcu

SEQ ID NO: 2258623 - RNA, 22 nt, Human
ugccacccugggcucugugggc

SEQ ID NO: 2258624 - RNA, 18 nt, Human
ugcccaggcuggagugca

SEQ ID NO: 2258625 - RNA, 20 nt, Human
ugcccaggcuggagugcaau

SEQ ID NO: 2258626 - RNA, 13 nt, Human
ugcccaggcugga

SEQ ID NO: 2258627 - RNA, 21 nt, Human
ugcccacucccugcaaccuga

SEQ ID NO: 2258628 - RNA, 13 nt, Human
ugcccaggcuggc

SEQ ID NO: 2258629 - RNA, 21 nt, Human
ugcccagggcucagccuggug

SEQ ID NO: 2258630 - RNA, 20 nt, Human
ugcccagggcucagccuggu

SEQ ID NO: 2258631 - RNA, 21 nt, Human
ugcccacccguggagauggga

SEQ ID NO: 2258632 - RNA, 21 nt, Human
ugccacucacacagccaggug

SEQ ID NO: 2258633 - RNA, 11 nt, Human
ugcccaggcug

SEQ ID NO: 2258634 - RNA, 16 nt, Human
ugcccacucccugcaa

SEQ ID NO: 2258635 - RNA, 14 nt, Human
ugcccacucccugc

SEQ ID NO: 2258636 - RNA, 15 nt, Human
ugcccacucccugca

SEQ ID NO: 2258637 - RNA, 19 nt, Human
ugcccaccugcccaucaca

SEQ ID NO: 2258638 - RNA, 17 nt, Human
ugcccaccugcccauca

SEQ ID NO: 2258639 - RNA, 15 nt, Human
ugcccaccugcccau

SEQ ID NO: 2258640 - RNA, 14 nt, Human
ugcccaccugccca

SEQ ID NO: 2258641 - RNA, 13 nt, Human
ugcccaccuggcc

SEQ ID NO: 2258642 - RNA, 14 nt, Human
ugcccaccuggccu

SEQ ID NO: 2258643 - RNA, 21 nt, Human
ugccauccagguucagcuugu

SEQ ID NO: 2258644 - RNA, 20 nt, Human
ugccauccagguucagcuug

SEQ ID NO: 2258645 - RNA, 17 nt, Human
ugcccacccuccacucu

SEQ ID NO: 2258646 - RNA, 13 nt, Human
ugcccaucccugg

SEQ ID NO: 2258647 - RNA, 19 nt, Human
ugcccaucugggaaaauac

SEQ ID NO: 2258648 - RNA, 23 nt, Human
ugcccaucacaggguugggccca

SEQ ID NO: 2258649 - RNA, 19 nt, Human
ugcccaguuucugccucug

SEQ ID NO: 2258650 - RNA, 20 nt, Human
ugcccaucacaggguugggc

SEQ ID NO: 2258651 - RNA, 17 nt, Human
ugcccaguuucugccuc

SEQ ID NO: 2258652 - RNA, 18 nt, Human
ugcccaguuucugccucu

SEQ ID NO: 2258653 - RNA, 16 nt, Human
ugcccaguuucugccu

SEQ ID NO: 2258654 - RNA, 17 nt, Human
ugcccaguuucagggcu

SEQ ID NO: 2258655 - RNA, 15 nt, Human
ugcccaugccaccgc

SEQ ID NO: 2258656 - RNA, 24 nt, Human
ugcccauggacaggcuggcuccag

SEQ ID NO: 2258657 - RNA, 16 nt, Human
ugcccaugggagcugg

SEQ ID NO: 2258658 - RNA, 13 nt, Human
ugccccaggacca

SEQ ID NO: 2258659 - RNA, 20 nt, Human
ugcccaugggcacugcuggg

SEQ ID NO: 2258660 - RNA, 22 nt, Human
ugcccaugggcacugcugggug

SEQ ID NO: 2258661 - RNA, 15 nt, Human
ugcccaugggcacug

SEQ ID NO: 2258662 - RNA, 16 nt, Human
ugcccaugggcacugc

SEQ ID NO: 2258663 - RNA, 17 nt, Human
ugcccaugggcacugcu

SEQ ID NO: 2258664 - RNA, 18 nt, Human
ugcccaugggcacugcug

SEQ ID NO: 2258665 - RNA, 23 nt, Human
ugcccagggcucagccugguggg

SEQ ID NO: 2258666 - RNA, 14 nt, Human
ugcccaggggagcc

SEQ ID NO: 2258667 - RNA, 15 nt, Human
ugcccaggggagccc

SEQ ID NO: 2258668 - RNA, 16 nt, Human
ugcccaggggagcccu

SEQ ID NO: 2258669 - RNA, 17 nt, Human
ugcccaggggagcccuc

SEQ ID NO: 2258670 - RNA, 20 nt, Human
ugcccaggggcccacaggga

SEQ ID NO: 2258671 - RNA, 11 nt, Human
ugcccaggggu

SEQ ID NO: 2258672 - RNA, 15 nt, Human
ugcccaggggugccc

SEQ ID NO: 2258673 - RNA, 16 nt, Human
ugcccaggggugcccc

SEQ ID NO: 2258674 - RNA, 18 nt, Human
ugcccaggggugcccccu

SEQ ID NO: 2258675 - RNA, 19 nt, Human
ugcccaggggugcccccuc

SEQ ID NO: 2258676 - RNA, 20 nt, Human
ugcccaggggugcccccucc

SEQ ID NO: 2258677 - RNA, 21 nt, Human
ugcccaggggugcccccuccu

SEQ ID NO: 2258678 - RNA, 22 nt, Human
ugcccaggggugcccccuccuc

SEQ ID NO: 2258679 - RNA, 23 nt, Human
ugcccaggggugcccccuccucu

SEQ ID NO: 2258680 - RNA, 22 nt, Human
ugcccagucccccaaccccagc

SEQ ID NO: 2258681 - RNA, 23 nt, Human
ugcccagucccccaaccccagcc

SEQ ID NO: 2258682 - RNA, 21 nt, Human
ugcccagucgauaucucacuu

SEQ ID NO: 2258683 - RNA, 20 nt, Human
ugcccagguuucuggucucu

SEQ ID NO: 2258684 - RNA, 14 nt, Human
ugcccaguccccca

SEQ ID NO: 2258685 - RNA, 16 nt, Human
ugcccagucccccaac

SEQ ID NO: 2258686 - RNA, 18 nt, Human
ugcccagucccccaaccc

SEQ ID NO: 2258687 - RNA, 20 nt, Human
ugcccagucccccaacccca

SEQ ID NO: 2258688 - RNA, 21 nt, Human
ugccccucccccaacccccac

SEQ ID NO: 2258689 - RNA, 17 nt, Human
ugccccucccccaaccc

SEQ ID NO: 2258690 - RNA, 12 nt, Human
ugccccuccccc

SEQ ID NO: 2258691 - RNA, 21 nt, Human
ugccccucccagaacacacuc

SEQ ID NO: 2258692 - RNA, 12 nt, Human
ugccccucccag

SEQ ID NO: 2258693 - RNA, 19 nt, Human
ugccccauccuccagcagg

SEQ ID NO: 2258694 - RNA, 19 nt, Human
ugccccucaacucuccucc

SEQ ID NO: 2258695 - RNA, 18 nt, Human
ugccccauccuccagcag

SEQ ID NO: 2258696 - RNA, 17 nt, Human
ugccccauccuccagca

SEQ ID NO: 2258697 - RNA, 23 nt, Human
ugccccucccccaacccccaccc

SEQ ID NO: 2258698 - RNA, 22 nt, Human
ugccccucccccaacccccacc

SEQ ID NO: 2258699 - RNA, 13 nt, Human
ugccccucccuuc

SEQ ID NO: 2258700 - RNA, 17 nt, Human
ugccccuggcagccccu

SEQ ID NO: 2258701 - RNA, 15 nt, Human
ugccccagggcuccc

SEQ ID NO: 2258702 - RNA, 14 nt, Human
ugccccaggccuga

SEQ ID NO: 2258703 - RNA, 20 nt, Human
ugccccaggaccagcucagg

SEQ ID NO: 2258704 - RNA, 19 nt, Human
ugccccaggaccagcucag

SEQ ID NO: 2258705 - RNA, 18 nt, Human
ugccccaggaccagcuca

SEQ ID NO: 2258706 - RNA, 14 nt, Human
ugccccaggaccag

SEQ ID NO: 2258707 - RNA, 23 nt, Human
ugccccucaacucuccuccagag

SEQ ID NO: 2258708 - RNA, 21 nt, Human
ugccccaucagugcucccuca

SEQ ID NO: 2258709 - RNA, 20 nt, Human
ugccccaucagugcucccuc

SEQ ID NO: 2258710 - RNA, 18 nt, Human
ugccccaucagugcuccc

SEQ ID NO: 2258711 - RNA, 16 nt, Human
ugccccaucagugcuc

SEQ ID NO: 2258712 - RNA, 14 nt, Human
uggcuuuaaugaau

SEQ ID NO: 2258713 - RNA, 16 nt, Human
uggcuuuauccucuuu

SEQ ID NO: 2258714 - RNA, 20 nt, Human
uggcuuuauccucuuuagag

SEQ ID NO: 2258715 - RNA, 21 nt, Human
uggcuugaguuuaaauuguaa

SEQ ID NO: 2258716 - RNA, 12 nt, Human
uggcuuucccgg

SEQ ID NO: 2258717 - RNA, 17 nt, Human
uggcuuucauuauuagu

SEQ ID NO: 2258718 - RNA, 21 nt, Human
uggcuuucccggacugcaagc

SEQ ID NO: 2258719 - RNA, 20 nt, Human
uggcuuucucccacugaguu

SEQ ID NO: 2258720 - RNA, 22 nt, Human
uggcuuucuccgacugcuaggg

SEQ ID NO: 2258721 - RNA, 15 nt, Human
uggcuuucagccucu

SEQ ID NO: 2258722 - RNA, 21 nt, Human
uggcuuuauccucuuuagagu

SEQ ID NO: 2258723 - RNA, 17 nt, Human
uggcuuuggcuucuugg

SEQ ID NO: 2258724 - RNA, 23 nt, Human
uggcuuucuccgacugcuaggga

SEQ ID NO: 2258725 - RNA, 14 nt, Human
uggcuuuugugcau

SEQ ID NO: 2258726 - RNA, 18 nt, Human
uggcuucuucuuuaggau

SEQ ID NO: 2258727 - RNA, 20 nt, Human
uggcuugaagccaagucagc

SEQ ID NO: 2258728 - RNA, 15 nt, Human
uggcuugagaaauau

SEQ ID NO: 2258729 - RNA, 14 nt, Human
uggcuucuccaggg

SEQ ID NO: 2258730 - RNA, 14 nt, Human
uggcuuccuuucuu

SEQ ID NO: 2258731 - RNA, 13 nt, Human
uggcuucucauac

SEQ ID NO: 2258732 - RNA, 21 nt, Human
uggcuucucauacguccacca

SEQ ID NO: 2258733 - RNA, 22 nt, Human
uggcuucucauacguccaccau

SEQ ID NO: 2258734 - RNA, 14 nt, Human
uggcuucuggagcc

SEQ ID NO: 2258735 - RNA, 13 nt, Human
uggcuuccuccug

SEQ ID NO: 2258736 - RNA, 21 nt, Human
uggcuuccuccucccuccugc

SEQ ID NO: 2258737 - RNA, 15 nt, Human
uggcuuccuccugcg

SEQ ID NO: 2258738 - RNA, 16 nt, Human
uggcuuccuuucuugg

SEQ ID NO: 2258739 - RNA, 16 nt, Human
uggcuuccuggcaaua

SEQ ID NO: 2258740 - RNA, 20 nt, Human
uggccccaagggcaaaauuc

SEQ ID NO: 2258741 - RNA, 13 nt, Human
uggccccacccug

SEQ ID NO: 2258742 - RNA, 15 nt, Human
uggccccacccuggg

SEQ ID NO: 2258743 - RNA, 16 nt, Human
uggccccacccugggc

SEQ ID NO: 2258744 - RNA, 18 nt, Human
uggccccacccugggccc

SEQ ID NO: 2258745 - RNA, 22 nt, Human
uggcccauccccccucaccagg

SEQ ID NO: 2258746 - RNA, 20 nt, Human
uggcccauccccccucacca

SEQ ID NO: 2258747 - RNA, 21 nt, Human
uggcccauccccccucaccag

SEQ ID NO: 2258748 - RNA, 16 nt, Human
uggcccagggcccaga

SEQ ID NO: 2258749 - RNA, 19 nt, Human
uggcccauccccccucacc

SEQ ID NO: 2258750 - RNA, 15 nt, Human
uggcccagggcccag

SEQ ID NO: 2258751 - RNA, 14 nt, Human
uggcccagggccca

SEQ ID NO: 2258752 - RNA, 19 nt, Human
uggcucugaccgaaacagc

SEQ ID NO: 2258753 - RNA, 15 nt, Human
uggcucucuccagga

SEQ ID NO: 2258754 - RNA, 19 nt, Human
uggcucugagcgccuccau

SEQ ID NO: 2258755 - RNA, 20 nt, Human
uggcucugaggugccugucc

SEQ ID NO: 2258756 - RNA, 21 nt, Human
uggcucugaggugccuguccc

SEQ ID NO: 2258757 - RNA, 17 nt, Human
uggcucucccauuuccu

SEQ ID NO: 2258758 - RNA, 23 nt, Human
uggcucuccaagugccagaggug

SEQ ID NO: 2258759 - RNA, 13 nt, Human
uggcucucuccag

SEQ ID NO: 2258760 - RNA, 14 nt, Human
uggcucucuccagg

SEQ ID NO: 2258761 - RNA, 12 nt, Human
uggccccagcac

SEQ ID NO: 2258762 - RNA, 14 nt, Human
uggcucuccaagug

SEQ ID NO: 2258763 - RNA, 15 nt, Human
uggcucuccaagugc

SEQ ID NO: 2258764 - RNA, 19 nt, Human
uggcucuccaagugccaga

SEQ ID NO: 2258765 - RNA, 20 nt, Human
uggcucuccaagugccagag

SEQ ID NO: 2258766 - RNA, 22 nt, Human
uggccccacccugggcccuggg

SEQ ID NO: 2258767 - RNA, 14 nt, Human
uggcucugcaaugg

SEQ ID NO: 2258768 - RNA, 22 nt, Human
uggcucugaggugccuguccca

SEQ ID NO: 2258769 - RNA, 23 nt, Human
uggcucugcaaugggcacuggga

SEQ ID NO: 2258770 - RNA, 12 nt, Human
uggcucugcugg

SEQ ID NO: 2258771 - RNA, 11 nt, Human
uggcucugcug

SEQ ID NO: 2258772 - RNA, 16 nt, Human
uggcugcuucaaggau

SEQ ID NO: 2258773 - RNA, 21 nt, Human
uggcugcuucaaggauccuga

SEQ ID NO: 2258774 - RNA, 19 nt, Human
uggcuggaagauccugcgg

SEQ ID NO: 2258775 - RNA, 13 nt, Human
uggcucuggagac

SEQ ID NO: 2258776 - RNA, 15 nt, Human
uggcugcuuggccuu

SEQ ID NO: 2258777 - RNA, 20 nt, Human
uggcuggaagauccugcggg

SEQ ID NO: 2258778 - RNA, 21 nt, Human
uggcuggaagauccugcgggu

SEQ ID NO: 2258779 - RNA, 22 nt, Human
uggcugguaacaguucauguuu

SEQ ID NO: 2258780 - RNA, 13 nt, Human
uggcugguccagg

SEQ ID NO: 2258781 - RNA, 15 nt, Human
uggcugguccagggc

SEQ ID NO: 2258782 - RNA, 16 nt, Human
uggcugguccagggcu

SEQ ID NO: 2258783 - RNA, 23 nt, Human
uggcuggagacgggugggcggcu

SEQ ID NO: 2258784 - RNA, 19 nt, Human
uggcuggaugaaauuuucu

SEQ ID NO: 2258785 - RNA, 22 nt, Human
uggcuggaugaaauuuucuaga

SEQ ID NO: 2258786 - RNA, 21 nt, Human
uggcugggggccucagugcca

SEQ ID NO: 2258787 - RNA, 16 nt, Human
uggcuggaagggagga

SEQ ID NO: 2258788 - RNA, 17 nt, Human
ugggaccugccaggcag

SEQ ID NO: 2258789 - RNA, 23 nt, Human
ugggaccucaguuuuaucauuuu

SEQ ID NO: 2258790 - RNA, 19 nt, Human
ugggaccuaggggcgccgc

SEQ ID NO: 2258791 - RNA, 13 nt, Human
ugggacacccugu

SEQ ID NO: 2258792 - RNA, 20 nt, Human
ugggaccugccaggcagggg

SEQ ID NO: 2258793 - RNA, 15 nt, Human
ugggaccuuuagugg

SEQ ID NO: 2258794 - RNA, 18 nt, Human
ugggaccugccaggcagg

SEQ ID NO: 2258795 - RNA, 19 nt, Human
ugggaccugccaggcaggg

SEQ ID NO: 2258796 - RNA, 23 nt, Human
ugggaccugccaggcaggggugg

SEQ ID NO: 2258797 - RNA, 15 nt, Human
ugggacguggcucag

SEQ ID NO: 2258798 - RNA, 23 nt, Human
ugggacggugcccaagccagagg

SEQ ID NO: 2258799 - RNA, 14 nt, Human
ugggacggugccca

SEQ ID NO: 2258800 - RNA, 20 nt, Human
ugggaauguuacauuguuug

SEQ ID NO: 2258801 - RNA, 16 nt, Human
ugggaauguuugucuc

SEQ ID NO: 2258802 - RNA, 22 nt, Human
ugggaauguuugucucauccca

SEQ ID NO: 2258803 - RNA, 14 nt, Human
ugggaauuguguga

SEQ ID NO: 2258804 - RNA, 17 nt, Human
ugggaauugugugaugu

SEQ ID NO: 2258805 - RNA, 12 nt, Human
ugggacacccug

SEQ ID NO: 2258806 - RNA, 19 nt, Human
ugggacaaaucaagcuuca

SEQ ID NO: 2258807 - RNA, 23 nt, Human
ugggagauucaagggacccauga

SEQ ID NO: 2258808 - RNA, 22 nt, Human
ugggagcugaggccacacucag

SEQ ID NO: 2258809 - RNA, 20 nt, Human
ugggagcugaggccacacuc

SEQ ID NO: 2258810 - RNA, 12 nt, Human
ugggagcugccu

SEQ ID NO: 2258811 - RNA, 13 nt, Human
ugggagcugccug

SEQ ID NO: 2258812 - RNA, 14 nt, Human
ugggagcugccugu

SEQ ID NO: 2258813 - RNA, 13 nt, Human
ugggagcaaaaga

SEQ ID NO: 2258814 - RNA, 14 nt, Human
ugggagauguggaa

SEQ ID NO: 2258815 - RNA, 22 nt, Human
ugggagaggugccagcaacuga

SEQ ID NO: 2258816 - RNA, 21 nt, Human
ugggagauauauuuuuaagau

SEQ ID NO: 2258817 - RNA, 23 nt, Human
ugggagauauauuuuuaagauaa

SEQ ID NO: 2258818 - RNA, 16 nt, Human
ugggacguggcucagc

SEQ ID NO: 2258819 - RNA, 20 nt, Human
ugggagaggauuuuuuucug

SEQ ID NO: 2258820 - RNA, 23 nt, Human
ugggagaggauuuuuuucugagc

SEQ ID NO: 2258821 - RNA, 17 nt, Human
ugggagaggugccagca

SEQ ID NO: 2258822 - RNA, 21 nt, Human
ugggauuacagggaugagcca

SEQ ID NO: 2258823 - RNA, 17 nt, Human
ugggauuacagguguga

SEQ ID NO: 2258824 - RNA, 16 nt, Human
ugggaucugccccucc

SEQ ID NO: 2258825 - RNA, 18 nt, Human
ugggaucugccccucccu

SEQ ID NO: 2258826 - RNA, 15 nt, Human
ugggcagaggaaagc

SEQ ID NO: 2258827 - RNA, 18 nt, Human
ugggcagagcuggcucug

SEQ ID NO: 2258828 - RNA, 20 nt, Human
ugggcagagcuggcucugag

SEQ ID NO: 2258829 - RNA, 16 nt, Human
ugggauuacaggugug

SEQ ID NO: 2258830 - RNA, 13 nt, Human
ugggaucugcccc

SEQ ID NO: 2258831 - RNA, 20 nt, Human
ugggaguccccuuuucuuuu

SEQ ID NO: 2258832 - RNA, 18 nt, Human
ugggauuacaggcuccug

SEQ ID NO: 2258833 - RNA, 18 nt, Human
ugggauccuccaggugca

SEQ ID NO: 2258834 - RNA, 13 nt, Human
ugggauccuggag

SEQ ID NO: 2258835 - RNA, 15 nt, Human
ugggagugagcuggu

SEQ ID NO: 2258836 - RNA, 15 nt, Human
ugggagucaagugug

SEQ ID NO: 2258837 - RNA, 13 nt, Human
ugggaguccccuu

SEQ ID NO: 2258838 - RNA, 15 nt, Human
ugggauccuccaggu

SEQ ID NO: 2258839 - RNA, 21 nt, Human
ugggagugaggaugucugggc

SEQ ID NO: 2258840 - RNA, 17 nt, Human
ugggagcugccuguuca

SEQ ID NO: 2258841 - RNA, 21 nt, Human
ugggagcugccuguucagcuc

SEQ ID NO: 2258842 - RNA, 22 nt, Human
ugggagcugccuguucagcucc

SEQ ID NO: 2258843 - RNA, 14 nt, Human
ugggaguacaaaag

SEQ ID NO: 2258844 - RNA, 21 nt, Human
ugggggcggggugggaaagau

SEQ ID NO: 2258845 - RNA, 16 nt, Human
ugggggcagagggcag

SEQ ID NO: 2258846 - RNA, 14 nt, Human
ugggggcugcagca

SEQ ID NO: 2258847 - RNA, 13 nt, Human
ugggggcagaggg

SEQ ID NO: 2258848 - RNA, 23 nt, Human
ugggggcaagaagaucacgcucc

SEQ ID NO: 2258849 - RNA, 13 nt, Human
ugggggcaagaag

SEQ ID NO: 2258850 - RNA, 11 nt, Human
ugggggaugua

SEQ ID NO: 2258851 - RNA, 17 nt, Human
ugggggcugggcagagg

SEQ ID NO: 2258852 - RNA, 18 nt, Human
ugggggcugggcagagga

SEQ ID NO: 2258853 - RNA, 15 nt, Human
ugggggugcauuuga

SEQ ID NO: 2258854 - RNA, 12 nt, Human
ugggggugcauu

SEQ ID NO: 2258855 - RNA, 21 nt, Human
ugggggcugcagcauguugcu

SEQ ID NO: 2258856 - RNA, 14 nt, Human
ugggggcuggccuc

SEQ ID NO: 2258857 - RNA, 19 nt, Human
ugggggcugggcagaggaa

SEQ ID NO: 2258858 - RNA, 15 nt, Human
ugggggucugugugu

SEQ ID NO: 2258859 - RNA, 18 nt, Human
ugggggucuguguguuua

SEQ ID NO: 2258860 - RNA, 20 nt, Human
ugggggaucacagccucuga

SEQ ID NO: 2258861 - RNA, 23 nt, Human
uggggauugggugggcaggaaaa

SEQ ID NO: 2258862 - RNA, 20 nt, Human
ugggggaugacuagaggcag

SEQ ID NO: 2258863 - RNA, 20 nt, Human
uggggauugggccccugcca

SEQ ID NO: 2258864 - RNA, 21 nt, Human
ugggggaucacagccucugaa

SEQ ID NO: 2258865 - RNA, 15 nt, Human
uggggaacaagggug

SEQ ID NO: 2258866 - RNA, 23 nt, Human
uggggaaaggggucggcugacca

SEQ ID NO: 2258867 - RNA, 21 nt, Human
uggggaaaggggucggcugac

SEQ ID NO: 2258868 - RNA, 22 nt, Human
uggggaaaggggucggcugacc

SEQ ID NO: 2258869 - RNA, 19 nt, Human
uggggaacaaggguggcau

SEQ ID NO: 2258870 - RNA, 15 nt, Human
uggggaugugggagg

SEQ ID NO: 2258871 - RNA, 16 nt, Human
uggggaugugggaggg

SEQ ID NO: 2258872 - RNA, 22 nt, Human
ugggcuaagugauccucccacc

SEQ ID NO: 2258873 - RNA, 20 nt, Human
ugggcgugagaccugccccu

SEQ ID NO: 2258874 - RNA, 17 nt, Human
ugggcagauuuucagca

SEQ ID NO: 2258875 - RNA, 22 nt, Human
ugggcagaucuaccccuuacuu

SEQ ID NO: 2258876 - RNA, 15 nt, Human
ugggcagauuuucag

SEQ ID NO: 2258877 - RNA, 15 nt, Human
ugggcagaucuaccc

SEQ ID NO: 2258878 - RNA, 16 nt, Human
ugggcagaucuacccc

SEQ ID NO: 2258879 - RNA, 21 nt, Human
ugggcagaucuaccccuuacu

SEQ ID NO: 2258880 - RNA, 16 nt, Human
ugggcagaggaaagca

SEQ ID NO: 2258881 - RNA, 16 nt, Human
ugggcuacuuuguccu

SEQ ID NO: 2258882 - RNA, 17 nt, Human
ugggcuaauuaaauaaa

SEQ ID NO: 2258883 - RNA, 19 nt, Human
ugggcguggucacugcugu

SEQ ID NO: 2258884 - RNA, 20 nt, Human
ugggcguggucacugcuguc

SEQ ID NO: 2258885 - RNA, 13 nt, Human
ugggcuacaagga

SEQ ID NO: 2258886 - RNA, 16 nt, Human
ugggcuaguugggcuu

SEQ ID NO: 2258887 - RNA, 17 nt, Human
ugggcuggugucaccug

SEQ ID NO: 2258888 - RNA, 23 nt, Human
ugggcuggguucuacccaggugc

SEQ ID NO: 2258889 - RNA, 22 nt, Human
ugggcugugaguguaaguguga

SEQ ID NO: 2258890 - RNA, 15 nt, Human
ugggcugugagugua

SEQ ID NO: 2258891 - RNA, 12 nt, Human
ugggcugugcua

SEQ ID NO: 2258892 - RNA, 17 nt, Human
ugggcuguuggcacuca

SEQ ID NO: 2258893 - RNA, 19 nt, Human
ugggcuguuggcacucaca

SEQ ID NO: 2258894 - RNA, 23 nt, Human
ugggcuguuggcacucacagacc

SEQ ID NO: 2258895 - RNA, 14 nt, Human
ugggcuuaagaaau

SEQ ID NO: 2258896 - RNA, 14 nt, Human
ugggcuuagagcag

SEQ ID NO: 2258897 - RNA, 12 nt, Human
ugggcugugagu

SEQ ID NO: 2258898 - RNA, 19 nt, Human
ugggcugguggcucccgga

SEQ ID NO: 2258899 - RNA, 15 nt, Human
ugggcuucaguggca

SEQ ID NO: 2258900 - RNA, 16 nt, Human
ugggcuucacuguaua

SEQ ID NO: 2258901 - RNA, 17 nt, Human
ugggcuucacuguauaa

SEQ ID NO: 2258902 - RNA, 23 nt, Human
ugggcuucacuguauaaauagga

SEQ ID NO: 2258903 - RNA, 14 nt, Human
ugggcuuguuuucu

SEQ ID NO: 2258904 - RNA, 22 nt, Human
ugggcuuuuuuuuucucuuucu

SEQ ID NO: 2258905 - RNA, 17 nt, Human
ugggcuucaguggcagc

SEQ ID NO: 2258906 - RNA, 18 nt, Human
ugggcuucacuguauaaa

SEQ ID NO: 2258907 - RNA, 16 nt, Human
ugguauuccugccucc

SEQ ID NO: 2258908 - RNA, 19 nt, Human
ugguauucaggauuacaug

SEQ ID NO: 2258909 - RNA, 16 nt, Human
ugguaugagcugaggg

SEQ ID NO: 2258910 - RNA, 18 nt, Human
ugguauuacacuguauuu

SEQ ID NO: 2258911 - RNA, 20 nt, Human
ugguauuacacuguauuugu

SEQ ID NO: 2258912 - RNA, 14 nt, Human
ugguaugagcugag

SEQ ID NO: 2258913 - RNA, 23 nt, Human
ugguaucuguucuuuaauuuauu

SEQ ID NO: 2258914 - RNA, 15 nt, Human
ugguaugagcugagg

SEQ ID NO: 2258915 - RNA, 23 nt, Human
ugguauuggcuagagguucaaag

SEQ ID NO: 2258916 - RNA, 12 nt, Human
ugguauuguauu

SEQ ID NO: 2258917 - RNA, 13 nt, Human
ugguauuguauuu

SEQ ID NO: 2258918 - RNA, 14 nt, Human
ugguauuguauuua

SEQ ID NO: 2258919 - RNA, 18 nt, Human
ugguauuguauuuauuca

SEQ ID NO: 2258920 - RNA, 16 nt, Human
ugguaucuuaaagugu

SEQ ID NO: 2258921 - RNA, 18 nt, Human
ugguaugaucacggcuca

SEQ ID NO: 2258922 - RNA, 14 nt, Human
ugguaucuguucuu

SEQ ID NO: 2258923 - RNA, 17 nt, Human
ugguaucuguucuuuaa

SEQ ID NO: 2258924 - RNA, 19 nt, Human
ugguaucuguucuuuaauu

SEQ ID NO: 2258925 - RNA, 22 nt, Human
ugguaucuguucuuuaauuuau

SEQ ID NO: 2258926 - RNA, 22 nt, Human
ugguauauccaaaagcuuuuua

SEQ ID NO: 2258927 - RNA, 22 nt, Human
ugguaucuagacccaucuucuu

SEQ ID NO: 2258928 - RNA, 15 nt, Human
ugguaucaagaaagu

SEQ ID NO: 2258929 - RNA, 22 nt, Human
ugguauccugugacauguaaca

SEQ ID NO: 2258930 - RNA, 13 nt, Human
ugguauagaaaug

SEQ ID NO: 2258931 - RNA, 20 nt, Human
uggguuuggaccccagcugg

SEQ ID NO: 2258932 - RNA, 21 nt, Human
uggguuuggaccccagcuggg

SEQ ID NO: 2258933 - RNA, 22 nt, Human
ugguauagaaaugcugguuuuu

SEQ ID NO: 2258934 - RNA, 19 nt, Human
ugguauauccaaaagcuuu

SEQ ID NO: 2258935 - RNA, 16 nt, Human
ugguauauccaaaagc

SEQ ID NO: 2258936 - RNA, 14 nt, Human
ugguauagaaaugc

SEQ ID NO: 2258937 - RNA, 16 nt, Human
ugguauagaaaugcug

SEQ ID NO: 2258938 - RNA, 21 nt, Human
uggguuucuaaagcugccagc

SEQ ID NO: 2258939 - RNA, 19 nt, Human
uggguucugccugccagcu

SEQ ID NO: 2258940 - RNA, 16 nt, Human
uggguucugccugcca

SEQ ID NO: 2258941 - RNA, 17 nt, Human
uggguucugauauugcc

SEQ ID NO: 2258942 - RNA, 16 nt, Human
uggguuucuagcccau

SEQ ID NO: 2258943 - RNA, 14 nt, Human
uggguuuggacccc

SEQ ID NO: 2258944 - RNA, 19 nt, Human
uggguuuggaccccagcug

SEQ ID NO: 2258945 - RNA, 17 nt, Human
uggguuucuaaagcugc

SEQ ID NO: 2258946 - RNA, 18 nt, Human
uggguuucuaaagcugcc

SEQ ID NO: 2258947 - RNA, 20 nt, Human
uggguguauuuauuuuccuc

SEQ ID NO: 2258948 - RNA, 22 nt, Human
uggguguaacaggucuccucuu

SEQ ID NO: 2258949 - RNA, 15 nt, Human
ugggugguggaucug

SEQ ID NO: 2258950 - RNA, 14 nt, Human
ugggugguggggag

SEQ ID NO: 2258951 - RNA, 18 nt, Human
uggguguguguagccaag

SEQ ID NO: 2258952 - RNA, 23 nt, Human
uggguguaacaggucuccucuua

SEQ ID NO: 2258953 - RNA, 15 nt, Human
uggguguuccuggca

SEQ ID NO: 2258954 - RNA, 19 nt, Human
uggguguuccuggcaguuu

SEQ ID NO: 2258955 - RNA, 20 nt, Human
uggguguuccuggcaguuua

SEQ ID NO: 2258956 - RNA, 21 nt, Human
uggguuagggaaaacauucca

SEQ ID NO: 2258957 - RNA, 19 nt, Human
uggguuagggaaaacauuc

SEQ ID NO: 2258958 - RNA, 18 nt, Human
uggguuagggaaaacauu

SEQ ID NO: 2258959 - RNA, 16 nt, Human
uggguuagggaaaaca

SEQ ID NO: 2258960 - RNA, 14 nt, Human
uggguuaguggaug

SEQ ID NO: 2258961 - RNA, 14 nt, Human
uggguucugccugc

SEQ ID NO: 2258962 - RNA, 22 nt, Human
uggguucuacccaggugcuagg

SEQ ID NO: 2258963 - RNA, 15 nt, Human
uggguucuacccagg

SEQ ID NO: 2258964 - RNA, 16 nt, Human
uggguucuacccaggu

SEQ ID NO: 2258965 - RNA, 20 nt, Human
uggguggggugaggaccacu

SEQ ID NO: 2258966 - RNA, 15 nt, Human
uggguggggugagga

SEQ ID NO: 2258967 - RNA, 12 nt, Human
uggguaaauuca

SEQ ID NO: 2258968 - RNA, 13 nt, Human
ugggugguacccu

SEQ ID NO: 2258969 - RNA, 14 nt, Human
uggguggguggugg

SEQ ID NO: 2258970 - RNA, 15 nt, Human
ugggugggugguggg

SEQ ID NO: 2258971 - RNA, 14 nt, Human
ugggugguacccuc

SEQ ID NO: 2258972 - RNA, 18 nt, Human
ugggugguacccucugga

SEQ ID NO: 2258973 - RNA, 22 nt, Human
ugggugguacccucuggagggg

SEQ ID NO: 2258974 - RNA, 16 nt, Human
uggguggguggugggg

SEQ ID NO: 2258975 - RNA, 14 nt, Human
ugggugguggaucu

SEQ ID NO: 2258976 - RNA, 18 nt, Human
uggguggggggcuucaua

SEQ ID NO: 2258977 - RNA, 15 nt, Human
uggguaaaugcagcg

SEQ ID NO: 2258978 - RNA, 21 nt, Human
uggguggggggcuucauacac

SEQ ID NO: 2258979 - RNA, 20 nt, Human
uggguggggggcuucauaca

SEQ ID NO: 2258980 - RNA, 19 nt, Human
ugggguuuaucagaauucu

SEQ ID NO: 2258981 - RNA, 14 nt, Human
ugggggugccagga

SEQ ID NO: 2258982 - RNA, 15 nt, Human
ugggggugagggucc

SEQ ID NO: 2258983 - RNA, 15 nt, Human
uggggguggaauaaa

SEQ ID NO: 2258984 - RNA, 18 nt, Human
uggggguggaggcuuccu

SEQ ID NO: 2258985 - RNA, 21 nt, Human
ugggguuggcugggcccagaa

SEQ ID NO: 2258986 - RNA, 19 nt, Human
ugggguugggauugggggc

SEQ ID NO: 2258987 - RNA, 14 nt, Human
ugggguuguguugu

SEQ ID NO: 2258988 - RNA, 16 nt, Human
uggguaacuagggaag

SEQ ID NO: 2258989 - RNA, 11 nt, Human
uggcaggacca

SEQ ID NO: 2258990 - RNA, 14 nt, Human
uggcaggaccagga

SEQ ID NO: 2258991 - RNA, 16 nt, Human
uggcaggaccaggacu

SEQ ID NO: 2258992 - RNA, 17 nt, Human
uggcaggaccaggacua

SEQ ID NO: 2258993 - RNA, 19 nt, Human
uggcaggaguuggaagugu

SEQ ID NO: 2258994 - RNA, 13 nt, Human
uggcagcugcuuu

SEQ ID NO: 2258995 - RNA, 20 nt, Human
uggcacgguggcucaggccu

SEQ ID NO: 2258996 - RNA, 19 nt, Human
uggcacgguggcucaggcc

SEQ ID NO: 2258997 - RNA, 14 nt, Human
uggcacggugguac

SEQ ID NO: 2258998 - RNA, 16 nt, Human
uggcaccgccuucucu

SEQ ID NO: 2258999 - RNA, 15 nt, Human
uggcaccgccuucuc

SEQ ID NO: 2259000 - RNA, 20 nt, Human
uggcaccuaauccaggcaga

SEQ ID NO: 2259001 - RNA, 12 nt, Human
uggcaccuccua

SEQ ID NO: 2259002 - RNA, 22 nt, Human
uggcaccuucagacuuugcuuc

SEQ ID NO: 2259003 - RNA, 21 nt, Human
uggcacccggccccugcuggu

SEQ ID NO: 2259004 - RNA, 22 nt, Human
uggcaacagaucuggaaccuca

SEQ ID NO: 2259005 - RNA, 21 nt, Human
uggcaacaguuagcuggagcu

SEQ ID NO: 2259006 - RNA, 22 nt, Human
uggcaggaugacccugcgaagg

SEQ ID NO: 2259007 - RNA, 18 nt, Human
uggcaggauggccuggcc

SEQ ID NO: 2259008 - RNA, 19 nt, Human
uggcaggauggccuggcca

SEQ ID NO: 2259009 - RNA, 14 nt, Human
uggcagggccuagc

SEQ ID NO: 2259010 - RNA, 15 nt, Human
uggcagggccuagcu

SEQ ID NO: 2259011 - RNA, 19 nt, Human
uggcagggccuagcugcua

SEQ ID NO: 2259012 - RNA, 11 nt, Human
uggcagggcuc

SEQ ID NO: 2259013 - RNA, 15 nt, Human
uggcaggggacagga

SEQ ID NO: 2259014 - RNA, 18 nt, Human
uggcaggggacaggaguc

SEQ ID NO: 2259015 - RNA, 12 nt, Human
uggcagggcuca

SEQ ID NO: 2259016 - RNA, 14 nt, Human
uggcagggcucagg

SEQ ID NO: 2259017 - RNA, 17 nt, Human
uggcagggcucaggauu

SEQ ID NO: 2259018 - RNA, 23 nt, Human
uggcagggguggcugccucauuu

SEQ ID NO: 2259019 - RNA, 21 nt, Human
uggcagggguggcugccucau

SEQ ID NO: 2259020 - RNA, 17 nt, Human
uggcagggugggaugga

SEQ ID NO: 2259021 - RNA, 16 nt, Human
uggcagggugggaugg

SEQ ID NO: 2259022 - RNA, 15 nt, Human
uggcagggcucagga

SEQ ID NO: 2259023 - RNA, 22 nt, Human
uggcagguggaggugucaggcu

SEQ ID NO: 2259024 - RNA, 15 nt, Human
uggcaggugcagccc

SEQ ID NO: 2259025 - RNA, 17 nt, Human
uggcagucacugaauuc

SEQ ID NO: 2259026 - RNA, 18 nt, Human
uggcaguccuggaagcca

SEQ ID NO: 2259027 - RNA, 16 nt, Human
uggcagucugaauuuu

SEQ ID NO: 2259028 - RNA, 13 nt, Human
uggcagucuauau

SEQ ID NO: 2259029 - RNA, 19 nt, Human
uggcagucuauauguuugu

SEQ ID NO: 2259030 - RNA, 13 nt, Human
uggcagugggagc

SEQ ID NO: 2259031 - RNA, 22 nt, Human
uggcagucugaauuuuuaaaac

SEQ ID NO: 2259032 - RNA, 14 nt, Human
uggcagugagugag

SEQ ID NO: 2259033 - RNA, 17 nt, Human
uggcagugagugagccu

SEQ ID NO: 2259034 - RNA, 18 nt, Human
uggcagugagugagccug

SEQ ID NO: 2259035 - RNA, 19 nt, Human
uggcagugagugagccugg

SEQ ID NO: 2259036 - RNA, 23 nt, Human
uggcagugagugagccuggcucu

SEQ ID NO: 2259037 - RNA, 16 nt, Human
uggccaggagcucuuc

SEQ ID NO: 2259038 - RNA, 15 nt, Human
uggccaggagcucuu

SEQ ID NO: 2259039 - RNA, 14 nt, Human
uggccaggagcucu

SEQ ID NO: 2259040 - RNA, 17 nt, Human
uggccagccccacagcc

SEQ ID NO: 2259041 - RNA, 22 nt, Human
uggccaggagcucuucaggccu

SEQ ID NO: 2259042 - RNA, 20 nt, Human
uggccaggagcucuucaggc

SEQ ID NO: 2259043 - RNA, 23 nt, Human
uggccaggagcucuucaggccuc

SEQ ID NO: 2259044 - RNA, 16 nt, Human
uggccagccccacagc

SEQ ID NO: 2259045 - RNA, 20 nt, Human
uggccaggcagaucugugcc

SEQ ID NO: 2259046 - RNA, 19 nt, Human
uggccaggcagaucugugc

SEQ ID NO: 2259047 - RNA, 17 nt, Human
uggccaggcagaucugu

SEQ ID NO: 2259048 - RNA, 16 nt, Human
uggccaggcagaucug

SEQ ID NO: 2259049 - RNA, 12 nt, Human
uggccaggcaga

SEQ ID NO: 2259050 - RNA, 20 nt, Human
uggccaggcacccccuggag

SEQ ID NO: 2259051 - RNA, 21 nt, Human
uggccaggcacccccuggaga

SEQ ID NO: 2259052 - RNA, 12 nt, Human
uggccaggaugg

SEQ ID NO: 2259053 - RNA, 14 nt, Human
uggccaggauggag

SEQ ID NO: 2259054 - RNA, 23 nt, Human
uggccaggcagaucugugcccca

SEQ ID NO: 2259055 - RNA, 14 nt, Human
uggccagcagcuug

SEQ ID NO: 2259056 - RNA, 12 nt, Human
uggccagcccca

SEQ ID NO: 2259057 - RNA, 13 nt, Human
uggccagccccac

SEQ ID NO: 2259058 - RNA, 15 nt, Human
uggccagccccacag

SEQ ID NO: 2259059 - RNA, 21 nt, Human
uggccagccaacuuuugcaug

SEQ ID NO: 2259060 - RNA, 13 nt, Human
uggccagcagcuu

SEQ ID NO: 2259061 - RNA, 12 nt, Human
uggccagcagcu

SEQ ID NO: 2259062 - RNA, 15 nt, Human
uggccacucagcuuc

SEQ ID NO: 2259063 - RNA, 22 nt, Human
uggccacucagcuuccuaccca

SEQ ID NO: 2259064 - RNA, 20 nt, Human
uggccagaugcaccagcccu

SEQ ID NO: 2259065 - RNA, 21 nt, Human
uggccagaugcaccagcccuu

SEQ ID NO: 2259066 - RNA, 21 nt, Human
uggcagugagugagccuggcu

SEQ ID NO: 2259067 - RNA, 17 nt, Human
uggccaccugagguggg

SEQ ID NO: 2259068 - RNA, 20 nt, Human
uggccaccugaggugggccc

SEQ ID NO: 2259069 - RNA, 17 nt, Human
uggccaccuuuucagcg

SEQ ID NO: 2259070 - RNA, 21 nt, Human
uggccaccugaggugggccca

SEQ ID NO: 2259071 - RNA, 22 nt, Human
uggccaccugaggugggcccag

SEQ ID NO: 2259072 - RNA, 23 nt, Human
uggccaccugaggugggcccagg

SEQ ID NO: 2259073 - RNA, 16 nt, Human
uggccaccuuuucagc

SEQ ID NO: 2259074 - RNA, 17 nt, Human
uggccacuccagacccc

SEQ ID NO: 2259075 - RNA, 20 nt, Human
uggccacuccagaccccugg

SEQ ID NO: 2259076 - RNA, 19 nt, Human
uggccacuaagcagaggag

SEQ ID NO: 2259077 - RNA, 18 nt, Human
uggccacuaagcagagga

SEQ ID NO: 2259078 - RNA, 12 nt, Human
uggccacucagc

SEQ ID NO: 2259079 - RNA, 13 nt, Human
uggccacucagcu

SEQ ID NO: 2259080 - RNA, 12 nt, Human
uggccacuaagc

SEQ ID NO: 2259081 - RNA, 20 nt, Human
uggaggcuuccugcguccuc

SEQ ID NO: 2259082 - RNA, 22 nt, Human
uggaggagcagugcaggcacag

SEQ ID NO: 2259083 - RNA, 20 nt, Human
uggaggagcagugcaggcac

SEQ ID NO: 2259084 - RNA, 21 nt, Human
uggaggagcagugcaggcaca

SEQ ID NO: 2259085 - RNA, 18 nt, Human
uggaggagcaaaggcuga

SEQ ID NO: 2259086 - RNA, 20 nt, Human
uggaggagcaaaggcugaga

SEQ ID NO: 2259087 - RNA, 21 nt, Human
uggaggagcaaaggcugagaa

SEQ ID NO: 2259088 - RNA, 13 nt, Human
uggaggagcagug

SEQ ID NO: 2259089 - RNA, 11 nt, Human
uggaggagcaa

SEQ ID NO: 2259090 - RNA, 14 nt, Human
uggaggagcaaagg

SEQ ID NO: 2259091 - RNA, 16 nt, Human
uggaggagcaaaggcu

SEQ ID NO: 2259092 - RNA, 14 nt, Human
uggaggagaaggac

SEQ ID NO: 2259093 - RNA, 15 nt, Human
uggaggagagaagaa

SEQ ID NO: 2259094 - RNA, 21 nt, Human
uggaggagaagaauuuucaga

SEQ ID NO: 2259095 - RNA, 14 nt, Human
uggaggagaagaau

SEQ ID NO: 2259096 - RNA, 19 nt, Human
uggaggacuagaaccugga

SEQ ID NO: 2259097 - RNA, 20 nt, Human
uggaggacuagaaccuggag

SEQ ID NO: 2259098 - RNA, 21 nt, Human
uggaggacuagaaccuggagg

SEQ ID NO: 2259099 - RNA, 19 nt, Human
uggagggaaugaaccugga

SEQ ID NO: 2259100 - RNA, 22 nt, Human
uggaggcuuccugcguccuccu

SEQ ID NO: 2259101 - RNA, 22 nt, Human
uggagggacaaguggacucagg

SEQ ID NO: 2259102 - RNA, 11 nt, Human
uggagggaagc

SEQ ID NO: 2259103 - RNA, 20 nt, Human
uggagggaaugaaccuggag

SEQ ID NO: 2259104 - RNA, 21 nt, Human
uggagggaaugaaccuggagg

SEQ ID NO: 2259105 - RNA, 21 nt, Human
uggagggcgugggagcguggg

SEQ ID NO: 2259106 - RNA, 20 nt, Human
uggagggcuagaaccuggag

SEQ ID NO: 2259107 - RNA, 21 nt, Human
uggagggcuagaaccuggaga

SEQ ID NO: 2259108 - RNA, 22 nt, Human
uggagggcuagaaccuggagaa

SEQ ID NO: 2259109 - RNA, 22 nt, Human
uggagggcuagaaccuggagag

SEQ ID NO: 2259110 - RNA, 23 nt, Human
uggagggcuagaaccuggagagc

SEQ ID NO: 2259111 - RNA, 14 nt, Human
uggaucacagcugc

SEQ ID NO: 2259112 - RNA, 15 nt, Human
uggaucacagcugcu

SEQ ID NO: 2259113 - RNA, 22 nt, Human
uggacucucagucucugagcag

SEQ ID NO: 2259114 - RNA, 13 nt, Human
uggacucugcaca

SEQ ID NO: 2259115 - RNA, 14 nt, Human
uggacucugcacau

SEQ ID NO: 2259116 - RNA, 14 nt, Human
uggaggaaagcaac

SEQ ID NO: 2259117 - RNA, 21 nt, Human
uggacucuacacugugaacuu

SEQ ID NO: 2259118 - RNA, 17 nt, Human
uggacucuacacuguga

SEQ ID NO: 2259119 - RNA, 20 nt, Human
uggacucucagucucugagc

SEQ ID NO: 2259120 - RNA, 15 nt, Human
uggacucucagucuc

SEQ ID NO: 2259121 - RNA, 15 nt, Human
uggacuccucugucc

SEQ ID NO: 2259122 - RNA, 14 nt, Human
uggacuccucuguc

SEQ ID NO: 2259123 - RNA, 15 nt, Human
uggacuccugcacac

SEQ ID NO: 2259124 - RNA, 16 nt, Human
uggacucgccuguaau

SEQ ID NO: 2259125 - RNA, 18 nt, Human
uggaggaagagggacaga

SEQ ID NO: 2259126 - RNA, 20 nt, Human
uggaggaaggaaacccagcu

SEQ ID NO: 2259127 - RNA, 12 nt, Human
uggaggaaggaa

SEQ ID NO: 2259128 - RNA, 18 nt, Human
uggaggaaggaaacccag

SEQ ID NO: 2259129 - RNA, 14 nt, Human
uggauuucagaaag

SEQ ID NO: 2259130 - RNA, 20 nt, Human
uggauuuauaaaugcuauuu

SEQ ID NO: 2259131 - RNA, 14 nt, Human
uggauuuauaaaug

SEQ ID NO: 2259132 - RNA, 18 nt, Human
uggaucuccaaggaccag

SEQ ID NO: 2259133 - RNA, 24 nt, Human
uggauuuaacagaaauguacagca

SEQ ID NO: 2259134 - RNA, 20 nt, Human
uggauuuaacagaaauguac

SEQ ID NO: 2259135 - RNA, 16 nt, Human
uggaucaguccuuuga

SEQ ID NO: 2259136 - RNA, 13 nt, Human
uggauccuagccu

SEQ ID NO: 2259137 - RNA, 23 nt, Human
uggauccuagccuuauccucuga

SEQ ID NO: 2259138 - RNA, 20 nt, Human
uggauccugaaauagaggcu

SEQ ID NO: 2259139 - RNA, 18 nt, Human
uggaucucauuggacccu

SEQ ID NO: 2259140 - RNA, 14 nt, Human
uggaucuccaagga

SEQ ID NO: 2259141 - RNA, 15 nt, Human
uggaucuccaaggac

SEQ ID NO: 2259142 - RNA, 19 nt, Human
uggaucaguccuuugauca

SEQ ID NO: 2259143 - RNA, 16 nt, Human
uggaucagaugaacuc

SEQ ID NO: 2259144 - RNA, 16 nt, Human
uggaucacagcugcuu

SEQ ID NO: 2259145 - RNA, 20 nt, Human
uggaucacagcugcuuucug

SEQ ID NO: 2259146 - RNA, 18 nt, Human
uggauuugccugugccac

SEQ ID NO: 2259147 - RNA, 17 nt, Human
uggauuugccugugcca

SEQ ID NO: 2259148 - RNA, 14 nt, Human
uggauuugacauug

SEQ ID NO: 2259149 - RNA, 13 nt, Human
uggauuugaagca

SEQ ID NO: 2259150 - RNA, 13 nt, Human
uggauuugaugcu

SEQ ID NO: 2259151 - RNA, 13 nt, Human
uggauuugacauu

SEQ ID NO: 2259152 - RNA, 15 nt, Human
uggauuuguuuaaaa

SEQ ID NO: 2259153 - RNA, 16 nt, Human
uggauuuguuuaaaag

SEQ ID NO: 2259154 - RNA, 17 nt, Human
uggauuuguuuaaaagg

SEQ ID NO: 2259155 - RNA, 22 nt, Human
uggauuuugguuuuguuccccu

SEQ ID NO: 2259156 - RNA, 19 nt, Human
uggauuuucuauuguuacu

SEQ ID NO: 2259157 - RNA, 20 nt, Human
uggauuuucuauuguuacuc

SEQ ID NO: 2259158 - RNA, 20 nt, Human
uggcaaauuaacuugaguuu

SEQ ID NO: 2259159 - RNA, 12 nt, Human
uggcaacagaag

SEQ ID NO: 2259160 - RNA, 17 nt, Human
uggcaaauuaacuugag

SEQ ID NO: 2259161 - RNA, 21 nt, Human
uggcaaagggagcagaacuga

SEQ ID NO: 2259162 - RNA, 22 nt, Human
uggcaaagggagcagaacugaa

SEQ ID NO: 2259163 - RNA, 17 nt, Human
uggcaaaggaaggugga

SEQ ID NO: 2259164 - RNA, 13 nt, Human
uggcaacagaagc

SEQ ID NO: 2259165 - RNA, 15 nt, Human
uggcaacagaagcag

SEQ ID NO: 2259166 - RNA, 14 nt, Human
uggcaacagaagug

SEQ ID NO: 2259167 - RNA, 15 nt, Human
uggcaacagaucugg

SEQ ID NO: 2259168 - RNA, 13 nt, Human
uggcaacagaucu

SEQ ID NO: 2259169 - RNA, 20 nt, Human
uggcaacagaucuggaaccu

SEQ ID NO: 2259170 - RNA, 18 nt, Human
uggcaacagaucuggaac

SEQ ID NO: 2259171 - RNA, 17 nt, Human
uggcaacagaucuggaa

SEQ ID NO: 2259172 - RNA, 16 nt, Human
uggcaacagaucugga

SEQ ID NO: 2259173 - RNA, 19 nt, Human
uggaaagacagcuucucau

SEQ ID NO: 2259174 - RNA, 17 nt, Human
uggaaacuguugccaga

SEQ ID NO: 2259175 - RNA, 14 nt, Human
uggaaacaggacca

SEQ ID NO: 2259176 - RNA, 21 nt, Human
uggaaacuguugccagagaug

SEQ ID NO: 2259177 - RNA, 21 nt, Human
uggaaagacuuuuccaacccu

SEQ ID NO: 2259178 - RNA, 22 nt, Human
uggaaacagcucgacuuuaaaa

SEQ ID NO: 2259179 - RNA, 23 nt, Human
uggaaacuucagcgguuuauaua

SEQ ID NO: 2259180 - RNA, 17 nt, Human
uggaaaacaaggaaguc

SEQ ID NO: 2259181 - RNA, 17 nt, Human
uggaaacagcucgacuu

SEQ ID NO: 2259182 - RNA, 23 nt, Human
uggaaagauaacuaggaaaucca

SEQ ID NO: 2259183 - RNA, 19 nt, Human
uggaaagcaucaccucagg

SEQ ID NO: 2259184 - RNA, 16 nt, Human
uggaaagcaucaccuc

SEQ ID NO: 2259185 - RNA, 23 nt, Human
uggaaagacagcuucucauccug

SEQ ID NO: 2259186 - RNA, 16 nt, Human
uggaaagaaucuaaua

SEQ ID NO: 2259187 - RNA, 18 nt, Human
uggaaagauaacuaggaa

SEQ ID NO: 2259188 - RNA, 14 nt, Human
uggaaagaguacuc

SEQ ID NO: 2259189 - RNA, 20 nt, Human
uggaaagaguaggaagacuu

SEQ ID NO: 2259190 - RNA, 12 nt, Human
uggaaagccucu

SEQ ID NO: 2259191 - RNA, 21 nt, Human
uggaacaucaucaaggcacug

SEQ ID NO: 2259192 - RNA, 23 nt, Human
uggaacaucaucaaggcacugcc

SEQ ID NO: 2259193 - RNA, 21 nt, Human
uggaaagcaucaccucaggcc

SEQ ID NO: 2259194 - RNA, 20 nt, Human
uggaaagcaucaccucaggc

SEQ ID NO: 2259195 - RNA, 21 nt, Human
uggaacauaaaauacaauguu

SEQ ID NO: 2259196 - RNA, 20 nt, Human
uggaacauaaaauacaaugu

SEQ ID NO: 2259197 - RNA, 15 nt, Human
ugcuuugaagcaguu

SEQ ID NO: 2259198 - RNA, 14 nt, Human
ugcuuugaagcagu

SEQ ID NO: 2259199 - RNA, 19 nt, Human
ugcuuugaagcaguugugu

SEQ ID NO: 2259200 - RNA, 22 nt, Human
ugcuuugaagcaguugugucag

SEQ ID NO: 2259201 - RNA, 17 nt, Human
uggaaaaauagccugcc

SEQ ID NO: 2259202 - RNA, 19 nt, Human
uggaaaaauccagaaagaa

SEQ ID NO: 2259203 - RNA, 18 nt, Human
uggaaaaauccagaaaga

SEQ ID NO: 2259204 - RNA, 18 nt, Human
uggaaaaaugagagaagg

SEQ ID NO: 2259205 - RNA, 13 nt, Human
uggaaaaauccag

SEQ ID NO: 2259206 - RNA, 18 nt, Human
ugcuuugacucaccuguu

SEQ ID NO: 2259207 - RNA, 12 nt, Human
uggaaaaauauu

SEQ ID NO: 2259208 - RNA, 20 nt, Human
uggaaaaauagccugccucu

SEQ ID NO: 2259209 - RNA, 22 nt, Human
ugcuuucuuucguuuguuuguu

SEQ ID NO: 2259210 - RNA, 15 nt, Human
ugcuuucuuucguuu

SEQ ID NO: 2259211 - RNA, 23 nt, Human
ugcuuucuguugucauugcuguu

SEQ ID NO: 2259212 - RNA, 14 nt, Human
ugcuuuacugucaa

SEQ ID NO: 2259213 - RNA, 13 nt, Human
ugcuuucugcuca

SEQ ID NO: 2259214 - RNA, 12 nt, Human
ugcuuucugcuc

SEQ ID NO: 2259215 - RNA, 20 nt, Human
ugcuuucugcucagcuucuc

SEQ ID NO: 2259216 - RNA, 19 nt, Human
ugcuuucugcucagcuucu

SEQ ID NO: 2259217 - RNA, 15 nt, Human
ugcuuucugcucagc

SEQ ID NO: 2259218 - RNA, 14 nt, Human
ugcuuucugcucag

SEQ ID NO: 2259219 - RNA, 20 nt, Human
ugcuggacggcauuccugcu

SEQ ID NO: 2259220 - RNA, 19 nt, Human
ugcuggacggcauuccugc

SEQ ID NO: 2259221 - RNA, 16 nt, Human
ugcuggacaguaucac

SEQ ID NO: 2259222 - RNA, 17 nt, Human
ugcuggaauucuaacaa

SEQ ID NO: 2259223 - RNA, 19 nt, Human
ugcuggacugucauagaaa

SEQ ID NO: 2259224 - RNA, 15 nt, Human
ugcuggacugucaua

SEQ ID NO: 2259225 - RNA, 14 nt, Human
ugcuggacugucau

SEQ ID NO: 2259226 - RNA, 21 nt, Human
ugcuggacggggacuggggau

SEQ ID NO: 2259227 - RNA, 10 nt, Human
ugcuggagcc

SEQ ID NO: 2259228 - RNA, 18 nt, Human
ugcuggagccacuaacua

SEQ ID NO: 2259229 - RNA, 14 nt, Human
ugcuggagauguuu

SEQ ID NO: 2259230 - RNA, 13 nt, Human
ugcuggagagguu

SEQ ID NO: 2259231 - RNA, 14 nt, Human
ugcuggagagguua

SEQ ID NO: 2259232 - RNA, 13 nt, Human
ugcuggagacucc

SEQ ID NO: 2259233 - RNA, 12 nt, Human
ugcuggagaggu

SEQ ID NO: 2259234 - RNA, 20 nt, Human
ugcuggacggggacugggga

SEQ ID NO: 2259235 - RNA, 13 nt, Human
ugcuggagaagag

SEQ ID NO: 2259236 - RNA, 18 nt, Human
ugcuggagaagagaggag

SEQ ID NO: 2259237 - RNA, 22 nt, Human
ugcuggagaagagaggagagga

SEQ ID NO: 2259238 - RNA, 19 nt, Human
ugcuuuaauuguuaagaua

SEQ ID NO: 2259239 - RNA, 20 nt, Human
ugcuuuaauaucaucaguau

SEQ ID NO: 2259240 - RNA, 18 nt, Human
ugcuuuaauaucaucagu

SEQ ID NO: 2259241 - RNA, 15 nt, Human
ugcuuuaauaucauc

SEQ ID NO: 2259242 - RNA, 13 nt, Human
ugcuuuaauauca

SEQ ID NO: 2259243 - RNA, 17 nt, Human
ugcuggagccuguguaa

SEQ ID NO: 2259244 - RNA, 19 nt, Human
ugcuggagccuguguaaca

SEQ ID NO: 2259245 - RNA, 19 nt, Human
ugcuggagccacuaacuag

SEQ ID NO: 2259246 - RNA, 20 nt, Human
ugcuggagccacuaacuaga

SEQ ID NO: 2259247 - RNA, 11 nt, Human
ugcuggagccu

SEQ ID NO: 2259248 - RNA, 12 nt, Human
ugcuggagccug

SEQ ID NO: 2259249 - RNA, 13 nt, Human
ugcuggagccugu

SEQ ID NO: 2259250 - RNA, 14 nt, Human
ugcuggagccugug

SEQ ID NO: 2259251 - RNA, 15 nt, Human
ugcuggagccugugu

SEQ ID NO: 2259252 - RNA, 16 nt, Human
ugcuggagccugugua

SEQ ID NO: 2259253 - RNA, 21 nt, Human
uggacuagagggaccucuccc

SEQ ID NO: 2259254 - RNA, 24 nt, Human
uggacuacccacguucucacaccc

SEQ ID NO: 2259255 - RNA, 19 nt, Human
uggacauccucuucugcuu

SEQ ID NO: 2259256 - RNA, 16 nt, Human
uggacaugagauaaug

SEQ ID NO: 2259257 - RNA, 12 nt, Human
uggacauggccc

SEQ ID NO: 2259258 - RNA, 14 nt, Human
uggacuaucugucu

SEQ ID NO: 2259259 - RNA, 15 nt, Human
uggacuaucugucug

SEQ ID NO: 2259260 - RNA, 17 nt, Human
uggacuaucugucuggu

SEQ ID NO: 2259261 - RNA, 20 nt, Human
uggacuaucugucugguggc

SEQ ID NO: 2259262 - RNA, 18 nt, Human
uggacuauuauaauuuaa

SEQ ID NO: 2259263 - RNA, 22 nt, Human
uggacuaucugucugguggccc

SEQ ID NO: 2259264 - RNA, 23 nt, Human
uggacuaucugucugguggcccc

SEQ ID NO: 2259265 - RNA, 20 nt, Human
uggacucaccucccccaucu

SEQ ID NO: 2259266 - RNA, 18 nt, Human
uggacucaccucccccau

SEQ ID NO: 2259267 - RNA, 13 nt, Human
uggacaugcacag

SEQ ID NO: 2259268 - RNA, 19 nt, Human
uggacaugcacagcuaaca

SEQ ID NO: 2259269 - RNA, 18 nt, Human
uggacauccuccucccac

SEQ ID NO: 2259270 - RNA, 12 nt, Human
uggacagcccca

SEQ ID NO: 2259271 - RNA, 20 nt, Human
uggacauccuccucccaccc

SEQ ID NO: 2259272 - RNA, 23 nt, Human
uggacauccuccucccacccggc

SEQ ID NO: 2259273 - RNA, 22 nt, Human
uggacaugaagauucuuuccca

SEQ ID NO: 2259274 - RNA, 21 nt, Human
uggacaugaagauucuuuccc

SEQ ID NO: 2259275 - RNA, 18 nt, Human
uggacauccucuucugcu

SEQ ID NO: 2259276 - RNA, 18 nt, Human
uggacaugaagauucuuu

SEQ ID NO: 2259277 - RNA, 12 nt, Human
uggacagaagaa

SEQ ID NO: 2259278 - RNA, 23 nt, Human
uggacacuuugaaauguguuucu

SEQ ID NO: 2259279 - RNA, 17 nt, Human
uggaaugguuauaaaag

SEQ ID NO: 2259280 - RNA, 18 nt, Human
uggaaugguuauaaaagu

SEQ ID NO: 2259281 - RNA, 21 nt, Human
uggacacuuugaaauguguuu

SEQ ID NO: 2259282 - RNA, 22 nt, Human
uggacacuuugaaauguguuuc

SEQ ID NO: 2259283 - RNA, 16 nt, Human
uggacagaagcagcuc

SEQ ID NO: 2259284 - RNA, 15 nt, Human
uggacagaagcagcu

SEQ ID NO: 2259285 - RNA, 16 nt, Human
uggacagacagaggau

SEQ ID NO: 2259286 - RNA, 22 nt, Human
uggacagacagaggaugagcuc

SEQ ID NO: 2259287 - RNA, 18 nt, Human
uggacagaagcagcucuu

SEQ ID NO: 2259288 - RNA, 17 nt, Human
uggacagaagcagcucu

SEQ ID NO: 2259289 - RNA, 17 nt, Human
uggaaugaauuaaauaa

SEQ ID NO: 2259290 - RNA, 18 nt, Human
uggaaugaauuaaauaaa

SEQ ID NO: 2259291 - RNA, 16 nt, Human
uggaaugcuguguuaa

SEQ ID NO: 2259292 - RNA, 16 nt, Human
uggaaugcuuccuaga

SEQ ID NO: 2259293 - RNA, 17 nt, Human
uggaaugcuuccuagaa

SEQ ID NO: 2259294 - RNA, 20 nt, Human
uggaaugaugggucaguugu

SEQ ID NO: 2259295 - RNA, 22 nt, Human
uggaaugcuugaaaaaugugca

SEQ ID NO: 2259296 - RNA, 17 nt, Human
uggaaugggcagcucau

SEQ ID NO: 2259297 - RNA, 24 nt, Human
uggaaugcuuccuagaaguuacug

SEQ ID NO: 2259298 - RNA, 18 nt, Human
uggaaugcuucuucucag

SEQ ID NO: 2259299 - RNA, 20 nt, Human
uggaaugcuucuucucaggc

SEQ ID NO: 2259300 - RNA, 13 nt, Human
uggaaugcuugaa

SEQ ID NO: 2259301 - RNA, 21 nt, Human
uggaacguuuuuccuguucuu

SEQ ID NO: 2259302 - RNA, 21 nt, Human
uggaacucauuccugccuguc

SEQ ID NO: 2259303 - RNA, 19 nt, Human
uggaacucauuccugccug

SEQ ID NO: 2259304 - RNA, 16 nt, Human
uggaacucauuccugc

SEQ ID NO: 2259305 - RNA, 19 nt, Human
uggaauaacauguaauuaa

SEQ ID NO: 2259306 - RNA, 15 nt, Human
uggaauaacauguaa

SEQ ID NO: 2259307 - RNA, 14 nt, Human
uggaauaacaugua

SEQ ID NO: 2259308 - RNA, 14 nt, Human
uggaaguuuugcau

SEQ ID NO: 2259309 - RNA, 22 nt, Human
ugcuuugacucaccuguuacuu

SEQ ID NO: 2259310 - RNA, 13 nt, Human
uggaauaaaauac

SEQ ID NO: 2259311 - RNA, 18 nt, Human
uggaauauaaggaaagca

SEQ ID NO: 2259312 - RNA, 14 nt, Human
uggaauauaaggaa

SEQ ID NO: 2259313 - RNA, 13 nt, Human
uggaauauaaaga

SEQ ID NO: 2259314 - RNA, 14 nt, Human
uggaauaauguaaa

SEQ ID NO: 2259315 - RNA, 22 nt, Human
uggaauaguauccuccagguuu

SEQ ID NO: 2259316 - RNA, 23 nt, Human
uggaauaguauccuccagguuuu

SEQ ID NO: 2259317 - RNA, 15 nt, Human
uggaauauauaacca

SEQ ID NO: 2259318 - RNA, 21 nt, Human
uggaauauaaggaaagcaaua

SEQ ID NO: 2259319 - RNA, 13 nt, Human
uggaauaguuuuu

SEQ ID NO: 2259320 - RNA, 16 nt, Human
uggaauauauaaccag

SEQ ID NO: 2259321 - RNA, 22 nt, Human
uggaauaauccuaaacauauga

SEQ ID NO: 2259322 - RNA, 17 nt, Human
uggaauaaggagaauga

SEQ ID NO: 2259323 - RNA, 15 nt, Human
uggaauaaguucaaa

SEQ ID NO: 2259324 - RNA, 15 nt, Human
uggaauaaaauacua

SEQ ID NO: 2259325 - RNA, 18 nt, Human
uggaauaaaauacuauuu

SEQ ID NO: 2259326 - RNA, 19 nt, Human
uggaauaaaauacuauuuu

SEQ ID NO: 2259327 - RNA, 21 nt, Human
uggaauaaaauauuuuuuuca

SEQ ID NO: 2259328 - RNA, 12 nt, Human
ucuagggaaaaa

SEQ ID NO: 2259329 - RNA, 17 nt, Human
ucuagguagugcccuau

SEQ ID NO: 2259330 - RNA, 20 nt, Human
ucuagguaggggcccacuuc

SEQ ID NO: 2259331 - RNA, 12 nt, Human
ucuaggcugggg

SEQ ID NO: 2259332 - RNA, 15 nt, Human
ucuagguaaauuaca

SEQ ID NO: 2259333 - RNA, 17 nt, Human
ucuagguggcaaggcug

SEQ ID NO: 2259334 - RNA, 23 nt, Human
ucuaggugcccuuggaggccagc

SEQ ID NO: 2259335 - RNA, 14 nt, Human
ucuagguucuaaaa

SEQ ID NO: 2259336 - RNA, 18 nt, Human
ucuagguggcaaggcugu

SEQ ID NO: 2259337 - RNA, 20 nt, Human
ucuagguggcaaggcugugc

SEQ ID NO: 2259338 - RNA, 23 nt, Human
ucuagguucuaaaaauugugauc

SEQ ID NO: 2259339 - RNA, 17 nt, Human
ucuagguuuaacucaga

SEQ ID NO: 2259340 - RNA, 19 nt, Human
ucuagguuuaacucagauc

SEQ ID NO: 2259341 - RNA, 21 nt, Human
ucuauaugaauuuaaauauaa

SEQ ID NO: 2259342 - RNA, 20 nt, Human
ucuagguuuaacucagauca

SEQ ID NO: 2259343 - RNA, 13 nt, Human
ucuauauguacuu

SEQ ID NO: 2259344 - RNA, 18 nt, Human
ucuauauguacuugucaa

SEQ ID NO: 2259345 - RNA, 20 nt, Human
ucuauauguacuugucaaag

SEQ ID NO: 2259346 - RNA, 21 nt, Human
ucuauauguacuugucaaaga

SEQ ID NO: 2259347 - RNA, 23 nt, Human
ucuauauguacuugucaaagaag

SEQ ID NO: 2259348 - RNA, 18 nt, Human
ucuacucauauauaucua

SEQ ID NO: 2259349 - RNA, 18 nt, Human
ucuacucauuccccgggg

SEQ ID NO: 2259350 - RNA, 19 nt, Human
ucuacuccuaccucagccu

SEQ ID NO: 2259351 - RNA, 17 nt, Human
ucuacuccuaccucagc

SEQ ID NO: 2259352 - RNA, 14 nt, Human
ucuacucauauaua

SEQ ID NO: 2259353 - RNA, 21 nt, Human
ucuacucagaaauuuuuauuu

SEQ ID NO: 2259354 - RNA, 14 nt, Human
ucuacucagaaauu

SEQ ID NO: 2259355 - RNA, 18 nt, Human
ucuacuaauuccacaccu

SEQ ID NO: 2259356 - RNA, 20 nt, Human
ucuacucgaguuacagacaa

SEQ ID NO: 2259357 - RNA, 21 nt, Human
ucuacucgaguuacagacaaa

SEQ ID NO: 2259358 - RNA, 19 nt, Human
ucuacuccuuguaaagacu

SEQ ID NO: 2259359 - RNA, 22 nt, Human
ucuacuccuaccucagccuaga

SEQ ID NO: 2259360 - RNA, 20 nt, Human
ucuacucuccucaucucuaa

SEQ ID NO: 2259361 - RNA, 18 nt, Human
ucuacucucccauggcuu

SEQ ID NO: 2259362 - RNA, 21 nt, Human
ucuacucccaaguaugggguu

SEQ ID NO: 2259363 - RNA, 13 nt, Human
ucuacucucccau

SEQ ID NO: 2259364 - RNA, 18 nt, Human
ucuacucuagggaaaaac

SEQ ID NO: 2259365 - RNA, 18 nt, Human
ucuaggcaucccagggga

SEQ ID NO: 2259366 - RNA, 18 nt, Human
ucuaggaggucucuaaga

SEQ ID NO: 2259367 - RNA, 16 nt, Human
ucuacucuuaagccau

SEQ ID NO: 2259368 - RNA, 17 nt, Human
ucuacucuuaagccauc

SEQ ID NO: 2259369 - RNA, 18 nt, Human
ucuacucuuaagccaucu

SEQ ID NO: 2259370 - RNA, 20 nt, Human
ucuaauuggaagaaauuccu

SEQ ID NO: 2259371 - RNA, 22 nt, Human
ucuaauuggaagaaauuccugu

SEQ ID NO: 2259372 - RNA, 22 nt, Human
ucuaauuuaucuugucucuggg

SEQ ID NO: 2259373 - RNA, 23 nt, Human
ucuaauuuaucuugucucugggc

SEQ ID NO: 2259374 - RNA, 19 nt, Human
ucuaauuucaaaaauauaa

SEQ ID NO: 2259375 - RNA, 22 nt, Human
ucuaauuucaaaaauauaacuu

SEQ ID NO: 2259376 - RNA, 12 nt, Human
ucuacuaaaaau

SEQ ID NO: 2259377 - RNA, 15 nt, Human
ucuacuaaaaauaca

SEQ ID NO: 2259378 - RNA, 19 nt, Human
ucuacuaaaaauacaaaaa

SEQ ID NO: 2259379 - RNA, 15 nt, Human
ucuacuaaaaaugca

SEQ ID NO: 2259380 - RNA, 20 nt, Human
ucuaauuucaaaaauauaac

SEQ ID NO: 2259381 - RNA, 15 nt, Human
ucuaauuuuggaugg

SEQ ID NO: 2259382 - RNA, 16 nt, Human
ucuaauuuuggaugga

SEQ ID NO: 2259383 - RNA, 14 nt, Human
ucuacuauuuaugu

SEQ ID NO: 2259384 - RNA, 15 nt, Human
ucuacuaauuccaca

SEQ ID NO: 2259385 - RNA, 22 nt, Human
ucuaauauuuauugcuuuauaa

SEQ ID NO: 2259386 - RNA, 18 nt, Human
ucuaauauuaaaaauaug

SEQ ID NO: 2259387 - RNA, 20 nt, Human
ucuaauauuuauugcuuuau

SEQ ID NO: 2259388 - RNA, 19 nt, Human
ucuaaucuagauaucgacu

SEQ ID NO: 2259389 - RNA, 20 nt, Human
ucuaaucuagauaucgacuu

SEQ ID NO: 2259390 - RNA, 15 nt, Human
ucuaauguauuuuau

SEQ ID NO: 2259391 - RNA, 20 nt, Human
ucuaauggguauuuaaacaa

SEQ ID NO: 2259392 - RNA, 17 nt, Human
ucuaauguauuuuauug

SEQ ID NO: 2259393 - RNA, 24 nt, Human
ucuaauguauuuuauuguaacaga

SEQ ID NO: 2259394 - RNA, 14 nt, Human
ucuaaugucuucau

SEQ ID NO: 2259395 - RNA, 15 nt, Human
ucuaaugucuucauu

SEQ ID NO: 2259396 - RNA, 17 nt, Human
ucuaaugucuucauuuc

SEQ ID NO: 2259397 - RNA, 11 nt, Human
ucuaauguggu

SEQ ID NO: 2259398 - RNA, 19 nt, Human
ucuaaugugguuauuucuc

SEQ ID NO: 2259399 - RNA, 20 nt, Human
ucuaaugugguuauuucucu

SEQ ID NO: 2259400 - RNA, 12 nt, Human
ucguccagggag

SEQ ID NO: 2259401 - RNA, 13 nt, Human
ucguccucccccu

SEQ ID NO: 2259402 - RNA, 17 nt, Human
ucguccucccccugcca

SEQ ID NO: 2259403 - RNA, 16 nt, Human
ucguccucccccugcc

SEQ ID NO: 2259404 - RNA, 14 nt, Human
ucguccucccccug

SEQ ID NO: 2259405 - RNA, 23 nt, Human
ucgucaucauuuuuccuucccuu

SEQ ID NO: 2259406 - RNA, 23 nt, Human
ucguccucccccugccagugccu

SEQ ID NO: 2259407 - RNA, 18 nt, Human
ucguccucccccugccag

SEQ ID NO: 2259408 - RNA, 14 nt, Human
ucgucgcacagucu

SEQ ID NO: 2259409 - RNA, 19 nt, Human
ucgucggggggacagcucc

SEQ ID NO: 2259410 - RNA, 16 nt, Human
ucgucgcacagucucu

SEQ ID NO: 2259411 - RNA, 21 nt, Human
ucgucuccagccccuucucag

SEQ ID NO: 2259412 - RNA, 18 nt, Human
ucgucuguuuauaaacau

SEQ ID NO: 2259413 - RNA, 15 nt, Human
ucgucugacugugug

SEQ ID NO: 2259414 - RNA, 16 nt, Human
ucgucugacugugugu

SEQ ID NO: 2259415 - RNA, 17 nt, Human
ucuaauauuaaaaauau

SEQ ID NO: 2259416 - RNA, 16 nt, Human
ucgucuuaacucacca

SEQ ID NO: 2259417 - RNA, 22 nt, Human
ucucaauuuuugguugaauaaa

SEQ ID NO: 2259418 - RNA, 13 nt, Human
ucucaauuuuugg

SEQ ID NO: 2259419 - RNA, 16 nt, Human
ucucacacaugagcau

SEQ ID NO: 2259420 - RNA, 18 nt, Human
ucucaaauuucuaaaucu

SEQ ID NO: 2259421 - RNA, 12 nt, Human
ucucaauuucua

SEQ ID NO: 2259422 - RNA, 20 nt, Human
ucucacugccaugccagcuu

SEQ ID NO: 2259423 - RNA, 21 nt, Human
ucucacugagaagauugugaa

SEQ ID NO: 2259424 - RNA, 22 nt, Human
ucucacugagaagauugugaau

SEQ ID NO: 2259425 - RNA, 23 nt, Human
ucucacucugucgcccagucugg

SEQ ID NO: 2259426 - RNA, 21 nt, Human
ucucacacaugagcaucaggc

SEQ ID NO: 2259427 - RNA, 16 nt, Human
ucuaucuuauauaguu

SEQ ID NO: 2259428 - RNA, 16 nt, Human
ucuauccuacaacaag

SEQ ID NO: 2259429 - RNA, 12 nt, Human
ucuaucucaucu

SEQ ID NO: 2259430 - RNA, 14 nt, Human
ucuauccucuguaa

SEQ ID NO: 2259431 - RNA, 19 nt, Human
ucuaucauuuuuguacagu

SEQ ID NO: 2259432 - RNA, 14 nt, Human
ucuauccacagaga

SEQ ID NO: 2259433 - RNA, 15 nt, Human
ucuauccacagagag

SEQ ID NO: 2259434 - RNA, 17 nt, Human
ucuauccacagagaguc

SEQ ID NO: 2259435 - RNA, 23 nt, Human
ucuaucauuuuuguacaguuugc

SEQ ID NO: 2259436 - RNA, 16 nt, Human
ucucaaauuucuaaau

SEQ ID NO: 2259437 - RNA, 14 nt, Human
ucucaaauuucuaa

SEQ ID NO: 2259438 - RNA, 22 nt, Human
ucuaucuuugagcgcccacuag

SEQ ID NO: 2259439 - RNA, 17 nt, Human
ucuaucuugcucuguaa

SEQ ID NO: 2259440 - RNA, 19 nt, Human
ucuaucuugcucuguaauc

SEQ ID NO: 2259441 - RNA, 20 nt, Human
ucuaucuugcucuguaaucu

SEQ ID NO: 2259442 - RNA, 13 nt, Human
ucucaaauuucua

SEQ ID NO: 2259443 - RNA, 16 nt, Human
ucucagauauuuauau

SEQ ID NO: 2259444 - RNA, 14 nt, Human
ucucagauauuuau

SEQ ID NO: 2259445 - RNA, 21 nt, Human
ucucagagcuacuugggccau

SEQ ID NO: 2259446 - RNA, 22 nt, Human
ucucagacuuuggaaaaugcau

SEQ ID NO: 2259447 - RNA, 19 nt, Human
ucucagagcuacuugggcc

SEQ ID NO: 2259448 - RNA, 20 nt, Human
ucucagagcuacuugggcca

SEQ ID NO: 2259449 - RNA, 21 nt, Human
ucucagacuuuggaaaaugca

SEQ ID NO: 2259450 - RNA, 16 nt, Human
ucucagacugcaugua

SEQ ID NO: 2259451 - RNA, 17 nt, Human
ucucagacccuuuagcc

SEQ ID NO: 2259452 - RNA, 23 nt, Human
ucucagauauuuauauuuuuauu

SEQ ID NO: 2259453 - RNA, 20 nt, Human
ucucagauauuuauauuuuu

SEQ ID NO: 2259454 - RNA, 14 nt, Human
ucucagauccuugu

SEQ ID NO: 2259455 - RNA, 16 nt, Human
ucucagauccuuguuu

SEQ ID NO: 2259456 - RNA, 17 nt, Human
ucucagauccuuguuuc

SEQ ID NO: 2259457 - RNA, 18 nt, Human
ucucagauccuuguuuca

SEQ ID NO: 2259458 - RNA, 19 nt, Human
ucucagauccuuguuucaa

SEQ ID NO: 2259459 - RNA, 22 nt, Human
ucucagauccuuguuucaaaca

SEQ ID NO: 2259460 - RNA, 14 nt, Human
ucucacuguucccu

SEQ ID NO: 2259461 - RNA, 21 nt, Human
ucucacugugggaaggccagc

SEQ ID NO: 2259462 - RNA, 16 nt, Human
ucucacuguucccucu

SEQ ID NO: 2259463 - RNA, 17 nt, Human
ucucacuguucccucug

SEQ ID NO: 2259464 - RNA, 18 nt, Human
ucucacuguucccucugc

SEQ ID NO: 2259465 - RNA, 21 nt, Human
ucucacuguucccucugcucc

SEQ ID NO: 2259466 - RNA, 22 nt, Human
ucucacuguucccucugcuccu

SEQ ID NO: 2259467 - RNA, 17 nt, Human
ucucacuggaugcaaag

SEQ ID NO: 2259468 - RNA, 20 nt, Human
ucucacugugggaaggccag

SEQ ID NO: 2259469 - RNA, 14 nt, Human
ucucacuguugccc

SEQ ID NO: 2259470 - RNA, 15 nt, Human
ucucacuguugccca

SEQ ID NO: 2259471 - RNA, 13 nt, Human
ucucaguuucacu

SEQ ID NO: 2259472 - RNA, 16 nt, Human
ucucaguuuguguguc

SEQ ID NO: 2259473 - RNA, 17 nt, Human
ucucaguuugugugucu

SEQ ID NO: 2259474 - RNA, 16 nt, Human
ucucaguuuucauaag

SEQ ID NO: 2259475 - RNA, 15 nt, Human
ucucaguuuucauaa

SEQ ID NO: 2259476 - RNA, 18 nt, Human
ucucaguuugugugucuu

SEQ ID NO: 2259477 - RNA, 19 nt, Human
ucucaguuugugugucuua

SEQ ID NO: 2259478 - RNA, 20 nt, Human
ucucagauccuuguuucaaa

SEQ ID NO: 2259479 - RNA, 13 nt, Human
uccuuuguacuuu

SEQ ID NO: 2259480 - RNA, 18 nt, Human
uccuuuguacuuugugcu

SEQ ID NO: 2259481 - RNA, 11 nt, Human
uccuuuguaua

SEQ ID NO: 2259482 - RNA, 19 nt, Human
uccuuuguauauuauuucu

SEQ ID NO: 2259483 - RNA, 17 nt, Human
uccuuugugaggaagcc

SEQ ID NO: 2259484 - RNA, 18 nt, Human
uccuuugugaggaagccg

SEQ ID NO: 2259485 - RNA, 22 nt, Human
uccuuugugaggaagccgcugg

SEQ ID NO: 2259486 - RNA, 13 nt, Human
uccuuugggaaag

SEQ ID NO: 2259487 - RNA, 20 nt, Human
uccuuugcacugagggccac

SEQ ID NO: 2259488 - RNA, 22 nt, Human
uccuuuggagcuuuuuucuuua

SEQ ID NO: 2259489 - RNA, 15 nt, Human
uccuuugcaggcuca

SEQ ID NO: 2259490 - RNA, 22 nt, Human
uccuuugaucaguauaauuuuu

SEQ ID NO: 2259491 - RNA, 14 nt, Human
uccuuugcacugag

SEQ ID NO: 2259492 - RNA, 15 nt, Human
uccuuugcacugagg

SEQ ID NO: 2259493 - RNA, 17 nt, Human
uccuuugcacugagggc

SEQ ID NO: 2259494 - RNA, 21 nt, Human
uccuuugaauccucucucugu

SEQ ID NO: 2259495 - RNA, 15 nt, Human
uccuuugaagaggaa

SEQ ID NO: 2259496 - RNA, 20 nt, Human
uccuuugauaaaauaaauga

SEQ ID NO: 2259497 - RNA, 17 nt, Human
uccuuggggcaggcagu

SEQ ID NO: 2259498 - RNA, 14 nt, Human
uccuuugaagagga

SEQ ID NO: 2259499 - RNA, 18 nt, Human
uccuuggugccuggccug

SEQ ID NO: 2259500 - RNA, 20 nt, Human
uccuuugaauccucucucug

SEQ ID NO: 2259501 - RNA, 20 nt, Human
uccuuugaagaggaaaauga

SEQ ID NO: 2259502 - RNA, 22 nt, Human
uccuuggugucgggcaugacac

SEQ ID NO: 2259503 - RNA, 21 nt, Human
uccuugcuguccuaggccaca

SEQ ID NO: 2259504 - RNA, 16 nt, Human
uccuugcucugcaggc

SEQ ID NO: 2259505 - RNA, 14 nt, Human
uccuuggugccugg

SEQ ID NO: 2259506 - RNA, 19 nt, Human
uccuugcuguccuaggcca

SEQ ID NO: 2259507 - RNA, 17 nt, Human
uccuugcuguccuaggc

SEQ ID NO: 2259508 - RNA, 15 nt, Human
uccuugcucugcacc

SEQ ID NO: 2259509 - RNA, 14 nt, Human
uccuugcucugcag

SEQ ID NO: 2259510 - RNA, 18 nt, Human
uccuuggugucgggcaug

SEQ ID NO: 2259511 - RNA, 21 nt, Human
uccuuggugucgggcaugaca

SEQ ID NO: 2259512 - RNA, 18 nt, Human
uccuugccuccuguguaa

SEQ ID NO: 2259513 - RNA, 14 nt, Human
uccuugcuacccag

SEQ ID NO: 2259514 - RNA, 17 nt, Human
uccuugccuccugugua

SEQ ID NO: 2259515 - RNA, 16 nt, Human
uccuugccuccugugu

SEQ ID NO: 2259516 - RNA, 19 nt, Human
uccuugaagaacugcaggc

SEQ ID NO: 2259517 - RNA, 15 nt, Human
uccuugcuaugauga

SEQ ID NO: 2259518 - RNA, 13 nt, Human
uccuugcucuccc

SEQ ID NO: 2259519 - RNA, 14 nt, Human
uccuugcucucccu

SEQ ID NO: 2259520 - RNA, 19 nt, Human
uccuugcucucccucuucu

SEQ ID NO: 2259521 - RNA, 20 nt, Human
uccuugcucucccucuucuc

SEQ ID NO: 2259522 - RNA, 21 nt, Human
uccuugcucucccucuucuca

SEQ ID NO: 2259523 - RNA, 14 nt, Human
uccuugcucugcac

SEQ ID NO: 2259524 - RNA, 22 nt, Human
uccuucuuugauaauguuaaau

SEQ ID NO: 2259525 - RNA, 19 nt, Human
uccuucuuugauaauguua

SEQ ID NO: 2259526 - RNA, 20 nt, Human
uccuucuuugauaauguuaa

SEQ ID NO: 2259527 - RNA, 18 nt, Human
uccuugaagaacugcagg

SEQ ID NO: 2259528 - RNA, 17 nt, Human
uccuugcaucaauuuuu

SEQ ID NO: 2259529 - RNA, 21 nt, Human
uccuuaucacugacacaaaaa

SEQ ID NO: 2259530 - RNA, 22 nt, Human
uccuuagucuucucauagcauu

SEQ ID NO: 2259531 - RNA, 18 nt, Human
uccuuagucuucucauag

SEQ ID NO: 2259532 - RNA, 17 nt, Human
uccuuaucaaaggacac

SEQ ID NO: 2259533 - RNA, 13 nt, Human
uccuucuuugaua

SEQ ID NO: 2259534 - RNA, 16 nt, Human
uccuucuuugauaaug

SEQ ID NO: 2259535 - RNA, 22 nt, Human
uccuugaaaacacuguucucug

SEQ ID NO: 2259536 - RNA, 23 nt, Human
uccuugaaaacacuguucucugc

SEQ ID NO: 2259537 - RNA, 17 nt, Human
uccuuaccucuuccgga

SEQ ID NO: 2259538 - RNA, 15 nt, Human
uccuuaccuuuuuau

SEQ ID NO: 2259539 - RNA, 20 nt, Human
uccuuaccuuuuuauuugca

SEQ ID NO: 2259540 - RNA, 17 nt, Human
uccuuagucuucucaua

SEQ ID NO: 2259541 - RNA, 16 nt, Human
uccuuagucuucucau

SEQ ID NO: 2259542 - RNA, 15 nt, Human
uccuuagucuucuca

SEQ ID NO: 2259543 - RNA, 22 nt, Human
uccuuagguuuuuuuccuucug

SEQ ID NO: 2259544 - RNA, 23 nt, Human
uccuuagcuuagaccucagccug

SEQ ID NO: 2259545 - RNA, 15 nt, Human
uccuuaucaaaggac

SEQ ID NO: 2259546 - RNA, 14 nt, Human
uccuuaucaaagga

SEQ ID NO: 2259547 - RNA, 20 nt, Human
uccuguccaaccuaaccccu

SEQ ID NO: 2259548 - RNA, 17 nt, Human
uccuguccacacccagc

SEQ ID NO: 2259549 - RNA, 19 nt, Human
uccuguccacacccagcuc

SEQ ID NO: 2259550 - RNA, 22 nt, Human
uccuguccacacccagcucagc

SEQ ID NO: 2259551 - RNA, 20 nt, Human
uccugaggggcaucugcccc

SEQ ID NO: 2259552 - RNA, 18 nt, Human
uccuguccaaccuaaccc

SEQ ID NO: 2259553 - RNA, 16 nt, Human
uccuguccagcuccaa

SEQ ID NO: 2259554 - RNA, 15 nt, Human
uccuguccagcucca

SEQ ID NO: 2259555 - RNA, 14 nt, Human
uccuguccagcucc

SEQ ID NO: 2259556 - RNA, 13 nt, Human
uccuguccagcuc

SEQ ID NO: 2259557 - RNA, 19 nt, Human
uccugaggggcaucugccc

SEQ ID NO: 2259558 - RNA, 16 nt, Human
uccugaggggcaucug

SEQ ID NO: 2259559 - RNA, 15 nt, Human
uccugaggggcaucu

SEQ ID NO: 2259560 - RNA, 13 nt, Human
uccugaggcugag

SEQ ID NO: 2259561 - RNA, 18 nt, Human
uccugaggcuuuggauuu

SEQ ID NO: 2259562 - RNA, 17 nt, Human
uccugaggcuuuggauu

SEQ ID NO: 2259563 - RNA, 16 nt, Human
uccugaggcuuuggau

SEQ ID NO: 2259564 - RNA, 14 nt, Human
uccuguccagagag

SEQ ID NO: 2259565 - RNA, 18 nt, Human
uccugucccuucucuuaa

SEQ ID NO: 2259566 - RNA, 21 nt, Human
uccugucccuucucuuaauuu

SEQ ID NO: 2259567 - RNA, 19 nt, Human
uccugucccucauccauag

SEQ ID NO: 2259568 - RNA, 17 nt, Human
uccuguccagcuccaac

SEQ ID NO: 2259569 - RNA, 16 nt, Human
uccugucccaccaugc

SEQ ID NO: 2259570 - RNA, 14 nt, Human
uccuuaccucuucc

SEQ ID NO: 2259571 - RNA, 18 nt, Human
uccuuacccaucugcacc

SEQ ID NO: 2259572 - RNA, 14 nt, Human
uccuuacccaucug

SEQ ID NO: 2259573 - RNA, 20 nt, Human
uccuuaccagcagagcaccu

SEQ ID NO: 2259574 - RNA, 21 nt, Human
uccuuaccagcagagcaccuu

SEQ ID NO: 2259575 - RNA, 17 nt, Human
ucgcaggauucuuccuc

SEQ ID NO: 2259576 - RNA, 15 nt, Human
ucgauucauauugaa

SEQ ID NO: 2259577 - RNA, 20 nt, Human
ucgauuauucccuguacaau

SEQ ID NO: 2259578 - RNA, 16 nt, Human
ucgauguuauguaaaa

SEQ ID NO: 2259579 - RNA, 23 nt, Human
ucgcaggauucuuccucccuccc

SEQ ID NO: 2259580 - RNA, 21 nt, Human
ucgcaggauucuuccucccuc

SEQ ID NO: 2259581 - RNA, 14 nt, Human
ucgcaucaaaagac

SEQ ID NO: 2259582 - RNA, 15 nt, Human
ucgcaucaaaagaca

SEQ ID NO: 2259583 - RNA, 17 nt, Human
ucgcaucaaaagacaau

SEQ ID NO: 2259584 - RNA, 20 nt, Human
ucgcaucaaaagacaauucu

SEQ ID NO: 2259585 - RNA, 20 nt, Human
ucgcauggucacacacugau

SEQ ID NO: 2259586 - RNA, 19 nt, Human
ucgcauggucacacacuga

SEQ ID NO: 2259587 - RNA, 21 nt, Human
ucgcaucaaaagacaauucuu

SEQ ID NO: 2259588 - RNA, 22 nt, Human
ucgcaucaaaagacaauucuuu

SEQ ID NO: 2259589 - RNA, 23 nt, Human
ucgcaucaaaagacaauucuuua

SEQ ID NO: 2259590 - RNA, 22 nt, Human
uccuuuucgcaggauucuuccu

SEQ ID NO: 2259591 - RNA, 23 nt, Human
uccuuuguauauuauuucuagga

SEQ ID NO: 2259592 - RNA, 15 nt, Human
uccuuuguguuucua

SEQ ID NO: 2259593 - RNA, 20 nt, Human
uccuuuguguuucuauugac

SEQ ID NO: 2259594 - RNA, 18 nt, Human
uccuuuucgcaggauucu

SEQ ID NO: 2259595 - RNA, 19 nt, Human
ucgaugaagcccaauaaac

SEQ ID NO: 2259596 - RNA, 22 nt, Human
ucgauacugcgacuuucugccu

SEQ ID NO: 2259597 - RNA, 23 nt, Human
ucgauacugcgacuuucugccug

SEQ ID NO: 2259598 - RNA, 23 nt, Human
ucgaugaagcccaauaaaccucu

SEQ ID NO: 2259599 - RNA, 14 nt, Human
ucgaugcaaugaac

SEQ ID NO: 2259600 - RNA, 23 nt, Human
ucgaugggggagucugaagcaga

SEQ ID NO: 2259601 - RNA, 19 nt, Human
ucgauacugcgacuuucug

SEQ ID NO: 2259602 - RNA, 20 nt, Human
ucgauacugcgacuuucugc

SEQ ID NO: 2259603 - RNA, 19 nt, Human
ucgcuucuugccucugugc

SEQ ID NO: 2259604 - RNA, 20 nt, Human
ucgcuugugcagaaaacauu

SEQ ID NO: 2259605 - RNA, 21 nt, Human
ucgcuugugcagaaaacauug

SEQ ID NO: 2259606 - RNA, 21 nt, Human
ucgcuucuugccucugugcug

SEQ ID NO: 2259607 - RNA, 18 nt, Human
ucggaaaacaugcuacac

SEQ ID NO: 2259608 - RNA, 15 nt, Human
ucggaaaacaugcua

SEQ ID NO: 2259609 - RNA, 15 nt, Human
ucgcauuugucaaug

SEQ ID NO: 2259610 - RNA, 13 nt, Human
ucgcauuugucaa

SEQ ID NO: 2259611 - RNA, 18 nt, Human
ucgccaccccuccuuccu

SEQ ID NO: 2259612 - RNA, 18 nt, Human
ucgccaccuggcauuccu

SEQ ID NO: 2259613 - RNA, 21 nt, Human
ucgccaccuggcauuccuucu

SEQ ID NO: 2259614 - RNA, 14 nt, Human
ucgcccagucugga

SEQ ID NO: 2259615 - RNA, 19 nt, Human
ucgcccagucuggaaugca

SEQ ID NO: 2259616 - RNA, 23 nt, Human
ucgcccagucuggaaugcagugg

SEQ ID NO: 2259617 - RNA, 15 nt, Human
ucgcuuuugauaauc

SEQ ID NO: 2259618 - RNA, 19 nt, Human
ucgcuuuauuggcugagau

SEQ ID NO: 2259619 - RNA, 23 nt, Human
ucgcuugugcagaaaacauuguu

SEQ ID NO: 2259620 - RNA, 21 nt, Human
ucggaaaccuugguguaguug

SEQ ID NO: 2259621 - RNA, 22 nt, Human
ucggagccucauccgaggcagg

SEQ ID NO: 2259622 - RNA, 23 nt, Human
ucggagacagugaucuccauaug

SEQ ID NO: 2259623 - RNA, 23 nt, Human
ucggagccucauccgaggcaggg

SEQ ID NO: 2259624 - RNA, 12 nt, Human
ucggaggaagcc

SEQ ID NO: 2259625 - RNA, 13 nt, Human
ucggaggaagccc

SEQ ID NO: 2259626 - RNA, 20 nt, Human
ucggaggccccaaaggaaaa

SEQ ID NO: 2259627 - RNA, 12 nt, Human
ucggaggcccca

SEQ ID NO: 2259628 - RNA, 14 nt, Human
ucggaggcugcccc

SEQ ID NO: 2259629 - RNA, 23 nt, Human
ucggaggcugcccccggcccccu

SEQ ID NO: 2259630 - RNA, 14 nt, Human
ucggaggcuuggga

SEQ ID NO: 2259631 - RNA, 22 nt, Human
ucggaggcuugucagagcuggg

SEQ ID NO: 2259632 - RNA, 21 nt, Human
ucgucauguuggccaggcugg

SEQ ID NO: 2259633 - RNA, 17 nt, Human
ucggccuccauccugag

SEQ ID NO: 2259634 - RNA, 16 nt, Human
ucggccuccauccuga

SEQ ID NO: 2259635 - RNA, 15 nt, Human
ucggccuccauccug

SEQ ID NO: 2259636 - RNA, 14 nt, Human
uccuauuuguuuuc

SEQ ID NO: 2259637 - RNA, 16 nt, Human
uccuauuuguuuucau

SEQ ID NO: 2259638 - RNA, 17 nt, Human
uccuauuuguuuucaug

SEQ ID NO: 2259639 - RNA, 11 nt, Human
uccuccagguu

SEQ ID NO: 2259640 - RNA, 12 nt, Human
uccuccagguuu

SEQ ID NO: 2259641 - RNA, 13 nt, Human
uccuccagguuuu

SEQ ID NO: 2259642 - RNA, 14 nt, Human
uccuccagguuuuu

SEQ ID NO: 2259643 - RNA, 15 nt, Human
uccuccagguuuuuc

SEQ ID NO: 2259644 - RNA, 16 nt, Human
uccuccagguuuuuca

SEQ ID NO: 2259645 - RNA, 17 nt, Human
uccuccagguuuuucaa

SEQ ID NO: 2259646 - RNA, 18 nt, Human
uccuccagguuuuucaau

SEQ ID NO: 2259647 - RNA, 19 nt, Human
uccuccagguuuuucaauu

SEQ ID NO: 2259648 - RNA, 17 nt, Human
uccuccgucaccucaga

SEQ ID NO: 2259649 - RNA, 23 nt, Human
uccuccgagccggggaguuucuu

SEQ ID NO: 2259650 - RNA, 14 nt, Human
uccuccgaggccag

SEQ ID NO: 2259651 - RNA, 20 nt, Human
uccuccagguuuuucaauua

SEQ ID NO: 2259652 - RNA, 21 nt, Human
uccuccagguuuuucaauuaa

SEQ ID NO: 2259653 - RNA, 23 nt, Human
uccuccagguuuuucaauuaaac

SEQ ID NO: 2259654 - RNA, 22 nt, Human
uccuccagguuuuucaauuaaa

SEQ ID NO: 2259655 - RNA, 17 nt, Human
uccucccuuuuuccuug

SEQ ID NO: 2259656 - RNA, 19 nt, Human
uccucccuuuuuccuuguc

SEQ ID NO: 2259657 - RNA, 16 nt, Human
uccuccguccagccgc

SEQ ID NO: 2259658 - RNA, 14 nt, Human
uccuccguccagcc

SEQ ID NO: 2259659 - RNA, 18 nt, Human
uccuccguccagccgcca

SEQ ID NO: 2259660 - RNA, 18 nt, Human
uccuccgugcuuccucag

SEQ ID NO: 2259661 - RNA, 15 nt, Human
uccuccgaggccagu

SEQ ID NO: 2259662 - RNA, 12 nt, Human
uccuccucagau

SEQ ID NO: 2259663 - RNA, 12 nt, Human
uccuccugcaga

SEQ ID NO: 2259664 - RNA, 15 nt, Human
uccuccugcagacca

SEQ ID NO: 2259665 - RNA, 20 nt, Human
uccuccugcagaccacgccc

SEQ ID NO: 2259666 - RNA, 18 nt, Human
uccuccucaccucaugcc

SEQ ID NO: 2259667 - RNA, 19 nt, Human
uccuccgugcuuccucagu

SEQ ID NO: 2259668 - RNA, 22 nt, Human
uccuccuaccgaaaccuugccu

SEQ ID NO: 2259669 - RNA, 12 nt, Human
uccuccucaccu

SEQ ID NO: 2259670 - RNA, 16 nt, Human
uccuccucaccucaug

SEQ ID NO: 2259671 - RNA, 16 nt, Human
uccuauuugcacugua

SEQ ID NO: 2259672 - RNA, 18 nt, Human
uccuauuugccaugggcu

SEQ ID NO: 2259673 - RNA, 18 nt, Human
uccuauuuggggcuugca

SEQ ID NO: 2259674 - RNA, 15 nt, Human
uccuauuucuuauag

SEQ ID NO: 2259675 - RNA, 20 nt, Human
uccucaaaacuucagacaua

SEQ ID NO: 2259676 - RNA, 12 nt, Human
uccuccaggugc

SEQ ID NO: 2259677 - RNA, 13 nt, Human
uccuccaggugca

SEQ ID NO: 2259678 - RNA, 14 nt, Human
uccuccaggugcac

SEQ ID NO: 2259679 - RNA, 18 nt, Human
uccuccaggugcacaagc

SEQ ID NO: 2259680 - RNA, 20 nt, Human
uccuccaggugcacaagcuc

SEQ ID NO: 2259681 - RNA, 22 nt, Human
uccuccaggugcacaagcucca

SEQ ID NO: 2259682 - RNA, 15 nt, Human
uccuauugugauuug

SEQ ID NO: 2259683 - RNA, 20 nt, Human
uccuauggcuggccacugca

SEQ ID NO: 2259684 - RNA, 22 nt, Human
uccuauggcuggccacugcaca

SEQ ID NO: 2259685 - RNA, 18 nt, Human
uccuauugugauuugacu

SEQ ID NO: 2259686 - RNA, 19 nt, Human
uccuauugugauuugacug

SEQ ID NO: 2259687 - RNA, 20 nt, Human
uccuauugugauuugacugu

SEQ ID NO: 2259688 - RNA, 22 nt, Human
uccuauugugauuugacuguuu

SEQ ID NO: 2259689 - RNA, 13 nt, Human
uccuaucuguguu

SEQ ID NO: 2259690 - RNA, 14 nt, Human
uccuaucuguguuu

SEQ ID NO: 2259691 - RNA, 17 nt, Human
uccuaucuguguuuuga

SEQ ID NO: 2259692 - RNA, 21 nt, Human
uccuaguuccaccaucaagcc

SEQ ID NO: 2259693 - RNA, 22 nt, Human
uccuaucagccugucucuucca

SEQ ID NO: 2259694 - RNA, 18 nt, Human
uccggaauccuguccuca

SEQ ID NO: 2259695 - RNA, 22 nt, Human
uccggaauccuguccucagcuu

SEQ ID NO: 2259696 - RNA, 15 nt, Human
uccggaguagcuggg

SEQ ID NO: 2259697 - RNA, 21 nt, Human
uccggagugagaagcuuugcc

SEQ ID NO: 2259698 - RNA, 15 nt, Human
uccggagauguagca

SEQ ID NO: 2259699 - RNA, 15 nt, Human
uccggacacuccuag

SEQ ID NO: 2259700 - RNA, 18 nt, Human
uccggacacuccuagaga

SEQ ID NO: 2259701 - RNA, 16 nt, Human
uccuaagcuauucagu

SEQ ID NO: 2259702 - RNA, 17 nt, Human
uccuaagagugcugggc

SEQ ID NO: 2259703 - RNA, 19 nt, Human
uccuaagagugcugggcau

SEQ ID NO: 2259704 - RNA, 17 nt, Human
uccggauuggcuugugu

SEQ ID NO: 2259705 - RNA, 18 nt, Human
uccuaagcuauucaguaa

SEQ ID NO: 2259706 - RNA, 14 nt, Human
uccuaagccuaaaa

SEQ ID NO: 2259707 - RNA, 14 nt, Human
uccuaguuccacca

SEQ ID NO: 2259708 - RNA, 17 nt, Human
uccuaguuccaccauca

SEQ ID NO: 2259709 - RNA, 21 nt, Human
uccugagccagauuucacucu

SEQ ID NO: 2259710 - RNA, 15 nt, Human
uccugaggcuccacu

SEQ ID NO: 2259711 - RNA, 18 nt, Human
uccugagccagauuucac

SEQ ID NO: 2259712 - RNA, 19 nt, Human
uccugagccagauuucacu

SEQ ID NO: 2259713 - RNA, 20 nt, Human
uccucugggcaggaccucag

SEQ ID NO: 2259714 - RNA, 19 nt, Human
uccucugucagucacagcc

SEQ ID NO: 2259715 - RNA, 19 nt, Human
uccucuguacagagcccac

SEQ ID NO: 2259716 - RNA, 23 nt, Human
uccucuguacagagcccacgccc

SEQ ID NO: 2259717 - RNA, 17 nt, Human
uccucuguccaggcacu

SEQ ID NO: 2259718 - RNA, 22 nt, Human
uccucugucagucacagccacc

SEQ ID NO: 2259719 - RNA, 21 nt, Human
uccucugucagucacagccac

SEQ ID NO: 2259720 - RNA, 17 nt, Human
uccugagccagauuuca

SEQ ID NO: 2259721 - RNA, 13 nt, Human
uccucuguccagg

SEQ ID NO: 2259722 - RNA, 12 nt, Human
uccugaggcugg

SEQ ID NO: 2259723 - RNA, 17 nt, Human
uccugaggcuccacuug

SEQ ID NO: 2259724 - RNA, 16 nt, Human
uccugaggcuccacuu

SEQ ID NO: 2259725 - RNA, 15 nt, Human
uccugaggcugggcu

SEQ ID NO: 2259726 - RNA, 16 nt, Human
uccugaggcugggcuc

SEQ ID NO: 2259727 - RNA, 17 nt, Human
uccugaggcugggcucc

SEQ ID NO: 2259728 - RNA, 19 nt, Human
uccugaggcugggcucccu

SEQ ID NO: 2259729 - RNA, 9 nt, Human
uccucuggc

SEQ ID NO: 2259730 - RNA, 19 nt, Human
uccucuggauggcaccaga

SEQ ID NO: 2259731 - RNA, 23 nt, Human
uccucuggcuggcuaacuggaag

SEQ ID NO: 2259732 - RNA, 15 nt, Human
uccucuguacagagc

SEQ ID NO: 2259733 - RNA, 13 nt, Human
uccucuguacaga

SEQ ID NO: 2259734 - RNA, 14 nt, Human
uccucucagccccu

SEQ ID NO: 2259735 - RNA, 17 nt, Human
uccucuggauggcacca

SEQ ID NO: 2259736 - RNA, 15 nt, Human
uccucuggccugugu

SEQ ID NO: 2259737 - RNA, 19 nt, Human
uccucuauugauguacagu

SEQ ID NO: 2259738 - RNA, 18 nt, Human
uccucucaaccaccuuuc

SEQ ID NO: 2259739 - RNA, 21 nt, Human
uccucucaaccaccuuucaga

SEQ ID NO: 2259740 - RNA, 20 nt, Human
uccucucaaccaccuuucag

SEQ ID NO: 2259741 - RNA, 17 nt, Human
uccucugcugcuggcug

SEQ ID NO: 2259742 - RNA, 18 nt, Human
uccucucacuaaacuuua

SEQ ID NO: 2259743 - RNA, 16 nt, Human
uccucgcaagcugggu

SEQ ID NO: 2259744 - RNA, 14 nt, Human
uccucgcagagagg

SEQ ID NO: 2259745 - RNA, 16 nt, Human
uccucgcagagaggcc

SEQ ID NO: 2259746 - RNA, 17 nt, Human
uccucgcagagaggcca

SEQ ID NO: 2259747 - RNA, 15 nt, Human
uccucgcaagcuggg

SEQ ID NO: 2259748 - RNA, 14 nt, Human
uccucgcaagcugg

SEQ ID NO: 2259749 - RNA, 13 nt, Human
uccucgcaagcug

SEQ ID NO: 2259750 - RNA, 17 nt, Human
uccucgagggcagggac

SEQ ID NO: 2259751 - RNA, 17 nt, Human
uccucuaggaggucucu

SEQ ID NO: 2259752 - RNA, 23 nt, Human
uccucgcagagaggccaggugca

SEQ ID NO: 2259753 - RNA, 21 nt, Human
uccucuaggaggucucuaaga

SEQ ID NO: 2259754 - RNA, 16 nt, Human
uccuccugcccaccug

SEQ ID NO: 2259755 - RNA, 12 nt, Human
uccuccugccca

SEQ ID NO: 2259756 - RNA, 12 nt, Human
uccuccugcuca

SEQ ID NO: 2259757 - RNA, 11 nt, Human
uccuccuggaa

SEQ ID NO: 2259758 - RNA, 17 nt, Human
uccuccugcccaccugu

SEQ ID NO: 2259759 - RNA, 13 nt, Human
uccuccuggcaga

SEQ ID NO: 2259760 - RNA, 13 nt, Human
uccuccuggacuc

SEQ ID NO: 2259761 - RNA, 21 nt, Human
uccuccuuuucacaguucucu

SEQ ID NO: 2259762 - RNA, 16 nt, Human
uccuccugggcccucu

SEQ ID NO: 2259763 - RNA, 15 nt, Human
uccuccugggcccuc

SEQ ID NO: 2259764 - RNA, 14 nt, Human
uccuccugggcccu

SEQ ID NO: 2259765 - RNA, 15 nt, Human
uccggaauccugucc

SEQ ID NO: 2259766 - RNA, 17 nt, Human
uccgcccugcuccuccc

SEQ ID NO: 2259767 - RNA, 14 nt, Human
uccgcccugcuccu

SEQ ID NO: 2259768 - RNA, 15 nt, Human
uccgcccugcuccuc

SEQ ID NO: 2259769 - RNA, 19 nt, Human
uccgcccugcuccucccug

SEQ ID NO: 2259770 - RNA, 21 nt, Human
uccgcuuucuacccagcgagc

SEQ ID NO: 2259771 - RNA, 22 nt, Human
uccgcccucaaaaugacagcca

SEQ ID NO: 2259772 - RNA, 12 nt, Human
uccgcccugcuc

SEQ ID NO: 2259773 - RNA, 16 nt, Human
uccgcccugccacuca

SEQ ID NO: 2259774 - RNA, 14 nt, Human
uccgcccugccacu

SEQ ID NO: 2259775 - RNA, 15 nt, Human
uccgcccugccacuc

SEQ ID NO: 2259776 - RNA, 13 nt, Human
uccgcccugccac

SEQ ID NO: 2259777 - RNA, 14 nt, Human
uccgaggcaggguc

SEQ ID NO: 2259778 - RNA, 13 nt, Human
uccgaggcagggu

SEQ ID NO: 2259779 - RNA, 12 nt, Human
uccgaggcaggg

SEQ ID NO: 2259780 - RNA, 21 nt, Human
uccgagccggggaguuucuuu

SEQ ID NO: 2259781 - RNA, 24 nt, Human
uccgagccggggaguuucuuuccu

SEQ ID NO: 2259782 - RNA, 17 nt, Human
uccgagagagcaccccu

SEQ ID NO: 2259783 - RNA, 13 nt, Human
uccgagagggaga

SEQ ID NO: 2259784 - RNA, 14 nt, Human
uccgagagggagag

SEQ ID NO: 2259785 - RNA, 16 nt, Human
uccgagaggugggcca

SEQ ID NO: 2259786 - RNA, 15 nt, Human
uccgagagggagaga

SEQ ID NO: 2259787 - RNA, 19 nt, Human
uccgagccggggaguuucu

SEQ ID NO: 2259788 - RNA, 19 nt, Human
uccgccagggcccacaccc

SEQ ID NO: 2259789 - RNA, 13 nt, Human
uccgccagggccc

SEQ ID NO: 2259790 - RNA, 18 nt, Human
uccgccagggcccacacc

SEQ ID NO: 2259791 - RNA, 21 nt, Human
uccgcccacaggaagccugca

SEQ ID NO: 2259792 - RNA, 22 nt, Human
uccgaaagggacuuggaagcuc

SEQ ID NO: 2259793 - RNA, 19 nt, Human
uccgaacacccucgaagcg

SEQ ID NO: 2259794 - RNA, 17 nt, Human
uccgaaccuccucugug

SEQ ID NO: 2259795 - RNA, 16 nt, Human
uccgaaccuccucugu

SEQ ID NO: 2259796 - RNA, 17 nt, Human
uccgacucuucugagca

SEQ ID NO: 2259797 - RNA, 15 nt, Human
uccgaaccuccucug

SEQ ID NO: 2259798 - RNA, 12 nt, Human
uccgacugcuuu

SEQ ID NO: 2259799 - RNA, 15 nt, Human
uccgacugcuuugga

SEQ ID NO: 2259800 - RNA, 21 nt, Human
uccgacuugaauuuucccacu

SEQ ID NO: 2259801 - RNA, 22 nt, Human
uccgacuugaauuuucccacug

SEQ ID NO: 2259802 - RNA, 20 nt, Human
ucccuucugcuacuggcaaa

SEQ ID NO: 2259803 - RNA, 13 nt, Human
ucccuucuugguu

SEQ ID NO: 2259804 - RNA, 22 nt, Human
ucccuucugucccucacagcac

SEQ ID NO: 2259805 - RNA, 17 nt, Human
ucccuucugucccucac

SEQ ID NO: 2259806 - RNA, 17 nt, Human
ucccuucuuuuucuucu

SEQ ID NO: 2259807 - RNA, 17 nt, Human
ucccuugaaauuuuaaa

SEQ ID NO: 2259808 - RNA, 17 nt, Human
ucccuugaccaggccug

SEQ ID NO: 2259809 - RNA, 21 nt, Human
ucccuugaccaggccugggcc

SEQ ID NO: 2259810 - RNA, 21 nt, Human
uccgaaagggacuuggaagcu

SEQ ID NO: 2259811 - RNA, 17 nt, Human
ucccuugagaccucagc

SEQ ID NO: 2259812 - RNA, 16 nt, Human
ucccuugagaccucag

SEQ ID NO: 2259813 - RNA, 13 nt, Human
ucccuugagaccu

SEQ ID NO: 2259814 - RNA, 19 nt, Human
uccgaaaccaaagaagaaa

SEQ ID NO: 2259815 - RNA, 18 nt, Human
uccgaaaccaaagaagaa

SEQ ID NO: 2259816 - RNA, 22 nt, Human
uccgaaaaauccucuuccucug

SEQ ID NO: 2259817 - RNA, 23 nt, Human
uccgaaaaauccucuuccucuga

SEQ ID NO: 2259818 - RNA, 18 nt, Human
ucccugggcauugcuuuc

SEQ ID NO: 2259819 - RNA, 14 nt, Human
ucccuucccaccuc

SEQ ID NO: 2259820 - RNA, 15 nt, Human
ucccugggcugugcu

SEQ ID NO: 2259821 - RNA, 16 nt, Human
ucccugggcugugcua

SEQ ID NO: 2259822 - RNA, 19 nt, Human
ucccugggcugugcuaccu

SEQ ID NO: 2259823 - RNA, 16 nt, Human
ucccuucccaccucuc

SEQ ID NO: 2259824 - RNA, 16 nt, Human
ucccuucccauaagcu

SEQ ID NO: 2259825 - RNA, 20 nt, Human
ucccugggcugugcuaccug

SEQ ID NO: 2259826 - RNA, 20 nt, Human
ucccuggggcuagggggagc

SEQ ID NO: 2259827 - RNA, 22 nt, Human
ucccuucccaugacccaggcug

SEQ ID NO: 2259828 - RNA, 13 nt, Human
ucccuucugcuac

SEQ ID NO: 2259829 - RNA, 15 nt, Human
ucccuucugcuacug

SEQ ID NO: 2259830 - RNA, 14 nt, Human
ucccuucugcuacu

SEQ ID NO: 2259831 - RNA, 16 nt, Human
ucccuucugucccuca

SEQ ID NO: 2259832 - RNA, 17 nt, Human
ucccuucccaccucucu

SEQ ID NO: 2259833 - RNA, 21 nt, Human
ucccuucccacuggaggcaug

SEQ ID NO: 2259834 - RNA, 13 nt, Human
ucccugccagcuc

SEQ ID NO: 2259835 - RNA, 14 nt, Human
ucccugcauuucug

SEQ ID NO: 2259836 - RNA, 17 nt, Human
ucccugcauuucugagu

SEQ ID NO: 2259837 - RNA, 14 nt, Human
ucccugccccuccc

SEQ ID NO: 2259838 - RNA, 16 nt, Human
ucccugccccccagcc

SEQ ID NO: 2259839 - RNA, 14 nt, Human
ucccuggcucccau

SEQ ID NO: 2259840 - RNA, 16 nt, Human
ucccuggccuuucaua

SEQ ID NO: 2259841 - RNA, 24 nt, Human
ucccuggccuuucauauuuuagcu

SEQ ID NO: 2259842 - RNA, 15 nt, Human
ucccuggccuuucau

SEQ ID NO: 2259843 - RNA, 18 nt, Human
ucccugccccucccuuca

SEQ ID NO: 2259844 - RNA, 17 nt, Human
ucccugggcauugcuuu

SEQ ID NO: 2259845 - RNA, 12 nt, Human
ucccugggcauu

SEQ ID NO: 2259846 - RNA, 16 nt, Human
ucccugggcagaaagu

SEQ ID NO: 2259847 - RNA, 22 nt, Human
ucccuggcuuguaacuccacca

SEQ ID NO: 2259848 - RNA, 19 nt, Human
ucccugggaggaaauuuga

SEQ ID NO: 2259849 - RNA, 11 nt, Human
ucccuggcuug

SEQ ID NO: 2259850 - RNA, 21 nt, Human
ucccuggcuuguaacuccacc

SEQ ID NO: 2259851 - RNA, 19 nt, Human
ucccuggcuuguaacucca

SEQ ID NO: 2259852 - RNA, 18 nt, Human
ucccuggcuuguaacucc

SEQ ID NO: 2259853 - RNA, 20 nt, Human
ucccuggcucucagaaggua

SEQ ID NO: 2259854 - RNA, 19 nt, Human
ucccuggcucucagaaggu

SEQ ID NO: 2259855 - RNA, 14 nt, Human
ucccuggcugcccu

SEQ ID NO: 2259856 - RNA, 15 nt, Human
ucccuggcugcccug

SEQ ID NO: 2259857 - RNA, 18 nt, Human
ucccuggcucucagaagg

SEQ ID NO: 2259858 - RNA, 16 nt, Human
ucccuggcucucagaa

SEQ ID NO: 2259859 - RNA, 15 nt, Human
ucccuggcucucaga

SEQ ID NO: 2259860 - RNA, 23 nt, Human
ucccuggcugcccuggcccugag

SEQ ID NO: 2259861 - RNA, 21 nt, Human
ucccuggcugcccuggcccug

SEQ ID NO: 2259862 - RNA, 22 nt, Human
ucccuggcugcccuggcccuga

SEQ ID NO: 2259863 - RNA, 16 nt, Human
ucccuggcugcccugg

SEQ ID NO: 2259864 - RNA, 18 nt, Human
ucccuggcugcccuggcc

SEQ ID NO: 2259865 - RNA, 19 nt, Human
ucccuggcugcccuggccc

SEQ ID NO: 2259866 - RNA, 20 nt, Human
ucccuggcugcccuggcccu

SEQ ID NO: 2259867 - RNA, 20 nt, Human
ucccucucaggcaugccugu

SEQ ID NO: 2259868 - RNA, 19 nt, Human
ucccucucaggcaugccug

SEQ ID NO: 2259869 - RNA, 19 nt, Human
ucccucuauuuauguuugc

SEQ ID NO: 2259870 - RNA, 13 nt, Human
ucccucuauuuau

SEQ ID NO: 2259871 - RNA, 13 nt, Human
ucccuccucaccu

SEQ ID NO: 2259872 - RNA, 23 nt, Human
ucccucuacugggagccuaccca

SEQ ID NO: 2259873 - RNA, 21 nt, Human
ucccucucucuucugcuccac

SEQ ID NO: 2259874 - RNA, 23 nt, Human
ucccucucaggcaugccugugug

SEQ ID NO: 2259875 - RNA, 22 nt, Human
ucccucucaggcaugccugugu

SEQ ID NO: 2259876 - RNA, 20 nt, Human
ucccucuccauaaccccacc

SEQ ID NO: 2259877 - RNA, 20 nt, Human
ucccucugccugucccucuc

SEQ ID NO: 2259878 - RNA, 18 nt, Human
ucccucugccugucccuc

SEQ ID NO: 2259879 - RNA, 16 nt, Human
ucccucugccuguccc

SEQ ID NO: 2259880 - RNA, 21 nt, Human
ucccucugccugaaccuucca

SEQ ID NO: 2259881 - RNA, 19 nt, Human
ucccucugaggcuguagga

SEQ ID NO: 2259882 - RNA, 11 nt, Human
ucccucugccu

SEQ ID NO: 2259883 - RNA, 13 nt, Human
ucccucugcccca

SEQ ID NO: 2259884 - RNA, 19 nt, Human
ucccucugaccugcaggcc

SEQ ID NO: 2259885 - RNA, 18 nt, Human
ucccucugaccugcaggc

SEQ ID NO: 2259886 - RNA, 21 nt, Human
ucccucugagaauuccaagga

SEQ ID NO: 2259887 - RNA, 22 nt, Human
ucccucugagaauuccaaggag

SEQ ID NO: 2259888 - RNA, 16 nt, Human
ucccucugaggcugua

SEQ ID NO: 2259889 - RNA, 17 nt, Human
ucccucugaccugcagg

SEQ ID NO: 2259890 - RNA, 13 nt, Human
ucccucugaccug

SEQ ID NO: 2259891 - RNA, 23 nt, Human
ucccucucucuucugcuccaccc

SEQ ID NO: 2259892 - RNA, 20 nt, Human
ucccucuggcccugccuucu

SEQ ID NO: 2259893 - RNA, 19 nt, Human
ucccucuggcccugccuuc

SEQ ID NO: 2259894 - RNA, 18 nt, Human
ucccucuggcccugccuu

SEQ ID NO: 2259895 - RNA, 17 nt, Human
ucccucuggcccugccu

SEQ ID NO: 2259896 - RNA, 16 nt, Human
ucccucuggcccugcc

SEQ ID NO: 2259897 - RNA, 20 nt, Human
ucccucugcuccuggagccu

SEQ ID NO: 2259898 - RNA, 15 nt, Human
ucccucugcuccugg

SEQ ID NO: 2259899 - RNA, 18 nt, Human
ucccucugcuccuggagc

SEQ ID NO: 2259900 - RNA, 13 nt, Human
ucccucuggggcu

SEQ ID NO: 2259901 - RNA, 20 nt, Human
ucccugcacuugcagacucu

SEQ ID NO: 2259902 - RNA, 17 nt, Human
ucccucuggggcuguuc

SEQ ID NO: 2259903 - RNA, 14 nt, Human
ucccugccaaugga

SEQ ID NO: 2259904 - RNA, 16 nt, Human
ucccugccaauggacu

SEQ ID NO: 2259905 - RNA, 21 nt, Human
ucccugcaucugaccagcagc

SEQ ID NO: 2259906 - RNA, 20 nt, Human
ucccugcaucugaccagcag

SEQ ID NO: 2259907 - RNA, 18 nt, Human
ucccugcaucugaccagc

SEQ ID NO: 2259908 - RNA, 16 nt, Human
ucccugcaucugacca

SEQ ID NO: 2259909 - RNA, 22 nt, Human
ucccugcaucugaccagcagcg

SEQ ID NO: 2259910 - RNA, 13 nt, Human
ucccucuguuucu

SEQ ID NO: 2259911 - RNA, 14 nt, Human
ucccucuguuucuc

SEQ ID NO: 2259912 - RNA, 12 nt, Human
ucccuccucacc

SEQ ID NO: 2259913 - RNA, 15 nt, Human
ucccuccgggaccug

SEQ ID NO: 2259914 - RNA, 14 nt, Human
ucccuccgggaccu

SEQ ID NO: 2259915 - RNA, 22 nt, Human
ucccucuacugggagccuaccc

SEQ ID NO: 2259916 - RNA, 18 nt, Human
ucccucuacugggagccu

SEQ ID NO: 2259917 - RNA, 15 nt, Human
ucccucccuuugaaa

SEQ ID NO: 2259918 - RNA, 22 nt, Human
ucccuagcuuuagacccugggu

SEQ ID NO: 2259919 - RNA, 19 nt, Human
ucccuagcuuuagacccug

SEQ ID NO: 2259920 - RNA, 20 nt, Human
ucccuagcuuuagacccugg

SEQ ID NO: 2259921 - RNA, 19 nt, Human
ucccuccgauccuuccucc

SEQ ID NO: 2259922 - RNA, 15 nt, Human
ucccuccgauccuuc

SEQ ID NO: 2259923 - RNA, 18 nt, Human
ucccuccgauccuuccuc

SEQ ID NO: 2259924 - RNA, 14 nt, Human
ucccucccuugggg

SEQ ID NO: 2259925 - RNA, 13 nt, Human
ucccucccuuggg

SEQ ID NO: 2259926 - RNA, 18 nt, Human
ucccucccuuccucuuuc

SEQ ID NO: 2259927 - RNA, 18 nt, Human
ucccuagcugugaccucu

SEQ ID NO: 2259928 - RNA, 20 nt, Human
ucccuagccagcacuuguau

SEQ ID NO: 2259929 - RNA, 22 nt, Human
ucccuagccagcacuuguauau

SEQ ID NO: 2259930 - RNA, 16 nt, Human
ucccuagccagcacuu

SEQ ID NO: 2259931 - RNA, 17 nt, Human
ucccuagccagcacuug

SEQ ID NO: 2259932 - RNA, 20 nt, Human
ucccuagaggguuccuguag

SEQ ID NO: 2259933 - RNA, 19 nt, Human
ucccuagaggguuccugua

SEQ ID NO: 2259934 - RNA, 16 nt, Human
ucccuagaucuuucua

SEQ ID NO: 2259935 - RNA, 23 nt, Human
ucccuagaucuuucuauuccaaa

SEQ ID NO: 2259936 - RNA, 18 nt, Human
ucccuagaggguuccugu

SEQ ID NO: 2259937 - RNA, 17 nt, Human
ucccuagaggguuccug

SEQ ID NO: 2259938 - RNA, 18 nt, Human
ucccuagaaacuuccaaa

SEQ ID NO: 2259939 - RNA, 17 nt, Human
ucccuacuuccugugac

SEQ ID NO: 2259940 - RNA, 19 nt, Human
ucccuagaaacuuccaaau

SEQ ID NO: 2259941 - RNA, 17 nt, Human
ucccaugagccucagca

SEQ ID NO: 2259942 - RNA, 22 nt, Human
ucccaugagccucagcauccug

SEQ ID NO: 2259943 - RNA, 12 nt, Human
ucccaugaugua

SEQ ID NO: 2259944 - RNA, 16 nt, Human
ucccaugaucccugug

SEQ ID NO: 2259945 - RNA, 19 nt, Human
ucccaugaucccuguguug

SEQ ID NO: 2259946 - RNA, 15 nt, Human
ucccaugaucccugu

SEQ ID NO: 2259947 - RNA, 19 nt, Human
ucccaugacccaggcuggg

SEQ ID NO: 2259948 - RNA, 19 nt, Human
ucccuacccccuaagagcc

SEQ ID NO: 2259949 - RNA, 13 nt, Human
ucccuaccaccuc

SEQ ID NO: 2259950 - RNA, 20 nt, Human
ucccuacccccuaagagcca

SEQ ID NO: 2259951 - RNA, 18 nt, Human
ucccuaccaccuccccag

SEQ ID NO: 2259952 - RNA, 19 nt, Human
ucccuaccgagucucuucu

SEQ ID NO: 2259953 - RNA, 21 nt, Human
ucccuaccgagucucuucucc

SEQ ID NO: 2259954 - RNA, 22 nt, Human
ucccuaccgagucucuucucca

SEQ ID NO: 2259955 - RNA, 23 nt, Human
ucccuaccgagucucuucuccac

SEQ ID NO: 2259956 - RNA, 18 nt, Human
uccacuuucagugaaagc

SEQ ID NO: 2259957 - RNA, 14 nt, Human
uccacuuucuagcc

SEQ ID NO: 2259958 - RNA, 17 nt, Human
uccacuuuaucuugaau

SEQ ID NO: 2259959 - RNA, 22 nt, Human
uccagagaguggcuccucccgg

SEQ ID NO: 2259960 - RNA, 19 nt, Human
uccagagaguggcuccucc

SEQ ID NO: 2259961 - RNA, 12 nt, Human
uccagagggcac

SEQ ID NO: 2259962 - RNA, 20 nt, Human
uccagaggcuauuauuuuca

SEQ ID NO: 2259963 - RNA, 15 nt, Human
uccagaugcagggca

SEQ ID NO: 2259964 - RNA, 17 nt, Human
uccagagggcacucugc

SEQ ID NO: 2259965 - RNA, 21 nt, Human
uccacuuagaaauugcauuuc

SEQ ID NO: 2259966 - RNA, 23 nt, Human
uccacuuagaaauugcauuuccu

SEQ ID NO: 2259967 - RNA, 15 nt, Human
uccacuuuaucuuga

SEQ ID NO: 2259968 - RNA, 12 nt, Human
uccacuguguau

SEQ ID NO: 2259969 - RNA, 20 nt, Human
uccacuguguauagaaguag

SEQ ID NO: 2259970 - RNA, 14 nt, Human
uccacccugucccc

SEQ ID NO: 2259971 - RNA, 12 nt, Human
uccacccugucc

SEQ ID NO: 2259972 - RNA, 22 nt, Human
uccacugugccaugugccaggu

SEQ ID NO: 2259973 - RNA, 13 nt, Human
uccacccugcucu

SEQ ID NO: 2259974 - RNA, 14 nt, Human
uccacccugcucuc

SEQ ID NO: 2259975 - RNA, 12 nt, Human
uccacccuggaa

SEQ ID NO: 2259976 - RNA, 22 nt, Human
uccacccuggccgaguccaagc

SEQ ID NO: 2259977 - RNA, 13 nt, Human
uccacaggaagug

SEQ ID NO: 2259978 - RNA, 21 nt, Human
uccacccugcucuccgaccag

SEQ ID NO: 2259979 - RNA, 21 nt, Human
uccagaugccuucuccagaca

SEQ ID NO: 2259980 - RNA, 19 nt, Human
uccagaugcagggcaguca

SEQ ID NO: 2259981 - RNA, 18 nt, Human
uccagaugcagggcaguc

SEQ ID NO: 2259982 - RNA, 17 nt, Human
uccagaugcagggcagu

SEQ ID NO: 2259983 - RNA, 16 nt, Human
uccagaugcagggcag

SEQ ID NO: 2259984 - RNA, 22 nt, Human
uccagauuuuuuacagcugccu

SEQ ID NO: 2259985 - RNA, 16 nt, Human
uccagauuuacacugg

SEQ ID NO: 2259986 - RNA, 18 nt, Human
uccagauuuacacuggga

SEQ ID NO: 2259987 - RNA, 20 nt, Human
uccagauuuacacugggaga

SEQ ID NO: 2259988 - RNA, 19 nt, Human
uccagauguuuccagacuu

SEQ ID NO: 2259989 - RNA, 18 nt, Human
uccagauguuuccagacu

SEQ ID NO: 2259990 - RNA, 17 nt, Human
uccagauugacgacaag

SEQ ID NO: 2259991 - RNA, 18 nt, Human
uccagcaauucuccugcc

SEQ ID NO: 2259992 - RNA, 19 nt, Human
uccagauuuacacugggag

SEQ ID NO: 2259993 - RNA, 20 nt, Human
uccagcaauucuccugccuc

SEQ ID NO: 2259994 - RNA, 19 nt, Human
uccagcaauucuccugccu

SEQ ID NO: 2259995 - RNA, 23 nt, Human
uccagggccacgugccaggcccg

SEQ ID NO: 2259996 - RNA, 22 nt, Human
uccagggccacgugccaggccc

SEQ ID NO: 2259997 - RNA, 13 nt, Human
uccaggagaggag

SEQ ID NO: 2259998 - RNA, 13 nt, Human
uccagggcccuga

SEQ ID NO: 2259999 - RNA, 17 nt, Human
uccagggcccccaucuc

SEQ ID NO: 2260000 - RNA, 23 nt, Human
uccaggagaaggccaauuccuau

SEQ ID NO: 2260001 - RNA, 20 nt, Human
uccaggagaaggccaauucc

SEQ ID NO: 2260002 - RNA, 16 nt, Human
uccaggagaaggccaa

SEQ ID NO: 2260003 - RNA, 22 nt, Human
uccaggaaugccuccucccugg

SEQ ID NO: 2260004 - RNA, 23 nt, Human
uccaggacuauauuugggccugc

SEQ ID NO: 2260005 - RNA, 20 nt, Human
uccaggacuauauuugggcc

SEQ ID NO: 2260006 - RNA, 21 nt, Human
uccaggaaacuccacaucugc

SEQ ID NO: 2260007 - RNA, 23 nt, Human
uccaggaaacuccacaucugccu

SEQ ID NO: 2260008 - RNA, 18 nt, Human
uccaggaaccacaccaca

SEQ ID NO: 2260009 - RNA, 20 nt, Human
uccaggaaggcggggcuuca

SEQ ID NO: 2260010 - RNA, 17 nt, Human
uccaggaaaugugcaca

SEQ ID NO: 2260011 - RNA, 19 nt, Human
uccagcuggguuggaaaac

SEQ ID NO: 2260012 - RNA, 19 nt, Human
uccagcugggcucugcaau

SEQ ID NO: 2260013 - RNA, 22 nt, Human
uccagcuggccgggagccugau

SEQ ID NO: 2260014 - RNA, 21 nt, Human
uccagcuggccgggagccuga

SEQ ID NO: 2260015 - RNA, 15 nt, Human
uccagcuggccggga

SEQ ID NO: 2260016 - RNA, 15 nt, Human
uccaagccagcggga

SEQ ID NO: 2260017 - RNA, 22 nt, Human
uccaagcccaguucagcuuggg

SEQ ID NO: 2260018 - RNA, 23 nt, Human
uccaagcagccugagcaacucuu

SEQ ID NO: 2260019 - RNA, 15 nt, Human
uccaagccccaucuu

SEQ ID NO: 2260020 - RNA, 19 nt, Human
uccaagccccaucuucuaa

SEQ ID NO: 2260021 - RNA, 23 nt, Human
uccaagccccaucuucuaaaugg

SEQ ID NO: 2260022 - RNA, 12 nt, Human
uccaagcccugg

SEQ ID NO: 2260023 - RNA, 11 nt, Human
uccaagccugc

SEQ ID NO: 2260024 - RNA, 18 nt, Human
uccacaagauucccagag

SEQ ID NO: 2260025 - RNA, 17 nt, Human
uccacaagauucccaga

SEQ ID NO: 2260026 - RNA, 16 nt, Human
uccacaagauucccag

SEQ ID NO: 2260027 - RNA, 22 nt, Human
uccaagcgaggucaacagagaa

SEQ ID NO: 2260028 - RNA, 21 nt, Human
uccaagcgaggucaacagaga

SEQ ID NO: 2260029 - RNA, 23 nt, Human
uccaagcgaggucaacagagaag

SEQ ID NO: 2260030 - RNA, 21 nt, Human
uccacaagagcccaggccucc

SEQ ID NO: 2260031 - RNA, 20 nt, Human
uccacaagagcccaggccuc

SEQ ID NO: 2260032 - RNA, 19 nt, Human
uccacaagagcccaggccu

SEQ ID NO: 2260033 - RNA, 23 nt, Human
uccacacucaccucuaaaacagu

SEQ ID NO: 2260034 - RNA, 19 nt, Human
uccacagcaaccccaggcu

SEQ ID NO: 2260035 - RNA, 20 nt, Human
uccacagcaaccccaggcug

SEQ ID NO: 2260036 - RNA, 22 nt, Human
uccacaccuggcacugcugugc

SEQ ID NO: 2260037 - RNA, 14 nt, Human
uccacagccauccc

SEQ ID NO: 2260038 - RNA, 17 nt, Human
uccacagccgcagccuc

SEQ ID NO: 2260039 - RNA, 16 nt, Human
uccacagccgcagccu

SEQ ID NO: 2260040 - RNA, 14 nt, Human
uccacagccgcagc

SEQ ID NO: 2260041 - RNA, 15 nt, Human
uccacagccauccca

SEQ ID NO: 2260042 - RNA, 22 nt, Human
uccacagccaucccagccuugg

SEQ ID NO: 2260043 - RNA, 18 nt, Human
uccacagccgcagccucc

SEQ ID NO: 2260044 - RNA, 15 nt, Human
uccacagccugcaag

SEQ ID NO: 2260045 - RNA, 18 nt, Human
uccacagccugcaaguca

SEQ ID NO: 2260046 - RNA, 14 nt, Human
uccacagcuaccuc

SEQ ID NO: 2260047 - RNA, 23 nt, Human
uccacagcuuccccucucuccuc

SEQ ID NO: 2260048 - RNA, 23 nt, Human
uccacaagauucccagagacagg

SEQ ID NO: 2260049 - RNA, 21 nt, Human
uccacaagauucccagagaca

SEQ ID NO: 2260050 - RNA, 20 nt, Human
uccacaagauucccagagac

SEQ ID NO: 2260051 - RNA, 19 nt, Human
uccacaagauucccagaga

SEQ ID NO: 2260052 - RNA, 14 nt, Human
uccacacacgcagg

SEQ ID NO: 2260053 - RNA, 15 nt, Human
uccacacacgcagga

SEQ ID NO: 2260054 - RNA, 20 nt, Human
uccacacacagcugggcugu

SEQ ID NO: 2260055 - RNA, 21 nt, Human
uccacacacagcugggcugug

SEQ ID NO: 2260056 - RNA, 19 nt, Human
uccacacacgcaggaacuc

SEQ ID NO: 2260057 - RNA, 17 nt, Human
uccacaccaagcagcaa

SEQ ID NO: 2260058 - RNA, 12 nt, Human
uccacaccccca

SEQ ID NO: 2260059 - RNA, 13 nt, Human
uccacacccccac

SEQ ID NO: 2260060 - RNA, 15 nt, Human
uccacacccccaccc

SEQ ID NO: 2260061 - RNA, 21 nt, Human
uccacacccucucccaggacc

SEQ ID NO: 2260062 - RNA, 20 nt, Human
uccacacccucucccaggac

SEQ ID NO: 2260063 - RNA, 19 nt, Human
uccacacccucucccagga

SEQ ID NO: 2260064 - RNA, 18 nt, Human
uccacacccucucccagg

SEQ ID NO: 2260065 - RNA, 21 nt, Human
uccacaccuuuuauugacaca

SEQ ID NO: 2260066 - RNA, 15 nt, Human
uccacaccuuuuauu

SEQ ID NO: 2260067 - RNA, 19 nt, Human
uccacaccuggcacugcug

SEQ ID NO: 2260068 - RNA, 20 nt, Human
uccacaccuggcacugcugu

SEQ ID NO: 2260069 - RNA, 12 nt, Human
uccaagagcuga

SEQ ID NO: 2260070 - RNA, 14 nt, Human
uccaagagccugag

SEQ ID NO: 2260071 - RNA, 13 nt, Human
uccaagagccuga

SEQ ID NO: 2260072 - RNA, 19 nt, Human
uccaagaagcccaggaaag

SEQ ID NO: 2260073 - RNA, 20 nt, Human
uccaagaccuucuccuucac

SEQ ID NO: 2260074 - RNA, 15 nt, Human
uccaagcaaauguga

SEQ ID NO: 2260075 - RNA, 19 nt, Human
uccaagaggguccuuuagu

SEQ ID NO: 2260076 - RNA, 17 nt, Human
uccaagcaaaugugaau

SEQ ID NO: 2260077 - RNA, 14 nt, Human
uccaagcaggacau

SEQ ID NO: 2260078 - RNA, 22 nt, Human
uccaagcaggacauggacaagg

SEQ ID NO: 2260079 - RNA, 16 nt, Human
ucaugucaacuucugg

SEQ ID NO: 2260080 - RNA, 17 nt, Human
ucaugucaacuucuggc

SEQ ID NO: 2260081 - RNA, 20 nt, Human
ucauguaucaucuggauagg

SEQ ID NO: 2260082 - RNA, 14 nt, Human
uccaagaagcccag

SEQ ID NO: 2260083 - RNA, 15 nt, Human
uccaagaagcccagg

SEQ ID NO: 2260084 - RNA, 16 nt, Human
uccaagaagcccagga

SEQ ID NO: 2260085 - RNA, 19 nt, Human
ucauguaguaucaaauauu

SEQ ID NO: 2260086 - RNA, 15 nt, Human
ucauguaucaucugg

SEQ ID NO: 2260087 - RNA, 18 nt, Human
ucauguaucaucuggaua

SEQ ID NO: 2260088 - RNA, 19 nt, Human
ucauguaucaucuggauag

SEQ ID NO: 2260089 - RNA, 16 nt, Human
ucauguaguaucaaau

SEQ ID NO: 2260090 - RNA, 17 nt, Human
ucauguaguaucaaaua

SEQ ID NO: 2260091 - RNA, 12 nt, Human
ucauguacauuu

SEQ ID NO: 2260092 - RNA, 22 nt, Human
ucauggcugugcccucuugaug

SEQ ID NO: 2260093 - RNA, 14 nt, Human
ucauggcuuaaugu

SEQ ID NO: 2260094 - RNA, 15 nt, Human
ucauggcuuaauguu

SEQ ID NO: 2260095 - RNA, 18 nt, Human
ucauggcuuaauguuuau

SEQ ID NO: 2260096 - RNA, 23 nt, Human
ucaugggagggggcuugaagcca

SEQ ID NO: 2260097 - RNA, 17 nt, Human
ucaugggauagcacgug

SEQ ID NO: 2260098 - RNA, 14 nt, Human
ucauguacauuucu

SEQ ID NO: 2260099 - RNA, 18 nt, Human
ucauguacaagaugaagg

SEQ ID NO: 2260100 - RNA, 17 nt, Human
ucauguacaagaugaag

SEQ ID NO: 2260101 - RNA, 16 nt, Human
ucauguacaagaugaa

SEQ ID NO: 2260102 - RNA, 15 nt, Human
uccaugucggccucu

SEQ ID NO: 2260103 - RNA, 21 nt, Human
uccaugucggccucuaacccc

SEQ ID NO: 2260104 - RNA, 19 nt, Human
uccaugucgccucugcauu

SEQ ID NO: 2260105 - RNA, 14 nt, Human
uccaugucggccuc

SEQ ID NO: 2260106 - RNA, 17 nt, Human
uccaugucgccucugca

SEQ ID NO: 2260107 - RNA, 18 nt, Human
uccaugucgccucugcau

SEQ ID NO: 2260108 - RNA, 12 nt, Human
uccaugccugag

SEQ ID NO: 2260109 - RNA, 13 nt, Human
uccaugccugagg

SEQ ID NO: 2260110 - RNA, 14 nt, Human
uccaugccugaggg

SEQ ID NO: 2260111 - RNA, 15 nt, Human
uccaugccugagggu

SEQ ID NO: 2260112 - RNA, 16 nt, Human
uccaugccugagggug

SEQ ID NO: 2260113 - RNA, 21 nt, Human
uccaugccugaggguggagac

SEQ ID NO: 2260114 - RNA, 15 nt, Human
uccaugauggaguca

SEQ ID NO: 2260115 - RNA, 12 nt, Human
uccaugauggag

SEQ ID NO: 2260116 - RNA, 14 nt, Human
uccaugauggaaua

SEQ ID NO: 2260117 - RNA, 15 nt, Human
uccaugaugcuggga

SEQ ID NO: 2260118 - RNA, 12 nt, Human
uccaugauucua

SEQ ID NO: 2260119 - RNA, 16 nt, Human
uccaugucgccucugc

SEQ ID NO: 2260120 - RNA, 20 nt, Human
uccaugcguguuucugacuc

SEQ ID NO: 2260121 - RNA, 19 nt, Human
uccaugcguguuucugacu

SEQ ID NO: 2260122 - RNA, 18 nt, Human
uccaugcguguuucugac

SEQ ID NO: 2260123 - RNA, 15 nt, Human
uccaugcgcucaggg

SEQ ID NO: 2260124 - RNA, 16 nt, Human
uccaugcgcucagggc

SEQ ID NO: 2260125 - RNA, 11 nt, Human
ucccaacagga

SEQ ID NO: 2260126 - RNA, 18 nt, Human
ucccaacaggaggacaau

SEQ ID NO: 2260127 - RNA, 19 nt, Human
ucccaacaggaggacaauu

SEQ ID NO: 2260128 - RNA, 20 nt, Human
ucccaacaggaggacaauuc

SEQ ID NO: 2260129 - RNA, 21 nt, Human
ucccaacaggaggacaauuca

SEQ ID NO: 2260130 - RNA, 22 nt, Human
ucccaacaggaggacaauucau

SEQ ID NO: 2260131 - RNA, 11 nt, Human
ucccaacaucg

SEQ ID NO: 2260132 - RNA, 17 nt, Human
ucccaacucaccccagc

SEQ ID NO: 2260133 - RNA, 18 nt, Human
ucccaacucaccccagcc

SEQ ID NO: 2260134 - RNA, 17 nt, Human
ucccaacuccuauaauu

SEQ ID NO: 2260135 - RNA, 14 nt, Human
ucccaacucuagcu

SEQ ID NO: 2260136 - RNA, 23 nt, Human
ucccaacaggaggacaauucaug

SEQ ID NO: 2260137 - RNA, 17 nt, Human
ucccaacucuagcuggg

SEQ ID NO: 2260138 - RNA, 16 nt, Human
ucccaacucuagcugg

SEQ ID NO: 2260139 - RNA, 15 nt, Human
ucccaacucuagcug

SEQ ID NO: 2260140 - RNA, 14 nt, Human
ucccaacuuguaaa

SEQ ID NO: 2260141 - RNA, 19 nt, Human
ucccaacucaccccagccc

SEQ ID NO: 2260142 - RNA, 21 nt, Human
ucccaacucaccccagcccca

SEQ ID NO: 2260143 - RNA, 12 nt, Human
uccauaauguau

SEQ ID NO: 2260144 - RNA, 18 nt, Human
uccauaaugcuacugucu

SEQ ID NO: 2260145 - RNA, 16 nt, Human
uccauaaugcuacugu

SEQ ID NO: 2260146 - RNA, 20 nt, Human
uccauaauguauaaagaaca

SEQ ID NO: 2260147 - RNA, 21 nt, Human
uccauaauuaugacaguuaua

SEQ ID NO: 2260148 - RNA, 19 nt, Human
uccauaauuaugacaguua

SEQ ID NO: 2260149 - RNA, 17 nt, Human
uccauaauuaugacagu

SEQ ID NO: 2260150 - RNA, 12 nt, Human
uccauaauuaug

SEQ ID NO: 2260151 - RNA, 17 nt, Human
uccauagagagcaagac

SEQ ID NO: 2260152 - RNA, 12 nt, Human
uccauacauuug

SEQ ID NO: 2260153 - RNA, 17 nt, Human
uccagggcccugagcuc

SEQ ID NO: 2260154 - RNA, 16 nt, Human
uccagggcccugagcu

SEQ ID NO: 2260155 - RNA, 20 nt, Human
uccagggcccugagcucggu

SEQ ID NO: 2260156 - RNA, 14 nt, Human
uccagggcuaguga

SEQ ID NO: 2260157 - RNA, 14 nt, Human
uccagggcuggacu

SEQ ID NO: 2260158 - RNA, 17 nt, Human
uccagggcuggacugag

SEQ ID NO: 2260159 - RNA, 19 nt, Human
uccagggcuggacugaggc

SEQ ID NO: 2260160 - RNA, 17 nt, Human
uccaggggaugggaggu

SEQ ID NO: 2260161 - RNA, 13 nt, Human
uccaggggccccu

SEQ ID NO: 2260162 - RNA, 17 nt, Human
uccaggggccccuccag

SEQ ID NO: 2260163 - RNA, 23 nt, Human
uccauaaucuggacuccucuguc

SEQ ID NO: 2260164 - RNA, 13 nt, Human
uccagggcucuga

SEQ ID NO: 2260165 - RNA, 23 nt, Human
uccagggcuggacugaggccuga

SEQ ID NO: 2260166 - RNA, 21 nt, Human
uccagggcuggacugaggccu

SEQ ID NO: 2260167 - RNA, 22 nt, Human
uccagggcuggacugaggccug

SEQ ID NO: 2260168 - RNA, 21 nt, Human
uccauagccuaaucccugggc

SEQ ID NO: 2260169 - RNA, 13 nt, Human
uccauacagcucu

SEQ ID NO: 2260170 - RNA, 14 nt, Human
uccauacagcucua

SEQ ID NO: 2260171 - RNA, 22 nt, Human
uccauagccuaaucccugggca

SEQ ID NO: 2260172 - RNA, 20 nt, Human
uccauagagagcaagacgcu

SEQ ID NO: 2260173 - RNA, 18 nt, Human
uccauaguaguaugauga

SEQ ID NO: 2260174 - RNA, 19 nt, Human
uccauauaaauauuagaaa

SEQ ID NO: 2260175 - RNA, 12 nt, Human
uccauauaaaua

SEQ ID NO: 2260176 - RNA, 13 nt, Human
uccauauaaauau

SEQ ID NO: 2260177 - RNA, 18 nt, Human
uccauauauuagcauuua

SEQ ID NO: 2260178 - RNA, 17 nt, Human
uccauauauuagcauuu

SEQ ID NO: 2260179 - RNA, 20 nt, Human
uccauauauuagcauuuagu

SEQ ID NO: 2260180 - RNA, 17 nt, Human
uccauaugaccucaugc

SEQ ID NO: 2260181 - RNA, 24 nt, Human
uccauaugaccucaugcaucucca

SEQ ID NO: 2260182 - RNA, 18 nt, Human
uccauaugaccucaugca

SEQ ID NO: 2260183 - RNA, 19 nt, Human
uccauaugaccucaugcau

SEQ ID NO: 2260184 - RNA, 23 nt, Human
uccaugaguuuuuucucuugggc

SEQ ID NO: 2260185 - RNA, 14 nt, Human
uccauauuuauuca

SEQ ID NO: 2260186 - RNA, 14 nt, Human
uccaugaugcuggg

SEQ ID NO: 2260187 - RNA, 19 nt, Human
uccaugaguuugcccuggu

SEQ ID NO: 2260188 - RNA, 14 nt, Human
uccauauucaugua

SEQ ID NO: 2260189 - RNA, 18 nt, Human
uccauauggauuuucuau

SEQ ID NO: 2260190 - RNA, 13 nt, Human
uccauauggauuu

SEQ ID NO: 2260191 - RNA, 12 nt, Human
ucccaggggacc

SEQ ID NO: 2260192 - RNA, 17 nt, Human
ucccaggggaccacacc

SEQ ID NO: 2260193 - RNA, 15 nt, Human
ucccaugacccaggc

SEQ ID NO: 2260194 - RNA, 16 nt, Human
ucccaugacccaggcu

SEQ ID NO: 2260195 - RNA, 20 nt, Human
ucccaugacccaggcugggc

SEQ ID NO: 2260196 - RNA, 22 nt, Human
ucccagggccagggcccugcag

SEQ ID NO: 2260197 - RNA, 21 nt, Human
ucccagggccagggcccugca

SEQ ID NO: 2260198 - RNA, 23 nt, Human
ucccagggccagggcccugcaga

SEQ ID NO: 2260199 - RNA, 15 nt, Human
ucccaugagccucag

SEQ ID NO: 2260200 - RNA, 16 nt, Human
ucccaugagccucagc

SEQ ID NO: 2260201 - RNA, 20 nt, Human
ucccagggccagggcccugc

SEQ ID NO: 2260202 - RNA, 17 nt, Human
ucccagggccagggccc

SEQ ID NO: 2260203 - RNA, 16 nt, Human
ucccagggccagggcc

SEQ ID NO: 2260204 - RNA, 22 nt, Human
ucccaggcuucacccugaaugg

SEQ ID NO: 2260205 - RNA, 18 nt, Human
ucccagggaagugcucug

SEQ ID NO: 2260206 - RNA, 15 nt, Human
ucccaggcuggggcu

SEQ ID NO: 2260207 - RNA, 16 nt, Human
ucccaggcuggggcug

SEQ ID NO: 2260208 - RNA, 15 nt, Human
ucccaggcuucaccc

SEQ ID NO: 2260209 - RNA, 18 nt, Human
ucccaggcuucacccuga

SEQ ID NO: 2260210 - RNA, 19 nt, Human
ucccaggcugagccucagu

SEQ ID NO: 2260211 - RNA, 18 nt, Human
ucccaggcugagccucag

SEQ ID NO: 2260212 - RNA, 19 nt, Human
ucccaggcauuccccagga

SEQ ID NO: 2260213 - RNA, 22 nt, Human
ucccacugggguccagggagca

SEQ ID NO: 2260214 - RNA, 14 nt, Human
ucccacugccucag

SEQ ID NO: 2260215 - RNA, 16 nt, Human
ucccacugccucaggu

SEQ ID NO: 2260216 - RNA, 18 nt, Human
ucccacugccucagguuc

SEQ ID NO: 2260217 - RNA, 20 nt, Human
ucccacugccucagguuccu

SEQ ID NO: 2260218 - RNA, 21 nt, Human
ucccacugcacccccuccugc

SEQ ID NO: 2260219 - RNA, 18 nt, Human
ucccacugcacccccucc

SEQ ID NO: 2260220 - RNA, 20 nt, Human
ucccacugcacccccuccug

SEQ ID NO: 2260221 - RNA, 13 nt, Human
ucccacugcaccc

SEQ ID NO: 2260222 - RNA, 16 nt, Human
ucccacugcacccccu

SEQ ID NO: 2260223 - RNA, 18 nt, Human
ucccacucaagccaagca

SEQ ID NO: 2260224 - RNA, 15 nt, Human
ucccacucaccccgg

SEQ ID NO: 2260225 - RNA, 23 nt, Human
ucccacucaccccggcagacgcc

SEQ ID NO: 2260226 - RNA, 17 nt, Human
ucccacucuagggcagu

SEQ ID NO: 2260227 - RNA, 22 nt, Human
ucccacucuagggcaguggagu

SEQ ID NO: 2260228 - RNA, 15 nt, Human
ucccacuugccccug

SEQ ID NO: 2260229 - RNA, 16 nt, Human
ucccaggauguacaag

SEQ ID NO: 2260230 - RNA, 20 nt, Human
ucccacuuccccuccuaccc

SEQ ID NO: 2260231 - RNA, 17 nt, Human
ucccacuucccugacac

SEQ ID NO: 2260232 - RNA, 23 nt, Human
ucccacugccucagguuccuaug

SEQ ID NO: 2260233 - RNA, 15 nt, Human
ucccacuuccccucc

SEQ ID NO: 2260234 - RNA, 17 nt, Human
ucccaggcauuccccag

SEQ ID NO: 2260235 - RNA, 18 nt, Human
ucccaggcauuccccagg

SEQ ID NO: 2260236 - RNA, 16 nt, Human
ucccaccucagccucc

SEQ ID NO: 2260237 - RNA, 18 nt, Human
ucccaagaucugugcagc

SEQ ID NO: 2260238 - RNA, 18 nt, Human
ucccaccucagccucccg

SEQ ID NO: 2260239 - RNA, 14 nt, Human
ucccaccucucuca

SEQ ID NO: 2260240 - RNA, 23 nt, Human
ucccaccucccccucccccuucu

SEQ ID NO: 2260241 - RNA, 17 nt, Human
ucccaccucucucacuc

SEQ ID NO: 2260242 - RNA, 18 nt, Human
ucccaccucucucacucc

SEQ ID NO: 2260243 - RNA, 19 nt, Human
ucccaccuuggcugcaggg

SEQ ID NO: 2260244 - RNA, 21 nt, Human
ucccaccuuggcugcagggag

SEQ ID NO: 2260245 - RNA, 20 nt, Human
ucccaccucucucacuccuu

SEQ ID NO: 2260246 - RNA, 21 nt, Human
ucccacgaauuugcuggggaa

SEQ ID NO: 2260247 - RNA, 18 nt, Human
ucccacgcuucucuuugg

SEQ ID NO: 2260248 - RNA, 14 nt, Human
ucccacgugggaga

SEQ ID NO: 2260249 - RNA, 20 nt, Human
ucccacgcacuccaugagca

SEQ ID NO: 2260250 - RNA, 15 nt, Human
ucccacgaauuugcu

SEQ ID NO: 2260251 - RNA, 18 nt, Human
ucccacgaauuugcuggg

SEQ ID NO: 2260252 - RNA, 20 nt, Human
ucccacgaauuugcugggga

SEQ ID NO: 2260253 - RNA, 17 nt, Human
ucccacucaagccaagc

SEQ ID NO: 2260254 - RNA, 20 nt, Human
ucccacuaucugggugcaug

SEQ ID NO: 2260255 - RNA, 14 nt, Human
ucccacuaucuggg

SEQ ID NO: 2260256 - RNA, 15 nt, Human
ucccacuaucugggu

SEQ ID NO: 2260257 - RNA, 13 nt, Human
ucccacucacccc

SEQ ID NO: 2260258 - RNA, 14 nt, Human
ucccacucagucca

SEQ ID NO: 2260259 - RNA, 16 nt, Human
ucaucugggaaagaca

SEQ ID NO: 2260260 - RNA, 22 nt, Human
ucaucuuucuugaucaacaucu

SEQ ID NO: 2260261 - RNA, 13 nt, Human
ucaucuuucuuga

SEQ ID NO: 2260262 - RNA, 18 nt, Human
ucaucugggaaagacauc

SEQ ID NO: 2260263 - RNA, 13 nt, Human
ucaucuggaacca

SEQ ID NO: 2260264 - RNA, 21 nt, Human
ucaucuggauaggagccugcu

SEQ ID NO: 2260265 - RNA, 22 nt, Human
ucaucuggauaggagccugcug

SEQ ID NO: 2260266 - RNA, 23 nt, Human
ucaucuggcaacaucuuuauccg

SEQ ID NO: 2260267 - RNA, 19 nt, Human
ucaucuggcaacaucuuua

SEQ ID NO: 2260268 - RNA, 23 nt, Human
ucaucuggauaggagccugcugg

SEQ ID NO: 2260269 - RNA, 12 nt, Human
ucaucugggaaa

SEQ ID NO: 2260270 - RNA, 13 nt, Human
ucaucugggaaag

SEQ ID NO: 2260271 - RNA, 14 nt, Human
ucaucugggaaaga

SEQ ID NO: 2260272 - RNA, 22 nt, Human
ucauccaauccucacugggugg

SEQ ID NO: 2260273 - RNA, 20 nt, Human
ucauccaauccucacugggu

SEQ ID NO: 2260274 - RNA, 14 nt, Human
ucauccacauuguu

SEQ ID NO: 2260275 - RNA, 19 nt, Human
ucauccaauccucacuggg

SEQ ID NO: 2260276 - RNA, 18 nt, Human
ucauccaauccucacugg

SEQ ID NO: 2260277 - RNA, 15 nt, Human
ucauccaauccucac

SEQ ID NO: 2260278 - RNA, 12 nt, Human
ucauccacccca

SEQ ID NO: 2260279 - RNA, 19 nt, Human
ucauccacauuguuuuaaa

SEQ ID NO: 2260280 - RNA, 22 nt, Human
ucauccacauuguuuuaaaaag

SEQ ID NO: 2260281 - RNA, 22 nt, Human
ucauccaaucuaaccacaucaa

SEQ ID NO: 2260282 - RNA, 15 nt, Human
ucauccacauuguuu

SEQ ID NO: 2260283 - RNA, 16 nt, Human
ucauccacauuguuuu

SEQ ID NO: 2260284 - RNA, 17 nt, Human
ucauccacauuguuuua

SEQ ID NO: 2260285 - RNA, 18 nt, Human
ucaucuggaaccaucaga

SEQ ID NO: 2260286 - RNA, 12 nt, Human
ucaucuggaacc

SEQ ID NO: 2260287 - RNA, 19 nt, Human
ucaucugcugguccguggg

SEQ ID NO: 2260288 - RNA, 14 nt, Human
ucauccaccccauc

SEQ ID NO: 2260289 - RNA, 16 nt, Human
ucauccaccccauccc

SEQ ID NO: 2260290 - RNA, 21 nt, Human
ucaucugcucuccuuccugga

SEQ ID NO: 2260291 - RNA, 13 nt, Human
ucaucugcugguc

SEQ ID NO: 2260292 - RNA, 14 nt, Human
ucaucugcuggucc

SEQ ID NO: 2260293 - RNA, 11 nt, Human
ucaugaaaauu

SEQ ID NO: 2260294 - RNA, 19 nt, Human
ucauggaauuggagcucgu

SEQ ID NO: 2260295 - RNA, 17 nt, Human
ucauggacacuuugaaa

SEQ ID NO: 2260296 - RNA, 21 nt, Human
ucauggaauuggagcucgugg

SEQ ID NO: 2260297 - RNA, 24 nt, Human
ucauggacuucugccagcauaaua

SEQ ID NO: 2260298 - RNA, 23 nt, Human
ucauggaugggggaacucagauc

SEQ ID NO: 2260299 - RNA, 20 nt, Human
ucauggauucauuacagcuu

SEQ ID NO: 2260300 - RNA, 14 nt, Human
ucauggacacuuug

SEQ ID NO: 2260301 - RNA, 20 nt, Human
ucauggagaagcagaaauac

SEQ ID NO: 2260302 - RNA, 23 nt, Human
ucauggagugacggucccacacu

SEQ ID NO: 2260303 - RNA, 22 nt, Human
ucauggcagaaggcaaacccau

SEQ ID NO: 2260304 - RNA, 13 nt, Human
ucauggccccucu

SEQ ID NO: 2260305 - RNA, 14 nt, Human
ucauggccccucug

SEQ ID NO: 2260306 - RNA, 18 nt, Human
ucauggccccucugaccu

SEQ ID NO: 2260307 - RNA, 20 nt, Human
ucauggccuauuauauuaaa

SEQ ID NO: 2260308 - RNA, 19 nt, Human
ucaucauuguauauaugug

SEQ ID NO: 2260309 - RNA, 22 nt, Human
ucaucauucucugucucaucca

SEQ ID NO: 2260310 - RNA, 20 nt, Human
ucaucauuguauauaugugu

SEQ ID NO: 2260311 - RNA, 19 nt, Human
ucaucauucucugucucau

SEQ ID NO: 2260312 - RNA, 20 nt, Human
ucaucauucucugucucauc

SEQ ID NO: 2260313 - RNA, 19 nt, Human
ucaucauaaaauaaaguau

SEQ ID NO: 2260314 - RNA, 15 nt, Human
ucaucauaaaauaaa

SEQ ID NO: 2260315 - RNA, 14 nt, Human
ucaucauaaaauaa

SEQ ID NO: 2260316 - RNA, 13 nt, Human
ucaucauaaaaua

SEQ ID NO: 2260317 - RNA, 17 nt, Human
ucaucauauuauacaga

SEQ ID NO: 2260318 - RNA, 14 nt, Human
ucaucauauuauac

SEQ ID NO: 2260319 - RNA, 15 nt, Human
ucaucauacaugacu

SEQ ID NO: 2260320 - RNA, 17 nt, Human
ucaucaacccuaaaaag

SEQ ID NO: 2260321 - RNA, 13 nt, Human
ucaucaacugaau

SEQ ID NO: 2260322 - RNA, 23 nt, Human
ucauauuuuguauauaucugcuu

SEQ ID NO: 2260323 - RNA, 19 nt, Human
ucaucaaauggaagacaca

SEQ ID NO: 2260324 - RNA, 23 nt, Human
ucaucaaauggaagacacauuga

SEQ ID NO: 2260325 - RNA, 11 nt, Human
ucaucaagacu

SEQ ID NO: 2260326 - RNA, 22 nt, Human
ucaucaacugaaugaggucagc

SEQ ID NO: 2260327 - RNA, 15 nt, Human
ucaucaacugaauga

SEQ ID NO: 2260328 - RNA, 23 nt, Human
ucaucaguauugaagcauuuuau

SEQ ID NO: 2260329 - RNA, 17 nt, Human
ucaucaaggcacugccu

SEQ ID NO: 2260330 - RNA, 15 nt, Human
ucaucaguggagcca

SEQ ID NO: 2260331 - RNA, 21 nt, Human
ucaucaguauugaagcauuuu

SEQ ID NO: 2260332 - RNA, 20 nt, Human
ucaucaguauugaagcauuu

SEQ ID NO: 2260333 - RNA, 16 nt, Human
ucaucaguauugaagc

SEQ ID NO: 2260334 - RNA, 16 nt, Human
ucaucaaggcacugcc

SEQ ID NO: 2260335 - RNA, 19 nt, Human
ucaucaagacuggaaggug

SEQ ID NO: 2260336 - RNA, 15 nt, Human
ucaucaaggcacugc

SEQ ID NO: 2260337 - RNA, 13 nt, Human
ucauagaaaugua

SEQ ID NO: 2260338 - RNA, 23 nt, Human
ucauagaaauguaacuuuuguaa

SEQ ID NO: 2260339 - RNA, 22 nt, Human
ucauagaaauguaacuuuugua

SEQ ID NO: 2260340 - RNA, 19 nt, Human
ucauauuuugauuauugua

SEQ ID NO: 2260341 - RNA, 15 nt, Human
ucauauuuuguauau

SEQ ID NO: 2260342 - RNA, 18 nt, Human
ucauauuuucuuucaaaa

SEQ ID NO: 2260343 - RNA, 12 nt, Human
ucauauuuugau

SEQ ID NO: 2260344 - RNA, 14 nt, Human
ucauauuuugauua

SEQ ID NO: 2260345 - RNA, 16 nt, Human
ucauauuuugauuauu

SEQ ID NO: 2260346 - RNA, 19 nt, Human
ucauacugugcuggagcca

SEQ ID NO: 2260347 - RNA, 13 nt, Human
ucauacugaagau

SEQ ID NO: 2260348 - RNA, 15 nt, Human
ucauacugaagaugc

SEQ ID NO: 2260349 - RNA, 17 nt, Human
ucauacugugcuggagc

SEQ ID NO: 2260350 - RNA, 18 nt, Human
ucauacugugcuggagcc

SEQ ID NO: 2260351 - RNA, 20 nt, Human
ucauacugugcuggagccac

SEQ ID NO: 2260352 - RNA, 20 nt, Human
ucaguuccugcccuuggccu

SEQ ID NO: 2260353 - RNA, 17 nt, Human
ucaguuccucuuugcau

SEQ ID NO: 2260354 - RNA, 18 nt, Human
ucaguuccucuuugcaug

SEQ ID NO: 2260355 - RNA, 19 nt, Human
ucaguuccucuuugcaugg

SEQ ID NO: 2260356 - RNA, 21 nt, Human
ucaguuccucuuugcauggaa

SEQ ID NO: 2260357 - RNA, 14 nt, Human
ucaguucucuucac

SEQ ID NO: 2260358 - RNA, 19 nt, Human
ucaguucuagucucucugg

SEQ ID NO: 2260359 - RNA, 14 nt, Human
ucauacucuagauu

SEQ ID NO: 2260360 - RNA, 23 nt, Human
ucauacucuagauuuuguuuugc

SEQ ID NO: 2260361 - RNA, 20 nt, Human
ucaguucuagucucucuggg

SEQ ID NO: 2260362 - RNA, 17 nt, Human
ucaguucucuucacuca

SEQ ID NO: 2260363 - RNA, 13 nt, Human
ucagguggccaug

SEQ ID NO: 2260364 - RNA, 21 nt, Human
ucagguggggucacucuggca

SEQ ID NO: 2260365 - RNA, 17 nt, Human
ucaggugggcgugguca

SEQ ID NO: 2260366 - RNA, 19 nt, Human
ucagucagugcaaauguca

SEQ ID NO: 2260367 - RNA, 14 nt, Human
ucagucaugcauaa

SEQ ID NO: 2260368 - RNA, 15 nt, Human
ucagucaugcauaaa

SEQ ID NO: 2260369 - RNA, 16 nt, Human
ucagucaugcauaaau

SEQ ID NO: 2260370 - RNA, 17 nt, Human
ucagguggggucacucu

SEQ ID NO: 2260371 - RNA, 20 nt, Human
ucagguggggucacucuggc

SEQ ID NO: 2260372 - RNA, 15 nt, Human
ucaguccauagcaga

SEQ ID NO: 2260373 - RNA, 18 nt, Human
ucaguccaugaagaugua

SEQ ID NO: 2260374 - RNA, 18 nt, Human
ucaguccccgugaaggag

SEQ ID NO: 2260375 - RNA, 17 nt, Human
ucagucccaucagagag

SEQ ID NO: 2260376 - RNA, 12 nt, Human
ucaguccaggau

SEQ ID NO: 2260377 - RNA, 17 nt, Human
ucagucaugcauaaaua

SEQ ID NO: 2260378 - RNA, 20 nt, Human
ucagucaugcauaaauaugc

SEQ ID NO: 2260379 - RNA, 21 nt, Human
ucagucauuagacuccuccuc

SEQ ID NO: 2260380 - RNA, 11 nt, Human
ucagguggcca

SEQ ID NO: 2260381 - RNA, 20 nt, Human
ucaggagucccaaggaaagc

SEQ ID NO: 2260382 - RNA, 19 nt, Human
ucaggagucccaaggaaag

SEQ ID NO: 2260383 - RNA, 14 nt, Human
ucagguggggcagc

SEQ ID NO: 2260384 - RNA, 18 nt, Human
ucaggugcugccauccag

SEQ ID NO: 2260385 - RNA, 20 nt, Human
ucaggugcugccauccaggu

SEQ ID NO: 2260386 - RNA, 15 nt, Human
ucagguggggcagcu

SEQ ID NO: 2260387 - RNA, 16 nt, Human
ucagguggggcagcuu

SEQ ID NO: 2260388 - RNA, 21 nt, Human
ucagguggggcagcuugaggg

SEQ ID NO: 2260389 - RNA, 17 nt, Human
ucagguggggcagcuug

SEQ ID NO: 2260390 - RNA, 13 nt, Human
ucaguuacagaaa

SEQ ID NO: 2260391 - RNA, 14 nt, Human
ucaguuacagaaag

SEQ ID NO: 2260392 - RNA, 14 nt, Human
ucaguuacuaagaa

SEQ ID NO: 2260393 - RNA, 15 nt, Human
ucaguuacagaaagu

SEQ ID NO: 2260394 - RNA, 20 nt, Human
ucaguuacuaagaagaaaau

SEQ ID NO: 2260395 - RNA, 17 nt, Human
ucaguuaagccuuugga

SEQ ID NO: 2260396 - RNA, 16 nt, Human
ucaguuaagccuuugg

SEQ ID NO: 2260397 - RNA, 22 nt, Human
ucaguucccuuggccucagaau

SEQ ID NO: 2260398 - RNA, 20 nt, Human
ucaguuccgauuucccaggc

SEQ ID NO: 2260399 - RNA, 16 nt, Human
ucaguuccucuuugca

SEQ ID NO: 2260400 - RNA, 20 nt, Human
ucaguucccuuggccucaga

SEQ ID NO: 2260401 - RNA, 19 nt, Human
ucaguucccuuggccucag

SEQ ID NO: 2260402 - RNA, 18 nt, Human
ucaguucccuuggccuca

SEQ ID NO: 2260403 - RNA, 17 nt, Human
ucaguucccuuggccuc

SEQ ID NO: 2260404 - RNA, 16 nt, Human
ucaguucccuuggccu

SEQ ID NO: 2260405 - RNA, 14 nt, Human
ucaguuacucagcc

SEQ ID NO: 2260406 - RNA, 19 nt, Human
ucagugugccccccauccu

SEQ ID NO: 2260407 - RNA, 20 nt, Human
ucagugugccccccauccug

SEQ ID NO: 2260408 - RNA, 17 nt, Human
ucaguguuaaaugugau

SEQ ID NO: 2260409 - RNA, 15 nt, Human
ucaguguuaaaugug

SEQ ID NO: 2260410 - RNA, 20 nt, Human
ucaguguucccuuuccuacu

SEQ ID NO: 2260411 - RNA, 14 nt, Human
ucaguguuauuagu

SEQ ID NO: 2260412 - RNA, 21 nt, Human
ucaguguuaaaugugaugaau

SEQ ID NO: 2260413 - RNA, 22 nt, Human
ucaguguuugggucaccccucc

SEQ ID NO: 2260414 - RNA, 22 nt, Human
ucagugugccccccauccuggc

SEQ ID NO: 2260415 - RNA, 23 nt, Human
ucagucugauuaaagguggugcc

SEQ ID NO: 2260416 - RNA, 17 nt, Human
ucagucucugagggcuu

SEQ ID NO: 2260417 - RNA, 13 nt, Human
ucagugugccccc

SEQ ID NO: 2260418 - RNA, 14 nt, Human
ucagugugcccccc

SEQ ID NO: 2260419 - RNA, 19 nt, Human
ucagugugucuaaauuuga

SEQ ID NO: 2260420 - RNA, 18 nt, Human
ucagugugacugaucucu

SEQ ID NO: 2260421 - RNA, 17 nt, Human
ucagucugauucccaag

SEQ ID NO: 2260422 - RNA, 19 nt, Human
ucagucugauucccaagcu

SEQ ID NO: 2260423 - RNA, 20 nt, Human
ucagucucugagcagugaau

SEQ ID NO: 2260424 - RNA, 17 nt, Human
ucagucucugagcagug

SEQ ID NO: 2260425 - RNA, 15 nt, Human
ucagucucugagcag

SEQ ID NO: 2260426 - RNA, 13 nt, Human
ucagucucugagc

SEQ ID NO: 2260427 - RNA, 19 nt, Human
ucaguccuccccucacagc

SEQ ID NO: 2260428 - RNA, 21 nt, Human
ucaguccuccccucacagccu

SEQ ID NO: 2260429 - RNA, 12 nt, Human
ucaguccccucc

SEQ ID NO: 2260430 - RNA, 13 nt, Human
ucaguccccuccc

SEQ ID NO: 2260431 - RNA, 14 nt, Human
ucaguccccuccca

SEQ ID NO: 2260432 - RNA, 15 nt, Human
ucaguccccucccau

SEQ ID NO: 2260433 - RNA, 18 nt, Human
ucaguccccucccaucug

SEQ ID NO: 2260434 - RNA, 20 nt, Human
ucaguccccucccaucuggg

SEQ ID NO: 2260435 - RNA, 23 nt, Human
ucaguccccucccaucugggagu

SEQ ID NO: 2260436 - RNA, 13 nt, Human
ucagucccuaugu

SEQ ID NO: 2260437 - RNA, 16 nt, Human
ucagucccuauguauu

SEQ ID NO: 2260438 - RNA, 17 nt, Human
ucagucccuauguauuu

SEQ ID NO: 2260439 - RNA, 18 nt, Human
ucagucccuauguauuug

SEQ ID NO: 2260440 - RNA, 23 nt, Human
ucagucccuauguauuugcaguu

SEQ ID NO: 2260441 - RNA, 13 nt, Human
ucaguccuccccu

SEQ ID NO: 2260442 - RNA, 17 nt, Human
ucaguccuccccucaca

SEQ ID NO: 2260443 - RNA, 18 nt, Human
ucaguccuccccucacag

SEQ ID NO: 2260444 - RNA, 13 nt, Human
ucaggacacuaau

SEQ ID NO: 2260445 - RNA, 13 nt, Human
ucaggaccaggca

SEQ ID NO: 2260446 - RNA, 15 nt, Human
ucaggacccagagga

SEQ ID NO: 2260447 - RNA, 19 nt, Human
ucaggacccagaggaaggg

SEQ ID NO: 2260448 - RNA, 16 nt, Human
ucaggacccagaggaa

SEQ ID NO: 2260449 - RNA, 20 nt, Human
ucagcuguaagaagagacug

SEQ ID NO: 2260450 - RNA, 21 nt, Human
ucagcuggcacugucucugcu

SEQ ID NO: 2260451 - RNA, 14 nt, Human
ucaggacagaugcc

SEQ ID NO: 2260452 - RNA, 15 nt, Human
ucaggacagaugcca

SEQ ID NO: 2260453 - RNA, 20 nt, Human
ucaggaccaaagcuuucaug

SEQ ID NO: 2260454 - RNA, 17 nt, Human
ucaggaccugggaccuc

SEQ ID NO: 2260455 - RNA, 14 nt, Human
ucaggaccaggcaa

SEQ ID NO: 2260456 - RNA, 21 nt, Human
ucaggaccugggaccuccccu

SEQ ID NO: 2260457 - RNA, 19 nt, Human
ucaggacgagaaugagggu

SEQ ID NO: 2260458 - RNA, 23 nt, Human
ucaggaccugggaccuccccuga

SEQ ID NO: 2260459 - RNA, 14 nt, Human
ucaggaccuuuuga

SEQ ID NO: 2260460 - RNA, 21 nt, Human
ucaggacucagaagccucugg

SEQ ID NO: 2260461 - RNA, 14 nt, Human
ucaggacucagaag

SEQ ID NO: 2260462 - RNA, 15 nt, Human
ucagcugccucacuu

SEQ ID NO: 2260463 - RNA, 14 nt, Human
ucagcugccucacu

SEQ ID NO: 2260464 - RNA, 12 nt, Human
ucagcugccuca

SEQ ID NO: 2260465 - RNA, 15 nt, Human
ucagcugcuacuacu

SEQ ID NO: 2260466 - RNA, 12 nt, Human
ucagcugcuucu

SEQ ID NO: 2260467 - RNA, 15 nt, Human
ucagcugcuucuccc

SEQ ID NO: 2260468 - RNA, 24 nt, Human
ucagcugccucacuuccuacaaga

SEQ ID NO: 2260469 - RNA, 16 nt, Human
ucagcugcugaaacaa

SEQ ID NO: 2260470 - RNA, 16 nt, Human
ucaggaggaaggcuua

SEQ ID NO: 2260471 - RNA, 23 nt, Human
ucaggaggaaggcuuacacccac

SEQ ID NO: 2260472 - RNA, 11 nt, Human
ucaggagcaca

SEQ ID NO: 2260473 - RNA, 17 nt, Human
ucaggaggcaggaccuu

SEQ ID NO: 2260474 - RNA, 13 nt, Human
ucaggagggauug

SEQ ID NO: 2260475 - RNA, 18 nt, Human
ucaggaggcugaggggag

SEQ ID NO: 2260476 - RNA, 15 nt, Human
ucaggaggcugaggg

SEQ ID NO: 2260477 - RNA, 22 nt, Human
ucaggaggcugaggcagaagaa

SEQ ID NO: 2260478 - RNA, 20 nt, Human
ucaggaggcugaggcagaag

SEQ ID NO: 2260479 - RNA, 18 nt, Human
ucaggaggcugaggcaga

SEQ ID NO: 2260480 - RNA, 13 nt, Human
ucaggaggcugag

SEQ ID NO: 2260481 - RNA, 12 nt, Human
ucaggaggcuga

SEQ ID NO: 2260482 - RNA, 18 nt, Human
ucaggagcacaggcagcu

SEQ ID NO: 2260483 - RNA, 15 nt, Human
ucaggacuuggucug

SEQ ID NO: 2260484 - RNA, 12 nt, Human
ucaggagaaaaa

SEQ ID NO: 2260485 - RNA, 20 nt, Human
ucaggacuuaacggcuccag

SEQ ID NO: 2260486 - RNA, 14 nt, Human
ucaggacuccucuc

SEQ ID NO: 2260487 - RNA, 18 nt, Human
ucaggagaggggcagaac

SEQ ID NO: 2260488 - RNA, 17 nt, Human
ucaggagaggggcagaa

SEQ ID NO: 2260489 - RNA, 15 nt, Human
ucaggagaggggcag

SEQ ID NO: 2260490 - RNA, 20 nt, Human
ucaggagagaguugaaccua

SEQ ID NO: 2260491 - RNA, 20 nt, Human
ucaggagaggggcagaacag

SEQ ID NO: 2260492 - RNA, 13 nt, Human
ucaggagagcagc

SEQ ID NO: 2260493 - RNA, 22 nt, Human
ucaggagaguagaacagauaau

SEQ ID NO: 2260494 - RNA, 18 nt, Human
ucagccugaggcugagac

SEQ ID NO: 2260495 - RNA, 13 nt, Human
ucagccugaggcu

SEQ ID NO: 2260496 - RNA, 20 nt, Human
ucagccugaggcugagacug

SEQ ID NO: 2260497 - RNA, 11 nt, Human
ucagccugagu

SEQ ID NO: 2260498 - RNA, 16 nt, Human
ucagccugcuccagcu

SEQ ID NO: 2260499 - RNA, 21 nt, Human
ucagccucuuaaagcugccug

SEQ ID NO: 2260500 - RNA, 12 nt, Human
ucagccucuuaa

SEQ ID NO: 2260501 - RNA, 22 nt, Human
ucagccucuuaaagcugccugu

SEQ ID NO: 2260502 - RNA, 10 nt, Human
ucagccugag

SEQ ID NO: 2260503 - RNA, 16 nt, Human
ucagccucucucccag

SEQ ID NO: 2260504 - RNA, 17 nt, Human
ucagccucucucccagu

SEQ ID NO: 2260505 - RNA, 18 nt, Human
ucagccucucucccaguc

SEQ ID NO: 2260506 - RNA, 19 nt, Human
ucagccucucucccagucu

SEQ ID NO: 2260507 - RNA, 20 nt, Human
ucagccucucucccagucua

SEQ ID NO: 2260508 - RNA, 21 nt, Human
ucagccucucucccagucuac

SEQ ID NO: 2260509 - RNA, 22 nt, Human
ucagccucccaaagugcuggga

SEQ ID NO: 2260510 - RNA, 20 nt, Human
ucagccucccaaguagcugg

SEQ ID NO: 2260511 - RNA, 18 nt, Human
ucagccuccagccucugu

SEQ ID NO: 2260512 - RNA, 19 nt, Human
ucagccuccagccucuguu

SEQ ID NO: 2260513 - RNA, 12 nt, Human
ucagccucccga

SEQ ID NO: 2260514 - RNA, 20 nt, Human
ucagccucccgaauagcugg

SEQ ID NO: 2260515 - RNA, 18 nt, Human
ucagcuccagcucaccag

SEQ ID NO: 2260516 - RNA, 15 nt, Human
ucagccugagucucc

SEQ ID NO: 2260517 - RNA, 16 nt, Human
ucagccugagucuccu

SEQ ID NO: 2260518 - RNA, 19 nt, Human
ucagccugagucuccugug

SEQ ID NO: 2260519 - RNA, 21 nt, Human
ucagcuccagcucaccagccc

SEQ ID NO: 2260520 - RNA, 22 nt, Human
ucagcuccagcucaccagcccc

SEQ ID NO: 2260521 - RNA, 17 nt, Human
ucagcuccuuccuggag

SEQ ID NO: 2260522 - RNA, 16 nt, Human
ucagcuccuuccugga

SEQ ID NO: 2260523 - RNA, 15 nt, Human
ucagcuccuuccugg

SEQ ID NO: 2260524 - RNA, 14 nt, Human
ucagcuccuuccug

SEQ ID NO: 2260525 - RNA, 21 nt, Human
ucagcuccccucggagaagag

SEQ ID NO: 2260526 - RNA, 22 nt, Human
ucagcuccccucggagaagagc

SEQ ID NO: 2260527 - RNA, 20 nt, Human
ucagcaccuacaguguacag

SEQ ID NO: 2260528 - RNA, 17 nt, Human
ucagcaccccugucucu

SEQ ID NO: 2260529 - RNA, 13 nt, Human
ucagcaccccuuc

SEQ ID NO: 2260530 - RNA, 14 nt, Human
ucagcaccccuucc

SEQ ID NO: 2260531 - RNA, 21 nt, Human
ucagcaccuacaguguacagu

SEQ ID NO: 2260532 - RNA, 22 nt, Human
ucagcaccuacaguguacaguc

SEQ ID NO: 2260533 - RNA, 16 nt, Human
ucagcacgauuucugu

SEQ ID NO: 2260534 - RNA, 15 nt, Human
ucagcacgauuucug

SEQ ID NO: 2260535 - RNA, 20 nt, Human
ucagcaguaccuauaaagua

SEQ ID NO: 2260536 - RNA, 15 nt, Human
ucagcaccccuucca

SEQ ID NO: 2260537 - RNA, 17 nt, Human
ucagcaccccuuccaug

SEQ ID NO: 2260538 - RNA, 17 nt, Human
ucagcacgauuucuguu

SEQ ID NO: 2260539 - RNA, 12 nt, Human
ucagccucccaa

SEQ ID NO: 2260540 - RNA, 13 nt, Human
ucagccucccaaa

SEQ ID NO: 2260541 - RNA, 18 nt, Human
ucagccuaggggucaggg

SEQ ID NO: 2260542 - RNA, 23 nt, Human
ucagccuagccgaccucagccuu

SEQ ID NO: 2260543 - RNA, 14 nt, Human
ucagccuccagccu

SEQ ID NO: 2260544 - RNA, 15 nt, Human
ucagccuccagccuc

SEQ ID NO: 2260545 - RNA, 16 nt, Human
ucagccuccagccucu

SEQ ID NO: 2260546 - RNA, 17 nt, Human
ucagccuccagccucug

SEQ ID NO: 2260547 - RNA, 17 nt, Human
ucagcauaccuuuauug

SEQ ID NO: 2260548 - RNA, 13 nt, Human
ucagcauauuugu

SEQ ID NO: 2260549 - RNA, 22 nt, Human
ucagcauauuuguauaguugcu

SEQ ID NO: 2260550 - RNA, 23 nt, Human
ucagcauauuuguauaguugcuu

SEQ ID NO: 2260551 - RNA, 15 nt, Human
ucagcauccuggcac

SEQ ID NO: 2260552 - RNA, 16 nt, Human
ucagcauccuggcacc

SEQ ID NO: 2260553 - RNA, 17 nt, Human
ucagcauccuggcaccc

SEQ ID NO: 2260554 - RNA, 18 nt, Human
ucagcauccuggcacccg

SEQ ID NO: 2260555 - RNA, 13 nt, Human
ucagaucagugcu

SEQ ID NO: 2260556 - RNA, 17 nt, Human
ucagaucacuacugcag

SEQ ID NO: 2260557 - RNA, 18 nt, Human
ucagaucacuacugcagu

SEQ ID NO: 2260558 - RNA, 23 nt, Human
ucagaucaguguaccauuugccu

SEQ ID NO: 2260559 - RNA, 13 nt, Human
ucagaucauggca

SEQ ID NO: 2260560 - RNA, 16 nt, Human
ucagaucauggcaucc

SEQ ID NO: 2260561 - RNA, 23 nt, Human
ucagauauuuuuucagaaauaug

SEQ ID NO: 2260562 - RNA, 22 nt, Human
ucagauauuuuuucagaaauau

SEQ ID NO: 2260563 - RNA, 15 nt, Human
ucagaucacuacugc

SEQ ID NO: 2260564 - RNA, 16 nt, Human
ucagaucacuacugca

SEQ ID NO: 2260565 - RNA, 21 nt, Human
ucagauauuuuuucagaaaua

SEQ ID NO: 2260566 - RNA, 21 nt, Human
ucagaucauuucaaaacucau

SEQ ID NO: 2260567 - RNA, 20 nt, Human
ucagaucauuaucagccugu

SEQ ID NO: 2260568 - RNA, 16 nt, Human
ucagauccagggacag

SEQ ID NO: 2260569 - RNA, 15 nt, Human
ucagauccagggaca

SEQ ID NO: 2260570 - RNA, 14 nt, Human
ucagauccagggac

SEQ ID NO: 2260571 - RNA, 16 nt, Human
ucagauccuuguuuca

SEQ ID NO: 2260572 - RNA, 17 nt, Human
ucagauccuuguuucaa

SEQ ID NO: 2260573 - RNA, 18 nt, Human
ucagauccuuguuucaaa

SEQ ID NO: 2260574 - RNA, 19 nt, Human
ucagauccuuguuucaaac

SEQ ID NO: 2260575 - RNA, 19 nt, Human
ucagcacaaggccaucugg

SEQ ID NO: 2260576 - RNA, 14 nt, Human
ucagcaccacccua

SEQ ID NO: 2260577 - RNA, 13 nt, Human
ucagcaccacccu

SEQ ID NO: 2260578 - RNA, 12 nt, Human
ucagcaccaccc

SEQ ID NO: 2260579 - RNA, 23 nt, Human
ucagcaccacccuagucccuucc

SEQ ID NO: 2260580 - RNA, 15 nt, Human
ucagcaccacccuag

SEQ ID NO: 2260581 - RNA, 21 nt, Human
ucagauauuuauauuuuuauu

SEQ ID NO: 2260582 - RNA, 13 nt, Human
ucagauauuuaua

SEQ ID NO: 2260583 - RNA, 13 nt, Human
uaucauucauucu

SEQ ID NO: 2260584 - RNA, 15 nt, Human
uaucauuaaaguucu

SEQ ID NO: 2260585 - RNA, 22 nt, Human
uaucauucaaguguaaaauauu

SEQ ID NO: 2260586 - RNA, 18 nt, Human
uaucauucauucuuagcu

SEQ ID NO: 2260587 - RNA, 14 nt, Human
uaucauuuaauaau

SEQ ID NO: 2260588 - RNA, 22 nt, Human
ucagauaacuguuauuuauaau

SEQ ID NO: 2260589 - RNA, 14 nt, Human
ucagauacaaugua

SEQ ID NO: 2260590 - RNA, 19 nt, Human
ucuucuuuugagcaacuuu

SEQ ID NO: 2260591 - RNA, 22 nt, Human
ucuucuuuuaaaccauuuucuu

SEQ ID NO: 2260592 - RNA, 21 nt, Human
ucuucuuuuaaaccauuuucu

SEQ ID NO: 2260593 - RNA, 23 nt, Human
ucuucuuuaggauugugaugguu

SEQ ID NO: 2260594 - RNA, 21 nt, Human
ucuucuuuuugaaaucagcau

SEQ ID NO: 2260595 - RNA, 18 nt, Human
ucuucuuuuggcuuccau

SEQ ID NO: 2260596 - RNA, 15 nt, Human
ucuucuuuuugcugu

SEQ ID NO: 2260597 - RNA, 15 nt, Human
ucuucuuuugugaag

SEQ ID NO: 2260598 - RNA, 22 nt, Human
ucuucuuuugagcaacuuucuu

SEQ ID NO: 2260599 - RNA, 16 nt, Human
ucuucuuuuggcuucc

SEQ ID NO: 2260600 - RNA, 19 nt, Human
ucuucggggaacuccugga

SEQ ID NO: 2260601 - RNA, 14 nt, Human
ucuucguacaguuc

SEQ ID NO: 2260602 - RNA, 15 nt, Human
ucuucguacaguucu

SEQ ID NO: 2260603 - RNA, 17 nt, Human
ucuucguacaguucuuc

SEQ ID NO: 2260604 - RNA, 16 nt, Human
ucuucuuggucucagu

SEQ ID NO: 2260605 - RNA, 13 nt, Human
ucuucgaggugga

SEQ ID NO: 2260606 - RNA, 14 nt, Human
ucuucggaaaccuu

SEQ ID NO: 2260607 - RNA, 18 nt, Human
ucuucgggaagagaggag

SEQ ID NO: 2260608 - RNA, 22 nt, Human
ucuucgggaagagaggaguuca

SEQ ID NO: 2260609 - RNA, 13 nt, Human
ucuucgggaagag

SEQ ID NO: 2260610 - RNA, 14 nt, Human
ucuucgggaagaga

SEQ ID NO: 2260611 - RNA, 16 nt, Human
ucuucgggaagagagg

SEQ ID NO: 2260612 - RNA, 15 nt, Human
ucuuccaaaggcaua

SEQ ID NO: 2260613 - RNA, 18 nt, Human
ucuuccuuggagggggga

SEQ ID NO: 2260614 - RNA, 14 nt, Human
ucuuccuuuuauca

SEQ ID NO: 2260615 - RNA, 23 nt, Human
ucuuccuugaagaacugcaggcc

SEQ ID NO: 2260616 - RNA, 13 nt, Human
ucuugaaaugaaa

SEQ ID NO: 2260617 - RNA, 12 nt, Human
ucuugaaaugaa

SEQ ID NO: 2260618 - RNA, 14 nt, Human
ucuugaaagcugug

SEQ ID NO: 2260619 - RNA, 17 nt, Human
ucuucuuuuugcuguug

SEQ ID NO: 2260620 - RNA, 20 nt, Human
ucuugaaauuaagaaggcaa

SEQ ID NO: 2260621 - RNA, 14 nt, Human
ucuugaaauuaaga

SEQ ID NO: 2260622 - RNA, 17 nt, Human
ucuugaacugagcuugg

SEQ ID NO: 2260623 - RNA, 22 nt, Human
ucuugaaauuaagaaggcaaaa

SEQ ID NO: 2260624 - RNA, 21 nt, Human
ucuugaaauauaggaacuuaa

SEQ ID NO: 2260625 - RNA, 20 nt, Human
ucuugaaauauaggaacuua

SEQ ID NO: 2260626 - RNA, 23 nt, Human
ucuugaaaugaaaguauaacuga

SEQ ID NO: 2260627 - RNA, 21 nt, Human
ucuugaaauuaagaaggcaaa

SEQ ID NO: 2260628 - RNA, 18 nt, Human
ucuugaacugagcuugga

SEQ ID NO: 2260629 - RNA, 13 nt, Human
ucuugaagacuuu

SEQ ID NO: 2260630 - RNA, 22 nt, Human
ucuugaagacuuuucuuucagc

SEQ ID NO: 2260631 - RNA, 21 nt, Human
ucuugccccccaccccagccu

SEQ ID NO: 2260632 - RNA, 13 nt, Human
ucuugcccuuccc

SEQ ID NO: 2260633 - RNA, 15 nt, Human
ucuugcccuucccug

SEQ ID NO: 2260634 - RNA, 16 nt, Human
ucuugcccuucccugu

SEQ ID NO: 2260635 - RNA, 12 nt, Human
ucuugcccccca

SEQ ID NO: 2260636 - RNA, 22 nt, Human
ucuugccccaacccccagcacc

SEQ ID NO: 2260637 - RNA, 14 nt, Human
ucuugcucugcuga

SEQ ID NO: 2260638 - RNA, 23 nt, Human
ucuugccaaccuguaauaaauau

SEQ ID NO: 2260639 - RNA, 18 nt, Human
ucuugccccaacccccag

SEQ ID NO: 2260640 - RNA, 20 nt, Human
ucuugccccaacccccagca

SEQ ID NO: 2260641 - RNA, 21 nt, Human
ucuugccccaacccccagcac

SEQ ID NO: 2260642 - RNA, 23 nt, Human
ucuugccccaacccccagcaccc

SEQ ID NO: 2260643 - RNA, 16 nt, Human
ucuugccacugccucu

SEQ ID NO: 2260644 - RNA, 17 nt, Human
ucuugccacugccucuu

SEQ ID NO: 2260645 - RNA, 23 nt, Human
ucuugcauggcaaggacugcagg

SEQ ID NO: 2260646 - RNA, 19 nt, Human
ucuugaaggaaaaugauac

SEQ ID NO: 2260647 - RNA, 20 nt, Human
ucuugccaaccuguaauaaa

SEQ ID NO: 2260648 - RNA, 22 nt, Human
ucuugccaaccuguaauaaaua

SEQ ID NO: 2260649 - RNA, 19 nt, Human
ucuugccaaauauaaauaa

SEQ ID NO: 2260650 - RNA, 13 nt, Human
ucuuguccuagcu

SEQ ID NO: 2260651 - RNA, 19 nt, Human
ucuuguauuaaacucuuca

SEQ ID NO: 2260652 - RNA, 15 nt, Human
ucuuguauuaagaau

SEQ ID NO: 2260653 - RNA, 14 nt, Human
ucuugucucaaugc

SEQ ID NO: 2260654 - RNA, 15 nt, Human
ucuugucucaaugcu

SEQ ID NO: 2260655 - RNA, 17 nt, Human
ucuugucucaaugcuca

SEQ ID NO: 2260656 - RNA, 16 nt, Human
ucuuguauuaaacucu

SEQ ID NO: 2260657 - RNA, 14 nt, Human
ucuuguauuaagaa

SEQ ID NO: 2260658 - RNA, 16 nt, Human
ucuuguaguagucuca

SEQ ID NO: 2260659 - RNA, 19 nt, Human
ucuuguacauguguagccu

SEQ ID NO: 2260660 - RNA, 24 nt, Human
ucuuguacauguguagccugugca

SEQ ID NO: 2260661 - RNA, 15 nt, Human
ucuugcucugcugac

SEQ ID NO: 2260662 - RNA, 23 nt, Human
ucuugcucugcugacagacacag

SEQ ID NO: 2260663 - RNA, 14 nt, Human
ucuuguacaugugu

SEQ ID NO: 2260664 - RNA, 17 nt, Human
ucuuguacauguguagc

SEQ ID NO: 2260665 - RNA, 23 nt, Human
ucuuguaauuuaaacaggcccag

SEQ ID NO: 2260666 - RNA, 18 nt, Human
ucuugcccuucccugucc

SEQ ID NO: 2260667 - RNA, 20 nt, Human
ucuugcccuucccugucccu

SEQ ID NO: 2260668 - RNA, 21 nt, Human
ucuugcccuucccugucccuc

SEQ ID NO: 2260669 - RNA, 13 nt, Human
ucuugcucuguaa

SEQ ID NO: 2260670 - RNA, 14 nt, Human
ucuugcucuguaau

SEQ ID NO: 2260671 - RNA, 17 nt, Human
ucuugcucuguaaucuc

SEQ ID NO: 2260672 - RNA, 14 nt, Human
ucuugcucuuucua

SEQ ID NO: 2260673 - RNA, 24 nt, Human
ucuucauuucauuguaugaugugu

SEQ ID NO: 2260674 - RNA, 14 nt, Human
ucuuccaaagcaca

SEQ ID NO: 2260675 - RNA, 16 nt, Human
ucuucauuucauugua

SEQ ID NO: 2260676 - RNA, 17 nt, Human
ucuucauuucauuguau

SEQ ID NO: 2260677 - RNA, 21 nt, Human
ucuucauuucauuguaugaug

SEQ ID NO: 2260678 - RNA, 22 nt, Human
ucuucauuucauuguaugaugu

SEQ ID NO: 2260679 - RNA, 22 nt, Human
ucuucauuaccucagugagaag

SEQ ID NO: 2260680 - RNA, 22 nt, Human
ucuucauuaagcccucuuccau

SEQ ID NO: 2260681 - RNA, 14 nt, Human
ucuucauuucauug

SEQ ID NO: 2260682 - RNA, 15 nt, Human
ucuucauuucauugu

SEQ ID NO: 2260683 - RNA, 19 nt, Human
ucuucaguuuuaucuuuaa

SEQ ID NO: 2260684 - RNA, 18 nt, Human
ucuucaguuuuaucuuua

SEQ ID NO: 2260685 - RNA, 12 nt, Human
ucuucaguuuua

SEQ ID NO: 2260686 - RNA, 20 nt, Human
ucuucauaacaauuuuagga

SEQ ID NO: 2260687 - RNA, 21 nt, Human
ucuucauuaagcccucuucca

SEQ ID NO: 2260688 - RNA, 16 nt, Human
ucuucauguuucagga

SEQ ID NO: 2260689 - RNA, 19 nt, Human
ucuucagauacaaacugca

SEQ ID NO: 2260690 - RNA, 22 nt, Human
ucuucaguuaagccuuuggaaa

SEQ ID NO: 2260691 - RNA, 20 nt, Human
ucuucaguuaagccuuugga

SEQ ID NO: 2260692 - RNA, 19 nt, Human
ucuucaguuaagccuuugg

SEQ ID NO: 2260693 - RNA, 15 nt, Human
ucuucagaucucuaa

SEQ ID NO: 2260694 - RNA, 15 nt, Human
ucuucagaggcccuc

SEQ ID NO: 2260695 - RNA, 14 nt, Human
ucuucagaggcccu

SEQ ID NO: 2260696 - RNA, 13 nt, Human
ucuuaucaagcag

SEQ ID NO: 2260697 - RNA, 16 nt, Human
ucuuaucaagcagcca

SEQ ID NO: 2260698 - RNA, 23 nt, Human
ucuuaucaccacaguaaguuccu

SEQ ID NO: 2260699 - RNA, 22 nt, Human
ucuuauccaacaucaacaucuu

SEQ ID NO: 2260700 - RNA, 14 nt, Human
ucuuagugccugag

SEQ ID NO: 2260701 - RNA, 14 nt, Human
ucuuaguagauuuu

SEQ ID NO: 2260702 - RNA, 16 nt, Human
ucuuagcuccccucca

SEQ ID NO: 2260703 - RNA, 13 nt, Human
ucuuagcuccccu

SEQ ID NO: 2260704 - RNA, 14 nt, Human
ucuuagcuccccuc

SEQ ID NO: 2260705 - RNA, 18 nt, Human
ucuuagugccugagagua

SEQ ID NO: 2260706 - RNA, 18 nt, Human
ucuuauauaugugaacau

SEQ ID NO: 2260707 - RNA, 15 nt, Human
ucuuauauaugugaa

SEQ ID NO: 2260708 - RNA, 14 nt, Human
ucuucagaucucua

SEQ ID NO: 2260709 - RNA, 15 nt, Human
ucuuaucuucugcaa

SEQ ID NO: 2260710 - RNA, 16 nt, Human
ucuucagagcaggggu

SEQ ID NO: 2260711 - RNA, 12 nt, Human
ucuucagagcug

SEQ ID NO: 2260712 - RNA, 13 nt, Human
ucuucagagcuga

SEQ ID NO: 2260713 - RNA, 21 nt, Human
ucuucagagacuccugcaggc

SEQ ID NO: 2260714 - RNA, 12 nt, Human
ucuuaucucagu

SEQ ID NO: 2260715 - RNA, 20 nt, Human
ucuuaucauggucucaguca

SEQ ID NO: 2260716 - RNA, 14 nt, Human
ucuuaucucaguca

SEQ ID NO: 2260717 - RNA, 20 nt, Human
ucuuaucucagucaugcaua

SEQ ID NO: 2260718 - RNA, 22 nt, Human
ucuuaucucagucaugcauaaa

SEQ ID NO: 2260719 - RNA, 11 nt, Human
ucugugugugu

SEQ ID NO: 2260720 - RNA, 14 nt, Human
ucuuagauguauau

SEQ ID NO: 2260721 - RNA, 13 nt, Human
ucugugugugugu

SEQ ID NO: 2260722 - RNA, 18 nt, Human
ucugugugcaccuuacca

SEQ ID NO: 2260723 - RNA, 19 nt, Human
ucugugugcaccuuaccaa

SEQ ID NO: 2260724 - RNA, 16 nt, Human
ucuuagcauccugccu

SEQ ID NO: 2260725 - RNA, 16 nt, Human
ucuuagcagcuuccag

SEQ ID NO: 2260726 - RNA, 22 nt, Human
ucugugugcaccuuaccaacuu

SEQ ID NO: 2260727 - RNA, 15 nt, Human
ucuuagauguauaua

SEQ ID NO: 2260728 - RNA, 22 nt, Human
ucugugugcaagugugugcaca

SEQ ID NO: 2260729 - RNA, 20 nt, Human
ucugugugaugaacuuucuc

SEQ ID NO: 2260730 - RNA, 18 nt, Human
ucugugugaugaacuuuc

SEQ ID NO: 2260731 - RNA, 21 nt, Human
ucugugugcacaaauauuuau

SEQ ID NO: 2260732 - RNA, 14 nt, Human
ucugugugcacaaa

SEQ ID NO: 2260733 - RNA, 13 nt, Human
ucugugugaaaau

SEQ ID NO: 2260734 - RNA, 17 nt, Human
ucugugucagguggggc

SEQ ID NO: 2260735 - RNA, 20 nt, Human
ucugugucagguggggcagc

SEQ ID NO: 2260736 - RNA, 22 nt, Human
ucuuaggguuaugauuaaguaa

SEQ ID NO: 2260737 - RNA, 23 nt, Human
ucuuagguuggcaaaaaggcagg

SEQ ID NO: 2260738 - RNA, 20 nt, Human
ucuuagguuggcaaaaaggc

SEQ ID NO: 2260739 - RNA, 14 nt, Human
ucuuauaauuuaaa

SEQ ID NO: 2260740 - RNA, 13 nt, Human
ucuuauaauuuaa

SEQ ID NO: 2260741 - RNA, 23 nt, Human
ucuuguggauguuuuaauuccau

SEQ ID NO: 2260742 - RNA, 21 nt, Human
ucuugugugguuuggcccuuc

SEQ ID NO: 2260743 - RNA, 22 nt, Human
ucuugugcuggauggagcccag

SEQ ID NO: 2260744 - RNA, 23 nt, Human
ucuugugcuggauggagcccagg

SEQ ID NO: 2260745 - RNA, 19 nt, Human
ucuuguggauguuuuaauu

SEQ ID NO: 2260746 - RNA, 21 nt, Human
ucuugugcuuuuccuauuugu

SEQ ID NO: 2260747 - RNA, 23 nt, Human
ucuuuccaaaguacacuguuuca

SEQ ID NO: 2260748 - RNA, 13 nt, Human
ucuuguguguuua

SEQ ID NO: 2260749 - RNA, 21 nt, Human
ucuugucucaaugcucauaac

SEQ ID NO: 2260750 - RNA, 13 nt, Human
ucuugugaggaaa

SEQ ID NO: 2260751 - RNA, 23 nt, Human
ucuugugaggaaagucauuggcu

SEQ ID NO: 2260752 - RNA, 18 nt, Human
ucuugucucaaugcucau

SEQ ID NO: 2260753 - RNA, 20 nt, Human
ucuugucucaaugcucauaa

SEQ ID NO: 2260754 - RNA, 12 nt, Human
ucuuucccuccc

SEQ ID NO: 2260755 - RNA, 17 nt, Human
ucuuuccacagaagcuc

SEQ ID NO: 2260756 - RNA, 23 nt, Human
ucuuucccucccuuccucuuucc

SEQ ID NO: 2260757 - RNA, 13 nt, Human
ucuuucccucccu

SEQ ID NO: 2260758 - RNA, 16 nt, Human
ucuuugaaugacaaag

SEQ ID NO: 2260759 - RNA, 14 nt, Human
ucuuugaaugcuuu

SEQ ID NO: 2260760 - RNA, 15 nt, Human
ucuuugaaugacaaa

SEQ ID NO: 2260761 - RNA, 18 nt, Human
ucuuucccauggggaggg

SEQ ID NO: 2260762 - RNA, 14 nt, Human
ucuuugcagacagg

SEQ ID NO: 2260763 - RNA, 17 nt, Human
ucuuugcagacaggcaa

SEQ ID NO: 2260764 - RNA, 21 nt, Human
ucuuugccacccucaugcugu

SEQ ID NO: 2260765 - RNA, 22 nt, Human
ucuuugccacccucaugcugug

SEQ ID NO: 2260766 - RNA, 22 nt, Human
ucuuugagauagaagaacugca

SEQ ID NO: 2260767 - RNA, 18 nt, Human
ucuuugagauagaagaac

SEQ ID NO: 2260768 - RNA, 17 nt, Human
ucuuugagauagaagaa

SEQ ID NO: 2260769 - RNA, 23 nt, Human
ucuuugaccucaaccugugauga

SEQ ID NO: 2260770 - RNA, 13 nt, Human
ucuuugcagacag

SEQ ID NO: 2260771 - RNA, 16 nt, Human
ucuuugaauuuucugu

SEQ ID NO: 2260772 - RNA, 17 nt, Human
ucuuugaauuuucugug

SEQ ID NO: 2260773 - RNA, 23 nt, Human
ucuuugagugaagcugggagaac

SEQ ID NO: 2260774 - RNA, 13 nt, Human
ucuuugcuugccu

SEQ ID NO: 2260775 - RNA, 11 nt, Human
ucuuugcuuug

SEQ ID NO: 2260776 - RNA, 22 nt, Human
ucuuuggacagaagcagcucuu

SEQ ID NO: 2260777 - RNA, 19 nt, Human
ucuuugcuucacuucuccc

SEQ ID NO: 2260778 - RNA, 15 nt, Human
ucuuugcuugccucu

SEQ ID NO: 2260779 - RNA, 13 nt, Human
ucuuuggacccug

SEQ ID NO: 2260780 - RNA, 21 nt, Human
ucuuugccuugggcugcuccu

SEQ ID NO: 2260781 - RNA, 20 nt, Human
ucuuugccuugggcugcucc

SEQ ID NO: 2260782 - RNA, 14 nt, Human
ucuuugccuugggc

SEQ ID NO: 2260783 - RNA, 17 nt, Human
ucuuugccuguucaguu

SEQ ID NO: 2260784 - RNA, 23 nt, Human
ucuuugccuguucaguuacagaa

SEQ ID NO: 2260785 - RNA, 12 nt, Human
ucuuugccuggu

SEQ ID NO: 2260786 - RNA, 12 nt, Human
ucuuugccuguu

SEQ ID NO: 2260787 - RNA, 15 nt, Human
ucuuugccuguucag

SEQ ID NO: 2260788 - RNA, 16 nt, Human
ucuuugccuguucagu

SEQ ID NO: 2260789 - RNA, 16 nt, Human
ucuuuggacccugagg

SEQ ID NO: 2260790 - RNA, 18 nt, Human
ucuuuucaucugggaaag

SEQ ID NO: 2260791 - RNA, 20 nt, Human
ucuuuucagaucauggcauc

SEQ ID NO: 2260792 - RNA, 17 nt, Human
ucuuuucacauucuuau

SEQ ID NO: 2260793 - RNA, 18 nt, Human
ucuuuucacauucuuaua

SEQ ID NO: 2260794 - RNA, 19 nt, Human
ucuuuucacauucuuauaa

SEQ ID NO: 2260795 - RNA, 22 nt, Human
ucuuuucacauucuuauaaaua

SEQ ID NO: 2260796 - RNA, 14 nt, Human
ucuuuggacccuga

SEQ ID NO: 2260797 - RNA, 15 nt, Human
ucuuuggacccugag

SEQ ID NO: 2260798 - RNA, 22 nt, Human
ucuuuucaucugggaaagacau

SEQ ID NO: 2260799 - RNA, 19 nt, Human
ucuuuucaucugggaaaga

SEQ ID NO: 2260800 - RNA, 19 nt, Human
ucuuuucccacuguuuaag

SEQ ID NO: 2260801 - RNA, 22 nt, Human
ucuuuucgccguggcugcggca

SEQ ID NO: 2260802 - RNA, 12 nt, Human
ucuuuucuaccc

SEQ ID NO: 2260803 - RNA, 17 nt, Human
ucuuuucuacccuagcc

SEQ ID NO: 2260804 - RNA, 18 nt, Human
ucuuuucuacccuagcca

SEQ ID NO: 2260805 - RNA, 19 nt, Human
ucuuuucuacccuagccau

SEQ ID NO: 2260806 - RNA, 14 nt, Human
ucuuuucuauuuuc

SEQ ID NO: 2260807 - RNA, 18 nt, Human
ucuuuucuauuuucccuc

SEQ ID NO: 2260808 - RNA, 10 nt, Human
ucuuuuguau

SEQ ID NO: 2260809 - RNA, 11 nt, Human
ucuuuuguaug

SEQ ID NO: 2260810 - RNA, 15 nt, Human
ucuuuuguauguaaa

SEQ ID NO: 2260811 - RNA, 17 nt, Human
ucuuuuguauguaaaug

SEQ ID NO: 2260812 - RNA, 20 nt, Human
ucuuuuguauguaaaugugc

SEQ ID NO: 2260813 - RNA, 22 nt, Human
ucuuuuguauguaaaugugcau

SEQ ID NO: 2260814 - RNA, 21 nt, Human
ucuuuuuaagcuuauuuaauu

SEQ ID NO: 2260815 - RNA, 14 nt, Human
ucuuuuuaagcuua

SEQ ID NO: 2260816 - RNA, 15 nt, Human
ucuuuuuaauaaaaa

SEQ ID NO: 2260817 - RNA, 21 nt, Human
ugaaaacacauuuuucuuagg

SEQ ID NO: 2260818 - RNA, 23 nt, Human
ucuuuuuaaaguguuucuguuau

SEQ ID NO: 2260819 - RNA, 20 nt, Human
ucuuuuguucgcauggucac

SEQ ID NO: 2260820 - RNA, 18 nt, Human
ugaaaacagaaaacgguu

SEQ ID NO: 2260821 - RNA, 14 nt, Human
ugaaaacauguaau

SEQ ID NO: 2260822 - RNA, 23 nt, Human
ugaaaacaugguagaauuggaga

SEQ ID NO: 2260823 - RNA, 19 nt, Human
ugaaaacaugguagaauug

SEQ ID NO: 2260824 - RNA, 13 nt, Human
ugaaaacaucugg

SEQ ID NO: 2260825 - RNA, 17 nt, Human
ugaaaacaucuggaagg

SEQ ID NO: 2260826 - RNA, 22 nt, Human
ugaaaacacuguucucugcccu

SEQ ID NO: 2260827 - RNA, 23 nt, Human
ugaaaacacuguucucugcccuc

SEQ ID NO: 2260828 - RNA, 17 nt, Human
ugaaaacacuguucucu

SEQ ID NO: 2260829 - RNA, 18 nt, Human
ugaaaacacugugcacau

SEQ ID NO: 2260830 - RNA, 16 nt, Human
ugaaaacacugugcac

SEQ ID NO: 2260831 - RNA, 20 nt, Human
ugaaaacacuguucucugcc

SEQ ID NO: 2260832 - RNA, 21 nt, Human
ugaaaacacuguucucugccc

SEQ ID NO: 2260833 - RNA, 14 nt, Human
ugaaaauucagugg

SEQ ID NO: 2260834 - RNA, 18 nt, Human
ugaaaauuauuuuaaaca

SEQ ID NO: 2260835 - RNA, 19 nt, Human
ugaaaauuauuuuaaacaa

SEQ ID NO: 2260836 - RNA, 21 nt, Human
ugaaaauuauuuuaaacaaaa

SEQ ID NO: 2260837 - RNA, 17 nt, Human
ugaaaauucaaaaagug

SEQ ID NO: 2260838 - RNA, 23 nt, Human
ugaaaauucaaaaaguguuuauu

SEQ ID NO: 2260839 - RNA, 18 nt, Human
ugaaaauucaaaaagugu

SEQ ID NO: 2260840 - RNA, 19 nt, Human
ugaaaauucaaaaaguguu

SEQ ID NO: 2260841 - RNA, 12 nt, Human
ugaaaauuuuga

SEQ ID NO: 2260842 - RNA, 17 nt, Human
ugaaaauuguauguuaa

SEQ ID NO: 2260843 - RNA, 18 nt, Human
ugaaacaccuucucugga

SEQ ID NO: 2260844 - RNA, 19 nt, Human
ugaaacaccuucucuggag

SEQ ID NO: 2260845 - RNA, 15 nt, Human
ugaaacacuuugcau

SEQ ID NO: 2260846 - RNA, 23 nt, Human
ugaaacacucaguuguucaauaa

SEQ ID NO: 2260847 - RNA, 22 nt, Human
ugaaaagaaaaaugagccuggc

SEQ ID NO: 2260848 - RNA, 20 nt, Human
ugaaaagaaaaaugagccug

SEQ ID NO: 2260849 - RNA, 15 nt, Human
ugaaaauuauuugaa

SEQ ID NO: 2260850 - RNA, 20 nt, Human
ugaaaauuaggauuucauga

SEQ ID NO: 2260851 - RNA, 16 nt, Human
ugaaaauuauuugaaa

SEQ ID NO: 2260852 - RNA, 15 nt, Human
ugaaaauuauuuuaa

SEQ ID NO: 2260853 - RNA, 16 nt, Human
ugaaaauuauuuuaaa

SEQ ID NO: 2260854 - RNA, 15 nt, Human
ugaaaagaaaaauga

SEQ ID NO: 2260855 - RNA, 18 nt, Human
ugaaaacguuuuauugug

SEQ ID NO: 2260856 - RNA, 17 nt, Human
ugaaaacguuuuauugu

SEQ ID NO: 2260857 - RNA, 16 nt, Human
ugaaaacguuuuauug

SEQ ID NO: 2260858 - RNA, 16 nt, Human
ugaaaacccagagagg

SEQ ID NO: 2260859 - RNA, 19 nt, Human
ugaaaagaaaaaugagccu

SEQ ID NO: 2260860 - RNA, 15 nt, Human
ugaaaacccagagag

SEQ ID NO: 2260861 - RNA, 14 nt, Human
ugaaaacccagaga

SEQ ID NO: 2260862 - RNA, 23 nt, Human
ugaaaacccagagaggaaucaga

SEQ ID NO: 2260863 - RNA, 20 nt, Human
ugaaaacggagcugaacaau

SEQ ID NO: 2260864 - RNA, 18 nt, Human
ugaaaaccacauuggaga

SEQ ID NO: 2260865 - RNA, 20 nt, Human
ucuggaccuuguuguuguua

SEQ ID NO: 2260866 - RNA, 14 nt, Human
ucuggacggcaggc

SEQ ID NO: 2260867 - RNA, 15 nt, Human
ucuggacggcaggcu

SEQ ID NO: 2260868 - RNA, 17 nt, Human
ucuggacggcaggcuca

SEQ ID NO: 2260869 - RNA, 19 nt, Human
ucuggacggcaggcucacu

SEQ ID NO: 2260870 - RNA, 23 nt, Human
ucuggaccccaucugugaauaag

SEQ ID NO: 2260871 - RNA, 23 nt, Human
ucuggacaagccaacuuguaaau

SEQ ID NO: 2260872 - RNA, 20 nt, Human
ucuggacagccccacccugg

SEQ ID NO: 2260873 - RNA, 21 nt, Human
ucuggaccccaucugugaaua

SEQ ID NO: 2260874 - RNA, 15 nt, Human
ucuggacuccucugu

SEQ ID NO: 2260875 - RNA, 23 nt, Human
ucuggacggcaggcucacugcca

SEQ ID NO: 2260876 - RNA, 16 nt, Human
ucuggacuccucuguc

SEQ ID NO: 2260877 - RNA, 18 nt, Human
ucuggacuccucugucca

SEQ ID NO: 2260878 - RNA, 22 nt, Human
ucuggacuccucuguccaggca

SEQ ID NO: 2260879 - RNA, 21 nt, Human
ucuggacggcaggcucacugc

SEQ ID NO: 2260880 - RNA, 22 nt, Human
ucuggacggcaggcucacugcc

SEQ ID NO: 2260881 - RNA, 21 nt, Human
ucuggacugaagccugcagga

SEQ ID NO: 2260882 - RNA, 19 nt, Human
ucuggacugccccagaaaa

SEQ ID NO: 2260883 - RNA, 19 nt, Human
ucuggacugaagccugcag

SEQ ID NO: 2260884 - RNA, 17 nt, Human
ucuggacugaagccugc

SEQ ID NO: 2260885 - RNA, 13 nt, Human
ucuggacugaagc

SEQ ID NO: 2260886 - RNA, 15 nt, Human
ucuggacuggcuaga

SEQ ID NO: 2260887 - RNA, 14 nt, Human
ucuggacuggcuag

SEQ ID NO: 2260888 - RNA, 20 nt, Human
ucuggacugaagccugcagg

SEQ ID NO: 2260889 - RNA, 19 nt, Human
ucuggacuuggcaacagaa

SEQ ID NO: 2260890 - RNA, 11 nt, Human
ucuggagaagc

SEQ ID NO: 2260891 - RNA, 16 nt, Human
ucuggagaagcaguga

SEQ ID NO: 2260892 - RNA, 21 nt, Human
ucuggagagcuagaaccugga

SEQ ID NO: 2260893 - RNA, 22 nt, Human
ucuggagagcuagaaccuggag

SEQ ID NO: 2260894 - RNA, 23 nt, Human
ucuggagagcuagaaccuggagg

SEQ ID NO: 2260895 - RNA, 22 nt, Human
ucuggagaagcagugagccgca

SEQ ID NO: 2260896 - RNA, 15 nt, Human
ucuggagaagcagug

SEQ ID NO: 2260897 - RNA, 18 nt, Human
ucugcugcccuccauccc

SEQ ID NO: 2260898 - RNA, 21 nt, Human
ucugcugccgccccacccaga

SEQ ID NO: 2260899 - RNA, 13 nt, Human
ucugcuggaguuu

SEQ ID NO: 2260900 - RNA, 18 nt, Human
ucugcugcugucccuccc

SEQ ID NO: 2260901 - RNA, 17 nt, Human
ucugcugcuggcugguu

SEQ ID NO: 2260902 - RNA, 14 nt, Human
ucugcugcuggcug

SEQ ID NO: 2260903 - RNA, 15 nt, Human
ucugcugcuggcugg

SEQ ID NO: 2260904 - RNA, 12 nt, Human
ucuggacaagcc

SEQ ID NO: 2260905 - RNA, 21 nt, Human
ucuggacaagccaacuuguaa

SEQ ID NO: 2260906 - RNA, 19 nt, Human
ucuggacagccccacccug

SEQ ID NO: 2260907 - RNA, 18 nt, Human
ucuggacagccccacccu

SEQ ID NO: 2260908 - RNA, 14 nt, Human
ucuggaauuugaaa

SEQ ID NO: 2260909 - RNA, 19 nt, Human
ucugcuggaguuucaugua

SEQ ID NO: 2260910 - RNA, 22 nt, Human
ucugcugccgccccacccagau

SEQ ID NO: 2260911 - RNA, 23 nt, Human
ucugcuggaguuucauguacaag

SEQ ID NO: 2260912 - RNA, 15 nt, Human
ucuggaauguaauca

SEQ ID NO: 2260913 - RNA, 16 nt, Human
ucuggaauguaaucaa

SEQ ID NO: 2260914 - RNA, 18 nt, Human
ucuggaauguaaucaaug

SEQ ID NO: 2260915 - RNA, 22 nt, Human
ucuggaauguaaucaauguuuc

SEQ ID NO: 2260916 - RNA, 15 nt, Human
ucugcugcccuccau

SEQ ID NO: 2260917 - RNA, 14 nt, Human
ucugcugcccucca

SEQ ID NO: 2260918 - RNA, 13 nt, Human
ucugcugcccucc

SEQ ID NO: 2260919 - RNA, 17 nt, Human
ucugcugaauuuucaca

SEQ ID NO: 2260920 - RNA, 20 nt, Human
ucugcucuuucucugccagu

SEQ ID NO: 2260921 - RNA, 14 nt, Human
ucugcugaauuuuc

SEQ ID NO: 2260922 - RNA, 16 nt, Human
ucugcugaauuuucac

SEQ ID NO: 2260923 - RNA, 11 nt, Human
ucugcugcugg

SEQ ID NO: 2260924 - RNA, 13 nt, Human
ucugcugcuggcu

SEQ ID NO: 2260925 - RNA, 13 nt, Human
ucugcugaaggaa

SEQ ID NO: 2260926 - RNA, 18 nt, Human
ucugcucuuucucugcca

SEQ ID NO: 2260927 - RNA, 19 nt, Human
ucugcucuuucucugccag

SEQ ID NO: 2260928 - RNA, 14 nt, Human
ucugcucuuucucu

SEQ ID NO: 2260929 - RNA, 15 nt, Human
ucugcucuuucucug

SEQ ID NO: 2260930 - RNA, 16 nt, Human
ucugcucuuucucugc

SEQ ID NO: 2260931 - RNA, 17 nt, Human
ucugcucuuucucugcc

SEQ ID NO: 2260932 - RNA, 19 nt, Human
ucugcucugaggcuuccag

SEQ ID NO: 2260933 - RNA, 20 nt, Human
ucugcucugaggcuuccaga

SEQ ID NO: 2260934 - RNA, 12 nt, Human
ucugcucugccc

SEQ ID NO: 2260935 - RNA, 13 nt, Human
ucugcucugcccu

SEQ ID NO: 2260936 - RNA, 14 nt, Human
ucugcucugcccuu

SEQ ID NO: 2260937 - RNA, 21 nt, Human
ucugcucugcgugucaccugu

SEQ ID NO: 2260938 - RNA, 16 nt, Human
ucugcucugcguguca

SEQ ID NO: 2260939 - RNA, 18 nt, Human
ucugcucggccgucuuca

SEQ ID NO: 2260940 - RNA, 15 nt, Human
ucugcucggccgucu

SEQ ID NO: 2260941 - RNA, 14 nt, Human
ucugcucggccguc

SEQ ID NO: 2260942 - RNA, 16 nt, Human
ucugcucgccuuagca

SEQ ID NO: 2260943 - RNA, 22 nt, Human
ucugccugccagcugcacugau

SEQ ID NO: 2260944 - RNA, 22 nt, Human
ucugcuccuggagccuuugaau

SEQ ID NO: 2260945 - RNA, 12 nt, Human
ucugcucuccuu

SEQ ID NO: 2260946 - RNA, 13 nt, Human
ucugcucuccuuc

SEQ ID NO: 2260947 - RNA, 16 nt, Human
ucugcucgggcccagg

SEQ ID NO: 2260948 - RNA, 17 nt, Human
ucugcucgggcccaggc

SEQ ID NO: 2260949 - RNA, 18 nt, Human
ucugcucgggcccaggcc

SEQ ID NO: 2260950 - RNA, 22 nt, Human
ucugcucgggcccaggccaucu

SEQ ID NO: 2260951 - RNA, 14 nt, Human
ucugcucuccuucc

SEQ ID NO: 2260952 - RNA, 15 nt, Human
ucugcucuccuuccu

SEQ ID NO: 2260953 - RNA, 19 nt, Human
ucugcucuccuuccuggag

SEQ ID NO: 2260954 - RNA, 20 nt, Human
ucugcucuccuuccuggagc

SEQ ID NO: 2260955 - RNA, 17 nt, Human
ucugccugcccaggccc

SEQ ID NO: 2260956 - RNA, 21 nt, Human
ucugccugccagcugcacuga

SEQ ID NO: 2260957 - RNA, 18 nt, Human
ucugccugccagcugcac

SEQ ID NO: 2260958 - RNA, 18 nt, Human
ucugccugcccaggcccc

SEQ ID NO: 2260959 - RNA, 20 nt, Human
ucugccugcccaggccccug

SEQ ID NO: 2260960 - RNA, 22 nt, Human
ucugucgccuuagcauguuugc

SEQ ID NO: 2260961 - RNA, 23 nt, Human
ucugucgccuuagcauguuugcu

SEQ ID NO: 2260962 - RNA, 17 nt, Human
ucugucgccuuagcaug

SEQ ID NO: 2260963 - RNA, 18 nt, Human
ucugucgccuuagcaugu

SEQ ID NO: 2260964 - RNA, 19 nt, Human
ucugucgccuuagcauguu

SEQ ID NO: 2260965 - RNA, 16 nt, Human
ucugucgccuuagcau

SEQ ID NO: 2260966 - RNA, 12 nt, Human
ucuguccugcug

SEQ ID NO: 2260967 - RNA, 21 nt, Human
ucugucucaaaaaauaaaaau

SEQ ID NO: 2260968 - RNA, 13 nt, Human
ucugucuaggaau

SEQ ID NO: 2260969 - RNA, 23 nt, Human
ucugugucacuggcugccuccac

SEQ ID NO: 2260970 - RNA, 17 nt, Human
ucugugucacuggcugc

SEQ ID NO: 2260971 - RNA, 22 nt, Human
ucugugucacuggcugccucca

SEQ ID NO: 2260972 - RNA, 15 nt, Human
ucuguguacaaagaa

SEQ ID NO: 2260973 - RNA, 14 nt, Human
ucugugucacuggc

SEQ ID NO: 2260974 - RNA, 15 nt, Human
ucugugucacuggcu

SEQ ID NO: 2260975 - RNA, 14 nt, Human
ucugucuccuuaac

SEQ ID NO: 2260976 - RNA, 17 nt, Human
ucugucucauccaucau

SEQ ID NO: 2260977 - RNA, 19 nt, Human
ucugucuccuuaacacuga

SEQ ID NO: 2260978 - RNA, 16 nt, Human
ucuguguacaaagaaa

SEQ ID NO: 2260979 - RNA, 15 nt, Human
ucugucucauaugau

SEQ ID NO: 2260980 - RNA, 13 nt, Human
ucugucucaucca

SEQ ID NO: 2260981 - RNA, 21 nt, Human
ucugucucauccaucaucaug

SEQ ID NO: 2260982 - RNA, 14 nt, Human
ucugucucagucca

SEQ ID NO: 2260983 - RNA, 12 nt, Human
ucuguccuggga

SEQ ID NO: 2260984 - RNA, 17 nt, Human
ucugucgcccagucugg

SEQ ID NO: 2260985 - RNA, 23 nt, Human
ucuguccucagccuugccagaga

SEQ ID NO: 2260986 - RNA, 23 nt, Human
ucuguacaaugaacccccaugau

SEQ ID NO: 2260987 - RNA, 10 nt, Human
ucuguccuga

SEQ ID NO: 2260988 - RNA, 21 nt, Human
ucuguccucagccuugccaga

SEQ ID NO: 2260989 - RNA, 19 nt, Human
ucuguccucagccuugcca

SEQ ID NO: 2260990 - RNA, 15 nt, Human
ucuguccucagccuu

SEQ ID NO: 2260991 - RNA, 14 nt, Human
ucuguccucagccu

SEQ ID NO: 2260992 - RNA, 13 nt, Human
ucuguccucagcc

SEQ ID NO: 2260993 - RNA, 17 nt, Human
ucuguacacguguccug

SEQ ID NO: 2260994 - RNA, 15 nt, Human
ucuguacagagccca

SEQ ID NO: 2260995 - RNA, 13 nt, Human
ucuguacacgugu

SEQ ID NO: 2260996 - RNA, 13 nt, Human
ucuguacaaugaa

SEQ ID NO: 2260997 - RNA, 14 nt, Human
ucuguacagagccc

SEQ ID NO: 2260998 - RNA, 17 nt, Human
ucuguaauuguguguga

SEQ ID NO: 2260999 - RNA, 23 nt, Human
ucuggcuuccagaaaaccccagc

SEQ ID NO: 2261000 - RNA, 24 nt, Human
ucuggcuuccagguaucuccagga

SEQ ID NO: 2261001 - RNA, 13 nt, Human
ucuggcuuccagg

SEQ ID NO: 2261002 - RNA, 15 nt, Human
ucuggcuuccaggua

SEQ ID NO: 2261003 - RNA, 22 nt, Human
ucuggcuuccagguaucuccag

SEQ ID NO: 2261004 - RNA, 21 nt, Human
ucuggcuggcuaacuggaagc

SEQ ID NO: 2261005 - RNA, 22 nt, Human
ucuggcugguuuggaaugcuuc

SEQ ID NO: 2261006 - RNA, 15 nt, Human
ucuggcugcagagca

SEQ ID NO: 2261007 - RNA, 14 nt, Human
ucuggcugcagagc

SEQ ID NO: 2261008 - RNA, 21 nt, Human
ucuggcugccccaaccugcug

SEQ ID NO: 2261009 - RNA, 22 nt, Human
ucuggcugccccaaccugcuga

SEQ ID NO: 2261010 - RNA, 22 nt, Human
ucuggagagguuauaggucacu

SEQ ID NO: 2261011 - RNA, 20 nt, Human
ucuggagagguuauagguca

SEQ ID NO: 2261012 - RNA, 16 nt, Human
ucuggagccaagucca

SEQ ID NO: 2261013 - RNA, 12 nt, Human
ucuggagcccac

SEQ ID NO: 2261014 - RNA, 16 nt, Human
ucuggagcccacugua

SEQ ID NO: 2261015 - RNA, 22 nt, Human
ucuggagcccacuguacuugcu

SEQ ID NO: 2261016 - RNA, 22 nt, Human
ucuguaacucuaaaagauccuu

SEQ ID NO: 2261017 - RNA, 22 nt, Human
ucuguaaacuguguauuccaag

SEQ ID NO: 2261018 - RNA, 19 nt, Human
ucuguaaacuguguauucc

SEQ ID NO: 2261019 - RNA, 22 nt, Human
ucuguaaaaucuuucuuucuua

SEQ ID NO: 2261020 - RNA, 23 nt, Human
ucuguaaaaucuuucuuucuuag

SEQ ID NO: 2261021 - RNA, 12 nt, Human
ucuguaaacugu

SEQ ID NO: 2261022 - RNA, 15 nt, Human
ucuguaaacucaaaa

SEQ ID NO: 2261023 - RNA, 18 nt, Human
ucuguaaacucaaaacuu

SEQ ID NO: 2261024 - RNA, 16 nt, Human
ucuguaaacuguguau

SEQ ID NO: 2261025 - RNA, 15 nt, Human
ucuguaaacugugua

SEQ ID NO: 2261026 - RNA, 14 nt, Human
ucuguaaacugugu

SEQ ID NO: 2261027 - RNA, 13 nt, Human
ucuguaaacugug

SEQ ID NO: 2261028 - RNA, 18 nt, Human
ucuggugacaccagccuu

SEQ ID NO: 2261029 - RNA, 17 nt, Human
ucuggugacaccagccu

SEQ ID NO: 2261030 - RNA, 16 nt, Human
ucuggugacaccagcc

SEQ ID NO: 2261031 - RNA, 14 nt, Human
ucuggucugggugc

SEQ ID NO: 2261032 - RNA, 16 nt, Human
ucuggugaccuuccaa

SEQ ID NO: 2261033 - RNA, 17 nt, Human
ucuggugaagcucacuu

SEQ ID NO: 2261034 - RNA, 19 nt, Human
ucuggucucuaggcugggg

SEQ ID NO: 2261035 - RNA, 21 nt, Human
ucuggucucuaggcuggggaa

SEQ ID NO: 2261036 - RNA, 16 nt, Human
ucuggucucuaggcug

SEQ ID NO: 2261037 - RNA, 17 nt, Human
ucuggucucuaggcugg

SEQ ID NO: 2261038 - RNA, 18 nt, Human
ucuggucucuaggcuggg

SEQ ID NO: 2261039 - RNA, 16 nt, Human
ucuggugacuuuccuc

SEQ ID NO: 2261040 - RNA, 23 nt, Human
ucuggugaccuuccaagagccug

SEQ ID NO: 2261041 - RNA, 18 nt, Human
ucuggugaccuuccaaga

SEQ ID NO: 2261042 - RNA, 18 nt, Human
ucugcaccguacugugga

SEQ ID NO: 2261043 - RNA, 23 nt, Human
ucugcacccuggggccuggaccu

SEQ ID NO: 2261044 - RNA, 12 nt, Human
ucugcacuacuc

SEQ ID NO: 2261045 - RNA, 14 nt, Human
ucugcacuacuccu

SEQ ID NO: 2261046 - RNA, 18 nt, Human
ucugcacuacuccucugc

SEQ ID NO: 2261047 - RNA, 18 nt, Human
ucugcacuacugacaugu

SEQ ID NO: 2261048 - RNA, 20 nt, Human
ucugcacuacugacaugugg

SEQ ID NO: 2261049 - RNA, 19 nt, Human
ucugcacuacuccucugca

SEQ ID NO: 2261050 - RNA, 20 nt, Human
ucugcacuacuccucugcag

SEQ ID NO: 2261051 - RNA, 21 nt, Human
ucugcacuacuccucugcagu

SEQ ID NO: 2261052 - RNA, 23 nt, Human
ucugcacuacuccucugcagugc

SEQ ID NO: 2261053 - RNA, 13 nt, Human
ucugcacuccccu

SEQ ID NO: 2261054 - RNA, 16 nt, Human
ucugcaguaaaucuuu

SEQ ID NO: 2261055 - RNA, 21 nt, Human
ucugcacuacugacauguggg

SEQ ID NO: 2261056 - RNA, 20 nt, Human
ucugcaagcacaucugcauu

SEQ ID NO: 2261057 - RNA, 21 nt, Human
ucugcaagauucugaaacauu

SEQ ID NO: 2261058 - RNA, 14 nt, Human
ucugcaagccugcg

SEQ ID NO: 2261059 - RNA, 17 nt, Human
ucugcaaggucuuuggu

SEQ ID NO: 2261060 - RNA, 15 nt, Human
ucugcaagccugcgu

SEQ ID NO: 2261061 - RNA, 23 nt, Human
ucugcaagggcagaacacuaacc

SEQ ID NO: 2261062 - RNA, 12 nt, Human
ucugcaagucag

SEQ ID NO: 2261063 - RNA, 13 nt, Human
ucugcaagucaga

SEQ ID NO: 2261064 - RNA, 14 nt, Human
ucugcaagucagag

SEQ ID NO: 2261065 - RNA, 15 nt, Human
ucugcaagucagagg

SEQ ID NO: 2261066 - RNA, 16 nt, Human
ucugcaagucagagga

SEQ ID NO: 2261067 - RNA, 17 nt, Human
ucugcaagucagaggau

SEQ ID NO: 2261068 - RNA, 17 nt, Human
ucugcaaucuucucaga

SEQ ID NO: 2261069 - RNA, 14 nt, Human
ucugcaaucuucuc

SEQ ID NO: 2261070 - RNA, 23 nt, Human
ucugcaagucagaggauggccag

SEQ ID NO: 2261071 - RNA, 16 nt, Human
ucugcaaugggcacug

SEQ ID NO: 2261072 - RNA, 19 nt, Human
ucugcaaugggcacuggga

SEQ ID NO: 2261073 - RNA, 21 nt, Human
ucugcaaugggcacugggaug

SEQ ID NO: 2261074 - RNA, 24 nt, Human
ucugcacccuggggccuggaccug

SEQ ID NO: 2261075 - RNA, 20 nt, Human
ucugcaaaaauauuuauaaa

SEQ ID NO: 2261076 - RNA, 19 nt, Human
ucugcaaaaauauuuauaa

SEQ ID NO: 2261077 - RNA, 14 nt, Human
ucugcaaaaauauu

SEQ ID NO: 2261078 - RNA, 20 nt, Human
ucugauuugucccuaugcau

SEQ ID NO: 2261079 - RNA, 13 nt, Human
ucugauuucagga

SEQ ID NO: 2261080 - RNA, 18 nt, Human
ucugcaaagaaugagaag

SEQ ID NO: 2261081 - RNA, 22 nt, Human
ucugcaaaaugaggaauguaua

SEQ ID NO: 2261082 - RNA, 24 nt, Human
ucugcaaacaccaacauguuggga

SEQ ID NO: 2261083 - RNA, 20 nt, Human
ucugcaaaaugaggaaugua

SEQ ID NO: 2261084 - RNA, 21 nt, Human
ucugcaaaaugaggaauguau

SEQ ID NO: 2261085 - RNA, 23 nt, Human
ucugcaaaaugaggaauguauau

SEQ ID NO: 2261086 - RNA, 22 nt, Human
ucugaggaauccagacccggcu

SEQ ID NO: 2261087 - RNA, 18 nt, Human
ucugagcccucaaaguga

SEQ ID NO: 2261088 - RNA, 16 nt, Human
ucugauugugauguga

SEQ ID NO: 2261089 - RNA, 18 nt, Human
ucugaggaauccagaccc

SEQ ID NO: 2261090 - RNA, 21 nt, Human
ucugaggaauccagacccggc

SEQ ID NO: 2261091 - RNA, 16 nt, Human
ucugagccccugggac

SEQ ID NO: 2261092 - RNA, 15 nt, Human
ucugagccccuggga

SEQ ID NO: 2261093 - RNA, 22 nt, Human
ucugagccaguucaguaccugg

SEQ ID NO: 2261094 - RNA, 12 nt, Human
ucugagccaguu

SEQ ID NO: 2261095 - RNA, 13 nt, Human
ucugagcccgggc

SEQ ID NO: 2261096 - RNA, 15 nt, Human
ucugagcccgggcug

SEQ ID NO: 2261097 - RNA, 16 nt, Human
ucugagcccgggcugc

SEQ ID NO: 2261098 - RNA, 17 nt, Human
ucugagcccgggcugcc

SEQ ID NO: 2261099 - RNA, 18 nt, Human
ucugagcccgggcugccu

SEQ ID NO: 2261100 - RNA, 19 nt, Human
ucugagcccgggcugccug

SEQ ID NO: 2261101 - RNA, 20 nt, Human
ucugagcccgggcugccugg

SEQ ID NO: 2261102 - RNA, 21 nt, Human
ucugagcccgggcugccuggg

SEQ ID NO: 2261103 - RNA, 22 nt, Human
ucugagcuauuucaucuauuuu

SEQ ID NO: 2261104 - RNA, 20 nt, Human
ucugagcuauuucaucuauu

SEQ ID NO: 2261105 - RNA, 17 nt, Human
ucugagcuauuucaucu

SEQ ID NO: 2261106 - RNA, 14 nt, Human
ucugagcgccucca

SEQ ID NO: 2261107 - RNA, 17 nt, Human
ucugagcccucaaagug

SEQ ID NO: 2261108 - RNA, 24 nt, Human
ucugagcccgggcugccugggcug

SEQ ID NO: 2261109 - RNA, 21 nt, Human
ucugagcgccuccauccaagg

SEQ ID NO: 2261110 - RNA, 24 nt, Human
ucugagaucaaaacgguuuuacug

SEQ ID NO: 2261111 - RNA, 18 nt, Human
ucugagaggacuuuucuu

SEQ ID NO: 2261112 - RNA, 15 nt, Human
ucucauccccagggg

SEQ ID NO: 2261113 - RNA, 12 nt, Human
ucugagagcugu

SEQ ID NO: 2261114 - RNA, 22 nt, Human
ucucauccccaggggucccagc

SEQ ID NO: 2261115 - RNA, 14 nt, Human
ucucauccccaggg

SEQ ID NO: 2261116 - RNA, 10 nt, Human
ucucauccca

SEQ ID NO: 2261117 - RNA, 19 nt, Human
ucucaucccacgcacucca

SEQ ID NO: 2261118 - RNA, 14 nt, Human
ucucauccaucauc

SEQ ID NO: 2261119 - RNA, 13 nt, Human
ucucauccaucau

SEQ ID NO: 2261120 - RNA, 15 nt, Human
ucucaucaguguccu

SEQ ID NO: 2261121 - RNA, 21 nt, Human
ucucaucaguguccucuugcu

SEQ ID NO: 2261122 - RNA, 15 nt, Human
ucucaucacuccccu

SEQ ID NO: 2261123 - RNA, 16 nt, Human
ucucaucacuccccuc

SEQ ID NO: 2261124 - RNA, 19 nt, Human
ucucaucacuccccuccaa

SEQ ID NO: 2261125 - RNA, 17 nt, Human
ucucaucaacugaauga

SEQ ID NO: 2261126 - RNA, 22 nt, Human
ucucauaggaaaaguacauuua

SEQ ID NO: 2261127 - RNA, 23 nt, Human
ucucauaggaaaaguacauuuaa

SEQ ID NO: 2261128 - RNA, 15 nt, Human
ucucaucaacugaau

SEQ ID NO: 2261129 - RNA, 24 nt, Human
ucucauaggaaaaguacauuuaau

SEQ ID NO: 2261130 - RNA, 19 nt, Human
ucugacccaugcugcccug

SEQ ID NO: 2261131 - RNA, 20 nt, Human
ucugacccaugcugcccugu

SEQ ID NO: 2261132 - RNA, 22 nt, Human
ucugacccaugcugcccuguga

SEQ ID NO: 2261133 - RNA, 23 nt, Human
ucugacccaugcugcccugugag

SEQ ID NO: 2261134 - RNA, 20 nt, Human
ucugccucacauagcuuaca

SEQ ID NO: 2261135 - RNA, 21 nt, Human
ucugccucaaugugaaucaga

SEQ ID NO: 2261136 - RNA, 15 nt, Human
ucugccucccucacc

SEQ ID NO: 2261137 - RNA, 15 nt, Human
ucugccuccucuuca

SEQ ID NO: 2261138 - RNA, 12 nt, Human
ucugccucucaa

SEQ ID NO: 2261139 - RNA, 15 nt, Human
ucugccucugacaca

SEQ ID NO: 2261140 - RNA, 18 nt, Human
ucugccucugacacacag

SEQ ID NO: 2261141 - RNA, 16 nt, Human
ucugccucccaucacc

SEQ ID NO: 2261142 - RNA, 17 nt, Human
ucugccucccaucaccc

SEQ ID NO: 2261143 - RNA, 20 nt, Human
ucugccucccaucacccgcu

SEQ ID NO: 2261144 - RNA, 21 nt, Human
ucugccucccaucacccgcua

SEQ ID NO: 2261145 - RNA, 23 nt, Human
ucugccucugacacacagcucug

SEQ ID NO: 2261146 - RNA, 16 nt, Human
ucugccucugccugca

SEQ ID NO: 2261147 - RNA, 14 nt, Human
ucugccucugccug

SEQ ID NO: 2261148 - RNA, 14 nt, Human
ucugccucuucugg

SEQ ID NO: 2261149 - RNA, 15 nt, Human
ucugccucugaggga

SEQ ID NO: 2261150 - RNA, 21 nt, Human
ucugccucugacacacagcuc

SEQ ID NO: 2261151 - RNA, 22 nt, Human
ucugccucugacacacagcucu

SEQ ID NO: 2261152 - RNA, 19 nt, Human
ucugccugaagucacacag

SEQ ID NO: 2261153 - RNA, 19 nt, Human
ucugccucuucugggaggg

SEQ ID NO: 2261154 - RNA, 18 nt, Human
ucugccucuucugggagg

SEQ ID NO: 2261155 - RNA, 17 nt, Human
ucugccucuucugggag

SEQ ID NO: 2261156 - RNA, 15 nt, Human
ucugccucuucuggg

SEQ ID NO: 2261157 - RNA, 20 nt, Human
ucugccugaagucacacagu

SEQ ID NO: 2261158 - RNA, 12 nt, Human
ucugccugagcu

SEQ ID NO: 2261159 - RNA, 17 nt, Human
ucugccugccagcugca

SEQ ID NO: 2261160 - RNA, 16 nt, Human
ucugccugccagcugc

SEQ ID NO: 2261161 - RNA, 18 nt, Human
ucugcccacauuggaccc

SEQ ID NO: 2261162 - RNA, 19 nt, Human
ucugcccaaaaauaugguu

SEQ ID NO: 2261163 - RNA, 18 nt, Human
ucugcccaauuggaggaa

SEQ ID NO: 2261164 - RNA, 13 nt, Human
ucugcccacuccc

SEQ ID NO: 2261165 - RNA, 14 nt, Human
ucugcccacucccu

SEQ ID NO: 2261166 - RNA, 16 nt, Human
ucugccucaaugugaa

SEQ ID NO: 2261167 - RNA, 12 nt, Human
ucugccucccau

SEQ ID NO: 2261168 - RNA, 13 nt, Human
ucugccucccauc

SEQ ID NO: 2261169 - RNA, 15 nt, Human
ucugccucccaucac

SEQ ID NO: 2261170 - RNA, 22 nt, Human
ucugccauauucuguuggccag

SEQ ID NO: 2261171 - RNA, 23 nt, Human
ucugccauauucuguuggccagu

SEQ ID NO: 2261172 - RNA, 12 nt, Human
ucugcccacucc

SEQ ID NO: 2261173 - RNA, 21 nt, Human
ucugcauauguugaauacuuu

SEQ ID NO: 2261174 - RNA, 19 nt, Human
ucugcauauguugaauacu

SEQ ID NO: 2261175 - RNA, 12 nt, Human
ucugcccaaccc

SEQ ID NO: 2261176 - RNA, 18 nt, Human
ucugccauauucuguugg

SEQ ID NO: 2261177 - RNA, 18 nt, Human
ucugcauauguugaauac

SEQ ID NO: 2261178 - RNA, 16 nt, Human
ucugcauauguugaau

SEQ ID NO: 2261179 - RNA, 15 nt, Human
ucugcauauguugaa

SEQ ID NO: 2261180 - RNA, 15 nt, Human
ucugcagugccuugg

SEQ ID NO: 2261181 - RNA, 16 nt, Human
ucugcaguagucucug

SEQ ID NO: 2261182 - RNA, 18 nt, Human
ucugcaguagucucugug

SEQ ID NO: 2261183 - RNA, 19 nt, Human
ucugcaguagucucugugc

SEQ ID NO: 2261184 - RNA, 20 nt, Human
ucugcaguagucucugugcu

SEQ ID NO: 2261185 - RNA, 21 nt, Human
ucugcaguagucucugugcuu

SEQ ID NO: 2261186 - RNA, 13 nt, Human
ucugcagugccuu

SEQ ID NO: 2261187 - RNA, 20 nt, Human
ucugcagucacuucguggga

SEQ ID NO: 2261188 - RNA, 14 nt, Human
ucugcagugccuug

SEQ ID NO: 2261189 - RNA, 17 nt, Human
ugagcuccagaccccca

SEQ ID NO: 2261190 - RNA, 16 nt, Human
ugagcuccagaccccc

SEQ ID NO: 2261191 - RNA, 15 nt, Human
ugagcuccagacccc

SEQ ID NO: 2261192 - RNA, 14 nt, Human
ugagcuccagaccc

SEQ ID NO: 2261193 - RNA, 13 nt, Human
ugagcuccagacc

SEQ ID NO: 2261194 - RNA, 12 nt, Human
ugagcuccagac

SEQ ID NO: 2261195 - RNA, 22 nt, Human
ugagcucagacccccacucuca

SEQ ID NO: 2261196 - RNA, 20 nt, Human
ugagcucagacccccacucu

SEQ ID NO: 2261197 - RNA, 20 nt, Human
ugagcucagcccuggugggc

SEQ ID NO: 2261198 - RNA, 13 nt, Human
ugagcugagcagg

SEQ ID NO: 2261199 - RNA, 19 nt, Human
ugagcugagaucgugccgu

SEQ ID NO: 2261200 - RNA, 14 nt, Human
ugagcugagcaggg

SEQ ID NO: 2261201 - RNA, 14 nt, Human
ugagcugaggcagc

SEQ ID NO: 2261202 - RNA, 17 nt, Human
ugagcugagaucgugcc

SEQ ID NO: 2261203 - RNA, 17 nt, Human
ugagcugaaaugcugca

SEQ ID NO: 2261204 - RNA, 18 nt, Human
ugagcugaaaugcugcau

SEQ ID NO: 2261205 - RNA, 20 nt, Human
ugagcugaaaugcugcauuu

SEQ ID NO: 2261206 - RNA, 19 nt, Human
ugagcucaggaguuugaga

SEQ ID NO: 2261207 - RNA, 11 nt, Human
ugagcucagga

SEQ ID NO: 2261208 - RNA, 19 nt, Human
ugagcucagacccccacuc

SEQ ID NO: 2261209 - RNA, 18 nt, Human
ugagcucagacccccacu

SEQ ID NO: 2261210 - RNA, 17 nt, Human
ugagcucagacccccac

SEQ ID NO: 2261211 - RNA, 16 nt, Human
ugagcucagaccccca

SEQ ID NO: 2261212 - RNA, 12 nt, Human
ugagcucagccc

SEQ ID NO: 2261213 - RNA, 11 nt, Human
ugagcucagcc

SEQ ID NO: 2261214 - RNA, 23 nt, Human
ugagccgagaucacgccacugca

SEQ ID NO: 2261215 - RNA, 23 nt, Human
ugagccgcaucuucuccaucugg

SEQ ID NO: 2261216 - RNA, 21 nt, Human
ugagccgcaucuucuccaucu

SEQ ID NO: 2261217 - RNA, 20 nt, Human
ugagccgcaucuucuccauc

SEQ ID NO: 2261218 - RNA, 17 nt, Human
ugagccgcaucuucucc

SEQ ID NO: 2261219 - RNA, 16 nt, Human
ugagcuauugcuguuc

SEQ ID NO: 2261220 - RNA, 15 nt, Human
ugagcuauguauuaa

SEQ ID NO: 2261221 - RNA, 15 nt, Human
ugagcuauuucaucu

SEQ ID NO: 2261222 - RNA, 21 nt, Human
ugagccgcugugagccccugg

SEQ ID NO: 2261223 - RNA, 14 nt, Human
ugagcuauguauua

SEQ ID NO: 2261224 - RNA, 19 nt, Human
ugagcuauuuccauuccag

SEQ ID NO: 2261225 - RNA, 21 nt, Human
ugagcuauuuccauuccagaa

SEQ ID NO: 2261226 - RNA, 20 nt, Human
ugagcagggcucagcgggga

SEQ ID NO: 2261227 - RNA, 22 nt, Human
ugagcagggcucagcggggaca

SEQ ID NO: 2261228 - RNA, 23 nt, Human
ugagcagggcucagcggggacag

SEQ ID NO: 2261229 - RNA, 22 nt, Human
ugagccgagaucacgccacugc

SEQ ID NO: 2261230 - RNA, 16 nt, Human
ugagcugagcagggag

SEQ ID NO: 2261231 - RNA, 16 nt, Human
ugagcugccucugaga

SEQ ID NO: 2261232 - RNA, 11 nt, Human
ugagcugccuu

SEQ ID NO: 2261233 - RNA, 20 nt, Human
ugagcugccuguaacuugag

SEQ ID NO: 2261234 - RNA, 15 nt, Human
ugagcugccauccag

SEQ ID NO: 2261235 - RNA, 14 nt, Human
ugagcuguugccuc

SEQ ID NO: 2261236 - RNA, 15 nt, Human
ugagcuguugccuca

SEQ ID NO: 2261237 - RNA, 11 nt, Human
ugagcuguuuu

SEQ ID NO: 2261238 - RNA, 23 nt, Human
ugagcuuaagaauuuugagcagg

SEQ ID NO: 2261239 - RNA, 15 nt, Human
ugagcuuaucaugcu

SEQ ID NO: 2261240 - RNA, 16 nt, Human
ugagcuuagugaaauu

SEQ ID NO: 2261241 - RNA, 15 nt, Human
ugagcuucucuguga

SEQ ID NO: 2261242 - RNA, 19 nt, Human
ugagcuuggcagcugaacu

SEQ ID NO: 2261243 - RNA, 16 nt, Human
ugagcuucucugugaa

SEQ ID NO: 2261244 - RNA, 14 nt, Human
ugagcuuggccaga

SEQ ID NO: 2261245 - RNA, 13 nt, Human
ugagcuuggccag

SEQ ID NO: 2261246 - RNA, 20 nt, Human
ugagcuuggcagcugaacua

SEQ ID NO: 2261247 - RNA, 16 nt, Human
ugagcuuggccagaag

SEQ ID NO: 2261248 - RNA, 15 nt, Human
ugagcuuggccagaa

SEQ ID NO: 2261249 - RNA, 19 nt, Human
ugaggaggggcagguaaac

SEQ ID NO: 2261250 - RNA, 15 nt, Human
ugaggagucuugugu

SEQ ID NO: 2261251 - RNA, 16 nt, Human
ugaggagucuugugug

SEQ ID NO: 2261252 - RNA, 12 nt, Human
ugaggaugggaa

SEQ ID NO: 2261253 - RNA, 18 nt, Human
ugaggaugcagagucagc

SEQ ID NO: 2261254 - RNA, 16 nt, Human
ugaggaugagcuggaa

SEQ ID NO: 2261255 - RNA, 22 nt, Human
ugaggaugauuauuuucaaggc

SEQ ID NO: 2261256 - RNA, 20 nt, Human
ugaggaugggaaggagggag

SEQ ID NO: 2261257 - RNA, 16 nt, Human
ugaggaugggaaggag

SEQ ID NO: 2261258 - RNA, 17 nt, Human
ugaggaugucacucaga

SEQ ID NO: 2261259 - RNA, 15 nt, Human
ugaggaugagcugga

SEQ ID NO: 2261260 - RNA, 14 nt, Human
ugaggaugaggccg

SEQ ID NO: 2261261 - RNA, 16 nt, Human
ugaggagugugagaau

SEQ ID NO: 2261262 - RNA, 20 nt, Human
ugaggauauauuuucacuuu

SEQ ID NO: 2261263 - RNA, 16 nt, Human
ugaggauuucaagccu

SEQ ID NO: 2261264 - RNA, 16 nt, Human
ugaggauuuugaguau

SEQ ID NO: 2261265 - RNA, 20 nt, Human
ugaggcaaccacaggcagca

SEQ ID NO: 2261266 - RNA, 20 nt, Human
ugaggcaauaaaaaucauag

SEQ ID NO: 2261267 - RNA, 14 nt, Human
ugaggcaagagaau

SEQ ID NO: 2261268 - RNA, 13 nt, Human
ugaggauuucaag

SEQ ID NO: 2261269 - RNA, 12 nt, Human
ugagcugccuuc

SEQ ID NO: 2261270 - RNA, 13 nt, Human
ugaggaucagagu

SEQ ID NO: 2261271 - RNA, 17 nt, Human
ugaggaucagaguaauc

SEQ ID NO: 2261272 - RNA, 19 nt, Human
ugaggaucagaguaaucca

SEQ ID NO: 2261273 - RNA, 22 nt, Human
ugaggaugaaaaaauaacacug

SEQ ID NO: 2261274 - RNA, 18 nt, Human
ugaggucauagcagugcu

SEQ ID NO: 2261275 - RNA, 13 nt, Human
ugaggcuguagga

SEQ ID NO: 2261276 - RNA, 16 nt, Human
ugagguccagcccugg

SEQ ID NO: 2261277 - RNA, 20 nt, Human
ugagguccagcccuggcuga

SEQ ID NO: 2261278 - RNA, 21 nt, Human
ugagguccagcccuggcugaa

SEQ ID NO: 2261279 - RNA, 23 nt, Human
ugagguccagcccuggcugaagg

SEQ ID NO: 2261280 - RNA, 16 nt, Human
ugaggucaggaguucc

SEQ ID NO: 2261281 - RNA, 13 nt, Human
ugaggcuguccug

SEQ ID NO: 2261282 - RNA, 14 nt, Human
ugaggcuguccugu

SEQ ID NO: 2261283 - RNA, 16 nt, Human
ugaggugaaagggagc

SEQ ID NO: 2261284 - RNA, 15 nt, Human
ugaggugaaagggag

SEQ ID NO: 2261285 - RNA, 23 nt, Human
ugaggucuuuugacauguggaaa

SEQ ID NO: 2261286 - RNA, 22 nt, Human
ugaggucuuuugacauguggaa

SEQ ID NO: 2261287 - RNA, 21 nt, Human
ugaggucuuuugacaugugga

SEQ ID NO: 2261288 - RNA, 18 nt, Human
ugaggugaaagggagcua

SEQ ID NO: 2261289 - RNA, 17 nt, Human
ugaggugaaagggagcu

SEQ ID NO: 2261290 - RNA, 17 nt, Human
ugaggugcagagugccc

SEQ ID NO: 2261291 - RNA, 13 nt, Human
ugaggcugagacu

SEQ ID NO: 2261292 - RNA, 19 nt, Human
ugaggcucuuucugggcca

SEQ ID NO: 2261293 - RNA, 18 nt, Human
ugaggcugagacugcggg

SEQ ID NO: 2261294 - RNA, 10 nt, Human
ugaggcugua

SEQ ID NO: 2261295 - RNA, 12 nt, Human
ugaggcuguccu

SEQ ID NO: 2261296 - RNA, 21 nt, Human
ugaggcugggcucccuuccca

SEQ ID NO: 2261297 - RNA, 18 nt, Human
ugaggucagagccugcag

SEQ ID NO: 2261298 - RNA, 19 nt, Human
ugaggucagagccugcagu

SEQ ID NO: 2261299 - RNA, 21 nt, Human
ugaggugcagagugcccagaa

SEQ ID NO: 2261300 - RNA, 22 nt, Human
ugaggugcccagcuagcugcag

SEQ ID NO: 2261301 - RNA, 20 nt, Human
ugaggugcagagugcccaga

SEQ ID NO: 2261302 - RNA, 21 nt, Human
ugaggugcccagcuagcugca

SEQ ID NO: 2261303 - RNA, 14 nt, Human
ugaggugccugucc

SEQ ID NO: 2261304 - RNA, 15 nt, Human
ugaggugccuguccc

SEQ ID NO: 2261305 - RNA, 11 nt, Human
ugaggugggcc

SEQ ID NO: 2261306 - RNA, 13 nt, Human
ugaggugggccca

SEQ ID NO: 2261307 - RNA, 21 nt, Human
ugaggugggagguggaagaag

SEQ ID NO: 2261308 - RNA, 22 nt, Human
ugaggugggagguggaagaagg

SEQ ID NO: 2261309 - RNA, 14 nt, Human
ugaggugggcccag

SEQ ID NO: 2261310 - RNA, 15 nt, Human
ugaggugggcccagg

SEQ ID NO: 2261311 - RNA, 16 nt, Human
ugaggugggcccagga

SEQ ID NO: 2261312 - RNA, 20 nt, Human
ugaggugggcccaggaccag

SEQ ID NO: 2261313 - RNA, 16 nt, Human
ugaggugccuguccca

SEQ ID NO: 2261314 - RNA, 13 nt, Human
ugaggugggaggu

SEQ ID NO: 2261315 - RNA, 18 nt, Human
ugaggugggagguggaag

SEQ ID NO: 2261316 - RNA, 20 nt, Human
ugagguggucugaauguucu

SEQ ID NO: 2261317 - RNA, 19 nt, Human
ugagguggucugaauguuc

SEQ ID NO: 2261318 - RNA, 18 nt, Human
ugagguggucugaauguu

SEQ ID NO: 2261319 - RNA, 17 nt, Human
ugagguggucugaaugu

SEQ ID NO: 2261320 - RNA, 14 nt, Human
ugagguggucugaa

SEQ ID NO: 2261321 - RNA, 13 nt, Human
ugagguggucuga

SEQ ID NO: 2261322 - RNA, 21 nt, Human
ugagguggguuuucuucccau

SEQ ID NO: 2261323 - RNA, 21 nt, Human
ugagguggucugaauguucug

SEQ ID NO: 2261324 - RNA, 14 nt, Human
ugaggugugggggc

SEQ ID NO: 2261325 - RNA, 18 nt, Human
ugaggugugggggcugca

SEQ ID NO: 2261326 - RNA, 19 nt, Human
ugagucccaggcugagccu

SEQ ID NO: 2261327 - RNA, 22 nt, Human
ugagguggucugaauguucuga

SEQ ID NO: 2261328 - RNA, 18 nt, Human
ugaggugucuuaagccuu

SEQ ID NO: 2261329 - RNA, 21 nt, Human
ugagucccaggcugagccuca

SEQ ID NO: 2261330 - RNA, 20 nt, Human
ugagucccaggcugagccuc

SEQ ID NO: 2261331 - RNA, 19 nt, Human
ugagucccagugggaggcg

SEQ ID NO: 2261332 - RNA, 15 nt, Human
ugaggugugggggcu

SEQ ID NO: 2261333 - RNA, 13 nt, Human
ugagucccagugg

SEQ ID NO: 2261334 - RNA, 15 nt, Human
ugagucccaguggga

SEQ ID NO: 2261335 - RNA, 16 nt, Human
ugagucccagugggag

SEQ ID NO: 2261336 - RNA, 23 nt, Human
ugaggcagacagcagcucaggca

SEQ ID NO: 2261337 - RNA, 20 nt, Human
ugaggcagacagcagcucag

SEQ ID NO: 2261338 - RNA, 17 nt, Human
ugaggcagacagcagcu

SEQ ID NO: 2261339 - RNA, 16 nt, Human
ugaggcagacagcagc

SEQ ID NO: 2261340 - RNA, 15 nt, Human
ugaggcagacagcag

SEQ ID NO: 2261341 - RNA, 14 nt, Human
ugaggcagacagca

SEQ ID NO: 2261342 - RNA, 13 nt, Human
ugaggcagacagc

SEQ ID NO: 2261343 - RNA, 12 nt, Human
ugaggcagacag

SEQ ID NO: 2261344 - RNA, 21 nt, Human
ugaggcaaugucaggaacaga

SEQ ID NO: 2261345 - RNA, 20 nt, Human
ugaggcaaugucaggaacag

SEQ ID NO: 2261346 - RNA, 17 nt, Human
ugaggcaaugucaggaa

SEQ ID NO: 2261347 - RNA, 16 nt, Human
ugaggcaaugucagga

SEQ ID NO: 2261348 - RNA, 22 nt, Human
ugaggcacgaaugaucuuucuu

SEQ ID NO: 2261349 - RNA, 13 nt, Human
ugaggcagaagaa

SEQ ID NO: 2261350 - RNA, 15 nt, Human
ugaggcaggggcgga

SEQ ID NO: 2261351 - RNA, 21 nt, Human
ugaggccugcccucagggauc

SEQ ID NO: 2261352 - RNA, 11 nt, Human
ugaggccugga

SEQ ID NO: 2261353 - RNA, 12 nt, Human
ugaggccuggac

SEQ ID NO: 2261354 - RNA, 14 nt, Human
ugaggccuggacuu

SEQ ID NO: 2261355 - RNA, 17 nt, Human
ugaggccuggacuuucc

SEQ ID NO: 2261356 - RNA, 19 nt, Human
ugaggccuggacuuuccug

SEQ ID NO: 2261357 - RNA, 20 nt, Human
ugaggccuggacuuuccugc

SEQ ID NO: 2261358 - RNA, 23 nt, Human
ugaggccuggacuuuccugcaac

SEQ ID NO: 2261359 - RNA, 22 nt, Human
ugaggcagggaaguccccaggc

SEQ ID NO: 2261360 - RNA, 14 nt, Human
ugaggcagggaagu

SEQ ID NO: 2261361 - RNA, 13 nt, Human
ugaggcagggaag

SEQ ID NO: 2261362 - RNA, 13 nt, Human
ugaggcagguccc

SEQ ID NO: 2261363 - RNA, 15 nt, Human
ugaggcaggcuuugu

SEQ ID NO: 2261364 - RNA, 21 nt, Human
ugaggcagcagugugaggcca

SEQ ID NO: 2261365 - RNA, 24 nt, Human
ugaggcagacagcagcucaggcac

SEQ ID NO: 2261366 - RNA, 18 nt, Human
ugaggcagaagaauugaa

SEQ ID NO: 2261367 - RNA, 18 nt, Human
ugaggcucuuucugggcc

SEQ ID NO: 2261368 - RNA, 17 nt, Human
ugaggcucuuucugggc

SEQ ID NO: 2261369 - RNA, 16 nt, Human
ugaggcucuuucuggg

SEQ ID NO: 2261370 - RNA, 18 nt, Human
ugaggcucugcccuuggu

SEQ ID NO: 2261371 - RNA, 15 nt, Human
ugaggcugggcuccc

SEQ ID NO: 2261372 - RNA, 16 nt, Human
ugaggcugggcucccu

SEQ ID NO: 2261373 - RNA, 23 nt, Human
ugaggcggguggaucaccugagg

SEQ ID NO: 2261374 - RNA, 15 nt, Human
ugaggcucugcccuu

SEQ ID NO: 2261375 - RNA, 16 nt, Human
ugaggcucugcccuug

SEQ ID NO: 2261376 - RNA, 12 nt, Human
ugaggccugggc

SEQ ID NO: 2261377 - RNA, 13 nt, Human
ugaggccugggcc

SEQ ID NO: 2261378 - RNA, 14 nt, Human
ugaggccuggccag

SEQ ID NO: 2261379 - RNA, 15 nt, Human
ugaggccuggccagg

SEQ ID NO: 2261380 - RNA, 16 nt, Human
ugaggccuggccaggc

SEQ ID NO: 2261381 - RNA, 17 nt, Human
ugaggccuggccaggca

SEQ ID NO: 2261382 - RNA, 22 nt, Human
ugaggccugggccgcugccacg

SEQ ID NO: 2261383 - RNA, 13 nt, Human
ugaggccuugcuc

SEQ ID NO: 2261384 - RNA, 22 nt, Human
ugaggccuuaucauucauucuu

SEQ ID NO: 2261385 - RNA, 12 nt, Human
ugaggccuugcu

SEQ ID NO: 2261386 - RNA, 22 nt, Human
ugagaguuuuggaugcagugcu

SEQ ID NO: 2261387 - RNA, 22 nt, Human
ugagauaaugugauauuauaca

SEQ ID NO: 2261388 - RNA, 18 nt, Human
ugagaguuuugucuugaa

SEQ ID NO: 2261389 - RNA, 21 nt, Human
ugagauaccagcgaggaggcu

SEQ ID NO: 2261390 - RNA, 21 nt, Human
ugagaguuuugucuugaaugu

SEQ ID NO: 2261391 - RNA, 16 nt, Human
ugagauaauguuagag

SEQ ID NO: 2261392 - RNA, 16 nt, Human
ugagauagcauuguga

SEQ ID NO: 2261393 - RNA, 18 nt, Human
ugagauagcauugugaac

SEQ ID NO: 2261394 - RNA, 19 nt, Human
ugagauagcauugugaacu

SEQ ID NO: 2261395 - RNA, 19 nt, Human
ugagauaguagcauacauu

SEQ ID NO: 2261396 - RNA, 23 nt, Human
ugagauagcauugugaacugaca

SEQ ID NO: 2261397 - RNA, 23 nt, Human
ugagauaguagcauacauuuaua

SEQ ID NO: 2261398 - RNA, 21 nt, Human
ugagauagaagaacugcaaag

SEQ ID NO: 2261399 - RNA, 19 nt, Human
ugagauagaagaacugcaa

SEQ ID NO: 2261400 - RNA, 16 nt, Human
ugagauagaagaacug

SEQ ID NO: 2261401 - RNA, 15 nt, Human
ugagauagaagaacu

SEQ ID NO: 2261402 - RNA, 20 nt, Human
ugagauaccagcgaggaggc

SEQ ID NO: 2261403 - RNA, 22 nt, Human
ugagcagggagauccugguugg

SEQ ID NO: 2261404 - RNA, 17 nt, Human
ugagcagggauccuggu

SEQ ID NO: 2261405 - RNA, 20 nt, Human
ugagcaggauuuuaaucuuu

SEQ ID NO: 2261406 - RNA, 23 nt, Human
ugagcagacuggugagcagacug

SEQ ID NO: 2261407 - RNA, 21 nt, Human
ugagcagacuggugagcagac

SEQ ID NO: 2261408 - RNA, 12 nt, Human
ugagcagagucu

SEQ ID NO: 2261409 - RNA, 21 nt, Human
ugagcagagucuugcuaccuc

SEQ ID NO: 2261410 - RNA, 15 nt, Human
ugagcaggauuuuaa

SEQ ID NO: 2261411 - RNA, 22 nt, Human
ugagagggcaugcgcacaaggc

SEQ ID NO: 2261412 - RNA, 17 nt, Human
ugagagggcaugcgcac

SEQ ID NO: 2261413 - RNA, 21 nt, Human
ugagagggcaguguuuccuuu

SEQ ID NO: 2261414 - RNA, 18 nt, Human
ugagaggggaacagacug

SEQ ID NO: 2261415 - RNA, 14 nt, Human
ugagaggggaacag

SEQ ID NO: 2261416 - RNA, 19 nt, Human
ugagaccucagccaugagg

SEQ ID NO: 2261417 - RNA, 17 nt, Human
ugagaccucagccauga

SEQ ID NO: 2261418 - RNA, 20 nt, Human
ugagacgccaccauuccugg

SEQ ID NO: 2261419 - RNA, 21 nt, Human
ugagacgccaccauuccugga

SEQ ID NO: 2261420 - RNA, 23 nt, Human
ugagacggagucucgcucuguca

SEQ ID NO: 2261421 - RNA, 14 nt, Human
ugagaccaaccugg

SEQ ID NO: 2261422 - RNA, 16 nt, Human
ugagaccucagccaug

SEQ ID NO: 2261423 - RNA, 12 nt, Human
ugagaccugccc

SEQ ID NO: 2261424 - RNA, 22 nt, Human
ugagaccugccccuccucucug

SEQ ID NO: 2261425 - RNA, 15 nt, Human
ugagaccugccccuc

SEQ ID NO: 2261426 - RNA, 14 nt, Human
ugagaccugccccu

SEQ ID NO: 2261427 - RNA, 13 nt, Human
ugagaccugcccc

SEQ ID NO: 2261428 - RNA, 11 nt, Human
ugacuuugucu

SEQ ID NO: 2261429 - RNA, 20 nt, Human
ugacuuuuaaggcuaaaacu

SEQ ID NO: 2261430 - RNA, 13 nt, Human
ugacuuuuccaug

SEQ ID NO: 2261431 - RNA, 22 nt, Human
ugacuuuucuguccgagcuuug

SEQ ID NO: 2261432 - RNA, 12 nt, Human
ugacuuuuguau

SEQ ID NO: 2261433 - RNA, 14 nt, Human
ugacuuuuugcauu

SEQ ID NO: 2261434 - RNA, 22 nt, Human
ugacuuuuccauguaucuaccu

SEQ ID NO: 2261435 - RNA, 18 nt, Human
ugacuuuuccauguaucu

SEQ ID NO: 2261436 - RNA, 19 nt, Human
ugacuuuuccauguaucua

SEQ ID NO: 2261437 - RNA, 16 nt, Human
ugagaaaaagcuccug

SEQ ID NO: 2261438 - RNA, 17 nt, Human
ugagaaaaagcuccugu

SEQ ID NO: 2261439 - RNA, 18 nt, Human
ugagaaaaagcuccuguc

SEQ ID NO: 2261440 - RNA, 21 nt, Human
ugagaaaaauuuacauggcaa

SEQ ID NO: 2261441 - RNA, 22 nt, Human
ugacuuuuucuaagagcucccg

SEQ ID NO: 2261442 - RNA, 23 nt, Human
ugacuuuuugcauuuaaaacaga

SEQ ID NO: 2261443 - RNA, 17 nt, Human
ugacuuuuugcauuuaa

SEQ ID NO: 2261444 - RNA, 16 nt, Human
ugagaaaacuucuuuu

SEQ ID NO: 2261445 - RNA, 12 nt, Human
ugagaaaacaug

SEQ ID NO: 2261446 - RNA, 20 nt, Human
ugagaaacaacaauuucuac

SEQ ID NO: 2261447 - RNA, 19 nt, Human
ugagaaaagcuuugaaccc

SEQ ID NO: 2261448 - RNA, 23 nt, Human
ugagaaaccuuauuguaccucuc

SEQ ID NO: 2261449 - RNA, 17 nt, Human
ugagaaaacuucuuuua

SEQ ID NO: 2261450 - RNA, 15 nt, Human
ugagaaagacuauuc

SEQ ID NO: 2261451 - RNA, 15 nt, Human
ugagaaauaaaguuu

SEQ ID NO: 2261452 - RNA, 14 nt, Human
ugagaaagagcacu

SEQ ID NO: 2261453 - RNA, 13 nt, Human
ugagaaagagcac

SEQ ID NO: 2261454 - RNA, 21 nt, Human
ugagaaagagcacuuaagaga

SEQ ID NO: 2261455 - RNA, 23 nt, Human
ugagacaguuucuuagcuuuuua

SEQ ID NO: 2261456 - RNA, 20 nt, Human
ugagacaguuucuuagcuuu

SEQ ID NO: 2261457 - RNA, 21 nt, Human
ugagacaguuucuuagcuuuu

SEQ ID NO: 2261458 - RNA, 16 nt, Human
ugagacagugggaaau

SEQ ID NO: 2261459 - RNA, 17 nt, Human
ugagacagugggaaaua

SEQ ID NO: 2261460 - RNA, 18 nt, Human
ugagacagugggaaauau

SEQ ID NO: 2261461 - RNA, 14 nt, Human
ugagacaguuucuu

SEQ ID NO: 2261462 - RNA, 15 nt, Human
ugagacaguuucuua

SEQ ID NO: 2261463 - RNA, 16 nt, Human
ugagacaguuucuuag

SEQ ID NO: 2261464 - RNA, 18 nt, Human
ugagacaguuucuuagcu

SEQ ID NO: 2261465 - RNA, 19 nt, Human
ugagacaguuucuuagcuu

SEQ ID NO: 2261466 - RNA, 21 nt, Human
ugagaaauauggacacuuaau

SEQ ID NO: 2261467 - RNA, 13 nt, Human
ugagacaguggga

SEQ ID NO: 2261468 - RNA, 15 nt, Human
ugagacagugggaaa

SEQ ID NO: 2261469 - RNA, 17 nt, Human
ugagaaauauggacacu

SEQ ID NO: 2261470 - RNA, 15 nt, Human
ugagaaauauggaca

SEQ ID NO: 2261471 - RNA, 21 nt, Human
ugagaaagucuuauuuauuca

SEQ ID NO: 2261472 - RNA, 13 nt, Human
ugacuaauuguau

SEQ ID NO: 2261473 - RNA, 14 nt, Human
ugacuaauuguaua

SEQ ID NO: 2261474 - RNA, 15 nt, Human
ugacuaauuguauaa

SEQ ID NO: 2261475 - RNA, 17 nt, Human
ugacuaauuguauaaca

SEQ ID NO: 2261476 - RNA, 18 nt, Human
ugacuaauuguauaacag

SEQ ID NO: 2261477 - RNA, 19 nt, Human
ugacuaauuguauaacagg

SEQ ID NO: 2261478 - RNA, 20 nt, Human
ugacuaauuguauaacaggu

SEQ ID NO: 2261479 - RNA, 21 nt, Human
ugacuaauuguauaacagguu

SEQ ID NO: 2261480 - RNA, 22 nt, Human
ugacuaauuguauaacagguua

SEQ ID NO: 2261481 - RNA, 23 nt, Human
ugacuaauuguauaacagguuau

SEQ ID NO: 2261482 - RNA, 17 nt, Human
ugacuacagucaggaaa

SEQ ID NO: 2261483 - RNA, 16 nt, Human
ugacuacagucaggaa

SEQ ID NO: 2261484 - RNA, 13 nt, Human
ugacucuuaagaa

SEQ ID NO: 2261485 - RNA, 18 nt, Human
ugacuacagucaggaaag

SEQ ID NO: 2261486 - RNA, 16 nt, Human
ugacucuuaagaagac

SEQ ID NO: 2261487 - RNA, 14 nt, Human
ugacucuuaagaag

SEQ ID NO: 2261488 - RNA, 15 nt, Human
ugacucuuaagaaga

SEQ ID NO: 2261489 - RNA, 17 nt, Human
ugacuaaagagagaaug

SEQ ID NO: 2261490 - RNA, 16 nt, Human
ugacuaaagagagaau

SEQ ID NO: 2261491 - RNA, 22 nt, Human
ugacuaaaaauauuauaacuua

SEQ ID NO: 2261492 - RNA, 14 nt, Human
ugacuaaaaauauu

SEQ ID NO: 2261493 - RNA, 22 nt, Human
ugacuaaaaaacaaagaagaca

SEQ ID NO: 2261494 - RNA, 14 nt, Human
ugacuaaaauauuu

SEQ ID NO: 2261495 - RNA, 15 nt, Human
ugacuaaaaaacaaa

SEQ ID NO: 2261496 - RNA, 23 nt, Human
ugacgugccuuuugcaccccucc

SEQ ID NO: 2261497 - RNA, 19 nt, Human
ugaccaugcucaucugcug

SEQ ID NO: 2261498 - RNA, 14 nt, Human
ugaccauucuccac

SEQ ID NO: 2261499 - RNA, 13 nt, Human
ugaccauucucca

SEQ ID NO: 2261500 - RNA, 12 nt, Human
ugaccaugcuca

SEQ ID NO: 2261501 - RNA, 16 nt, Human
ugaccaugcucaucug

SEQ ID NO: 2261502 - RNA, 18 nt, Human
ugaccaugcucaucugcu

SEQ ID NO: 2261503 - RNA, 13 nt, Human
ugacuuucaggua

SEQ ID NO: 2261504 - RNA, 21 nt, Human
ugacuggguuucucuguauag

SEQ ID NO: 2261505 - RNA, 21 nt, Human
ugacugggcccugccucuguu

SEQ ID NO: 2261506 - RNA, 18 nt, Human
ugacugggcccugccucu

SEQ ID NO: 2261507 - RNA, 11 nt, Human
ugacuggauau

SEQ ID NO: 2261508 - RNA, 16 nt, Human
ugacugggcccugccu

SEQ ID NO: 2261509 - RNA, 16 nt, Human
ugacuuugcucuuucu

SEQ ID NO: 2261510 - RNA, 13 nt, Human
ugacuuucucagc

SEQ ID NO: 2261511 - RNA, 16 nt, Human
ugacuuuccucuuugg

SEQ ID NO: 2261512 - RNA, 16 nt, Human
ugacuuuggcugcaug

SEQ ID NO: 2261513 - RNA, 19 nt, Human
ugacucuuggcacagcaug

SEQ ID NO: 2261514 - RNA, 14 nt, Human
ugacucuuggcaca

SEQ ID NO: 2261515 - RNA, 20 nt, Human
ugacucuuguuuucaguuuc

SEQ ID NO: 2261516 - RNA, 21 nt, Human
ugacucuuucuauuguuucuu

SEQ ID NO: 2261517 - RNA, 15 nt, Human
ugacuggcacagucu

SEQ ID NO: 2261518 - RNA, 15 nt, Human
ugacugcugauucuc

SEQ ID NO: 2261519 - RNA, 23 nt, Human
ugacugcuccccagcccuggcuc

SEQ ID NO: 2261520 - RNA, 20 nt, Human
ugacugccccaacuccugga

SEQ ID NO: 2261521 - RNA, 17 nt, Human
ugacugcgaucuucaga

SEQ ID NO: 2261522 - RNA, 16 nt, Human
ugacugcgaucuucag

SEQ ID NO: 2261523 - RNA, 20 nt, Human
ugacugcuccccagcccugg

SEQ ID NO: 2261524 - RNA, 21 nt, Human
ugacugcuccccagcccuggc

SEQ ID NO: 2261525 - RNA, 22 nt, Human
ugacugcuccccagcccuggcu

SEQ ID NO: 2261526 - RNA, 19 nt, Human
ugacugccccaacuccugg

SEQ ID NO: 2261527 - RNA, 17 nt, Human
ugacugccccaacuccu

SEQ ID NO: 2261528 - RNA, 16 nt, Human
ugacugccccaacucc

SEQ ID NO: 2261529 - RNA, 15 nt, Human
ugacugccccaacuc

SEQ ID NO: 2261530 - RNA, 22 nt, Human
ugacucuuuuuagggccaggca

SEQ ID NO: 2261531 - RNA, 19 nt, Human
ugacugaagaugcagcuca

SEQ ID NO: 2261532 - RNA, 23 nt, Human
ugacucuuuuuagggccaggcag

SEQ ID NO: 2261533 - RNA, 19 nt, Human
ugacaacuggaauaguuuu

SEQ ID NO: 2261534 - RNA, 22 nt, Human
ugacaacuucccagugaauucu

SEQ ID NO: 2261535 - RNA, 23 nt, Human
ugacaaccaccgcuccccagccc

SEQ ID NO: 2261536 - RNA, 21 nt, Human
ugacaacguuucagcgacucc

SEQ ID NO: 2261537 - RNA, 17 nt, Human
ugacaaccacuggucug

SEQ ID NO: 2261538 - RNA, 21 nt, Human
ugacaaccaccgcuccccagc

SEQ ID NO: 2261539 - RNA, 20 nt, Human
ugacaaccaccgcuccccag

SEQ ID NO: 2261540 - RNA, 16 nt, Human
ugacaaccacuggucu

SEQ ID NO: 2261541 - RNA, 19 nt, Human
ugacaaccaugagaccacu

SEQ ID NO: 2261542 - RNA, 16 nt, Human
ugacaaggccccagag

SEQ ID NO: 2261543 - RNA, 15 nt, Human
ugacaaggccccaga

SEQ ID NO: 2261544 - RNA, 14 nt, Human
ugacaaggccccag

SEQ ID NO: 2261545 - RNA, 13 nt, Human
ugacaaggcccca

SEQ ID NO: 2261546 - RNA, 23 nt, Human
ugacaaggauugcuacuguccua

SEQ ID NO: 2261547 - RNA, 22 nt, Human
ugacaaggccccagagacucag

SEQ ID NO: 2261548 - RNA, 18 nt, Human
ugacaaggccccagagac

SEQ ID NO: 2261549 - RNA, 17 nt, Human
ugacaaggccccagaga

SEQ ID NO: 2261550 - RNA, 14 nt, Human
ugacaagucauuuu

SEQ ID NO: 2261551 - RNA, 20 nt, Human
ugacaagucauuuuaacuuu

SEQ ID NO: 2261552 - RNA, 12 nt, Human
ugacaauaaaac

SEQ ID NO: 2261553 - RNA, 13 nt, Human
ugacaauaaaaca

SEQ ID NO: 2261554 - RNA, 14 nt, Human
ugacaauaaaacau

SEQ ID NO: 2261555 - RNA, 16 nt, Human
ugacaauaaaacauua

SEQ ID NO: 2261556 - RNA, 14 nt, Human
ugacacacagcucu

SEQ ID NO: 2261557 - RNA, 16 nt, Human
ugacacaaguggaccu

SEQ ID NO: 2261558 - RNA, 17 nt, Human
ugacacaaaccugccug

SEQ ID NO: 2261559 - RNA, 18 nt, Human
ugacacaaaccugccugg

SEQ ID NO: 2261560 - RNA, 19 nt, Human
ugacacaaaccugccuggg

SEQ ID NO: 2261561 - RNA, 15 nt, Human
ugacacacagcucug

SEQ ID NO: 2261562 - RNA, 19 nt, Human
ugacacaaguggaccuuag

SEQ ID NO: 2261563 - RNA, 17 nt, Human
ugacacaaguggaccuu

SEQ ID NO: 2261564 - RNA, 14 nt, Human
ugacagacacaggc

SEQ ID NO: 2261565 - RNA, 16 nt, Human
ugacagacacaggccc

SEQ ID NO: 2261566 - RNA, 13 nt, Human
ugacagacacagg

SEQ ID NO: 2261567 - RNA, 17 nt, Human
ugaauugugaccaaguu

SEQ ID NO: 2261568 - RNA, 12 nt, Human
ugaauuuaaaua

SEQ ID NO: 2261569 - RNA, 14 nt, Human
ugaauuuaaauaua

SEQ ID NO: 2261570 - RNA, 14 nt, Human
ugacaaaguuacug

SEQ ID NO: 2261571 - RNA, 20 nt, Human
ugacaaagguaaaucagacu

SEQ ID NO: 2261572 - RNA, 23 nt, Human
ugacaaauguguaucggaugcuu

SEQ ID NO: 2261573 - RNA, 13 nt, Human
ugacaacacucau

SEQ ID NO: 2261574 - RNA, 16 nt, Human
ugacaaccaccgcucc

SEQ ID NO: 2261575 - RNA, 19 nt, Human
ugacaaccaccgcucccca

SEQ ID NO: 2261576 - RNA, 12 nt, Human
ugacaacaucug

SEQ ID NO: 2261577 - RNA, 22 nt, Human
ugacaacagaagcuucagaagu

SEQ ID NO: 2261578 - RNA, 13 nt, Human
ugacaacagaagc

SEQ ID NO: 2261579 - RNA, 14 nt, Human
ugacaacagaagcu

SEQ ID NO: 2261580 - RNA, 19 nt, Human
ugacaacagacuucugaaa

SEQ ID NO: 2261581 - RNA, 18 nt, Human
ugacaacagacuucugaa

SEQ ID NO: 2261582 - RNA, 15 nt, Human
ugacaacagacuucu

SEQ ID NO: 2261583 - RNA, 23 nt, Human
ugacaacacucauugaccugagg

SEQ ID NO: 2261584 - RNA, 16 nt, Human
ugaauuaaauuaggaa

SEQ ID NO: 2261585 - RNA, 15 nt, Human
ugaauuaaauuuaau

SEQ ID NO: 2261586 - RNA, 11 nt, Human
ugaauuaaauu

SEQ ID NO: 2261587 - RNA, 15 nt, Human
ugaauuaaaguaauu

SEQ ID NO: 2261588 - RNA, 17 nt, Human
ugaauuaaauaaacccu

SEQ ID NO: 2261589 - RNA, 14 nt, Human
ugaauuaaguuuuu

SEQ ID NO: 2261590 - RNA, 13 nt, Human
ugaauuacauuug

SEQ ID NO: 2261591 - RNA, 16 nt, Human
ugaauuaauaucccua

SEQ ID NO: 2261592 - RNA, 19 nt, Human
ugaauuaauaucccuacau

SEQ ID NO: 2261593 - RNA, 22 nt, Human
ugaauuaauaucccuacaugua

SEQ ID NO: 2261594 - RNA, 23 nt, Human
ugaauuaauaucccuacauguau

SEQ ID NO: 2261595 - RNA, 21 nt, Human
ugaauuaaugacagagccagu

SEQ ID NO: 2261596 - RNA, 20 nt, Human
ugaauuaaugacagagccag

SEQ ID NO: 2261597 - RNA, 23 nt, Human
ugaauuaaucaucuauaaagaag

SEQ ID NO: 2261598 - RNA, 15 nt, Human
ugaauuguccccagu

SEQ ID NO: 2261599 - RNA, 19 nt, Human
ugaauuguaacuguucuug

SEQ ID NO: 2261600 - RNA, 21 nt, Human
ugaauuguaaggaaugauuaa

SEQ ID NO: 2261601 - RNA, 13 nt, Human
ugaauuguaagga

SEQ ID NO: 2261602 - RNA, 14 nt, Human
ugaauuacauuugu

SEQ ID NO: 2261603 - RNA, 18 nt, Human
ugacaugcacucagcucu

SEQ ID NO: 2261604 - RNA, 22 nt, Human
ugacaugauuccuuccuguucu

SEQ ID NO: 2261605 - RNA, 18 nt, Human
ugacaugauuccuuccug

SEQ ID NO: 2261606 - RNA, 16 nt, Human
ugacaugauuccuucc

SEQ ID NO: 2261607 - RNA, 17 nt, Human
ugacaugcgggcugggc

SEQ ID NO: 2261608 - RNA, 18 nt, Human
ugacaugcgggcugggca

SEQ ID NO: 2261609 - RNA, 19 nt, Human
ugacaugauuccuuccugu

SEQ ID NO: 2261610 - RNA, 17 nt, Human
ugacaucuuaguauuug

SEQ ID NO: 2261611 - RNA, 12 nt, Human
ugacaugaaaaa

SEQ ID NO: 2261612 - RNA, 15 nt, Human
ugacaugauuccuuc

SEQ ID NO: 2261613 - RNA, 16 nt, Human
ugacaucuucaaagcu

SEQ ID NO: 2261614 - RNA, 16 nt, Human
ugacaucuguguuuca

SEQ ID NO: 2261615 - RNA, 14 nt, Human
ugacaucuggaauc

SEQ ID NO: 2261616 - RNA, 19 nt, Human
ugacaugcgggcugggcag

SEQ ID NO: 2261617 - RNA, 20 nt, Human
ugacaugcgggcugggcagc

SEQ ID NO: 2261618 - RNA, 21 nt, Human
ugacaugcgggcugggcagcu

SEQ ID NO: 2261619 - RNA, 22 nt, Human
ugacaugcgggcugggcagcug

SEQ ID NO: 2261620 - RNA, 15 nt, Human
ugacaugugaaaccu

SEQ ID NO: 2261621 - RNA, 16 nt, Human
ugacaugugaaaccuu

SEQ ID NO: 2261622 - RNA, 17 nt, Human
ugacaugugaaaccuuu

SEQ ID NO: 2261623 - RNA, 19 nt, Human
ugacaugugaaaccuuuuu

SEQ ID NO: 2261624 - RNA, 21 nt, Human
ugacaugugaaaccuuuuuua

SEQ ID NO: 2261625 - RNA, 16 nt, Human
ugacaugugacuccua

SEQ ID NO: 2261626 - RNA, 22 nt, Human
ugacauguggaaagugaauuug

SEQ ID NO: 2261627 - RNA, 21 nt, Human
ugacauguggaaagugaauuu

SEQ ID NO: 2261628 - RNA, 17 nt, Human
ugacauguggaaaguga

SEQ ID NO: 2261629 - RNA, 14 nt, Human
ugacauguggaaag

SEQ ID NO: 2261630 - RNA, 17 nt, Human
ugacauguggggccagg

SEQ ID NO: 2261631 - RNA, 18 nt, Human
ugacauguggggccaggu

SEQ ID NO: 2261632 - RNA, 19 nt, Human
ugacauguguuggcagccu

SEQ ID NO: 2261633 - RNA, 19 nt, Human
ugacauguggggccagguc

SEQ ID NO: 2261634 - RNA, 20 nt, Human
ugacauguggggccagguca

SEQ ID NO: 2261635 - RNA, 21 nt, Human
ugaccagcagaucccagcuca

SEQ ID NO: 2261636 - RNA, 20 nt, Human
ugaccagcagaucccagcuc

SEQ ID NO: 2261637 - RNA, 18 nt, Human
ugaccagcagaucccagc

SEQ ID NO: 2261638 - RNA, 17 nt, Human
ugaccagcagaucccag

SEQ ID NO: 2261639 - RNA, 18 nt, Human
ugaccagcacugucucag

SEQ ID NO: 2261640 - RNA, 19 nt, Human
ugacauguuauauauuuuu

SEQ ID NO: 2261641 - RNA, 18 nt, Human
ugacauguuauauauuuu

SEQ ID NO: 2261642 - RNA, 22 nt, Human
ugaccagcagaucccagcucac

SEQ ID NO: 2261643 - RNA, 11 nt, Human
ugaccagcagc

SEQ ID NO: 2261644 - RNA, 15 nt, Human
ugaccagcagcgccu

SEQ ID NO: 2261645 - RNA, 14 nt, Human
ugaccagcagcgcc

SEQ ID NO: 2261646 - RNA, 21 nt, Human
ugaccagccuccaugcugccu

SEQ ID NO: 2261647 - RNA, 23 nt, Human
ugaccauccacucuacccuccca

SEQ ID NO: 2261648 - RNA, 22 nt, Human
ugaccauccacucuacccuccc

SEQ ID NO: 2261649 - RNA, 19 nt, Human
ugaccauccacucuacccu

SEQ ID NO: 2261650 - RNA, 22 nt, Human
ugaccagccuccaugcugccuc

SEQ ID NO: 2261651 - RNA, 13 nt, Human
ugacauguuuuau

SEQ ID NO: 2261652 - RNA, 16 nt, Human
ugaccacucugucuug

SEQ ID NO: 2261653 - RNA, 18 nt, Human
ugaccacugcagaagaca

SEQ ID NO: 2261654 - RNA, 17 nt, Human
ugaccacugcagaagac

SEQ ID NO: 2261655 - RNA, 16 nt, Human
ugaccacugcagaaga

SEQ ID NO: 2261656 - RNA, 21 nt, Human
ugacagagcaagacucugucu

SEQ ID NO: 2261657 - RNA, 12 nt, Human
ugacagagccag

SEQ ID NO: 2261658 - RNA, 22 nt, Human
ugacagagcaagugagacccug

SEQ ID NO: 2261659 - RNA, 22 nt, Human
ugacagagccuucugaggacau

SEQ ID NO: 2261660 - RNA, 23 nt, Human
ugacagagccuucugaggacauu

SEQ ID NO: 2261661 - RNA, 23 nt, Human
ugacaucaacugcaucaagaugu

SEQ ID NO: 2261662 - RNA, 18 nt, Human
ugacagagcaagacucug

SEQ ID NO: 2261663 - RNA, 14 nt, Human
ugacagacucucgu

SEQ ID NO: 2261664 - RNA, 17 nt, Human
ugacagacuccugagga

SEQ ID NO: 2261665 - RNA, 19 nt, Human
ugacagacuccugaggaca

SEQ ID NO: 2261666 - RNA, 22 nt, Human
ugacagaccacaucuuuaucug

SEQ ID NO: 2261667 - RNA, 14 nt, Human
ugacagacuccuga

SEQ ID NO: 2261668 - RNA, 15 nt, Human
ugacagacuccugag

SEQ ID NO: 2261669 - RNA, 17 nt, Human
ugacagacacaggcccg

SEQ ID NO: 2261670 - RNA, 18 nt, Human
ugacagacacaggcccgg

SEQ ID NO: 2261671 - RNA, 17 nt, Human
ugacauccaagcuuccu

SEQ ID NO: 2261672 - RNA, 14 nt, Human
ugacaucucagggg

SEQ ID NO: 2261673 - RNA, 15 nt, Human
ugacaucucaggggc

SEQ ID NO: 2261674 - RNA, 13 nt, Human
ugacauccaagcu

SEQ ID NO: 2261675 - RNA, 23 nt, Human
ugacaucaguggcauggcuccag

SEQ ID NO: 2261676 - RNA, 17 nt, Human
ugacaucaguggcaugg

SEQ ID NO: 2261677 - RNA, 14 nt, Human
ugacaucucuuuga

SEQ ID NO: 2261678 - RNA, 13 nt, Human
ugacaucucuuug

SEQ ID NO: 2261679 - RNA, 12 nt, Human
ugacaucucuuu

SEQ ID NO: 2261680 - RNA, 23 nt, Human
ugacaucucugcaaucuucucag

SEQ ID NO: 2261681 - RNA, 14 nt, Human
ugacaucucugcaa

SEQ ID NO: 2261682 - RNA, 13 nt, Human
ugacaucucugca

SEQ ID NO: 2261683 - RNA, 18 nt, Human
ugacaucucaggggccag

SEQ ID NO: 2261684 - RNA, 19 nt, Human
ugacaucucaggggccaga

SEQ ID NO: 2261685 - RNA, 21 nt, Human
ugacaucucaggggccagagg

SEQ ID NO: 2261686 - RNA, 22 nt, Human
ugacaucucaggggccagagga

SEQ ID NO: 2261687 - RNA, 15 nt, Human
ugacauauuuuugcu

SEQ ID NO: 2261688 - RNA, 17 nt, Human
ugacaucaccacaguuu

SEQ ID NO: 2261689 - RNA, 13 nt, Human
ugacaucacuugu

SEQ ID NO: 2261690 - RNA, 23 nt, Human
ugacaucacuuguacaaaauaaa

SEQ ID NO: 2261691 - RNA, 22 nt, Human
ugacaucacuuguacaaaauaa

SEQ ID NO: 2261692 - RNA, 21 nt, Human
ugacaucacuuguacaaaaua

SEQ ID NO: 2261693 - RNA, 20 nt, Human
ugacaucacuuguacaaaau

SEQ ID NO: 2261694 - RNA, 19 nt, Human
ugacaucacuuguacaaaa

SEQ ID NO: 2261695 - RNA, 18 nt, Human
ugacaucacuuguacaaa

SEQ ID NO: 2261696 - RNA, 17 nt, Human
ugacaucacuuguacaa

SEQ ID NO: 2261697 - RNA, 16 nt, Human
ugacaucacuuguaca

SEQ ID NO: 2261698 - RNA, 18 nt, Human
ugaaggccuggcccacag

SEQ ID NO: 2261699 - RNA, 19 nt, Human
ugaaggaacauuccuuagu

SEQ ID NO: 2261700 - RNA, 19 nt, Human
ugaaggccgagaagcaaga

SEQ ID NO: 2261701 - RNA, 16 nt, Human
ugaaggaaccaaagcg

SEQ ID NO: 2261702 - RNA, 19 nt, Human
ugaaggccccgcccaggcu

SEQ ID NO: 2261703 - RNA, 20 nt, Human
ugaaggccccgcccaggcuu

SEQ ID NO: 2261704 - RNA, 21 nt, Human
ugaagcuuuuaugugaaacau

SEQ ID NO: 2261705 - RNA, 23 nt, Human
ugaaggaaaaacacaagcaaaaa

SEQ ID NO: 2261706 - RNA, 21 nt, Human
ugaaggaaaaacacaagcaaa

SEQ ID NO: 2261707 - RNA, 16 nt, Human
ugaagcuuuuauguga

SEQ ID NO: 2261708 - RNA, 12 nt, Human
ugaaggaaacag

SEQ ID NO: 2261709 - RNA, 14 nt, Human
ugaaggaaacaguu

SEQ ID NO: 2261710 - RNA, 16 nt, Human
ugaaggaaacaguuaa

SEQ ID NO: 2261711 - RNA, 15 nt, Human
ugaaggaaaaugaua

SEQ ID NO: 2261712 - RNA, 18 nt, Human
ugaaggccccgcccaggc

SEQ ID NO: 2261713 - RNA, 23 nt, Human
ugaagaguccucugaaugaaccu

SEQ ID NO: 2261714 - RNA, 23 nt, Human
ugaagaguaagucaaccugccug

SEQ ID NO: 2261715 - RNA, 16 nt, Human
ugaagaggaaaaugaa

SEQ ID NO: 2261716 - RNA, 19 nt, Human
ugaagaggaaaaugaauaa

SEQ ID NO: 2261717 - RNA, 17 nt, Human
ugaagaguccucugaau

SEQ ID NO: 2261718 - RNA, 16 nt, Human
ugaagagugagagggc

SEQ ID NO: 2261719 - RNA, 19 nt, Human
ugaagaguggguuucacaa

SEQ ID NO: 2261720 - RNA, 18 nt, Human
ugaagagugagagggcau

SEQ ID NO: 2261721 - RNA, 17 nt, Human
ugaagagugagagggca

SEQ ID NO: 2261722 - RNA, 12 nt, Human
ugaagaggaaaa

SEQ ID NO: 2261723 - RNA, 23 nt, Human
ugaagagaccaagacucugaaau

SEQ ID NO: 2261724 - RNA, 15 nt, Human
ugaagagauuuuuca

SEQ ID NO: 2261725 - RNA, 16 nt, Human
ugaagagauccuucug

SEQ ID NO: 2261726 - RNA, 16 nt, Human
ugaagagauuuuucau

SEQ ID NO: 2261727 - RNA, 17 nt, Human
ugaagacuggaagcuaa

SEQ ID NO: 2261728 - RNA, 15 nt, Human
ugaagacuggaagcu

SEQ ID NO: 2261729 - RNA, 22 nt, Human
ugaagagaagggcagggcugag

SEQ ID NO: 2261730 - RNA, 20 nt, Human
ugaagagaagggcagggcug

SEQ ID NO: 2261731 - RNA, 20 nt, Human
ugaaacaggagagaaagggg

SEQ ID NO: 2261732 - RNA, 16 nt, Human
ugaaacagaaacaaaa

SEQ ID NO: 2261733 - RNA, 14 nt, Human
ugaaacagaaacaa

SEQ ID NO: 2261734 - RNA, 21 nt, Human
ugaaacaggagagaaagggga

SEQ ID NO: 2261735 - RNA, 16 nt, Human
ugaaacacuuugcaua

SEQ ID NO: 2261736 - RNA, 13 nt, Human
ugaaacagaaaca

SEQ ID NO: 2261737 - RNA, 23 nt, Human
ugaacuggguacuuguggacaca

SEQ ID NO: 2261738 - RNA, 13 nt, Human
ugaacugguucau

SEQ ID NO: 2261739 - RNA, 13 nt, Human
ugaaacauguuuc

SEQ ID NO: 2261740 - RNA, 22 nt, Human
ugaacuuaaauaaaugucauua

SEQ ID NO: 2261741 - RNA, 17 nt, Human
ugaacuuaaauaaaugu

SEQ ID NO: 2261742 - RNA, 15 nt, Human
ugaacuuaaaaugaa

SEQ ID NO: 2261743 - RNA, 18 nt, Human
ugaacuuaaaaugaaagu

SEQ ID NO: 2261744 - RNA, 19 nt, Human
ugaagacucauucuucugu

SEQ ID NO: 2261745 - RNA, 20 nt, Human
ugaagacucauucuucugua

SEQ ID NO: 2261746 - RNA, 22 nt, Human
ugaacuuccugcagguaaacag

SEQ ID NO: 2261747 - RNA, 21 nt, Human
ugaacuuauuuacacauaguu

SEQ ID NO: 2261748 - RNA, 16 nt, Human
ugaacuuauucuguag

SEQ ID NO: 2261749 - RNA, 14 nt, Human
ugaacuucgcauca

SEQ ID NO: 2261750 - RNA, 18 nt, Human
ugaacuucgcaucaaaag

SEQ ID NO: 2261751 - RNA, 19 nt, Human
ugaacuucgcaucaaaaga

SEQ ID NO: 2261752 - RNA, 21 nt, Human
ugaacuucgcaucaaaagaca

SEQ ID NO: 2261753 - RNA, 15 nt, Human
ugaacuucucucaga

SEQ ID NO: 2261754 - RNA, 22 nt, Human
ugaacuucucucagacuuacuu

SEQ ID NO: 2261755 - RNA, 18 nt, Human
ugaacuucucucagacuu

SEQ ID NO: 2261756 - RNA, 19 nt, Human
ugaaugcaccauggucaaa

SEQ ID NO: 2261757 - RNA, 19 nt, Human
ugaauguuuacacucuuug

SEQ ID NO: 2261758 - RNA, 14 nt, Human
ugaaugcauaaaau

SEQ ID NO: 2261759 - RNA, 22 nt, Human
ugaauguuuacacucuuuguaa

SEQ ID NO: 2261760 - RNA, 19 nt, Human
ugaauguuuauuccuugau

SEQ ID NO: 2261761 - RNA, 22 nt, Human
ugaauguuuccaaccuggagua

SEQ ID NO: 2261762 - RNA, 18 nt, Human
ugaaugcaccauggucaa

SEQ ID NO: 2261763 - RNA, 21 nt, Human
ugaauguuuccaaccuggagu

SEQ ID NO: 2261764 - RNA, 11 nt, Human
ugaauuaaaac

SEQ ID NO: 2261765 - RNA, 19 nt, Human
ugaaugcacacuagccucu

SEQ ID NO: 2261766 - RNA, 19 nt, Human
ugaaugauuuccaaagaga

SEQ ID NO: 2261767 - RNA, 16 nt, Human
ugaaugauucaguguu

SEQ ID NO: 2261768 - RNA, 23 nt, Human
ugaaugaugauccuaggcauuug

SEQ ID NO: 2261769 - RNA, 20 nt, Human
ugaaugaauggcuaagcaaa

SEQ ID NO: 2261770 - RNA, 15 nt, Human
ugaaugaauggcuaa

SEQ ID NO: 2261771 - RNA, 16 nt, Human
ugaaugaaccuucugg

SEQ ID NO: 2261772 - RNA, 15 nt, Human
ugaaugaaccuucug

SEQ ID NO: 2261773 - RNA, 15 nt, Human
ugaaugaacacucuu

SEQ ID NO: 2261774 - RNA, 12 nt, Human
ugaaugaacacu

SEQ ID NO: 2261775 - RNA, 11 nt, Human
ugaaugaacac

SEQ ID NO: 2261776 - RNA, 21 nt, Human
ugaaucuugucucaaugcuca

SEQ ID NO: 2261777 - RNA, 23 nt, Human
ugaaucuugucucaaugcucaua

SEQ ID NO: 2261778 - RNA, 16 nt, Human
ugaaucuuggugucua

SEQ ID NO: 2261779 - RNA, 13 nt, Human
ugaaucuugucuc

SEQ ID NO: 2261780 - RNA, 15 nt, Human
ugaaucuugucucaa

SEQ ID NO: 2261781 - RNA, 16 nt, Human
ugaaucuugucucaau

SEQ ID NO: 2261782 - RNA, 19 nt, Human
ugaaucuugucucaaugcu

SEQ ID NO: 2261783 - RNA, 20 nt, Human
ugaaucuugucucaaugcuc

SEQ ID NO: 2261784 - RNA, 14 nt, Human
ugaaucuauuuaag

SEQ ID NO: 2261785 - RNA, 16 nt, Human
ugaaucuauuuaagua

SEQ ID NO: 2261786 - RNA, 18 nt, Human
ugaaucuaugccaaagau

SEQ ID NO: 2261787 - RNA, 19 nt, Human
ugaaucuauuauacuguau

SEQ ID NO: 2261788 - RNA, 21 nt, Human
ugaaucuauuauacuguauua

SEQ ID NO: 2261789 - RNA, 22 nt, Human
ugaaucuauuauacuguauuaa

SEQ ID NO: 2261790 - RNA, 15 nt, Human
ugaaucgcuucucuu

SEQ ID NO: 2261791 - RNA, 15 nt, Human
ugaaucuaagcagca

SEQ ID NO: 2261792 - RNA, 20 nt, Human
ugaaucuaagcagcauuucu

SEQ ID NO: 2261793 - RNA, 15 nt, Human
ugaaucuagcuuauu

SEQ ID NO: 2261794 - RNA, 23 nt, Human
ugaaucuagcuuauuuugaggcu

SEQ ID NO: 2261795 - RNA, 12 nt, Human
ugaaucuaugcc

SEQ ID NO: 2261796 - RNA, 14 nt, Human
ugaaucuaugccaa

SEQ ID NO: 2261797 - RNA, 15 nt, Human
ugaaucuaugccaaa

SEQ ID NO: 2261798 - RNA, 23 nt, Human
ugaaucugauuggacauuuucuu

SEQ ID NO: 2261799 - RNA, 23 nt, Human
ugaaucacguaaagcuagaaaug

SEQ ID NO: 2261800 - RNA, 18 nt, Human
ugaaucagacccuacccc

SEQ ID NO: 2261801 - RNA, 16 nt, Human
ugaaucagacccuacc

SEQ ID NO: 2261802 - RNA, 16 nt, Human
ugaaucaccuaggggu

SEQ ID NO: 2261803 - RNA, 22 nt, Human
ugaaucagacccuaccccacca

SEQ ID NO: 2261804 - RNA, 21 nt, Human
ugaaucagacccuaccccacc

SEQ ID NO: 2261805 - RNA, 19 nt, Human
ugaaucaguauaaacaaag

SEQ ID NO: 2261806 - RNA, 16 nt, Human
ugaaucaguauaaaca

SEQ ID NO: 2261807 - RNA, 22 nt, Human
ugaaucaguauaaacaaaguua

SEQ ID NO: 2261808 - RNA, 21 nt, Human
ugaaucaguauaaacaaaguu

SEQ ID NO: 2261809 - RNA, 20 nt, Human
ugaaucaguauaaacaaagu

SEQ ID NO: 2261810 - RNA, 22 nt, Human
ugaauccuaagggcuggucucu

SEQ ID NO: 2261811 - RNA, 15 nt, Human
ugaauccuaagggcu

SEQ ID NO: 2261812 - RNA, 10 nt, Human
ugaauccuac

SEQ ID NO: 2261813 - RNA, 16 nt, Human
ugaauccuagggccug

SEQ ID NO: 2261814 - RNA, 19 nt, Human
ugaaucaugguuuuucuua

SEQ ID NO: 2261815 - RNA, 21 nt, Human
ugaaucccacgcuucucuuug

SEQ ID NO: 2261816 - RNA, 21 nt, Human
ugaaucccccuugccacccca

SEQ ID NO: 2261817 - RNA, 21 nt, Human
ugaauccucucucuguguuac

SEQ ID NO: 2261818 - RNA, 17 nt, Human
ugaauccucuucuuuau

SEQ ID NO: 2261819 - RNA, 16 nt, Human
ugaauccucucucugu

SEQ ID NO: 2261820 - RNA, 14 nt, Human
ugaauccucucucu

SEQ ID NO: 2261821 - RNA, 17 nt, Human
ugaaucacguaaagcua

SEQ ID NO: 2261822 - RNA, 15 nt, Human
ugaaucaccuagggg

SEQ ID NO: 2261823 - RNA, 22 nt, Human
ugaaucaauaauauauuuucug

SEQ ID NO: 2261824 - RNA, 17 nt, Human
ugaaguuuuacauuguu

SEQ ID NO: 2261825 - RNA, 16 nt, Human
ugaaguuuuacauugu

SEQ ID NO: 2261826 - RNA, 15 nt, Human
ugaaguuuuacauug

SEQ ID NO: 2261827 - RNA, 14 nt, Human
ugaaguuuuacauu

SEQ ID NO: 2261828 - RNA, 18 nt, Human
ugaaguuugaacuucaua

SEQ ID NO: 2261829 - RNA, 21 nt, Human
ugaaguuugaauguuaaauaa

SEQ ID NO: 2261830 - RNA, 16 nt, Human
ugaaguuugaauguua

SEQ ID NO: 2261831 - RNA, 17 nt, Human
ugaaguuugaauguuaa

SEQ ID NO: 2261832 - RNA, 18 nt, Human
ugaaguuugaauguuaaa

SEQ ID NO: 2261833 - RNA, 20 nt, Human
ugaaguuugaauguuaaaua

SEQ ID NO: 2261834 - RNA, 17 nt, Human
ugaaguuuacaaucaaa

SEQ ID NO: 2261835 - RNA, 16 nt, Human
ugaaguuuacauugua

SEQ ID NO: 2261836 - RNA, 20 nt, Human
ugaaguuuacauuguaaaua

SEQ ID NO: 2261837 - RNA, 16 nt, Human
ugaaguuuccuuggcu

SEQ ID NO: 2261838 - RNA, 19 nt, Human
ugaaguuuccuuggcuggu

SEQ ID NO: 2261839 - RNA, 21 nt, Human
ugaaguuuccuuggcuggugc

SEQ ID NO: 2261840 - RNA, 13 nt, Human
ugaaguuucacau

SEQ ID NO: 2261841 - RNA, 14 nt, Human
ugaaguuucacaug

SEQ ID NO: 2261842 - RNA, 14 nt, Human
ugaaguuucacucc

SEQ ID NO: 2261843 - RNA, 17 nt, Human
ugaaguuucacuccgga

SEQ ID NO: 2261844 - RNA, 14 nt, Human
ugaaguuugaaugu

SEQ ID NO: 2261845 - RNA, 15 nt, Human
ugaaguuugaauguu

SEQ ID NO: 2261846 - RNA, 12 nt, Human
ugaaguuugaau

SEQ ID NO: 2261847 - RNA, 13 nt, Human
ugaaguuugaaug

SEQ ID NO: 2261848 - RNA, 19 nt, Human
ugaaggcuucucucugugg

SEQ ID NO: 2261849 - RNA, 14 nt, Human
ugaaguuuacauug

SEQ ID NO: 2261850 - RNA, 16 nt, Human
ugaaggcuucucucug

SEQ ID NO: 2261851 - RNA, 15 nt, Human
ugaaggcuucucucu

SEQ ID NO: 2261852 - RNA, 13 nt, Human
ugaaggcuucucu

SEQ ID NO: 2261853 - RNA, 14 nt, Human
ugaaggcuguacac

SEQ ID NO: 2261854 - RNA, 20 nt, Human
ugaaggcuggguucugaucc

SEQ ID NO: 2261855 - RNA, 21 nt, Human
ugaaggcuggguucugauccu

SEQ ID NO: 2261856 - RNA, 20 nt, Human
uacacagggauguacaaggc

SEQ ID NO: 2261857 - RNA, 11 nt, Human
uacacaguugc

SEQ ID NO: 2261858 - RNA, 23 nt, Human
uacacauagcauguaaugguauc

SEQ ID NO: 2261859 - RNA, 19 nt, Human
uacacauaauuaaaguguc

SEQ ID NO: 2261860 - RNA, 17 nt, Human
uacacaucucagacccu

SEQ ID NO: 2261861 - RNA, 21 nt, Human
uacacauguaucuaugcauuu

SEQ ID NO: 2261862 - RNA, 20 nt, Human
uacacauucggcucccugga

SEQ ID NO: 2261863 - RNA, 18 nt, Human
uacacauucaauaagcau

SEQ ID NO: 2261864 - RNA, 13 nt, Human
uacacucuuauag

SEQ ID NO: 2261865 - RNA, 12 nt, Human
uacacucuuaua

SEQ ID NO: 2261866 - RNA, 20 nt, Human
uacacugaaguuaacagaga

SEQ ID NO: 2261867 - RNA, 16 nt, Human
uacacucuuuguaaga

SEQ ID NO: 2261868 - RNA, 18 nt, Human
uacacugaauauuuauau

SEQ ID NO: 2261869 - RNA, 17 nt, Human
uacacugaauauuuaua

SEQ ID NO: 2261870 - RNA, 16 nt, Human
uacacugacaccuuug

SEQ ID NO: 2261871 - RNA, 23 nt, Human
uacacugacaccuuugcaggcau

SEQ ID NO: 2261872 - RNA, 21 nt, Human
uacacugugcugagucugaag

SEQ ID NO: 2261873 - RNA, 13 nt, Human
uacacacacacac

SEQ ID NO: 2261874 - RNA, 12 nt, Human
uacacacacaca

SEQ ID NO: 2261875 - RNA, 18 nt, Human
uacacacacacacacagc

SEQ ID NO: 2261876 - RNA, 17 nt, Human
uacacacacacacacag

SEQ ID NO: 2261877 - RNA, 16 nt, Human
uacacacacacacaca

SEQ ID NO: 2261878 - RNA, 14 nt, Human
uacacacacacaca

SEQ ID NO: 2261879 - RNA, 21 nt, Human
uacacacacacacacagccac

SEQ ID NO: 2261880 - RNA, 20 nt, Human
uacacacacacacacagcca

SEQ ID NO: 2261881 - RNA, 19 nt, Human
uacacacacacacacagcc

SEQ ID NO: 2261882 - RNA, 16 nt, Human
uacacacucaaaucaa

SEQ ID NO: 2261883 - RNA, 23 nt, Human
uacacaggauccuauucucacca

SEQ ID NO: 2261884 - RNA, 16 nt, Human
uacacagucugcaaga

SEQ ID NO: 2261885 - RNA, 17 nt, Human
uacacagucugcaagau

SEQ ID NO: 2261886 - RNA, 15 nt, Human
uacacagcucuagac

SEQ ID NO: 2261887 - RNA, 16 nt, Human
uacacacgugcaauuu

SEQ ID NO: 2261888 - RNA, 23 nt, Human
uacacacgugcaauuuguuugug

SEQ ID NO: 2261889 - RNA, 15 nt, Human
uacacacugcauguu

SEQ ID NO: 2261890 - RNA, 17 nt, Human
uacacacucaaaucaag

SEQ ID NO: 2261891 - RNA, 12 nt, Human
uacaaccugcuu

SEQ ID NO: 2261892 - RNA, 21 nt, Human
uacaacagauuugugaacuca

SEQ ID NO: 2261893 - RNA, 13 nt, Human
uacaacagugcua

SEQ ID NO: 2261894 - RNA, 14 nt, Human
uacaacagugcuaa

SEQ ID NO: 2261895 - RNA, 20 nt, Human
uacaacagugcuaaaaaugg

SEQ ID NO: 2261896 - RNA, 14 nt, Human
uacaaccaagcucu

SEQ ID NO: 2261897 - RNA, 17 nt, Human
uacaaccaagcucucug

SEQ ID NO: 2261898 - RNA, 22 nt, Human
uacaacaagaguuuauuuccaa

SEQ ID NO: 2261899 - RNA, 12 nt, Human
uacaacagauuu

SEQ ID NO: 2261900 - RNA, 13 nt, Human
uacaacagauuug

SEQ ID NO: 2261901 - RNA, 14 nt, Human
uacaacagauuugu

SEQ ID NO: 2261902 - RNA, 15 nt, Human
uacaacagauuugug

SEQ ID NO: 2261903 - RNA, 16 nt, Human
uacaacagauuuguga

SEQ ID NO: 2261904 - RNA, 17 nt, Human
uacaacagauuugugaa

SEQ ID NO: 2261905 - RNA, 18 nt, Human
uacaacagauuugugaac

SEQ ID NO: 2261906 - RNA, 19 nt, Human
uacaacagauuugugaacu

SEQ ID NO: 2261907 - RNA, 20 nt, Human
uacaacagauuugugaacuc

SEQ ID NO: 2261908 - RNA, 16 nt, Human
uacaaauuuguuauuu

SEQ ID NO: 2261909 - RNA, 16 nt, Human
uacaaauugcuugaaa

SEQ ID NO: 2261910 - RNA, 21 nt, Human
uacaaauugcuuacuuuggaa

SEQ ID NO: 2261911 - RNA, 19 nt, Human
uacaaauugcuugaaagaa

SEQ ID NO: 2261912 - RNA, 19 nt, Human
uacaacaagaguuuauuuc

SEQ ID NO: 2261913 - RNA, 15 nt, Human
uacaaauugcuuacu

SEQ ID NO: 2261914 - RNA, 14 nt, Human
uacaaauuagaaaa

SEQ ID NO: 2261915 - RNA, 15 nt, Human
uacaaauuagaaaau

SEQ ID NO: 2261916 - RNA, 21 nt, Human
uacaaauggacauaggacuca

SEQ ID NO: 2261917 - RNA, 12 nt, Human
uacaaaugucuu

SEQ ID NO: 2261918 - RNA, 13 nt, Human
uacaaauuagaaa

SEQ ID NO: 2261919 - RNA, 18 nt, Human
uacaacuuaaauaauaaa

SEQ ID NO: 2261920 - RNA, 20 nt, Human
uacaacugaguccuuaaaca

SEQ ID NO: 2261921 - RNA, 17 nt, Human
uacaacuuaaguugguc

SEQ ID NO: 2261922 - RNA, 23 nt, Human
uacaacugccucgaaacacagaa

SEQ ID NO: 2261923 - RNA, 14 nt, Human
uacaacugaguccu

SEQ ID NO: 2261924 - RNA, 19 nt, Human
uacaaccaagcucucugca

SEQ ID NO: 2261925 - RNA, 20 nt, Human
uacaaccaagcucucugcau

SEQ ID NO: 2261926 - RNA, 23 nt, Human
uacaaccaagcucucugcaucua

SEQ ID NO: 2261927 - RNA, 14 nt, Human
uacaacuucaagug

SEQ ID NO: 2261928 - RNA, 14 nt, Human
uacaacuucagcag

SEQ ID NO: 2261929 - RNA, 17 nt, Human
uacaagaaaaaaugaau

SEQ ID NO: 2261930 - RNA, 20 nt, Human
uacaauugaacuuaaauaaa

SEQ ID NO: 2261931 - RNA, 14 nt, Human
uacaauugaacuua

SEQ ID NO: 2261932 - RNA, 17 nt, Human
uacaauuguaaaacuga

SEQ ID NO: 2261933 - RNA, 15 nt, Human
uacaauuuacaaagu

SEQ ID NO: 2261934 - RNA, 21 nt, Human
uacaauuguaaaacugaggca

SEQ ID NO: 2261935 - RNA, 22 nt, Human
uacaauuuacaaaguguguauu

SEQ ID NO: 2261936 - RNA, 16 nt, Human
uacaauuuacaaagug

SEQ ID NO: 2261937 - RNA, 17 nt, Human
uacaauuuacaaagugu

SEQ ID NO: 2261938 - RNA, 11 nt, Human
uacacacacac

SEQ ID NO: 2261939 - RNA, 21 nt, Human
uacaauuuucucccaggaagc

SEQ ID NO: 2261940 - RNA, 18 nt, Human
uacaauuuucucccagga

SEQ ID NO: 2261941 - RNA, 19 nt, Human
uacaauuuucucccaggaa

SEQ ID NO: 2261942 - RNA, 11 nt, Human
uaauucuaaag

SEQ ID NO: 2261943 - RNA, 12 nt, Human
uaauucuaaagg

SEQ ID NO: 2261944 - RNA, 13 nt, Human
uaauucuaaggaa

SEQ ID NO: 2261945 - RNA, 11 nt, Human
uaauucuaaau

SEQ ID NO: 2261946 - RNA, 18 nt, Human
uaauucuaaaugaauguu

SEQ ID NO: 2261947 - RNA, 21 nt, Human
uaauucuaaggaauaugagcu

SEQ ID NO: 2261948 - RNA, 12 nt, Human
uaauucucaggc

SEQ ID NO: 2261949 - RNA, 15 nt, Human
uaauucuaugagaua

SEQ ID NO: 2261950 - RNA, 13 nt, Human
uaauuuugugaag

SEQ ID NO: 2261951 - RNA, 17 nt, Human
uaauuagggguugcuaa

SEQ ID NO: 2261952 - RNA, 18 nt, Human
uaauuagggguugcuaag

SEQ ID NO: 2261953 - RNA, 12 nt, Human
uaauuagugcua

SEQ ID NO: 2261954 - RNA, 14 nt, Human
uaauuagugcuaag

SEQ ID NO: 2261955 - RNA, 15 nt, Human
uaauuagugcuaagu

SEQ ID NO: 2261956 - RNA, 16 nt, Human
uaauuagugcuaagug

SEQ ID NO: 2261957 - RNA, 20 nt, Human
uaauuagugcuaagugugaa

SEQ ID NO: 2261958 - RNA, 22 nt, Human
uaauuccucucacuaaacuuua

SEQ ID NO: 2261959 - RNA, 18 nt, Human
uacaaacaaaauuucuau

SEQ ID NO: 2261960 - RNA, 15 nt, Human
uacaaacauauuugu

SEQ ID NO: 2261961 - RNA, 12 nt, Human
uacaaacauauu

SEQ ID NO: 2261962 - RNA, 22 nt, Human
uacaaacaauggaaacugaaug

SEQ ID NO: 2261963 - RNA, 17 nt, Human
uacaaacaccuggacuu

SEQ ID NO: 2261964 - RNA, 12 nt, Human
uacaaacaaugg

SEQ ID NO: 2261965 - RNA, 16 nt, Human
uaauuuuuauauuuga

SEQ ID NO: 2261966 - RNA, 17 nt, Human
uaauuuuuauauuugaa

SEQ ID NO: 2261967 - RNA, 13 nt, Human
uaauuuuuaaagu

SEQ ID NO: 2261968 - RNA, 19 nt, Human
uaauuuuguucuaguuuuc

SEQ ID NO: 2261969 - RNA, 12 nt, Human
uaauuuuuauau

SEQ ID NO: 2261970 - RNA, 15 nt, Human
uaauucucaggccau

SEQ ID NO: 2261971 - RNA, 20 nt, Human
uaauucucaugugauccuuu

SEQ ID NO: 2261972 - RNA, 18 nt, Human
uaauuuugugaagcaaaa

SEQ ID NO: 2261973 - RNA, 17 nt, Human
uacaaacaugugguuaa

SEQ ID NO: 2261974 - RNA, 13 nt, Human
uacaaagaagaca

SEQ ID NO: 2261975 - RNA, 17 nt, Human
uacaaagaaauaacaag

SEQ ID NO: 2261976 - RNA, 14 nt, Human
uacaaagaagacau

SEQ ID NO: 2261977 - RNA, 13 nt, Human
uacaaagaaauaa

SEQ ID NO: 2261978 - RNA, 19 nt, Human
uacaaacucccacuuguca

SEQ ID NO: 2261979 - RNA, 19 nt, Human
uacaaagaagacauguuuu

SEQ ID NO: 2261980 - RNA, 22 nt, Human
uacaaagaagacauguuuuaga

SEQ ID NO: 2261981 - RNA, 15 nt, Human
uacaaagaagacaug

SEQ ID NO: 2261982 - RNA, 16 nt, Human
uacaaagaagacaugu

SEQ ID NO: 2261983 - RNA, 17 nt, Human
uacaaagaagacauguu

SEQ ID NO: 2261984 - RNA, 18 nt, Human
uacaaagaagacauguuu

SEQ ID NO: 2261985 - RNA, 18 nt, Human
uacaaaguagaagucuua

SEQ ID NO: 2261986 - RNA, 14 nt, Human
uacaaaguagaagu

SEQ ID NO: 2261987 - RNA, 13 nt, Human
uacaaagugugua

SEQ ID NO: 2261988 - RNA, 13 nt, Human
uacaaagugaugu

SEQ ID NO: 2261989 - RNA, 15 nt, Human
uacaaaguguguauu

SEQ ID NO: 2261990 - RNA, 19 nt, Human
uacaaaguguguauuaaaa

SEQ ID NO: 2261991 - RNA, 12 nt, Human
uacaaauacucu

SEQ ID NO: 2261992 - RNA, 17 nt, Human
uacaaauacucuuagga

SEQ ID NO: 2261993 - RNA, 19 nt, Human
uacaaauacucuuaggaag

SEQ ID NO: 2261994 - RNA, 23 nt, Human
uacaaauacucuuaggaagagaa

SEQ ID NO: 2261995 - RNA, 16 nt, Human
uacaaaucaaguauuu

SEQ ID NO: 2261996 - RNA, 18 nt, Human
uacaaauauaagaauaaa

SEQ ID NO: 2261997 - RNA, 18 nt, Human
uacaaaguguguauuaaa

SEQ ID NO: 2261998 - RNA, 12 nt, Human
uacaaauauaag

SEQ ID NO: 2261999 - RNA, 14 nt, Human
uacaaauauaagaa

SEQ ID NO: 2262000 - RNA, 16 nt, Human
uacaaauauaagaaua

SEQ ID NO: 2262001 - RNA, 17 nt, Human
uacaaauauaagaauaa

SEQ ID NO: 2262002 - RNA, 13 nt, Human
uacaaaucaauca

SEQ ID NO: 2262003 - RNA, 22 nt, Human
uacauggaauaacauguaauua

SEQ ID NO: 2262004 - RNA, 19 nt, Human
uacauggaauaacauguaa

SEQ ID NO: 2262005 - RNA, 18 nt, Human
uacauggaauaacaugua

SEQ ID NO: 2262006 - RNA, 14 nt, Human
uacauggaauaaca

SEQ ID NO: 2262007 - RNA, 14 nt, Human
uacauuuuuaagug

SEQ ID NO: 2262008 - RNA, 22 nt, Human
uacauggacaauacccccaggc

SEQ ID NO: 2262009 - RNA, 16 nt, Human
uacauggcagaguuug

SEQ ID NO: 2262010 - RNA, 19 nt, Human
uacauggcagaguuugugu

SEQ ID NO: 2262011 - RNA, 22 nt, Human
uacauuuuuaagugcugcauuu

SEQ ID NO: 2262012 - RNA, 19 nt, Human
uacauuuuuaagugcugca

SEQ ID NO: 2262013 - RNA, 14 nt, Human
uacaugcauuugag

SEQ ID NO: 2262014 - RNA, 22 nt, Human
uacaugcauugagcucucucau

SEQ ID NO: 2262015 - RNA, 20 nt, Human
uacaugcauuacugcaugca

SEQ ID NO: 2262016 - RNA, 21 nt, Human
uacaugcauacuucaaaagua

SEQ ID NO: 2262017 - RNA, 14 nt, Human
uacaugccagugac

SEQ ID NO: 2262018 - RNA, 16 nt, Human
uacaugcuuugugaac

SEQ ID NO: 2262019 - RNA, 15 nt, Human
uacaugcuuugugaa

SEQ ID NO: 2262020 - RNA, 15 nt, Human
uacaugcucuuagaa

SEQ ID NO: 2262021 - RNA, 12 nt, Human
uacaugcugcua

SEQ ID NO: 2262022 - RNA, 14 nt, Human
uacaugcugcuaau

SEQ ID NO: 2262023 - RNA, 14 nt, Human
uacaugcauacuuc

SEQ ID NO: 2262024 - RNA, 17 nt, Human
uacaugcauacuucaaa

SEQ ID NO: 2262025 - RNA, 19 nt, Human
uacaugcauacuucaaaag

SEQ ID NO: 2262026 - RNA, 17 nt, Human
uacaugcagcccaugcc

SEQ ID NO: 2262027 - RNA, 14 nt, Human
uacaugcagcccau

SEQ ID NO: 2262028 - RNA, 22 nt, Human
uacaugcagcccaugcccaccu

SEQ ID NO: 2262029 - RNA, 11 nt, Human
uacaugcauac

SEQ ID NO: 2262030 - RNA, 21 nt, Human
uacaugaaacagaaacaaaaa

SEQ ID NO: 2262031 - RNA, 21 nt, Human
uacaugcacuuggcugcauaa

SEQ ID NO: 2262032 - RNA, 22 nt, Human
uacaugcaauuuauuaaaauga

SEQ ID NO: 2262033 - RNA, 15 nt, Human
uacaugaaacagaaa

SEQ ID NO: 2262034 - RNA, 14 nt, Human
uacaugaaacagaa

SEQ ID NO: 2262035 - RNA, 13 nt, Human
uacaugaaacaga

SEQ ID NO: 2262036 - RNA, 12 nt, Human
uacaugaaacag

SEQ ID NO: 2262037 - RNA, 17 nt, Human
uacauaagauaaaugug

SEQ ID NO: 2262038 - RNA, 16 nt, Human
uacauaagauaaaugu

SEQ ID NO: 2262039 - RNA, 20 nt, Human
uacaucuuucacauuggcua

SEQ ID NO: 2262040 - RNA, 17 nt, Human
uacauaaacugacuuua

SEQ ID NO: 2262041 - RNA, 20 nt, Human
uacaucuuuucaacaaguaa

SEQ ID NO: 2262042 - RNA, 17 nt, Human
uacaucuuuuuucacaa

SEQ ID NO: 2262043 - RNA, 18 nt, Human
uacaucuuuuuucacaaa

SEQ ID NO: 2262044 - RNA, 20 nt, Human
uacaucuuuuuucacaaauu

SEQ ID NO: 2262045 - RNA, 16 nt, Human
uacaugaaaacacauu

SEQ ID NO: 2262046 - RNA, 23 nt, Human
uacaugaaaacacauuuuucuua

SEQ ID NO: 2262047 - RNA, 19 nt, Human
uacaugaaaacacauuuuu

SEQ ID NO: 2262048 - RNA, 18 nt, Human
uacaugaaaacacauuuu

SEQ ID NO: 2262049 - RNA, 17 nt, Human
uacaugaaaacacauuu

SEQ ID NO: 2262050 - RNA, 17 nt, Human
uacaguuuguuuacaca

SEQ ID NO: 2262051 - RNA, 17 nt, Human
uacaguuugcuguacua

SEQ ID NO: 2262052 - RNA, 17 nt, Human
uacaguuugucacauga

SEQ ID NO: 2262053 - RNA, 15 nt, Human
uacaguuuguuuaca

SEQ ID NO: 2262054 - RNA, 16 nt, Human
uacaguuuguuuacac

SEQ ID NO: 2262055 - RNA, 21 nt, Human
uacaguuuguuaguaugaggc

SEQ ID NO: 2262056 - RNA, 19 nt, Human
uacaguuuguuaguaugag

SEQ ID NO: 2262057 - RNA, 21 nt, Human
uacauaaaggugguaugugug

SEQ ID NO: 2262058 - RNA, 13 nt, Human
uacauaacugaaa

SEQ ID NO: 2262059 - RNA, 21 nt, Human
uacauaacugaaaaugugcua

SEQ ID NO: 2262060 - RNA, 17 nt, Human
uacauaacugaaaaugu

SEQ ID NO: 2262061 - RNA, 15 nt, Human
uacauaacugaaaau

SEQ ID NO: 2262062 - RNA, 13 nt, Human
uacauaaaggugg

SEQ ID NO: 2262063 - RNA, 16 nt, Human
uacauaaacaaguccu

SEQ ID NO: 2262064 - RNA, 18 nt, Human
uacaggaagguagaaaua

SEQ ID NO: 2262065 - RNA, 13 nt, Human
uacaggaaguacu

SEQ ID NO: 2262066 - RNA, 20 nt, Human
uacagcuugaccgugaggcc

SEQ ID NO: 2262067 - RNA, 21 nt, Human
uacagcuggguggcacugcca

SEQ ID NO: 2262068 - RNA, 24 nt, Human
uacagcuggguggcacugccaugc

SEQ ID NO: 2262069 - RNA, 14 nt, Human
uacagcuguuuaag

SEQ ID NO: 2262070 - RNA, 14 nt, Human
uacagcugccugca

SEQ ID NO: 2262071 - RNA, 20 nt, Human
uacagcuggguggcacugcc

SEQ ID NO: 2262072 - RNA, 13 nt, Human
uacagcugccugc

SEQ ID NO: 2262073 - RNA, 19 nt, Human
uacagcugagcacauucug

SEQ ID NO: 2262074 - RNA, 20 nt, Human
uacagcgagaggcagagaaa

SEQ ID NO: 2262075 - RNA, 16 nt, Human
uacagcgagaggcaga

SEQ ID NO: 2262076 - RNA, 19 nt, Human
uacagcgagaggcagagaa

SEQ ID NO: 2262077 - RNA, 21 nt, Human
uacagcucagaaguuucuucu

SEQ ID NO: 2262078 - RNA, 20 nt, Human
uacacuguuucaaacuuuac

SEQ ID NO: 2262079 - RNA, 22 nt, Human
uacacugugcugagucugaagg

SEQ ID NO: 2262080 - RNA, 23 nt, Human
uacacugugcugagucugaaggc

SEQ ID NO: 2262081 - RNA, 16 nt, Human
uacacuuacacuuuau

SEQ ID NO: 2262082 - RNA, 22 nt, Human
uacacuguuucaaacuuuacua

SEQ ID NO: 2262083 - RNA, 16 nt, Human
uacagcuaaucagcau

SEQ ID NO: 2262084 - RNA, 18 nt, Human
uacagcuaaucagcauuc

SEQ ID NO: 2262085 - RNA, 19 nt, Human
uacacuuacuguuguccua

SEQ ID NO: 2262086 - RNA, 21 nt, Human
uacacuuacuguuguccuaug

SEQ ID NO: 2262087 - RNA, 14 nt, Human
uacacuuacuguug

SEQ ID NO: 2262088 - RNA, 19 nt, Human
uacaguugaaaaacagcug

SEQ ID NO: 2262089 - RNA, 17 nt, Human
uacaguugaaaaacagc

SEQ ID NO: 2262090 - RNA, 16 nt, Human
uacagcuguuuaagau

SEQ ID NO: 2262091 - RNA, 11 nt, Human
uacaguucuuc

SEQ ID NO: 2262092 - RNA, 12 nt, Human
uacaguucuucg

SEQ ID NO: 2262093 - RNA, 15 nt, Human
uacaguuguuggccu

SEQ ID NO: 2262094 - RNA, 19 nt, Human
uacaguuggaaauccaucc

SEQ ID NO: 2262095 - RNA, 16 nt, Human
uacaguuguuggccuc

SEQ ID NO: 2262096 - RNA, 18 nt, Human
uacaguuguuggccuccg

SEQ ID NO: 2262097 - RNA, 18 nt, Human
uacaguucuucgggaaga

SEQ ID NO: 2262098 - RNA, 21 nt, Human
uacaguucuucgggaagagag

SEQ ID NO: 2262099 - RNA, 22 nt, Human
uacaguucuucgggaagagagg

SEQ ID NO: 2262100 - RNA, 20 nt, Human
uacaguugaaaaacagcuga

SEQ ID NO: 2262101 - RNA, 20 nt, Human
uacaguuguuuuuugaaaac

SEQ ID NO: 2262102 - RNA, 12 nt, Human
uacaguuucaaa

SEQ ID NO: 2262103 - RNA, 13 nt, Human
uacaguuucaaaa

SEQ ID NO: 2262104 - RNA, 15 nt, Human
uacaguuugcuguac

SEQ ID NO: 2262105 - RNA, 16 nt, Human
uacaguuugcuguacu

SEQ ID NO: 2262106 - RNA, 21 nt, Human
uacaguuugcuguacuagaga

SEQ ID NO: 2262107 - RNA, 18 nt, Human
uacaguuuguuaguauga

SEQ ID NO: 2262108 - RNA, 15 nt, Human
uacaggagugagcac

SEQ ID NO: 2262109 - RNA, 22 nt, Human
uacaggaaguacuggagaaaau

SEQ ID NO: 2262110 - RNA, 14 nt, Human
uacaggaaguacug

SEQ ID NO: 2262111 - RNA, 15 nt, Human
uacaggaaguacugg

SEQ ID NO: 2262112 - RNA, 23 nt, Human
uacaguucggugagcuacaaaug

SEQ ID NO: 2262113 - RNA, 20 nt, Human
uacaggaugaugacuaugga

SEQ ID NO: 2262114 - RNA, 15 nt, Human
uacugcaagaaaaug

SEQ ID NO: 2262115 - RNA, 17 nt, Human
uacugcagaauacagua

SEQ ID NO: 2262116 - RNA, 14 nt, Human
uacugcaagaaaau

SEQ ID NO: 2262117 - RNA, 19 nt, Human
uacugcaauuaaagugaua

SEQ ID NO: 2262118 - RNA, 22 nt, Human
uacugcagaauacaguaagcug

SEQ ID NO: 2262119 - RNA, 20 nt, Human
uacugcagccuuugccuccc

SEQ ID NO: 2262120 - RNA, 11 nt, Human
uacugccaaag

SEQ ID NO: 2262121 - RNA, 22 nt, Human
uacugcagccuuugccuccccg

SEQ ID NO: 2262122 - RNA, 15 nt, Human
uacugcagcuuuaca

SEQ ID NO: 2262123 - RNA, 13 nt, Human
uacugcaugcacu

SEQ ID NO: 2262124 - RNA, 16 nt, Human
uacucuacccucuuag

SEQ ID NO: 2262125 - RNA, 15 nt, Human
uacugauuguuucau

SEQ ID NO: 2262126 - RNA, 21 nt, Human
uacugauuuccuuuggagcuu

SEQ ID NO: 2262127 - RNA, 13 nt, Human
uacugauuuuugu

SEQ ID NO: 2262128 - RNA, 17 nt, Human
uacugauuuuuguaaga

SEQ ID NO: 2262129 - RNA, 15 nt, Human
uacugauuuuuguga

SEQ ID NO: 2262130 - RNA, 17 nt, Human
uacugauuuuugugauu

SEQ ID NO: 2262131 - RNA, 18 nt, Human
uacugcaaaugucaucag

SEQ ID NO: 2262132 - RNA, 19 nt, Human
uacugcccggggcagcugc

SEQ ID NO: 2262133 - RNA, 23 nt, Human
uacugcccaauaugcaguucugc

SEQ ID NO: 2262134 - RNA, 20 nt, Human
uacugccauucacuucauaa

SEQ ID NO: 2262135 - RNA, 22 nt, Human
uacugcccggggcagcugccag

SEQ ID NO: 2262136 - RNA, 22 nt, Human
uacugcccuccagcucuuuccu

SEQ ID NO: 2262137 - RNA, 23 nt, Human
uacugcccuccagcucuuuccuc

SEQ ID NO: 2262138 - RNA, 14 nt, Human
uacugccuauuuua

SEQ ID NO: 2262139 - RNA, 21 nt, Human
uacugccuauuuuaauaaaca

SEQ ID NO: 2262140 - RNA, 19 nt, Human
uacugcccaggccugccug

SEQ ID NO: 2262141 - RNA, 20 nt, Human
uacugcccaggccugccugu

SEQ ID NO: 2262142 - RNA, 21 nt, Human
uacugcccaggccugccuguu

SEQ ID NO: 2262143 - RNA, 22 nt, Human
uacugcccaggccugccuguuc

SEQ ID NO: 2262144 - RNA, 14 nt, Human
uacugccacucuuu

SEQ ID NO: 2262145 - RNA, 12 nt, Human
uacugccagaug

SEQ ID NO: 2262146 - RNA, 14 nt, Human
uacugccagaugcu

SEQ ID NO: 2262147 - RNA, 15 nt, Human
uacugccagaugcug

SEQ ID NO: 2262148 - RNA, 16 nt, Human
uacugccagaugcuga

SEQ ID NO: 2262149 - RNA, 17 nt, Human
uacugccagaugcugau

SEQ ID NO: 2262150 - RNA, 18 nt, Human
uacugccagaugcugaug

SEQ ID NO: 2262151 - RNA, 21 nt, Human
uacugccagaugcugauguuc

SEQ ID NO: 2262152 - RNA, 24 nt, Human
uacugccagaugcugauguucagu

SEQ ID NO: 2262153 - RNA, 22 nt, Human
uacucccacucccggccuguca

SEQ ID NO: 2262154 - RNA, 14 nt, Human
uacucccagacacc

SEQ ID NO: 2262155 - RNA, 21 nt, Human
uacuccagugccaacaauccu

SEQ ID NO: 2262156 - RNA, 14 nt, Human
uacuccagugguga

SEQ ID NO: 2262157 - RNA, 19 nt, Human
uacuccaguggugaagaaa

SEQ ID NO: 2262158 - RNA, 20 nt, Human
uacucauucauuuauucauu

SEQ ID NO: 2262159 - RNA, 16 nt, Human
uacuccccuugagcug

SEQ ID NO: 2262160 - RNA, 15 nt, Human
uacuccccuugagcu

SEQ ID NO: 2262161 - RNA, 22 nt, Human
uacucccucaaagcacacguca

SEQ ID NO: 2262162 - RNA, 10 nt, Human
uacuccccuu

SEQ ID NO: 2262163 - RNA, 15 nt, Human
uacuccccuccuuga

SEQ ID NO: 2262164 - RNA, 17 nt, Human
uacuccuaccucagccu

SEQ ID NO: 2262165 - RNA, 16 nt, Human
uacuccuaccucagcc

SEQ ID NO: 2262166 - RNA, 15 nt, Human
uacuccuaccucagc

SEQ ID NO: 2262167 - RNA, 14 nt, Human
uacuccuaccucag

SEQ ID NO: 2262168 - RNA, 12 nt, Human
uacuccucccag

SEQ ID NO: 2262169 - RNA, 22 nt, Human
uacucgaguuacagacaaagcg

SEQ ID NO: 2262170 - RNA, 18 nt, Human
uacucgaguuacagacaa

SEQ ID NO: 2262171 - RNA, 18 nt, Human
uacucauuccccggggcg

SEQ ID NO: 2262172 - RNA, 14 nt, Human
uacucauucaggga

SEQ ID NO: 2262173 - RNA, 20 nt, Human
uacucauguguaugggcaaa

SEQ ID NO: 2262174 - RNA, 22 nt, Human
uacucauguguaugggcaaaaa

SEQ ID NO: 2262175 - RNA, 23 nt, Human
uacuacaguuguuuuuugaaaac

SEQ ID NO: 2262176 - RNA, 12 nt, Human
uacucaugugua

SEQ ID NO: 2262177 - RNA, 13 nt, Human
uacucauguguau

SEQ ID NO: 2262178 - RNA, 14 nt, Human
uacucauguguaug

SEQ ID NO: 2262179 - RNA, 21 nt, Human
uacuacaguuguuuuuugaaa

SEQ ID NO: 2262180 - RNA, 14 nt, Human
uacuacaguuuguu

SEQ ID NO: 2262181 - RNA, 13 nt, Human
uacuacaguuugu

SEQ ID NO: 2262182 - RNA, 15 nt, Human
uacuaaugauguuuu

SEQ ID NO: 2262183 - RNA, 14 nt, Human
uacuaaugauguuu

SEQ ID NO: 2262184 - RNA, 13 nt, Human
uacuaaugauguu

SEQ ID NO: 2262185 - RNA, 16 nt, Human
uacuaaugauguuuuc

SEQ ID NO: 2262186 - RNA, 13 nt, Human
uacuaauuccaca

SEQ ID NO: 2262187 - RNA, 22 nt, Human
uacuaaggaguaaucuguguac

SEQ ID NO: 2262188 - RNA, 23 nt, Human
uacuaaggaguaaucuguguaca

SEQ ID NO: 2262189 - RNA, 16 nt, Human
uacuacaaaaaaguug

SEQ ID NO: 2262190 - RNA, 16 nt, Human
uacuaauuuucuagau

SEQ ID NO: 2262191 - RNA, 16 nt, Human
uacuaauuccacaccu

SEQ ID NO: 2262192 - RNA, 22 nt, Human
uacuacaguccucccaucucac

SEQ ID NO: 2262193 - RNA, 18 nt, Human
uacuguggaaaagaaaca

SEQ ID NO: 2262194 - RNA, 12 nt, Human
uacuguggagga

SEQ ID NO: 2262195 - RNA, 14 nt, Human
uacuguggaggaag

SEQ ID NO: 2262196 - RNA, 16 nt, Human
uacuguggaggaagga

SEQ ID NO: 2262197 - RNA, 18 nt, Human
uacuguggaggaaggauu

SEQ ID NO: 2262198 - RNA, 23 nt, Human
uacuguggaggaaggauuguaaa

SEQ ID NO: 2262199 - RNA, 23 nt, Human
uacugugugugugaaugaacacu

SEQ ID NO: 2262200 - RNA, 22 nt, Human
uacugugugugugaaugaacac

SEQ ID NO: 2262201 - RNA, 22 nt, Human
uacuguggaggaaggauuguaa

SEQ ID NO: 2262202 - RNA, 19 nt, Human
uacuguguuccuggcaaua

SEQ ID NO: 2262203 - RNA, 16 nt, Human
uacuguguuccuggca

SEQ ID NO: 2262204 - RNA, 13 nt, Human
uacuguguuucag

SEQ ID NO: 2262205 - RNA, 14 nt, Human
uacuguguuccugg

SEQ ID NO: 2262206 - RNA, 13 nt, Human
uacuguguuccug

SEQ ID NO: 2262207 - RNA, 12 nt, Human
uacuguguuccu

SEQ ID NO: 2262208 - RNA, 22 nt, Human
uacuguguuccuggcaauagug

SEQ ID NO: 2262209 - RNA, 15 nt, Human
uacuguuaaaggaaa

SEQ ID NO: 2262210 - RNA, 16 nt, Human
uacuguuaaaggaaaa

SEQ ID NO: 2262211 - RNA, 14 nt, Human
uacugucucacuga

SEQ ID NO: 2262212 - RNA, 22 nt, Human
uacugucucacugaaacauuua

SEQ ID NO: 2262213 - RNA, 21 nt, Human
uacugucuucaguaagccgug

SEQ ID NO: 2262214 - RNA, 22 nt, Human
uacugucugguuuuaacaauuu

SEQ ID NO: 2262215 - RNA, 15 nt, Human
uacugugaaacuggc

SEQ ID NO: 2262216 - RNA, 16 nt, Human
uacugucugguuuuaa

SEQ ID NO: 2262217 - RNA, 19 nt, Human
uacugucugguuuuaacaa

SEQ ID NO: 2262218 - RNA, 20 nt, Human
uacugucugguuuuaacaau

SEQ ID NO: 2262219 - RNA, 21 nt, Human
uacugucugguuuuaacaauu

SEQ ID NO: 2262220 - RNA, 20 nt, Human
uacuguggaaaaauauuuaa

SEQ ID NO: 2262221 - RNA, 19 nt, Human
uacuguggaaaaauauuua

SEQ ID NO: 2262222 - RNA, 16 nt, Human
uacuguggaaaaauau

SEQ ID NO: 2262223 - RNA, 18 nt, Human
uacugugcuggagccacu

SEQ ID NO: 2262224 - RNA, 13 nt, Human
uacugugacugau

SEQ ID NO: 2262225 - RNA, 15 nt, Human
uacugugcuggagcc

SEQ ID NO: 2262226 - RNA, 16 nt, Human
uacugugcuggagcca

SEQ ID NO: 2262227 - RNA, 16 nt, Human
uacuguccuacccacc

SEQ ID NO: 2262228 - RNA, 23 nt, Human
uacugucagcuccccucggagaa

SEQ ID NO: 2262229 - RNA, 19 nt, Human
uacugcuagucuuaagaac

SEQ ID NO: 2262230 - RNA, 20 nt, Human
uacugcuacuguaauuuuau

SEQ ID NO: 2262231 - RNA, 22 nt, Human
uacugcuaaguauuucccagca

SEQ ID NO: 2262232 - RNA, 15 nt, Human
uacugcuacuguaau

SEQ ID NO: 2262233 - RNA, 19 nt, Human
uacugcuaaguauuuccca

SEQ ID NO: 2262234 - RNA, 20 nt, Human
uacugcuaaguauuucccag

SEQ ID NO: 2262235 - RNA, 21 nt, Human
uacugcuaaguauuucccagc

SEQ ID NO: 2262236 - RNA, 12 nt, Human
uacugcgacuuu

SEQ ID NO: 2262237 - RNA, 16 nt, Human
uacugcgacuuucugc

SEQ ID NO: 2262238 - RNA, 17 nt, Human
uacugcgacuuucugcc

SEQ ID NO: 2262239 - RNA, 18 nt, Human
uacugcgacuuucugccu

SEQ ID NO: 2262240 - RNA, 19 nt, Human
uacugcgacuuucugccug

SEQ ID NO: 2262241 - RNA, 20 nt, Human
uacugcgacuuucugccugg

SEQ ID NO: 2262242 - RNA, 21 nt, Human
uacugcgacuuucugccugga

SEQ ID NO: 2262243 - RNA, 22 nt, Human
uacugcgacuuucugccuggag

SEQ ID NO: 2262244 - RNA, 13 nt, Human
uacuuaauaaauu

SEQ ID NO: 2262245 - RNA, 17 nt, Human
uacuugaagggccagag

SEQ ID NO: 2262246 - RNA, 16 nt, Human
uacuugaagggccaga

SEQ ID NO: 2262247 - RNA, 15 nt, Human
uacuugaagggccag

SEQ ID NO: 2262248 - RNA, 14 nt, Human
uacuugaagggcca

SEQ ID NO: 2262249 - RNA, 12 nt, Human
uacuugaagggc

SEQ ID NO: 2262250 - RNA, 11 nt, Human
uacuugaaggg

SEQ ID NO: 2262251 - RNA, 18 nt, Human
uacuuaaaugaaagcaug

SEQ ID NO: 2262252 - RNA, 17 nt, Human
uacuuaaaugaaagcau

SEQ ID NO: 2262253 - RNA, 19 nt, Human
uacuguuugucuucucccc

SEQ ID NO: 2262254 - RNA, 12 nt, Human
uacuuaaagauu

SEQ ID NO: 2262255 - RNA, 14 nt, Human
uacuuaaagauuua

SEQ ID NO: 2262256 - RNA, 19 nt, Human
uacuuaaagauuuaucaaa

SEQ ID NO: 2262257 - RNA, 20 nt, Human
uacuuaaauggaaaaaauga

SEQ ID NO: 2262258 - RNA, 13 nt, Human
uacuuaacuauuc

SEQ ID NO: 2262259 - RNA, 13 nt, Human
uacuguuucuguc

SEQ ID NO: 2262260 - RNA, 12 nt, Human
uacuguuugucu

SEQ ID NO: 2262261 - RNA, 20 nt, Human
uacuguuugucuucucccca

SEQ ID NO: 2262262 - RNA, 13 nt, Human
uacuuguggacac

SEQ ID NO: 2262263 - RNA, 20 nt, Human
uacuugucaauauuuaaaca

SEQ ID NO: 2262264 - RNA, 11 nt, Human
uacuugucaau

SEQ ID NO: 2262265 - RNA, 13 nt, Human
uacuugucaauau

SEQ ID NO: 2262266 - RNA, 15 nt, Human
uacuugucaaagaag

SEQ ID NO: 2262267 - RNA, 16 nt, Human
uacuugucaaagaagg

SEQ ID NO: 2262268 - RNA, 18 nt, Human
uacuugucaaagaagguu

SEQ ID NO: 2262269 - RNA, 19 nt, Human
uacuugaagggccagagcc

SEQ ID NO: 2262270 - RNA, 18 nt, Human
uacuugaagggccagagc

SEQ ID NO: 2262271 - RNA, 20 nt, Human
uacuugaagggccagagcca

SEQ ID NO: 2262272 - RNA, 14 nt, Human
uacuugucaaagaa

SEQ ID NO: 2262273 - RNA, 13 nt, Human
uacuugcucuuga

SEQ ID NO: 2262274 - RNA, 14 nt, Human
uacuugcucuugau

SEQ ID NO: 2262275 - RNA, 18 nt, Human
uacuugcucuugaugccu

SEQ ID NO: 2262276 - RNA, 19 nt, Human
uacuugcucuugaugccug

SEQ ID NO: 2262277 - RNA, 13 nt, Human
uaccuucauuuca

SEQ ID NO: 2262278 - RNA, 14 nt, Human
uaccuucauuucag

SEQ ID NO: 2262279 - RNA, 20 nt, Human
uaccuuccagucaggaugac

SEQ ID NO: 2262280 - RNA, 20 nt, Human
uaccuucaauaaaguaucua

SEQ ID NO: 2262281 - RNA, 17 nt, Human
uaccuucaauaaaguau

SEQ ID NO: 2262282 - RNA, 16 nt, Human
uaccuucaauaaagua

SEQ ID NO: 2262283 - RNA, 14 nt, Human
uaccuucaauaaag

SEQ ID NO: 2262284 - RNA, 13 nt, Human
uaccuucaauaaa

SEQ ID NO: 2262285 - RNA, 21 nt, Human
uaccuuagauuagcucuggac

SEQ ID NO: 2262286 - RNA, 22 nt, Human
uaccuuagauuagcucuggacc

SEQ ID NO: 2262287 - RNA, 21 nt, Human
uaccuuuugaggagccccagc

SEQ ID NO: 2262288 - RNA, 12 nt, Human
uaccuuccaguc

SEQ ID NO: 2262289 - RNA, 21 nt, Human
uaccuuuuaacaccugaugug

SEQ ID NO: 2262290 - RNA, 16 nt, Human
uaccuuuuaauuaaug

SEQ ID NO: 2262291 - RNA, 13 nt, Human
uaccuuuuuuaga

SEQ ID NO: 2262292 - RNA, 22 nt, Human
uaccuuuuuuagaguugauacu

SEQ ID NO: 2262293 - RNA, 19 nt, Human
uaccuuuuuuagaguugau

SEQ ID NO: 2262294 - RNA, 11 nt, Human
uaccuccuccu

SEQ ID NO: 2262295 - RNA, 13 nt, Human
uaccuccugagaa

SEQ ID NO: 2262296 - RNA, 17 nt, Human
uaccuccucagggaugg

SEQ ID NO: 2262297 - RNA, 23 nt, Human
uaccuccucagggauggccguug

SEQ ID NO: 2262298 - RNA, 16 nt, Human
uaccuccugcccagga

SEQ ID NO: 2262299 - RNA, 15 nt, Human
uaccuccugcccagg

SEQ ID NO: 2262300 - RNA, 14 nt, Human
uaccuccugucucu

SEQ ID NO: 2262301 - RNA, 15 nt, Human
uaccuccugucucug

SEQ ID NO: 2262302 - RNA, 13 nt, Human
uaccuccugccca

SEQ ID NO: 2262303 - RNA, 11 nt, Human
uaccuccugcc

SEQ ID NO: 2262304 - RNA, 14 nt, Human
uaccuccugagaaa

SEQ ID NO: 2262305 - RNA, 18 nt, Human
uaccucggugccuuccuc

SEQ ID NO: 2262306 - RNA, 17 nt, Human
uaccucucuuauagaau

SEQ ID NO: 2262307 - RNA, 21 nt, Human
uaccucucuuauagaauauuu

SEQ ID NO: 2262308 - RNA, 23 nt, Human
uaccucucuuauagaauauuuau

SEQ ID NO: 2262309 - RNA, 14 nt, Human
uaccucugauaccu

SEQ ID NO: 2262310 - RNA, 15 nt, Human
uaccucugauaccuc

SEQ ID NO: 2262311 - RNA, 17 nt, Human
uaccucugauaccucaa

SEQ ID NO: 2262312 - RNA, 21 nt, Human
uaccucuugagccuugaacuu

SEQ ID NO: 2262313 - RNA, 17 nt, Human
uaccucuuauugcaaaa

SEQ ID NO: 2262314 - RNA, 22 nt, Human
uaccuuacuguggaggaaggau

SEQ ID NO: 2262315 - RNA, 16 nt, Human
uaccuuagauuagcuc

SEQ ID NO: 2262316 - RNA, 20 nt, Human
uaccuuagauuagcucugga

SEQ ID NO: 2262317 - RNA, 12 nt, Human
uaccucugugug

SEQ ID NO: 2262318 - RNA, 14 nt, Human
uaccucugugugcu

SEQ ID NO: 2262319 - RNA, 14 nt, Human
uaccucuuagcuga

SEQ ID NO: 2262320 - RNA, 15 nt, Human
uaccucuuagcugag

SEQ ID NO: 2262321 - RNA, 16 nt, Human
uaccucuuagcugagu

SEQ ID NO: 2262322 - RNA, 14 nt, Human
uaccucuuauugca

SEQ ID NO: 2262323 - RNA, 15 nt, Human
uacuaagaaaagaua

SEQ ID NO: 2262324 - RNA, 14 nt, Human
uacuaagaagaaaa

SEQ ID NO: 2262325 - RNA, 15 nt, Human
uacuaagaagaaaau

SEQ ID NO: 2262326 - RNA, 15 nt, Human
uacuaaagaaagauu

SEQ ID NO: 2262327 - RNA, 16 nt, Human
uacuaaagaaagauua

SEQ ID NO: 2262328 - RNA, 13 nt, Human
uacuaacuuuccu

SEQ ID NO: 2262329 - RNA, 23 nt, Human
uacuaacaaucagcuccuuccug

SEQ ID NO: 2262330 - RNA, 18 nt, Human
uacuaaacauuuuguuau

SEQ ID NO: 2262331 - RNA, 14 nt, Human
uacuaaagaaagau

SEQ ID NO: 2262332 - RNA, 14 nt, Human
uacuaaggaaucuu

SEQ ID NO: 2262333 - RNA, 20 nt, Human
uacuaagcauagcaaacaga

SEQ ID NO: 2262334 - RNA, 18 nt, Human
uacuaaggaguaaucugu

SEQ ID NO: 2262335 - RNA, 22 nt, Human
uacuaagcuuugccagcugcug

SEQ ID NO: 2262336 - RNA, 15 nt, Human
uacuaagaugacauu

SEQ ID NO: 2262337 - RNA, 19 nt, Human
uacuaagaugacauugcua

SEQ ID NO: 2262338 - RNA, 21 nt, Human
uacuaauagacaauuuauuau

SEQ ID NO: 2262339 - RNA, 20 nt, Human
uacuaauagacaauuuauua

SEQ ID NO: 2262340 - RNA, 21 nt, Human
uaccuuuuuugauaaaguuuc

SEQ ID NO: 2262341 - RNA, 20 nt, Human
uaccuuuuuauuugcaugug

SEQ ID NO: 2262342 - RNA, 17 nt, Human
uaccuuuuuuauacaua

SEQ ID NO: 2262343 - RNA, 16 nt, Human
uaccuuuuuuauacau

SEQ ID NO: 2262344 - RNA, 13 nt, Human
uaccuuuuuuaua

SEQ ID NO: 2262345 - RNA, 18 nt, Human
uacgaaaagaggggaaga

SEQ ID NO: 2262346 - RNA, 21 nt, Human
uacgaaaagaggggaagagac

SEQ ID NO: 2262347 - RNA, 17 nt, Human
uaccuaauuagagcaga

SEQ ID NO: 2262348 - RNA, 20 nt, Human
uaccuaauuagagcagauga

SEQ ID NO: 2262349 - RNA, 23 nt, Human
uaccuacauguauuuguuugcau

SEQ ID NO: 2262350 - RNA, 13 nt, Human
uaccuacauguau

SEQ ID NO: 2262351 - RNA, 15 nt, Human
uaccuacauacaauu

SEQ ID NO: 2262352 - RNA, 15 nt, Human
uaccuaauuagagca

SEQ ID NO: 2262353 - RNA, 22 nt, Human
uaccuaaacagauauaaauggc

SEQ ID NO: 2262354 - RNA, 15 nt, Human
uaccuaacauuauuu

SEQ ID NO: 2262355 - RNA, 21 nt, Human
uaccuaaaagagauuucaaga

SEQ ID NO: 2262356 - RNA, 14 nt, Human
uaccuaaacagaua

SEQ ID NO: 2262357 - RNA, 15 nt, Human
uaccuaaacagauau

SEQ ID NO: 2262358 - RNA, 19 nt, Human
uaccuaaacagauauaaau

SEQ ID NO: 2262359 - RNA, 18 nt, Human
uaccuaccacagugucug

SEQ ID NO: 2262360 - RNA, 17 nt, Human
uaccuaccacagugucu

SEQ ID NO: 2262361 - RNA, 16 nt, Human
uaccuaccacaguguc

SEQ ID NO: 2262362 - RNA, 20 nt, Human
uaccuaccacagugucugua

SEQ ID NO: 2262363 - RNA, 13 nt, Human
uaccuacuuugac

SEQ ID NO: 2262364 - RNA, 13 nt, Human
uaccuagauuuac

SEQ ID NO: 2262365 - RNA, 21 nt, Human
uaccuacuuugacuuuuugca

SEQ ID NO: 2262366 - RNA, 14 nt, Human
uaccuacuuugacu

SEQ ID NO: 2262367 - RNA, 16 nt, Human
uaccuaucaucuuaag

SEQ ID NO: 2262368 - RNA, 19 nt, Human
uaccuauaaaguaaagcua

SEQ ID NO: 2262369 - RNA, 15 nt, Human
uaccucaggcaggaa

SEQ ID NO: 2262370 - RNA, 14 nt, Human
uaccucaggcagga

SEQ ID NO: 2262371 - RNA, 17 nt, Human
uaccucaggcagcucaa

SEQ ID NO: 2262372 - RNA, 18 nt, Human
uaccucaggcagcucaag

SEQ ID NO: 2262373 - RNA, 14 nt, Human
uaccucaggcagcu

SEQ ID NO: 2262374 - RNA, 16 nt, Human
uaccucaggcagcuca

SEQ ID NO: 2262375 - RNA, 13 nt, Human
uaccuccucaggg

SEQ ID NO: 2262376 - RNA, 15 nt, Human
uaccuccucagggau

SEQ ID NO: 2262377 - RNA, 21 nt, Human
uaccucagguugcugguugcu

SEQ ID NO: 2262378 - RNA, 12 nt, Human
uaccucagguug

SEQ ID NO: 2262379 - RNA, 14 nt, Human
uaccucagguugcu

SEQ ID NO: 2262380 - RNA, 20 nt, Human
uaccucagguugcugguugc

SEQ ID NO: 2262381 - RNA, 13 nt, Human
uaccucagucagu

SEQ ID NO: 2262382 - RNA, 14 nt, Human
uaccucagccuaga

SEQ ID NO: 2262383 - RNA, 12 nt, Human
uaccucagccua

SEQ ID NO: 2262384 - RNA, 16 nt, Human
uaccucagccuagacc

SEQ ID NO: 2262385 - RNA, 18 nt, Human
uaccucacccugcuacac

SEQ ID NO: 2262386 - RNA, 15 nt, Human
uaccucacugggguc

SEQ ID NO: 2262387 - RNA, 11 nt, Human
uaccucagccu

SEQ ID NO: 2262388 - RNA, 15 nt, Human
uaccucacccugcua

SEQ ID NO: 2262389 - RNA, 16 nt, Human
uaccuagauuuacagc

SEQ ID NO: 2262390 - RNA, 23 nt, Human
uaccuauauaauaaagcuacuga

SEQ ID NO: 2262391 - RNA, 13 nt, Human
uaccuauguaaca

SEQ ID NO: 2262392 - RNA, 20 nt, Human
uaccuauuuucauuguaaaa

SEQ ID NO: 2262393 - RNA, 13 nt, Human
uaccuauuuucau

SEQ ID NO: 2262394 - RNA, 17 nt, Human
uaccucaaccuauggua

SEQ ID NO: 2262395 - RNA, 22 nt, Human
uaccucaacccccauuucuauu

SEQ ID NO: 2262396 - RNA, 16 nt, Human
uacauggccaguguga

SEQ ID NO: 2262397 - RNA, 22 nt, Human
uacauggcagaguuuguguguu

SEQ ID NO: 2262398 - RNA, 14 nt, Human
uacauuuuuacaau

SEQ ID NO: 2262399 - RNA, 15 nt, Human
uacauuuuuacaaua

SEQ ID NO: 2262400 - RNA, 16 nt, Human
uacauuuuuacaauaa

SEQ ID NO: 2262401 - RNA, 23 nt, Human
uacauuuuuaagugcugcauuua

SEQ ID NO: 2262402 - RNA, 21 nt, Human
uacauuuuuacaauaaauaau

SEQ ID NO: 2262403 - RNA, 17 nt, Human
uacauuuuuacaauaaa

SEQ ID NO: 2262404 - RNA, 19 nt, Human
uacauuuuuacaauaaaua

SEQ ID NO: 2262405 - RNA, 15 nt, Human
uacccacugcucugg

SEQ ID NO: 2262406 - RNA, 22 nt, Human
uaccaaaaaucucaauauuuca

SEQ ID NO: 2262407 - RNA, 16 nt, Human
uacccagagaagcccc

SEQ ID NO: 2262408 - RNA, 21 nt, Human
uacccacuucuaaauagcaau

SEQ ID NO: 2262409 - RNA, 18 nt, Human
uacccagagaagccccuu

SEQ ID NO: 2262410 - RNA, 19 nt, Human
uacccagagaagccccuuc

SEQ ID NO: 2262411 - RNA, 21 nt, Human
uacccagagaagccccuuccc

SEQ ID NO: 2262412 - RNA, 15 nt, Human
uacccagagaauaua

SEQ ID NO: 2262413 - RNA, 20 nt, Human
uacccagagaauauauacau

SEQ ID NO: 2262414 - RNA, 13 nt, Human
uacccagagcauu

SEQ ID NO: 2262415 - RNA, 14 nt, Human
uacccagccaucug

SEQ ID NO: 2262416 - RNA, 23 nt, Human
uaccuaaaaggaaaucucacccc

SEQ ID NO: 2262417 - RNA, 22 nt, Human
uaccuaaaaggaaaucucaccc

SEQ ID NO: 2262418 - RNA, 19 nt, Human
uaccuaaaaggaaaucuca

SEQ ID NO: 2262419 - RNA, 14 nt, Human
uaccguuucuuccc

SEQ ID NO: 2262420 - RNA, 15 nt, Human
uaccguuucuucccu

SEQ ID NO: 2262421 - RNA, 22 nt, Human
uaccuaacgaaguauccuucag

SEQ ID NO: 2262422 - RNA, 22 nt, Human
uaccgagucucuucuccacugg

SEQ ID NO: 2262423 - RNA, 14 nt, Human
uaccgcguuguaaa

SEQ ID NO: 2262424 - RNA, 16 nt, Human
uaccgcguuguaaaau

SEQ ID NO: 2262425 - RNA, 15 nt, Human
uaccgcguuguaaaa

SEQ ID NO: 2262426 - RNA, 19 nt, Human
uaccgugagcgacaaagau

SEQ ID NO: 2262427 - RNA, 20 nt, Human
uacccagccaucugcccagg

SEQ ID NO: 2262428 - RNA, 23 nt, Human
uacccagccaucugcccaggggu

SEQ ID NO: 2262429 - RNA, 16 nt, Human
uacccagccaucugcc

SEQ ID NO: 2262430 - RNA, 17 nt, Human
uacccagccaucugccc

SEQ ID NO: 2262431 - RNA, 18 nt, Human
uacccagccaucugccca

SEQ ID NO: 2262432 - RNA, 19 nt, Human
uacccagccaucugcccag

SEQ ID NO: 2262433 - RNA, 17 nt, Human
uaccgaaaccuugccuu

SEQ ID NO: 2262434 - RNA, 18 nt, Human
uaccgaaaccuugccuuu

SEQ ID NO: 2262435 - RNA, 19 nt, Human
uaccgaaaccuugccuuuc

SEQ ID NO: 2262436 - RNA, 17 nt, Human
uaccgagucucuucucc

SEQ ID NO: 2262437 - RNA, 18 nt, Human
uaccgagucucuucucca

SEQ ID NO: 2262438 - RNA, 21 nt, Human
uaccgagucucuucuccacug

SEQ ID NO: 2262439 - RNA, 17 nt, Human
uagaccuuguuacuucu

SEQ ID NO: 2262440 - RNA, 19 nt, Human
uagaccuuguuacuucuga

SEQ ID NO: 2262441 - RNA, 23 nt, Human
uagacuaaggccauuauuguacu

SEQ ID NO: 2262442 - RNA, 19 nt, Human
uagacucaucuuacuguac

SEQ ID NO: 2262443 - RNA, 17 nt, Human
uagacucaucuuacugu

SEQ ID NO: 2262444 - RNA, 18 nt, Human
uagacucaucuuacugua

SEQ ID NO: 2262445 - RNA, 21 nt, Human
uagacucaucuuacuguaccu

SEQ ID NO: 2262446 - RNA, 18 nt, Human
uagacuucgacucaggau

SEQ ID NO: 2262447 - RNA, 18 nt, Human
uagacuuaauagaaacau

SEQ ID NO: 2262448 - RNA, 20 nt, Human
uagacuucgacucaggaucc

SEQ ID NO: 2262449 - RNA, 22 nt, Human
uagacuucgacucaggauccag

SEQ ID NO: 2262450 - RNA, 19 nt, Human
uagacuucugcuuuccaca

SEQ ID NO: 2262451 - RNA, 22 nt, Human
uagacuucugcuuuccacaccu

SEQ ID NO: 2262452 - RNA, 23 nt, Human
uagacuguugggguggguauaaa

SEQ ID NO: 2262453 - RNA, 17 nt, Human
uagacucuuacuuuuua

SEQ ID NO: 2262454 - RNA, 20 nt, Human
uagacucuuacuuuuuaaaa

SEQ ID NO: 2262455 - RNA, 13 nt, Human
uagacucuuacuu

SEQ ID NO: 2262456 - RNA, 16 nt, Human
uagacucuuacuuuuu

SEQ ID NO: 2262457 - RNA, 23 nt, Human
uagaccauuuaucugggauuaug

SEQ ID NO: 2262458 - RNA, 15 nt, Human
uagacccaucuucuu

SEQ ID NO: 2262459 - RNA, 20 nt, Human
uagacccacuggacucaccu

SEQ ID NO: 2262460 - RNA, 22 nt, Human
uagaccacaaauagugcucgcu

SEQ ID NO: 2262461 - RNA, 21 nt, Human
uagaauucccucucucugacu

SEQ ID NO: 2262462 - RNA, 16 nt, Human
uagaauuccuucaggg

SEQ ID NO: 2262463 - RNA, 23 nt, Human
uagaauuccuucagggugaugcc

SEQ ID NO: 2262464 - RNA, 16 nt, Human
uagaauucuagugcug

SEQ ID NO: 2262465 - RNA, 18 nt, Human
uagaauucuagugcugcu

SEQ ID NO: 2262466 - RNA, 19 nt, Human
uagaauucuagugcugcug

SEQ ID NO: 2262467 - RNA, 20 nt, Human
uagaauucuagugcugcuga

SEQ ID NO: 2262468 - RNA, 22 nt, Human
uagaauucuagugcugcugaag

SEQ ID NO: 2262469 - RNA, 11 nt, Human
uagagacaggg

SEQ ID NO: 2262470 - RNA, 22 nt, Human
uagagaaggacccggaggggcc

SEQ ID NO: 2262471 - RNA, 19 nt, Human
uagagaaguauacauaagu

SEQ ID NO: 2262472 - RNA, 13 nt, Human
uagagaaggaccc

SEQ ID NO: 2262473 - RNA, 21 nt, Human
uagagacagaagcaggcugga

SEQ ID NO: 2262474 - RNA, 23 nt, Human
uagagguaccagcaauauguaaa

SEQ ID NO: 2262475 - RNA, 14 nt, Human
uagagacagaagca

SEQ ID NO: 2262476 - RNA, 15 nt, Human
uagagacagaagcag

SEQ ID NO: 2262477 - RNA, 18 nt, Human
uagagacagaagcaggcu

SEQ ID NO: 2262478 - RNA, 15 nt, Human
uagagguucaaagau

SEQ ID NO: 2262479 - RNA, 14 nt, Human
uagagguucaaaga

SEQ ID NO: 2262480 - RNA, 12 nt, Human
uagagugggagc

SEQ ID NO: 2262481 - RNA, 15 nt, Human
uagagugagggccug

SEQ ID NO: 2262482 - RNA, 16 nt, Human
uagagugagggccuga

SEQ ID NO: 2262483 - RNA, 15 nt, Human
uagagugucuuucca

SEQ ID NO: 2262484 - RNA, 19 nt, Human
uagagugagggccugaggu

SEQ ID NO: 2262485 - RNA, 13 nt, Human
uagaguccucacu

SEQ ID NO: 2262486 - RNA, 16 nt, Human
uagaggugagggaagc

SEQ ID NO: 2262487 - RNA, 20 nt, Human
uagaguccucacucccaguc

SEQ ID NO: 2262488 - RNA, 17 nt, Human
uagagucugaacagcug

SEQ ID NO: 2262489 - RNA, 14 nt, Human
uagaguccucacuc

SEQ ID NO: 2262490 - RNA, 17 nt, Human
uagaguugauacuacag

SEQ ID NO: 2262491 - RNA, 14 nt, Human
uagaguugauacua

SEQ ID NO: 2262492 - RNA, 13 nt, Human
uagaguuagacug

SEQ ID NO: 2262493 - RNA, 14 nt, Human
uagaguuagacugu

SEQ ID NO: 2262494 - RNA, 16 nt, Human
uagaguuaagaagcug

SEQ ID NO: 2262495 - RNA, 17 nt, Human
uagaguuaagaagcugu

SEQ ID NO: 2262496 - RNA, 19 nt, Human
uagaguuaagaagcuguug

SEQ ID NO: 2262497 - RNA, 23 nt, Human
uagaguuaagaagcuguuguaca

SEQ ID NO: 2262498 - RNA, 16 nt, Human
uagaguguuguugaga

SEQ ID NO: 2262499 - RNA, 18 nt, Human
uagaguguuguugagaau

SEQ ID NO: 2262500 - RNA, 15 nt, Human
uagaguuaacaauga

SEQ ID NO: 2262501 - RNA, 17 nt, Human
uagaguuaacaaugaua

SEQ ID NO: 2262502 - RNA, 12 nt, Human
uagaguuaagaa

SEQ ID NO: 2262503 - RNA, 13 nt, Human
uagaguuaagaag

SEQ ID NO: 2262504 - RNA, 15 nt, Human
uagaguuaagaagcu

SEQ ID NO: 2262505 - RNA, 13 nt, Human
uacuuguucaaaa

SEQ ID NO: 2262506 - RNA, 23 nt, Human
uacuuguggacuaaaagauauaa

SEQ ID NO: 2262507 - RNA, 20 nt, Human
uacuuguggacuaaaagaua

SEQ ID NO: 2262508 - RNA, 22 nt, Human
uacuuguggacuaaaagauaua

SEQ ID NO: 2262509 - RNA, 22 nt, Human
uacuuguucaaaauauguucuu

SEQ ID NO: 2262510 - RNA, 14 nt, Human
uacuuguggacaca

SEQ ID NO: 2262511 - RNA, 15 nt, Human
uacuuguggacuaaa

SEQ ID NO: 2262512 - RNA, 16 nt, Human
uacuuguggacuaaaa

SEQ ID NO: 2262513 - RNA, 19 nt, Human
uacuuguggacuaaaagau

SEQ ID NO: 2262514 - RNA, 20 nt, Human
uagaagugggccaggacagg

SEQ ID NO: 2262515 - RNA, 16 nt, Human
uagaagugggccagga

SEQ ID NO: 2262516 - RNA, 20 nt, Human
uagaaguggaccaggacagg

SEQ ID NO: 2262517 - RNA, 19 nt, Human
uagaaguggaccaggacag

SEQ ID NO: 2262518 - RNA, 18 nt, Human
uagaaguggaccaggaca

SEQ ID NO: 2262519 - RNA, 16 nt, Human
uagaaguggaccagga

SEQ ID NO: 2262520 - RNA, 21 nt, Human
uacuuuaaaggaaaaaauguu

SEQ ID NO: 2262521 - RNA, 14 nt, Human
uacuuuaaaggaaa

SEQ ID NO: 2262522 - RNA, 15 nt, Human
uacuuuaaaggaaaa

SEQ ID NO: 2262523 - RNA, 20 nt, Human
uacuuuaaaggaaaaaaugu

SEQ ID NO: 2262524 - RNA, 18 nt, Human
uagaauauaauuaucgga

SEQ ID NO: 2262525 - RNA, 15 nt, Human
uagaauauaauuauc

SEQ ID NO: 2262526 - RNA, 23 nt, Human
uagaauaguguucugcaaaaaua

SEQ ID NO: 2262527 - RNA, 12 nt, Human
uagaauauuuau

SEQ ID NO: 2262528 - RNA, 15 nt, Human
uagaauauuuauuac

SEQ ID NO: 2262529 - RNA, 19 nt, Human
uagaauauuuauuaccucu

SEQ ID NO: 2262530 - RNA, 21 nt, Human
uagaaucagccuaggggucag

SEQ ID NO: 2262531 - RNA, 14 nt, Human
uagaauccaaacuu

SEQ ID NO: 2262532 - RNA, 20 nt, Human
uagaauauuuauuaccucug

SEQ ID NO: 2262533 - RNA, 16 nt, Human
uagaauauccuacuuc

SEQ ID NO: 2262534 - RNA, 19 nt, Human
uagaagugggccaggacag

SEQ ID NO: 2262535 - RNA, 15 nt, Human
uagaaguuacugaau

SEQ ID NO: 2262536 - RNA, 20 nt, Human
uagaaguuacugaaugcacc

SEQ ID NO: 2262537 - RNA, 16 nt, Human
uagaaguuacugaaug

SEQ ID NO: 2262538 - RNA, 18 nt, Human
uagaaguuguuugucauc

SEQ ID NO: 2262539 - RNA, 13 nt, Human
uagaaguuuuugu

SEQ ID NO: 2262540 - RNA, 14 nt, Human
uagaaguuuuugua

SEQ ID NO: 2262541 - RNA, 16 nt, Human
uagaaguuuuuguacu

SEQ ID NO: 2262542 - RNA, 18 nt, Human
uagaaguuuuuguacugu

SEQ ID NO: 2262543 - RNA, 22 nt, Human
uagaaguuuuuguacuguaaag

SEQ ID NO: 2262544 - RNA, 14 nt, Human
uagaauaaaauugu

SEQ ID NO: 2262545 - RNA, 23 nt, Human
uagaauaccacaggaaccacaag

SEQ ID NO: 2262546 - RNA, 15 nt, Human
uagaauaaaauugua

SEQ ID NO: 2262547 - RNA, 19 nt, Human
uagaauaaaauuguaaaau

SEQ ID NO: 2262548 - RNA, 12 nt, Human
uagaauuauuua

SEQ ID NO: 2262549 - RNA, 15 nt, Human
uagaauuauuuaaac

SEQ ID NO: 2262550 - RNA, 15 nt, Human
uagaauucccucucu

SEQ ID NO: 2262551 - RNA, 19 nt, Human
uagaauucccucucucuga

SEQ ID NO: 2262552 - RNA, 20 nt, Human
uagaauucccucucucugac

SEQ ID NO: 2262553 - RNA, 16 nt, Human
uagaauuauuuaaaca

SEQ ID NO: 2262554 - RNA, 23 nt, Human
uagaauuaguggcacuugcuuuu

SEQ ID NO: 2262555 - RNA, 18 nt, Human
uagaauuaacacaugauc

SEQ ID NO: 2262556 - RNA, 16 nt, Human
uagaauuaacacauga

SEQ ID NO: 2262557 - RNA, 15 nt, Human
uagaauuaacacaug

SEQ ID NO: 2262558 - RNA, 17 nt, Human
uagaaugaaaacucauu

SEQ ID NO: 2262559 - RNA, 12 nt, Human
uagaaucuggag

SEQ ID NO: 2262560 - RNA, 12 nt, Human
uagaaugaaaau

SEQ ID NO: 2262561 - RNA, 20 nt, Human
uagaaugaaaauuguauguu

SEQ ID NO: 2262562 - RNA, 21 nt, Human
uagaaugauuucaugcuaucu

SEQ ID NO: 2262563 - RNA, 23 nt, Human
uagaauccaaacuuggauuuuug

SEQ ID NO: 2262564 - RNA, 15 nt, Human
uagaauccaaacuug

SEQ ID NO: 2262565 - RNA, 16 nt, Human
uagaaugauuucaugc

SEQ ID NO: 2262566 - RNA, 18 nt, Human
uagaauguguuuucugaa

SEQ ID NO: 2262567 - RNA, 20 nt, Human
uagaauguguuuucugaaua

SEQ ID NO: 2262568 - RNA, 13 nt, Human
uagaauguguuuu

SEQ ID NO: 2262569 - RNA, 22 nt, Human
uagaauguauuguaccuuuuaa

SEQ ID NO: 2262570 - RNA, 17 nt, Human
uagaauguauuguaccu

SEQ ID NO: 2262571 - RNA, 18 nt, Human
uagaauguauuguaccuu

SEQ ID NO: 2262572 - RNA, 13 nt, Human
uagaauguauugu

SEQ ID NO: 2262573 - RNA, 16 nt, Human
uagaauguauuguacc

SEQ ID NO: 2262574 - RNA, 19 nt, Human
uagccgagagccugcuccc

SEQ ID NO: 2262575 - RNA, 19 nt, Human
uagccgggcaugguggcgc

SEQ ID NO: 2262576 - RNA, 18 nt, Human
uagccgagagccugcucc

SEQ ID NO: 2262577 - RNA, 17 nt, Human
uagccgagagccugcuc

SEQ ID NO: 2262578 - RNA, 15 nt, Human
uagccgagagccugc

SEQ ID NO: 2262579 - RNA, 14 nt, Human
uagccgagagccug

SEQ ID NO: 2262580 - RNA, 17 nt, Human
uagccgaccucagccuu

SEQ ID NO: 2262581 - RNA, 16 nt, Human
uagccgaccucagccu

SEQ ID NO: 2262582 - RNA, 12 nt, Human
uagcccgccugc

SEQ ID NO: 2262583 - RNA, 16 nt, Human
uagccuaggugacaga

SEQ ID NO: 2262584 - RNA, 20 nt, Human
uagccuaacacacuccaaga

SEQ ID NO: 2262585 - RNA, 18 nt, Human
uagcccccaggcugcugg

SEQ ID NO: 2262586 - RNA, 18 nt, Human
uagcccccacccacuucc

SEQ ID NO: 2262587 - RNA, 15 nt, Human
uagcccccacccacu

SEQ ID NO: 2262588 - RNA, 19 nt, Human
uagcccccaggcugcugga

SEQ ID NO: 2262589 - RNA, 15 nt, Human
uagcccccuggccuc

SEQ ID NO: 2262590 - RNA, 18 nt, Human
uagcccccuggccucugu

SEQ ID NO: 2262591 - RNA, 17 nt, Human
uagcccccuggccucug

SEQ ID NO: 2262592 - RNA, 16 nt, Human
uagcccccuggccucu

SEQ ID NO: 2262593 - RNA, 18 nt, Human
uagccccuuagcccccac

SEQ ID NO: 2262594 - RNA, 15 nt, Human
uagcccgaauacaaa

SEQ ID NO: 2262595 - RNA, 16 nt, Human
uagcccgaauacaaac

SEQ ID NO: 2262596 - RNA, 16 nt, Human
uagccccucuccugga

SEQ ID NO: 2262597 - RNA, 20 nt, Human
uagcaugacaagccccaggc

SEQ ID NO: 2262598 - RNA, 18 nt, Human
uagcaugacaagccccag

SEQ ID NO: 2262599 - RNA, 17 nt, Human
uagcaugacaagcccca

SEQ ID NO: 2262600 - RNA, 16 nt, Human
uagcaugacaagcccc

SEQ ID NO: 2262601 - RNA, 22 nt, Human
uagcaugacaagccccaggcag

SEQ ID NO: 2262602 - RNA, 21 nt, Human
uagcaugacaagccccaggca

SEQ ID NO: 2262603 - RNA, 16 nt, Human
uagcaugacauuucuu

SEQ ID NO: 2262604 - RNA, 15 nt, Human
uagcaugacauuucu

SEQ ID NO: 2262605 - RNA, 19 nt, Human
uagcaugaggccacugcug

SEQ ID NO: 2262606 - RNA, 22 nt, Human
uagccaggguguggcccugcca

SEQ ID NO: 2262607 - RNA, 16 nt, Human
uagccaguugaauuua

SEQ ID NO: 2262608 - RNA, 13 nt, Human
uagccccauaauu

SEQ ID NO: 2262609 - RNA, 13 nt, Human
uagccaggaucau

SEQ ID NO: 2262610 - RNA, 15 nt, Human
uagccaggaucaugg

SEQ ID NO: 2262611 - RNA, 18 nt, Human
uagccaggaucauggugu

SEQ ID NO: 2262612 - RNA, 20 nt, Human
uagccaggaucaugguguaa

SEQ ID NO: 2262613 - RNA, 22 nt, Human
uagccaggaucaugguguaaua

SEQ ID NO: 2262614 - RNA, 23 nt, Human
uagccaggaucaugguguaauaa

SEQ ID NO: 2262615 - RNA, 22 nt, Human
uagccagggggacuagccccug

SEQ ID NO: 2262616 - RNA, 18 nt, Human
uagccagcugcuccccag

SEQ ID NO: 2262617 - RNA, 15 nt, Human
uagccagcugcuccc

SEQ ID NO: 2262618 - RNA, 14 nt, Human
uagccagcugcucc

SEQ ID NO: 2262619 - RNA, 20 nt, Human
uagccagcacacagggcagu

SEQ ID NO: 2262620 - RNA, 19 nt, Human
uagccagcacuuguauaua

SEQ ID NO: 2262621 - RNA, 20 nt, Human
uagccuaauacaacauguag

SEQ ID NO: 2262622 - RNA, 17 nt, Human
uagccugggccacaggg

SEQ ID NO: 2262623 - RNA, 14 nt, Human
uagccugggguggg

SEQ ID NO: 2262624 - RNA, 22 nt, Human
uagccuggauauuauucuugua

SEQ ID NO: 2262625 - RNA, 20 nt, Human
uagccugugccucugggacu

SEQ ID NO: 2262626 - RNA, 18 nt, Human
uagccugugccucuggga

SEQ ID NO: 2262627 - RNA, 11 nt, Human
uagcucaguuu

SEQ ID NO: 2262628 - RNA, 12 nt, Human
uagcucauucuc

SEQ ID NO: 2262629 - RNA, 20 nt, Human
uagcucaggugucccugcac

SEQ ID NO: 2262630 - RNA, 21 nt, Human
uagcucaggugucccugcacu

SEQ ID NO: 2262631 - RNA, 11 nt, Human
uagcugagugu

SEQ ID NO: 2262632 - RNA, 17 nt, Human
uagcugagcgugguggc

SEQ ID NO: 2262633 - RNA, 21 nt, Human
uagcugaugaacuuauucugu

SEQ ID NO: 2262634 - RNA, 23 nt, Human
uagcugaugaacuuauucuguag

SEQ ID NO: 2262635 - RNA, 12 nt, Human
uagcugcagaac

SEQ ID NO: 2262636 - RNA, 11 nt, Human
uagcugcagaa

SEQ ID NO: 2262637 - RNA, 21 nt, Human
uagcugcauccuccaagaauc

SEQ ID NO: 2262638 - RNA, 17 nt, Human
uagcugcaaaggacaga

SEQ ID NO: 2262639 - RNA, 23 nt, Human
uagcugcacagggcagcugggcc

SEQ ID NO: 2262640 - RNA, 16 nt, Human
uagcugcaaaggacag

SEQ ID NO: 2262641 - RNA, 21 nt, Human
uagcugacccagccccuugag

SEQ ID NO: 2262642 - RNA, 23 nt, Human
uagcugacccagccccuugagaa

SEQ ID NO: 2262643 - RNA, 12 nt, Human
uagcucaguuua

SEQ ID NO: 2262644 - RNA, 12 nt, Human
uagcugggacua

SEQ ID NO: 2262645 - RNA, 15 nt, Human
uagcugggacuacag

SEQ ID NO: 2262646 - RNA, 17 nt, Human
uagcugggacuacaggc

SEQ ID NO: 2262647 - RNA, 19 nt, Human
uagcugggacuacaggcac

SEQ ID NO: 2262648 - RNA, 11 nt, Human
uagauagaaau

SEQ ID NO: 2262649 - RNA, 21 nt, Human
uagauagaaauaaauagcuau

SEQ ID NO: 2262650 - RNA, 12 nt, Human
uagauagaaaua

SEQ ID NO: 2262651 - RNA, 23 nt, Human
uagauagaaauaaauagcuauau

SEQ ID NO: 2262652 - RNA, 14 nt, Human
uagauaggccaugg

SEQ ID NO: 2262653 - RNA, 16 nt, Human
uagauacuguaucaug

SEQ ID NO: 2262654 - RNA, 17 nt, Human
uagaguuagacuguugg

SEQ ID NO: 2262655 - RNA, 15 nt, Human
uagaguuagacuguu

SEQ ID NO: 2262656 - RNA, 16 nt, Human
uagaguuagacuguug

SEQ ID NO: 2262657 - RNA, 21 nt, Human
uagauuacccccucauuguuu

SEQ ID NO: 2262658 - RNA, 17 nt, Human
uagauuauggagcuuuu

SEQ ID NO: 2262659 - RNA, 20 nt, Human
uagauuagaucuuuuaagcc

SEQ ID NO: 2262660 - RNA, 14 nt, Human
uagauuagcucugg

SEQ ID NO: 2262661 - RNA, 15 nt, Human
uagauuagcucugga

SEQ ID NO: 2262662 - RNA, 16 nt, Human
uagauuauggagcuuu

SEQ ID NO: 2262663 - RNA, 16 nt, Human
uagauuagcucuggac

SEQ ID NO: 2262664 - RNA, 18 nt, Human
uagauuagcucuggacca

SEQ ID NO: 2262665 - RNA, 24 nt, Human
uagauuuggcuccucugcuucuca

SEQ ID NO: 2262666 - RNA, 12 nt, Human
uagauuugaccu

SEQ ID NO: 2262667 - RNA, 13 nt, Human
uagauuugaccua

SEQ ID NO: 2262668 - RNA, 20 nt, Human
uagauuuggcuccucugcuu

SEQ ID NO: 2262669 - RNA, 15 nt, Human
uagauuuauuucauc

SEQ ID NO: 2262670 - RNA, 14 nt, Human
uagauuuauuucau

SEQ ID NO: 2262671 - RNA, 23 nt, Human
uagauuccccauugccuccuccu

SEQ ID NO: 2262672 - RNA, 14 nt, Human
uagcauaucugccu

SEQ ID NO: 2262673 - RNA, 16 nt, Human
uagcauaucugccuuu

SEQ ID NO: 2262674 - RNA, 17 nt, Human
uagcauaucugccuuua

SEQ ID NO: 2262675 - RNA, 22 nt, Human
uagcaggacugaauugucccca

SEQ ID NO: 2262676 - RNA, 12 nt, Human
uagcagcuggac

SEQ ID NO: 2262677 - RNA, 17 nt, Human
uagcaggagaggagagc

SEQ ID NO: 2262678 - RNA, 19 nt, Human
uagcaggagaggagagcca

SEQ ID NO: 2262679 - RNA, 21 nt, Human
uagcaggagaggagagccaga

SEQ ID NO: 2262680 - RNA, 22 nt, Human
uagcaggagaggagagccagag

SEQ ID NO: 2262681 - RNA, 14 nt, Human
uagcauaugaguuu

SEQ ID NO: 2262682 - RNA, 12 nt, Human
uagcauaucaau

SEQ ID NO: 2262683 - RNA, 18 nt, Human
uagcauaucugccuuuau

SEQ ID NO: 2262684 - RNA, 21 nt, Human
uagcauaucugccuuuauugu

SEQ ID NO: 2262685 - RNA, 22 nt, Human
uagcauaucugccuuuauugug

SEQ ID NO: 2262686 - RNA, 23 nt, Human
uagcauaucugccuuuauugugu

SEQ ID NO: 2262687 - RNA, 13 nt, Human
uagcaucuucugg

SEQ ID NO: 2262688 - RNA, 16 nt, Human
uagcaucuucuggagu

SEQ ID NO: 2262689 - RNA, 22 nt, Human
uagcaucuucuggagucuccag

SEQ ID NO: 2262690 - RNA, 23 nt, Human
uagcaucuucuggagucuccagu

SEQ ID NO: 2262691 - RNA, 22 nt, Human
uagcagcggaacaaggagucag

SEQ ID NO: 2262692 - RNA, 11 nt, Human
uagcagggaaa

SEQ ID NO: 2262693 - RNA, 14 nt, Human
uagcagcuaucucu

SEQ ID NO: 2262694 - RNA, 10 nt, Human
uagcagcugg

SEQ ID NO: 2262695 - RNA, 11 nt, Human
uagcagcugga

SEQ ID NO: 2262696 - RNA, 14 nt, Human
uagcagcuuccaga

SEQ ID NO: 2262697 - RNA, 15 nt, Human
uagcagcuuccagau

SEQ ID NO: 2262698 - RNA, 19 nt, Human
uagcauacguacacauuuu

SEQ ID NO: 2262699 - RNA, 18 nt, Human
uagcauacguacacauuu

SEQ ID NO: 2262700 - RNA, 17 nt, Human
uagcauacguacacauu

SEQ ID NO: 2262701 - RNA, 16 nt, Human
uagcauacguacacau

SEQ ID NO: 2262702 - RNA, 16 nt, Human
uaguagcccuuucugu

SEQ ID NO: 2262703 - RNA, 14 nt, Human
uaguagcauguuga

SEQ ID NO: 2262704 - RNA, 17 nt, Human
uaguagcccuuucugug

SEQ ID NO: 2262705 - RNA, 18 nt, Human
uaguagcccuuucugugu

SEQ ID NO: 2262706 - RNA, 19 nt, Human
uaguagcccuuucugugug

SEQ ID NO: 2262707 - RNA, 18 nt, Human
uaguaugaggcauuuguu

SEQ ID NO: 2262708 - RNA, 17 nt, Human
uaguaugaggcauuugu

SEQ ID NO: 2262709 - RNA, 12 nt, Human
uaguagauuuua

SEQ ID NO: 2262710 - RNA, 12 nt, Human
uagguucuaaaa

SEQ ID NO: 2262711 - RNA, 15 nt, Human
uagguucagccaagg

SEQ ID NO: 2262712 - RNA, 17 nt, Human
uaggugugggggaagca

SEQ ID NO: 2262713 - RNA, 13 nt, Human
uagguguggggga

SEQ ID NO: 2262714 - RNA, 16 nt, Human
uaggugucauuuccau

SEQ ID NO: 2262715 - RNA, 22 nt, Human
uagguuaauuccaauuauauga

SEQ ID NO: 2262716 - RNA, 22 nt, Human
uagguguugauuuucuguugua

SEQ ID NO: 2262717 - RNA, 17 nt, Human
uagguuaaaaaaaggca

SEQ ID NO: 2262718 - RNA, 14 nt, Human
uagguucagccaag

SEQ ID NO: 2262719 - RNA, 23 nt, Human
uaggugggccagccccucccacc

SEQ ID NO: 2262720 - RNA, 21 nt, Human
uaggugggccagccccuccca

SEQ ID NO: 2262721 - RNA, 20 nt, Human
uaggugggccagccccuccc

SEQ ID NO: 2262722 - RNA, 19 nt, Human
uaggugggccagccccucc

SEQ ID NO: 2262723 - RNA, 16 nt, Human
uaggugggccagcccc

SEQ ID NO: 2262724 - RNA, 16 nt, Human
uagguggcaaggcugu

SEQ ID NO: 2262725 - RNA, 15 nt, Human
uagguggcaaggcug

SEQ ID NO: 2262726 - RNA, 19 nt, Human
uaggugugacugaauuucu

SEQ ID NO: 2262727 - RNA, 23 nt, Human
uaggugugacugaauuucuuuug

SEQ ID NO: 2262728 - RNA, 21 nt, Human
uaggugugacugaauuucuuu

SEQ ID NO: 2262729 - RNA, 19 nt, Human
uaggcuggagcccagggag

SEQ ID NO: 2262730 - RNA, 16 nt, Human
uaggcuggagcccagg

SEQ ID NO: 2262731 - RNA, 16 nt, Human
uaggcugguggcccag

SEQ ID NO: 2262732 - RNA, 15 nt, Human
uaggcugguggccca

SEQ ID NO: 2262733 - RNA, 19 nt, Human
uaggcugguggcccaggac

SEQ ID NO: 2262734 - RNA, 18 nt, Human
uaggcugguggcccagga

SEQ ID NO: 2262735 - RNA, 18 nt, Human
uaggcuuaguuugugugu

SEQ ID NO: 2262736 - RNA, 21 nt, Human
uagcugucugcucagacagaa

SEQ ID NO: 2262737 - RNA, 16 nt, Human
uagcuguauugaauca

SEQ ID NO: 2262738 - RNA, 17 nt, Human
uagcugucuagaguagc

SEQ ID NO: 2262739 - RNA, 12 nt, Human
uaggcuggagaa

SEQ ID NO: 2262740 - RNA, 14 nt, Human
uaggcuggagaagc

SEQ ID NO: 2262741 - RNA, 15 nt, Human
uaggcuggagaagcu

SEQ ID NO: 2262742 - RNA, 17 nt, Human
uaggcuggagaagcuca

SEQ ID NO: 2262743 - RNA, 19 nt, Human
uaggcuggagaagcucacc

SEQ ID NO: 2262744 - RNA, 21 nt, Human
uaggcuggagaagcucaccca

SEQ ID NO: 2262745 - RNA, 20 nt, Human
uagcugguuggagagcuaga

SEQ ID NO: 2262746 - RNA, 14 nt, Human
uagcuggugguuuc

SEQ ID NO: 2262747 - RNA, 17 nt, Human
uagcuggugguuucacg

SEQ ID NO: 2262748 - RNA, 23 nt, Human
uagcugcauccuccaagaaucua

SEQ ID NO: 2262749 - RNA, 20 nt, Human
uagcugggggugggccaggc

SEQ ID NO: 2262750 - RNA, 22 nt, Human
uagcuggucuuauuuguaaagc

SEQ ID NO: 2262751 - RNA, 22 nt, Human
uagcugguuuccucauuccuga

SEQ ID NO: 2262752 - RNA, 12 nt, Human
uagcuguaaggc

SEQ ID NO: 2262753 - RNA, 19 nt, Human
uagcuguaaggcaugaagg

SEQ ID NO: 2262754 - RNA, 17 nt, Human
uagcuguaaggcaugaa

SEQ ID NO: 2262755 - RNA, 15 nt, Human
uagcugucuagagua

SEQ ID NO: 2262756 - RNA, 12 nt, Human
uagcuguauuga

SEQ ID NO: 2262757 - RNA, 14 nt, Human
uagcuguauugaau

SEQ ID NO: 2262758 - RNA, 12 nt, Human
uagcuguacaaa

SEQ ID NO: 2262759 - RNA, 16 nt, Human
uagcuguacaaauaua

SEQ ID NO: 2262760 - RNA, 18 nt, Human
uagcuguacaaauauaag

SEQ ID NO: 2262761 - RNA, 16 nt, Human
uagguggaucaccuga

SEQ ID NO: 2262762 - RNA, 21 nt, Human
uaggucuuaauacacacaguu

SEQ ID NO: 2262763 - RNA, 23 nt, Human
uaggugcuacaaaaacacagcaa

SEQ ID NO: 2262764 - RNA, 22 nt, Human
uaggugcuacaaaaacacagca

SEQ ID NO: 2262765 - RNA, 20 nt, Human
uaggugcuacaaaaacacag

SEQ ID NO: 2262766 - RNA, 15 nt, Human
uaggucucaauaccu

SEQ ID NO: 2262767 - RNA, 11 nt, Human
uagggaaaaac

SEQ ID NO: 2262768 - RNA, 17 nt, Human
uaggucugauauucaaa

SEQ ID NO: 2262769 - RNA, 19 nt, Human
uaggucucggacuaagccu

SEQ ID NO: 2262770 - RNA, 14 nt, Human
uaggucucuucccc

SEQ ID NO: 2262771 - RNA, 11 nt, Human
uaggugacaga

SEQ ID NO: 2262772 - RNA, 16 nt, Human
uaggugacagagugag

SEQ ID NO: 2262773 - RNA, 14 nt, Human
uaguugaacugaua

SEQ ID NO: 2262774 - RNA, 15 nt, Human
uaguucuuuggaaau

SEQ ID NO: 2262775 - RNA, 18 nt, Human
uaguugaacugauaguua

SEQ ID NO: 2262776 - RNA, 20 nt, Human
uaguugaacugauaguuacu

SEQ ID NO: 2262777 - RNA, 22 nt, Human
uaguugaacugauaguuacugu

SEQ ID NO: 2262778 - RNA, 23 nt, Human
uaguggggucucccucuccugcc

SEQ ID NO: 2262779 - RNA, 13 nt, Human
uaguggucuuugu

SEQ ID NO: 2262780 - RNA, 14 nt, Human
uaguggucuuugua

SEQ ID NO: 2262781 - RNA, 15 nt, Human
uaguggucuuuguaa

SEQ ID NO: 2262782 - RNA, 22 nt, Human
uaguggggucucccucuccugc

SEQ ID NO: 2262783 - RNA, 21 nt, Human
uaguggggucucccucuccug

SEQ ID NO: 2262784 - RNA, 20 nt, Human
uaguggggucucccucuccu

SEQ ID NO: 2262785 - RNA, 18 nt, Human
uaguggggucucccucuc

SEQ ID NO: 2262786 - RNA, 16 nt, Human
uaguggucuuuguaag

SEQ ID NO: 2262787 - RNA, 18 nt, Human
uaguggucuuuguaagag

SEQ ID NO: 2262788 - RNA, 21 nt, Human
uaguuguuugauucagacagc

SEQ ID NO: 2262789 - RNA, 22 nt, Human
uaguuguuugauucagacagcu

SEQ ID NO: 2262790 - RNA, 16 nt, Human
uaguugagccagcaga

SEQ ID NO: 2262791 - RNA, 20 nt, Human
uaguuguuugauucagacag

SEQ ID NO: 2262792 - RNA, 16 nt, Human
uaguaugguggcuggg

SEQ ID NO: 2262793 - RNA, 15 nt, Human
uaguaugaggcauuu

SEQ ID NO: 2262794 - RNA, 17 nt, Human
uaguauuguccaggucu

SEQ ID NO: 2262795 - RNA, 20 nt, Human
uaguggcuuaaaacaacacu

SEQ ID NO: 2262796 - RNA, 13 nt, Human
uaguggcugucca

SEQ ID NO: 2262797 - RNA, 14 nt, Human
uaguggcuucaaaa

SEQ ID NO: 2262798 - RNA, 20 nt, Human
uaguggcuucauuagagcag

SEQ ID NO: 2262799 - RNA, 18 nt, Human
uagugggcaccccacugc

SEQ ID NO: 2262800 - RNA, 16 nt, Human
uaguauuuauuuaaug

SEQ ID NO: 2262801 - RNA, 23 nt, Human
uaguggauuacugccauucacuu

SEQ ID NO: 2262802 - RNA, 14 nt, Human
uauaaacacuauau

SEQ ID NO: 2262803 - RNA, 14 nt, Human
uaguuucuuuggga

SEQ ID NO: 2262804 - RNA, 17 nt, Human
uauaaacaucacacaca

SEQ ID NO: 2262805 - RNA, 18 nt, Human
uauaaacaucacacacac

SEQ ID NO: 2262806 - RNA, 22 nt, Human
uauaaacaugcuugcauuauau

SEQ ID NO: 2262807 - RNA, 14 nt, Human
uauaaacaucacac

SEQ ID NO: 2262808 - RNA, 15 nt, Human
uaguuugauuaaauu

SEQ ID NO: 2262809 - RNA, 17 nt, Human
uaguuuaccucuuuaaa

SEQ ID NO: 2262810 - RNA, 20 nt, Human
uaguuucuguucuguggaaa

SEQ ID NO: 2262811 - RNA, 12 nt, Human
uaguuucuugug

SEQ ID NO: 2262812 - RNA, 21 nt, Human
uaguuugauuaaauucuugca

SEQ ID NO: 2262813 - RNA, 16 nt, Human
uaguuugauuaaauuc

SEQ ID NO: 2262814 - RNA, 11 nt, Human
uauaaacuuua

SEQ ID NO: 2262815 - RNA, 15 nt, Human
uauaaaccuaaaaaa

SEQ ID NO: 2262816 - RNA, 16 nt, Human
uauaaaccuaaaaaag

SEQ ID NO: 2262817 - RNA, 14 nt, Human
uauaaacuuuaccu

SEQ ID NO: 2262818 - RNA, 13 nt, Human
uauaaacuuuacc

SEQ ID NO: 2262819 - RNA, 17 nt, Human
uauaaacuuuaccuuuu

SEQ ID NO: 2262820 - RNA, 18 nt, Human
uauaaaccuaaaaaagau

SEQ ID NO: 2262821 - RNA, 19 nt, Human
uauaaaccuaaaaaagaua

SEQ ID NO: 2262822 - RNA, 20 nt, Human
uauaaaccuaaaaaagauau

SEQ ID NO: 2262823 - RNA, 19 nt, Human
uauaaaccucuaauuuauu

SEQ ID NO: 2262824 - RNA, 16 nt, Human
uauaaacuuuaccuuu

SEQ ID NO: 2262825 - RNA, 15 nt, Human
uauaaacuuuaccuu

SEQ ID NO: 2262826 - RNA, 11 nt, Human
uauagaaaugc

SEQ ID NO: 2262827 - RNA, 17 nt, Human
uauagaacugaaugaga

SEQ ID NO: 2262828 - RNA, 18 nt, Human
uauagaacugaaugagaa

SEQ ID NO: 2262829 - RNA, 16 nt, Human
uauagacccgaggaaa

SEQ ID NO: 2262830 - RNA, 15 nt, Human
uauagagauaugcag

SEQ ID NO: 2262831 - RNA, 17 nt, Human
uauagagauaugcagaa

SEQ ID NO: 2262832 - RNA, 21 nt, Human
uauagagauaugcagaaggaa

SEQ ID NO: 2262833 - RNA, 11 nt, Human
uauagacucua

SEQ ID NO: 2262834 - RNA, 16 nt, Human
uauagacaaauaauaa

SEQ ID NO: 2262835 - RNA, 21 nt, Human
uauagaauauuuauuaccucu

SEQ ID NO: 2262836 - RNA, 15 nt, Human
uauagaauauuuauu

SEQ ID NO: 2262837 - RNA, 16 nt, Human
uauaaagguugacaau

SEQ ID NO: 2262838 - RNA, 23 nt, Human
uauaaacuuagugcggacaaguu

SEQ ID NO: 2262839 - RNA, 22 nt, Human
uauaaaccucuaauuuauuuug

SEQ ID NO: 2262840 - RNA, 19 nt, Human
uauaaacuaucaguuuguc

SEQ ID NO: 2262841 - RNA, 15 nt, Human
uauaaaguaaagcua

SEQ ID NO: 2262842 - RNA, 16 nt, Human
uauaaaguaaagcuaa

SEQ ID NO: 2262843 - RNA, 18 nt, Human
uauaaaguaguccuguga

SEQ ID NO: 2262844 - RNA, 16 nt, Human
uauaaaguaguccugu

SEQ ID NO: 2262845 - RNA, 18 nt, Human
uauaaauaaauauauaua

SEQ ID NO: 2262846 - RNA, 16 nt, Human
uauaaauaaauauaua

SEQ ID NO: 2262847 - RNA, 17 nt, Human
uauaaauaaauauauau

SEQ ID NO: 2262848 - RNA, 12 nt, Human
uauaaauaaaua

SEQ ID NO: 2262849 - RNA, 13 nt, Human
uauaaauaaauau

SEQ ID NO: 2262850 - RNA, 14 nt, Human
uauaaauaaauaua

SEQ ID NO: 2262851 - RNA, 15 nt, Human
uauaaauaaauauau

SEQ ID NO: 2262852 - RNA, 19 nt, Human
uauacuuuuuucuuauuua

SEQ ID NO: 2262853 - RNA, 21 nt, Human
uauacuuuuuucuuauuuaac

SEQ ID NO: 2262854 - RNA, 17 nt, Human
uauacuuuuuucuuauu

SEQ ID NO: 2262855 - RNA, 14 nt, Human
uauagaaacacgaa

SEQ ID NO: 2262856 - RNA, 13 nt, Human
uauaaauaggaga

SEQ ID NO: 2262857 - RNA, 17 nt, Human
uauaaauaggagaggau

SEQ ID NO: 2262858 - RNA, 11 nt, Human
uauacuuuuuu

SEQ ID NO: 2262859 - RNA, 20 nt, Human
uauagucccagcuacucaga

SEQ ID NO: 2262860 - RNA, 13 nt, Human
uauaguccagcuu

SEQ ID NO: 2262861 - RNA, 18 nt, Human
uauagugauguaaucuug

SEQ ID NO: 2262862 - RNA, 13 nt, Human
uauagugauguaa

SEQ ID NO: 2262863 - RNA, 23 nt, Human
uauaguuuuacuuuuaaacugug

SEQ ID NO: 2262864 - RNA, 22 nt, Human
uauaguuuuacuuuuaaacugu

SEQ ID NO: 2262865 - RNA, 12 nt, Human
uauauaaaaaga

SEQ ID NO: 2262866 - RNA, 18 nt, Human
uauauaaaaagaaaagau

SEQ ID NO: 2262867 - RNA, 19 nt, Human
uauauaaaaagaaaagaua

SEQ ID NO: 2262868 - RNA, 20 nt, Human
uauauaaaaagaaaagauaa

SEQ ID NO: 2262869 - RNA, 23 nt, Human
uauauaaaaagaaaagauaaaga

SEQ ID NO: 2262870 - RNA, 16 nt, Human
uauauaaaauaaauau

SEQ ID NO: 2262871 - RNA, 17 nt, Human
uauauaaaauaaauaua

SEQ ID NO: 2262872 - RNA, 18 nt, Human
uauauaaaauaaauauau

SEQ ID NO: 2262873 - RNA, 19 nt, Human
uauauaaaauaaauauaua

SEQ ID NO: 2262874 - RNA, 22 nt, Human
uauauaaaauaaauauauauaa

SEQ ID NO: 2262875 - RNA, 13 nt, Human
uauaguauaucug

SEQ ID NO: 2262876 - RNA, 18 nt, Human
uauaguauaucuggacaa

SEQ ID NO: 2262877 - RNA, 21 nt, Human
uauagaggcuagcuucugcuu

SEQ ID NO: 2262878 - RNA, 22 nt, Human
uauagagauguuuuuaaaaguu

SEQ ID NO: 2262879 - RNA, 18 nt, Human
uauagguuuuguuugcua

SEQ ID NO: 2262880 - RNA, 20 nt, Human
uauagguuuuguuugcuauc

SEQ ID NO: 2262881 - RNA, 23 nt, Human
uauauaaaggaaaaaagagaagu

SEQ ID NO: 2262882 - RNA, 23 nt, Human
uauauaaaauaaauauauauaaa

SEQ ID NO: 2262883 - RNA, 21 nt, Human
uauauaaaauauuuucauaca

SEQ ID NO: 2262884 - RNA, 14 nt, Human
uauauaaaccuaaa

SEQ ID NO: 2262885 - RNA, 15 nt, Human
uauauaaaccuaaaa

SEQ ID NO: 2262886 - RNA, 17 nt, Human
uauauaaaccuaaaaaa

SEQ ID NO: 2262887 - RNA, 21 nt, Human
uauauaaaccuaaaaaagaua

SEQ ID NO: 2262888 - RNA, 22 nt, Human
uauauaaaccuaaaaaagauau

SEQ ID NO: 2262889 - RNA, 17 nt, Human
uauauaacaaugcugua

SEQ ID NO: 2262890 - RNA, 19 nt, Human
uauauaacaaugcuguauu

SEQ ID NO: 2262891 - RNA, 15 nt, Human
uauaucuguauauaa

SEQ ID NO: 2262892 - RNA, 17 nt, Human
uauaucugcuguccaga

SEQ ID NO: 2262893 - RNA, 16 nt, Human
uauaucugcuucagug

SEQ ID NO: 2262894 - RNA, 17 nt, Human
uauaucugcuucagugg

SEQ ID NO: 2262895 - RNA, 14 nt, Human
uauaucuguauaua

SEQ ID NO: 2262896 - RNA, 12 nt, Human
uauaucuuguuu

SEQ ID NO: 2262897 - RNA, 13 nt, Human
uauaucugcuguc

SEQ ID NO: 2262898 - RNA, 18 nt, Human
uauauaagauggaagcuu

SEQ ID NO: 2262899 - RNA, 22 nt, Human
uauauaagauggaagcuuccag

SEQ ID NO: 2262900 - RNA, 18 nt, Human
uauaugaagaaaaucacu

SEQ ID NO: 2262901 - RNA, 14 nt, Human
uauaucuuuuucca

SEQ ID NO: 2262902 - RNA, 14 nt, Human
uauaugcuucuguu

SEQ ID NO: 2262903 - RNA, 19 nt, Human
uauaugaagaaaaucacuu

SEQ ID NO: 2262904 - RNA, 16 nt, Human
uauaugcuucuguuuu

SEQ ID NO: 2262905 - RNA, 19 nt, Human
uauauggaugauucagaaa

SEQ ID NO: 2262906 - RNA, 16 nt, Human
uauauggaugauucag

SEQ ID NO: 2262907 - RNA, 18 nt, Human
uauauggaugauucagaa

SEQ ID NO: 2262908 - RNA, 13 nt, Human
uauauggauaaug

SEQ ID NO: 2262909 - RNA, 20 nt, Human
uauauuugaaauauugacuu

SEQ ID NO: 2262910 - RNA, 14 nt, Human
uauauuugcuuuuu

SEQ ID NO: 2262911 - RNA, 22 nt, Human
uauauuugggccugcuccagac

SEQ ID NO: 2262912 - RNA, 20 nt, Human
uauauuuguaaauuuaugug

SEQ ID NO: 2262913 - RNA, 12 nt, Human
uauauuuguaca

SEQ ID NO: 2262914 - RNA, 13 nt, Human
uauauuuguacaa

SEQ ID NO: 2262915 - RNA, 15 nt, Human
uauauuuguacaaaa

SEQ ID NO: 2262916 - RNA, 23 nt, Human
uauauuuucaugacuuuuccaug

SEQ ID NO: 2262917 - RNA, 21 nt, Human
uauauuugugauagcacuuuc

SEQ ID NO: 2262918 - RNA, 14 nt, Human
uauauuuguacaaa

SEQ ID NO: 2262919 - RNA, 24 nt, Human
uauauuuucaugacuuuuccaugu

SEQ ID NO: 2262920 - RNA, 13 nt, Human
uauauuuugggaa

SEQ ID NO: 2262921 - RNA, 12 nt, Human
uauauuuuggga

SEQ ID NO: 2262922 - RNA, 14 nt, Human
uauauuuucuguuu

SEQ ID NO: 2262923 - RNA, 15 nt, Human
uauauuuuuaagaua

SEQ ID NO: 2262924 - RNA, 20 nt, Human
uauauuuuuaagauaauaau

SEQ ID NO: 2262925 - RNA, 17 nt, Human
uauauuuuuaagauaau

SEQ ID NO: 2262926 - RNA, 19 nt, Human
uauauuuuuaagauaauaa

SEQ ID NO: 2262927 - RNA, 13 nt, Human
uauauuuuuauau

SEQ ID NO: 2262928 - RNA, 21 nt, Human
uauauuuuuuguuaaaugauu

SEQ ID NO: 2262929 - RNA, 19 nt, Human
uaucaaaacuuucuuuucu

SEQ ID NO: 2262930 - RNA, 15 nt, Human
uaucauggagugacg

SEQ ID NO: 2262931 - RNA, 18 nt, Human
uaucaugccccuguacuc

SEQ ID NO: 2262932 - RNA, 12 nt, Human
uaucauggucuc

SEQ ID NO: 2262933 - RNA, 12 nt, Human
uaucaugcauuc

SEQ ID NO: 2262934 - RNA, 14 nt, Human
uaucaugcccugug

SEQ ID NO: 2262935 - RNA, 19 nt, Human
uaucaugcauguccuguaa

SEQ ID NO: 2262936 - RNA, 17 nt, Human
uaucaugcauguccugu

SEQ ID NO: 2262937 - RNA, 17 nt, Human
uaucauggucucaguca

SEQ ID NO: 2262938 - RNA, 20 nt, Human
uaucauguguaaucaauaaa

SEQ ID NO: 2262939 - RNA, 22 nt, Human
uaucauguguaaucaauaaacg

SEQ ID NO: 2262940 - RNA, 12 nt, Human
uaucauuaaagu

SEQ ID NO: 2262941 - RNA, 13 nt, Human
uaucauuaaaguu

SEQ ID NO: 2262942 - RNA, 14 nt, Human
uaucauuaaaguuc

SEQ ID NO: 2262943 - RNA, 13 nt, Human
uaucauucaagug

SEQ ID NO: 2262944 - RNA, 14 nt, Human
uaucauucaagugu

SEQ ID NO: 2262945 - RNA, 18 nt, Human
uaucauagaaauguaacu

SEQ ID NO: 2262946 - RNA, 23 nt, Human
uaucauagaaauguaacuuuugu

SEQ ID NO: 2262947 - RNA, 15 nt, Human
uaucaucaguauuga

SEQ ID NO: 2262948 - RNA, 14 nt, Human
uaucaucaguauug

SEQ ID NO: 2262949 - RNA, 21 nt, Human
uaucaucagcauaccuuuauu

SEQ ID NO: 2262950 - RNA, 15 nt, Human
uaucauauugguauu

SEQ ID NO: 2262951 - RNA, 17 nt, Human
uaucaugcaaaugcugu

SEQ ID NO: 2262952 - RNA, 16 nt, Human
uaucaugcaaaugcug

SEQ ID NO: 2262953 - RNA, 15 nt, Human
uaucaugcaaaugcu

SEQ ID NO: 2262954 - RNA, 16 nt, Human
uaucaugagugaauaa

SEQ ID NO: 2262955 - RNA, 17 nt, Human
uaucaugacaaagacug

SEQ ID NO: 2262956 - RNA, 16 nt, Human
uaucaucaguauugaa

SEQ ID NO: 2262957 - RNA, 13 nt, Human
uaucaugacaugu

SEQ ID NO: 2262958 - RNA, 14 nt, Human
uaucaugacauguu

SEQ ID NO: 2262959 - RNA, 20 nt, Human
uaucaaacagaauuuuaaag

SEQ ID NO: 2262960 - RNA, 14 nt, Human
uaucaaaagaaaga

SEQ ID NO: 2262961 - RNA, 19 nt, Human
uaucaggugcugccaucca

SEQ ID NO: 2262962 - RNA, 13 nt, Human
uaucaaacugaag

SEQ ID NO: 2262963 - RNA, 16 nt, Human
uaucaaacugaagcca

SEQ ID NO: 2262964 - RNA, 9 nt, Human
uaucaguag

SEQ ID NO: 2262965 - RNA, 20 nt, Human
uaucaggugcugccauccag

SEQ ID NO: 2262966 - RNA, 23 nt, Human
uaucaguuugcuagcagaaaucu

SEQ ID NO: 2262967 - RNA, 22 nt, Human
uaucagucauaacuaaauaaag

SEQ ID NO: 2262968 - RNA, 21 nt, Human
uaucagucaauauuuuuagau

SEQ ID NO: 2262969 - RNA, 20 nt, Human
uaucagucaauauuuuuaga

SEQ ID NO: 2262970 - RNA, 20 nt, Human
uaucaguuuguccuguagag

SEQ ID NO: 2262971 - RNA, 15 nt, Human
uaucauagaaaugua

SEQ ID NO: 2262972 - RNA, 14 nt, Human
uaucauagaaaugu

SEQ ID NO: 2262973 - RNA, 16 nt, Human
uaauaaauauuuaugu

SEQ ID NO: 2262974 - RNA, 15 nt, Human
uaauaaauauuuaug

SEQ ID NO: 2262975 - RNA, 23 nt, Human
uaaguguauuuuucaauaaagca

SEQ ID NO: 2262976 - RNA, 12 nt, Human
uaauaaauauga

SEQ ID NO: 2262977 - RNA, 22 nt, Human
uaagugugaacuggacccuguu

SEQ ID NO: 2262978 - RNA, 12 nt, Human
uaauaaagcugu

SEQ ID NO: 2262979 - RNA, 18 nt, Human
uaauaagcuaaagaggcu

SEQ ID NO: 2262980 - RNA, 13 nt, Human
uaauaauauaugu

SEQ ID NO: 2262981 - RNA, 22 nt, Human
uaauaauauacuuguggacuaa

SEQ ID NO: 2262982 - RNA, 19 nt, Human
uaauaaauauuuuugccau

SEQ ID NO: 2262983 - RNA, 21 nt, Human
uaauaacugugaaguuuacau

SEQ ID NO: 2262984 - RNA, 19 nt, Human
uaauaagaaugguugccuu

SEQ ID NO: 2262985 - RNA, 12 nt, Human
uaauaagacaua

SEQ ID NO: 2262986 - RNA, 14 nt, Human
uaauaagacauaac

SEQ ID NO: 2262987 - RNA, 17 nt, Human
uaauaagacauaacguu

SEQ ID NO: 2262988 - RNA, 19 nt, Human
uaauaagacauaacguuuu

SEQ ID NO: 2262989 - RNA, 20 nt, Human
uaauaagacauaacguuuuu

SEQ ID NO: 2262990 - RNA, 22 nt, Human
uaauaagacauaacguuuuucc

SEQ ID NO: 2262991 - RNA, 13 nt, Human
uaaguguauuuuu

SEQ ID NO: 2262992 - RNA, 18 nt, Human
uaaguguacauaugugcu

SEQ ID NO: 2262993 - RNA, 21 nt, Human
uaagugcguguguagaguuaa

SEQ ID NO: 2262994 - RNA, 14 nt, Human
uaaguguacauaug

SEQ ID NO: 2262995 - RNA, 20 nt, Human
uaaguguauuuuucaauaaa

SEQ ID NO: 2262996 - RNA, 18 nt, Human
uaaguguauuuuucaaua

SEQ ID NO: 2262997 - RNA, 12 nt, Human
uaagugugaacu

SEQ ID NO: 2262998 - RNA, 14 nt, Human
uaagugugaacugg

SEQ ID NO: 2262999 - RNA, 15 nt, Human
uaagugugaacugga

SEQ ID NO: 2263000 - RNA, 15 nt, Human
uaaguggugugugua

SEQ ID NO: 2263001 - RNA, 12 nt, Human
uaagugcuguau

SEQ ID NO: 2263002 - RNA, 23 nt, Human
uaagugcguguguagaguuaaga

SEQ ID NO: 2263003 - RNA, 16 nt, Human
uaagugguguguguau

SEQ ID NO: 2263004 - RNA, 22 nt, Human
uaagugcugcauuuaaaagaua

SEQ ID NO: 2263005 - RNA, 18 nt, Human
uaagugcugcauuuaaaa

SEQ ID NO: 2263006 - RNA, 16 nt, Human
uaagugcugcauuuaa

SEQ ID NO: 2263007 - RNA, 15 nt, Human
uaagugcugcauuua

SEQ ID NO: 2263008 - RNA, 22 nt, Human
uaagugccaggauggaaugaug

SEQ ID NO: 2263009 - RNA, 16 nt, Human
uaagugauuguaugaa

SEQ ID NO: 2263010 - RNA, 18 nt, Human
uaagugauuuuuuugucc

SEQ ID NO: 2263011 - RNA, 14 nt, Human
uaagugcacaacau

SEQ ID NO: 2263012 - RNA, 22 nt, Human
uaagugcacaacauuacaggga

SEQ ID NO: 2263013 - RNA, 14 nt, Human
uaagugcugcauuu

SEQ ID NO: 2263014 - RNA, 13 nt, Human
uaagugccuucca

SEQ ID NO: 2263015 - RNA, 14 nt, Human
uaagugccuuccau

SEQ ID NO: 2263016 - RNA, 16 nt, Human
uaagugccuuccaugu

SEQ ID NO: 2263017 - RNA, 16 nt, Human
uaagugcguguguaga

SEQ ID NO: 2263018 - RNA, 17 nt, Human
uaagugcguguguagag

SEQ ID NO: 2263019 - RNA, 18 nt, Human
uaagugcguguguagagu

SEQ ID NO: 2263020 - RNA, 19 nt, Human
uaagugcguguguagaguu

SEQ ID NO: 2263021 - RNA, 22 nt, Human
uaagugauugcugguuuuaguu

SEQ ID NO: 2263022 - RNA, 12 nt, Human
uaagugagagag

SEQ ID NO: 2263023 - RNA, 23 nt, Human
uaagugaggaugaaaaaauaaca

SEQ ID NO: 2263024 - RNA, 16 nt, Human
uaagugaaaaggucau

SEQ ID NO: 2263025 - RNA, 13 nt, Human
uaagugaaauaag

SEQ ID NO: 2263026 - RNA, 22 nt, Human
uaagucuuaucaagcagccaag

SEQ ID NO: 2263027 - RNA, 20 nt, Human
uaagucuuaucaagcagcca

SEQ ID NO: 2263028 - RNA, 21 nt, Human
uaagucuguuuuaugacuuca

SEQ ID NO: 2263029 - RNA, 20 nt, Human
uaagucuguuuuaugacuuc

SEQ ID NO: 2263030 - RNA, 19 nt, Human
uaagucuguuuuaugacuu

SEQ ID NO: 2263031 - RNA, 16 nt, Human
uaagucuguuuuauga

SEQ ID NO: 2263032 - RNA, 13 nt, Human
uaagucuguuuua

SEQ ID NO: 2263033 - RNA, 20 nt, Human
uaaguccuugcaagaaucag

SEQ ID NO: 2263034 - RNA, 22 nt, Human
uaagucauguuccuucaagauc

SEQ ID NO: 2263035 - RNA, 19 nt, Human
uaagucauguuccuucaag

SEQ ID NO: 2263036 - RNA, 21 nt, Human
uaagucauguuccuucaagau

SEQ ID NO: 2263037 - RNA, 18 nt, Human
uaagucuaaauauuuccu

SEQ ID NO: 2263038 - RNA, 15 nt, Human
uaaguccuuuaugug

SEQ ID NO: 2263039 - RNA, 17 nt, Human
uaaguccuuuaugugga

SEQ ID NO: 2263040 - RNA, 20 nt, Human
uaaguccuuuauguggaaaa

SEQ ID NO: 2263041 - RNA, 18 nt, Human
uaaggucauuaccacagg

SEQ ID NO: 2263042 - RNA, 13 nt, Human
uaaggguuuuaga

SEQ ID NO: 2263043 - RNA, 21 nt, Human
uaagguaccuuucacauagag

SEQ ID NO: 2263044 - RNA, 20 nt, Human
uaaggguuaguuuacaauca

SEQ ID NO: 2263045 - RNA, 15 nt, Human
uaaggguuaagaaaa

SEQ ID NO: 2263046 - RNA, 17 nt, Human
uaaggguaucuggugac

SEQ ID NO: 2263047 - RNA, 22 nt, Human
uaagggcuggucucugcugaag

SEQ ID NO: 2263048 - RNA, 13 nt, Human
uaagggcagaguc

SEQ ID NO: 2263049 - RNA, 14 nt, Human
uaagggcagaguca

SEQ ID NO: 2263050 - RNA, 16 nt, Human
uaaggggcccggccag

SEQ ID NO: 2263051 - RNA, 13 nt, Human
uaaggggcagcuu

SEQ ID NO: 2263052 - RNA, 14 nt, Human
uaagggagaaaaaa

SEQ ID NO: 2263053 - RNA, 20 nt, Human
uaagggacauguuuugauaa

SEQ ID NO: 2263054 - RNA, 21 nt, Human
uaagggaaggaacucuggcuu

SEQ ID NO: 2263055 - RNA, 13 nt, Human
uaagggaagaauu

SEQ ID NO: 2263056 - RNA, 15 nt, Human
uaaggugugcucuga

SEQ ID NO: 2263057 - RNA, 13 nt, Human
uaaggugccuucu

SEQ ID NO: 2263058 - RNA, 12 nt, Human
uaaggugcaguu

SEQ ID NO: 2263059 - RNA, 20 nt, Human
uaagguggguacgggagggu

SEQ ID NO: 2263060 - RNA, 20 nt, Human
uaaggugauauauuuaaaaa

SEQ ID NO: 2263061 - RNA, 18 nt, Human
uaaggugauauauuuaaa

SEQ ID NO: 2263062 - RNA, 19 nt, Human
uaaggugaaggugaaucua

SEQ ID NO: 2263063 - RNA, 17 nt, Human
uaagucaaccugccuga

SEQ ID NO: 2263064 - RNA, 15 nt, Human
uaagucaaccugccu

SEQ ID NO: 2263065 - RNA, 17 nt, Human
uaaguauuugaaacuga

SEQ ID NO: 2263066 - RNA, 14 nt, Human
uaaguauuucccag

SEQ ID NO: 2263067 - RNA, 15 nt, Human
uaagccaugggagac

SEQ ID NO: 2263068 - RNA, 19 nt, Human
uaagccauucugacucaua

SEQ ID NO: 2263069 - RNA, 20 nt, Human
uaagccauucugacucauau

SEQ ID NO: 2263070 - RNA, 16 nt, Human
uaagccccagcaagca

SEQ ID NO: 2263071 - RNA, 17 nt, Human
uaagccccagcaagcaa

SEQ ID NO: 2263072 - RNA, 22 nt, Human
uaagccccagcaagcaauccua

SEQ ID NO: 2263073 - RNA, 12 nt, Human
uaagaggcaggg

SEQ ID NO: 2263074 - RNA, 15 nt, Human
uaagaggcagggucu

SEQ ID NO: 2263075 - RNA, 14 nt, Human
uaagcccuugaaga

SEQ ID NO: 2263076 - RNA, 15 nt, Human
uaagccuaccugcuc

SEQ ID NO: 2263077 - RNA, 16 nt, Human
uaagccuaaaaguggg

SEQ ID NO: 2263078 - RNA, 16 nt, Human
uaagccucauauuuaa

SEQ ID NO: 2263079 - RNA, 17 nt, Human
uaagccuaccugcucuc

SEQ ID NO: 2263080 - RNA, 17 nt, Human
uaagccucauauuuaaa

SEQ ID NO: 2263081 - RNA, 13 nt, Human
uaagcccccgcug

SEQ ID NO: 2263082 - RNA, 19 nt, Human
uaagcccucuuccaucaug

SEQ ID NO: 2263083 - RNA, 11 nt, Human
uaagcccuguc

SEQ ID NO: 2263084 - RNA, 16 nt, Human
uaagcccugucgagac

SEQ ID NO: 2263085 - RNA, 20 nt, Human
uaagcccugucgagacacuu

SEQ ID NO: 2263086 - RNA, 22 nt, Human
uaagcccugucgagacacuugc

SEQ ID NO: 2263087 - RNA, 22 nt, Human
uaagcuaacccccuucuacuga

SEQ ID NO: 2263088 - RNA, 16 nt, Human
uaagcuaacccccuuc

SEQ ID NO: 2263089 - RNA, 21 nt, Human
uaagcuaaagaggcugaaaga

SEQ ID NO: 2263090 - RNA, 13 nt, Human
uaaggcugaggaa

SEQ ID NO: 2263091 - RNA, 20 nt, Human
uaaggcugaggaaaggccag

SEQ ID NO: 2263092 - RNA, 21 nt, Human
uaaggcugcaagguuuaggcu

SEQ ID NO: 2263093 - RNA, 14 nt, Human
uaagggaaauagaa

SEQ ID NO: 2263094 - RNA, 20 nt, Human
uaaggauuuuaugcuuuaaa

SEQ ID NO: 2263095 - RNA, 22 nt, Human
uaaggauuuuaugcuuuaaaca

SEQ ID NO: 2263096 - RNA, 14 nt, Human
uaaggcaaucaugg

SEQ ID NO: 2263097 - RNA, 14 nt, Human
uaagcuauucagua

SEQ ID NO: 2263098 - RNA, 15 nt, Human
uaaggauugugauau

SEQ ID NO: 2263099 - RNA, 19 nt, Human
uaaggauuuuaugcuuuaa

SEQ ID NO: 2263100 - RNA, 17 nt, Human
uaaggauuuuaugcuuu

SEQ ID NO: 2263101 - RNA, 13 nt, Human
uaaggauuuuaug

SEQ ID NO: 2263102 - RNA, 12 nt, Human
uaaggauuuuau

SEQ ID NO: 2263103 - RNA, 16 nt, Human
uaaggauguucuagca

SEQ ID NO: 2263104 - RNA, 22 nt, Human
uaauuagagcagaugaccccuc

SEQ ID NO: 2263105 - RNA, 20 nt, Human
uaauuaaguacuauguauca

SEQ ID NO: 2263106 - RNA, 17 nt, Human
uaauuaaguacuaugua

SEQ ID NO: 2263107 - RNA, 14 nt, Human
uaauuaaguacuau

SEQ ID NO: 2263108 - RNA, 11 nt, Human
uaauguuuccu

SEQ ID NO: 2263109 - RNA, 13 nt, Human
uaauguuugcuau

SEQ ID NO: 2263110 - RNA, 14 nt, Human
uaauuaaaaaauuu

SEQ ID NO: 2263111 - RNA, 12 nt, Human
uaauguuugcua

SEQ ID NO: 2263112 - RNA, 21 nt, Human
uaauguuacugaucaugcauu

SEQ ID NO: 2263113 - RNA, 15 nt, Human
uaauguuacugauca

SEQ ID NO: 2263114 - RNA, 19 nt, Human
uaaugguaccagauaaaau

SEQ ID NO: 2263115 - RNA, 17 nt, Human
uaaugguaccagauaaa

SEQ ID NO: 2263116 - RNA, 18 nt, Human
uaaugguaccagauaaaa

SEQ ID NO: 2263117 - RNA, 23 nt, Human
uaauguuacugaucaugcauugu

SEQ ID NO: 2263118 - RNA, 22 nt, Human
uaauguucugaauaauuucuua

SEQ ID NO: 2263119 - RNA, 20 nt, Human
uaauguucugaauaauuucu

SEQ ID NO: 2263120 - RNA, 22 nt, Human
uaaugggguccuggccauccca

SEQ ID NO: 2263121 - RNA, 18 nt, Human
uaauggguuucauauuuc

SEQ ID NO: 2263122 - RNA, 14 nt, Human
uaaugguaccagau

SEQ ID NO: 2263123 - RNA, 16 nt, Human
uaaugguaccagauaa

SEQ ID NO: 2263124 - RNA, 18 nt, Human
uaaugggguccuggccau

SEQ ID NO: 2263125 - RNA, 17 nt, Human
uaaugggguccuggcca

SEQ ID NO: 2263126 - RNA, 15 nt, Human
uaaugggguccuggc

SEQ ID NO: 2263127 - RNA, 21 nt, Human
uaauggggguagcagcuggac

SEQ ID NO: 2263128 - RNA, 18 nt, Human
uaaugggcuuagagcagu

SEQ ID NO: 2263129 - RNA, 15 nt, Human
uaaugggauuuucuu

SEQ ID NO: 2263130 - RNA, 15 nt, Human
uaauggggguagcag

SEQ ID NO: 2263131 - RNA, 17 nt, Human
uaauggggguagcagcu

SEQ ID NO: 2263132 - RNA, 18 nt, Human
uaauggggguagcagcug

SEQ ID NO: 2263133 - RNA, 20 nt, Human
uaauggggguagcagcugga

SEQ ID NO: 2263134 - RNA, 20 nt, Human
uaauguuguaugucuuguuu

SEQ ID NO: 2263135 - RNA, 21 nt, Human
uaauguuguaugucuuguuua

SEQ ID NO: 2263136 - RNA, 14 nt, Human
uaauguuguuauuu

SEQ ID NO: 2263137 - RNA, 18 nt, Human
uaauguuguuauuuaaag

SEQ ID NO: 2263138 - RNA, 22 nt, Human
uaauguuucaaacauauauaac

SEQ ID NO: 2263139 - RNA, 20 nt, Human
uaaugcuaaagaaaaaguca

SEQ ID NO: 2263140 - RNA, 23 nt, Human
uaaugcgugcauaccacuuuugu

SEQ ID NO: 2263141 - RNA, 22 nt, Human
uaaugcgugcauaccacuuuug

SEQ ID NO: 2263142 - RNA, 19 nt, Human
uaaugcgugcauaccacuu

SEQ ID NO: 2263143 - RNA, 15 nt, Human
uaaugcgugcauacc

SEQ ID NO: 2263144 - RNA, 23 nt, Human
uaaugauaacuggaaacuucagc

SEQ ID NO: 2263145 - RNA, 17 nt, Human
uaaugauaacuggaaac

SEQ ID NO: 2263146 - RNA, 22 nt, Human
uaaugauaacuggaaacuucag

SEQ ID NO: 2263147 - RNA, 17 nt, Human
uaaugcuguugccucau

SEQ ID NO: 2263148 - RNA, 14 nt, Human
uaaugcuguugccu

SEQ ID NO: 2263149 - RNA, 18 nt, Human
uaaugcuccuuguuccua

SEQ ID NO: 2263150 - RNA, 13 nt, Human
uaaugcuccuugu

SEQ ID NO: 2263151 - RNA, 16 nt, Human
uaaugcuacgugugau

SEQ ID NO: 2263152 - RNA, 17 nt, Human
uaaugcuacgugugauu

SEQ ID NO: 2263153 - RNA, 18 nt, Human
uaaugcuacgugugauuu

SEQ ID NO: 2263154 - RNA, 22 nt, Human
uaaugcuacgugugauuuuucu

SEQ ID NO: 2263155 - RNA, 13 nt, Human
uaaugcuacuguc

SEQ ID NO: 2263156 - RNA, 15 nt, Human
uaaugcuacugucuc

SEQ ID NO: 2263157 - RNA, 16 nt, Human
uaaugcuguugccuca

SEQ ID NO: 2263158 - RNA, 19 nt, Human
uaaugcuuagagaauguuc

SEQ ID NO: 2263159 - RNA, 20 nt, Human
uaaugcuuagagaauguucu

SEQ ID NO: 2263160 - RNA, 21 nt, Human
uaaugcuucuuucauuuucug

SEQ ID NO: 2263161 - RNA, 14 nt, Human
uaaugcuuuuauau

SEQ ID NO: 2263162 - RNA, 15 nt, Human
uaauggggcggugag

SEQ ID NO: 2263163 - RNA, 23 nt, Human
uaauggccggcuggaaaugcugg

SEQ ID NO: 2263164 - RNA, 21 nt, Human
uaauggccaugguacccccuu

SEQ ID NO: 2263165 - RNA, 17 nt, Human
uaauggccggcuggaaa

SEQ ID NO: 2263166 - RNA, 16 nt, Human
uaauggccaugguacc

SEQ ID NO: 2263167 - RNA, 19 nt, Human
uaauggccaugguaccccc

SEQ ID NO: 2263168 - RNA, 19 nt, Human
uaauggacaugagauaaug

SEQ ID NO: 2263169 - RNA, 23 nt, Human
uaauggacaugagauaauguuag

SEQ ID NO: 2263170 - RNA, 14 nt, Human
uaaucccugggcau

SEQ ID NO: 2263171 - RNA, 17 nt, Human
uaaucccgauucacccu

SEQ ID NO: 2263172 - RNA, 20 nt, Human
uaaucccugggcauugcuuu

SEQ ID NO: 2263173 - RNA, 19 nt, Human
uaaucccugggcauugcuu

SEQ ID NO: 2263174 - RNA, 19 nt, Human
uaauccgaaucucuuuuug

SEQ ID NO: 2263175 - RNA, 22 nt, Human
uaaucccugggcauugcuuucc

SEQ ID NO: 2263176 - RNA, 21 nt, Human
uaauccgaaucucuuuuugcu

SEQ ID NO: 2263177 - RNA, 13 nt, Human
uaaucuaaaugga

SEQ ID NO: 2263178 - RNA, 12 nt, Human
uaaucuaaaugg

SEQ ID NO: 2263179 - RNA, 20 nt, Human
uaauccucuaggaggucucu

SEQ ID NO: 2263180 - RNA, 20 nt, Human
uaauauuaaggaagacaaug

SEQ ID NO: 2263181 - RNA, 21 nt, Human
uaauccccaguaaaauugcca

SEQ ID NO: 2263182 - RNA, 23 nt, Human
uaauauggcucuucauaauucua

SEQ ID NO: 2263183 - RNA, 15 nt, Human
uaauaugggcauugu

SEQ ID NO: 2263184 - RNA, 18 nt, Human
uaauaugggcauuguagu

SEQ ID NO: 2263185 - RNA, 16 nt, Human
uaauauuaaauauaug

SEQ ID NO: 2263186 - RNA, 17 nt, Human
uaaucuggacuccucug

SEQ ID NO: 2263187 - RNA, 18 nt, Human
uaaucuggacuccucugu

SEQ ID NO: 2263188 - RNA, 16 nt, Human
uaaucuauuggguuca

SEQ ID NO: 2263189 - RNA, 21 nt, Human
uaaucugcaaagaaugagaag

SEQ ID NO: 2263190 - RNA, 15 nt, Human
uaaucuggacuccuc

SEQ ID NO: 2263191 - RNA, 22 nt, Human
uaaucuacuccuuguaaagacu

SEQ ID NO: 2263192 - RNA, 17 nt, Human
uaaucuaauucuaagga

SEQ ID NO: 2263193 - RNA, 14 nt, Human
uaaucuagaacaca

SEQ ID NO: 2263194 - RNA, 22 nt, Human
uaaucuagaacacaggcaaaau

SEQ ID NO: 2263195 - RNA, 17 nt, Human
uaaucuagauaucgacu

SEQ ID NO: 2263196 - RNA, 22 nt, Human
uaaucuagauaucgacuuguuu

SEQ ID NO: 2263197 - RNA, 19 nt, Human
uaaucuggacuccucuguc

SEQ ID NO: 2263198 - RNA, 20 nt, Human
uaaucuggacuccucugucc

SEQ ID NO: 2263199 - RNA, 21 nt, Human
uaaucuggacuccucugucca

SEQ ID NO: 2263200 - RNA, 22 nt, Human
uaaucuggacuccucuguccag

SEQ ID NO: 2263201 - RNA, 17 nt, Human
uaaucugggaagggaag

SEQ ID NO: 2263202 - RNA, 16 nt, Human
uaaucuguagggcugg

SEQ ID NO: 2263203 - RNA, 17 nt, Human
uaaucuguagggcugga

SEQ ID NO: 2263204 - RNA, 20 nt, Human
uaaucuguagggcuggaccu

SEQ ID NO: 2263205 - RNA, 23 nt, Human
uaaucugggccagaauuucaaac

SEQ ID NO: 2263206 - RNA, 18 nt, Human
uaaucugggccagaauuu

SEQ ID NO: 2263207 - RNA, 15 nt, Human
uaauaucaauagaag

SEQ ID NO: 2263208 - RNA, 13 nt, Human
uaauaaugugaau

SEQ ID NO: 2263209 - RNA, 20 nt, Human
uaauaaucuuauuagggaga

SEQ ID NO: 2263210 - RNA, 14 nt, Human
uaauaauguuucaa

SEQ ID NO: 2263211 - RNA, 16 nt, Human
uaauaauauauguuua

SEQ ID NO: 2263212 - RNA, 23 nt, Human
uaauaaucauuggauucugagag

SEQ ID NO: 2263213 - RNA, 23 nt, Human
uaauaaucuuauuagggagaaaa

SEQ ID NO: 2263214 - RNA, 15 nt, Human
uaauaauguuuaaua

SEQ ID NO: 2263215 - RNA, 23 nt, Human
uaauaucaucaguauugaagcau

SEQ ID NO: 2263216 - RNA, 17 nt, Human
uaauaucccuacaugua

SEQ ID NO: 2263217 - RNA, 18 nt, Human
uaauaucccuacauguau

SEQ ID NO: 2263218 - RNA, 12 nt, Human
uaauaugagaau

SEQ ID NO: 2263219 - RNA, 16 nt, Human
uaauaugaaaacuuau

SEQ ID NO: 2263220 - RNA, 15 nt, Human
uaauaugaaaacuua

SEQ ID NO: 2263221 - RNA, 14 nt, Human
uaauaugaaaacuu

SEQ ID NO: 2263222 - RNA, 18 nt, Human
uaauaugcugccaaauuu

SEQ ID NO: 2263223 - RNA, 10 nt, Human
uaauaugcau

SEQ ID NO: 2263224 - RNA, 16 nt, Human
uaauaugcugccaaau

SEQ ID NO: 2263225 - RNA, 19 nt, Human
uaauaugcacacauuuuuu

SEQ ID NO: 2263226 - RNA, 22 nt, Human
uaauauggccacaguagucuug

SEQ ID NO: 2263227 - RNA, 15 nt, Human
uaauauggcaaaaau

SEQ ID NO: 2263228 - RNA, 16 nt, Human
uaauauggcaaaaaug

SEQ ID NO: 2263229 - RNA, 18 nt, Human
uaauauggcaaaaauggc

SEQ ID NO: 2263230 - RNA, 22 nt, Human
uaauauggcucuucauaauucu

SEQ ID NO: 2263231 - RNA, 18 nt, Human
uaauaugcacacauuuuu

SEQ ID NO: 2263232 - RNA, 17 nt, Human
uaauaugcacacauuuu

SEQ ID NO: 2263233 - RNA, 16 nt, Human
uaauaugcacacauuu

SEQ ID NO: 2263234 - RNA, 15 nt, Human
uaauaugcacacauu

SEQ ID NO: 2263235 - RNA, 18 nt, Human
uaaccccgggcggguggc

SEQ ID NO: 2263236 - RNA, 15 nt, Human
uaaccccaggccccg

SEQ ID NO: 2263237 - RNA, 15 nt, Human
uaaccccgggcgggu

SEQ ID NO: 2263238 - RNA, 12 nt, Human
uaaccccaggcc

SEQ ID NO: 2263239 - RNA, 13 nt, Human
uaaccccaggccc

SEQ ID NO: 2263240 - RNA, 14 nt, Human
uaaccccaggcccc

SEQ ID NO: 2263241 - RNA, 16 nt, Human
uaaccccuuuccugcg

SEQ ID NO: 2263242 - RNA, 23 nt, Human
uaacccgcucaucacuggaugaa

SEQ ID NO: 2263243 - RNA, 13 nt, Human
uaaccccuuuccu

SEQ ID NO: 2263244 - RNA, 12 nt, Human
uaaccccuuucc

SEQ ID NO: 2263245 - RNA, 20 nt, Human
uaacccuggugguugcuguu

SEQ ID NO: 2263246 - RNA, 18 nt, Human
uaacccucccauggcacc

SEQ ID NO: 2263247 - RNA, 17 nt, Human
uaacccuuaucaccagc

SEQ ID NO: 2263248 - RNA, 16 nt, Human
uaacuauguugauaaa

SEQ ID NO: 2263249 - RNA, 19 nt, Human
uaacuccagugauguucuu

SEQ ID NO: 2263250 - RNA, 15 nt, Human
uaacuccccacccca

SEQ ID NO: 2263251 - RNA, 16 nt, Human
uaacucaccuaacuca

SEQ ID NO: 2263252 - RNA, 17 nt, Human
uaacuauugcccagguu

SEQ ID NO: 2263253 - RNA, 19 nt, Human
uaacuauuuuauuuucuaa

SEQ ID NO: 2263254 - RNA, 14 nt, Human
uaacucaauauuuu

SEQ ID NO: 2263255 - RNA, 22 nt, Human
uaacucaauauuuuccaugaaa

SEQ ID NO: 2263256 - RNA, 22 nt, Human
uaacucuaauucccauuuugca

SEQ ID NO: 2263257 - RNA, 23 nt, Human
uaacucuaaaagauccuuuuuaa

SEQ ID NO: 2263258 - RNA, 17 nt, Human
uaacucuaaaagauccu

SEQ ID NO: 2263259 - RNA, 18 nt, Human
uaacucuaaaagauccuu

SEQ ID NO: 2263260 - RNA, 21 nt, Human
uaacucugcacuacuccucug

SEQ ID NO: 2263261 - RNA, 14 nt, Human
uaacuccuucuugu

SEQ ID NO: 2263262 - RNA, 14 nt, Human
uaacucuaaaagau

SEQ ID NO: 2263263 - RNA, 16 nt, Human
uaacucuaaaagaucc

SEQ ID NO: 2263264 - RNA, 21 nt, Human
uaacugaaaaugugcuauacu

SEQ ID NO: 2263265 - RNA, 20 nt, Human
uaacugaaaaugugcuauac

SEQ ID NO: 2263266 - RNA, 14 nt, Human
uaacucugucuuca

SEQ ID NO: 2263267 - RNA, 11 nt, Human
uaacucugucu

SEQ ID NO: 2263268 - RNA, 14 nt, Human
uaacucuugucuau

SEQ ID NO: 2263269 - RNA, 15 nt, Human
uaacucugucuucac

SEQ ID NO: 2263270 - RNA, 16 nt, Human
uaacucuugucuauuu

SEQ ID NO: 2263271 - RNA, 14 nt, Human
uaacugaaaaugug

SEQ ID NO: 2263272 - RNA, 16 nt, Human
uaacugaaggagaagg

SEQ ID NO: 2263273 - RNA, 15 nt, Human
uaacugaaggagaag

SEQ ID NO: 2263274 - RNA, 14 nt, Human
uaacugaaggagaa

SEQ ID NO: 2263275 - RNA, 13 nt, Human
uaacugacaacuu

SEQ ID NO: 2263276 - RNA, 15 nt, Human
uaaccauuaaaacug

SEQ ID NO: 2263277 - RNA, 18 nt, Human
uaaccauugucuuguucu

SEQ ID NO: 2263278 - RNA, 19 nt, Human
uaaccauugucuuguucug

SEQ ID NO: 2263279 - RNA, 20 nt, Human
uaaccauugucuuguucugu

SEQ ID NO: 2263280 - RNA, 23 nt, Human
uaaccauugucuuguucugugau

SEQ ID NO: 2263281 - RNA, 17 nt, Human
uaaccaucacugguugc

SEQ ID NO: 2263282 - RNA, 19 nt, Human
uaaccccagcucccuagga

SEQ ID NO: 2263283 - RNA, 13 nt, Human
uaaccccagcucc

SEQ ID NO: 2263284 - RNA, 11 nt, Human
uaaccccaccc

SEQ ID NO: 2263285 - RNA, 13 nt, Human
uaacccagauuuu

SEQ ID NO: 2263286 - RNA, 14 nt, Human
uaacccaacucucc

SEQ ID NO: 2263287 - RNA, 14 nt, Human
uaaccauuugcacu

SEQ ID NO: 2263288 - RNA, 16 nt, Human
uaacccaacucuccug

SEQ ID NO: 2263289 - RNA, 16 nt, Human
uaaccacuucagcuga

SEQ ID NO: 2263290 - RNA, 13 nt, Human
uaaccagaucauu

SEQ ID NO: 2263291 - RNA, 23 nt, Human
uaaccaguguuguggauuuaaca

SEQ ID NO: 2263292 - RNA, 17 nt, Human
uaaccaggggccaugaa

SEQ ID NO: 2263293 - RNA, 20 nt, Human
uaaccacgucugucuucaca

SEQ ID NO: 2263294 - RNA, 20 nt, Human
uaaccacuuaaaaaaugucc

SEQ ID NO: 2263295 - RNA, 19 nt, Human
uaaccacuuaaaaaauguc

SEQ ID NO: 2263296 - RNA, 19 nt, Human
uaaccacgucugucuucac

SEQ ID NO: 2263297 - RNA, 15 nt, Human
uaaccacggaaaaga

SEQ ID NO: 2263298 - RNA, 17 nt, Human
uaaccaaaaagaccaga

SEQ ID NO: 2263299 - RNA, 20 nt, Human
uaaccaaaaagaccagacua

SEQ ID NO: 2263300 - RNA, 22 nt, Human
uaacauucuguaaaaugucugu

SEQ ID NO: 2263301 - RNA, 20 nt, Human
uaacauuggguccugggucu

SEQ ID NO: 2263302 - RNA, 16 nt, Human
uaacauuucaagggca

SEQ ID NO: 2263303 - RNA, 13 nt, Human
uaacauuuuaaau

SEQ ID NO: 2263304 - RNA, 21 nt, Human
uaacauuuuaaauaaaagaaa

SEQ ID NO: 2263305 - RNA, 20 nt, Human
uaacauugggaaaucuuaua

SEQ ID NO: 2263306 - RNA, 15 nt, Human
uaacacuuuacaaug

SEQ ID NO: 2263307 - RNA, 11 nt, Human
uaacagaaagg

SEQ ID NO: 2263308 - RNA, 21 nt, Human
uaacagaaagggcaacaauaa

SEQ ID NO: 2263309 - RNA, 23 nt, Human
uaacagaaagggcaacaauaaaa

SEQ ID NO: 2263310 - RNA, 11 nt, Human
uaacagaaaug

SEQ ID NO: 2263311 - RNA, 21 nt, Human
uaagaaacacacugaggcagg

SEQ ID NO: 2263312 - RNA, 20 nt, Human
uaagaaacacacugaggcag

SEQ ID NO: 2263313 - RNA, 21 nt, Human
uaagaaacaacucuuugagaa

SEQ ID NO: 2263314 - RNA, 20 nt, Human
uaagaaacaacucuuugaga

SEQ ID NO: 2263315 - RNA, 23 nt, Human
uaagaaaauauuuugucuaaaau

SEQ ID NO: 2263316 - RNA, 21 nt, Human
uaagaaaagauacgacuuuau

SEQ ID NO: 2263317 - RNA, 12 nt, Human
uaagaaaagauu

SEQ ID NO: 2263318 - RNA, 14 nt, Human
uaagaaaagauuuu

SEQ ID NO: 2263319 - RNA, 17 nt, Human
uaagaaaauauuuuguc

SEQ ID NO: 2263320 - RNA, 20 nt, Human
uaagaaaauauuuugucuaa

SEQ ID NO: 2263321 - RNA, 21 nt, Human
uaagaaaauauuuugucuaaa

SEQ ID NO: 2263322 - RNA, 22 nt, Human
uaagaaaauauuuugucuaaaa

SEQ ID NO: 2263323 - RNA, 19 nt, Human
uaagaaaagauuuuaauca

SEQ ID NO: 2263324 - RNA, 21 nt, Human
uaagaaaauaucacuugucaa

SEQ ID NO: 2263325 - RNA, 23 nt, Human
uaagaaacacacugaggcaggga

SEQ ID NO: 2263326 - RNA, 18 nt, Human
uaagaaacccagacugaa

SEQ ID NO: 2263327 - RNA, 24 nt, Human
uaagaaaucuaguauuucaugcug

SEQ ID NO: 2263328 - RNA, 17 nt, Human
uaagaggcagaaaauug

SEQ ID NO: 2263329 - RNA, 21 nt, Human
uaagaggacauaauggggucc

SEQ ID NO: 2263330 - RNA, 20 nt, Human
uaagaggcagaaaauugcac

SEQ ID NO: 2263331 - RNA, 23 nt, Human
uaagaggcagaaaauugcacaau

SEQ ID NO: 2263332 - RNA, 15 nt, Human
uaagaggcagcguga

SEQ ID NO: 2263333 - RNA, 14 nt, Human
uaagagagaaugag

SEQ ID NO: 2263334 - RNA, 23 nt, Human
uaagagagaaugagagacacacu

SEQ ID NO: 2263335 - RNA, 22 nt, Human
uaagaacaaagagaaaaaauac

SEQ ID NO: 2263336 - RNA, 19 nt, Human
uaagaaccuuuugagugcc

SEQ ID NO: 2263337 - RNA, 14 nt, Human
uaagaaccuggaac

SEQ ID NO: 2263338 - RNA, 21 nt, Human
uaagagacagucaccccagga

SEQ ID NO: 2263339 - RNA, 13 nt, Human
uaagagagaauga

SEQ ID NO: 2263340 - RNA, 20 nt, Human
uaagaaaaaauaacacacau

SEQ ID NO: 2263341 - RNA, 18 nt, Human
uaagaaaaaggaugcaca

SEQ ID NO: 2263342 - RNA, 16 nt, Human
uaagaaaaaggaugca

SEQ ID NO: 2263343 - RNA, 16 nt, Human
uaagaaaacaucacug

SEQ ID NO: 2263344 - RNA, 16 nt, Human
uaagaaaaaucauguu

SEQ ID NO: 2263345 - RNA, 14 nt, Human
uaagaaaagagaua

SEQ ID NO: 2263346 - RNA, 16 nt, Human
uaagaaaagauguaga

SEQ ID NO: 2263347 - RNA, 18 nt, Human
uaagaaaagagauauuuu

SEQ ID NO: 2263348 - RNA, 22 nt, Human
uaagaaaagagauauuuuaaaa

SEQ ID NO: 2263349 - RNA, 14 nt, Human
uaagaaaaaucaug

SEQ ID NO: 2263350 - RNA, 17 nt, Human
uaagaaaaaucauguuu

SEQ ID NO: 2263351 - RNA, 23 nt, Human
uaagaaaaaggaugcacagaguu

SEQ ID NO: 2263352 - RNA, 19 nt, Human
uaagaaaaaggaugcacag

SEQ ID NO: 2263353 - RNA, 22 nt, Human
uaacuggaagcauguaggagaa

SEQ ID NO: 2263354 - RNA, 18 nt, Human
uaacugugaaguuuacau

SEQ ID NO: 2263355 - RNA, 22 nt, Human
uaacuguuaaauugcuguguau

SEQ ID NO: 2263356 - RNA, 17 nt, Human
uaacuguuauuuauaau

SEQ ID NO: 2263357 - RNA, 16 nt, Human
uaacuguuauuuauaa

SEQ ID NO: 2263358 - RNA, 20 nt, Human
uaacuuuuguaaauacacau

SEQ ID NO: 2263359 - RNA, 13 nt, Human
uaacuuuuguaag

SEQ ID NO: 2263360 - RNA, 18 nt, Human
uaacuuuuguaagacaaa

SEQ ID NO: 2263361 - RNA, 18 nt, Human
uaacuggagccccaucag

SEQ ID NO: 2263362 - RNA, 17 nt, Human
uaacugugaaguuuaca

SEQ ID NO: 2263363 - RNA, 15 nt, Human
uaacuggaaacuuca

SEQ ID NO: 2263364 - RNA, 21 nt, Human
uaacaccagguuuauggaaaa

SEQ ID NO: 2263365 - RNA, 19 nt, Human
uaacacauuuuguauaauu

SEQ ID NO: 2263366 - RNA, 14 nt, Human
uaacaccugaugug

SEQ ID NO: 2263367 - RNA, 16 nt, Human
uaacaccugaugugua

SEQ ID NO: 2263368 - RNA, 17 nt, Human
uaacaccugauguguac

SEQ ID NO: 2263369 - RNA, 15 nt, Human
uaacacuggccccua

SEQ ID NO: 2263370 - RNA, 13 nt, Human
uaacacuggcccc

SEQ ID NO: 2263371 - RNA, 16 nt, Human
uaacacuauaaagguu

SEQ ID NO: 2263372 - RNA, 19 nt, Human
uaacacuauguuuauuuac

SEQ ID NO: 2263373 - RNA, 14 nt, Human
uaacacuauuuuau

SEQ ID NO: 2263374 - RNA, 15 nt, Human
uaacacuauuuuaug

SEQ ID NO: 2263375 - RNA, 12 nt, Human
uaaauuuguaag

SEQ ID NO: 2263376 - RNA, 13 nt, Human
uaaauuuguaagu

SEQ ID NO: 2263377 - RNA, 15 nt, Human
uaaauuuguaaguuu

SEQ ID NO: 2263378 - RNA, 16 nt, Human
uaaauuuguaaguuuc

SEQ ID NO: 2263379 - RNA, 17 nt, Human
uaaauuuguaaguuuca

SEQ ID NO: 2263380 - RNA, 18 nt, Human
uaaauuuguaaguuucag

SEQ ID NO: 2263381 - RNA, 19 nt, Human
uaaauuuguaaguuucagg

SEQ ID NO: 2263382 - RNA, 20 nt, Human
uaaauuuguaaguuucaggu

SEQ ID NO: 2263383 - RNA, 23 nt, Human
uaaauuuguaaguuucaggugac

SEQ ID NO: 2263384 - RNA, 22 nt, Human
uaacacauuaucgggagcagug

SEQ ID NO: 2263385 - RNA, 14 nt, Human
uaacacauuuugua

SEQ ID NO: 2263386 - RNA, 17 nt, Human
uaacacauuugauucug

SEQ ID NO: 2263387 - RNA, 17 nt, Human
uaacacauuuuguauaa

SEQ ID NO: 2263388 - RNA, 18 nt, Human
uaacacauuuuguauaau

SEQ ID NO: 2263389 - RNA, 23 nt, Human
uaacacauuuuguauaauuguau

SEQ ID NO: 2263390 - RNA, 18 nt, Human
uaacaccaugauuaacca

SEQ ID NO: 2263391 - RNA, 17 nt, Human
uaaauuuauuucaaaaa

SEQ ID NO: 2263392 - RNA, 17 nt, Human
uaaauuuccccaacagu

SEQ ID NO: 2263393 - RNA, 18 nt, Human
uaaauuuccccaacagug

SEQ ID NO: 2263394 - RNA, 19 nt, Human
uaaauuuccccaacagugu

SEQ ID NO: 2263395 - RNA, 15 nt, Human
uaaauuuauuucaaa

SEQ ID NO: 2263396 - RNA, 18 nt, Human
uaaauuuauuuacugcua

SEQ ID NO: 2263397 - RNA, 15 nt, Human
uaaauuuauuuacug

SEQ ID NO: 2263398 - RNA, 14 nt, Human
uaaauuuauuuacu

SEQ ID NO: 2263399 - RNA, 22 nt, Human
uaaauugaaucaguauaaacaa

SEQ ID NO: 2263400 - RNA, 19 nt, Human
uaaauugaaucaguauaaa

SEQ ID NO: 2263401 - RNA, 22 nt, Human
uaaauuugaauguuaagcagau

SEQ ID NO: 2263402 - RNA, 22 nt, Human
uaaauuuccccaacagugugaa

SEQ ID NO: 2263403 - RNA, 14 nt, Human
uaaauuugaauguu

SEQ ID NO: 2263404 - RNA, 20 nt, Human
uaaauuuccccaacagugug

SEQ ID NO: 2263405 - RNA, 21 nt, Human
uaaauuuccccaacaguguga

SEQ ID NO: 2263406 - RNA, 23 nt, Human
uaaauuuccccaacagugugaag

SEQ ID NO: 2263407 - RNA, 20 nt, Human
uaaauugacacuuaaaaaug

SEQ ID NO: 2263408 - RNA, 23 nt, Human
uaaauugacacuuaaaaaugguu

SEQ ID NO: 2263409 - RNA, 12 nt, Human
uaaauugaauaa

SEQ ID NO: 2263410 - RNA, 13 nt, Human
uaaauugaauaau

SEQ ID NO: 2263411 - RNA, 16 nt, Human
uaaauugaauaauggu

SEQ ID NO: 2263412 - RNA, 17 nt, Human
uaaauugaauaauggua

SEQ ID NO: 2263413 - RNA, 13 nt, Human
uaaauuuauguga

SEQ ID NO: 2263414 - RNA, 14 nt, Human
uaaauuccacugga

SEQ ID NO: 2263415 - RNA, 13 nt, Human
uaaauuccacugg

SEQ ID NO: 2263416 - RNA, 14 nt, Human
uaaauucaguccua

SEQ ID NO: 2263417 - RNA, 18 nt, Human
uaaauucaguccuaagaa

SEQ ID NO: 2263418 - RNA, 13 nt, Human
uaaauucauuuua

SEQ ID NO: 2263419 - RNA, 20 nt, Human
uaaauucauuuuaauuuugu

SEQ ID NO: 2263420 - RNA, 16 nt, Human
uaaauuccacuggacu

SEQ ID NO: 2263421 - RNA, 14 nt, Human
uaaauuccucuuug

SEQ ID NO: 2263422 - RNA, 12 nt, Human
uaaauuccucuu

SEQ ID NO: 2263423 - RNA, 16 nt, Human
uaaauucuugcaaagu

SEQ ID NO: 2263424 - RNA, 19 nt, Human
uaaauuccucuuugcuuug

SEQ ID NO: 2263425 - RNA, 18 nt, Human
uaaauuccucuuugcuuu

SEQ ID NO: 2263426 - RNA, 17 nt, Human
uaaauuccucuuugcuu

SEQ ID NO: 2263427 - RNA, 16 nt, Human
uaaauuccucuuugcu

SEQ ID NO: 2263428 - RNA, 20 nt, Human
uaaauuccucuuugcuuugc

SEQ ID NO: 2263429 - RNA, 22 nt, Human
uaaauucuugcaaaguaucccu

SEQ ID NO: 2263430 - RNA, 18 nt, Human
uaaauucuugcaaaguau

SEQ ID NO: 2263431 - RNA, 17 nt, Human
uaaauucuugcaaagua

SEQ ID NO: 2263432 - RNA, 23 nt, Human
uaaauucagauauauuuuucaca

SEQ ID NO: 2263433 - RNA, 20 nt, Human
uaaauucagauauauuuuuc

SEQ ID NO: 2263434 - RNA, 18 nt, Human
uaaauucagauauauuuu

SEQ ID NO: 2263435 - RNA, 17 nt, Human
uaaauucacaauagaaa

SEQ ID NO: 2263436 - RNA, 22 nt, Human
uaaauucaccuagucuaaggau

SEQ ID NO: 2263437 - RNA, 18 nt, Human
uaaauucacaaacuuuua

SEQ ID NO: 2263438 - RNA, 23 nt, Human
uaaauucaaccacuguaaaauga

SEQ ID NO: 2263439 - RNA, 16 nt, Human
uaaauucacaaacuuu

SEQ ID NO: 2263440 - RNA, 23 nt, Human
uaaaugugcauucuuuuaaaaga

SEQ ID NO: 2263441 - RNA, 20 nt, Human
uaaauucaaccacuguaaaa

SEQ ID NO: 2263442 - RNA, 11 nt, Human
uaaauuauuuu

SEQ ID NO: 2263443 - RNA, 16 nt, Human
uaaaugugcuuuuaaa

SEQ ID NO: 2263444 - RNA, 16 nt, Human
uaaaugugcauucuuu

SEQ ID NO: 2263445 - RNA, 21 nt, Human
uaaaugugcauucuuuuaaaa

SEQ ID NO: 2263446 - RNA, 12 nt, Human
uaaaugucuaau

SEQ ID NO: 2263447 - RNA, 15 nt, Human
uaaaugucuaaugua

SEQ ID NO: 2263448 - RNA, 16 nt, Human
uaaaugucuaauguau

SEQ ID NO: 2263449 - RNA, 12 nt, Human
uaaaugucuguu

SEQ ID NO: 2263450 - RNA, 21 nt, Human
uaaaugucuuuuuuuuaaugu

SEQ ID NO: 2263451 - RNA, 22 nt, Human
uaaaugucuuuuuuuuaaugug

SEQ ID NO: 2263452 - RNA, 23 nt, Human
uaaaugucuuuuuuuuaaugugc

SEQ ID NO: 2263453 - RNA, 19 nt, Human
uaaaugugaugaauacugu

SEQ ID NO: 2263454 - RNA, 16 nt, Human
uaaaugugccuucauu

SEQ ID NO: 2263455 - RNA, 12 nt, Human
uaaauggccuca

SEQ ID NO: 2263456 - RNA, 16 nt, Human
uaaauggccucaugug

SEQ ID NO: 2263457 - RNA, 22 nt, Human
uaaauggccucauguggcugga

SEQ ID NO: 2263458 - RNA, 16 nt, Human
uaaauggaaccacucu

SEQ ID NO: 2263459 - RNA, 13 nt, Human
uaaaugcuauuuu

SEQ ID NO: 2263460 - RNA, 14 nt, Human
uaaaugcuauuuuu

SEQ ID NO: 2263461 - RNA, 15 nt, Human
uaaaugcuauuuuuu

SEQ ID NO: 2263462 - RNA, 23 nt, Human
uaaaugcuauuuuuuauuuuacu

SEQ ID NO: 2263463 - RNA, 17 nt, Human
uaaaugcuuuaugcaaa

SEQ ID NO: 2263464 - RNA, 21 nt, Human
uaaaugcuuugugugauugaa

SEQ ID NO: 2263465 - RNA, 17 nt, Human
uaaauggaaaaaaugau

SEQ ID NO: 2263466 - RNA, 14 nt, Human
uaaaugcccagccc

SEQ ID NO: 2263467 - RNA, 15 nt, Human
uaaaugcccagcccc

SEQ ID NO: 2263468 - RNA, 16 nt, Human
uaaaugcccagccccu

SEQ ID NO: 2263469 - RNA, 17 nt, Human
uaaaugcccagccccuu

SEQ ID NO: 2263470 - RNA, 17 nt, Human
uaaaguucugaguguuu

SEQ ID NO: 2263471 - RNA, 23 nt, Human
uaaaguucuguacucaaauguag

SEQ ID NO: 2263472 - RNA, 17 nt, Human
uaaaguugguaaaccuu

SEQ ID NO: 2263473 - RNA, 16 nt, Human
uaaaguugguaaaccu

SEQ ID NO: 2263474 - RNA, 17 nt, Human
uaaaguuuacaguaaau

SEQ ID NO: 2263475 - RNA, 23 nt, Human
uaaaguuuacaguaaauaaauug

SEQ ID NO: 2263476 - RNA, 13 nt, Human
uaaaguuuacagu

SEQ ID NO: 2263477 - RNA, 14 nt, Human
uaaaguuuacagua

SEQ ID NO: 2263478 - RNA, 16 nt, Human
uaaaguuuacaguaaa

SEQ ID NO: 2263479 - RNA, 13 nt, Human
uaaaugcccagcc

SEQ ID NO: 2263480 - RNA, 11 nt, Human
uaaauggcugc

SEQ ID NO: 2263481 - RNA, 23 nt, Human
uaaauggccucauguggcuggaa

SEQ ID NO: 2263482 - RNA, 20 nt, Human
uaaauggcuuccuggcaaua

SEQ ID NO: 2263483 - RNA, 17 nt, Human
uaaaugggggugcauuu

SEQ ID NO: 2263484 - RNA, 14 nt, Human
uaaaugggggugca

SEQ ID NO: 2263485 - RNA, 17 nt, Human
uaaauggucgcccagga

SEQ ID NO: 2263486 - RNA, 14 nt, Human
uaaaugguauagca

SEQ ID NO: 2263487 - RNA, 16 nt, Human
uaaauggguagagaaa

SEQ ID NO: 2263488 - RNA, 17 nt, Human
uaaauggggcucacaaa

SEQ ID NO: 2263489 - RNA, 14 nt, Human
uaaaugguuaaaag

SEQ ID NO: 2263490 - RNA, 20 nt, Human
uaaaugguauagcaaauguu

SEQ ID NO: 2263491 - RNA, 15 nt, Human
uaaaugguguacaua

SEQ ID NO: 2263492 - RNA, 16 nt, Human
uaaaugguguacauaa

SEQ ID NO: 2263493 - RNA, 17 nt, Human
uaaaugguguacauaau

SEQ ID NO: 2263494 - RNA, 19 nt, Human
uaaaugggggugcauuuga

SEQ ID NO: 2263495 - RNA, 18 nt, Human
uaaaugggggugcauuug

SEQ ID NO: 2263496 - RNA, 16 nt, Human
uaaauguagguaugaa

SEQ ID NO: 2263497 - RNA, 21 nt, Human
uaaaugguguacauaauguau

SEQ ID NO: 2263498 - RNA, 16 nt, Human
uaaauguaaagauauu

SEQ ID NO: 2263499 - RNA, 13 nt, Human
uaaauguaaagau

SEQ ID NO: 2263500 - RNA, 19 nt, Human
uaaauguaacagucugauc

SEQ ID NO: 2263501 - RNA, 17 nt, Human
uaaauguaacagucuga

SEQ ID NO: 2263502 - RNA, 18 nt, Human
uaaauguaacagucugau

SEQ ID NO: 2263503 - RNA, 17 nt, Human
uaaauguaaagauauuu

SEQ ID NO: 2263504 - RNA, 13 nt, Human
uaaauguaacagu

SEQ ID NO: 2263505 - RNA, 14 nt, Human
uaaauguaacaguc

SEQ ID NO: 2263506 - RNA, 19 nt, Human
uaaauguaucuuauucaca

SEQ ID NO: 2263507 - RNA, 20 nt, Human
uaaaugucuaguuguaacac

SEQ ID NO: 2263508 - RNA, 22 nt, Human
uaaaugucucuuuaaugucaca

SEQ ID NO: 2263509 - RNA, 16 nt, Human
uaaaccaaaaacugaa

SEQ ID NO: 2263510 - RNA, 21 nt, Human
uaaacauugguucuuguauua

SEQ ID NO: 2263511 - RNA, 18 nt, Human
uaaacauugaaguaauga

SEQ ID NO: 2263512 - RNA, 22 nt, Human
uaaacauuaaucaaucaucugu

SEQ ID NO: 2263513 - RNA, 20 nt, Human
uaaacauuaguguucauagc

SEQ ID NO: 2263514 - RNA, 16 nt, Human
uaaacaugguuacaau

SEQ ID NO: 2263515 - RNA, 13 nt, Human
uaaacauguguuu

SEQ ID NO: 2263516 - RNA, 18 nt, Human
uaaacaugguuacaauca

SEQ ID NO: 2263517 - RNA, 12 nt, Human
uaaacauguguu

SEQ ID NO: 2263518 - RNA, 15 nt, Human
uaaacauguguuuua

SEQ ID NO: 2263519 - RNA, 12 nt, Human
uaaacuguguuu

SEQ ID NO: 2263520 - RNA, 20 nt, Human
uaaacuguguggacugugau

SEQ ID NO: 2263521 - RNA, 13 nt, Human
uaaacugugugca

SEQ ID NO: 2263522 - RNA, 22 nt, Human
uaaacuguguauuccaagacau

SEQ ID NO: 2263523 - RNA, 17 nt, Human
uaaacuguguauuccaa

SEQ ID NO: 2263524 - RNA, 18 nt, Human
uaaacuguguacauaacu

SEQ ID NO: 2263525 - RNA, 15 nt, Human
uaaacuguguacaua

SEQ ID NO: 2263526 - RNA, 19 nt, Human
uaaacauugguucuuguau

SEQ ID NO: 2263527 - RNA, 14 nt, Human
uaaacugugcacca

SEQ ID NO: 2263528 - RNA, 12 nt, Human
uaaacugugcac

SEQ ID NO: 2263529 - RNA, 22 nt, Human
uaaacuuagugcggacaaguuu

SEQ ID NO: 2263530 - RNA, 20 nt, Human
uaaacuucauggucaugggu

SEQ ID NO: 2263531 - RNA, 13 nt, Human
uaaacuguguuua

SEQ ID NO: 2263532 - RNA, 22 nt, Human
uaaacuguguggacugugaugc

SEQ ID NO: 2263533 - RNA, 20 nt, Human
uaaacuuagaauaaaauugu

SEQ ID NO: 2263534 - RNA, 21 nt, Human
uaaacuuagaauaaaauugua

SEQ ID NO: 2263535 - RNA, 22 nt, Human
uaaacuugguuuuuaaaaaacu

SEQ ID NO: 2263536 - RNA, 18 nt, Human
uaaacuuccccaucuucu

SEQ ID NO: 2263537 - RNA, 14 nt, Human
uaaacuucucugaa

SEQ ID NO: 2263538 - RNA, 17 nt, Human
uaaacuucucugaaggg

SEQ ID NO: 2263539 - RNA, 20 nt, Human
uaaacuucucugaagggagg

SEQ ID NO: 2263540 - RNA, 21 nt, Human
uaaacuucucugaagggaggu

SEQ ID NO: 2263541 - RNA, 17 nt, Human
uaaacuuuuuuuugaga

SEQ ID NO: 2263542 - RNA, 18 nt, Human
uaaacuuuuuuuugagaa

SEQ ID NO: 2263543 - RNA, 17 nt, Human
uaaagaaaaagucaucc

SEQ ID NO: 2263544 - RNA, 20 nt, Human
uaaaaucuuggcacagaaac

SEQ ID NO: 2263545 - RNA, 19 nt, Human
uaaacaagaccacguuucu

SEQ ID NO: 2263546 - RNA, 20 nt, Human
uaaacaagaccacguuucua

SEQ ID NO: 2263547 - RNA, 22 nt, Human
uaaacaagaccacguuucuaaa

SEQ ID NO: 2263548 - RNA, 21 nt, Human
uaaacaagaccacguuucuaa

SEQ ID NO: 2263549 - RNA, 16 nt, Human
uaaaaucuugaaaaug

SEQ ID NO: 2263550 - RNA, 19 nt, Human
uaaaaucuuggcacagaaa

SEQ ID NO: 2263551 - RNA, 13 nt, Human
uaaaaucuuaaac

SEQ ID NO: 2263552 - RNA, 14 nt, Human
uaaaaucugucacg

SEQ ID NO: 2263553 - RNA, 13 nt, Human
uaaaaucugucac

SEQ ID NO: 2263554 - RNA, 19 nt, Human
uaaaaucauguacauuucu

SEQ ID NO: 2263555 - RNA, 18 nt, Human
uaaaaucauguacauuuc

SEQ ID NO: 2263556 - RNA, 15 nt, Human
uaaaaucauguacau

SEQ ID NO: 2263557 - RNA, 23 nt, Human
uaaaaucagccaauuauguuaaa

SEQ ID NO: 2263558 - RNA, 17 nt, Human
uaaacauccuucaagaa

SEQ ID NO: 2263559 - RNA, 17 nt, Human
uaaacauccaauauuuu

SEQ ID NO: 2263560 - RNA, 20 nt, Human
uaaacauccaauauuuucuu

SEQ ID NO: 2263561 - RNA, 15 nt, Human
uaaacaucacacaca

SEQ ID NO: 2263562 - RNA, 18 nt, Human
uaaacacccuucacauac

SEQ ID NO: 2263563 - RNA, 16 nt, Human
uaaacaucacacacac

SEQ ID NO: 2263564 - RNA, 18 nt, Human
uaaacacucuugaaaaau

SEQ ID NO: 2263565 - RNA, 15 nt, Human
uaaacacucuugaaa

SEQ ID NO: 2263566 - RNA, 17 nt, Human
uaaacacucuugaaaaa

SEQ ID NO: 2263567 - RNA, 18 nt, Human
uaaacacgccugcaaacg

SEQ ID NO: 2263568 - RNA, 22 nt, Human
uaaacacccaugaaucaaagac

SEQ ID NO: 2263569 - RNA, 23 nt, Human
uaaacacccaugaaucaaagaca

SEQ ID NO: 2263570 - RNA, 15 nt, Human
uaaaguuagucuacu

SEQ ID NO: 2263571 - RNA, 18 nt, Human
uaaaguguuucuguuauu

SEQ ID NO: 2263572 - RNA, 16 nt, Human
uaaaguuagucuacuc

SEQ ID NO: 2263573 - RNA, 20 nt, Human
uaaaguuagucuacucuuaa

SEQ ID NO: 2263574 - RNA, 17 nt, Human
uaaaguguguuucuaug

SEQ ID NO: 2263575 - RNA, 23 nt, Human
uaaaguguccauugacauguaca

SEQ ID NO: 2263576 - RNA, 18 nt, Human
uaaaguguggucccaaca

SEQ ID NO: 2263577 - RNA, 20 nt, Human
uaaaguguggucccaacagg

SEQ ID NO: 2263578 - RNA, 17 nt, Human
uaaaguguguuguugcu

SEQ ID NO: 2263579 - RNA, 18 nt, Human
uaaaguguguuguugcuu

SEQ ID NO: 2263580 - RNA, 17 nt, Human
uaaaguguuucuguuau

SEQ ID NO: 2263581 - RNA, 16 nt, Human
uaaaguuacuuuguca

SEQ ID NO: 2263582 - RNA, 20 nt, Human
uaaaggccucuuccuugcug

SEQ ID NO: 2263583 - RNA, 18 nt, Human
uaaaguguccauugacau

SEQ ID NO: 2263584 - RNA, 20 nt, Human
uaaaguguccauugacaugu

SEQ ID NO: 2263585 - RNA, 21 nt, Human
uaaaguguccauugacaugua

SEQ ID NO: 2263586 - RNA, 22 nt, Human
uaaaguguccauugacauguac

SEQ ID NO: 2263587 - RNA, 17 nt, Human
uaaaggcuaccuuugua

SEQ ID NO: 2263588 - RNA, 14 nt, Human
uaaaguguuugaaa

SEQ ID NO: 2263589 - RNA, 21 nt, Human
uaaagcugccuguaguuagga

SEQ ID NO: 2263590 - RNA, 18 nt, Human
uaaagcugccuguaguua

SEQ ID NO: 2263591 - RNA, 23 nt, Human
uaaagcugccuguaguuaggaaa

SEQ ID NO: 2263592 - RNA, 19 nt, Human
uaaagcuugcaacaaaauu

SEQ ID NO: 2263593 - RNA, 17 nt, Human
uaaagcugccuguaguu

SEQ ID NO: 2263594 - RNA, 16 nt, Human
uaaagcugccuguagu

SEQ ID NO: 2263595 - RNA, 14 nt, Human
uaaagcugaaaacu

SEQ ID NO: 2263596 - RNA, 20 nt, Human
uaaagccugaguuugcuuuc

SEQ ID NO: 2263597 - RNA, 16 nt, Human
uaaaggaaaugauuga

SEQ ID NO: 2263598 - RNA, 13 nt, Human
uaaaggaaaugau

SEQ ID NO: 2263599 - RNA, 15 nt, Human
uaaaggcuaccuuug

SEQ ID NO: 2263600 - RNA, 21 nt, Human
uaaaggcccuaucuguuuaca

SEQ ID NO: 2263601 - RNA, 18 nt, Human
uaaagaaaaucucuguga

SEQ ID NO: 2263602 - RNA, 12 nt, Human
uaaagaaaacug

SEQ ID NO: 2263603 - RNA, 19 nt, Human
uaaagaaaauaucugaaau

SEQ ID NO: 2263604 - RNA, 12 nt, Human
uaaagaaagaga

SEQ ID NO: 2263605 - RNA, 14 nt, Human
uaaagaaagagaga

SEQ ID NO: 2263606 - RNA, 13 nt, Human
uaaagaaagagag

SEQ ID NO: 2263607 - RNA, 23 nt, Human
uaaagcaauaauggucccaucca

SEQ ID NO: 2263608 - RNA, 23 nt, Human
uaaagcaacugucuauuucugcu

SEQ ID NO: 2263609 - RNA, 20 nt, Human
uaaagcaacuguuaugaaau

SEQ ID NO: 2263610 - RNA, 22 nt, Human
uaaagcaacuguuaugaaauaa

SEQ ID NO: 2263611 - RNA, 17 nt, Human
uaaagcaauaugcauuu

SEQ ID NO: 2263612 - RNA, 15 nt, Human
uaaagcaauaugcau

SEQ ID NO: 2263613 - RNA, 11 nt, Human
uaaagcaauuu

SEQ ID NO: 2263614 - RNA, 12 nt, Human
uaaagcaauuuu

SEQ ID NO: 2263615 - RNA, 13 nt, Human
uaaagcaauuuuc

SEQ ID NO: 2263616 - RNA, 14 nt, Human
uaaagcaauuuucc

SEQ ID NO: 2263617 - RNA, 15 nt, Human
uaaagcaauuuuccu

SEQ ID NO: 2263618 - RNA, 16 nt, Human
uaaagcaauuuuccuu

SEQ ID NO: 2263619 - RNA, 17 nt, Human
uaaagcaauuuuccuug

SEQ ID NO: 2263620 - RNA, 19 nt, Human
uaaagcaauuuuccuugaa

SEQ ID NO: 2263621 - RNA, 20 nt, Human
uaaagcaauuuuccuugaag

SEQ ID NO: 2263622 - RNA, 21 nt, Human
uaaagcaauuuuccuugaagc

SEQ ID NO: 2263623 - RNA, 22 nt, Human
uaaagcaauuuuccuugaagcc

SEQ ID NO: 2263624 - RNA, 23 nt, Human
uaaagcaauuuuccuugaagccg

SEQ ID NO: 2263625 - RNA, 20 nt, Human
uaaagcagagggacuuugua

SEQ ID NO: 2263626 - RNA, 22 nt, Human
uaaagcacagucugaugacaca

SEQ ID NO: 2263627 - RNA, 12 nt, Human
uaaagccuccuc

SEQ ID NO: 2263628 - RNA, 18 nt, Human
uaaagcaggcagaacuca

SEQ ID NO: 2263629 - RNA, 19 nt, Human
uaaagcagcguuucuauga

SEQ ID NO: 2263630 - RNA, 17 nt, Human
uaaagcagcguuucuau

SEQ ID NO: 2263631 - RNA, 16 nt, Human
uaaagcagcguuucua

SEQ ID NO: 2263632 - RNA, 12 nt, Human
uaaaacauguaa

SEQ ID NO: 2263633 - RNA, 14 nt, Human
uaaaacauguaaua

SEQ ID NO: 2263634 - RNA, 13 nt, Human
uaaaacauuaaga

SEQ ID NO: 2263635 - RNA, 12 nt, Human
uaaaacauuaau

SEQ ID NO: 2263636 - RNA, 14 nt, Human
uaaaacauuaagaa

SEQ ID NO: 2263637 - RNA, 16 nt, Human
uaaaacauuaagaaaa

SEQ ID NO: 2263638 - RNA, 17 nt, Human
uaaaacauuaagaaaau

SEQ ID NO: 2263639 - RNA, 17 nt, Human
uaaaacauuuucacaca

SEQ ID NO: 2263640 - RNA, 15 nt, Human
uaaaacauuuucaca

SEQ ID NO: 2263641 - RNA, 16 nt, Human
uaaaacauuuuaaaug

SEQ ID NO: 2263642 - RNA, 17 nt, Human
uaaaacauuuuaaaugg

SEQ ID NO: 2263643 - RNA, 18 nt, Human
uaaaacauuuuaaaugga

SEQ ID NO: 2263644 - RNA, 21 nt, Human
uaaaacauuuuaaauggacag

SEQ ID NO: 2263645 - RNA, 14 nt, Human
uaaaacauuuuaaa

SEQ ID NO: 2263646 - RNA, 18 nt, Human
uaaaacauuuucacacaa

SEQ ID NO: 2263647 - RNA, 22 nt, Human
uaaaacauuuuaaauggacaga

SEQ ID NO: 2263648 - RNA, 11 nt, Human
uaaaaccaaag

SEQ ID NO: 2263649 - RNA, 13 nt, Human
uaaaaccacagca

SEQ ID NO: 2263650 - RNA, 18 nt, Human
uaaaagagguuuuucuua

SEQ ID NO: 2263651 - RNA, 18 nt, Human
uaaaagagauuucaagag

SEQ ID NO: 2263652 - RNA, 20 nt, Human
uaaaagagauuucaagagau

SEQ ID NO: 2263653 - RNA, 13 nt, Human
uaaaaccaaagag

SEQ ID NO: 2263654 - RNA, 16 nt, Human
uaaaagagauuucaag

SEQ ID NO: 2263655 - RNA, 17 nt, Human
uaaaagagauuucaaga

SEQ ID NO: 2263656 - RNA, 23 nt, Human
uaaaagauaacaagaucuuucag

SEQ ID NO: 2263657 - RNA, 12 nt, Human
uaaaagauauaa

SEQ ID NO: 2263658 - RNA, 13 nt, Human
uaaaagauauaag

SEQ ID NO: 2263659 - RNA, 16 nt, Human
uaaaagauauaagugc

SEQ ID NO: 2263660 - RNA, 21 nt, Human
uaaaagauacaguuacucaga

SEQ ID NO: 2263661 - RNA, 12 nt, Human
uaaaagauucau

SEQ ID NO: 2263662 - RNA, 14 nt, Human
uaaaagauucauuu

SEQ ID NO: 2263663 - RNA, 19 nt, Human
uaaaagauucauuuuuaau

SEQ ID NO: 2263664 - RNA, 20 nt, Human
uaaaagauucauuuuuaauc

SEQ ID NO: 2263665 - RNA, 18 nt, Human
uaaaagauauaagugcug

SEQ ID NO: 2263666 - RNA, 19 nt, Human
uaaaagauauaagugcugu

SEQ ID NO: 2263667 - RNA, 20 nt, Human
uaaaagauauaagugcugua

SEQ ID NO: 2263668 - RNA, 21 nt, Human
uaaaagauauaagugcuguau

SEQ ID NO: 2263669 - RNA, 20 nt, Human
uaaaagauacaguuacucag

SEQ ID NO: 2263670 - RNA, 17 nt, Human
uaaaagauacaguuacu

SEQ ID NO: 2263671 - RNA, 14 nt, Human
uaaaagauacaguu

SEQ ID NO: 2263672 - RNA, 17 nt, Human
uaaaagauaaauauuau

SEQ ID NO: 2263673 - RNA, 21 nt, Human
uaaaagagguuuuucuuaaau

SEQ ID NO: 2263674 - RNA, 19 nt, Human
uaaaagagguuuuucuuaa

SEQ ID NO: 2263675 - RNA, 11 nt, Human
uaaaagcacac

SEQ ID NO: 2263676 - RNA, 17 nt, Human
uaaaagcaauuccaacc

SEQ ID NO: 2263677 - RNA, 21 nt, Human
uaaaaggaaaucucaccccau

SEQ ID NO: 2263678 - RNA, 19 nt, Human
uaaaaggaagccaaagagu

SEQ ID NO: 2263679 - RNA, 21 nt, Human
uaaaagcagcaucugcuaaua

SEQ ID NO: 2263680 - RNA, 20 nt, Human
uaaaagcagcaucugcuaau

SEQ ID NO: 2263681 - RNA, 11 nt, Human
uaaaagcagca

SEQ ID NO: 2263682 - RNA, 12 nt, Human
uaaaaggagcca

SEQ ID NO: 2263683 - RNA, 14 nt, Human
uaaaaggaagccaa

SEQ ID NO: 2263684 - RNA, 15 nt, Human
uaaaaggccaaaccu

SEQ ID NO: 2263685 - RNA, 19 nt, Human
uaaaaggcaaauguguaca

SEQ ID NO: 2263686 - RNA, 18 nt, Human
uaaaaggcaaauguguac

SEQ ID NO: 2263687 - RNA, 21 nt, Human
uaaaagguaugcaaucaaauc

SEQ ID NO: 2263688 - RNA, 20 nt, Human
uaaaaggccaaaccucuguu

SEQ ID NO: 2263689 - RNA, 18 nt, Human
uaaaaggccaaaccucug

SEQ ID NO: 2263690 - RNA, 19 nt, Human
uaaaagggauuacccaagc

SEQ ID NO: 2263691 - RNA, 20 nt, Human
uaaaagggauuacccaagca

SEQ ID NO: 2263692 - RNA, 21 nt, Human
uaaaagggauuacccaagcaa

SEQ ID NO: 2263693 - RNA, 20 nt, Human
uaaaagggcucuuuagccag

SEQ ID NO: 2263694 - RNA, 12 nt, Human
uaaaaggugacc

SEQ ID NO: 2263695 - RNA, 19 nt, Human
uaaaaggugaccaaugaug

SEQ ID NO: 2263696 - RNA, 22 nt, Human
uaaaagguauuaaauugauguu

SEQ ID NO: 2263697 - RNA, 13 nt, Human
uaaaaucauuucu

SEQ ID NO: 2263698 - RNA, 10 nt, Human
uaaaaucauu

SEQ ID NO: 2263699 - RNA, 15 nt, Human
uaaaauccauacauu

SEQ ID NO: 2263700 - RNA, 17 nt, Human
uaaaauccauacauuug

SEQ ID NO: 2263701 - RNA, 22 nt, Human
uaaaaucauuucugcaucagcu

SEQ ID NO: 2263702 - RNA, 18 nt, Human
uaaaaucauuucugcauc

SEQ ID NO: 2263703 - RNA, 14 nt, Human
uaaaacagaagccu

SEQ ID NO: 2263704 - RNA, 21 nt, Human
uaaaacacaccuaagagaaaa

SEQ ID NO: 2263705 - RNA, 19 nt, Human
uaaaacacuuccauaaucu

SEQ ID NO: 2263706 - RNA, 19 nt, Human
uaaaacagacacuggcaug

SEQ ID NO: 2263707 - RNA, 18 nt, Human
uaaaacagacacuggcau

SEQ ID NO: 2263708 - RNA, 17 nt, Human
uaaaacagacacuggca

SEQ ID NO: 2263709 - RNA, 15 nt, Human
uaaaacagacacugg

SEQ ID NO: 2263710 - RNA, 13 nt, Human
uaaaacagacacu

SEQ ID NO: 2263711 - RNA, 18 nt, Human
uaaaacaauauuguuucu

SEQ ID NO: 2263712 - RNA, 14 nt, Human
uaaaacaauauugu

SEQ ID NO: 2263713 - RNA, 23 nt, Human
uaaaacaauaaaauuuuuuuuca

SEQ ID NO: 2263714 - RNA, 17 nt, Human
uaaaacacaacaucuuu

SEQ ID NO: 2263715 - RNA, 22 nt, Human
uaaaacacaacaucuuuuucua

SEQ ID NO: 2263716 - RNA, 23 nt, Human
uaaaacacaacaucuuuuucuac

SEQ ID NO: 2263717 - RNA, 15 nt, Human
uaaaacaacacucac

SEQ ID NO: 2263718 - RNA, 22 nt, Human
uaaaacaagcacuaaacaaaga

SEQ ID NO: 2263719 - RNA, 16 nt, Human
uaaaacaaaagcucau

SEQ ID NO: 2263720 - RNA, 17 nt, Human
uaaaacaaaauuuguuu

SEQ ID NO: 2263721 - RNA, 23 nt, Human
uaaaaauuguuucaaaauaaaaa

SEQ ID NO: 2263722 - RNA, 15 nt, Human
uaaaaauucugaaug

SEQ ID NO: 2263723 - RNA, 17 nt, Human
uaaaaauugugaucaga

SEQ ID NO: 2263724 - RNA, 22 nt, Human
uaaaaauuguuaauuuuuccua

SEQ ID NO: 2263725 - RNA, 21 nt, Human
uaaaaauguaaauauucuaua

SEQ ID NO: 2263726 - RNA, 19 nt, Human
uaaaaauguaaauauucua

SEQ ID NO: 2263727 - RNA, 20 nt, Human
uaaaaauguaaauauucuau

SEQ ID NO: 2263728 - RNA, 14 nt, Human
uaaaaauucugaau

SEQ ID NO: 2263729 - RNA, 17 nt, Human
uaaaaauucugaaugua

SEQ ID NO: 2263730 - RNA, 22 nt, Human
uaaaaauguuaaaauguauucu

SEQ ID NO: 2263731 - RNA, 17 nt, Human
guuuuuaauaaagacag

SEQ ID NO: 2263732 - RNA, 21 nt, Human
guuuuuaaggguuuguggaaa

SEQ ID NO: 2263733 - RNA, 18 nt, Human
guuuuuaauauaaagccu

SEQ ID NO: 2263734 - RNA, 13 nt, Human
guuuuuaagcugu

SEQ ID NO: 2263735 - RNA, 14 nt, Human
guuuuuaagcuguu

SEQ ID NO: 2263736 - RNA, 15 nt, Human
guuuuuaagcuguuu

SEQ ID NO: 2263737 - RNA, 19 nt, Human
guuuuuaagcuguuuccau

SEQ ID NO: 2263738 - RNA, 15 nt, Human
guuuuguuugcuauc

SEQ ID NO: 2263739 - RNA, 18 nt, Human
guuuuguuugcuaucuua

SEQ ID NO: 2263740 - RNA, 19 nt, Human
guuuuguuuccuuucacug

SEQ ID NO: 2263741 - RNA, 21 nt, Human
uaaaaacaaagaaauuaugug

SEQ ID NO: 2263742 - RNA, 17 nt, Human
uaaaaacaaagaaauua

SEQ ID NO: 2263743 - RNA, 13 nt, Human
guuuuuacccaua

SEQ ID NO: 2263744 - RNA, 14 nt, Human
guuuuuacccauau

SEQ ID NO: 2263745 - RNA, 16 nt, Human
guuuuuacccauaucc

SEQ ID NO: 2263746 - RNA, 18 nt, Human
guuuuuacccauaucccc

SEQ ID NO: 2263747 - RNA, 20 nt, Human
guuuuuacccauauccccuc

SEQ ID NO: 2263748 - RNA, 22 nt, Human
uaaaaacaaaggagauaaaucu

SEQ ID NO: 2263749 - RNA, 16 nt, Human
uaaaaacagcauugcu

SEQ ID NO: 2263750 - RNA, 16 nt, Human
uaaaaagaaacaagau

SEQ ID NO: 2263751 - RNA, 18 nt, Human
uaaaaagaaacaagaugc

SEQ ID NO: 2263752 - RNA, 19 nt, Human
uaaaaagaaacaagaugcu

SEQ ID NO: 2263753 - RNA, 21 nt, Human
uaaaaagacauucuuccaaaa

SEQ ID NO: 2263754 - RNA, 19 nt, Human
uaaaaagagagaaaacuua

SEQ ID NO: 2263755 - RNA, 20 nt, Human
uaaaaagagagaaaacuuau

SEQ ID NO: 2263756 - RNA, 13 nt, Human
uaaaaagaaggaa

SEQ ID NO: 2263757 - RNA, 20 nt, Human
uaaaaagaaggaaaaugauc

SEQ ID NO: 2263758 - RNA, 21 nt, Human
uaaaaagaaggaaaaugaucu

SEQ ID NO: 2263759 - RNA, 20 nt, Human
uaaaaagauugaaguauuuu

SEQ ID NO: 2263760 - RNA, 18 nt, Human
uaaaaagauugaaguauu

SEQ ID NO: 2263761 - RNA, 14 nt, Human
uaaaaagaucacuu

SEQ ID NO: 2263762 - RNA, 13 nt, Human
uaaaaauguaaau

SEQ ID NO: 2263763 - RNA, 18 nt, Human
uaaaaauguaaauauucu

SEQ ID NO: 2263764 - RNA, 13 nt, Human
uaaaaagauuugu

SEQ ID NO: 2263765 - RNA, 19 nt, Human
uaaaaaugguuuaaauggu

SEQ ID NO: 2263766 - RNA, 18 nt, Human
uaaaaaugguuuaaaugg

SEQ ID NO: 2263767 - RNA, 23 nt, Human
guugucaauauuaaauacagaca

SEQ ID NO: 2263768 - RNA, 16 nt, Human
guugucaauauuaaau

SEQ ID NO: 2263769 - RNA, 17 nt, Human
guugucaauauuaaaua

SEQ ID NO: 2263770 - RNA, 19 nt, Human
guugucaauauuaaauaca

SEQ ID NO: 2263771 - RNA, 21 nt, Human
guugucaauauuaaauacaga

SEQ ID NO: 2263772 - RNA, 17 nt, Human
guuggcugggcccagaa

SEQ ID NO: 2263773 - RNA, 15 nt, Human
guugucaauauuaaa

SEQ ID NO: 2263774 - RNA, 22 nt, Human
guugucaagucucugcuggccc

SEQ ID NO: 2263775 - RNA, 17 nt, Human
guugucaagucucugcu

SEQ ID NO: 2263776 - RNA, 19 nt, Human
guuggcugggggccucagu

SEQ ID NO: 2263777 - RNA, 15 nt, Human
guuguccuaugggag

SEQ ID NO: 2263778 - RNA, 16 nt, Human
guuguccuccccuugg

SEQ ID NO: 2263779 - RNA, 19 nt, Human
guuguccuccccuugggcg

SEQ ID NO: 2263780 - RNA, 20 nt, Human
guugucauugcuguuguccc

SEQ ID NO: 2263781 - RNA, 22 nt, Human
guuguccaauuguugacaguuc

SEQ ID NO: 2263782 - RNA, 13 nt, Human
guugucccucugc

SEQ ID NO: 2263783 - RNA, 17 nt, Human
guugucccucugcuacg

SEQ ID NO: 2263784 - RNA, 12 nt, Human
guugucagcuga

SEQ ID NO: 2263785 - RNA, 20 nt, Human
guuggccccugcccggcugc

SEQ ID NO: 2263786 - RNA, 13 nt, Human
guuggccugcacu

SEQ ID NO: 2263787 - RNA, 13 nt, Human
guuggccucugca

SEQ ID NO: 2263788 - RNA, 17 nt, Human
guuggcccaagcucuug

SEQ ID NO: 2263789 - RNA, 13 nt, Human
guuggccccugcc

SEQ ID NO: 2263790 - RNA, 14 nt, Human
guuggccccugccc

SEQ ID NO: 2263791 - RNA, 20 nt, Human
guuggcugacuuccacaccu

SEQ ID NO: 2263792 - RNA, 13 nt, Human
guuggccuccggc

SEQ ID NO: 2263793 - RNA, 18 nt, Human
guuggcgagaggaggggc

SEQ ID NO: 2263794 - RNA, 19 nt, Human
guuggcgcacccuccccuc

SEQ ID NO: 2263795 - RNA, 21 nt, Human
guuggcgcacccuccccuccc

SEQ ID NO: 2263796 - RNA, 16 nt, Human
guuggcugggcccaga

SEQ ID NO: 2263797 - RNA, 14 nt, Human
guuggcugggccca

SEQ ID NO: 2263798 - RNA, 13 nt, Human
guuggcugggccc

SEQ ID NO: 2263799 - RNA, 17 nt, Human
guuggcugggaacucac

SEQ ID NO: 2263800 - RNA, 14 nt, Human
guuggcuggaugaa

SEQ ID NO: 2263801 - RNA, 12 nt, Human
guuggcuggccu

SEQ ID NO: 2263802 - RNA, 13 nt, Human
guuggcuggccuu

SEQ ID NO: 2263803 - RNA, 12 nt, Human
guuggcuggggg

SEQ ID NO: 2263804 - RNA, 22 nt, Human
guugugaggccuggccaggcac

SEQ ID NO: 2263805 - RNA, 16 nt, Human
guugugccccuuucca

SEQ ID NO: 2263806 - RNA, 17 nt, Human
guugugcaaauuaacag

SEQ ID NO: 2263807 - RNA, 20 nt, Human
guugugaguuuaccuuguau

SEQ ID NO: 2263808 - RNA, 21 nt, Human
guugugauagcuaacauuuua

SEQ ID NO: 2263809 - RNA, 18 nt, Human
guugugaccugaaguuca

SEQ ID NO: 2263810 - RNA, 17 nt, Human
guugugaccuuaguguu

SEQ ID NO: 2263811 - RNA, 13 nt, Human
guugugaggccug

SEQ ID NO: 2263812 - RNA, 14 nt, Human
guugugaggccugg

SEQ ID NO: 2263813 - RNA, 13 nt, Human
guugugaccugaa

SEQ ID NO: 2263814 - RNA, 17 nt, Human
guugugaccugaaguuc

SEQ ID NO: 2263815 - RNA, 14 nt, Human
guugugaauguugu

SEQ ID NO: 2263816 - RNA, 22 nt, Human
guugucugaagucacugcacag

SEQ ID NO: 2263817 - RNA, 19 nt, Human
guugucugaagucacugca

SEQ ID NO: 2263818 - RNA, 13 nt, Human
guugucucccugg

SEQ ID NO: 2263819 - RNA, 14 nt, Human
guugucucccuggc

SEQ ID NO: 2263820 - RNA, 18 nt, Human
guugucucuagagcaggg

SEQ ID NO: 2263821 - RNA, 15 nt, Human
guugucucccuggcc

SEQ ID NO: 2263822 - RNA, 16 nt, Human
guugucucccuggccc

SEQ ID NO: 2263823 - RNA, 17 nt, Human
guugucucccuggcccu

SEQ ID NO: 2263824 - RNA, 19 nt, Human
guugucucccuggcccuca

SEQ ID NO: 2263825 - RNA, 15 nt, Human
guuguuaauaaaagu

SEQ ID NO: 2263826 - RNA, 19 nt, Human
guuguuaaugaaaauguca

SEQ ID NO: 2263827 - RNA, 18 nt, Human
guuguuaaugaaaauguc

SEQ ID NO: 2263828 - RNA, 17 nt, Human
guuguuaaugaaaaugu

SEQ ID NO: 2263829 - RNA, 16 nt, Human
guuguuaaugaaaaug

SEQ ID NO: 2263830 - RNA, 22 nt, Human
guugugugugggaguguguaau

SEQ ID NO: 2263831 - RNA, 14 nt, Human
guuguguugucacc

SEQ ID NO: 2263832 - RNA, 12 nt, Human
guuguguuguca

SEQ ID NO: 2263833 - RNA, 16 nt, Human
guugugugugggagug

SEQ ID NO: 2263834 - RNA, 14 nt, Human
guugugugugggag

SEQ ID NO: 2263835 - RNA, 13 nt, Human
guuguguguggga

SEQ ID NO: 2263836 - RNA, 12 nt, Human
guuguguguggg

SEQ ID NO: 2263837 - RNA, 14 nt, Human
guugugguuaaucu

SEQ ID NO: 2263838 - RNA, 16 nt, Human
guuguguacguggaga

SEQ ID NO: 2263839 - RNA, 16 nt, Human
guugugggugggagag

SEQ ID NO: 2263840 - RNA, 17 nt, Human
guuguggugcugacaaa

SEQ ID NO: 2263841 - RNA, 14 nt, Human
guuguguauagaug

SEQ ID NO: 2263842 - RNA, 21 nt, Human
guuguggagagugcaacagua

SEQ ID NO: 2263843 - RNA, 19 nt, Human
guuguggaaagccucugcu

SEQ ID NO: 2263844 - RNA, 15 nt, Human
guugugggugggaga

SEQ ID NO: 2263845 - RNA, 22 nt, Human
guuguggauuuaacagaaaugu

SEQ ID NO: 2263846 - RNA, 15 nt, Human
guuucccauaauuuu

SEQ ID NO: 2263847 - RNA, 16 nt, Human
guuucauucuccugcc

SEQ ID NO: 2263848 - RNA, 19 nt, Human
guuucauguuuugugacua

SEQ ID NO: 2263849 - RNA, 15 nt, Human
guuucauucuccugc

SEQ ID NO: 2263850 - RNA, 18 nt, Human
guuucauguuuugugacu

SEQ ID NO: 2263851 - RNA, 14 nt, Human
guuucauauuucuu

SEQ ID NO: 2263852 - RNA, 16 nt, Human
guuucauccuuuucau

SEQ ID NO: 2263853 - RNA, 18 nt, Human
guuucauguaauccucaa

SEQ ID NO: 2263854 - RNA, 21 nt, Human
guuucagugucaaauaaacac

SEQ ID NO: 2263855 - RNA, 23 nt, Human
guuucagugucaaauaaacacug

SEQ ID NO: 2263856 - RNA, 14 nt, Human
guuucaggugacau

SEQ ID NO: 2263857 - RNA, 15 nt, Human
guuucaggugacaug

SEQ ID NO: 2263858 - RNA, 16 nt, Human
guuucaggugacaugu

SEQ ID NO: 2263859 - RNA, 20 nt, Human
guuucaggugacaugugaaa

SEQ ID NO: 2263860 - RNA, 18 nt, Human
guuucauacucuagauuu

SEQ ID NO: 2263861 - RNA, 22 nt, Human
guuucagugucaaauaaacacu

SEQ ID NO: 2263862 - RNA, 17 nt, Human
guuucauacucuagauu

SEQ ID NO: 2263863 - RNA, 13 nt, Human
guuucauauuucu

SEQ ID NO: 2263864 - RNA, 19 nt, Human
guuuauaucucucaugcau

SEQ ID NO: 2263865 - RNA, 14 nt, Human
guuuaucauucaag

SEQ ID NO: 2263866 - RNA, 15 nt, Human
guuuaucauucaagu

SEQ ID NO: 2263867 - RNA, 16 nt, Human
guuuaucauucaagug

SEQ ID NO: 2263868 - RNA, 17 nt, Human
guuuaucauucaagugu

SEQ ID NO: 2263869 - RNA, 20 nt, Human
guuuaucauucaaguguaaa

SEQ ID NO: 2263870 - RNA, 15 nt, Human
guuuauaccuuugcc

SEQ ID NO: 2263871 - RNA, 18 nt, Human
guuuaguggcucaacauu

SEQ ID NO: 2263872 - RNA, 15 nt, Human
guuuaguuaaaugag

SEQ ID NO: 2263873 - RNA, 12 nt, Human
guuuauauaaau

SEQ ID NO: 2263874 - RNA, 20 nt, Human
guuuauagcaaacuuggaau

SEQ ID NO: 2263875 - RNA, 20 nt, Human
guuuauagagggccaagacu

SEQ ID NO: 2263876 - RNA, 21 nt, Human
guuuauagagggccaagacuu

SEQ ID NO: 2263877 - RNA, 20 nt, Human
guuuauauaagcuuguauuc

SEQ ID NO: 2263878 - RNA, 19 nt, Human
guuuaggaacuacugagga

SEQ ID NO: 2263879 - RNA, 20 nt, Human
guuuagcuggaaaaguaugu

SEQ ID NO: 2263880 - RNA, 21 nt, Human
guuuagcuggaaaaguauguu

SEQ ID NO: 2263881 - RNA, 16 nt, Human
guuguuauggaaacug

SEQ ID NO: 2263882 - RNA, 19 nt, Human
guuguuacuaacuaaacuc

SEQ ID NO: 2263883 - RNA, 20 nt, Human
guuguuacuaacuaaacucu

SEQ ID NO: 2263884 - RNA, 21 nt, Human
guuguuacuaacuaaacucuc

SEQ ID NO: 2263885 - RNA, 15 nt, Human
guuguuacauuuuua

SEQ ID NO: 2263886 - RNA, 14 nt, Human
guuguuacauuuuu

SEQ ID NO: 2263887 - RNA, 11 nt, Human
guuguuucuuu

SEQ ID NO: 2263888 - RNA, 13 nt, Human
guuguuucuuucu

SEQ ID NO: 2263889 - RNA, 14 nt, Human
guuguuucuuucua

SEQ ID NO: 2263890 - RNA, 15 nt, Human
guuguuucuuucuag

SEQ ID NO: 2263891 - RNA, 20 nt, Human
guuguuugauucagacagcu

SEQ ID NO: 2263892 - RNA, 24 nt, Human
guuguuguuaaugaaaaugucaga

SEQ ID NO: 2263893 - RNA, 16 nt, Human
guuguuguuaaauauc

SEQ ID NO: 2263894 - RNA, 20 nt, Human
guuguuuacuuaaagauuua

SEQ ID NO: 2263895 - RNA, 13 nt, Human
guuuacuauuuua

SEQ ID NO: 2263896 - RNA, 23 nt, Human
guuuaccuuuuaauuaaugaaau

SEQ ID NO: 2263897 - RNA, 16 nt, Human
guuuagaagaagugug

SEQ ID NO: 2263898 - RNA, 15 nt, Human
guuuagauaauacac

SEQ ID NO: 2263899 - RNA, 14 nt, Human
guuuagauaauaca

SEQ ID NO: 2263900 - RNA, 16 nt, Human
guuuaccugugaaaua

SEQ ID NO: 2263901 - RNA, 12 nt, Human
guuuaccuugua

SEQ ID NO: 2263902 - RNA, 16 nt, Human
guuuaccugaauaaau

SEQ ID NO: 2263903 - RNA, 22 nt, Human
guuuaccugaauaaaugguagu

SEQ ID NO: 2263904 - RNA, 20 nt, Human
guuuacuaugccugugucuu

SEQ ID NO: 2263905 - RNA, 17 nt, Human
guuuacuaugccugugu

SEQ ID NO: 2263906 - RNA, 16 nt, Human
guuuacuaugccugug

SEQ ID NO: 2263907 - RNA, 22 nt, Human
guuuacuagggaucccucaucu

SEQ ID NO: 2263908 - RNA, 22 nt, Human
guuguuugaugcauuaaaagaa

SEQ ID NO: 2263909 - RNA, 18 nt, Human
guuguuugagaaauuaag

SEQ ID NO: 2263910 - RNA, 20 nt, Human
guuuucccuugaggaaacaa

SEQ ID NO: 2263911 - RNA, 22 nt, Human
guuuuccuauaauauaauaaau

SEQ ID NO: 2263912 - RNA, 17 nt, Human
guuuuccuaaaugcagu

SEQ ID NO: 2263913 - RNA, 16 nt, Human
guuuuccuaaaugcag

SEQ ID NO: 2263914 - RNA, 21 nt, Human
guuuucccugaccucccucua

SEQ ID NO: 2263915 - RNA, 23 nt, Human
guuuucccgagcaaagucuaaag

SEQ ID NO: 2263916 - RNA, 17 nt, Human
guuuuccauuguuugaa

SEQ ID NO: 2263917 - RNA, 17 nt, Human
guuuuccccucccuggg

SEQ ID NO: 2263918 - RNA, 22 nt, Human
guuuucccgagcaaagucuaaa

SEQ ID NO: 2263919 - RNA, 13 nt, Human
guuuuccugaaga

SEQ ID NO: 2263920 - RNA, 22 nt, Human
guuuuccucccuucugcuacug

SEQ ID NO: 2263921 - RNA, 18 nt, Human
guuuuccucccuucugcu

SEQ ID NO: 2263922 - RNA, 15 nt, Human
guuuuccucccuucu

SEQ ID NO: 2263923 - RNA, 13 nt, Human
guuuuccucccuu

SEQ ID NO: 2263924 - RNA, 14 nt, Human
guuuuccucccuuc

SEQ ID NO: 2263925 - RNA, 17 nt, Human
guuuucagacucagacu

SEQ ID NO: 2263926 - RNA, 13 nt, Human
guuuuccaugaaa

SEQ ID NO: 2263927 - RNA, 18 nt, Human
guuuuccaugaaaacguu

SEQ ID NO: 2263928 - RNA, 17 nt, Human
guuuuccaugaaaacgu

SEQ ID NO: 2263929 - RNA, 15 nt, Human
guuuuccaugaaaac

SEQ ID NO: 2263930 - RNA, 14 nt, Human
guuuuccaugaaaa

SEQ ID NO: 2263931 - RNA, 20 nt, Human
guuuuccagguuuaagcugu

SEQ ID NO: 2263932 - RNA, 19 nt, Human
guuuuccaugaguccccug

SEQ ID NO: 2263933 - RNA, 20 nt, Human
guuuuccaugaguccccugu

SEQ ID NO: 2263934 - RNA, 16 nt, Human
guuuuguaagaugcug

SEQ ID NO: 2263935 - RNA, 17 nt, Human
guuuuguaagaugcugg

SEQ ID NO: 2263936 - RNA, 23 nt, Human
guuuuguaagaugcuggguuggu

SEQ ID NO: 2263937 - RNA, 16 nt, Human
guuuugguugcuuuaa

SEQ ID NO: 2263938 - RNA, 17 nt, Human
guuuuggugguuuuagu

SEQ ID NO: 2263939 - RNA, 21 nt, Human
guuuugguaucuguucuuuaa

SEQ ID NO: 2263940 - RNA, 18 nt, Human
guuuuguaagaugcuggg

SEQ ID NO: 2263941 - RNA, 14 nt, Human
guuuuguuccccuc

SEQ ID NO: 2263942 - RNA, 15 nt, Human
guuuuguuccccucc

SEQ ID NO: 2263943 - RNA, 16 nt, Human
guuuuguuccccuccu

SEQ ID NO: 2263944 - RNA, 17 nt, Human
guuuuguuccccuccuc

SEQ ID NO: 2263945 - RNA, 15 nt, Human
guuuuguucuuuaaa

SEQ ID NO: 2263946 - RNA, 22 nt, Human
guuuuguuccccuccuccacuc

SEQ ID NO: 2263947 - RNA, 20 nt, Human
guuuuguuccccuccuccac

SEQ ID NO: 2263948 - RNA, 21 nt, Human
guuuuguuccccuccuccacu

SEQ ID NO: 2263949 - RNA, 14 nt, Human
guuuguuuguuuca

SEQ ID NO: 2263950 - RNA, 15 nt, Human
guuuuaaaaaaauaa

SEQ ID NO: 2263951 - RNA, 19 nt, Human
guuuuaaaaaaauaaaaca

SEQ ID NO: 2263952 - RNA, 17 nt, Human
guuuguuacauagguau

SEQ ID NO: 2263953 - RNA, 21 nt, Human
guuuguguguugucuugaaag

SEQ ID NO: 2263954 - RNA, 14 nt, Human
guuuguucaucugu

SEQ ID NO: 2263955 - RNA, 20 nt, Human
guuuguuucugaaagggacg

SEQ ID NO: 2263956 - RNA, 24 nt, Human
guuuuaaaauaaaaauucugaaug

SEQ ID NO: 2263957 - RNA, 21 nt, Human
guuuuaaaauaaaaauucuga

SEQ ID NO: 2263958 - RNA, 22 nt, Human
guuuuaaaaaaauaaaacauuu

SEQ ID NO: 2263959 - RNA, 20 nt, Human
guuuuaaaaaaauaaaacau

SEQ ID NO: 2263960 - RNA, 21 nt, Human
guuuuaaaaaaauaaaacauu

SEQ ID NO: 2263961 - RNA, 15 nt, Human
guuuuaaaaugagaa

SEQ ID NO: 2263962 - RNA, 16 nt, Human
guuuuaaaaugagaaa

SEQ ID NO: 2263963 - RNA, 14 nt, Human
guuuucagacucag

SEQ ID NO: 2263964 - RNA, 21 nt, Human
guuuucagaaccucuucccca

SEQ ID NO: 2263965 - RNA, 20 nt, Human
guuuucagaaccucuucccc

SEQ ID NO: 2263966 - RNA, 19 nt, Human
guuuucagaaccucuuccc

SEQ ID NO: 2263967 - RNA, 13 nt, Human
guuuucaaugaug

SEQ ID NO: 2263968 - RNA, 11 nt, Human
guuuucacucu

SEQ ID NO: 2263969 - RNA, 12 nt, Human
guuuucacucuu

SEQ ID NO: 2263970 - RNA, 17 nt, Human
guuuucaaaauaaaaau

SEQ ID NO: 2263971 - RNA, 20 nt, Human
guuuucaaaauuguuacaaa

SEQ ID NO: 2263972 - RNA, 21 nt, Human
guuuuauuuuuuauuguuuuc

SEQ ID NO: 2263973 - RNA, 18 nt, Human
guuuucaagucaaauuaa

SEQ ID NO: 2263974 - RNA, 17 nt, Human
guuuucaagucaaauua

SEQ ID NO: 2263975 - RNA, 15 nt, Human
guuuucaagucaaau

SEQ ID NO: 2263976 - RNA, 13 nt, Human
guuuucaagucaa

SEQ ID NO: 2263977 - RNA, 13 nt, Human
guuuguggcuggg

SEQ ID NO: 2263978 - RNA, 22 nt, Human
guuuguggcugggggcaggagg

SEQ ID NO: 2263979 - RNA, 20 nt, Human
guuuguggcugggggcagga

SEQ ID NO: 2263980 - RNA, 22 nt, Human
guuuguguauuuacgcuuugau

SEQ ID NO: 2263981 - RNA, 13 nt, Human
guuugugugucuu

SEQ ID NO: 2263982 - RNA, 14 nt, Human
guuugugugucuua

SEQ ID NO: 2263983 - RNA, 15 nt, Human
guuugugugucuuaa

SEQ ID NO: 2263984 - RNA, 22 nt, Human
guuugguucacuuacagauagu

SEQ ID NO: 2263985 - RNA, 15 nt, Human
guuuguguguugucu

SEQ ID NO: 2263986 - RNA, 20 nt, Human
guuuguguguugucucuuga

SEQ ID NO: 2263987 - RNA, 18 nt, Human
guuuguuucugaaaggga

SEQ ID NO: 2263988 - RNA, 16 nt, Human
guuuguggccucagaa

SEQ ID NO: 2263989 - RNA, 13 nt, Human
guuuguaugugug

SEQ ID NO: 2263990 - RNA, 15 nt, Human
guuuguggccucaga

SEQ ID NO: 2263991 - RNA, 18 nt, Human
guuugucgcucaugugug

SEQ ID NO: 2263992 - RNA, 13 nt, Human
guuugucauuagc

SEQ ID NO: 2263993 - RNA, 17 nt, Human
guuugucacaugaaaca

SEQ ID NO: 2263994 - RNA, 15 nt, Human
guuugucauuagccu

SEQ ID NO: 2263995 - RNA, 21 nt, Human
guuugucauuagccugaguag

SEQ ID NO: 2263996 - RNA, 13 nt, Human
guuuguauauugu

SEQ ID NO: 2263997 - RNA, 16 nt, Human
guuuguauaacuucuu

SEQ ID NO: 2263998 - RNA, 14 nt, Human
guuuguauguauaa

SEQ ID NO: 2263999 - RNA, 16 nt, Human
guuuguauguauaauu

SEQ ID NO: 2264000 - RNA, 20 nt, Human
guuuguauguguguagacaa

SEQ ID NO: 2264001 - RNA, 15 nt, Human
guuugguguguuccc

SEQ ID NO: 2264002 - RNA, 15 nt, Human
guuuguauaacuucu

SEQ ID NO: 2264003 - RNA, 17 nt, Human
guuugguauuguauuua

SEQ ID NO: 2264004 - RNA, 18 nt, Human
guuugguauuguauuuau

SEQ ID NO: 2264005 - RNA, 20 nt, Human
guuuguaaauuaacuuuuau

SEQ ID NO: 2264006 - RNA, 23 nt, Human
guuuggucugggacuuccuugcu

SEQ ID NO: 2264007 - RNA, 22 nt, Human
guuugguggggguagagcugau

SEQ ID NO: 2264008 - RNA, 16 nt, Human
guuuggguauauucau

SEQ ID NO: 2264009 - RNA, 18 nt, Human
guuuggggcgaggcagag

SEQ ID NO: 2264010 - RNA, 15 nt, Human
guuugguauuguauu

SEQ ID NO: 2264011 - RNA, 11 nt, Human
guuuggggcga

SEQ ID NO: 2264012 - RNA, 16 nt, Human
guuuggggcgaggcag

SEQ ID NO: 2264013 - RNA, 17 nt, Human
guuuggggcgaggcaga

SEQ ID NO: 2264014 - RNA, 16 nt, Human
guuugauucagacagc

SEQ ID NO: 2264015 - RNA, 20 nt, Human
guuugauucagacagcugcc

SEQ ID NO: 2264016 - RNA, 21 nt, Human
guuugauucagacagcugccu

SEQ ID NO: 2264017 - RNA, 20 nt, Human
guuugagaagaaaacaucua

SEQ ID NO: 2264018 - RNA, 15 nt, Human
guuugagaagcacug

SEQ ID NO: 2264019 - RNA, 18 nt, Human
guuugagacacugguuua

SEQ ID NO: 2264020 - RNA, 22 nt, Human
guuuccucuaguucuuuguuca

SEQ ID NO: 2264021 - RNA, 20 nt, Human
guuuccucauuccugaaaga

SEQ ID NO: 2264022 - RNA, 22 nt, Human
guuuccucaggcugcuggagga

SEQ ID NO: 2264023 - RNA, 19 nt, Human
guuuccucaggcugcugga

SEQ ID NO: 2264024 - RNA, 18 nt, Human
guuuccucaggcugcugg

SEQ ID NO: 2264025 - RNA, 18 nt, Human
guuuccucuaguucuuug

SEQ ID NO: 2264026 - RNA, 21 nt, Human
guuucccauaauuuucuucau

SEQ ID NO: 2264027 - RNA, 20 nt, Human
guuucccauaauuuucuuca

SEQ ID NO: 2264028 - RNA, 19 nt, Human
guuucccaucccacugcuc

SEQ ID NO: 2264029 - RNA, 21 nt, Human
guuucccaucccacugcuccc

SEQ ID NO: 2264030 - RNA, 16 nt, Human
guuuccucaggcugcu

SEQ ID NO: 2264031 - RNA, 14 nt, Human
guuuccucaggcug

SEQ ID NO: 2264032 - RNA, 16 nt, Human
guuucuuuaguuuuug

SEQ ID NO: 2264033 - RNA, 18 nt, Human
guuucuuuguaaugaaaa

SEQ ID NO: 2264034 - RNA, 11 nt, Human
guuucuuccaa

SEQ ID NO: 2264035 - RNA, 23 nt, Human
guuucuucauccggcagccugga

SEQ ID NO: 2264036 - RNA, 20 nt, Human
guuucuucaacaggagaauu

SEQ ID NO: 2264037 - RNA, 13 nt, Human
guuucuuccaaag

SEQ ID NO: 2264038 - RNA, 13 nt, Human
guuucuuagcuuu

SEQ ID NO: 2264039 - RNA, 16 nt, Human
guuucuuagcuuuuua

SEQ ID NO: 2264040 - RNA, 18 nt, Human
guuugagaucagccuggg

SEQ ID NO: 2264041 - RNA, 19 nt, Human
guuugacuagaugauggau

SEQ ID NO: 2264042 - RNA, 16 nt, Human
guuugaaacaaagaag

SEQ ID NO: 2264043 - RNA, 23 nt, Human
guuugauuaaauucuugcaaagu

SEQ ID NO: 2264044 - RNA, 17 nt, Human
guuugagaucagccugg

SEQ ID NO: 2264045 - RNA, 18 nt, Human
guuugacuagaugaugga

SEQ ID NO: 2264046 - RNA, 16 nt, Human
guuugacuagaugaug

SEQ ID NO: 2264047 - RNA, 17 nt, Human
guuugaauguuaaauaa

SEQ ID NO: 2264048 - RNA, 17 nt, Human
guuucuuuuguauguaa

SEQ ID NO: 2264049 - RNA, 20 nt, Human
guuucuuuuguauguaaaug

SEQ ID NO: 2264050 - RNA, 21 nt, Human
guuucuuuuguauguaaaugu

SEQ ID NO: 2264051 - RNA, 16 nt, Human
guuucuuuagcaguuu

SEQ ID NO: 2264052 - RNA, 17 nt, Human
guuucuuuaagaaagua

SEQ ID NO: 2264053 - RNA, 19 nt, Human
guuucuuuguaaugaaaac

SEQ ID NO: 2264054 - RNA, 15 nt, Human
guuugaaacaaagaa

SEQ ID NO: 2264055 - RNA, 15 nt, Human
guuugaauguuaaau

SEQ ID NO: 2264056 - RNA, 16 nt, Human
guuugaauguuaaaua

SEQ ID NO: 2264057 - RNA, 17 nt, Human
guuugaaacaaagaagg

SEQ ID NO: 2264058 - RNA, 14 nt, Human
guuugaaaucuuuu

SEQ ID NO: 2264059 - RNA, 16 nt, Human
guuccucgcccugggu

SEQ ID NO: 2264060 - RNA, 15 nt, Human
guuccucgcccuggg

SEQ ID NO: 2264061 - RNA, 13 nt, Human
guuccucgcccug

SEQ ID NO: 2264062 - RNA, 23 nt, Human
guuccuccccuccuccuggacuc

SEQ ID NO: 2264063 - RNA, 18 nt, Human
guuccuauugucauuaaa

SEQ ID NO: 2264064 - RNA, 12 nt, Human
guuccucugccu

SEQ ID NO: 2264065 - RNA, 13 nt, Human
guuccucugccug

SEQ ID NO: 2264066 - RNA, 14 nt, Human
guuccucugccugc

SEQ ID NO: 2264067 - RNA, 16 nt, Human
guuccucugccugccc

SEQ ID NO: 2264068 - RNA, 15 nt, Human
guuccucugccugcc

SEQ ID NO: 2264069 - RNA, 13 nt, Human
guuccucuuugca

SEQ ID NO: 2264070 - RNA, 15 nt, Human
guuccugcaaugaag

SEQ ID NO: 2264071 - RNA, 14 nt, Human
guuccucuuugcau

SEQ ID NO: 2264072 - RNA, 21 nt, Human
guuccugaauucuauuugcug

SEQ ID NO: 2264073 - RNA, 19 nt, Human
guuccugcggagugaagag

SEQ ID NO: 2264074 - RNA, 20 nt, Human
guuccugcggagugaagagg

SEQ ID NO: 2264075 - RNA, 16 nt, Human
guuccugaaccugaug

SEQ ID NO: 2264076 - RNA, 12 nt, Human
guuccugcaugc

SEQ ID NO: 2264077 - RNA, 12 nt, Human
guuccuggcaau

SEQ ID NO: 2264078 - RNA, 13 nt, Human
guuccuggcaaua

SEQ ID NO: 2264079 - RNA, 21 nt, Human
guuccuggcaauaguguguuc

SEQ ID NO: 2264080 - RNA, 14 nt, Human
guuccuggcaguuu

SEQ ID NO: 2264081 - RNA, 15 nt, Human
guuccuuacugcaga

SEQ ID NO: 2264082 - RNA, 14 nt, Human
guuccuuacugcag

SEQ ID NO: 2264083 - RNA, 13 nt, Human
guuccuuagaccu

SEQ ID NO: 2264084 - RNA, 23 nt, Human
guuccuggcaguuuaaaaaaauu

SEQ ID NO: 2264085 - RNA, 19 nt, Human
guuccuaagagugcugggc

SEQ ID NO: 2264086 - RNA, 15 nt, Human
guuccuagaguagag

SEQ ID NO: 2264087 - RNA, 16 nt, Human
guuccuagccaccgcc

SEQ ID NO: 2264088 - RNA, 22 nt, Human
guuccucauuagcauuuugcua

SEQ ID NO: 2264089 - RNA, 22 nt, Human
guuccuauggcuggccacugca

SEQ ID NO: 2264090 - RNA, 14 nt, Human
guuccuauugucau

SEQ ID NO: 2264091 - RNA, 15 nt, Human
guuccuauugucauu

SEQ ID NO: 2264092 - RNA, 16 nt, Human
guuccagcucuuugaa

SEQ ID NO: 2264093 - RNA, 14 nt, Human
guuccagcucuuug

SEQ ID NO: 2264094 - RNA, 17 nt, Human
guuccagggucccucug

SEQ ID NO: 2264095 - RNA, 19 nt, Human
guuccagggucccucugug

SEQ ID NO: 2264096 - RNA, 12 nt, Human
guuccagcucuu

SEQ ID NO: 2264097 - RNA, 15 nt, Human
guuccagccugccac

SEQ ID NO: 2264098 - RNA, 20 nt, Human
guuccagggucccucugugu

SEQ ID NO: 2264099 - RNA, 21 nt, Human
guuccagggucccucugugua

SEQ ID NO: 2264100 - RNA, 14 nt, Human
guuccuaauccucu

SEQ ID NO: 2264101 - RNA, 20 nt, Human
guuccacgucccccuggggc

SEQ ID NO: 2264102 - RNA, 21 nt, Human
guuccacgucccccuggggcu

SEQ ID NO: 2264103 - RNA, 16 nt, Human
guuccacguguuuuau

SEQ ID NO: 2264104 - RNA, 12 nt, Human
guuccacuaacc

SEQ ID NO: 2264105 - RNA, 17 nt, Human
guuccaccaucaagcca

SEQ ID NO: 2264106 - RNA, 20 nt, Human
guuccaccaucaagccacca

SEQ ID NO: 2264107 - RNA, 13 nt, Human
guuccacugagcu

SEQ ID NO: 2264108 - RNA, 14 nt, Human
guuccacugagcuc

SEQ ID NO: 2264109 - RNA, 18 nt, Human
guuccacugagcuccaug

SEQ ID NO: 2264110 - RNA, 15 nt, Human
guuccacugagcucc

SEQ ID NO: 2264111 - RNA, 16 nt, Human
guuccacugagcucca

SEQ ID NO: 2264112 - RNA, 21 nt, Human
guuccagcaauucuccugccu

SEQ ID NO: 2264113 - RNA, 20 nt, Human
guuccagcaauucuccugcc

SEQ ID NO: 2264114 - RNA, 23 nt, Human
guuccagcaauucuccugccuca

SEQ ID NO: 2264115 - RNA, 14 nt, Human
guuccagcaccaca

SEQ ID NO: 2264116 - RNA, 14 nt, Human
guuccagccugcca

SEQ ID NO: 2264117 - RNA, 13 nt, Human
guuccagccugcc

SEQ ID NO: 2264118 - RNA, 23 nt, Human
guucauuguaauguuacugauca

SEQ ID NO: 2264119 - RNA, 22 nt, Human
guucauuguaauguuacugauc

SEQ ID NO: 2264120 - RNA, 21 nt, Human
guucauuguaauguuacugau

SEQ ID NO: 2264121 - RNA, 20 nt, Human
guucauuguaauguuacuga

SEQ ID NO: 2264122 - RNA, 13 nt, Human
guucauuuccuca

SEQ ID NO: 2264123 - RNA, 13 nt, Human
guucauuugugua

SEQ ID NO: 2264124 - RNA, 19 nt, Human
guucauuguaauguuacug

SEQ ID NO: 2264125 - RNA, 18 nt, Human
guucauuguaauguuacu

SEQ ID NO: 2264126 - RNA, 14 nt, Human
guucauuguaaugu

SEQ ID NO: 2264127 - RNA, 16 nt, Human
guucauugcacuuuga

SEQ ID NO: 2264128 - RNA, 20 nt, Human
guucauuaaagcaugaaugg

SEQ ID NO: 2264129 - RNA, 16 nt, Human
guucauuaaagcauga

SEQ ID NO: 2264130 - RNA, 15 nt, Human
guucauuauuggaau

SEQ ID NO: 2264131 - RNA, 15 nt, Human
guucauguuugcuuc

SEQ ID NO: 2264132 - RNA, 22 nt, Human
guucauuauuggaauuaaccug

SEQ ID NO: 2264133 - RNA, 14 nt, Human
guuccaagacauug

SEQ ID NO: 2264134 - RNA, 13 nt, Human
guuccaagacauu

SEQ ID NO: 2264135 - RNA, 17 nt, Human
guuccaaccacugaauc

SEQ ID NO: 2264136 - RNA, 15 nt, Human
guuccaaaugaaugu

SEQ ID NO: 2264137 - RNA, 19 nt, Human
guuccaaaugaauguuguc

SEQ ID NO: 2264138 - RNA, 20 nt, Human
guucauuucaaauacaucuu

SEQ ID NO: 2264139 - RNA, 17 nt, Human
guucauuuugagcugaa

SEQ ID NO: 2264140 - RNA, 19 nt, Human
guuccaagacauugucaau

SEQ ID NO: 2264141 - RNA, 17 nt, Human
guuccaagacauuguca

SEQ ID NO: 2264142 - RNA, 16 nt, Human
guuccaagacauuguc

SEQ ID NO: 2264143 - RNA, 15 nt, Human
guuccaagacauugu

SEQ ID NO: 2264144 - RNA, 21 nt, Human
guuccaagacauugucaauaa

SEQ ID NO: 2264145 - RNA, 14 nt, Human
guuccaauaaacag

SEQ ID NO: 2264146 - RNA, 15 nt, Human
guuccaauaaacagg

SEQ ID NO: 2264147 - RNA, 15 nt, Human
guucagccaagguuu

SEQ ID NO: 2264148 - RNA, 15 nt, Human
guucagccccuccuc

SEQ ID NO: 2264149 - RNA, 14 nt, Human
guucagccccuccu

SEQ ID NO: 2264150 - RNA, 19 nt, Human
guucauauuccauauuuau

SEQ ID NO: 2264151 - RNA, 12 nt, Human
guucagccaagg

SEQ ID NO: 2264152 - RNA, 18 nt, Human
guucagcacugucccuug

SEQ ID NO: 2264153 - RNA, 17 nt, Human
guucagcaccacccuag

SEQ ID NO: 2264154 - RNA, 14 nt, Human
guucagcacugucc

SEQ ID NO: 2264155 - RNA, 16 nt, Human
guucagcaccacccua

SEQ ID NO: 2264156 - RNA, 16 nt, Human
guucagauugcuuuga

SEQ ID NO: 2264157 - RNA, 15 nt, Human
guucagcacuguccc

SEQ ID NO: 2264158 - RNA, 16 nt, Human
guucagcacugucccu

SEQ ID NO: 2264159 - RNA, 22 nt, Human
guucagcacugucccuugccuc

SEQ ID NO: 2264160 - RNA, 17 nt, Human
guucaucauccuaagcu

SEQ ID NO: 2264161 - RNA, 16 nt, Human
guucaucaaugaauga

SEQ ID NO: 2264162 - RNA, 19 nt, Human
guucauccaauccucacug

SEQ ID NO: 2264163 - RNA, 18 nt, Human
guucauccaauccucacu

SEQ ID NO: 2264164 - RNA, 15 nt, Human
guucauccaauccuc

SEQ ID NO: 2264165 - RNA, 16 nt, Human
guucagccccuccucu

SEQ ID NO: 2264166 - RNA, 21 nt, Human
guucauccaauccucacuggg

SEQ ID NO: 2264167 - RNA, 20 nt, Human
guucauccaauccucacugg

SEQ ID NO: 2264168 - RNA, 16 nt, Human
guucauccauucuauu

SEQ ID NO: 2264169 - RNA, 22 nt, Human
guucauccaauccucacugggu

SEQ ID NO: 2264170 - RNA, 17 nt, Human
guucaucguauaacaca

SEQ ID NO: 2264171 - RNA, 18 nt, Human
guucaucuugaauuguaa

SEQ ID NO: 2264172 - RNA, 12 nt, Human
guucaucuugaa

SEQ ID NO: 2264173 - RNA, 13 nt, Human
guucaucuugaau

SEQ ID NO: 2264174 - RNA, 20 nt, Human
guucaucugagcaagagcug

SEQ ID NO: 2264175 - RNA, 12 nt, Human
guucaugagaau

SEQ ID NO: 2264176 - RNA, 19 nt, Human
guucaugagaaucuauauu

SEQ ID NO: 2264177 - RNA, 16 nt, Human
guucaugccaccaugg

SEQ ID NO: 2264178 - RNA, 14 nt, Human
guucaugagaaucu

SEQ ID NO: 2264179 - RNA, 14 nt, Human
guucauguuugcuu

SEQ ID NO: 2264180 - RNA, 24 nt, Human
guucauguuugcuucauaaaugaa

SEQ ID NO: 2264181 - RNA, 16 nt, Human
guucacuucaucuucu

SEQ ID NO: 2264182 - RNA, 21 nt, Human
guucacuucaucuucucagcu

SEQ ID NO: 2264183 - RNA, 17 nt, Human
guucagaaaugcugccu

SEQ ID NO: 2264184 - RNA, 18 nt, Human
guucagaaaugcugccug

SEQ ID NO: 2264185 - RNA, 20 nt, Human
guucacuuuugacaaaggca

SEQ ID NO: 2264186 - RNA, 16 nt, Human
guucacuuuugacaaa

SEQ ID NO: 2264187 - RNA, 19 nt, Human
guucagaaaugcugccugc

SEQ ID NO: 2264188 - RNA, 21 nt, Human
guucagaaaugcugccugccu

SEQ ID NO: 2264189 - RNA, 17 nt, Human
guucagagacucagggc

SEQ ID NO: 2264190 - RNA, 16 nt, Human
guucagagacucaggg

SEQ ID NO: 2264191 - RNA, 22 nt, Human
guucagagacucagggccccag

SEQ ID NO: 2264192 - RNA, 12 nt, Human
guucaccccucc

SEQ ID NO: 2264193 - RNA, 14 nt, Human
guucaccccuccac

SEQ ID NO: 2264194 - RNA, 16 nt, Human
guucaccccuccaccc

SEQ ID NO: 2264195 - RNA, 12 nt, Human
guucaccagccu

SEQ ID NO: 2264196 - RNA, 11 nt, Human
guucaccagcc

SEQ ID NO: 2264197 - RNA, 16 nt, Human
guucacccacagggcu

SEQ ID NO: 2264198 - RNA, 12 nt, Human
guucacauuuuu

SEQ ID NO: 2264199 - RNA, 22 nt, Human
guucaccuugaagaaccucuca

SEQ ID NO: 2264200 - RNA, 19 nt, Human
guucacgugcagcucaagg

SEQ ID NO: 2264201 - RNA, 24 nt, Human
guucacucuacuuagcaugucccu

SEQ ID NO: 2264202 - RNA, 15 nt, Human
guucacuaaagcagu

SEQ ID NO: 2264203 - RNA, 19 nt, Human
guucacugcaaccuccgcc

SEQ ID NO: 2264204 - RNA, 24 nt, Human
guucacucuuggagccugcagagc

SEQ ID NO: 2264205 - RNA, 20 nt, Human
guucacucuuggagccugca

SEQ ID NO: 2264206 - RNA, 17 nt, Human
guucacucuuggagccu

SEQ ID NO: 2264207 - RNA, 19 nt, Human
guucacucuuggagccugc

SEQ ID NO: 2264208 - RNA, 18 nt, Human
guucacucuuggagccug

SEQ ID NO: 2264209 - RNA, 19 nt, Human
guucaaggccauccuuccc

SEQ ID NO: 2264210 - RNA, 20 nt, Human
guucaaguaauucugcuguc

SEQ ID NO: 2264211 - RNA, 23 nt, Human
guucaagugauucucaugccuca

SEQ ID NO: 2264212 - RNA, 18 nt, Human
guucaaucucccgcugcu

SEQ ID NO: 2264213 - RNA, 18 nt, Human
guucaauaauaaauauuu

SEQ ID NO: 2264214 - RNA, 18 nt, Human
guucaaggccauccuucc

SEQ ID NO: 2264215 - RNA, 13 nt, Human
guuauuauaauug

SEQ ID NO: 2264216 - RNA, 14 nt, Human
guuauuauaauugu

SEQ ID NO: 2264217 - RNA, 16 nt, Human
guuauuauaauuguau

SEQ ID NO: 2264218 - RNA, 18 nt, Human
guuauuauaauuguauca

SEQ ID NO: 2264219 - RNA, 20 nt, Human
guucaagcgauucuucugcu

SEQ ID NO: 2264220 - RNA, 23 nt, Human
guucaauucucauuugucacaca

SEQ ID NO: 2264221 - RNA, 13 nt, Human
guucaauuagaau

SEQ ID NO: 2264222 - RNA, 20 nt, Human
guucaaugaucuagguuuaa

SEQ ID NO: 2264223 - RNA, 21 nt, Human
guucaaugaucuagguuuaac

SEQ ID NO: 2264224 - RNA, 22 nt, Human
guucaaugaucuagguuuaacu

SEQ ID NO: 2264225 - RNA, 17 nt, Human
guucaauggcugcugaa

SEQ ID NO: 2264226 - RNA, 16 nt, Human
guucaauucucauuug

SEQ ID NO: 2264227 - RNA, 10 nt, Human
guucaaugau

SEQ ID NO: 2264228 - RNA, 12 nt, Human
guucaaugaucu

SEQ ID NO: 2264229 - RNA, 13 nt, Human
guucaaugaucua

SEQ ID NO: 2264230 - RNA, 14 nt, Human
guucaaugaucuag

SEQ ID NO: 2264231 - RNA, 17 nt, Human
guucaaugaucuagguu

SEQ ID NO: 2264232 - RNA, 19 nt, Human
guucaaugaucuagguuua

SEQ ID NO: 2264233 - RNA, 23 nt, Human
guuauggaaacuguugccagaga

SEQ ID NO: 2264234 - RNA, 13 nt, Human
guuaugcugugac

SEQ ID NO: 2264235 - RNA, 22 nt, Human
guuaugcaagggacuguguguu

SEQ ID NO: 2264236 - RNA, 20 nt, Human
guuaugauuuuuuuuucaua

SEQ ID NO: 2264237 - RNA, 21 nt, Human
guuauguaaaaggccaaaccu

SEQ ID NO: 2264238 - RNA, 19 nt, Human
guuaugcggucuagggaau

SEQ ID NO: 2264239 - RNA, 15 nt, Human
guuaugguguuucuc

SEQ ID NO: 2264240 - RNA, 22 nt, Human
guuaugugaaugaucucucuga

SEQ ID NO: 2264241 - RNA, 19 nt, Human
guuauuaaaaaucucaaau

SEQ ID NO: 2264242 - RNA, 19 nt, Human
guucaagcgauucuucugc

SEQ ID NO: 2264243 - RNA, 21 nt, Human
guuauuacccagaguuuuuau

SEQ ID NO: 2264244 - RNA, 22 nt, Human
guuauuaaacguaugcauguga

SEQ ID NO: 2264245 - RNA, 21 nt, Human
guuauuagggugguauuuagu

SEQ ID NO: 2264246 - RNA, 22 nt, Human
guuauuagagauuaccuccuga

SEQ ID NO: 2264247 - RNA, 19 nt, Human
guuauguguguauauguau

SEQ ID NO: 2264248 - RNA, 14 nt, Human
guuauguguguaua

SEQ ID NO: 2264249 - RNA, 21 nt, Human
guuauuaaacguaugcaugug

SEQ ID NO: 2264250 - RNA, 21 nt, Human
guuaucccuuccuuuuagccu

SEQ ID NO: 2264251 - RNA, 14 nt, Human
guuaucgaaauaac

SEQ ID NO: 2264252 - RNA, 15 nt, Human
guuaucgaaauaaca

SEQ ID NO: 2264253 - RNA, 17 nt, Human
guuaucgaaauaacaau

SEQ ID NO: 2264254 - RNA, 15 nt, Human
guuaucuaaaagaaa

SEQ ID NO: 2264255 - RNA, 23 nt, Human
guuaucgaaauaacaauguuaag

SEQ ID NO: 2264256 - RNA, 18 nt, Human
guuaucgaaauaacaaug

SEQ ID NO: 2264257 - RNA, 21 nt, Human
guuaucgaaauaacaauguua

SEQ ID NO: 2264258 - RNA, 16 nt, Human
guuaucuaaaagaaau

SEQ ID NO: 2264259 - RNA, 12 nt, Human
guuaucucugug

SEQ ID NO: 2264260 - RNA, 13 nt, Human
guuaucucugugu

SEQ ID NO: 2264261 - RNA, 14 nt, Human
guuaucucuguguu

SEQ ID NO: 2264262 - RNA, 21 nt, Human
guuaugacuccagaauuuccc

SEQ ID NO: 2264263 - RNA, 12 nt, Human
guuaugaauauu

SEQ ID NO: 2264264 - RNA, 23 nt, Human
guuaugaauauuuacguuuuugu

SEQ ID NO: 2264265 - RNA, 15 nt, Human
guuaugaaauaaaga

SEQ ID NO: 2264266 - RNA, 20 nt, Human
guuaugaaauucacccccuu

SEQ ID NO: 2264267 - RNA, 22 nt, Human
guuauagagggucuaagauuca

SEQ ID NO: 2264268 - RNA, 17 nt, Human
guuauaggucacuccug

SEQ ID NO: 2264269 - RNA, 15 nt, Human
guuauaguauaucug

SEQ ID NO: 2264270 - RNA, 16 nt, Human
guuauaguauaucugg

SEQ ID NO: 2264271 - RNA, 19 nt, Human
guuauaguauaucuggaca

SEQ ID NO: 2264272 - RNA, 10 nt, Human
guuauauaaa

SEQ ID NO: 2264273 - RNA, 13 nt, Human
guuauauaaaugg

SEQ ID NO: 2264274 - RNA, 12 nt, Human
guuauauaaaug

SEQ ID NO: 2264275 - RNA, 13 nt, Human
guuauauagguuu

SEQ ID NO: 2264276 - RNA, 20 nt, Human
guuauauuuuacuacugugg

SEQ ID NO: 2264277 - RNA, 19 nt, Human
guuauauugaaaaaauaga

SEQ ID NO: 2264278 - RNA, 17 nt, Human
guuauauauuuuuugua

SEQ ID NO: 2264279 - RNA, 14 nt, Human
guuauaucaacaga

SEQ ID NO: 2264280 - RNA, 23 nt, Human
guuaucaaacuucagcuguacuu

SEQ ID NO: 2264281 - RNA, 20 nt, Human
guuaucaccgugggcucccu

SEQ ID NO: 2264282 - RNA, 22 nt, Human
guuaucaccgugggcucccuga

SEQ ID NO: 2264283 - RNA, 13 nt, Human
guuacuauaugcc

SEQ ID NO: 2264284 - RNA, 16 nt, Human
guuacuagguaacuuc

SEQ ID NO: 2264285 - RNA, 23 nt, Human
guuacuaauuggccucuuuaaga

SEQ ID NO: 2264286 - RNA, 15 nt, Human
guuacuacaugcacu

SEQ ID NO: 2264287 - RNA, 22 nt, Human
guuacuaaguuuuuauggcuuu

SEQ ID NO: 2264288 - RNA, 23 nt, Human
guuacgcacacguacuuaaauga

SEQ ID NO: 2264289 - RNA, 21 nt, Human
guuaccugaucaaugacagag

SEQ ID NO: 2264290 - RNA, 16 nt, Human
guuacuaacuaaacuc

SEQ ID NO: 2264291 - RNA, 17 nt, Human
guuacuaacuaaacucu

SEQ ID NO: 2264292 - RNA, 13 nt, Human
guuacuaagaaga

SEQ ID NO: 2264293 - RNA, 14 nt, Human
guuacuaagaagaa

SEQ ID NO: 2264294 - RNA, 14 nt, Human
guuacucugaaggg

SEQ ID NO: 2264295 - RNA, 11 nt, Human
guuacucugaa

SEQ ID NO: 2264296 - RNA, 22 nt, Human
guuacucuccaaccuggacaac

SEQ ID NO: 2264297 - RNA, 18 nt, Human
guuacucuccaaccugga

SEQ ID NO: 2264298 - RNA, 17 nt, Human
guuacucuccaaccugg

SEQ ID NO: 2264299 - RNA, 18 nt, Human
guuacucagcccugggcc

SEQ ID NO: 2264300 - RNA, 17 nt, Human
guuacucagcccugggc

SEQ ID NO: 2264301 - RNA, 16 nt, Human
guuacucagcccuggg

SEQ ID NO: 2264302 - RNA, 14 nt, Human
guuacucuccaacc

SEQ ID NO: 2264303 - RNA, 22 nt, Human
guuacuccagugccaacaaucc

SEQ ID NO: 2264304 - RNA, 16 nt, Human
guuacuccagugccaa

SEQ ID NO: 2264305 - RNA, 15 nt, Human
guuacucagcccugg

SEQ ID NO: 2264306 - RNA, 14 nt, Human
guuacucagcccug

SEQ ID NO: 2264307 - RNA, 13 nt, Human
guuacucagcccu

SEQ ID NO: 2264308 - RNA, 12 nt, Human
guuacucagccc

SEQ ID NO: 2264309 - RNA, 20 nt, Human
guuacuagguaacuucauau

SEQ ID NO: 2264310 - RNA, 14 nt, Human
guuacuaucugcuu

SEQ ID NO: 2264311 - RNA, 15 nt, Human
guuacucagaauucu

SEQ ID NO: 2264312 - RNA, 16 nt, Human
guuaguuucuuuggga

SEQ ID NO: 2264313 - RNA, 22 nt, Human
guuaguuucuccaagcaggaca

SEQ ID NO: 2264314 - RNA, 16 nt, Human
guuaguuucuccaagc

SEQ ID NO: 2264315 - RNA, 19 nt, Human
guuaguuucuccaagcagg

SEQ ID NO: 2264316 - RNA, 14 nt, Human
guuaguuuuuacuu

SEQ ID NO: 2264317 - RNA, 12 nt, Human
guuauaaaagug

SEQ ID NO: 2264318 - RNA, 13 nt, Human
guuaguucccaac

SEQ ID NO: 2264319 - RNA, 15 nt, Human
guuauaaagauacag

SEQ ID NO: 2264320 - RNA, 14 nt, Human
guuauaaagauaca

SEQ ID NO: 2264321 - RNA, 14 nt, Human
guuauaaaagugau

SEQ ID NO: 2264322 - RNA, 22 nt, Human
guuauaaaagugauuguuggca

SEQ ID NO: 2264323 - RNA, 19 nt, Human
guuauacugucgguuuuuu

SEQ ID NO: 2264324 - RNA, 18 nt, Human
guuauaaaucaaugucac

SEQ ID NO: 2264325 - RNA, 17 nt, Human
guuauaaaucaauguca

SEQ ID NO: 2264326 - RNA, 16 nt, Human
guuauaaaagugauug

SEQ ID NO: 2264327 - RNA, 10 nt, Human
guuaccuaau

SEQ ID NO: 2264328 - RNA, 19 nt, Human
guuaccuaauuagagcaga

SEQ ID NO: 2264329 - RNA, 16 nt, Human
guuaccuacuuugacu

SEQ ID NO: 2264330 - RNA, 13 nt, Human
guuaccuacuuug

SEQ ID NO: 2264331 - RNA, 13 nt, Human
guuacccagagaa

SEQ ID NO: 2264332 - RNA, 20 nt, Human
guuacccaguaacucaucug

SEQ ID NO: 2264333 - RNA, 17 nt, Human
guuacccuccuguaaau

SEQ ID NO: 2264334 - RNA, 17 nt, Human
guuaccuccuauaaacu

SEQ ID NO: 2264335 - RNA, 15 nt, Human
guuaccuccuauaaa

SEQ ID NO: 2264336 - RNA, 22 nt, Human
guuaccugaaaacacugugcac

SEQ ID NO: 2264337 - RNA, 23 nt, Human
guuaccucugccucagaaaacaa

SEQ ID NO: 2264338 - RNA, 15 nt, Human
guuaccaugucacug

SEQ ID NO: 2264339 - RNA, 18 nt, Human
guuaccaugucacugugg

SEQ ID NO: 2264340 - RNA, 21 nt, Human
guuacauuuuuaagugcugca

SEQ ID NO: 2264341 - RNA, 23 nt, Human
guuaccauuuugggguacccacu

SEQ ID NO: 2264342 - RNA, 19 nt, Human
guuacauaagauaaaugug

SEQ ID NO: 2264343 - RNA, 18 nt, Human
guuacauaagauaaaugu

SEQ ID NO: 2264344 - RNA, 19 nt, Human
guuacaugcauacuucaaa

SEQ ID NO: 2264345 - RNA, 17 nt, Human
guuacaucacaguguuu

SEQ ID NO: 2264346 - RNA, 13 nt, Human
guuacauuaaugu

SEQ ID NO: 2264347 - RNA, 14 nt, Human
guuacauuaauguu

SEQ ID NO: 2264348 - RNA, 16 nt, Human
guuacauuaauguuaa

SEQ ID NO: 2264349 - RNA, 23 nt, Human
guuacaugcauacuucaaaagua

SEQ ID NO: 2264350 - RNA, 21 nt, Human
guuacaugcauacuucaaaag

SEQ ID NO: 2264351 - RNA, 22 nt, Human
guuacaugcauacuucaaaagu

SEQ ID NO: 2264352 - RNA, 22 nt, Human
guuacaggcaccgagaauguug

SEQ ID NO: 2264353 - RNA, 21 nt, Human
guuacagccuguuaguaacau

SEQ ID NO: 2264354 - RNA, 18 nt, Human
guuacagccuguuaguaa

SEQ ID NO: 2264355 - RNA, 19 nt, Human
guuacagcgagaggcagag

SEQ ID NO: 2264356 - RNA, 21 nt, Human
guuacagcgagaggcagagaa

SEQ ID NO: 2264357 - RNA, 15 nt, Human
guuacagacaaagcg

SEQ ID NO: 2264358 - RNA, 17 nt, Human
guuacagacaaagcgug

SEQ ID NO: 2264359 - RNA, 16 nt, Human
guugaagacagagcua

SEQ ID NO: 2264360 - RNA, 21 nt, Human
guugaacugauaguuacuguu

SEQ ID NO: 2264361 - RNA, 15 nt, Human
guugaagaggaaggg

SEQ ID NO: 2264362 - RNA, 15 nt, Human
guugaaagaguccua

SEQ ID NO: 2264363 - RNA, 22 nt, Human
guugaaaauucaaaaaguguuu

SEQ ID NO: 2264364 - RNA, 20 nt, Human
guugaaauuauguauguuua

SEQ ID NO: 2264365 - RNA, 15 nt, Human
guugaaugacaacag

SEQ ID NO: 2264366 - RNA, 17 nt, Human
guugaauacuuuuuaca

SEQ ID NO: 2264367 - RNA, 13 nt, Human
guugaauacuuuu

SEQ ID NO: 2264368 - RNA, 16 nt, Human
guugaauggccugccu

SEQ ID NO: 2264369 - RNA, 19 nt, Human
guugaaugacaacagaagc

SEQ ID NO: 2264370 - RNA, 13 nt, Human
guugaagcucugg

SEQ ID NO: 2264371 - RNA, 22 nt, Human
guugaagcuaagauuuagagau

SEQ ID NO: 2264372 - RNA, 14 nt, Human
guugaagcucuggu

SEQ ID NO: 2264373 - RNA, 14 nt, Human
guugaagccuuugu

SEQ ID NO: 2264374 - RNA, 13 nt, Human
guugaagccuuug

SEQ ID NO: 2264375 - RNA, 17 nt, Human
guugauguuggcuggga

SEQ ID NO: 2264376 - RNA, 17 nt, Human
guugauggguucuaauu

SEQ ID NO: 2264377 - RNA, 16 nt, Human
guugauguuggcuggg

SEQ ID NO: 2264378 - RNA, 21 nt, Human
guugauggugguauguuuuca

SEQ ID NO: 2264379 - RNA, 20 nt, Human
guugauggugguauguuuuc

SEQ ID NO: 2264380 - RNA, 23 nt, Human
guugauuucagcaccuacagugu

SEQ ID NO: 2264381 - RNA, 14 nt, Human
guugauugcuaaau

SEQ ID NO: 2264382 - RNA, 15 nt, Human
guugauugcuaaaug

SEQ ID NO: 2264383 - RNA, 16 nt, Human
guugauugcuaaaugu

SEQ ID NO: 2264384 - RNA, 17 nt, Human
guugauugcuaaaugua

SEQ ID NO: 2264385 - RNA, 12 nt, Human
guugauugcuaa

SEQ ID NO: 2264386 - RNA, 13 nt, Human
guugauugcuaaa

SEQ ID NO: 2264387 - RNA, 23 nt, Human
guugauucgguauccccccaucu

SEQ ID NO: 2264388 - RNA, 22 nt, Human
guugauugcuaaauguaacagu

SEQ ID NO: 2264389 - RNA, 18 nt, Human
guugauugcuaaauguaa

SEQ ID NO: 2264390 - RNA, 20 nt, Human
guugauugcuaaauguaaca

SEQ ID NO: 2264391 - RNA, 18 nt, Human
guugauuucuuuccagag

SEQ ID NO: 2264392 - RNA, 14 nt, Human
guugcaacuuugua

SEQ ID NO: 2264393 - RNA, 17 nt, Human
guugcaaguacugcugu

SEQ ID NO: 2264394 - RNA, 23 nt, Human
guugcaaggccgcuguucaccca

SEQ ID NO: 2264395 - RNA, 17 nt, Human
guugcaaggccgcuguu

SEQ ID NO: 2264396 - RNA, 16 nt, Human
guugcaaggccgcugu

SEQ ID NO: 2264397 - RNA, 20 nt, Human
guugcacacccacucagcuc

SEQ ID NO: 2264398 - RNA, 22 nt, Human
guugcaauagaacagagaaaga

SEQ ID NO: 2264399 - RNA, 16 nt, Human
guugcacagcuaugaa

SEQ ID NO: 2264400 - RNA, 15 nt, Human
guugcaaggccgcug

SEQ ID NO: 2264401 - RNA, 15 nt, Human
guugcaaacucagcc

SEQ ID NO: 2264402 - RNA, 13 nt, Human
guugcaaccacug

SEQ ID NO: 2264403 - RNA, 14 nt, Human
guugcaaccacugc

SEQ ID NO: 2264404 - RNA, 16 nt, Human
guugcaacuuuguaua

SEQ ID NO: 2264405 - RNA, 19 nt, Human
guugccaaauauguccugg

SEQ ID NO: 2264406 - RNA, 20 nt, Human
guugccaaauauguccuggg

SEQ ID NO: 2264407 - RNA, 18 nt, Human
guugccaaacagccacac

SEQ ID NO: 2264408 - RNA, 17 nt, Human
guugccaaacagccaca

SEQ ID NO: 2264409 - RNA, 20 nt, Human
guugcauuaaaaaugcauau

SEQ ID NO: 2264410 - RNA, 13 nt, Human
guugcagugagcu

SEQ ID NO: 2264411 - RNA, 16 nt, Human
guugcaugauguauuu

SEQ ID NO: 2264412 - RNA, 20 nt, Human
guugcaugucgugaccaacu

SEQ ID NO: 2264413 - RNA, 15 nt, Human
guugcagugagcuga

SEQ ID NO: 2264414 - RNA, 19 nt, Human
guugcacuuggccucugga

SEQ ID NO: 2264415 - RNA, 19 nt, Human
guugcacuuaugauuucau

SEQ ID NO: 2264416 - RNA, 14 nt, Human
guugcacugauauu

SEQ ID NO: 2264417 - RNA, 15 nt, Human
guugcaggaccucag

SEQ ID NO: 2264418 - RNA, 13 nt, Human
guugcacccagcc

SEQ ID NO: 2264419 - RNA, 14 nt, Human
guugcacccagccc

SEQ ID NO: 2264420 - RNA, 15 nt, Human
guugcacccagcccu

SEQ ID NO: 2264421 - RNA, 16 nt, Human
guugcacccagcccug

SEQ ID NO: 2264422 - RNA, 17 nt, Human
guugcacccagcccugg

SEQ ID NO: 2264423 - RNA, 18 nt, Human
guugcacccagcccuggu

SEQ ID NO: 2264424 - RNA, 20 nt, Human
guugcacccagcccuggucu

SEQ ID NO: 2264425 - RNA, 23 nt, Human
guugcacccagcccuggucucag

SEQ ID NO: 2264426 - RNA, 14 nt, Human
guuggauuuuuguc

SEQ ID NO: 2264427 - RNA, 18 nt, Human
guuggauuuauaaaugcu

SEQ ID NO: 2264428 - RNA, 21 nt, Human
guuggauuuauaaaugcuauu

SEQ ID NO: 2264429 - RNA, 14 nt, Human
guuggcaaaaaggc

SEQ ID NO: 2264430 - RNA, 20 nt, Human
guuggauuuuugucuugugu

SEQ ID NO: 2264431 - RNA, 12 nt, Human
guuggauuuguu

SEQ ID NO: 2264432 - RNA, 18 nt, Human
guuggcaaaaaggcagga

SEQ ID NO: 2264433 - RNA, 23 nt, Human
guuggccaaagccaaagcuaggc

SEQ ID NO: 2264434 - RNA, 16 nt, Human
guuggcagugagugag

SEQ ID NO: 2264435 - RNA, 22 nt, Human
guuggcagugagugagccuggc

SEQ ID NO: 2264436 - RNA, 23 nt, Human
guuggcagugagugagccuggcu

SEQ ID NO: 2264437 - RNA, 20 nt, Human
guuggcacucacagaccugg

SEQ ID NO: 2264438 - RNA, 15 nt, Human
guuggcacucacaga

SEQ ID NO: 2264439 - RNA, 19 nt, Human
guuggcacucacagaccug

SEQ ID NO: 2264440 - RNA, 13 nt, Human
guuggcaggcugg

SEQ ID NO: 2264441 - RNA, 14 nt, Human
guuggcaggcuggc

SEQ ID NO: 2264442 - RNA, 15 nt, Human
guuggcaggcuggcc

SEQ ID NO: 2264443 - RNA, 16 nt, Human
guuggcaggcuggcca

SEQ ID NO: 2264444 - RNA, 17 nt, Human
guuggcaggcuggccag

SEQ ID NO: 2264445 - RNA, 20 nt, Human
guuggcaggcuggccagucc

SEQ ID NO: 2264446 - RNA, 13 nt, Human
guuggccaggcug

SEQ ID NO: 2264447 - RNA, 20 nt, Human
guuggccacgucuuccuucu

SEQ ID NO: 2264448 - RNA, 14 nt, Human
guuggccaggcugc

SEQ ID NO: 2264449 - RNA, 15 nt, Human
guuggccaggcuggu

SEQ ID NO: 2264450 - RNA, 14 nt, Human
guuggccaggcugg

SEQ ID NO: 2264451 - RNA, 17 nt, Human
guuggccaggcuggucu

SEQ ID NO: 2264452 - RNA, 18 nt, Human
guuggccaggcuggucuc

SEQ ID NO: 2264453 - RNA, 19 nt, Human
guuggccaggcugcucuug

SEQ ID NO: 2264454 - RNA, 19 nt, Human
guuggccaggcuggucuca

SEQ ID NO: 2264455 - RNA, 14 nt, Human
guuggccaguguga

SEQ ID NO: 2264456 - RNA, 15 nt, Human
guugccagagaugga

SEQ ID NO: 2264457 - RNA, 11 nt, Human
guugccagaga

SEQ ID NO: 2264458 - RNA, 17 nt, Human
guugccagagauggagg

SEQ ID NO: 2264459 - RNA, 16 nt, Human
guugccacaggccucc

SEQ ID NO: 2264460 - RNA, 17 nt, Human
guugccacaggccuccc

SEQ ID NO: 2264461 - RNA, 19 nt, Human
guugccacaggccucccug

SEQ ID NO: 2264462 - RNA, 12 nt, Human
guugcccaggca

SEQ ID NO: 2264463 - RNA, 14 nt, Human
guugcccaggcagg

SEQ ID NO: 2264464 - RNA, 12 nt, Human
guuggagccugc

SEQ ID NO: 2264465 - RNA, 22 nt, Human
guuggagagcuagaaccuggag

SEQ ID NO: 2264466 - RNA, 14 nt, Human
guuggagccugcag

SEQ ID NO: 2264467 - RNA, 16 nt, Human
guuggagccugcaggg

SEQ ID NO: 2264468 - RNA, 19 nt, Human
guuggagccugcagggugg

SEQ ID NO: 2264469 - RNA, 13 nt, Human
guuggaucuucaa

SEQ ID NO: 2264470 - RNA, 19 nt, Human
guuggagagcuagaaccug

SEQ ID NO: 2264471 - RNA, 20 nt, Human
guuggacccgcucuggacca

SEQ ID NO: 2264472 - RNA, 15 nt, Human
guuggacccgcucug

SEQ ID NO: 2264473 - RNA, 16 nt, Human
guuggacccgcucugg

SEQ ID NO: 2264474 - RNA, 17 nt, Human
guuggacccgcucugga

SEQ ID NO: 2264475 - RNA, 18 nt, Human
guuggacccgcucuggac

SEQ ID NO: 2264476 - RNA, 13 nt, Human
guugccagucacc

SEQ ID NO: 2264477 - RNA, 14 nt, Human
guugccagucaccc

SEQ ID NO: 2264478 - RNA, 16 nt, Human
guugccacaggacaca

SEQ ID NO: 2264479 - RNA, 15 nt, Human
guugccacaggacac

SEQ ID NO: 2264480 - RNA, 12 nt, Human
guugccacaggc

SEQ ID NO: 2264481 - RNA, 15 nt, Human
guugccacaggccuc

SEQ ID NO: 2264482 - RNA, 14 nt, Human
guugccacaggaca

SEQ ID NO: 2264483 - RNA, 13 nt, Human
guugccacaggac

SEQ ID NO: 2264484 - RNA, 13 nt, Human
guugccaagcugg

SEQ ID NO: 2264485 - RNA, 11 nt, Human
guugccacagg

SEQ ID NO: 2264486 - RNA, 21 nt, Human
guugccaaauauguccugggg

SEQ ID NO: 2264487 - RNA, 15 nt, Human
guugccaagcuccaa

SEQ ID NO: 2264488 - RNA, 18 nt, Human
guugccaagcuccaagcc

SEQ ID NO: 2264489 - RNA, 19 nt, Human
guugccaagcuccaagccc

SEQ ID NO: 2264490 - RNA, 16 nt, Human
guugccagucaccccg

SEQ ID NO: 2264491 - RNA, 17 nt, Human
guugccagucaccccgg

SEQ ID NO: 2264492 - RNA, 18 nt, Human
guugccagucaccccggc

SEQ ID NO: 2264493 - RNA, 23 nt, Human
guugccagucaccccggccaccu

SEQ ID NO: 2264494 - RNA, 13 nt, Human
guucugacuugac

SEQ ID NO: 2264495 - RNA, 23 nt, Human
guucugacauuaacaguuuucca

SEQ ID NO: 2264496 - RNA, 21 nt, Human
guucugacauuaacaguuuuc

SEQ ID NO: 2264497 - RNA, 17 nt, Human
guucugacauuaacagu

SEQ ID NO: 2264498 - RNA, 16 nt, Human
guucugacauuaacag

SEQ ID NO: 2264499 - RNA, 15 nt, Human
guucugacauuaaca

SEQ ID NO: 2264500 - RNA, 20 nt, Human
guucugaauaugcugcucau

SEQ ID NO: 2264501 - RNA, 14 nt, Human
guucucuucuugaa

SEQ ID NO: 2264502 - RNA, 15 nt, Human
guucugaauaauuuc

SEQ ID NO: 2264503 - RNA, 16 nt, Human
guucugaauaauuucu

SEQ ID NO: 2264504 - RNA, 18 nt, Human
guucugaauaauuucuua

SEQ ID NO: 2264505 - RNA, 14 nt, Human
guucugaagaagau

SEQ ID NO: 2264506 - RNA, 15 nt, Human
guucugaagaagaug

SEQ ID NO: 2264507 - RNA, 18 nt, Human
guucuaauuuuggaugga

SEQ ID NO: 2264508 - RNA, 19 nt, Human
guucuaagucuuuccauug

SEQ ID NO: 2264509 - RNA, 17 nt, Human
guucuaagucuuuccau

SEQ ID NO: 2264510 - RNA, 12 nt, Human
guucugaagaag

SEQ ID NO: 2264511 - RNA, 13 nt, Human
guucugaagaaga

SEQ ID NO: 2264512 - RNA, 14 nt, Human
guucugaguguuuu

SEQ ID NO: 2264513 - RNA, 17 nt, Human
guucugaugaugugccu

SEQ ID NO: 2264514 - RNA, 18 nt, Human
guucugaugaugugccug

SEQ ID NO: 2264515 - RNA, 22 nt, Human
guucugagauuauuuuaaucua

SEQ ID NO: 2264516 - RNA, 19 nt, Human
guucugauccuaguuccac

SEQ ID NO: 2264517 - RNA, 18 nt, Human
guucugauuagaaaugac

SEQ ID NO: 2264518 - RNA, 16 nt, Human
guucugauuagaaaug

SEQ ID NO: 2264519 - RNA, 14 nt, Human
guucugauuagaaa

SEQ ID NO: 2264520 - RNA, 13 nt, Human
guucugauuagaa

SEQ ID NO: 2264521 - RNA, 20 nt, Human
guucugauuagaaaugacca

SEQ ID NO: 2264522 - RNA, 16 nt, Human
guucugcaaaaauauu

SEQ ID NO: 2264523 - RNA, 16 nt, Human
guucugcacacagcac

SEQ ID NO: 2264524 - RNA, 15 nt, Human
guucugcacacagca

SEQ ID NO: 2264525 - RNA, 15 nt, Human
guucugccugccagc

SEQ ID NO: 2264526 - RNA, 13 nt, Human
guucugccugcca

SEQ ID NO: 2264527 - RNA, 23 nt, Human
guucugccugccagcugcacuga

SEQ ID NO: 2264528 - RNA, 22 nt, Human
guucugccugccagcugcacug

SEQ ID NO: 2264529 - RNA, 19 nt, Human
guucugccugccagcugca

SEQ ID NO: 2264530 - RNA, 17 nt, Human
guucugccugccagcug

SEQ ID NO: 2264531 - RNA, 22 nt, Human
guucgacgagacggucgagcag

SEQ ID NO: 2264532 - RNA, 19 nt, Human
guucgagaccaaccugacc

SEQ ID NO: 2264533 - RNA, 14 nt, Human
guucgacucagccu

SEQ ID NO: 2264534 - RNA, 16 nt, Human
guucgacucagccuca

SEQ ID NO: 2264535 - RNA, 23 nt, Human
guuccuugaucuguauauacaau

SEQ ID NO: 2264536 - RNA, 20 nt, Human
guuccuucuggugucugcuu

SEQ ID NO: 2264537 - RNA, 17 nt, Human
guuccuuccucugagcc

SEQ ID NO: 2264538 - RNA, 19 nt, Human
guuccuuccucugagccuu

SEQ ID NO: 2264539 - RNA, 18 nt, Human
guuccuuccucugagccu

SEQ ID NO: 2264540 - RNA, 16 nt, Human
guucgagaccagccug

SEQ ID NO: 2264541 - RNA, 17 nt, Human
guucgagaccagccugg

SEQ ID NO: 2264542 - RNA, 19 nt, Human
guucgagaccagccuggcc

SEQ ID NO: 2264543 - RNA, 18 nt, Human
guucgagaccagccuggc

SEQ ID NO: 2264544 - RNA, 20 nt, Human
guucgagaccagccuggcca

SEQ ID NO: 2264545 - RNA, 16 nt, Human
guucgagaccagucug

SEQ ID NO: 2264546 - RNA, 19 nt, Human
guucgagaccagucuggcc

SEQ ID NO: 2264547 - RNA, 17 nt, Human
guucguggaaagggugc

SEQ ID NO: 2264548 - RNA, 13 nt, Human
guucguucuguuu

SEQ ID NO: 2264549 - RNA, 13 nt, Human
guucguagcuuuc

SEQ ID NO: 2264550 - RNA, 16 nt, Human
guucgggugugcaaug

SEQ ID NO: 2264551 - RNA, 18 nt, Human
guucggauuuggggugga

SEQ ID NO: 2264552 - RNA, 20 nt, Human
guucgcauggucacacacug

SEQ ID NO: 2264553 - RNA, 14 nt, Human
guucgcauggucac

SEQ ID NO: 2264554 - RNA, 23 nt, Human
guucuaaagauggaaaaaccacc

SEQ ID NO: 2264555 - RNA, 17 nt, Human
guucuaaagauggaaaa

SEQ ID NO: 2264556 - RNA, 20 nt, Human
guucuaaagauggaaaaacc

SEQ ID NO: 2264557 - RNA, 14 nt, Human
guucuaaagaugga

SEQ ID NO: 2264558 - RNA, 14 nt, Human
guucguucuguuua

SEQ ID NO: 2264559 - RNA, 19 nt, Human
guucuaaaaauugugauca

SEQ ID NO: 2264560 - RNA, 16 nt, Human
guucuaagucuuucca

SEQ ID NO: 2264561 - RNA, 19 nt, Human
guugaaaauuauuuuaaac

SEQ ID NO: 2264562 - RNA, 18 nt, Human
guugaaaauucaaaaagu

SEQ ID NO: 2264563 - RNA, 23 nt, Human
guugaaaagacuccaaagaaaug

SEQ ID NO: 2264564 - RNA, 22 nt, Human
guugaaaagacuccaaagaaau

SEQ ID NO: 2264565 - RNA, 17 nt, Human
guugaaaagacuccaaa

SEQ ID NO: 2264566 - RNA, 17 nt, Human
guugaaaaacagcugag

SEQ ID NO: 2264567 - RNA, 13 nt, Human
guucuuuuaaagg

SEQ ID NO: 2264568 - RNA, 21 nt, Human
guucuuuguucauagcccagu

SEQ ID NO: 2264569 - RNA, 22 nt, Human
guucuuugggccagacaugcca

SEQ ID NO: 2264570 - RNA, 17 nt, Human
guucuuugggccagaca

SEQ ID NO: 2264571 - RNA, 13 nt, Human
guucuuuguucau

SEQ ID NO: 2264572 - RNA, 20 nt, Human
guucuuuguucauagcccag

SEQ ID NO: 2264573 - RNA, 16 nt, Human
guucuuugggccagac

SEQ ID NO: 2264574 - RNA, 15 nt, Human
guucuuugggccaga

SEQ ID NO: 2264575 - RNA, 18 nt, Human
guucuuuggaaggaguga

SEQ ID NO: 2264576 - RNA, 16 nt, Human
guucuuucuuccucug

SEQ ID NO: 2264577 - RNA, 17 nt, Human
guucuuucuuccucugc

SEQ ID NO: 2264578 - RNA, 18 nt, Human
guucuuucuuccucugcu

SEQ ID NO: 2264579 - RNA, 19 nt, Human
guucuuucuuccucugcug

SEQ ID NO: 2264580 - RNA, 14 nt, Human
guucuuucuuccuc

SEQ ID NO: 2264581 - RNA, 15 nt, Human
guucuuucuuccucu

SEQ ID NO: 2264582 - RNA, 15 nt, Human
guucuuucuggaguc

SEQ ID NO: 2264583 - RNA, 20 nt, Human
guucuuuccaaaguacacug

SEQ ID NO: 2264584 - RNA, 18 nt, Human
guucuuuccaaaguacac

SEQ ID NO: 2264585 - RNA, 14 nt, Human
guucuuuccaaagu

SEQ ID NO: 2264586 - RNA, 13 nt, Human
guucuuuccaaag

SEQ ID NO: 2264587 - RNA, 23 nt, Human
guucuggcccucaccccugcccu

SEQ ID NO: 2264588 - RNA, 21 nt, Human
guucuggcccucaccccugcc

SEQ ID NO: 2264589 - RNA, 20 nt, Human
guucuggcugccccaaccug

SEQ ID NO: 2264590 - RNA, 22 nt, Human
guucuggcugccccaaccugcu

SEQ ID NO: 2264591 - RNA, 15 nt, Human
guucuggcccucacc

SEQ ID NO: 2264592 - RNA, 16 nt, Human
guucuggccagaaugc

SEQ ID NO: 2264593 - RNA, 11 nt, Human
guucugggaca

SEQ ID NO: 2264594 - RNA, 12 nt, Human
guucugggacac

SEQ ID NO: 2264595 - RNA, 14 nt, Human
guucugggacacag

SEQ ID NO: 2264596 - RNA, 15 nt, Human
guucugggacacagu

SEQ ID NO: 2264597 - RNA, 16 nt, Human
guucugggacacaguu

SEQ ID NO: 2264598 - RNA, 23 nt, Human
guucugggacacaguucaauucu

SEQ ID NO: 2264599 - RNA, 17 nt, Human
guucuuuaggagauuuu

SEQ ID NO: 2264600 - RNA, 18 nt, Human
guucuuucacccuuuucu

SEQ ID NO: 2264601 - RNA, 23 nt, Human
guucuggcagaguugaagacaga

SEQ ID NO: 2264602 - RNA, 22 nt, Human
guucugcuccucuccaggcacc

SEQ ID NO: 2264603 - RNA, 13 nt, Human
guucugcuggccu

SEQ ID NO: 2264604 - RNA, 16 nt, Human
guucugcuccucucca

SEQ ID NO: 2264605 - RNA, 17 nt, Human
guucugcuccucuccag

SEQ ID NO: 2264606 - RNA, 18 nt, Human
guucugcuccucuccagg

SEQ ID NO: 2264607 - RNA, 19 nt, Human
guucugcuccucuccaggc

SEQ ID NO: 2264608 - RNA, 11 nt, Human
guucugcuccu

SEQ ID NO: 2264609 - RNA, 13 nt, Human
guucugcuccucu

SEQ ID NO: 2264610 - RNA, 14 nt, Human
guucugcuccucuc

SEQ ID NO: 2264611 - RNA, 15 nt, Human
guucugcuccucucc

SEQ ID NO: 2264612 - RNA, 22 nt, Human
guucugcaaaaauauuuauaaa

SEQ ID NO: 2264613 - RNA, 15 nt, Human
guucugcucaucauu

SEQ ID NO: 2264614 - RNA, 23 nt, Human
guucugcucaucauucucugucu

SEQ ID NO: 2264615 - RNA, 18 nt, Human
guucugcucaucauucuc

SEQ ID NO: 2264616 - RNA, 12 nt, Human
guucuggcucuu

SEQ ID NO: 2264617 - RNA, 13 nt, Human
guucuggccagaa

SEQ ID NO: 2264618 - RNA, 12 nt, Human
guucuggccaga

SEQ ID NO: 2264619 - RNA, 14 nt, Human
guucugcuggccug

SEQ ID NO: 2264620 - RNA, 16 nt, Human
guucugcuggccugga

SEQ ID NO: 2264621 - RNA, 19 nt, Human
guucugcuggccuggaucu

SEQ ID NO: 2264622 - RNA, 16 nt, Human
guucuggcucuuccag

SEQ ID NO: 2264623 - RNA, 20 nt, Human
guucuggcucuuccaggcug

SEQ ID NO: 2264624 - RNA, 20 nt, Human
guggcucacgugugugacuc

SEQ ID NO: 2264625 - RNA, 23 nt, Human
guggcucacgccuguaaucccag

SEQ ID NO: 2264626 - RNA, 22 nt, Human
guggcucacgccuguaauccca

SEQ ID NO: 2264627 - RNA, 14 nt, Human
guggcuccccucua

SEQ ID NO: 2264628 - RNA, 12 nt, Human
guggcuccccuc

SEQ ID NO: 2264629 - RNA, 19 nt, Human
guggcucaugccuguaauc

SEQ ID NO: 2264630 - RNA, 15 nt, Human
guggcuccagcacca

SEQ ID NO: 2264631 - RNA, 15 nt, Human
guggcucagccagca

SEQ ID NO: 2264632 - RNA, 14 nt, Human
guggcucaugccug

SEQ ID NO: 2264633 - RNA, 23 nt, Human
guggcuccccucuauuuagcaug

SEQ ID NO: 2264634 - RNA, 22 nt, Human
guggcuccccucuauuuagcau

SEQ ID NO: 2264635 - RNA, 18 nt, Human
guggcuccuaucuguguu

SEQ ID NO: 2264636 - RNA, 20 nt, Human
guggcuccuaucuguguuuu

SEQ ID NO: 2264637 - RNA, 13 nt, Human
guggcuccucccg

SEQ ID NO: 2264638 - RNA, 20 nt, Human
guggcuccucccggugccca

SEQ ID NO: 2264639 - RNA, 16 nt, Human
guggcugcccacacac

SEQ ID NO: 2264640 - RNA, 18 nt, Human
guggcugcggcacccuug

SEQ ID NO: 2264641 - RNA, 17 nt, Human
guggcugcuagcacuug

SEQ ID NO: 2264642 - RNA, 20 nt, Human
guggcugccucauuuagaga

SEQ ID NO: 2264643 - RNA, 16 nt, Human
guggcugccucauuua

SEQ ID NO: 2264644 - RNA, 13 nt, Human
guggcuccuuccc

SEQ ID NO: 2264645 - RNA, 19 nt, Human
guggcugcuagcacuugga

SEQ ID NO: 2264646 - RNA, 12 nt, Human
guggcugcugcc

SEQ ID NO: 2264647 - RNA, 16 nt, Human
guggcugcugcccagg

SEQ ID NO: 2264648 - RNA, 13 nt, Human
guggcugcugccc

SEQ ID NO: 2264649 - RNA, 15 nt, Human
guggcugcugcccag

SEQ ID NO: 2264650 - RNA, 12 nt, Human
guggcugcuuca

SEQ ID NO: 2264651 - RNA, 14 nt, Human
guggcugcuucaag

SEQ ID NO: 2264652 - RNA, 21 nt, Human
gugcuaauaacagugcauauu

SEQ ID NO: 2264653 - RNA, 21 nt, Human
gugcuacaaaaacacagcaag

SEQ ID NO: 2264654 - RNA, 18 nt, Human
guggcuagucaagcuccu

SEQ ID NO: 2264655 - RNA, 12 nt, Human
guggcuaggcag

SEQ ID NO: 2264656 - RNA, 19 nt, Human
guggcuagucagagagagu

SEQ ID NO: 2264657 - RNA, 17 nt, Human
guggcuagucagagaga

SEQ ID NO: 2264658 - RNA, 23 nt, Human
guggcuagucaagcuccuccucc

SEQ ID NO: 2264659 - RNA, 22 nt, Human
guggcuagucaagcuccuccuc

SEQ ID NO: 2264660 - RNA, 21 nt, Human
guggcuagucaagcuccuccu

SEQ ID NO: 2264661 - RNA, 20 nt, Human
guggcuagucaagcuccucc

SEQ ID NO: 2264662 - RNA, 19 nt, Human
guggcuagucaagcuccuc

SEQ ID NO: 2264663 - RNA, 14 nt, Human
guggcucacgccug

SEQ ID NO: 2264664 - RNA, 13 nt, Human
gugcuaauuuuga

SEQ ID NO: 2264665 - RNA, 15 nt, Human
gugcuaauuuugaaa

SEQ ID NO: 2264666 - RNA, 20 nt, Human
gugcuacaaaaacacagcaa

SEQ ID NO: 2264667 - RNA, 15 nt, Human
gugcuacaaaaacac

SEQ ID NO: 2264668 - RNA, 19 nt, Human
guggcuucauuagagcagg

SEQ ID NO: 2264669 - RNA, 20 nt, Human
guggcuucauuagagcaggc

SEQ ID NO: 2264670 - RNA, 18 nt, Human
guggcuucccgcucagcc

SEQ ID NO: 2264671 - RNA, 19 nt, Human
guggcuucccgcucagccc

SEQ ID NO: 2264672 - RNA, 20 nt, Human
guggcuucccgcucagcccu

SEQ ID NO: 2264673 - RNA, 16 nt, Human
gugggcacccacccug

SEQ ID NO: 2264674 - RNA, 20 nt, Human
gugggcacccacccugggac

SEQ ID NO: 2264675 - RNA, 17 nt, Human
gugggcaaacaggcagu

SEQ ID NO: 2264676 - RNA, 21 nt, Human
guggcuucauuagagcaggcg

SEQ ID NO: 2264677 - RNA, 23 nt, Human
gugggcacgcugugggcaggugg

SEQ ID NO: 2264678 - RNA, 20 nt, Human
gugggcacgcugugggcagg

SEQ ID NO: 2264679 - RNA, 21 nt, Human
gugggcacgcugugggcaggu

SEQ ID NO: 2264680 - RNA, 13 nt, Human
gugggcaggaaaa

SEQ ID NO: 2264681 - RNA, 14 nt, Human
gugggcaggaaaag

SEQ ID NO: 2264682 - RNA, 12 nt, Human
gugggcaggugg

SEQ ID NO: 2264683 - RNA, 20 nt, Human
guggcuuacuacauguggga

SEQ ID NO: 2264684 - RNA, 17 nt, Human
guggcuguccagugccc

SEQ ID NO: 2264685 - RNA, 18 nt, Human
guggcuguccagugccca

SEQ ID NO: 2264686 - RNA, 19 nt, Human
guggcuguccagugcccau

SEQ ID NO: 2264687 - RNA, 22 nt, Human
guggcuuaaaacaacacucaca

SEQ ID NO: 2264688 - RNA, 22 nt, Human
guggcugggggcaggagggccc

SEQ ID NO: 2264689 - RNA, 17 nt, Human
guggcugggggcaggag

SEQ ID NO: 2264690 - RNA, 18 nt, Human
guggcuggguuuacacgc

SEQ ID NO: 2264691 - RNA, 15 nt, Human
guggcugguccaggg

SEQ ID NO: 2264692 - RNA, 19 nt, Human
guggcugucagcaggaagc

SEQ ID NO: 2264693 - RNA, 15 nt, Human
guggcuguccagugc

SEQ ID NO: 2264694 - RNA, 15 nt, Human
guggcugucagcagg

SEQ ID NO: 2264695 - RNA, 14 nt, Human
guggcugucagcag

SEQ ID NO: 2264696 - RNA, 21 nt, Human
guggcuggguccaggggaugg

SEQ ID NO: 2264697 - RNA, 17 nt, Human
guggcugguccagggcu

SEQ ID NO: 2264698 - RNA, 16 nt, Human
guggcugggggcagga

SEQ ID NO: 2264699 - RNA, 11 nt, Human
guggcuggggg

SEQ ID NO: 2264700 - RNA, 20 nt, Human
guggcuggaagauccugcgg

SEQ ID NO: 2264701 - RNA, 19 nt, Human
guggcuggguuggagggug

SEQ ID NO: 2264702 - RNA, 23 nt, Human
guggcugcuucaaggauccugag

SEQ ID NO: 2264703 - RNA, 17 nt, Human
guggcuggaucugugag

SEQ ID NO: 2264704 - RNA, 12 nt, Human
guggcuggaaga

SEQ ID NO: 2264705 - RNA, 17 nt, Human
guggcuggaagauccug

SEQ ID NO: 2264706 - RNA, 15 nt, Human
guggcugcuucaagg

SEQ ID NO: 2264707 - RNA, 16 nt, Human
guggcugcuucaagga

SEQ ID NO: 2264708 - RNA, 19 nt, Human
guggcugcuucaaggaucc

SEQ ID NO: 2264709 - RNA, 22 nt, Human
guggcugcuucaaggauccuga

SEQ ID NO: 2264710 - RNA, 13 nt, Human
guggggagggccg

SEQ ID NO: 2264711 - RNA, 17 nt, Human
guggggagacugggcug

SEQ ID NO: 2264712 - RNA, 11 nt, Human
guggggacagg

SEQ ID NO: 2264713 - RNA, 14 nt, Human
gugggcuugauucu

SEQ ID NO: 2264714 - RNA, 13 nt, Human
guggggacagggc

SEQ ID NO: 2264715 - RNA, 17 nt, Human
guggggauuucucccag

SEQ ID NO: 2264716 - RNA, 18 nt, Human
guggggcaagauuuuccu

SEQ ID NO: 2264717 - RNA, 16 nt, Human
guggggauuucuccca

SEQ ID NO: 2264718 - RNA, 15 nt, Human
guggggauugcccau

SEQ ID NO: 2264719 - RNA, 19 nt, Human
guggggaucucaggggcug

SEQ ID NO: 2264720 - RNA, 18 nt, Human
guggggaucucaggggcu

SEQ ID NO: 2264721 - RNA, 22 nt, Human
guggggacguccugccaccugg

SEQ ID NO: 2264722 - RNA, 11 nt, Human
guggggagggg

SEQ ID NO: 2264723 - RNA, 13 nt, Human
guggggaggggcg

SEQ ID NO: 2264724 - RNA, 13 nt, Human
guggggaggggcu

SEQ ID NO: 2264725 - RNA, 18 nt, Human
gugggcugagcccuggca

SEQ ID NO: 2264726 - RNA, 18 nt, Human
gugggcucugugcaguca

SEQ ID NO: 2264727 - RNA, 19 nt, Human
gugggcugcacucugugcc

SEQ ID NO: 2264728 - RNA, 20 nt, Human
gugggcugcacucugugccc

SEQ ID NO: 2264729 - RNA, 21 nt, Human
gugggcugcacucugugccca

SEQ ID NO: 2264730 - RNA, 15 nt, Human
gugggcugcaucugg

SEQ ID NO: 2264731 - RNA, 13 nt, Human
gugggcugugagu

SEQ ID NO: 2264732 - RNA, 16 nt, Human
gugggcuucccagugg

SEQ ID NO: 2264733 - RNA, 22 nt, Human
gugggcuucccaguggcugcug

SEQ ID NO: 2264734 - RNA, 23 nt, Human
gugggcuucccaguggcugcugc

SEQ ID NO: 2264735 - RNA, 14 nt, Human
gugggcugugagug

SEQ ID NO: 2264736 - RNA, 22 nt, Human
gugggcuggugacccagucaga

SEQ ID NO: 2264737 - RNA, 15 nt, Human
guggggaccucaggc

SEQ ID NO: 2264738 - RNA, 18 nt, Human
guggggaccucaggccug

SEQ ID NO: 2264739 - RNA, 12 nt, Human
guggggcagcac

SEQ ID NO: 2264740 - RNA, 14 nt, Human
guggggcagcacag

SEQ ID NO: 2264741 - RNA, 19 nt, Human
guggggcagcacagagagg

SEQ ID NO: 2264742 - RNA, 23 nt, Human
guggggcagcacagagagggggc

SEQ ID NO: 2264743 - RNA, 13 nt, Human
guggggcagcuug

SEQ ID NO: 2264744 - RNA, 17 nt, Human
guggggcagcuugaggg

SEQ ID NO: 2264745 - RNA, 16 nt, Human
guggguuuucuuccca

SEQ ID NO: 2264746 - RNA, 21 nt, Human
guggguuuucaucaagacugg

SEQ ID NO: 2264747 - RNA, 12 nt, Human
gugguaacccug

SEQ ID NO: 2264748 - RNA, 23 nt, Human
guggguuucuaaagcugccagcc

SEQ ID NO: 2264749 - RNA, 16 nt, Human
gugggugguggggagg

SEQ ID NO: 2264750 - RNA, 16 nt, Human
guggguuauucuggag

SEQ ID NO: 2264751 - RNA, 14 nt, Human
guggggccagguca

SEQ ID NO: 2264752 - RNA, 12 nt, Human
guggguggugga

SEQ ID NO: 2264753 - RNA, 16 nt, Human
gugggugguggaucug

SEQ ID NO: 2264754 - RNA, 14 nt, Human
guggguggugggga

SEQ ID NO: 2264755 - RNA, 19 nt, Human
gugggcgggcagcacagca

SEQ ID NO: 2264756 - RNA, 19 nt, Human
gugggcggcacagccuucu

SEQ ID NO: 2264757 - RNA, 18 nt, Human
gugggcgggcagcacagc

SEQ ID NO: 2264758 - RNA, 18 nt, Human
gugggcgugagaccugcc

SEQ ID NO: 2264759 - RNA, 22 nt, Human
gugggcgugagaccugccccuc

SEQ ID NO: 2264760 - RNA, 21 nt, Human
gugggcgugagaccugccccu

SEQ ID NO: 2264761 - RNA, 13 nt, Human
gugggcggcagag

SEQ ID NO: 2264762 - RNA, 16 nt, Human
gugggcggcagagagg

SEQ ID NO: 2264763 - RNA, 15 nt, Human
gugggccuugcuggg

SEQ ID NO: 2264764 - RNA, 17 nt, Human
gugggccuugcugggga

SEQ ID NO: 2264765 - RNA, 18 nt, Human
gugggccuugcuggggac

SEQ ID NO: 2264766 - RNA, 20 nt, Human
gugggccuuguccccugccu

SEQ ID NO: 2264767 - RNA, 19 nt, Human
gugggccuucagggaguga

SEQ ID NO: 2264768 - RNA, 12 nt, Human
gugggcuaagca

SEQ ID NO: 2264769 - RNA, 17 nt, Human
gugggcguggucacugc

SEQ ID NO: 2264770 - RNA, 14 nt, Human
gugggcuaauuaaa

SEQ ID NO: 2264771 - RNA, 15 nt, Human
gugggcuaguugggc

SEQ ID NO: 2264772 - RNA, 16 nt, Human
gugggcugagcccugg

SEQ ID NO: 2264773 - RNA, 15 nt, Human
gugggcugagcccug

SEQ ID NO: 2264774 - RNA, 14 nt, Human
gugggcugagcccu

SEQ ID NO: 2264775 - RNA, 13 nt, Human
gugggcugagccc

SEQ ID NO: 2264776 - RNA, 15 nt, Human
gugggcucccugacu

SEQ ID NO: 2264777 - RNA, 14 nt, Human
gugggcucccugac

SEQ ID NO: 2264778 - RNA, 13 nt, Human
gugggcucccuga

SEQ ID NO: 2264779 - RNA, 17 nt, Human
gugggccagugugggaa

SEQ ID NO: 2264780 - RNA, 11 nt, Human
gugggcccagg

SEQ ID NO: 2264781 - RNA, 17 nt, Human
gugggccagucugugga

SEQ ID NO: 2264782 - RNA, 18 nt, Human
gugggccagucuguggau

SEQ ID NO: 2264783 - RNA, 18 nt, Human
gugggcccuccgacagcc

SEQ ID NO: 2264784 - RNA, 22 nt, Human
gugggcccaggaccagcugggg

SEQ ID NO: 2264785 - RNA, 23 nt, Human
gugggcccaggaccagcuggggc

SEQ ID NO: 2264786 - RNA, 14 nt, Human
gugggcccaggacc

SEQ ID NO: 2264787 - RNA, 19 nt, Human
gugggcccaggaccagcug

SEQ ID NO: 2264788 - RNA, 20 nt, Human
gugggcccaggaccagcugg

SEQ ID NO: 2264789 - RNA, 21 nt, Human
gugggcccaggaccagcuggg

SEQ ID NO: 2264790 - RNA, 19 nt, Human
gugggccucaaggacuuga

SEQ ID NO: 2264791 - RNA, 11 nt, Human
gugggccucug

SEQ ID NO: 2264792 - RNA, 23 nt, Human
gugggccuccucuguccagggcc

SEQ ID NO: 2264793 - RNA, 20 nt, Human
gugggccuccucuguccagg

SEQ ID NO: 2264794 - RNA, 15 nt, Human
gugggccuccucugu

SEQ ID NO: 2264795 - RNA, 13 nt, Human
gugggccuggcca

SEQ ID NO: 2264796 - RNA, 23 nt, Human
gugggccucugguuuggggcgag

SEQ ID NO: 2264797 - RNA, 12 nt, Human
gugggccucugg

SEQ ID NO: 2264798 - RNA, 22 nt, Human
gugggccucugguuuggggcga

SEQ ID NO: 2264799 - RNA, 17 nt, Human
gugggccagccccuccc

SEQ ID NO: 2264800 - RNA, 15 nt, Human
gugggccagccccuc

SEQ ID NO: 2264801 - RNA, 13 nt, Human
gugggccagcccc

SEQ ID NO: 2264802 - RNA, 12 nt, Human
gugggccagccc

SEQ ID NO: 2264803 - RNA, 20 nt, Human
gugggcauugauggggaagg

SEQ ID NO: 2264804 - RNA, 17 nt, Human
gugggccaacaaagaac

SEQ ID NO: 2264805 - RNA, 20 nt, Human
gugggcaggugggagcuuga

SEQ ID NO: 2264806 - RNA, 17 nt, Human
gugggcaggugguggca

SEQ ID NO: 2264807 - RNA, 18 nt, Human
gugggcaggugguggcac

SEQ ID NO: 2264808 - RNA, 18 nt, Human
gugggccaggacaggccc

SEQ ID NO: 2264809 - RNA, 14 nt, Human
gugggccaggacag

SEQ ID NO: 2264810 - RNA, 19 nt, Human
gugggccagccccucccac

SEQ ID NO: 2264811 - RNA, 15 nt, Human
gugggccagucugug

SEQ ID NO: 2264812 - RNA, 16 nt, Human
gugggccagucugugg

SEQ ID NO: 2264813 - RNA, 17 nt, Human
gugggcccaaugcacuu

SEQ ID NO: 2264814 - RNA, 15 nt, Human
guguacuuaacuauu

SEQ ID NO: 2264815 - RNA, 16 nt, Human
guguacguggagaggg

SEQ ID NO: 2264816 - RNA, 20 nt, Human
guguacguggagagggauga

SEQ ID NO: 2264817 - RNA, 22 nt, Human
guguacauggaauaacauguaa

SEQ ID NO: 2264818 - RNA, 17 nt, Human
guguacccccgcccagg

SEQ ID NO: 2264819 - RNA, 17 nt, Human
guguaccauuugccucc

SEQ ID NO: 2264820 - RNA, 19 nt, Human
guguacccccgcccaggcu

SEQ ID NO: 2264821 - RNA, 15 nt, Human
guguagaguuaagaa

SEQ ID NO: 2264822 - RNA, 19 nt, Human
guguagaagcauuccuucu

SEQ ID NO: 2264823 - RNA, 23 nt, Human
guguagaagcauuccuucuuuga

SEQ ID NO: 2264824 - RNA, 13 nt, Human
guguagaagcauu

SEQ ID NO: 2264825 - RNA, 14 nt, Human
guguagaagcauuc

SEQ ID NO: 2264826 - RNA, 17 nt, Human
guguagaagcauuccuu

SEQ ID NO: 2264827 - RNA, 20 nt, Human
guguagaguuaagaagcugu

SEQ ID NO: 2264828 - RNA, 17 nt, Human
guguagaguuaagaagc

SEQ ID NO: 2264829 - RNA, 18 nt, Human
guguagaguuaagaagcu

SEQ ID NO: 2264830 - RNA, 14 nt, Human
guguagccaagguc

SEQ ID NO: 2264831 - RNA, 17 nt, Human
guguagccuugcccgga

SEQ ID NO: 2264832 - RNA, 16 nt, Human
guguagccuugcccgg

SEQ ID NO: 2264833 - RNA, 14 nt, Human
guguagccugugca

SEQ ID NO: 2264834 - RNA, 13 nt, Human
guguacagucuug

SEQ ID NO: 2264835 - RNA, 16 nt, Human
guguacagucuuguau

SEQ ID NO: 2264836 - RNA, 22 nt, Human
guguacagucuuguauuaaguu

SEQ ID NO: 2264837 - RNA, 12 nt, Human
guguacagugug

SEQ ID NO: 2264838 - RNA, 14 nt, Human
guguacauaacuga

SEQ ID NO: 2264839 - RNA, 17 nt, Human
guguacauggaauaaca

SEQ ID NO: 2264840 - RNA, 16 nt, Human
guguacauaacugaaa

SEQ ID NO: 2264841 - RNA, 12 nt, Human
guguacauaugu

SEQ ID NO: 2264842 - RNA, 15 nt, Human
guguacauaugugcu

SEQ ID NO: 2264843 - RNA, 19 nt, Human
guguacaucccauguaaca

SEQ ID NO: 2264844 - RNA, 22 nt, Human
guguacaucccauguaacagaa

SEQ ID NO: 2264845 - RNA, 23 nt, Human
guguaaucauuucuugggcccuc

SEQ ID NO: 2264846 - RNA, 20 nt, Human
guguaauuuaaaauugugau

SEQ ID NO: 2264847 - RNA, 23 nt, Human
guguaauuuaaaauugugaugug

SEQ ID NO: 2264848 - RNA, 22 nt, Human
guguaauuuaaaauugugaugu

SEQ ID NO: 2264849 - RNA, 18 nt, Human
guguacagaauucugcua

SEQ ID NO: 2264850 - RNA, 15 nt, Human
guguacacgggacug

SEQ ID NO: 2264851 - RNA, 21 nt, Human
guguacacgggacugacgcaa

SEQ ID NO: 2264852 - RNA, 19 nt, Human
guguacacugacaccuuug

SEQ ID NO: 2264853 - RNA, 23 nt, Human
guguaauuuuguucuaguuuuca

SEQ ID NO: 2264854 - RNA, 13 nt, Human
guguacaaagaaa

SEQ ID NO: 2264855 - RNA, 13 nt, Human
guguaauuucuuu

SEQ ID NO: 2264856 - RNA, 15 nt, Human
guguaauuucuuugc

SEQ ID NO: 2264857 - RNA, 19 nt, Human
guguaugcuacuacaaaaa

SEQ ID NO: 2264858 - RNA, 20 nt, Human
guguauggagagaaaacaga

SEQ ID NO: 2264859 - RNA, 19 nt, Human
guguauggaaauaaaugua

SEQ ID NO: 2264860 - RNA, 16 nt, Human
guguaugugcgugugu

SEQ ID NO: 2264861 - RNA, 22 nt, Human
guguauggguguguguuugugu

SEQ ID NO: 2264862 - RNA, 16 nt, Human
guguaugggugugugu

SEQ ID NO: 2264863 - RNA, 23 nt, Human
gugucccaugacccaccccugug

SEQ ID NO: 2264864 - RNA, 19 nt, Human
gugucccaugacccacccc

SEQ ID NO: 2264865 - RNA, 21 nt, Human
gugucccaugacccaccccug

SEQ ID NO: 2264866 - RNA, 22 nt, Human
gugucccaugacccaccccugu

SEQ ID NO: 2264867 - RNA, 13 nt, Human
guguccccuccac

SEQ ID NO: 2264868 - RNA, 14 nt, Human
gugucccccucugu

SEQ ID NO: 2264869 - RNA, 18 nt, Human
gugucccccucuguccag

SEQ ID NO: 2264870 - RNA, 13 nt, Human
gugucccugcacu

SEQ ID NO: 2264871 - RNA, 16 nt, Human
gugucccugcacuugc

SEQ ID NO: 2264872 - RNA, 18 nt, Human
gugucccugcacuugcag

SEQ ID NO: 2264873 - RNA, 15 nt, Human
guguaggcagacaca

SEQ ID NO: 2264874 - RNA, 17 nt, Human
guguaguugaacugaua

SEQ ID NO: 2264875 - RNA, 15 nt, Human
guguaguugaacuga

SEQ ID NO: 2264876 - RNA, 18 nt, Human
guguauagaaguagauua

SEQ ID NO: 2264877 - RNA, 14 nt, Human
guguagcuuugcuc

SEQ ID NO: 2264878 - RNA, 12 nt, Human
guguaggcagac

SEQ ID NO: 2264879 - RNA, 13 nt, Human
guguaggcagaca

SEQ ID NO: 2264880 - RNA, 14 nt, Human
guguaggcagacac

SEQ ID NO: 2264881 - RNA, 16 nt, Human
guguaugacuaaagag

SEQ ID NO: 2264882 - RNA, 18 nt, Human
guguaucguaaccagcca

SEQ ID NO: 2264883 - RNA, 15 nt, Human
guguaugacuaaaga

SEQ ID NO: 2264884 - RNA, 13 nt, Human
guguauccugggg

SEQ ID NO: 2264885 - RNA, 14 nt, Human
guguauccuggggc

SEQ ID NO: 2264886 - RNA, 15 nt, Human
guguauccuggggcu

SEQ ID NO: 2264887 - RNA, 20 nt, Human
guguauccuggggcucccuu

SEQ ID NO: 2264888 - RNA, 16 nt, Human
guguauccauuaucau

SEQ ID NO: 2264889 - RNA, 20 nt, Human
guguauccauuaucaugugu

SEQ ID NO: 2264890 - RNA, 22 nt, Human
guguauccauuaucauguguaa

SEQ ID NO: 2264891 - RNA, 23 nt, Human
guguauccauuaucauguguaau

SEQ ID NO: 2264892 - RNA, 21 nt, Human
guguauccccccccuguauag

SEQ ID NO: 2264893 - RNA, 22 nt, Human
guguauccccccccuguauagu

SEQ ID NO: 2264894 - RNA, 14 nt, Human
guguauauguaugu

SEQ ID NO: 2264895 - RNA, 14 nt, Human
guguauacaugcca

SEQ ID NO: 2264896 - RNA, 13 nt, Human
guguauaucagaa

SEQ ID NO: 2264897 - RNA, 17 nt, Human
guguauauguaugugug

SEQ ID NO: 2264898 - RNA, 14 nt, Human
gugguauagaaaug

SEQ ID NO: 2264899 - RNA, 16 nt, Human
gugguauccugugaca

SEQ ID NO: 2264900 - RNA, 19 nt, Human
gugguaugaucacggcuca

SEQ ID NO: 2264901 - RNA, 15 nt, Human
gugguaugugugugu

SEQ ID NO: 2264902 - RNA, 12 nt, Human
gugguaugugug

SEQ ID NO: 2264903 - RNA, 20 nt, Human
gugguauccugugacaugua

SEQ ID NO: 2264904 - RNA, 22 nt, Human
guggucaaaccgcacucaccca

SEQ ID NO: 2264905 - RNA, 15 nt, Human
guggucacagcggag

SEQ ID NO: 2264906 - RNA, 16 nt, Human
guggucacagcggagg

SEQ ID NO: 2264907 - RNA, 18 nt, Human
guggucacagcggaggug

SEQ ID NO: 2264908 - RNA, 22 nt, Human
guggucacagcggaggugugga

SEQ ID NO: 2264909 - RNA, 20 nt, Human
gugguacacacagauuacug

SEQ ID NO: 2264910 - RNA, 16 nt, Human
gugguaagcucuggcu

SEQ ID NO: 2264911 - RNA, 17 nt, Human
gugguagagugugccug

SEQ ID NO: 2264912 - RNA, 14 nt, Human
gugguacccucugg

SEQ ID NO: 2264913 - RNA, 18 nt, Human
guggucugaauguucuga

SEQ ID NO: 2264914 - RNA, 17 nt, Human
guggucugaauguucug

SEQ ID NO: 2264915 - RNA, 14 nt, Human
guggucugaauguu

SEQ ID NO: 2264916 - RNA, 13 nt, Human
guggucugaaugu

SEQ ID NO: 2264917 - RNA, 15 nt, Human
gugguccugagaccu

SEQ ID NO: 2264918 - RNA, 17 nt, Human
guggucuccuuggaaau

SEQ ID NO: 2264919 - RNA, 12 nt, Human
gugguccugacu

SEQ ID NO: 2264920 - RNA, 13 nt, Human
gugguccccaaca

SEQ ID NO: 2264921 - RNA, 23 nt, Human
guggucccaacaggaggacaauu

SEQ ID NO: 2264922 - RNA, 24 nt, Human
guggucccaacaggaggacaauuc

SEQ ID NO: 2264923 - RNA, 18 nt, Human
guggucuccacuggggau

SEQ ID NO: 2264924 - RNA, 17 nt, Human
guggucccaccccacac

SEQ ID NO: 2264925 - RNA, 18 nt, Human
gugguccuaaucuucuga

SEQ ID NO: 2264926 - RNA, 16 nt, Human
guggucauuaagcauu

SEQ ID NO: 2264927 - RNA, 22 nt, Human
guggucaggcguagaucaccag

SEQ ID NO: 2264928 - RNA, 18 nt, Human
gugguccauggaaugcuu

SEQ ID NO: 2264929 - RNA, 14 nt, Human
guggucacugcugu

SEQ ID NO: 2264930 - RNA, 15 nt, Human
guggucacugcuguc

SEQ ID NO: 2264931 - RNA, 14 nt, Human
guggucccacccca

SEQ ID NO: 2264932 - RNA, 15 nt, Human
guggucccaccccac

SEQ ID NO: 2264933 - RNA, 16 nt, Human
guggucccaccccaca

SEQ ID NO: 2264934 - RNA, 21 nt, Human
guguaaucauuucuugggccc

SEQ ID NO: 2264935 - RNA, 19 nt, Human
guguaaucauuucuugggc

SEQ ID NO: 2264936 - RNA, 17 nt, Human
guguaaucaauaaacga

SEQ ID NO: 2264937 - RNA, 19 nt, Human
guguaaucaauaaacgauu

SEQ ID NO: 2264938 - RNA, 14 nt, Human
guguaauaagacau

SEQ ID NO: 2264939 - RNA, 14 nt, Human
guguaaucaauaaa

SEQ ID NO: 2264940 - RNA, 15 nt, Human
guguaaucaauaaac

SEQ ID NO: 2264941 - RNA, 16 nt, Human
guguaaucaauaaacg

SEQ ID NO: 2264942 - RNA, 22 nt, Human
guguaagugugaguaagagcug

SEQ ID NO: 2264943 - RNA, 13 nt, Human
guguaauaagaca

SEQ ID NO: 2264944 - RNA, 15 nt, Human
guguaauaagacaua

SEQ ID NO: 2264945 - RNA, 21 nt, Human
guguaaguauucuuauuuaau

SEQ ID NO: 2264946 - RNA, 21 nt, Human
guguaaguagauaggccaugg

SEQ ID NO: 2264947 - RNA, 19 nt, Human
guggugcgaucuggguuca

SEQ ID NO: 2264948 - RNA, 13 nt, Human
guggugagaucau

SEQ ID NO: 2264949 - RNA, 19 nt, Human
guggugaucaauuaaaugu

SEQ ID NO: 2264950 - RNA, 23 nt, Human
guggugagcagaaguggagcugg

SEQ ID NO: 2264951 - RNA, 16 nt, Human
guggucugcaggcagg

SEQ ID NO: 2264952 - RNA, 18 nt, Human
guggucugcucgggccca

SEQ ID NO: 2264953 - RNA, 15 nt, Human
guggucugcaggcag

SEQ ID NO: 2264954 - RNA, 24 nt, Human
guggucugaauguucugacauuaa

SEQ ID NO: 2264955 - RNA, 14 nt, Human
guggucugcaggca

SEQ ID NO: 2264956 - RNA, 23 nt, Human
guggucugaauguucugacauua

SEQ ID NO: 2264957 - RNA, 20 nt, Human
guggucugaauguucugaca

SEQ ID NO: 2264958 - RNA, 13 nt, Human
guggucuguuggc

SEQ ID NO: 2264959 - RNA, 19 nt, Human
guggucugcucgggcccag

SEQ ID NO: 2264960 - RNA, 22 nt, Human
guggucugcucgggcccaggcc

SEQ ID NO: 2264961 - RNA, 17 nt, Human
guggucuguuggcaggc

SEQ ID NO: 2264962 - RNA, 19 nt, Human
guggucuguuggcaggcug

SEQ ID NO: 2264963 - RNA, 17 nt, Human
guggucuuucuggagag

SEQ ID NO: 2264964 - RNA, 16 nt, Human
guggucuuucuggaga

SEQ ID NO: 2264965 - RNA, 15 nt, Human
guggucuuuguaaga

SEQ ID NO: 2264966 - RNA, 19 nt, Human
guggucuuuguaagagugu

SEQ ID NO: 2264967 - RNA, 15 nt, Human
guggugaagaaaacu

SEQ ID NO: 2264968 - RNA, 20 nt, Human
guggucuguuggcaggcugg

SEQ ID NO: 2264969 - RNA, 21 nt, Human
guggucuguuggcaggcuggc

SEQ ID NO: 2264970 - RNA, 22 nt, Human
guggucuguuggcaggcuggcc

SEQ ID NO: 2264971 - RNA, 23 nt, Human
guggucuguuggcaggcuggcca

SEQ ID NO: 2264972 - RNA, 14 nt, Human
guggugaccucugc

SEQ ID NO: 2264973 - RNA, 17 nt, Human
guggugaccucugccug

SEQ ID NO: 2264974 - RNA, 21 nt, Human
guggugagaggcauccaguau

SEQ ID NO: 2264975 - RNA, 15 nt, Human
guguuuuuaacucaa

SEQ ID NO: 2264976 - RNA, 18 nt, Human
guguuuuucauaaagcag

SEQ ID NO: 2264977 - RNA, 14 nt, Human
guguuuuuguaaag

SEQ ID NO: 2264978 - RNA, 15 nt, Human
guguuuuugaaauau

SEQ ID NO: 2264979 - RNA, 19 nt, Human
guguuuuucugcuuuugaa

SEQ ID NO: 2264980 - RNA, 21 nt, Human
guguuuuuguaaagugugguc

SEQ ID NO: 2264981 - RNA, 14 nt, Human
guguuuuucugcuu

SEQ ID NO: 2264982 - RNA, 14 nt, Human
guguuuucauaaua

SEQ ID NO: 2264983 - RNA, 13 nt, Human
guguuuucauaau

SEQ ID NO: 2264984 - RNA, 15 nt, Human
guguuuuaauuuaaa

SEQ ID NO: 2264985 - RNA, 18 nt, Human
guguucuggugaggccuu

SEQ ID NO: 2264986 - RNA, 16 nt, Human
guguucugauuagaaa

SEQ ID NO: 2264987 - RNA, 14 nt, Human
guguucucucuuau

SEQ ID NO: 2264988 - RNA, 14 nt, Human
guguuuuaauuuaa

SEQ ID NO: 2264989 - RNA, 16 nt, Human
guguuuucauaauaaa

SEQ ID NO: 2264990 - RNA, 15 nt, Human
guguuuucauaauaa

SEQ ID NO: 2264991 - RNA, 13 nt, Human
guguuuucugaau

SEQ ID NO: 2264992 - RNA, 19 nt, Human
guguuuucugaauaacauu

SEQ ID NO: 2264993 - RNA, 12 nt, Human
guguuuugcugu

SEQ ID NO: 2264994 - RNA, 18 nt, Human
guguuuucugaauaacau

SEQ ID NO: 2264995 - RNA, 23 nt, Human
guguucaaggccauccuucccug

SEQ ID NO: 2264996 - RNA, 17 nt, Human
guguuauuuaaagaaga

SEQ ID NO: 2264997 - RNA, 17 nt, Human
guguuauuuaaaugagu

SEQ ID NO: 2264998 - RNA, 16 nt, Human
guguuauuuaaagaag

SEQ ID NO: 2264999 - RNA, 15 nt, Human
guguuccaacaacca

SEQ ID NO: 2265000 - RNA, 17 nt, Human
guguucccauuucagcu

SEQ ID NO: 2265001 - RNA, 19 nt, Human
guguuccccaucugggucc

SEQ ID NO: 2265002 - RNA, 12 nt, Human
guguucauacau

SEQ ID NO: 2265003 - RNA, 17 nt, Human
guguucauacauuugag

SEQ ID NO: 2265004 - RNA, 18 nt, Human
guguuccuggcaauagug

SEQ ID NO: 2265005 - RNA, 15 nt, Human
guguuccuggcaaua

SEQ ID NO: 2265006 - RNA, 10 nt, Human
guguuccugg

SEQ ID NO: 2265007 - RNA, 23 nt, Human
guguuccccuuccacugagggca

SEQ ID NO: 2265008 - RNA, 22 nt, Human
guguuccccuuccacugagggc

SEQ ID NO: 2265009 - RNA, 19 nt, Human
guguuccccuuccacugag

SEQ ID NO: 2265010 - RNA, 18 nt, Human
guguuccccuuccacuga

SEQ ID NO: 2265011 - RNA, 21 nt, Human
guguucccauuucagcugauc

SEQ ID NO: 2265012 - RNA, 19 nt, Human
guguuccuggcaguuuaaa

SEQ ID NO: 2265013 - RNA, 11 nt, Human
guguucuccuu

SEQ ID NO: 2265014 - RNA, 16 nt, Human
guguucuccuuuuccu

SEQ ID NO: 2265015 - RNA, 18 nt, Human
guguguuuucauaauaaa

SEQ ID NO: 2265016 - RNA, 20 nt, Human
guguguuuugagaguauauu

SEQ ID NO: 2265017 - RNA, 21 nt, Human
guguguuuugagaguauauua

SEQ ID NO: 2265018 - RNA, 17 nt, Human
guguguuuucauaauaa

SEQ ID NO: 2265019 - RNA, 14 nt, Human
guguguuuguguga

SEQ ID NO: 2265020 - RNA, 19 nt, Human
guguguuuuaaaaugagaa

SEQ ID NO: 2265021 - RNA, 13 nt, Human
guguguuuuaaaa

SEQ ID NO: 2265022 - RNA, 16 nt, Human
guguguuuuaaaauga

SEQ ID NO: 2265023 - RNA, 19 nt, Human
guguuaaaugaaauuguaa

SEQ ID NO: 2265024 - RNA, 21 nt, Human
guguuaaaugugaugaauacu

SEQ ID NO: 2265025 - RNA, 14 nt, Human
guguguuuuucaua

SEQ ID NO: 2265026 - RNA, 18 nt, Human
guguuaaucaauuuaaac

SEQ ID NO: 2265027 - RNA, 16 nt, Human
guguuaaucauuucau

SEQ ID NO: 2265028 - RNA, 15 nt, Human
guguuaaucaauuua

SEQ ID NO: 2265029 - RNA, 19 nt, Human
guguuaauacuaguuguga

SEQ ID NO: 2265030 - RNA, 14 nt, Human
guguuacuaaguuu

SEQ ID NO: 2265031 - RNA, 16 nt, Human
guguuaccugaaaaca

SEQ ID NO: 2265032 - RNA, 23 nt, Human
guguuacccaguaacucaucugu

SEQ ID NO: 2265033 - RNA, 12 nt, Human
guguuacuaagu

SEQ ID NO: 2265034 - RNA, 20 nt, Human
guguuauaauggguaauaua

SEQ ID NO: 2265035 - RNA, 24 nt, Human
guguuaggccuggcacagugucug

SEQ ID NO: 2265036 - RNA, 12 nt, Human
guguuaguuccc

SEQ ID NO: 2265037 - RNA, 23 nt, Human
guguuagggaagggccugccaca

SEQ ID NO: 2265038 - RNA, 18 nt, Human
guguuaugacuccagaau

SEQ ID NO: 2265039 - RNA, 15 nt, Human
guguuacuguaauuc

SEQ ID NO: 2265040 - RNA, 14 nt, Human
guguuaggccuggc

SEQ ID NO: 2265041 - RNA, 19 nt, Human
guguuacuguaauuccuca

SEQ ID NO: 2265042 - RNA, 22 nt, Human
guguuagggaagggccugccac

SEQ ID NO: 2265043 - RNA, 16 nt, Human
guguuagggaagggcc

SEQ ID NO: 2265044 - RNA, 15 nt, Human
guguuaggccuggca

SEQ ID NO: 2265045 - RNA, 18 nt, Human
guguuaggccuggcacag

SEQ ID NO: 2265046 - RNA, 19 nt, Human
guguuaggccuggcacagu

SEQ ID NO: 2265047 - RNA, 21 nt, Human
guguuaggccuggcacagugu

SEQ ID NO: 2265048 - RNA, 21 nt, Human
guuaacuauuuuauuuucuaa

SEQ ID NO: 2265049 - RNA, 20 nt, Human
guuaaccagaauaaaguucu

SEQ ID NO: 2265050 - RNA, 17 nt, Human
guuaaccucagugucau

SEQ ID NO: 2265051 - RNA, 23 nt, Human
guuaacagagacagauaacucuc

SEQ ID NO: 2265052 - RNA, 12 nt, Human
guuaacagauuu

SEQ ID NO: 2265053 - RNA, 19 nt, Human
guuaacacauuuuguauaa

SEQ ID NO: 2265054 - RNA, 23 nt, Human
guuaacacauuuuguauaauugu

SEQ ID NO: 2265055 - RNA, 13 nt, Human
guuaacacauuuu

SEQ ID NO: 2265056 - RNA, 15 nt, Human
guuaacacauuuugu

SEQ ID NO: 2265057 - RNA, 16 nt, Human
guuaacacauuuugua

SEQ ID NO: 2265058 - RNA, 18 nt, Human
guuaacacauuuuguaua

SEQ ID NO: 2265059 - RNA, 22 nt, Human
guuaaauauuuacauaugaaau

SEQ ID NO: 2265060 - RNA, 16 nt, Human
guuaaauauuuacaua

SEQ ID NO: 2265061 - RNA, 15 nt, Human
guuaaauauuuacau

SEQ ID NO: 2265062 - RNA, 13 nt, Human
guuaaauauuuac

SEQ ID NO: 2265063 - RNA, 15 nt, Human
guuaaaugaaauugu

SEQ ID NO: 2265064 - RNA, 17 nt, Human
guuaaaugaaauuguaa

SEQ ID NO: 2265065 - RNA, 18 nt, Human
guuaaaugaaauuguaaa

SEQ ID NO: 2265066 - RNA, 20 nt, Human
guuaaaugaaauuguaaaac

SEQ ID NO: 2265067 - RNA, 19 nt, Human
guuaaauuuguaaguuuca

SEQ ID NO: 2265068 - RNA, 23 nt, Human
guuaaauuuguaaguuucaggug

SEQ ID NO: 2265069 - RNA, 12 nt, Human
guuaacacauuu

SEQ ID NO: 2265070 - RNA, 14 nt, Human
guuaacaaugauau

SEQ ID NO: 2265071 - RNA, 17 nt, Human
guuaaauugcuguguau

SEQ ID NO: 2265072 - RNA, 17 nt, Human
guuaaauuucuggaccu

SEQ ID NO: 2265073 - RNA, 13 nt, Human
guuaaauuuguaa

SEQ ID NO: 2265074 - RNA, 14 nt, Human
guuaaauuuguaag

SEQ ID NO: 2265075 - RNA, 15 nt, Human
guuaaauuuguaagu

SEQ ID NO: 2265076 - RNA, 16 nt, Human
guuaaauuuguaaguu

SEQ ID NO: 2265077 - RNA, 17 nt, Human
guuaaauuuguaaguuu

SEQ ID NO: 2265078 - RNA, 18 nt, Human
guuaaauuuguaaguuuc

SEQ ID NO: 2265079 - RNA, 16 nt, Human
guuacacauuuuucag

SEQ ID NO: 2265080 - RNA, 23 nt, Human
guuaacuuuaagacugagcaccu

SEQ ID NO: 2265081 - RNA, 13 nt, Human
guuaagaagcugu

SEQ ID NO: 2265082 - RNA, 17 nt, Human
guuaacuuuaagacuga

SEQ ID NO: 2265083 - RNA, 18 nt, Human
guuaacugagugccuuuu

SEQ ID NO: 2265084 - RNA, 16 nt, Human
guuacacuaaaaggug

SEQ ID NO: 2265085 - RNA, 15 nt, Human
guuacacuaaaaggu

SEQ ID NO: 2265086 - RNA, 17 nt, Human
guuacacauuuuucaga

SEQ ID NO: 2265087 - RNA, 22 nt, Human
guuacacuggaggagagaagaa

SEQ ID NO: 2265088 - RNA, 23 nt, Human
guuacacuggaggagagaagaau

SEQ ID NO: 2265089 - RNA, 13 nt, Human
guuacacuugugc

SEQ ID NO: 2265090 - RNA, 12 nt, Human
guuacagaaagu

SEQ ID NO: 2265091 - RNA, 13 nt, Human
guuacagacaaag

SEQ ID NO: 2265092 - RNA, 13 nt, Human
guuacagaaagug

SEQ ID NO: 2265093 - RNA, 19 nt, Human
guuacagaaaguggugcuc

SEQ ID NO: 2265094 - RNA, 21 nt, Human
guuacagaaaguggugcucag

SEQ ID NO: 2265095 - RNA, 22 nt, Human
guuacagaaaguggugcucagu

SEQ ID NO: 2265096 - RNA, 19 nt, Human
guuaaacuuacuuaguguu

SEQ ID NO: 2265097 - RNA, 15 nt, Human
guuaaagcugccggc

SEQ ID NO: 2265098 - RNA, 17 nt, Human
guuaaacucgcucacug

SEQ ID NO: 2265099 - RNA, 23 nt, Human
guuaaacuagcauaucugccuuu

SEQ ID NO: 2265100 - RNA, 15 nt, Human
guuaaaauuccaucc

SEQ ID NO: 2265101 - RNA, 21 nt, Human
guuaaaccauccauguauuuu

SEQ ID NO: 2265102 - RNA, 15 nt, Human
guuaaacuagcauau

SEQ ID NO: 2265103 - RNA, 19 nt, Human
guuaaacuagcauaucugc

SEQ ID NO: 2265104 - RNA, 20 nt, Human
guuaaacuagcauaucugcc

SEQ ID NO: 2265105 - RNA, 21 nt, Human
guuaaacuagcauaucugccu

SEQ ID NO: 2265106 - RNA, 22 nt, Human
guuaaacuagcauaucugccuu

SEQ ID NO: 2265107 - RNA, 12 nt, Human
guuaaauauuua

SEQ ID NO: 2265108 - RNA, 21 nt, Human
guuaaauagaguauaugcacu

SEQ ID NO: 2265109 - RNA, 19 nt, Human
guuaaauagaguauaugca

SEQ ID NO: 2265110 - RNA, 20 nt, Human
guuaaauagaguauaugcac

SEQ ID NO: 2265111 - RNA, 22 nt, Human
guuaaauaaauuguauauucac

SEQ ID NO: 2265112 - RNA, 20 nt, Human
guuaaauaaauuguauauuc

SEQ ID NO: 2265113 - RNA, 21 nt, Human
guuaaauaaauuguauauuca

SEQ ID NO: 2265114 - RNA, 20 nt, Human
guuaaagucagugggaacgu

SEQ ID NO: 2265115 - RNA, 13 nt, Human
guuaaaggaaaaa

SEQ ID NO: 2265116 - RNA, 23 nt, Human
guuaaaggcucgauuuuguaucu

SEQ ID NO: 2265117 - RNA, 13 nt, Human
guuaaauaaauug

SEQ ID NO: 2265118 - RNA, 17 nt, Human
guuaaauaaauuguaua

SEQ ID NO: 2265119 - RNA, 18 nt, Human
guuaaauaaauuguauau

SEQ ID NO: 2265120 - RNA, 19 nt, Human
guuaaauaaauuguauauu

SEQ ID NO: 2265121 - RNA, 12 nt, Human
guuaaaacuguc

SEQ ID NO: 2265122 - RNA, 14 nt, Human
guuaaaagagguuu

SEQ ID NO: 2265123 - RNA, 20 nt, Human
guuaaaaaaaggcauuguuu

SEQ ID NO: 2265124 - RNA, 16 nt, Human
guuaaaagaugaaaau

SEQ ID NO: 2265125 - RNA, 14 nt, Human
guuaaaagaugaaa

SEQ ID NO: 2265126 - RNA, 21 nt, Human
guuaaaauaacuaguguugcu

SEQ ID NO: 2265127 - RNA, 21 nt, Human
guuaaaagagguuuuucuuaa

SEQ ID NO: 2265128 - RNA, 20 nt, Human
guuaaaagagguuuuucuua

SEQ ID NO: 2265129 - RNA, 14 nt, Human
guuaaacauugaag

SEQ ID NO: 2265130 - RNA, 22 nt, Human
guuaaaauaccagccaguaaau

SEQ ID NO: 2265131 - RNA, 20 nt, Human
guuaaaagaugaaaauauuu

SEQ ID NO: 2265132 - RNA, 13 nt, Human
gugugcucuucuu

SEQ ID NO: 2265133 - RNA, 17 nt, Human
gugugcucuucuucuuu

SEQ ID NO: 2265134 - RNA, 14 nt, Human
gugugcuggaggac

SEQ ID NO: 2265135 - RNA, 11 nt, Human
gugugcuggga

SEQ ID NO: 2265136 - RNA, 19 nt, Human
guguggaaauuaagaagaa

SEQ ID NO: 2265137 - RNA, 22 nt, Human
gugugcuuuaugcugaaacaga

SEQ ID NO: 2265138 - RNA, 18 nt, Human
gugugcuuuaugcugaaa

SEQ ID NO: 2265139 - RNA, 12 nt, Human
gugugcugggag

SEQ ID NO: 2265140 - RNA, 19 nt, Human
gugugcugggagcuccacu

SEQ ID NO: 2265141 - RNA, 15 nt, Human
gugugcucugaucau

SEQ ID NO: 2265142 - RNA, 22 nt, Human
gugugcucugaucauccacugu

SEQ ID NO: 2265143 - RNA, 12 nt, Human
gugugcucugau

SEQ ID NO: 2265144 - RNA, 16 nt, Human
gugugcguguuugcac

SEQ ID NO: 2265145 - RNA, 18 nt, Human
gugugcucaggagcccug

SEQ ID NO: 2265146 - RNA, 19 nt, Human
gugugcucaggagcccugg

SEQ ID NO: 2265147 - RNA, 18 nt, Human
gugugccugcagccccgc

SEQ ID NO: 2265148 - RNA, 13 nt, Human
gugugccugucug

SEQ ID NO: 2265149 - RNA, 22 nt, Human
gugugccugucuguuacacugg

SEQ ID NO: 2265150 - RNA, 16 nt, Human
gugugcucaggagccc

SEQ ID NO: 2265151 - RNA, 17 nt, Human
gugugcucaggagcccu

SEQ ID NO: 2265152 - RNA, 16 nt, Human
gugugccugcagcccc

SEQ ID NO: 2265153 - RNA, 15 nt, Human
gugugccugcagccc

SEQ ID NO: 2265154 - RNA, 14 nt, Human
gugugccugcagcc

SEQ ID NO: 2265155 - RNA, 13 nt, Human
gugugccugcagc

SEQ ID NO: 2265156 - RNA, 16 nt, Human
gugugccccccauccu

SEQ ID NO: 2265157 - RNA, 17 nt, Human
gugugccccccauccug

SEQ ID NO: 2265158 - RNA, 18 nt, Human
gugugccccccauccugg

SEQ ID NO: 2265159 - RNA, 19 nt, Human
gugugccccccauccuggc

SEQ ID NO: 2265160 - RNA, 20 nt, Human
gugugccccccauccuggcc

SEQ ID NO: 2265161 - RNA, 21 nt, Human
gugugccccccauccuggccc

SEQ ID NO: 2265162 - RNA, 22 nt, Human
gugugccccccauccuggccca

SEQ ID NO: 2265163 - RNA, 23 nt, Human
gugugccccccauccuggcccau

SEQ ID NO: 2265164 - RNA, 15 nt, Human
guguggcugaggagg

SEQ ID NO: 2265165 - RNA, 20 nt, Human
guguggcugaggaggccucc

SEQ ID NO: 2265166 - RNA, 16 nt, Human
gugugggaagggagag

SEQ ID NO: 2265167 - RNA, 13 nt, Human
gugugggaaggga

SEQ ID NO: 2265168 - RNA, 14 nt, Human
gugugggcuguguc

SEQ ID NO: 2265169 - RNA, 17 nt, Human
gugugggaguguguaau

SEQ ID NO: 2265170 - RNA, 19 nt, Human
guguggcucacguguguga

SEQ ID NO: 2265171 - RNA, 14 nt, Human
guguggcccugcca

SEQ ID NO: 2265172 - RNA, 15 nt, Human
guguggccccuucac

SEQ ID NO: 2265173 - RNA, 12 nt, Human
guguggcagugg

SEQ ID NO: 2265174 - RNA, 15 nt, Human
guguggcuccccucu

SEQ ID NO: 2265175 - RNA, 13 nt, Human
guguggcugagga

SEQ ID NO: 2265176 - RNA, 14 nt, Human
guguggcuccuucc

SEQ ID NO: 2265177 - RNA, 14 nt, Human
guguggcagugguu

SEQ ID NO: 2265178 - RNA, 13 nt, Human
guguggagaagcg

SEQ ID NO: 2265179 - RNA, 15 nt, Human
guguggacugugaug

SEQ ID NO: 2265180 - RNA, 18 nt, Human
guguggacucaaguccuu

SEQ ID NO: 2265181 - RNA, 20 nt, Human
guguggaaauuaagaagaaa

SEQ ID NO: 2265182 - RNA, 16 nt, Human
guguggacugugaugc

SEQ ID NO: 2265183 - RNA, 22 nt, Human
guguggagaagccacaggccug

SEQ ID NO: 2265184 - RNA, 23 nt, Human
guguggagaagccacaggccuga

SEQ ID NO: 2265185 - RNA, 21 nt, Human
guguggagaagcggcuggcag

SEQ ID NO: 2265186 - RNA, 14 nt, Human
guguguuugugauu

SEQ ID NO: 2265187 - RNA, 22 nt, Human
guguguuuaaauaaaguaucau

SEQ ID NO: 2265188 - RNA, 14 nt, Human
guguguuucacuuu

SEQ ID NO: 2265189 - RNA, 16 nt, Human
guguguuuaugugugu

SEQ ID NO: 2265190 - RNA, 12 nt, Human
guguguuuuaaa

SEQ ID NO: 2265191 - RNA, 15 nt, Human
guguguuucugaucu

SEQ ID NO: 2265192 - RNA, 15 nt, Human
guguguuuaugugug

SEQ ID NO: 2265193 - RNA, 14 nt, Human
guguguuuaugugu

SEQ ID NO: 2265194 - RNA, 15 nt, Human
guguguugccacagg

SEQ ID NO: 2265195 - RNA, 14 nt, Human
guguguugucucuu

SEQ ID NO: 2265196 - RNA, 16 nt, Human
guguguugucucuuga

SEQ ID NO: 2265197 - RNA, 13 nt, Human
guguguugucuug

SEQ ID NO: 2265198 - RNA, 16 nt, Human
guguguugucuugaaa

SEQ ID NO: 2265199 - RNA, 18 nt, Human
guguguugucuugaaaga

SEQ ID NO: 2265200 - RNA, 17 nt, Human
guguguuguguguggga

SEQ ID NO: 2265201 - RNA, 15 nt, Human
guguguuuaaauaaa

SEQ ID NO: 2265202 - RNA, 16 nt, Human
guguguuuaaauaaag

SEQ ID NO: 2265203 - RNA, 18 nt, Human
guguguuuaaauaaagua

SEQ ID NO: 2265204 - RNA, 19 nt, Human
guguguuuaaauaaaguau

SEQ ID NO: 2265205 - RNA, 14 nt, Human
guguguugugugug

SEQ ID NO: 2265206 - RNA, 12 nt, Human
guguguugugug

SEQ ID NO: 2265207 - RNA, 14 nt, Human
gugucugcacccag

SEQ ID NO: 2265208 - RNA, 22 nt, Human
gugucugagcccucaaagugag

SEQ ID NO: 2265209 - RNA, 19 nt, Human
gugucucuuuucucuuucu

SEQ ID NO: 2265210 - RNA, 18 nt, Human
gugucucuuuucucuuuc

SEQ ID NO: 2265211 - RNA, 21 nt, Human
gugucucggagggauuccccu

SEQ ID NO: 2265212 - RNA, 22 nt, Human
gugucucuugguccugcugcag

SEQ ID NO: 2265213 - RNA, 15 nt, Human
gugucugcucaguaa

SEQ ID NO: 2265214 - RNA, 22 nt, Human
gugucucuuuucucuuucuccu

SEQ ID NO: 2265215 - RNA, 21 nt, Human
gugucugcacccagggguggg

SEQ ID NO: 2265216 - RNA, 14 nt, Human
gugucuggcugcag

SEQ ID NO: 2265217 - RNA, 18 nt, Human
gugucucuugguccugcu

SEQ ID NO: 2265218 - RNA, 19 nt, Human
gugucucuugguccugcug

SEQ ID NO: 2265219 - RNA, 20 nt, Human
gugucucuugguccugcugc

SEQ ID NO: 2265220 - RNA, 21 nt, Human
gugucucuugguccugcugca

SEQ ID NO: 2265221 - RNA, 22 nt, Human
gugugcacacacaccacacaua

SEQ ID NO: 2265222 - RNA, 20 nt, Human
gugugcacaaauauuuauuu

SEQ ID NO: 2265223 - RNA, 17 nt, Human
gugugcacuaaggggcc

SEQ ID NO: 2265224 - RNA, 16 nt, Human
gugugcaccaggguug

SEQ ID NO: 2265225 - RNA, 14 nt, Human
gugugauuuuucug

SEQ ID NO: 2265226 - RNA, 16 nt, Human
gugugcaaguauguga

SEQ ID NO: 2265227 - RNA, 16 nt, Human
gugugcaagugugugc

SEQ ID NO: 2265228 - RNA, 19 nt, Human
gugugcaaugucugaguga

SEQ ID NO: 2265229 - RNA, 20 nt, Human
gugugcaugugugugcucag

SEQ ID NO: 2265230 - RNA, 18 nt, Human
gugugcaugugugugcuc

SEQ ID NO: 2265231 - RNA, 16 nt, Human
gugugcauugcuguga

SEQ ID NO: 2265232 - RNA, 21 nt, Human
gugugccauagaguuuaacac

SEQ ID NO: 2265233 - RNA, 12 nt, Human
gugugcaugugu

SEQ ID NO: 2265234 - RNA, 21 nt, Human
gugugcauauuguacacuuuu

SEQ ID NO: 2265235 - RNA, 22 nt, Human
gugugcauauuguacacuuuuu

SEQ ID NO: 2265236 - RNA, 23 nt, Human
gugugcacuaaggggcccggcca

SEQ ID NO: 2265237 - RNA, 22 nt, Human
gugugcaccuuaccaacuuucu

SEQ ID NO: 2265238 - RNA, 13 nt, Human
gugugcagugaag

SEQ ID NO: 2265239 - RNA, 14 nt, Human
gugugcauauugua

SEQ ID NO: 2265240 - RNA, 15 nt, Human
gugugcauauuguac

SEQ ID NO: 2265241 - RNA, 16 nt, Human
gugugcauauuguaca

SEQ ID NO: 2265242 - RNA, 18 nt, Human
gugugcauauuguacacu

SEQ ID NO: 2265243 - RNA, 19 nt, Human
gugugaucccaagugccag

SEQ ID NO: 2265244 - RNA, 17 nt, Human
gugugaucccaagugcc

SEQ ID NO: 2265245 - RNA, 14 nt, Human
gugugaucgucuga

SEQ ID NO: 2265246 - RNA, 17 nt, Human
gugugaugaacuuucuc

SEQ ID NO: 2265247 - RNA, 22 nt, Human
gugugaugaacuuucucuucau

SEQ ID NO: 2265248 - RNA, 16 nt, Human
gugugauugaaucuga

SEQ ID NO: 2265249 - RNA, 23 nt, Human
gugugauugacagcuuugcugcu

SEQ ID NO: 2265250 - RNA, 21 nt, Human
gugugauugggaauaaauaug

SEQ ID NO: 2265251 - RNA, 21 nt, Human
gugugauugacagcuuugcug

SEQ ID NO: 2265252 - RNA, 16 nt, Human
gugugauugacagcuu

SEQ ID NO: 2265253 - RNA, 20 nt, Human
gugugagucaccaagcccag

SEQ ID NO: 2265254 - RNA, 11 nt, Human
gugugagugug

SEQ ID NO: 2265255 - RNA, 17 nt, Human
gugucuggauucccagg

SEQ ID NO: 2265256 - RNA, 21 nt, Human
gugucuggauucccaggauga

SEQ ID NO: 2265257 - RNA, 14 nt, Human
gugugagugugugc

SEQ ID NO: 2265258 - RNA, 23 nt, Human
gugucgcucugcuggccuggccg

SEQ ID NO: 2265259 - RNA, 15 nt, Human
gugucguagccaagg

SEQ ID NO: 2265260 - RNA, 16 nt, Human
guguccuuucccucca

SEQ ID NO: 2265261 - RNA, 20 nt, Human
guguccuugugcaugagcua

SEQ ID NO: 2265262 - RNA, 19 nt, Human
guguccuugcaccugcauc

SEQ ID NO: 2265263 - RNA, 14 nt, Human
guguccuugugcau

SEQ ID NO: 2265264 - RNA, 17 nt, Human
gugucuaaaaacaccaa

SEQ ID NO: 2265265 - RNA, 14 nt, Human
gugucuaaaaacac

SEQ ID NO: 2265266 - RNA, 17 nt, Human
guguccuuucccuccac

SEQ ID NO: 2265267 - RNA, 13 nt, Human
gugucuaaacugc

SEQ ID NO: 2265268 - RNA, 19 nt, Human
gugucuaggcaggaccugu

SEQ ID NO: 2265269 - RNA, 14 nt, Human
gugucuacagagaa

SEQ ID NO: 2265270 - RNA, 21 nt, Human
gugucuccaaccccccagcac

SEQ ID NO: 2265271 - RNA, 18 nt, Human
gugucuccaaccccccag

SEQ ID NO: 2265272 - RNA, 19 nt, Human
gugucuccaaccccccagc

SEQ ID NO: 2265273 - RNA, 14 nt, Human
gugucucuuggucc

SEQ ID NO: 2265274 - RNA, 22 nt, Human
gugucucaguccaccugagcug

SEQ ID NO: 2265275 - RNA, 13 nt, Human
gugucuccaaccc

SEQ ID NO: 2265276 - RNA, 17 nt, Human
gugucuccaacccccca

SEQ ID NO: 2265277 - RNA, 17 nt, Human
gugucucccuucauccu

SEQ ID NO: 2265278 - RNA, 14 nt, Human
guguccggucccug

SEQ ID NO: 2265279 - RNA, 23 nt, Human
gugucccugcacuugcagacucu

SEQ ID NO: 2265280 - RNA, 14 nt, Human
guguccuaggagua

SEQ ID NO: 2265281 - RNA, 20 nt, Human
guguccccuccacugucaca

SEQ ID NO: 2265282 - RNA, 15 nt, Human
guguccucacggugc

SEQ ID NO: 2265283 - RNA, 13 nt, Human
guguccugaccac

SEQ ID NO: 2265284 - RNA, 16 nt, Human
guguccugaccacccu

SEQ ID NO: 2265285 - RNA, 17 nt, Human
guguccugaccacccuc

SEQ ID NO: 2265286 - RNA, 18 nt, Human
guguccugaccacccucc

SEQ ID NO: 2265287 - RNA, 20 nt, Human
guguccugaccacccucccc

SEQ ID NO: 2265288 - RNA, 13 nt, Human
guguccuggugcu

SEQ ID NO: 2265289 - RNA, 16 nt, Human
guguccuggugcucuc

SEQ ID NO: 2265290 - RNA, 18 nt, Human
guguccuugcaccugcau

SEQ ID NO: 2265291 - RNA, 17 nt, Human
guguccuugcaccugca

SEQ ID NO: 2265292 - RNA, 12 nt, Human
guguccuucccu

SEQ ID NO: 2265293 - RNA, 15 nt, Human
guguccuucccugca

SEQ ID NO: 2265294 - RNA, 16 nt, Human
guguccuuagaacauu

SEQ ID NO: 2265295 - RNA, 23 nt, Human
guguccuggugcucucugccacu

SEQ ID NO: 2265296 - RNA, 21 nt, Human
guguccuguaguugcguggac

SEQ ID NO: 2265297 - RNA, 15 nt, Human
gugucgggcaugaca

SEQ ID NO: 2265298 - RNA, 19 nt, Human
gugaauuucuucacuguug

SEQ ID NO: 2265299 - RNA, 13 nt, Human
gugaauuugaaug

SEQ ID NO: 2265300 - RNA, 19 nt, Human
gugaauugugaccaaguua

SEQ ID NO: 2265301 - RNA, 23 nt, Human
gugaauugccugcagagagaagc

SEQ ID NO: 2265302 - RNA, 20 nt, Human
gugaauugccugcagagaga

SEQ ID NO: 2265303 - RNA, 22 nt, Human
gugaauugccugcagagagaag

SEQ ID NO: 2265304 - RNA, 22 nt, Human
gugaauucuugaaggaaaauga

SEQ ID NO: 2265305 - RNA, 18 nt, Human
gugaauuugaaugaaaaa

SEQ ID NO: 2265306 - RNA, 16 nt, Human
gugaauuugaaugaaa

SEQ ID NO: 2265307 - RNA, 14 nt, Human
gugaauuugaauga

SEQ ID NO: 2265308 - RNA, 20 nt, Human
gugacaaggauugcuacugu

SEQ ID NO: 2265309 - RNA, 15 nt, Human
gugaauggauuggau

SEQ ID NO: 2265310 - RNA, 20 nt, Human
gugaauggauuggauuauuu

SEQ ID NO: 2265311 - RNA, 14 nt, Human
gugaauggauugga

SEQ ID NO: 2265312 - RNA, 21 nt, Human
gugaaugcugggacucagccu

SEQ ID NO: 2265313 - RNA, 18 nt, Human
gugaauucuugaaggaaa

SEQ ID NO: 2265314 - RNA, 21 nt, Human
gugaaugaugauccuaggcau

SEQ ID NO: 2265315 - RNA, 13 nt, Human
gugaaugcuggga

SEQ ID NO: 2265316 - RNA, 15 nt, Human
gugaaugcugggacu

SEQ ID NO: 2265317 - RNA, 20 nt, Human
gugaaugcugggacucagcc

SEQ ID NO: 2265318 - RNA, 18 nt, Human
gugaacaaagcagccacg

SEQ ID NO: 2265319 - RNA, 18 nt, Human
gugaacaaaagaugcucu

SEQ ID NO: 2265320 - RNA, 17 nt, Human
gugaacaaagcagccac

SEQ ID NO: 2265321 - RNA, 21 nt, Human
gugaacaaauuuacagagaca

SEQ ID NO: 2265322 - RNA, 19 nt, Human
gugaacaaaagaugcucuu

SEQ ID NO: 2265323 - RNA, 15 nt, Human
gugaaucuaaaagcu

SEQ ID NO: 2265324 - RNA, 13 nt, Human
gugaaugaacacu

SEQ ID NO: 2265325 - RNA, 13 nt, Human
gugaacacaucag

SEQ ID NO: 2265326 - RNA, 15 nt, Human
gucuuguacaugugu

SEQ ID NO: 2265327 - RNA, 13 nt, Human
gucuuuuuuugua

SEQ ID NO: 2265328 - RNA, 17 nt, Human
gucuuuuuuuguauuau

SEQ ID NO: 2265329 - RNA, 21 nt, Human
gucuuuuuuuguauuauaaaa

SEQ ID NO: 2265330 - RNA, 16 nt, Human
gucuuuuuuuuaaugu

SEQ ID NO: 2265331 - RNA, 17 nt, Human
gucuuuuuuuuaaugug

SEQ ID NO: 2265332 - RNA, 18 nt, Human
gucuuuuuuuuaaugugc

SEQ ID NO: 2265333 - RNA, 19 nt, Human
gucuuuuuuuuaaugugcu

SEQ ID NO: 2265334 - RNA, 22 nt, Human
gucuuuuuuuuaaugugcugug

SEQ ID NO: 2265335 - RNA, 15 nt, Human
gugaaaaaaaaaaug

SEQ ID NO: 2265336 - RNA, 14 nt, Human
gugaaaaaaaaaau

SEQ ID NO: 2265337 - RNA, 15 nt, Human
gugaaaacaagugcu

SEQ ID NO: 2265338 - RNA, 18 nt, Human
gugaaaaaaaaaaugcug

SEQ ID NO: 2265339 - RNA, 19 nt, Human
gugaaaacaagugcuggca

SEQ ID NO: 2265340 - RNA, 22 nt, Human
gugacagacuccugaggacagc

SEQ ID NO: 2265341 - RNA, 15 nt, Human
gugaccuucugggaa

SEQ ID NO: 2265342 - RNA, 17 nt, Human
gugacgccugcccuccc

SEQ ID NO: 2265343 - RNA, 15 nt, Human
gugacgcugaauaaa

SEQ ID NO: 2265344 - RNA, 17 nt, Human
gugacgcugaauaaaug

SEQ ID NO: 2265345 - RNA, 18 nt, Human
gugacgcugaauaaaugu

SEQ ID NO: 2265346 - RNA, 19 nt, Human
gugacggucccacacuggu

SEQ ID NO: 2265347 - RNA, 22 nt, Human
gugacggucccacacuggugac

SEQ ID NO: 2265348 - RNA, 19 nt, Human
gugacgcugaauaaauguc

SEQ ID NO: 2265349 - RNA, 13 nt, Human
gugacggucccac

SEQ ID NO: 2265350 - RNA, 15 nt, Human
gugacggucccacac

SEQ ID NO: 2265351 - RNA, 15 nt, Human
gugaccucugccuga

SEQ ID NO: 2265352 - RNA, 22 nt, Human
gugaccuuccaagagccugaga

SEQ ID NO: 2265353 - RNA, 21 nt, Human
gugaccuuccaagagccugag

SEQ ID NO: 2265354 - RNA, 12 nt, Human
gugaccucugcc

SEQ ID NO: 2265355 - RNA, 15 nt, Human
gugacagaggcagcc

SEQ ID NO: 2265356 - RNA, 13 nt, Human
gugaccucugccu

SEQ ID NO: 2265357 - RNA, 14 nt, Human
gugaccucugccug

SEQ ID NO: 2265358 - RNA, 17 nt, Human
gugacaaggccccagag

SEQ ID NO: 2265359 - RNA, 14 nt, Human
gugacaaggcccca

SEQ ID NO: 2265360 - RNA, 13 nt, Human
gugacaaggcccc

SEQ ID NO: 2265361 - RNA, 23 nt, Human
gugacaagcuccuggucuugaga

SEQ ID NO: 2265362 - RNA, 19 nt, Human
gugacaaggccccagagac

SEQ ID NO: 2265363 - RNA, 18 nt, Human
gugacaaggccccagaga

SEQ ID NO: 2265364 - RNA, 12 nt, Human
gugacaauaaaa

SEQ ID NO: 2265365 - RNA, 16 nt, Human
gugacaauuuuguaca

SEQ ID NO: 2265366 - RNA, 14 nt, Human
gugacaauaaaaca

SEQ ID NO: 2265367 - RNA, 21 nt, Human
gugacacuucagagagcuggu

SEQ ID NO: 2265368 - RNA, 20 nt, Human
gugacacuucagagagcugg

SEQ ID NO: 2265369 - RNA, 18 nt, Human
gugacacuucagagagcu

SEQ ID NO: 2265370 - RNA, 22 nt, Human
gugacacagcagcuucaccaga

SEQ ID NO: 2265371 - RNA, 15 nt, Human
gugacagacaggcuc

SEQ ID NO: 2265372 - RNA, 16 nt, Human
gugacagacaggcucu

SEQ ID NO: 2265373 - RNA, 23 nt, Human
gugacaccagccuuucucccagg

SEQ ID NO: 2265374 - RNA, 12 nt, Human
gugacacagcag

SEQ ID NO: 2265375 - RNA, 19 nt, Human
gugacacagcagcuucacc

SEQ ID NO: 2265376 - RNA, 22 nt, Human
gugacacuucagagagcuggua

SEQ ID NO: 2265377 - RNA, 23 nt, Human
gugacagaccacaucuuuaucug

SEQ ID NO: 2265378 - RNA, 17 nt, Human
gugacagacaggcucuu

SEQ ID NO: 2265379 - RNA, 15 nt, Human
gugacagacuccuga

SEQ ID NO: 2265380 - RNA, 16 nt, Human
gugacagacuccugag

SEQ ID NO: 2265381 - RNA, 19 nt, Human
gugacagacuccugaggac

SEQ ID NO: 2265382 - RNA, 20 nt, Human
gugacagacuccugaggaca

SEQ ID NO: 2265383 - RNA, 12 nt, Human
gugacagaggca

SEQ ID NO: 2265384 - RNA, 13 nt, Human
gugacagaggcag

SEQ ID NO: 2265385 - RNA, 14 nt, Human
gugacagaggcagc

SEQ ID NO: 2265386 - RNA, 13 nt, Human
gugaucaaagcca

SEQ ID NO: 2265387 - RNA, 17 nt, Human
gugaucaauuaaaugua

SEQ ID NO: 2265388 - RNA, 18 nt, Human
gugaucaauaaaauguga

SEQ ID NO: 2265389 - RNA, 19 nt, Human
gugaucaauaaaaugugau

SEQ ID NO: 2265390 - RNA, 17 nt, Human
gugaucaauaaaaugug

SEQ ID NO: 2265391 - RNA, 16 nt, Human
gugaucaauaaaaugu

SEQ ID NO: 2265392 - RNA, 22 nt, Human
gugauccacccaccucagccuc

SEQ ID NO: 2265393 - RNA, 17 nt, Human
gugaucacagcagcuuc

SEQ ID NO: 2265394 - RNA, 20 nt, Human
gugaucagaccauaauguua

SEQ ID NO: 2265395 - RNA, 20 nt, Human
gugauacccauagcuuccau

SEQ ID NO: 2265396 - RNA, 13 nt, Human
gugauagcacuuu

SEQ ID NO: 2265397 - RNA, 14 nt, Human
gugauagcacuuuc

SEQ ID NO: 2265398 - RNA, 18 nt, Human
gugauagcuaacauuuua

SEQ ID NO: 2265399 - RNA, 22 nt, Human
gugauagucuuuugcuuuuggc

SEQ ID NO: 2265400 - RNA, 19 nt, Human
gugauauaaguguguguuu

SEQ ID NO: 2265401 - RNA, 13 nt, Human
gugauauggagcc

SEQ ID NO: 2265402 - RNA, 16 nt, Human
gugauauggcagaaga

SEQ ID NO: 2265403 - RNA, 19 nt, Human
gugauauggcagaagacac

SEQ ID NO: 2265404 - RNA, 13 nt, Human
gugauauauuuaa

SEQ ID NO: 2265405 - RNA, 21 nt, Human
gugauauauaaguguacauau

SEQ ID NO: 2265406 - RNA, 23 nt, Human
gugauauauaaguguacauaugu

SEQ ID NO: 2265407 - RNA, 15 nt, Human
gugagugugugcaag

SEQ ID NO: 2265408 - RNA, 14 nt, Human
gugaguucucaggg

SEQ ID NO: 2265409 - RNA, 15 nt, Human
gugaguucucagggc

SEQ ID NO: 2265410 - RNA, 17 nt, Human
gugaguucucagggcuc

SEQ ID NO: 2265411 - RNA, 18 nt, Human
gugaguucucagggcucc

SEQ ID NO: 2265412 - RNA, 20 nt, Human
gugaguucucagggcuccug

SEQ ID NO: 2265413 - RNA, 13 nt, Human
gugagugugugca

SEQ ID NO: 2265414 - RNA, 23 nt, Human
gugaguguguccaagugugugug

SEQ ID NO: 2265415 - RNA, 22 nt, Human
gugaguguguccaagugugugu

SEQ ID NO: 2265416 - RNA, 16 nt, Human
gugaguguggcucccc

SEQ ID NO: 2265417 - RNA, 17 nt, Human
gugaguuacagcgagag

SEQ ID NO: 2265418 - RNA, 17 nt, Human
gugaguugauagcacag

SEQ ID NO: 2265419 - RNA, 20 nt, Human
gugaguuuaguaaggcugug

SEQ ID NO: 2265420 - RNA, 15 nt, Human
gugaguuugagcugc

SEQ ID NO: 2265421 - RNA, 17 nt, Human
gugaguuugagcugccu

SEQ ID NO: 2265422 - RNA, 21 nt, Human
gugaguuugagcugccuuccc

SEQ ID NO: 2265423 - RNA, 20 nt, Human
gugauacaacuucaagugca

SEQ ID NO: 2265424 - RNA, 14 nt, Human
gugauaaacuuugc

SEQ ID NO: 2265425 - RNA, 13 nt, Human
gugauaaacuuug

SEQ ID NO: 2265426 - RNA, 17 nt, Human
gugauacaaugcugugc

SEQ ID NO: 2265427 - RNA, 18 nt, Human
gugaguuugagcugccuu

SEQ ID NO: 2265428 - RNA, 15 nt, Human
gugauacaaugcugu

SEQ ID NO: 2265429 - RNA, 19 nt, Human
gugaggaugggaaggaggg

SEQ ID NO: 2265430 - RNA, 17 nt, Human
gugaggaugggaaggag

SEQ ID NO: 2265431 - RNA, 21 nt, Human
gugaggauggccucugcuaag

SEQ ID NO: 2265432 - RNA, 16 nt, Human
gugagcggagaucgca

SEQ ID NO: 2265433 - RNA, 22 nt, Human
gugaggaugucacucagaugga

SEQ ID NO: 2265434 - RNA, 18 nt, Human
gugaggaugucacucaga

SEQ ID NO: 2265435 - RNA, 15 nt, Human
gugaggaugucuggg

SEQ ID NO: 2265436 - RNA, 16 nt, Human
gugaguguaaguguga

SEQ ID NO: 2265437 - RNA, 15 nt, Human
gugaguguggcuccc

SEQ ID NO: 2265438 - RNA, 18 nt, Human
gugaggagcuugaaaccc

SEQ ID NO: 2265439 - RNA, 17 nt, Human
gugaggaugaaaaaaua

SEQ ID NO: 2265440 - RNA, 15 nt, Human
gugaggagcugcugg

SEQ ID NO: 2265441 - RNA, 17 nt, Human
gugaggagcugcuggcu

SEQ ID NO: 2265442 - RNA, 14 nt, Human
gugagccuuggcug

SEQ ID NO: 2265443 - RNA, 18 nt, Human
gugaggagcugcuggcuu

SEQ ID NO: 2265444 - RNA, 13 nt, Human
gugaggagcuggg

SEQ ID NO: 2265445 - RNA, 21 nt, Human
gugagccgcaucuucuccauc

SEQ ID NO: 2265446 - RNA, 18 nt, Human
gugagccgcaucuucucc

SEQ ID NO: 2265447 - RNA, 12 nt, Human
gugagccgcauc

SEQ ID NO: 2265448 - RNA, 17 nt, Human
gugagccccugguccug

SEQ ID NO: 2265449 - RNA, 13 nt, Human
gugagccuggcuc

SEQ ID NO: 2265450 - RNA, 14 nt, Human
gugagccuggcucu

SEQ ID NO: 2265451 - RNA, 16 nt, Human
gugagccuggcucuug

SEQ ID NO: 2265452 - RNA, 23 nt, Human
gugagccuggcucuugugcugga

SEQ ID NO: 2265453 - RNA, 19 nt, Human
gugagccgagaucacgcca

SEQ ID NO: 2265454 - RNA, 14 nt, Human
gugagccacugcac

SEQ ID NO: 2265455 - RNA, 15 nt, Human
gugacucacccaagc

SEQ ID NO: 2265456 - RNA, 20 nt, Human
gugagccagguaaugaggga

SEQ ID NO: 2265457 - RNA, 15 nt, Human
gugagcccagcuggg

SEQ ID NO: 2265458 - RNA, 20 nt, Human
gugagcccagcugggucagg

SEQ ID NO: 2265459 - RNA, 18 nt, Human
gugagcccagcuggguca

SEQ ID NO: 2265460 - RNA, 18 nt, Human
gugagcccauggcccucc

SEQ ID NO: 2265461 - RNA, 17 nt, Human
gugagcccauggcccuc

SEQ ID NO: 2265462 - RNA, 14 nt, Human
gugagccccugguc

SEQ ID NO: 2265463 - RNA, 15 nt, Human
gugagccacugcacc

SEQ ID NO: 2265464 - RNA, 20 nt, Human
gugagccacugcaccgggcc

SEQ ID NO: 2265465 - RNA, 15 nt, Human
gugacuauauagaga

SEQ ID NO: 2265466 - RNA, 17 nt, Human
gugacuauauagagaug

SEQ ID NO: 2265467 - RNA, 20 nt, Human
gugacuauauagagauguuu

SEQ ID NO: 2265468 - RNA, 14 nt, Human
gugacuaugaacuu

SEQ ID NO: 2265469 - RNA, 21 nt, Human
gugacuauggagcugagcagg

SEQ ID NO: 2265470 - RNA, 22 nt, Human
gugacuaauuguauaacagguu

SEQ ID NO: 2265471 - RNA, 23 nt, Human
gugacuaauuguauaacagguua

SEQ ID NO: 2265472 - RNA, 18 nt, Human
gugacuaauuguauaaca

SEQ ID NO: 2265473 - RNA, 19 nt, Human
gugacuaauuguauaacag

SEQ ID NO: 2265474 - RNA, 20 nt, Human
gugacuaauuguauaacagg

SEQ ID NO: 2265475 - RNA, 21 nt, Human
gugacuaauuguauaacaggu

SEQ ID NO: 2265476 - RNA, 15 nt, Human
gugacuaauuguaua

SEQ ID NO: 2265477 - RNA, 17 nt, Human
gugacuaauuguauaac

SEQ ID NO: 2265478 - RNA, 13 nt, Human
gugcccccuccuc

SEQ ID NO: 2265479 - RNA, 14 nt, Human
gugcccccuccucu

SEQ ID NO: 2265480 - RNA, 17 nt, Human
gugcccccuccucuccc

SEQ ID NO: 2265481 - RNA, 18 nt, Human
gugcccccuccucuccca

SEQ ID NO: 2265482 - RNA, 20 nt, Human
gugcccccuccucucccauc

SEQ ID NO: 2265483 - RNA, 14 nt, Human
gugcccccucuacc

SEQ ID NO: 2265484 - RNA, 17 nt, Human
gugcccccucuaccauu

SEQ ID NO: 2265485 - RNA, 19 nt, Human
gugccccugcugccucccc

SEQ ID NO: 2265486 - RNA, 13 nt, Human
gugccccugcugc

SEQ ID NO: 2265487 - RNA, 16 nt, Human
gugccccgccuccccg

SEQ ID NO: 2265488 - RNA, 17 nt, Human
gugccccgccuccccga

SEQ ID NO: 2265489 - RNA, 13 nt, Human
gugccccuagcuu

SEQ ID NO: 2265490 - RNA, 20 nt, Human
gugccccccuugccagacau

SEQ ID NO: 2265491 - RNA, 13 nt, Human
gugccccccuugc

SEQ ID NO: 2265492 - RNA, 20 nt, Human
gugcccaagaauagaugcug

SEQ ID NO: 2265493 - RNA, 17 nt, Human
gugccaggcccggggcu

SEQ ID NO: 2265494 - RNA, 13 nt, Human
gugccaggcccgg

SEQ ID NO: 2265495 - RNA, 12 nt, Human
gugccaggcccg

SEQ ID NO: 2265496 - RNA, 23 nt, Human
gugccaggacuccccaggccagg

SEQ ID NO: 2265497 - RNA, 21 nt, Human
gugccaggauggaaugauggg

SEQ ID NO: 2265498 - RNA, 20 nt, Human
gugccaggcccggggcuggc

SEQ ID NO: 2265499 - RNA, 19 nt, Human
gugccaggcccggggcugg

SEQ ID NO: 2265500 - RNA, 16 nt, Human
gugccagggcagcacu

SEQ ID NO: 2265501 - RNA, 16 nt, Human
gugccagguccuugcc

SEQ ID NO: 2265502 - RNA, 20 nt, Human
gugccagguuuucugggugu

SEQ ID NO: 2265503 - RNA, 14 nt, Human
gugccaugugccag

SEQ ID NO: 2265504 - RNA, 16 nt, Human
gugccaugugccaggu

SEQ ID NO: 2265505 - RNA, 23 nt, Human
gugccuucuuauucucacuccac

SEQ ID NO: 2265506 - RNA, 19 nt, Human
gugccuucuuauucucacu

SEQ ID NO: 2265507 - RNA, 23 nt, Human
gugccuuccuguuuuucacauuu

SEQ ID NO: 2265508 - RNA, 22 nt, Human
gugccuuccaugucggccucua

SEQ ID NO: 2265509 - RNA, 20 nt, Human
gugccuucgcgguggaaggc

SEQ ID NO: 2265510 - RNA, 14 nt, Human
gugccuuuugccau

SEQ ID NO: 2265511 - RNA, 23 nt, Human
gugccuuggagggucccaagcug

SEQ ID NO: 2265512 - RNA, 19 nt, Human
gugccuuggggaauuuccu

SEQ ID NO: 2265513 - RNA, 19 nt, Human
gugccuuuugcaccccucc

SEQ ID NO: 2265514 - RNA, 21 nt, Human
gugcgaucuggguucacugca

SEQ ID NO: 2265515 - RNA, 22 nt, Human
gugccuuuugcaccccucccau

SEQ ID NO: 2265516 - RNA, 21 nt, Human
gugccuuuugcaccccuccca

SEQ ID NO: 2265517 - RNA, 18 nt, Human
gugccuuuuuucacggaa

SEQ ID NO: 2265518 - RNA, 22 nt, Human
gugccuuuuuucacggaaguuu

SEQ ID NO: 2265519 - RNA, 16 nt, Human
gugcgaccccaucugc

SEQ ID NO: 2265520 - RNA, 18 nt, Human
gugcgaccccaucugccc

SEQ ID NO: 2265521 - RNA, 20 nt, Human
gugcgaccccaucugcccag

SEQ ID NO: 2265522 - RNA, 22 nt, Human
gugccuuccauaauuaugacag

SEQ ID NO: 2265523 - RNA, 17 nt, Human
gugccuuccauaauuau

SEQ ID NO: 2265524 - RNA, 20 nt, Human
gugccuuccaugucggccuc

SEQ ID NO: 2265525 - RNA, 21 nt, Human
gugccuuccaugucggccucu

SEQ ID NO: 2265526 - RNA, 15 nt, Human
gugccuuccauaauu

SEQ ID NO: 2265527 - RNA, 12 nt, Human
gugccuuccaac

SEQ ID NO: 2265528 - RNA, 12 nt, Human
gugccuuccaua

SEQ ID NO: 2265529 - RNA, 14 nt, Human
gugccuucauuugg

SEQ ID NO: 2265530 - RNA, 12 nt, Human
gugccuucauuu

SEQ ID NO: 2265531 - RNA, 11 nt, Human
gugccuucauu

SEQ ID NO: 2265532 - RNA, 14 nt, Human
gugcccucgcugcu

SEQ ID NO: 2265533 - RNA, 20 nt, Human
gugcccuccacagccgcagc

SEQ ID NO: 2265534 - RNA, 15 nt, Human
gugccuucagcucua

SEQ ID NO: 2265535 - RNA, 20 nt, Human
gugccccugcugccucccca

SEQ ID NO: 2265536 - RNA, 14 nt, Human
gugcggccuuuggc

SEQ ID NO: 2265537 - RNA, 19 nt, Human
gugcggcagggacacccga

SEQ ID NO: 2265538 - RNA, 15 nt, Human
gugcgugaaacacac

SEQ ID NO: 2265539 - RNA, 14 nt, Human
gugcgugaaacaca

SEQ ID NO: 2265540 - RNA, 14 nt, Human
gugcggcugugcag

SEQ ID NO: 2265541 - RNA, 15 nt, Human
gugcgguggcucacg

SEQ ID NO: 2265542 - RNA, 15 nt, Human
gugcguccacgagcu

SEQ ID NO: 2265543 - RNA, 22 nt, Human
gugcgcugacaaccaccgcucc

SEQ ID NO: 2265544 - RNA, 22 nt, Human
gugcgccgagucugucucuguc

SEQ ID NO: 2265545 - RNA, 23 nt, Human
gugcgagugugugcaugugugug

SEQ ID NO: 2265546 - RNA, 14 nt, Human
gugcgagugugugc

SEQ ID NO: 2265547 - RNA, 15 nt, Human
gugcgauucuggaua

SEQ ID NO: 2265548 - RNA, 14 nt, Human
gugcgccuacagga

SEQ ID NO: 2265549 - RNA, 16 nt, Human
gugcuaaauuuucagu

SEQ ID NO: 2265550 - RNA, 20 nt, Human
gugcuaagugugaacuggac

SEQ ID NO: 2265551 - RNA, 17 nt, Human
gugcuaauaacagugca

SEQ ID NO: 2265552 - RNA, 17 nt, Human
gugcuaagugugaacug

SEQ ID NO: 2265553 - RNA, 18 nt, Human
gugcuaagugugaacugg

SEQ ID NO: 2265554 - RNA, 13 nt, Human
gugcuaaguguga

SEQ ID NO: 2265555 - RNA, 14 nt, Human
gugcuaagugugaa

SEQ ID NO: 2265556 - RNA, 16 nt, Human
gugcuaagugugaacu

SEQ ID NO: 2265557 - RNA, 21 nt, Human
gugcgugaaacacaccaggcu

SEQ ID NO: 2265558 - RNA, 12 nt, Human
gugcgugcucag

SEQ ID NO: 2265559 - RNA, 12 nt, Human
gugcguggguga

SEQ ID NO: 2265560 - RNA, 14 nt, Human
gugcgugggugaag

SEQ ID NO: 2265561 - RNA, 13 nt, Human
gugcgugugugca

SEQ ID NO: 2265562 - RNA, 13 nt, Human
gugcgugugucca

SEQ ID NO: 2265563 - RNA, 14 nt, Human
gugcguguuugcac

SEQ ID NO: 2265564 - RNA, 13 nt, Human
gugcuaaaaaugg

SEQ ID NO: 2265565 - RNA, 13 nt, Human
gugcguguguaga

SEQ ID NO: 2265566 - RNA, 15 nt, Human
gugcguguguagagu

SEQ ID NO: 2265567 - RNA, 17 nt, Human
gugcguguguagaguua

SEQ ID NO: 2265568 - RNA, 23 nt, Human
gugcuaaccacgucugucuucac

SEQ ID NO: 2265569 - RNA, 13 nt, Human
gugcuaaauuuuc

SEQ ID NO: 2265570 - RNA, 22 nt, Human
gugcuaaauggucgcccaggag

SEQ ID NO: 2265571 - RNA, 14 nt, Human
gugcuaaaaauggg

SEQ ID NO: 2265572 - RNA, 18 nt, Human
gugcuaaaaaugggacuu

SEQ ID NO: 2265573 - RNA, 21 nt, Human
gugcuaaaaaugggacuucuu

SEQ ID NO: 2265574 - RNA, 22 nt, Human
gugcuaaaaaugggacuucuuu

SEQ ID NO: 2265575 - RNA, 17 nt, Human
gugcagcauaugaggau

SEQ ID NO: 2265576 - RNA, 15 nt, Human
gugcagcauaugagg

SEQ ID NO: 2265577 - RNA, 18 nt, Human
gugcagagugcccagaac

SEQ ID NO: 2265578 - RNA, 16 nt, Human
gugcagagugcccaga

SEQ ID NO: 2265579 - RNA, 17 nt, Human
gugcagaugagguugcu

SEQ ID NO: 2265580 - RNA, 19 nt, Human
gugcagcccguguggcccc

SEQ ID NO: 2265581 - RNA, 22 nt, Human
gugcagccccgccuccaggcca

SEQ ID NO: 2265582 - RNA, 19 nt, Human
gugcagcccccacugccuu

SEQ ID NO: 2265583 - RNA, 21 nt, Human
gugcagcccguguggccccuu

SEQ ID NO: 2265584 - RNA, 20 nt, Human
gugcagcccguguggccccu

SEQ ID NO: 2265585 - RNA, 17 nt, Human
gugcagccgcugagcga

SEQ ID NO: 2265586 - RNA, 23 nt, Human
gugcagcucaaggaaaggccuga

SEQ ID NO: 2265587 - RNA, 22 nt, Human
gugcagcucaaggaaaggccug

SEQ ID NO: 2265588 - RNA, 18 nt, Human
gugcagccgcugagcgag

SEQ ID NO: 2265589 - RNA, 15 nt, Human
gugcagccuguccug

SEQ ID NO: 2265590 - RNA, 21 nt, Human
gugcagccuguccugggcugg

SEQ ID NO: 2265591 - RNA, 20 nt, Human
gugcaguggugcgaucuggg

SEQ ID NO: 2265592 - RNA, 23 nt, Human
gugcaguggugcgaucuggguuc

SEQ ID NO: 2265593 - RNA, 23 nt, Human
gugcagcugauuuuaacaauaac

SEQ ID NO: 2265594 - RNA, 18 nt, Human
gugcagcugauuuuaaca

SEQ ID NO: 2265595 - RNA, 15 nt, Human
gugcagcuucugucc

SEQ ID NO: 2265596 - RNA, 16 nt, Human
gugcagcuucuguccu

SEQ ID NO: 2265597 - RNA, 16 nt, Human
gugcagcugauuuuaa

SEQ ID NO: 2265598 - RNA, 14 nt, Human
gugcagcugauuuu

SEQ ID NO: 2265599 - RNA, 13 nt, Human
gugcagcugauuu

SEQ ID NO: 2265600 - RNA, 12 nt, Human
gugcagcugauu

SEQ ID NO: 2265601 - RNA, 17 nt, Human
gugcagcuucuguccug

SEQ ID NO: 2265602 - RNA, 15 nt, Human
gugcaggcuggcacc

SEQ ID NO: 2265603 - RNA, 22 nt, Human
gugcaguucccccaaccucaga

SEQ ID NO: 2265604 - RNA, 18 nt, Human
gugcaggccugcucaggg

SEQ ID NO: 2265605 - RNA, 24 nt, Human
gugcaguucccccaaccucagacu

SEQ ID NO: 2265606 - RNA, 19 nt, Human
gugcaguucuaguuugcau

SEQ ID NO: 2265607 - RNA, 20 nt, Human
gugcaguucuaguuugcauu

SEQ ID NO: 2265608 - RNA, 15 nt, Human
gugcaguugacagca

SEQ ID NO: 2265609 - RNA, 22 nt, Human
gugcauaccacuuuuguucuug

SEQ ID NO: 2265610 - RNA, 20 nt, Human
gugcaguugacagcaggugg

SEQ ID NO: 2265611 - RNA, 19 nt, Human
gugcaguugacagcaggug

SEQ ID NO: 2265612 - RNA, 16 nt, Human
gugcauauuccuuucu

SEQ ID NO: 2265613 - RNA, 21 nt, Human
gugcauauuccuuucuaucau

SEQ ID NO: 2265614 - RNA, 13 nt, Human
gugcaucucagcc

SEQ ID NO: 2265615 - RNA, 12 nt, Human
gugcauccaaag

SEQ ID NO: 2265616 - RNA, 20 nt, Human
gugcauauuguacacuuuuu

SEQ ID NO: 2265617 - RNA, 13 nt, Human
gugcauauuguac

SEQ ID NO: 2265618 - RNA, 14 nt, Human
gugcauauuguaca

SEQ ID NO: 2265619 - RNA, 15 nt, Human
gugcauauuguacac

SEQ ID NO: 2265620 - RNA, 18 nt, Human
gugcauauuguacacuuu

SEQ ID NO: 2265621 - RNA, 18 nt, Human
gugcauccgggggcagcu

SEQ ID NO: 2265622 - RNA, 20 nt, Human
gugcauccgggggcagcucu

SEQ ID NO: 2265623 - RNA, 22 nt, Human
gugccagccgugaugcucaggc

SEQ ID NO: 2265624 - RNA, 13 nt, Human
gugccagccuucc

SEQ ID NO: 2265625 - RNA, 19 nt, Human
gugccagccuuccucugca

SEQ ID NO: 2265626 - RNA, 16 nt, Human
gugccaggaccaguca

SEQ ID NO: 2265627 - RNA, 13 nt, Human
gugccaggaccag

SEQ ID NO: 2265628 - RNA, 18 nt, Human
gugccagccuuccucugc

SEQ ID NO: 2265629 - RNA, 17 nt, Human
gugccaggacuccccag

SEQ ID NO: 2265630 - RNA, 18 nt, Human
gugccaggacuccccagg

SEQ ID NO: 2265631 - RNA, 21 nt, Human
gugccaggacuccccaggcca

SEQ ID NO: 2265632 - RNA, 23 nt, Human
gugauccacccaccucagccucc

SEQ ID NO: 2265633 - RNA, 24 nt, Human
gugauccacccaccucagccuccc

SEQ ID NO: 2265634 - RNA, 18 nt, Human
gugauuuacgcucauugu

SEQ ID NO: 2265635 - RNA, 18 nt, Human
gugauuuagaacuguaug

SEQ ID NO: 2265636 - RNA, 21 nt, Human
gugauuuagaacuguauguca

SEQ ID NO: 2265637 - RNA, 23 nt, Human
gugauuuagaacuguaugucaga

SEQ ID NO: 2265638 - RNA, 19 nt, Human
gugauuucagagagggcag

SEQ ID NO: 2265639 - RNA, 18 nt, Human
gugauuucccguggcccc

SEQ ID NO: 2265640 - RNA, 20 nt, Human
gugauuucccguggccccag

SEQ ID NO: 2265641 - RNA, 21 nt, Human
gugauuucccguggccccagc

SEQ ID NO: 2265642 - RNA, 23 nt, Human
gugauuucccguggccccagccu

SEQ ID NO: 2265643 - RNA, 12 nt, Human
gugauuuucauu

SEQ ID NO: 2265644 - RNA, 18 nt, Human
gugauuuuaacucugucu

SEQ ID NO: 2265645 - RNA, 17 nt, Human
gugauuuuaacucuguc

SEQ ID NO: 2265646 - RNA, 16 nt, Human
gugauuuuaacucugu

SEQ ID NO: 2265647 - RNA, 14 nt, Human
gugauuuuaacucu

SEQ ID NO: 2265648 - RNA, 13 nt, Human
gugauuugacugu

SEQ ID NO: 2265649 - RNA, 22 nt, Human
gugauuucccguggccccagcc

SEQ ID NO: 2265650 - RNA, 14 nt, Human
gugauuugacuguu

SEQ ID NO: 2265651 - RNA, 19 nt, Human
gugauuugacuguuuuuac

SEQ ID NO: 2265652 - RNA, 21 nt, Human
gugauuugacuguuuuuaccc

SEQ ID NO: 2265653 - RNA, 22 nt, Human
gugauuugacuguuuuuaccca

SEQ ID NO: 2265654 - RNA, 18 nt, Human
gugauuuuuguaauuuuu

SEQ ID NO: 2265655 - RNA, 13 nt, Human
gugauuuuuguaa

SEQ ID NO: 2265656 - RNA, 20 nt, Human
gugcaaaacagcguuuaaga

SEQ ID NO: 2265657 - RNA, 21 nt, Human
gugcaaaaagcugaguauggu

SEQ ID NO: 2265658 - RNA, 19 nt, Human
gugauuuuaacucugucuu

SEQ ID NO: 2265659 - RNA, 14 nt, Human
gugauuuuuuucuu

SEQ ID NO: 2265660 - RNA, 14 nt, Human
gugauuuuuuuguc

SEQ ID NO: 2265661 - RNA, 15 nt, Human
gugcacugcccaugg

SEQ ID NO: 2265662 - RNA, 20 nt, Human
gugcacugcccauggacagg

SEQ ID NO: 2265663 - RNA, 19 nt, Human
gugcacugcccauggacag

SEQ ID NO: 2265664 - RNA, 21 nt, Human
gugcacugcccauggacaggc

SEQ ID NO: 2265665 - RNA, 15 nt, Human
gugcagacuggaggg

SEQ ID NO: 2265666 - RNA, 23 nt, Human
gugcagacuggaggggacgcugg

SEQ ID NO: 2265667 - RNA, 23 nt, Human
gugcagaggaaguggaaggcauc

SEQ ID NO: 2265668 - RNA, 14 nt, Human
gugcagacuggagg

SEQ ID NO: 2265669 - RNA, 16 nt, Human
gugcagaaaacauugu

SEQ ID NO: 2265670 - RNA, 17 nt, Human
gugcagaaaacauuguu

SEQ ID NO: 2265671 - RNA, 13 nt, Human
gugcacugucacu

SEQ ID NO: 2265672 - RNA, 15 nt, Human
gugcacugucacuuu

SEQ ID NO: 2265673 - RNA, 23 nt, Human
gugcacugucacuuugcucuggg

SEQ ID NO: 2265674 - RNA, 14 nt, Human
gugcagaaaacauu

SEQ ID NO: 2265675 - RNA, 15 nt, Human
gugcagaaaacauug

SEQ ID NO: 2265676 - RNA, 15 nt, Human
gucuucucaggcucu

SEQ ID NO: 2265677 - RNA, 21 nt, Human
gucuuaaaaaguggaaaaaua

SEQ ID NO: 2265678 - RNA, 23 nt, Human
gucuucucauagcauuaacuaau

SEQ ID NO: 2265679 - RNA, 20 nt, Human
gucuucucauagcauuaacu

SEQ ID NO: 2265680 - RNA, 19 nt, Human
gucuucucauagcauuaac

SEQ ID NO: 2265681 - RNA, 17 nt, Human
gucuucucauagcauua

SEQ ID NO: 2265682 - RNA, 16 nt, Human
gucuucucauagcauu

SEQ ID NO: 2265683 - RNA, 22 nt, Human
gucuucucaggcucugcccugc

SEQ ID NO: 2265684 - RNA, 19 nt, Human
gucuucucaggcucugccc

SEQ ID NO: 2265685 - RNA, 18 nt, Human
gucuucucaggcucugcc

SEQ ID NO: 2265686 - RNA, 20 nt, Human
gucuucuccaccacgcuggg

SEQ ID NO: 2265687 - RNA, 17 nt, Human
gucuucuccaccacgcu

SEQ ID NO: 2265688 - RNA, 12 nt, Human
gucuucucccca

SEQ ID NO: 2265689 - RNA, 13 nt, Human
gucuucuccccag

SEQ ID NO: 2265690 - RNA, 16 nt, Human
gucuugaacuccuggc

SEQ ID NO: 2265691 - RNA, 17 nt, Human
gucuugaacuccuggcc

SEQ ID NO: 2265692 - RNA, 17 nt, Human
gucuucuuugcccacaa

SEQ ID NO: 2265693 - RNA, 14 nt, Human
gucuucuucagggu

SEQ ID NO: 2265694 - RNA, 16 nt, Human
gucuucuuacaugcau

SEQ ID NO: 2265695 - RNA, 13 nt, Human
gucuucugccugu

SEQ ID NO: 2265696 - RNA, 14 nt, Human
gucuucugccuguu

SEQ ID NO: 2265697 - RNA, 15 nt, Human
gucuucugccuguua

SEQ ID NO: 2265698 - RNA, 17 nt, Human
gucuucugccuguuaua

SEQ ID NO: 2265699 - RNA, 20 nt, Human
gucuucuuugcccacaaugc

SEQ ID NO: 2265700 - RNA, 12 nt, Human
gucuugaaagau

SEQ ID NO: 2265701 - RNA, 15 nt, Human
gucuugaaugucuuu

SEQ ID NO: 2265702 - RNA, 17 nt, Human
gucuugaaugucuuuug

SEQ ID NO: 2265703 - RNA, 19 nt, Human
gucuugaaugucuuuugaa

SEQ ID NO: 2265704 - RNA, 21 nt, Human
gucuugaacuccuggccucaa

SEQ ID NO: 2265705 - RNA, 18 nt, Human
gucuugaacuccuggccu

SEQ ID NO: 2265706 - RNA, 20 nt, Human
gucuugaacuccuggccuca

SEQ ID NO: 2265707 - RNA, 16 nt, Human
gucuugcaauggcagc

SEQ ID NO: 2265708 - RNA, 17 nt, Human
gucuugcaauggcagcc

SEQ ID NO: 2265709 - RNA, 18 nt, Human
gucuugcaauggcagccu

SEQ ID NO: 2265710 - RNA, 19 nt, Human
gucuugcaauggcagccuu

SEQ ID NO: 2265711 - RNA, 22 nt, Human
gucuugcuauggggagaaaaga

SEQ ID NO: 2265712 - RNA, 18 nt, Human
gucuugcuaccucaguca

SEQ ID NO: 2265713 - RNA, 14 nt, Human
gucuuggacacugu

SEQ ID NO: 2265714 - RNA, 15 nt, Human
gucuuggacacugua

SEQ ID NO: 2265715 - RNA, 18 nt, Human
gucuugaugaccaaaguc

SEQ ID NO: 2265716 - RNA, 23 nt, Human
gucuugcaauggcagccuuggca

SEQ ID NO: 2265717 - RNA, 20 nt, Human
gucuugcaauggcagccuug

SEQ ID NO: 2265718 - RNA, 21 nt, Human
gucuugcaauggcagccuugg

SEQ ID NO: 2265719 - RNA, 15 nt, Human
gucuugguauucuua

SEQ ID NO: 2265720 - RNA, 19 nt, Human
gucuugguuccagccugcc

SEQ ID NO: 2265721 - RNA, 17 nt, Human
gucuugguuccagccug

SEQ ID NO: 2265722 - RNA, 16 nt, Human
gucuuuuuucacuaca

SEQ ID NO: 2265723 - RNA, 16 nt, Human
gucuugguuccagccu

SEQ ID NO: 2265724 - RNA, 21 nt, Human
gucuugggcagagcuggcucu

SEQ ID NO: 2265725 - RNA, 22 nt, Human
gucuugggcagagcuggcucug

SEQ ID NO: 2265726 - RNA, 16 nt, Human
gucuugggcagagcug

SEQ ID NO: 2265727 - RNA, 16 nt, Human
gucuugggaaauauga

SEQ ID NO: 2265728 - RNA, 21 nt, Human
gucuugggaaauaugaaugcc

SEQ ID NO: 2265729 - RNA, 19 nt, Human
gucuugggcagagcuggcu

SEQ ID NO: 2265730 - RNA, 20 nt, Human
gucuugggcagagcuggcuc

SEQ ID NO: 2265731 - RNA, 18 nt, Human
gucuuggacacuguacaa

SEQ ID NO: 2265732 - RNA, 17 nt, Human
gucuuggagcugagccu

SEQ ID NO: 2265733 - RNA, 20 nt, Human
gucuuggcagcaccugucuc

SEQ ID NO: 2265734 - RNA, 18 nt, Human
gucuuggagcugagccuc

SEQ ID NO: 2265735 - RNA, 23 nt, Human
gucuuggagcugagccucucacc

SEQ ID NO: 2265736 - RNA, 22 nt, Human
gucuuggcagcaccugucuccu

SEQ ID NO: 2265737 - RNA, 15 nt, Human
gucuuggcggcagca

SEQ ID NO: 2265738 - RNA, 16 nt, Human
gucuuggcggcagcag

SEQ ID NO: 2265739 - RNA, 18 nt, Human
gucuuggcggcagcagcc

SEQ ID NO: 2265740 - RNA, 23 nt, Human
gucuuggcggcagcagccaucau

SEQ ID NO: 2265741 - RNA, 16 nt, Human
gucuuggcuuucaugu

SEQ ID NO: 2265742 - RNA, 20 nt, Human
gucuuggcuuucauguuauu

SEQ ID NO: 2265743 - RNA, 14 nt, Human
gucuguuuuccuuu

SEQ ID NO: 2265744 - RNA, 16 nt, Human
gucuguuuuccuuucu

SEQ ID NO: 2265745 - RNA, 20 nt, Human
gucuguuuuccuuucucacc

SEQ ID NO: 2265746 - RNA, 21 nt, Human
gucuguuuuccuuucucaccg

SEQ ID NO: 2265747 - RNA, 12 nt, Human
gucuguuuuccu

SEQ ID NO: 2265748 - RNA, 15 nt, Human
gucuguuuuaugacu

SEQ ID NO: 2265749 - RNA, 13 nt, Human
gucuguuuuauga

SEQ ID NO: 2265750 - RNA, 22 nt, Human
gucuguuggcaggcuggccagu

SEQ ID NO: 2265751 - RNA, 20 nt, Human
gucuguuggcaggcuggcca

SEQ ID NO: 2265752 - RNA, 21 nt, Human
gucuguuggcaggcuggccag

SEQ ID NO: 2265753 - RNA, 17 nt, Human
gucuguuuauaaacauu

SEQ ID NO: 2265754 - RNA, 13 nt, Human
gucuguucuugaa

SEQ ID NO: 2265755 - RNA, 15 nt, Human
gucuguucuugaagc

SEQ ID NO: 2265756 - RNA, 14 nt, Human
gucuguuggcaggc

SEQ ID NO: 2265757 - RNA, 16 nt, Human
gucuguuggcaggcug

SEQ ID NO: 2265758 - RNA, 18 nt, Human
gucuguuggcaggcuggc

SEQ ID NO: 2265759 - RNA, 19 nt, Human
gucuguuggcaggcuggcc

SEQ ID NO: 2265760 - RNA, 17 nt, Human
gucuguucuuuccaaag

SEQ ID NO: 2265761 - RNA, 14 nt, Human
gucuguucuuucca

SEQ ID NO: 2265762 - RNA, 16 nt, Human
gucuguuaacuuaaua

SEQ ID NO: 2265763 - RNA, 14 nt, Human
gucuguuacacugg

SEQ ID NO: 2265764 - RNA, 15 nt, Human
gucuguuaccauguc

SEQ ID NO: 2265765 - RNA, 22 nt, Human
gucuguguugcgugucgugggu

SEQ ID NO: 2265766 - RNA, 14 nt, Human
gucuguguuuuaau

SEQ ID NO: 2265767 - RNA, 17 nt, Human
gucuguucacuuuuccu

SEQ ID NO: 2265768 - RNA, 21 nt, Human
gucuguuccccauggccacuu

SEQ ID NO: 2265769 - RNA, 16 nt, Human
gucuguuaugcuguga

SEQ ID NO: 2265770 - RNA, 20 nt, Human
gucuguuaccaugucacugu

SEQ ID NO: 2265771 - RNA, 12 nt, Human
gucuguuagcca

SEQ ID NO: 2265772 - RNA, 20 nt, Human
gucuguguuccaaccacuga

SEQ ID NO: 2265773 - RNA, 22 nt, Human
gucuguguguuuaugugugugu

SEQ ID NO: 2265774 - RNA, 21 nt, Human
gucuguguguuuaugugugug

SEQ ID NO: 2265775 - RNA, 11 nt, Human
gucuguguguu

SEQ ID NO: 2265776 - RNA, 17 nt, Human
gucugugugcaagugug

SEQ ID NO: 2265777 - RNA, 20 nt, Human
gucugugugaugaacuuucu

SEQ ID NO: 2265778 - RNA, 21 nt, Human
gucuguggcuuucagccucug

SEQ ID NO: 2265779 - RNA, 20 nt, Human
gucuguggcuuucagccucu

SEQ ID NO: 2265780 - RNA, 13 nt, Human
gucuguggaucag

SEQ ID NO: 2265781 - RNA, 12 nt, Human
gucugugcugag

SEQ ID NO: 2265782 - RNA, 13 nt, Human
gucugugcugagg

SEQ ID NO: 2265783 - RNA, 14 nt, Human
gucugugcugaggc

SEQ ID NO: 2265784 - RNA, 20 nt, Human
gucuguguguguguaugugg

SEQ ID NO: 2265785 - RNA, 16 nt, Human
gucuguguguguguau

SEQ ID NO: 2265786 - RNA, 12 nt, Human
gucugugugugu

SEQ ID NO: 2265787 - RNA, 11 nt, Human
gucugugugug

SEQ ID NO: 2265788 - RNA, 11 nt, Human
gucugccaggg

SEQ ID NO: 2265789 - RNA, 12 nt, Human
gucugccagggc

SEQ ID NO: 2265790 - RNA, 13 nt, Human
gucugccagggcc

SEQ ID NO: 2265791 - RNA, 18 nt, Human
gucugccagccagcagcc

SEQ ID NO: 2265792 - RNA, 17 nt, Human
gucugccagccagcagc

SEQ ID NO: 2265793 - RNA, 23 nt, Human
gucugagacucucuuaggagcag

SEQ ID NO: 2265794 - RNA, 22 nt, Human
gucugucuucacagcucugugu

SEQ ID NO: 2265795 - RNA, 16 nt, Human
gucugucuucacagcu

SEQ ID NO: 2265796 - RNA, 18 nt, Human
gucugcuauauuuucaug

SEQ ID NO: 2265797 - RNA, 15 nt, Human
gucugcuauauuuuc

SEQ ID NO: 2265798 - RNA, 17 nt, Human
gucugcuauauuuucau

SEQ ID NO: 2265799 - RNA, 10 nt, Human
gucugcccuu

SEQ ID NO: 2265800 - RNA, 11 nt, Human
gucugccucuu

SEQ ID NO: 2265801 - RNA, 17 nt, Human
gucugcccuucacccca

SEQ ID NO: 2265802 - RNA, 12 nt, Human
gucugugcuagg

SEQ ID NO: 2265803 - RNA, 21 nt, Human
gucugugaauuggaccauccu

SEQ ID NO: 2265804 - RNA, 18 nt, Human
gucugugccauuuuguau

SEQ ID NO: 2265805 - RNA, 23 nt, Human
gucugugagaugcuagaacuccc

SEQ ID NO: 2265806 - RNA, 22 nt, Human
gucugugagaugcuagaacucc

SEQ ID NO: 2265807 - RNA, 21 nt, Human
gucugugagaugcuagaacuc

SEQ ID NO: 2265808 - RNA, 17 nt, Human
gucugugagaugcuaga

SEQ ID NO: 2265809 - RNA, 16 nt, Human
gucugugagaugcuag

SEQ ID NO: 2265810 - RNA, 15 nt, Human
gucugugagaugcua

SEQ ID NO: 2265811 - RNA, 19 nt, Human
gucucgugguaggacugua

SEQ ID NO: 2265812 - RNA, 12 nt, Human
gucucuagagca

SEQ ID NO: 2265813 - RNA, 16 nt, Human
gucucaggagcauggg

SEQ ID NO: 2265814 - RNA, 12 nt, Human
gucucaggagca

SEQ ID NO: 2265815 - RNA, 13 nt, Human
gucucgugguagg

SEQ ID NO: 2265816 - RNA, 15 nt, Human
gucucaggaccuagg

SEQ ID NO: 2265817 - RNA, 22 nt, Human
gucucagcagcgaccaccccug

SEQ ID NO: 2265818 - RNA, 13 nt, Human
gucucagccuccc

SEQ ID NO: 2265819 - RNA, 22 nt, Human
gucucacugugggaaggccagc

SEQ ID NO: 2265820 - RNA, 23 nt, Human
gucucacugugggaaggccagcu

SEQ ID NO: 2265821 - RNA, 21 nt, Human
gucucagcagcgaccaccccu

SEQ ID NO: 2265822 - RNA, 18 nt, Human
gucucuagugcugugaaa

SEQ ID NO: 2265823 - RNA, 17 nt, Human
gucucuagugcugugaa

SEQ ID NO: 2265824 - RNA, 16 nt, Human
gucucuagugcuguga

SEQ ID NO: 2265825 - RNA, 14 nt, Human
gucucuagugcugu

SEQ ID NO: 2265826 - RNA, 18 nt, Human
gucucuagagcagggauu

SEQ ID NO: 2265827 - RNA, 14 nt, Human
gucucuagccacuu

SEQ ID NO: 2265828 - RNA, 16 nt, Human
gucucuagccacuuug

SEQ ID NO: 2265829 - RNA, 13 nt, Human
gucucuaggcugg

SEQ ID NO: 2265830 - RNA, 14 nt, Human
gucucuaggcuggg

SEQ ID NO: 2265831 - RNA, 15 nt, Human
gucucuaggcugggg

SEQ ID NO: 2265832 - RNA, 15 nt, Human
gucucucucucucua

SEQ ID NO: 2265833 - RNA, 23 nt, Human
gucucucucccauggagccccag

SEQ ID NO: 2265834 - RNA, 14 nt, Human
gucucucucucucu

SEQ ID NO: 2265835 - RNA, 17 nt, Human
gucucuaggcuggggaa

SEQ ID NO: 2265836 - RNA, 13 nt, Human
gucucucucccau

SEQ ID NO: 2265837 - RNA, 16 nt, Human
gucucucucccaugga

SEQ ID NO: 2265838 - RNA, 17 nt, Human
gucucucucccauggag

SEQ ID NO: 2265839 - RNA, 15 nt, Human
gucucacucugucgc

SEQ ID NO: 2265840 - RNA, 16 nt, Human
gucucacucugucgcc

SEQ ID NO: 2265841 - RNA, 18 nt, Human
gucucacucugucgccca

SEQ ID NO: 2265842 - RNA, 19 nt, Human
gucucacucugucgcccag

SEQ ID NO: 2265843 - RNA, 22 nt, Human
gucucacucugucgcccagucu

SEQ ID NO: 2265844 - RNA, 23 nt, Human
gucucacgggcaugggcacuccc

SEQ ID NO: 2265845 - RNA, 15 nt, Human
gucucacugaaacau

SEQ ID NO: 2265846 - RNA, 21 nt, Human
gucucacugaaacauuuaaau

SEQ ID NO: 2265847 - RNA, 12 nt, Human
gucucugcugaa

SEQ ID NO: 2265848 - RNA, 18 nt, Human
gucucugccggcucuuuc

SEQ ID NO: 2265849 - RNA, 12 nt, Human
gucucugccucc

SEQ ID NO: 2265850 - RNA, 12 nt, Human
gucucugcugcc

SEQ ID NO: 2265851 - RNA, 13 nt, Human
gucucugcugccg

SEQ ID NO: 2265852 - RNA, 14 nt, Human
gucucugcugccgc

SEQ ID NO: 2265853 - RNA, 17 nt, Human
gucucugccggcucuuu

SEQ ID NO: 2265854 - RNA, 18 nt, Human
gucucugccucccucacc

SEQ ID NO: 2265855 - RNA, 17 nt, Human
gucucugcuggcccagc

SEQ ID NO: 2265856 - RNA, 16 nt, Human
gucucugcuggcccag

SEQ ID NO: 2265857 - RNA, 15 nt, Human
gucucugcuggccca

SEQ ID NO: 2265858 - RNA, 13 nt, Human
gucucugcuggcc

SEQ ID NO: 2265859 - RNA, 17 nt, Human
gucucuggaauuugaaa

SEQ ID NO: 2265860 - RNA, 15 nt, Human
gucucugaagugaaa

SEQ ID NO: 2265861 - RNA, 13 nt, Human
gucucugagcauu

SEQ ID NO: 2265862 - RNA, 21 nt, Human
gucucugaagugaaacugcuu

SEQ ID NO: 2265863 - RNA, 14 nt, Human
gucucugagggcuu

SEQ ID NO: 2265864 - RNA, 21 nt, Human
gucucugagggcuuccuuugg

SEQ ID NO: 2265865 - RNA, 19 nt, Human
gucucucucucucuacaaa

SEQ ID NO: 2265866 - RNA, 21 nt, Human
gucucucuggggccacacaga

SEQ ID NO: 2265867 - RNA, 20 nt, Human
gucucugcuggcccagccaa

SEQ ID NO: 2265868 - RNA, 16 nt, Human
gucucuggcaguucug

SEQ ID NO: 2265869 - RNA, 21 nt, Human
gucucuggcaguucuggaaug

SEQ ID NO: 2265870 - RNA, 12 nt, Human
gucucuggccug

SEQ ID NO: 2265871 - RNA, 13 nt, Human
gucucuggccugu

SEQ ID NO: 2265872 - RNA, 21 nt, Human
gucucuggauuauauuaugaa

SEQ ID NO: 2265873 - RNA, 18 nt, Human
gucucuucuccacuggau

SEQ ID NO: 2265874 - RNA, 17 nt, Human
gucucugguuccucccc

SEQ ID NO: 2265875 - RNA, 16 nt, Human
gucucugguuccuccc

SEQ ID NO: 2265876 - RNA, 23 nt, Human
gucucuugagggagcuuagccaa

SEQ ID NO: 2265877 - RNA, 13 nt, Human
gucucuugaggga

SEQ ID NO: 2265878 - RNA, 13 nt, Human
gucugacuguuuc

SEQ ID NO: 2265879 - RNA, 22 nt, Human
gucucuucugagcuauuucauc

SEQ ID NO: 2265880 - RNA, 14 nt, Human
gucucuucugagcu

SEQ ID NO: 2265881 - RNA, 15 nt, Human
gucgggggcuggccu

SEQ ID NO: 2265882 - RNA, 18 nt, Human
gucgggaguucgagacca

SEQ ID NO: 2265883 - RNA, 23 nt, Human
gucggguuuuauuguuuaaaauc

SEQ ID NO: 2265884 - RNA, 14 nt, Human
gucggcugaccaug

SEQ ID NO: 2265885 - RNA, 17 nt, Human
gucggcugaccaugcuc

SEQ ID NO: 2265886 - RNA, 18 nt, Human
gucggcugaccaugcuca

SEQ ID NO: 2265887 - RNA, 16 nt, Human
gucgggcaugacacga

SEQ ID NO: 2265888 - RNA, 14 nt, Human
gucggaggcuuggg

SEQ ID NO: 2265889 - RNA, 17 nt, Human
gucggaggcuugggacc

SEQ ID NO: 2265890 - RNA, 16 nt, Human
gucggaggcuugggac

SEQ ID NO: 2265891 - RNA, 20 nt, Human
gucggccucuaaccccaggc

SEQ ID NO: 2265892 - RNA, 21 nt, Human
gucggccucuaaccccaggcc

SEQ ID NO: 2265893 - RNA, 22 nt, Human
gucggccucuaaccccaggccc

SEQ ID NO: 2265894 - RNA, 23 nt, Human
gucggccucuaaccccaggcccc

SEQ ID NO: 2265895 - RNA, 17 nt, Human
guccuuagaacauuuua

SEQ ID NO: 2265896 - RNA, 21 nt, Human
gucggaaaacaugcuacacac

SEQ ID NO: 2265897 - RNA, 18 nt, Human
gucccugccccagcaaga

SEQ ID NO: 2265898 - RNA, 15 nt, Human
gucccugccaaugga

SEQ ID NO: 2265899 - RNA, 11 nt, Human
gucccugccaa

SEQ ID NO: 2265900 - RNA, 14 nt, Human
gucccugccaaugg

SEQ ID NO: 2265901 - RNA, 21 nt, Human
guccuuaccagcagagcaccu

SEQ ID NO: 2265902 - RNA, 15 nt, Human
guccuuagaacauuu

SEQ ID NO: 2265903 - RNA, 12 nt, Human
gucccugccuca

SEQ ID NO: 2265904 - RNA, 18 nt, Human
guccuuaccagcagagca

SEQ ID NO: 2265905 - RNA, 19 nt, Human
guccuuaccagcagagcac

SEQ ID NO: 2265906 - RNA, 18 nt, Human
gucucacuauguugccca

SEQ ID NO: 2265907 - RNA, 11 nt, Human
gucucacucug

SEQ ID NO: 2265908 - RNA, 19 nt, Human
gucucacuauguugcccag

SEQ ID NO: 2265909 - RNA, 23 nt, Human
gucuaaauauuuccuuaaacugu

SEQ ID NO: 2265910 - RNA, 15 nt, Human
gucuaaaugcugaaa

SEQ ID NO: 2265911 - RNA, 16 nt, Human
gucuaaauauuuccuu

SEQ ID NO: 2265912 - RNA, 13 nt, Human
gucuaaauauuuc

SEQ ID NO: 2265913 - RNA, 13 nt, Human
gucuaaauuugaa

SEQ ID NO: 2265914 - RNA, 11 nt, Human
gucuaaaguuu

SEQ ID NO: 2265915 - RNA, 15 nt, Human
gucuaaaguuuacag

SEQ ID NO: 2265916 - RNA, 16 nt, Human
gucuaaaguuuacagu

SEQ ID NO: 2265917 - RNA, 17 nt, Human
gucuaaaguuuacagua

SEQ ID NO: 2265918 - RNA, 16 nt, Human
gucuaaauaaguuugc

SEQ ID NO: 2265919 - RNA, 21 nt, Human
gucuaagauaguaacaaugaa

SEQ ID NO: 2265920 - RNA, 22 nt, Human
gucguggcagauaaucagccuc

SEQ ID NO: 2265921 - RNA, 15 nt, Human
gucguggcagauaau

SEQ ID NO: 2265922 - RNA, 23 nt, Human
gucguggcagauaaucagccucu

SEQ ID NO: 2265923 - RNA, 17 nt, Human
gucguggggugugcugg

SEQ ID NO: 2265924 - RNA, 18 nt, Human
gucgugccuguguccaug

SEQ ID NO: 2265925 - RNA, 17 nt, Human
gucguggagaugucuuc

SEQ ID NO: 2265926 - RNA, 17 nt, Human
gucgugagcucuuguga

SEQ ID NO: 2265927 - RNA, 17 nt, Human
gucgucgcacagucucu

SEQ ID NO: 2265928 - RNA, 12 nt, Human
gucgugccugug

SEQ ID NO: 2265929 - RNA, 19 nt, Human
gucgucgcacagucucucu

SEQ ID NO: 2265930 - RNA, 21 nt, Human
gucgugccuccuuccaccucc

SEQ ID NO: 2265931 - RNA, 13 nt, Human
gucgugccugugu

SEQ ID NO: 2265932 - RNA, 14 nt, Human
gucgugccuguguc

SEQ ID NO: 2265933 - RNA, 15 nt, Human
gucgugccugugucc

SEQ ID NO: 2265934 - RNA, 17 nt, Human
gucgugccuguguccau

SEQ ID NO: 2265935 - RNA, 17 nt, Human
gucggggggacagcucc

SEQ ID NO: 2265936 - RNA, 16 nt, Human
gucgggggcuggccua

SEQ ID NO: 2265937 - RNA, 20 nt, Human
gucguagccaaggugggcug

SEQ ID NO: 2265938 - RNA, 15 nt, Human
gucgucgcacagucu

SEQ ID NO: 2265939 - RNA, 18 nt, Human
gucgucaaagcugaaaug

SEQ ID NO: 2265940 - RNA, 22 nt, Human
guauuuucccccuuuucugcau

SEQ ID NO: 2265941 - RNA, 11 nt, Human
guauuuuccug

SEQ ID NO: 2265942 - RNA, 16 nt, Human
guauuuuccuguaaaa

SEQ ID NO: 2265943 - RNA, 17 nt, Human
guauuuuauuguaacag

SEQ ID NO: 2265944 - RNA, 16 nt, Human
guauuuuccaagugug

SEQ ID NO: 2265945 - RNA, 17 nt, Human
guauuuuccaagugugc

SEQ ID NO: 2265946 - RNA, 20 nt, Human
guauuuuccaagugugcaua

SEQ ID NO: 2265947 - RNA, 13 nt, Human
guauuuucuuucu

SEQ ID NO: 2265948 - RNA, 15 nt, Human
guauuuucuuucucu

SEQ ID NO: 2265949 - RNA, 17 nt, Human
guauuuuggagaaauua

SEQ ID NO: 2265950 - RNA, 18 nt, Human
guauuuuguauuguuuca

SEQ ID NO: 2265951 - RNA, 18 nt, Human
guauuuucuuucucuacu

SEQ ID NO: 2265952 - RNA, 14 nt, Human
guauuuuggagaaa

SEQ ID NO: 2265953 - RNA, 21 nt, Human
guauuuuaguaagagauuccu

SEQ ID NO: 2265954 - RNA, 19 nt, Human
guauuuuaggcagggauuu

SEQ ID NO: 2265955 - RNA, 14 nt, Human
guauuuuacuaaua

SEQ ID NO: 2265956 - RNA, 22 nt, Human
guauuuuaucuuugauucuccu

SEQ ID NO: 2265957 - RNA, 13 nt, Human
guauuuuauugua

SEQ ID NO: 2265958 - RNA, 23 nt, Human
guauuuuaucuuugauucuccuu

SEQ ID NO: 2265959 - RNA, 22 nt, Human
guauuaaguuguuaauaaaagu

SEQ ID NO: 2265960 - RNA, 16 nt, Human
guauuaagaaugaaau

SEQ ID NO: 2265961 - RNA, 14 nt, Human
guauuaauauucau

SEQ ID NO: 2265962 - RNA, 13 nt, Human
guauuacacugua

SEQ ID NO: 2265963 - RNA, 13 nt, Human
guauuuuaaucac

SEQ ID NO: 2265964 - RNA, 20 nt, Human
guauuuuaaaagaaugauua

SEQ ID NO: 2265965 - RNA, 17 nt, Human
gucaagucucugcuggc

SEQ ID NO: 2265966 - RNA, 14 nt, Human
gucaagucucugcu

SEQ ID NO: 2265967 - RNA, 13 nt, Human
gucaagucaacca

SEQ ID NO: 2265968 - RNA, 15 nt, Human
gucaaguaagaagac

SEQ ID NO: 2265969 - RNA, 14 nt, Human
gucaaguaagaaga

SEQ ID NO: 2265970 - RNA, 19 nt, Human
guauuuuguuuuugucuua

SEQ ID NO: 2265971 - RNA, 15 nt, Human
gucaagugaaaaagg

SEQ ID NO: 2265972 - RNA, 22 nt, Human
gucaauaaaauccauacauuug

SEQ ID NO: 2265973 - RNA, 21 nt, Human
gucaagucucugcuggcccag

SEQ ID NO: 2265974 - RNA, 20 nt, Human
gucaauacaguacaggcagc

SEQ ID NO: 2265975 - RNA, 19 nt, Human
gucaauacaguacaggcag

SEQ ID NO: 2265976 - RNA, 23 nt, Human
gucaauaaaauccauacauuugu

SEQ ID NO: 2265977 - RNA, 17 nt, Human
gucaccaccuucccagc

SEQ ID NO: 2265978 - RNA, 16 nt, Human
gucaccaccuucccag

SEQ ID NO: 2265979 - RNA, 15 nt, Human
gucaccaccuuccca

SEQ ID NO: 2265980 - RNA, 14 nt, Human
gucaccaccuuccc

SEQ ID NO: 2265981 - RNA, 11 nt, Human
gucaccaccuu

SEQ ID NO: 2265982 - RNA, 13 nt, Human
gucaccaccucuc

SEQ ID NO: 2265983 - RNA, 20 nt, Human
gucaccaccuucccagcucu

SEQ ID NO: 2265984 - RNA, 19 nt, Human
gucaccaccuucccagcuc

SEQ ID NO: 2265985 - RNA, 22 nt, Human
gucaccaccuucccagcucucc

SEQ ID NO: 2265986 - RNA, 15 nt, Human
gucaccaucucaggc

SEQ ID NO: 2265987 - RNA, 18 nt, Human
gucaccaggaauguuaaa

SEQ ID NO: 2265988 - RNA, 16 nt, Human
gucaccagcuccuccc

SEQ ID NO: 2265989 - RNA, 23 nt, Human
gucaccaggaauguuaaagucag

SEQ ID NO: 2265990 - RNA, 14 nt, Human
gucaccagcuccuc

SEQ ID NO: 2265991 - RNA, 21 nt, Human
gucaauacaguacaggcagca

SEQ ID NO: 2265992 - RNA, 14 nt, Human
gucaauauuaaaua

SEQ ID NO: 2265993 - RNA, 15 nt, Human
gucaauauuaaauac

SEQ ID NO: 2265994 - RNA, 16 nt, Human
gucaauauuaaauaca

SEQ ID NO: 2265995 - RNA, 17 nt, Human
gucaauauuaaauacag

SEQ ID NO: 2265996 - RNA, 18 nt, Human
gucaauauuaaauacaga

SEQ ID NO: 2265997 - RNA, 20 nt, Human
gucaauauuaaauacagaca

SEQ ID NO: 2265998 - RNA, 22 nt, Human
gucaauauuaaauacagacacu

SEQ ID NO: 2265999 - RNA, 16 nt, Human
gucaauccccucauuc

SEQ ID NO: 2266000 - RNA, 13 nt, Human
gucaauauuuaaa

SEQ ID NO: 2266001 - RNA, 22 nt, Human
gucaauccaagagucugaugau

SEQ ID NO: 2266002 - RNA, 23 nt, Human
gucaauauuaaauacagacacua

SEQ ID NO: 2266003 - RNA, 12 nt, Human
gucaauauuuaa

SEQ ID NO: 2266004 - RNA, 16 nt, Human
gucaauccugugggug

SEQ ID NO: 2266005 - RNA, 15 nt, Human
gucaauccugugggu

SEQ ID NO: 2266006 - RNA, 22 nt, Human
gucaauccccucauucaggaaa

SEQ ID NO: 2266007 - RNA, 17 nt, Human
gucaauccccucauuca

SEQ ID NO: 2266008 - RNA, 19 nt, Human
gucaauccugugggugaag

SEQ ID NO: 2266009 - RNA, 15 nt, Human
gucaaugcagccccc

SEQ ID NO: 2266010 - RNA, 22 nt, Human
gucacuacucacagucucuuua

SEQ ID NO: 2266011 - RNA, 17 nt, Human
gucacuacucacagucu

SEQ ID NO: 2266012 - RNA, 14 nt, Human
gucacuacucacag

SEQ ID NO: 2266013 - RNA, 23 nt, Human
gucacuacgugacuguggcacac

SEQ ID NO: 2266014 - RNA, 23 nt, Human
gucacucagauggaaccgcagga

SEQ ID NO: 2266015 - RNA, 14 nt, Human
gucacucauugcug

SEQ ID NO: 2266016 - RNA, 24 nt, Human
gucacucauugcugagccucugcu

SEQ ID NO: 2266017 - RNA, 11 nt, Human
gucacucccaa

SEQ ID NO: 2266018 - RNA, 14 nt, Human
gucacucccaagcc

SEQ ID NO: 2266019 - RNA, 23 nt, Human
gucacucauugcugagccucugc

SEQ ID NO: 2266020 - RNA, 22 nt, Human
gucacucauugcugagccucug

SEQ ID NO: 2266021 - RNA, 21 nt, Human
gucacucauugcugagccucu

SEQ ID NO: 2266022 - RNA, 20 nt, Human
gucacucauugcugagccuc

SEQ ID NO: 2266023 - RNA, 19 nt, Human
gucacucauugcugagccu

SEQ ID NO: 2266024 - RNA, 18 nt, Human
gucacucauugcugagcc

SEQ ID NO: 2266025 - RNA, 15 nt, Human
gucaccccuccagga

SEQ ID NO: 2266026 - RNA, 20 nt, Human
gucaccccuccaggaaugau

SEQ ID NO: 2266027 - RNA, 22 nt, Human
gucaccccggccaccugcggug

SEQ ID NO: 2266028 - RNA, 17 nt, Human
gucaccccggccaccug

SEQ ID NO: 2266029 - RNA, 18 nt, Human
gucaccccggccaccugc

SEQ ID NO: 2266030 - RNA, 21 nt, Human
gucacuccuggggccucuugg

SEQ ID NO: 2266031 - RNA, 13 nt, Human
gucacuccugggg

SEQ ID NO: 2266032 - RNA, 12 nt, Human
gucacuccuggg

SEQ ID NO: 2266033 - RNA, 18 nt, Human
gucacucccaagcccccu

SEQ ID NO: 2266034 - RNA, 22 nt, Human
gucacucuggcagcucagagag

SEQ ID NO: 2266035 - RNA, 18 nt, Human
gucagacgccugaggaac

SEQ ID NO: 2266036 - RNA, 17 nt, Human
gucagacgccugaggaa

SEQ ID NO: 2266037 - RNA, 16 nt, Human
gucagacgccugagga

SEQ ID NO: 2266038 - RNA, 17 nt, Human
gucacucuggcagcuca

SEQ ID NO: 2266039 - RNA, 19 nt, Human
gucacucuggcagcucaga

SEQ ID NO: 2266040 - RNA, 12 nt, Human
gucacucuggca

SEQ ID NO: 2266041 - RNA, 13 nt, Human
gucacucuggcag

SEQ ID NO: 2266042 - RNA, 14 nt, Human
gucacucuggcagc

SEQ ID NO: 2266043 - RNA, 16 nt, Human
gucacucuggcagcuc

SEQ ID NO: 2266044 - RNA, 13 nt, Human
gucagagcuggga

SEQ ID NO: 2266045 - RNA, 13 nt, Human
gucagaggauggc

SEQ ID NO: 2266046 - RNA, 12 nt, Human
gucagagcuggg

SEQ ID NO: 2266047 - RNA, 14 nt, Human
gucagaggauggcc

SEQ ID NO: 2266048 - RNA, 15 nt, Human
gucagaggauggcca

SEQ ID NO: 2266049 - RNA, 16 nt, Human
gucagaggauggccag

SEQ ID NO: 2266050 - RNA, 19 nt, Human
gucagaggauggccagugu

SEQ ID NO: 2266051 - RNA, 14 nt, Human
gucagagcugggag

SEQ ID NO: 2266052 - RNA, 21 nt, Human
gucagagaggagucagagaga

SEQ ID NO: 2266053 - RNA, 19 nt, Human
gucagagaggagucagaga

SEQ ID NO: 2266054 - RNA, 15 nt, Human
gucagagccugcagu

SEQ ID NO: 2266055 - RNA, 16 nt, Human
gucagagccugcaguu

SEQ ID NO: 2266056 - RNA, 18 nt, Human
gucagacuggcuggcugc

SEQ ID NO: 2266057 - RNA, 14 nt, Human
gucagacuggcugg

SEQ ID NO: 2266058 - RNA, 24 nt, Human
gucagacugcugggacuggccagg

SEQ ID NO: 2266059 - RNA, 22 nt, Human
gucagacugcugggacuggcca

SEQ ID NO: 2266060 - RNA, 20 nt, Human
gucagacugcugggacuggc

SEQ ID NO: 2266061 - RNA, 16 nt, Human
gucagacugcugggac

SEQ ID NO: 2266062 - RNA, 15 nt, Human
gucagacugcuggga

SEQ ID NO: 2266063 - RNA, 14 nt, Human
gucagacugcuggg

SEQ ID NO: 2266064 - RNA, 17 nt, Human
gucagagaggagucaga

SEQ ID NO: 2266065 - RNA, 12 nt, Human
gucagagagaau

SEQ ID NO: 2266066 - RNA, 15 nt, Human
gucagacuuuaaaga

SEQ ID NO: 2266067 - RNA, 16 nt, Human
gucagagacugcugug

SEQ ID NO: 2266068 - RNA, 16 nt, Human
gucagacuuuaaagaa

SEQ ID NO: 2266069 - RNA, 22 nt, Human
gucagacuggcuggcugcagug

SEQ ID NO: 2266070 - RNA, 14 nt, Human
gucagagccugcag

SEQ ID NO: 2266071 - RNA, 15 nt, Human
gucagauacaaugua

SEQ ID NO: 2266072 - RNA, 20 nt, Human
gucagaggauggccaguguc

SEQ ID NO: 2266073 - RNA, 21 nt, Human
gucagaggauggccagugucu

SEQ ID NO: 2266074 - RNA, 21 nt, Human
gucagaggcuaauucugcaga

SEQ ID NO: 2266075 - RNA, 19 nt, Human
gucagcuacuaaugauguu

SEQ ID NO: 2266076 - RNA, 20 nt, Human
gucagcaaaaagcaaaauca

SEQ ID NO: 2266077 - RNA, 22 nt, Human
gucagcaaaaagcaaaaucauu

SEQ ID NO: 2266078 - RNA, 21 nt, Human
gucagauuuccagucuccacc

SEQ ID NO: 2266079 - RNA, 15 nt, Human
gucagcaaaaagcaa

SEQ ID NO: 2266080 - RNA, 16 nt, Human
gucagcaaaaagcaaa

SEQ ID NO: 2266081 - RNA, 19 nt, Human
gucagcuccccucggagaa

SEQ ID NO: 2266082 - RNA, 14 nt, Human
gucagauuuccagu

SEQ ID NO: 2266083 - RNA, 18 nt, Human
gucagaugggaagacaug

SEQ ID NO: 2266084 - RNA, 22 nt, Human
gucagaugcugugcaaauguua

SEQ ID NO: 2266085 - RNA, 21 nt, Human
guccaccaugggguccuacca

SEQ ID NO: 2266086 - RNA, 13 nt, Human
guccacaggaagu

SEQ ID NO: 2266087 - RNA, 13 nt, Human
guccacccaggag

SEQ ID NO: 2266088 - RNA, 12 nt, Human
guccacccagga

SEQ ID NO: 2266089 - RNA, 23 nt, Human
guccacccaggagccccgaggcc

SEQ ID NO: 2266090 - RNA, 21 nt, Human
guccaccuggccccaugucuc

SEQ ID NO: 2266091 - RNA, 14 nt, Human
guccacccagcaaa

SEQ ID NO: 2266092 - RNA, 20 nt, Human
guccacccaccuaugugcca

SEQ ID NO: 2266093 - RNA, 11 nt, Human
guccacccagc

SEQ ID NO: 2266094 - RNA, 22 nt, Human
guccaccugagcugccauccag

SEQ ID NO: 2266095 - RNA, 15 nt, Human
guccacggcucuagg

SEQ ID NO: 2266096 - RNA, 16 nt, Human
guccacucccagugcu

SEQ ID NO: 2266097 - RNA, 12 nt, Human
guccacucccag

SEQ ID NO: 2266098 - RNA, 15 nt, Human
guccacucccagugc

SEQ ID NO: 2266099 - RNA, 18 nt, Human
guccacgacugucuccau

SEQ ID NO: 2266100 - RNA, 16 nt, Human
guccacgacugucucc

SEQ ID NO: 2266101 - RNA, 15 nt, Human
guccacgacugucuc

SEQ ID NO: 2266102 - RNA, 22 nt, Human
guccagagagagaagugccccu

SEQ ID NO: 2266103 - RNA, 21 nt, Human
guccagaccuuguucacacuc

SEQ ID NO: 2266104 - RNA, 20 nt, Human
guccagagagagaagugccc

SEQ ID NO: 2266105 - RNA, 12 nt, Human
guccacugucac

SEQ ID NO: 2266106 - RNA, 16 nt, Human
guccagacagccugua

SEQ ID NO: 2266107 - RNA, 23 nt, Human
guccagagagagaagugccccug

SEQ ID NO: 2266108 - RNA, 15 nt, Human
guccagauuuacacu

SEQ ID NO: 2266109 - RNA, 17 nt, Human
guccagauuuacacugg

SEQ ID NO: 2266110 - RNA, 19 nt, Human
guccagauuuacacuggga

SEQ ID NO: 2266111 - RNA, 18 nt, Human
guccagggcuagugacuu

SEQ ID NO: 2266112 - RNA, 11 nt, Human
guccaggggau

SEQ ID NO: 2266113 - RNA, 14 nt, Human
guccaggggccccu

SEQ ID NO: 2266114 - RNA, 18 nt, Human
guccaggggccccuccag

SEQ ID NO: 2266115 - RNA, 19 nt, Human
guccaggggccccuccagc

SEQ ID NO: 2266116 - RNA, 13 nt, Human
guccagccugggc

SEQ ID NO: 2266117 - RNA, 11 nt, Human
guccagccugg

SEQ ID NO: 2266118 - RNA, 20 nt, Human
guccagggcccugagcucgg

SEQ ID NO: 2266119 - RNA, 22 nt, Human
guccagccgccauugccaccag

SEQ ID NO: 2266120 - RNA, 20 nt, Human
guccagccgccauugccacc

SEQ ID NO: 2266121 - RNA, 18 nt, Human
guccagcccuggcugaag

SEQ ID NO: 2266122 - RNA, 19 nt, Human
guccagcccuggcugaagg

SEQ ID NO: 2266123 - RNA, 20 nt, Human
guccagcccuggcugaagga

SEQ ID NO: 2266124 - RNA, 23 nt, Human
guccagcccuggcugaaggacug

SEQ ID NO: 2266125 - RNA, 22 nt, Human
guccagauuuacacugggagag

SEQ ID NO: 2266126 - RNA, 21 nt, Human
guccagauuuacacugggaga

SEQ ID NO: 2266127 - RNA, 14 nt, Human
guccagcccuggcu

SEQ ID NO: 2266128 - RNA, 16 nt, Human
guccagcccuggcuga

SEQ ID NO: 2266129 - RNA, 17 nt, Human
guccagcccuggcugaa

SEQ ID NO: 2266130 - RNA, 21 nt, Human
gucccaccuuggcugcaggga

SEQ ID NO: 2266131 - RNA, 16 nt, Human
guccagucucuucugc

SEQ ID NO: 2266132 - RNA, 23 nt, Human
guccaggggccccuccagcuugu

SEQ ID NO: 2266133 - RNA, 20 nt, Human
guccaggggccccuccagcu

SEQ ID NO: 2266134 - RNA, 21 nt, Human
guccaggggccccuccagcuu

SEQ ID NO: 2266135 - RNA, 22 nt, Human
gucauugcuguugucccucugc

SEQ ID NO: 2266136 - RNA, 23 nt, Human
gucagcaaaaagcaaaaucauuu

SEQ ID NO: 2266137 - RNA, 18 nt, Human
gucauugcuguugucccu

SEQ ID NO: 2266138 - RNA, 14 nt, Human
gucauuggcuuuau

SEQ ID NO: 2266139 - RNA, 17 nt, Human
gucauuggcuuuauccu

SEQ ID NO: 2266140 - RNA, 21 nt, Human
gucauuaugagaggcaaugau

SEQ ID NO: 2266141 - RNA, 22 nt, Human
gucauuauagaucccccagacu

SEQ ID NO: 2266142 - RNA, 19 nt, Human
gucauuauccuugcuauga

SEQ ID NO: 2266143 - RNA, 13 nt, Human
gucauuagccuga

SEQ ID NO: 2266144 - RNA, 16 nt, Human
gucauuagacuccucc

SEQ ID NO: 2266145 - RNA, 19 nt, Human
gucauuagccugaguagaa

SEQ ID NO: 2266146 - RNA, 21 nt, Human
gucauuagccugaguagaaag

SEQ ID NO: 2266147 - RNA, 15 nt, Human
gucauucaauaaauu

SEQ ID NO: 2266148 - RNA, 14 nt, Human
gucauucagaaaaa

SEQ ID NO: 2266149 - RNA, 16 nt, Human
gucauucguucugugg

SEQ ID NO: 2266150 - RNA, 17 nt, Human
gucagcuacuaaugaug

SEQ ID NO: 2266151 - RNA, 16 nt, Human
gucagcucccuucucu

SEQ ID NO: 2266152 - RNA, 23 nt, Human
gucagcuccccucggagaagagc

SEQ ID NO: 2266153 - RNA, 22 nt, Human
gucagcuccccucggagaagag

SEQ ID NO: 2266154 - RNA, 21 nt, Human
gucagcuccccucggagaaga

SEQ ID NO: 2266155 - RNA, 22 nt, Human
gucauuaaaauaaauaaaugca

SEQ ID NO: 2266156 - RNA, 18 nt, Human
gucagcuuugccuuccac

SEQ ID NO: 2266157 - RNA, 14 nt, Human
gucauuaaaauaaa

SEQ ID NO: 2266158 - RNA, 12 nt, Human
gucauuaaaggu

SEQ ID NO: 2266159 - RNA, 11 nt, Human
gucauuaaaug

SEQ ID NO: 2266160 - RNA, 23 nt, Human
gucagcuuugccuuccacgcugu

SEQ ID NO: 2266161 - RNA, 17 nt, Human
gucagcuuugccuucca

SEQ ID NO: 2266162 - RNA, 16 nt, Human
gucagcuuugccuucc

SEQ ID NO: 2266163 - RNA, 20 nt, Human
gucagcuugcugcccuaggc

SEQ ID NO: 2266164 - RNA, 16 nt, Human
gucagcuugcugcccu

SEQ ID NO: 2266165 - RNA, 15 nt, Human
gucagcucccuucuc

SEQ ID NO: 2266166 - RNA, 19 nt, Human
gucccuccacguucacccc

SEQ ID NO: 2266167 - RNA, 20 nt, Human
gucccuccacguucaccccu

SEQ ID NO: 2266168 - RNA, 21 nt, Human
gucccuccacguucaccccuc

SEQ ID NO: 2266169 - RNA, 23 nt, Human
gucccucaaaugacccaaagacc

SEQ ID NO: 2266170 - RNA, 12 nt, Human
gucccucccacc

SEQ ID NO: 2266171 - RNA, 15 nt, Human
gucccuaugcauauc

SEQ ID NO: 2266172 - RNA, 22 nt, Human
gucccuauguauuugcaguuca

SEQ ID NO: 2266173 - RNA, 20 nt, Human
gucccucaaaugacccaaag

SEQ ID NO: 2266174 - RNA, 23 nt, Human
gucccuccgggaccuggugcugc

SEQ ID NO: 2266175 - RNA, 21 nt, Human
gucccucccaccucugugacc

SEQ ID NO: 2266176 - RNA, 12 nt, Human
gucccuccuggg

SEQ ID NO: 2266177 - RNA, 13 nt, Human
gucccuccuggga

SEQ ID NO: 2266178 - RNA, 14 nt, Human
gucccuccugggau

SEQ ID NO: 2266179 - RNA, 21 nt, Human
gucccuccugggaucugcucg

SEQ ID NO: 2266180 - RNA, 16 nt, Human
gucccucccccuuguc

SEQ ID NO: 2266181 - RNA, 17 nt, Human
gucccucccaccucugu

SEQ ID NO: 2266182 - RNA, 18 nt, Human
gucccucccaccucugug

SEQ ID NO: 2266183 - RNA, 13 nt, Human
gucccucccaccu

SEQ ID NO: 2266184 - RNA, 14 nt, Human
gucccucccaccuc

SEQ ID NO: 2266185 - RNA, 15 nt, Human
gucccucccaccucu

SEQ ID NO: 2266186 - RNA, 16 nt, Human
gucccucccaccucug

SEQ ID NO: 2266187 - RNA, 21 nt, Human
gucccuacaccccuccccugc

SEQ ID NO: 2266188 - RNA, 16 nt, Human
gucccuacaccccucc

SEQ ID NO: 2266189 - RNA, 21 nt, Human
gucccuaccgagucucuucuc

SEQ ID NO: 2266190 - RNA, 22 nt, Human
gucccuaccgagucucuucucc

SEQ ID NO: 2266191 - RNA, 23 nt, Human
gucccuaccgagucucuucucca

SEQ ID NO: 2266192 - RNA, 18 nt, Human
gucccuaauaaagcugug

SEQ ID NO: 2266193 - RNA, 20 nt, Human
gucccuaauaaagcugugug

SEQ ID NO: 2266194 - RNA, 14 nt, Human
gucccucucaggca

SEQ ID NO: 2266195 - RNA, 13 nt, Human
gucccucucaggc

SEQ ID NO: 2266196 - RNA, 21 nt, Human
gucccucucggaaggcuggcu

SEQ ID NO: 2266197 - RNA, 16 nt, Human
gucccucucaggcaug

SEQ ID NO: 2266198 - RNA, 14 nt, Human
gucccucugcccca

SEQ ID NO: 2266199 - RNA, 11 nt, Human
gucccucugcc

SEQ ID NO: 2266200 - RNA, 21 nt, Human
gucccucugccccauccucca

SEQ ID NO: 2266201 - RNA, 20 nt, Human
gucccucugccccauccucc

SEQ ID NO: 2266202 - RNA, 11 nt, Human
gucccucugug

SEQ ID NO: 2266203 - RNA, 12 nt, Human
gucccucugugu

SEQ ID NO: 2266204 - RNA, 13 nt, Human
gucccucugugua

SEQ ID NO: 2266205 - RNA, 18 nt, Human
gucccugacucucuguga

SEQ ID NO: 2266206 - RNA, 17 nt, Human
gucccugacucucugug

SEQ ID NO: 2266207 - RNA, 18 nt, Human
gucccugaggcagguccc

SEQ ID NO: 2266208 - RNA, 16 nt, Human
gucccugaagagaagg

SEQ ID NO: 2266209 - RNA, 14 nt, Human
gucccucuguguau

SEQ ID NO: 2266210 - RNA, 22 nt, Human
gucccucuguguauuugcuuuu

SEQ ID NO: 2266211 - RNA, 20 nt, Human
gucccugacucucugugacc

SEQ ID NO: 2266212 - RNA, 22 nt, Human
gucccugaggcagguccccaga

SEQ ID NO: 2266213 - RNA, 16 nt, Human
gucccugcacuugcag

SEQ ID NO: 2266214 - RNA, 19 nt, Human
gucccugcacuugcagacu

SEQ ID NO: 2266215 - RNA, 21 nt, Human
gucccugcacuugcagacucu

SEQ ID NO: 2266216 - RNA, 20 nt, Human
gucccaccuuggcugcaggg

SEQ ID NO: 2266217 - RNA, 22 nt, Human
gucccacgaauuugcuggggaa

SEQ ID NO: 2266218 - RNA, 23 nt, Human
gucccaccuuggcugcagggagu

SEQ ID NO: 2266219 - RNA, 12 nt, Human
gucccaggcaga

SEQ ID NO: 2266220 - RNA, 20 nt, Human
gucccacgaauuugcugggg

SEQ ID NO: 2266221 - RNA, 17 nt, Human
gucccacuaucugggug

SEQ ID NO: 2266222 - RNA, 15 nt, Human
gucccaggcugagcc

SEQ ID NO: 2266223 - RNA, 17 nt, Human
gucccaggcugagccuc

SEQ ID NO: 2266224 - RNA, 16 nt, Human
gucccaggcugagccu

SEQ ID NO: 2266225 - RNA, 19 nt, Human
gucccaggcugagccucag

SEQ ID NO: 2266226 - RNA, 18 nt, Human
gucccaggcugagccuca

SEQ ID NO: 2266227 - RNA, 21 nt, Human
gucccaggcugagccucaguc

SEQ ID NO: 2266228 - RNA, 14 nt, Human
gucccauauccugc

SEQ ID NO: 2266229 - RNA, 20 nt, Human
gucccaggagcugcccagag

SEQ ID NO: 2266230 - RNA, 16 nt, Human
gucccaugacccaccc

SEQ ID NO: 2266231 - RNA, 17 nt, Human
gucccaugacccacccc

SEQ ID NO: 2266232 - RNA, 18 nt, Human
gucccaugacccaccccu

SEQ ID NO: 2266233 - RNA, 19 nt, Human
gucccaugacccaccccug

SEQ ID NO: 2266234 - RNA, 20 nt, Human
gucccaugacccaccccugu

SEQ ID NO: 2266235 - RNA, 22 nt, Human
gucccaugacccaccccugugc

SEQ ID NO: 2266236 - RNA, 23 nt, Human
gucccaugacccaccccugugcu

SEQ ID NO: 2266237 - RNA, 15 nt, Human
gucccauauccugcc

SEQ ID NO: 2266238 - RNA, 16 nt, Human
gucccauauccugccu

SEQ ID NO: 2266239 - RNA, 18 nt, Human
gucccauauccugccuca

SEQ ID NO: 2266240 - RNA, 13 nt, Human
gucccauccaggc

SEQ ID NO: 2266241 - RNA, 14 nt, Human
gucccauccaggca

SEQ ID NO: 2266242 - RNA, 15 nt, Human
gucccauccaggcag

SEQ ID NO: 2266243 - RNA, 16 nt, Human
gucccauccaggcagu

SEQ ID NO: 2266244 - RNA, 17 nt, Human
gucccauccaggcaguc

SEQ ID NO: 2266245 - RNA, 23 nt, Human
gucccauggacacuccagugcca

SEQ ID NO: 2266246 - RNA, 17 nt, Human
gucccaugaucccugug

SEQ ID NO: 2266247 - RNA, 21 nt, Human
gucccauggacacuccagugc

SEQ ID NO: 2266248 - RNA, 22 nt, Human
gucccauggacacuccagugcc

SEQ ID NO: 2266249 - RNA, 13 nt, Human
gucccauguggug

SEQ ID NO: 2266250 - RNA, 24 nt, Human
guccccacacuccuacaccuaacu

SEQ ID NO: 2266251 - RNA, 21 nt, Human
guccccaagauucacaccuga

SEQ ID NO: 2266252 - RNA, 11 nt, Human
guccccacacu

SEQ ID NO: 2266253 - RNA, 12 nt, Human
guccccacacuc

SEQ ID NO: 2266254 - RNA, 22 nt, Human
guccccaaauccgaaccuccuc

SEQ ID NO: 2266255 - RNA, 18 nt, Human
guccccaaaccugcaagg

SEQ ID NO: 2266256 - RNA, 17 nt, Human
guccccaaaccugcaag

SEQ ID NO: 2266257 - RNA, 16 nt, Human
gucccauuucucacug

SEQ ID NO: 2266258 - RNA, 18 nt, Human
gucccauuucucacugag

SEQ ID NO: 2266259 - RNA, 16 nt, Human
gucccuaauaaagcug

SEQ ID NO: 2266260 - RNA, 17 nt, Human
gucccuaauaaagcugu

SEQ ID NO: 2266261 - RNA, 12 nt, Human
guccccaccccu

SEQ ID NO: 2266262 - RNA, 14 nt, Human
guccccaccccugc

SEQ ID NO: 2266263 - RNA, 15 nt, Human
guccccaccccugcc

SEQ ID NO: 2266264 - RNA, 16 nt, Human
guccccaccccugccc

SEQ ID NO: 2266265 - RNA, 17 nt, Human
guccccaccccugcccc

SEQ ID NO: 2266266 - RNA, 17 nt, Human
guccccaccgcagacag

SEQ ID NO: 2266267 - RNA, 23 nt, Human
guagauguucagauugcuuugau

SEQ ID NO: 2266268 - RNA, 21 nt, Human
guagaugugcauuuuugugaa

SEQ ID NO: 2266269 - RNA, 21 nt, Human
guagaugggagggaggcucag

SEQ ID NO: 2266270 - RNA, 17 nt, Human
guagaugggagggaggc

SEQ ID NO: 2266271 - RNA, 17 nt, Human
guagaucagagcagcag

SEQ ID NO: 2266272 - RNA, 21 nt, Human
guagaugaaaaagcauguaca

SEQ ID NO: 2266273 - RNA, 22 nt, Human
guagaugaaaaagcauguacag

SEQ ID NO: 2266274 - RNA, 23 nt, Human
guagaugaaaaagcauguacagu

SEQ ID NO: 2266275 - RNA, 13 nt, Human
guagauagaaaua

SEQ ID NO: 2266276 - RNA, 19 nt, Human
guagauauuuuuucugaau

SEQ ID NO: 2266277 - RNA, 17 nt, Human
guagaucaccagaauaa

SEQ ID NO: 2266278 - RNA, 19 nt, Human
guagaucaccagaauaaac

SEQ ID NO: 2266279 - RNA, 17 nt, Human
guagaucaguggucucc

SEQ ID NO: 2266280 - RNA, 12 nt, Human
guagauagaaau

SEQ ID NO: 2266281 - RNA, 20 nt, Human
guagaguuugaaggagguga

SEQ ID NO: 2266282 - RNA, 14 nt, Human
guagauagaaauaa

SEQ ID NO: 2266283 - RNA, 15 nt, Human
guagagugugccuga

SEQ ID NO: 2266284 - RNA, 18 nt, Human
gcuauaggugcuacaaaa

SEQ ID NO: 2266285 - RNA, 19 nt, Human
gcuauaggcuggagaagcu

SEQ ID NO: 2266286 - RNA, 12 nt, Human
guagaguuaaga

SEQ ID NO: 2266287 - RNA, 14 nt, Human
guagaguuaagaag

SEQ ID NO: 2266288 - RNA, 15 nt, Human
guagaguuaagaagc

SEQ ID NO: 2266289 - RNA, 16 nt, Human
guagaguuaagaagcu

SEQ ID NO: 2266290 - RNA, 17 nt, Human
guagaguuaagaagcug

SEQ ID NO: 2266291 - RNA, 18 nt, Human
guagaguuaagaagcugu

SEQ ID NO: 2266292 - RNA, 13 nt, Human
guagcacuuacug

SEQ ID NO: 2266293 - RNA, 11 nt, Human
guagcagcugg

SEQ ID NO: 2266294 - RNA, 12 nt, Human
guagcagcugga

SEQ ID NO: 2266295 - RNA, 13 nt, Human
guagcagcuggac

SEQ ID NO: 2266296 - RNA, 14 nt, Human
guagcagcuggacu

SEQ ID NO: 2266297 - RNA, 15 nt, Human
guagcaguagaugca

SEQ ID NO: 2266298 - RNA, 17 nt, Human
guagcagguaccacuga

SEQ ID NO: 2266299 - RNA, 15 nt, Human
guagcagggaaaaua

SEQ ID NO: 2266300 - RNA, 20 nt, Human
guagcaaguucuagagaaga

SEQ ID NO: 2266301 - RNA, 21 nt, Human
guagcaaguucuagagaagag

SEQ ID NO: 2266302 - RNA, 16 nt, Human
guagauuuauuucauc

SEQ ID NO: 2266303 - RNA, 12 nt, Human
guagauuuauuu

SEQ ID NO: 2266304 - RNA, 19 nt, Human
guagauucuguggaacaag

SEQ ID NO: 2266305 - RNA, 13 nt, Human
guagauucugugg

SEQ ID NO: 2266306 - RNA, 16 nt, Human
guagauucuguggaac

SEQ ID NO: 2266307 - RNA, 21 nt, Human
guagauuuuaaaaguuauuaa

SEQ ID NO: 2266308 - RNA, 21 nt, Human
guagauuuauuucaucauauu

SEQ ID NO: 2266309 - RNA, 19 nt, Human
guagauuuauuucaucaua

SEQ ID NO: 2266310 - RNA, 16 nt, Human
guagauuuucuuuaaa

SEQ ID NO: 2266311 - RNA, 14 nt, Human
guagauuuuccaaa

SEQ ID NO: 2266312 - RNA, 13 nt, Human
guagauuuucuuu

SEQ ID NO: 2266313 - RNA, 15 nt, Human
guagauuuucuuuaa

SEQ ID NO: 2266314 - RNA, 13 nt, Human
guagcauuucauu

SEQ ID NO: 2266315 - RNA, 15 nt, Human
guagcauuucauucu

SEQ ID NO: 2266316 - RNA, 12 nt, Human
guagcaugagag

SEQ ID NO: 2266317 - RNA, 16 nt, Human
guagcaucuucuggag

SEQ ID NO: 2266318 - RNA, 13 nt, Human
guagcauacauuu

SEQ ID NO: 2266319 - RNA, 18 nt, Human
guagcagguaccacugau

SEQ ID NO: 2266320 - RNA, 15 nt, Human
guagcauuacagugg

SEQ ID NO: 2266321 - RNA, 21 nt, Human
guagcauguugagccaggccu

SEQ ID NO: 2266322 - RNA, 19 nt, Human
guagccaaggugggcugag

SEQ ID NO: 2266323 - RNA, 18 nt, Human
guagccaaggugggcuga

SEQ ID NO: 2266324 - RNA, 17 nt, Human
guagcauuucauucuuc

SEQ ID NO: 2266325 - RNA, 19 nt, Human
guagcauuucauucuucuc

SEQ ID NO: 2266326 - RNA, 14 nt, Human
guagccaaagguuc

SEQ ID NO: 2266327 - RNA, 18 nt, Human
guagccagcacacagggc

SEQ ID NO: 2266328 - RNA, 15 nt, Human
guagccagcacacag

SEQ ID NO: 2266329 - RNA, 20 nt, Human
guagcccacucugcucgccu

SEQ ID NO: 2266330 - RNA, 16 nt, Human
guagcccacucugcuc

SEQ ID NO: 2266331 - RNA, 15 nt, Human
guagccaugggacca

SEQ ID NO: 2266332 - RNA, 21 nt, Human
guagcccacacuugagaggau

SEQ ID NO: 2266333 - RNA, 17 nt, Human
guagcccccuggccucu

SEQ ID NO: 2266334 - RNA, 16 nt, Human
guagcccccuggccuc

SEQ ID NO: 2266335 - RNA, 21 nt, Human
guagccagcacacagggcagu

SEQ ID NO: 2266336 - RNA, 19 nt, Human
guagccagcacacagggca

SEQ ID NO: 2266337 - RNA, 19 nt, Human
guagccagggggacuagcc

SEQ ID NO: 2266338 - RNA, 22 nt, Human
guagccagggggacuagccccu

SEQ ID NO: 2266339 - RNA, 23 nt, Human
guagccaggguguggcccugcca

SEQ ID NO: 2266340 - RNA, 23 nt, Human
guagccagggggacuagccccug

SEQ ID NO: 2266341 - RNA, 20 nt, Human
guagccaucccaugaacaca

SEQ ID NO: 2266342 - RNA, 23 nt, Human
guagccaucccaugaacacacug

SEQ ID NO: 2266343 - RNA, 14 nt, Human
guagccaugggacc

SEQ ID NO: 2266344 - RNA, 23 nt, Human
guagggcgggaggauguucuggg

SEQ ID NO: 2266345 - RNA, 21 nt, Human
guagggcugccaccaagguga

SEQ ID NO: 2266346 - RNA, 12 nt, Human
guagggcugacu

SEQ ID NO: 2266347 - RNA, 13 nt, Human
guagggagggcgg

SEQ ID NO: 2266348 - RNA, 21 nt, Human
guagggcgggaggauguucug

SEQ ID NO: 2266349 - RNA, 22 nt, Human
guagggcgggaggauguucugg

SEQ ID NO: 2266350 - RNA, 15 nt, Human
guagcccgccugcca

SEQ ID NO: 2266351 - RNA, 23 nt, Human
guagcccccuggccucugugccu

SEQ ID NO: 2266352 - RNA, 19 nt, Human
guagcccccuggccucugu

SEQ ID NO: 2266353 - RNA, 18 nt, Human
guagcccccuggccucug

SEQ ID NO: 2266354 - RNA, 15 nt, Human
guagggaacucuggg

SEQ ID NO: 2266355 - RNA, 17 nt, Human
guaggcucaacuaggga

SEQ ID NO: 2266356 - RNA, 19 nt, Human
guaggcucaacuagggagu

SEQ ID NO: 2266357 - RNA, 23 nt, Human
guaggcuccugccaguguggaac

SEQ ID NO: 2266358 - RNA, 16 nt, Human
guagggcgggaggaug

SEQ ID NO: 2266359 - RNA, 17 nt, Human
guagucaagauuguguu

SEQ ID NO: 2266360 - RNA, 13 nt, Human
guagucccagcua

SEQ ID NO: 2266361 - RNA, 12 nt, Human
guagucccagcu

SEQ ID NO: 2266362 - RNA, 22 nt, Human
guaguccucauaaaaagcaaaa

SEQ ID NO: 2266363 - RNA, 12 nt, Human
guaguccuguga

SEQ ID NO: 2266364 - RNA, 23 nt, Human
guaguccgugcugacagcugcuc

SEQ ID NO: 2266365 - RNA, 22 nt, Human
guaguccgugcugacagcugcu

SEQ ID NO: 2266366 - RNA, 16 nt, Human
guaguccgugcugaca

SEQ ID NO: 2266367 - RNA, 12 nt, Human
guagucccagcc

SEQ ID NO: 2266368 - RNA, 18 nt, Human
guagucucauuacuuuug

SEQ ID NO: 2266369 - RNA, 12 nt, Human
guagucuugaug

SEQ ID NO: 2266370 - RNA, 14 nt, Human
guagucucugugcu

SEQ ID NO: 2266371 - RNA, 14 nt, Human
guagugagauagca

SEQ ID NO: 2266372 - RNA, 16 nt, Human
guagucuugaugacca

SEQ ID NO: 2266373 - RNA, 14 nt, Human
guaguguuggagaa

SEQ ID NO: 2266374 - RNA, 15 nt, Human
guaguguuggagaag

SEQ ID NO: 2266375 - RNA, 12 nt, Human
guauacaugcca

SEQ ID NO: 2266376 - RNA, 21 nt, Human
guauacaguggauuaauuaaa

SEQ ID NO: 2266377 - RNA, 15 nt, Human
guauacuguaggcac

SEQ ID NO: 2266378 - RNA, 15 nt, Human
guauaccugauuuuu

SEQ ID NO: 2266379 - RNA, 22 nt, Human
guauaauuuuuuaaaguuacuu

SEQ ID NO: 2266380 - RNA, 19 nt, Human
guauacaacccuggcauua

SEQ ID NO: 2266381 - RNA, 18 nt, Human
guauaauuguaucguaua

SEQ ID NO: 2266382 - RNA, 17 nt, Human
guauaauucacauugua

SEQ ID NO: 2266383 - RNA, 21 nt, Human
guagggucaggccacggcagc

SEQ ID NO: 2266384 - RNA, 22 nt, Human
guagggucaggccacggcagcc

SEQ ID NO: 2266385 - RNA, 14 nt, Human
guagggugggccuu

SEQ ID NO: 2266386 - RNA, 17 nt, Human
guaggguaaggugccuu

SEQ ID NO: 2266387 - RNA, 22 nt, Human
guaggguaauuaguaacaugug

SEQ ID NO: 2266388 - RNA, 15 nt, Human
guaggggugugugug

SEQ ID NO: 2266389 - RNA, 20 nt, Human
guaggggucaaagaaaugcu

SEQ ID NO: 2266390 - RNA, 22 nt, Human
guaggggagggguugccacagg

SEQ ID NO: 2266391 - RNA, 23 nt, Human
guagguaucauuuucugcauuua

SEQ ID NO: 2266392 - RNA, 15 nt, Human
guagguucagccaag

SEQ ID NO: 2266393 - RNA, 16 nt, Human
guagguucagccaagg

SEQ ID NO: 2266394 - RNA, 23 nt, Human
guaggguuuaauccccaguaaaa

SEQ ID NO: 2266395 - RNA, 16 nt, Human
guaggguuauaauaau

SEQ ID NO: 2266396 - RNA, 22 nt, Human
guagggugggccuucagggagu

SEQ ID NO: 2266397 - RNA, 17 nt, Human
guagggugggccuucag

SEQ ID NO: 2266398 - RNA, 18 nt, Human
guaguagggucaggccac

SEQ ID NO: 2266399 - RNA, 16 nt, Human
guaguauaaagaaaag

SEQ ID NO: 2266400 - RNA, 22 nt, Human
guaguagucucauuacuuuuga

SEQ ID NO: 2266401 - RNA, 14 nt, Human
guaguaucaaauau

SEQ ID NO: 2266402 - RNA, 13 nt, Human
guaguaugauggg

SEQ ID NO: 2266403 - RNA, 14 nt, Human
guagucaggugccu

SEQ ID NO: 2266404 - RNA, 22 nt, Human
guaguacuccugcaaaauuuua

SEQ ID NO: 2266405 - RNA, 17 nt, Human
guaguagcccuuucugu

SEQ ID NO: 2266406 - RNA, 20 nt, Human
guaguagcccuuucugugug

SEQ ID NO: 2266407 - RNA, 21 nt, Human
guaguagcccuuucugugugc

SEQ ID NO: 2266408 - RNA, 21 nt, Human
guaguacuccugcaaaauuuu

SEQ ID NO: 2266409 - RNA, 19 nt, Human
guaguaccaaaugcuuuaa

SEQ ID NO: 2266410 - RNA, 15 nt, Human
guaguaauugacaug

SEQ ID NO: 2266411 - RNA, 16 nt, Human
guaguaccaaaugcuu

SEQ ID NO: 2266412 - RNA, 14 nt, Human
guagguugggagaa

SEQ ID NO: 2266413 - RNA, 17 nt, Human
guagguucagccaaggu

SEQ ID NO: 2266414 - RNA, 20 nt, Human
guagguuggaagcuagcucc

SEQ ID NO: 2266415 - RNA, 19 nt, Human
guaguaaaaauuaaaaaaa

SEQ ID NO: 2266416 - RNA, 23 nt, Human
guauguuuuuguguauuuguuaa

SEQ ID NO: 2266417 - RNA, 15 nt, Human
guauuaaaaaaaaca

SEQ ID NO: 2266418 - RNA, 19 nt, Human
guauguuuuuguguauuug

SEQ ID NO: 2266419 - RNA, 22 nt, Human
guauuaaaaaaaacaaaaagaa

SEQ ID NO: 2266420 - RNA, 19 nt, Human
guauuaaaaaaaacaaaaa

SEQ ID NO: 2266421 - RNA, 13 nt, Human
guauuaaagacag

SEQ ID NO: 2266422 - RNA, 18 nt, Human
guauuaagaaaaucuauu

SEQ ID NO: 2266423 - RNA, 18 nt, Human
guauguuguccaauuguu

SEQ ID NO: 2266424 - RNA, 21 nt, Human
guauguuguccaauuguugac

SEQ ID NO: 2266425 - RNA, 14 nt, Human
guauguuugcacac

SEQ ID NO: 2266426 - RNA, 16 nt, Human
guauguuuuagcaugu

SEQ ID NO: 2266427 - RNA, 14 nt, Human
guauguuuuagcau

SEQ ID NO: 2266428 - RNA, 21 nt, Human
guauguuugcacacuugugug

SEQ ID NO: 2266429 - RNA, 16 nt, Human
guauguguuugugugu

SEQ ID NO: 2266430 - RNA, 17 nt, Human
guauguguuugugugug

SEQ ID NO: 2266431 - RNA, 18 nt, Human
guauguuaagcucuuuau

SEQ ID NO: 2266432 - RNA, 17 nt, Human
guauguugaagccuuug

SEQ ID NO: 2266433 - RNA, 13 nt, Human
guauguugucaaa

SEQ ID NO: 2266434 - RNA, 16 nt, Human
guauguugucaaagag

SEQ ID NO: 2266435 - RNA, 17 nt, Human
guauguugucaaagaga

SEQ ID NO: 2266436 - RNA, 11 nt, Human
guauguugucc

SEQ ID NO: 2266437 - RNA, 21 nt, Human
guaugaucacggcucacugca

SEQ ID NO: 2266438 - RNA, 14 nt, Human
guauguguguaugg

SEQ ID NO: 2266439 - RNA, 13 nt, Human
guauguguguaga

SEQ ID NO: 2266440 - RNA, 15 nt, Human
guauguguguguaug

SEQ ID NO: 2266441 - RNA, 18 nt, Human
guauguguguguaugcua

SEQ ID NO: 2266442 - RNA, 16 nt, Human
guauguguguguaugc

SEQ ID NO: 2266443 - RNA, 17 nt, Human
guauguuagugcaaauu

SEQ ID NO: 2266444 - RNA, 20 nt, Human
guaugaucacggcucacugc

SEQ ID NO: 2266445 - RNA, 21 nt, Human
guaugagucaaugugcagugu

SEQ ID NO: 2266446 - RNA, 14 nt, Human
guaugagcugaggg

SEQ ID NO: 2266447 - RNA, 20 nt, Human
guaugagucaaugugcagug

SEQ ID NO: 2266448 - RNA, 20 nt, Human
guaugaggcauuuguuugaa

SEQ ID NO: 2266449 - RNA, 17 nt, Human
guaugaggcauuuguuu

SEQ ID NO: 2266450 - RNA, 14 nt, Human
guaucugggaacug

SEQ ID NO: 2266451 - RNA, 16 nt, Human
guaucuguaucucucu

SEQ ID NO: 2266452 - RNA, 18 nt, Human
guaucugcaggcagacac

SEQ ID NO: 2266453 - RNA, 19 nt, Human
guaucugcaggcagacacg

SEQ ID NO: 2266454 - RNA, 16 nt, Human
guaucugcaggcagac

SEQ ID NO: 2266455 - RNA, 17 nt, Human
guaucugcaggcagaca

SEQ ID NO: 2266456 - RNA, 19 nt, Human
guaucuggugacuuuccuc

SEQ ID NO: 2266457 - RNA, 12 nt, Human
guaucugagcag

SEQ ID NO: 2266458 - RNA, 12 nt, Human
guaucuggugac

SEQ ID NO: 2266459 - RNA, 22 nt, Human
guaugaaagauggcugugccuc

SEQ ID NO: 2266460 - RNA, 23 nt, Human
guaugaaagauggcugugccucu

SEQ ID NO: 2266461 - RNA, 16 nt, Human
guaucuuuuuucaaaa

SEQ ID NO: 2266462 - RNA, 23 nt, Human
guaucuuguuuuuccacuacugc

SEQ ID NO: 2266463 - RNA, 21 nt, Human
guaucuugggggacagggcug

SEQ ID NO: 2266464 - RNA, 15 nt, Human
guaucuguucuuuaa

SEQ ID NO: 2266465 - RNA, 14 nt, Human
guaucuucauguau

SEQ ID NO: 2266466 - RNA, 20 nt, Human
guaugacuaaagagagaaug

SEQ ID NO: 2266467 - RNA, 12 nt, Human
guaugagcugag

SEQ ID NO: 2266468 - RNA, 18 nt, Human
guaugacuaaagagagaa

SEQ ID NO: 2266469 - RNA, 14 nt, Human
guaugacuaaagag

SEQ ID NO: 2266470 - RNA, 15 nt, Human
guaugaaugcagugg

SEQ ID NO: 2266471 - RNA, 21 nt, Human
guaugaaucuaugccaaagau

SEQ ID NO: 2266472 - RNA, 16 nt, Human
guaugaaucuaugcca

SEQ ID NO: 2266473 - RNA, 20 nt, Human
guaugaaucuaugccaaaga

SEQ ID NO: 2266474 - RNA, 15 nt, Human
guaugaaucuaugcc

SEQ ID NO: 2266475 - RNA, 15 nt, Human
guaugaggcauuugu

SEQ ID NO: 2266476 - RNA, 13 nt, Human
guaugaggcauuu

SEQ ID NO: 2266477 - RNA, 18 nt, Human
guaugaauaaagacaccu

SEQ ID NO: 2266478 - RNA, 19 nt, Human
guaugaauaaagacaccua

SEQ ID NO: 2266479 - RNA, 14 nt, Human
guaucuagcaauca

SEQ ID NO: 2266480 - RNA, 13 nt, Human
guaucuagugcag

SEQ ID NO: 2266481 - RNA, 17 nt, Human
guaucuagugcagcuga

SEQ ID NO: 2266482 - RNA, 16 nt, Human
guaucuagugcagcug

SEQ ID NO: 2266483 - RNA, 15 nt, Human
guaucuagugcagcu

SEQ ID NO: 2266484 - RNA, 24 nt, Human
guaucuagcaaucacaacacuggc

SEQ ID NO: 2266485 - RNA, 20 nt, Human
guaucuagacccaucuucuu

SEQ ID NO: 2266486 - RNA, 16 nt, Human
guaucguaaccagcca

SEQ ID NO: 2266487 - RNA, 17 nt, Human
guaucguaaccagccag

SEQ ID NO: 2266488 - RNA, 15 nt, Human
guaucguauagcugu

SEQ ID NO: 2266489 - RNA, 16 nt, Human
guaucguauagcugua

SEQ ID NO: 2266490 - RNA, 17 nt, Human
guaucggagacagugau

SEQ ID NO: 2266491 - RNA, 15 nt, Human
guaucguaaccagcc

SEQ ID NO: 2266492 - RNA, 15 nt, Human
guaucggagacagug

SEQ ID NO: 2266493 - RNA, 14 nt, Human
guaucggagacagu

SEQ ID NO: 2266494 - RNA, 15 nt, Human
guaucgauguuaugu

SEQ ID NO: 2266495 - RNA, 20 nt, Human
guauccugugacauguaaca

SEQ ID NO: 2266496 - RNA, 18 nt, Human
guauccugggggacccaa

SEQ ID NO: 2266497 - RNA, 15 nt, Human
guaucuccucgcaag

SEQ ID NO: 2266498 - RNA, 20 nt, Human
guaucucggaccuuucagcu

SEQ ID NO: 2266499 - RNA, 17 nt, Human
guaucucugaagcaugu

SEQ ID NO: 2266500 - RNA, 19 nt, Human
guaucucugaagcauguuu

SEQ ID NO: 2266501 - RNA, 20 nt, Human
guaucucugaagcauguuuc

SEQ ID NO: 2266502 - RNA, 11 nt, Human
guaucugaagg

SEQ ID NO: 2266503 - RNA, 14 nt, Human
guaucugaaggaga

SEQ ID NO: 2266504 - RNA, 18 nt, Human
guaucuagugcagcugau

SEQ ID NO: 2266505 - RNA, 20 nt, Human
guaucuauauauguguaugu

SEQ ID NO: 2266506 - RNA, 17 nt, Human
guaucuaugcauuuucu

SEQ ID NO: 2266507 - RNA, 14 nt, Human
guaucuccaggauu

SEQ ID NO: 2266508 - RNA, 13 nt, Human
guaucuccaggau

SEQ ID NO: 2266509 - RNA, 14 nt, Human
guauaucagaaaag

SEQ ID NO: 2266510 - RNA, 19 nt, Human
guauaucagaaaagggaag

SEQ ID NO: 2266511 - RNA, 17 nt, Human
guauaucuggacaagcc

SEQ ID NO: 2266512 - RNA, 22 nt, Human
guauaugucaagccauaauugu

SEQ ID NO: 2266513 - RNA, 18 nt, Human
guauaucuggacaagcca

SEQ ID NO: 2266514 - RNA, 21 nt, Human
guauaucuggacaagccaacu

SEQ ID NO: 2266515 - RNA, 17 nt, Human
guauauguaugugugua

SEQ ID NO: 2266516 - RNA, 16 nt, Human
guauauguaugugugu

SEQ ID NO: 2266517 - RNA, 13 nt, Human
guauccuggggcu

SEQ ID NO: 2266518 - RNA, 17 nt, Human
guauccuggggcucccu

SEQ ID NO: 2266519 - RNA, 23 nt, Human
guauccuccagguuuuucaauua

SEQ ID NO: 2266520 - RNA, 13 nt, Human
guauaugucucag

SEQ ID NO: 2266521 - RNA, 15 nt, Human
guauaugucucaggu

SEQ ID NO: 2266522 - RNA, 21 nt, Human
guauaugucucaggucccugc

SEQ ID NO: 2266523 - RNA, 16 nt, Human
guauauguugggugca

SEQ ID NO: 2266524 - RNA, 15 nt, Human
guauauagcccagcc

SEQ ID NO: 2266525 - RNA, 12 nt, Human
guauauacuuuu

SEQ ID NO: 2266526 - RNA, 20 nt, Human
guauauaaugguuucaaaga

SEQ ID NO: 2266527 - RNA, 14 nt, Human
guauauauagaauc

SEQ ID NO: 2266528 - RNA, 13 nt, Human
guauauacuuuuu

SEQ ID NO: 2266529 - RNA, 21 nt, Human
guauauauaugccaugaugga

SEQ ID NO: 2266530 - RNA, 20 nt, Human
guauauauaugccaugaugg

SEQ ID NO: 2266531 - RNA, 12 nt, Human
guauauaugugu

SEQ ID NO: 2266532 - RNA, 22 nt, Human
guauauaucugcuucaguggag

SEQ ID NO: 2266533 - RNA, 13 nt, Human
guauauaugugug

SEQ ID NO: 2266534 - RNA, 14 nt, Human
guauauaugugugu

SEQ ID NO: 2266535 - RNA, 16 nt, Human
guauauauguguguuu

SEQ ID NO: 2266536 - RNA, 18 nt, Human
guauauauguguguuuaa

SEQ ID NO: 2266537 - RNA, 19 nt, Human
guauauauguguguuuaaa

SEQ ID NO: 2266538 - RNA, 20 nt, Human
guauauauguguguuuaaau

SEQ ID NO: 2266539 - RNA, 13 nt, Human
guauauauuccca

SEQ ID NO: 2266540 - RNA, 14 nt, Human
guauauauucccaa

SEQ ID NO: 2266541 - RNA, 16 nt, Human
guauauacgcaucuau

SEQ ID NO: 2266542 - RNA, 22 nt, Human
guauauaaaggaaaaaagagaa

SEQ ID NO: 2266543 - RNA, 12 nt, Human
guauaguugcuu

SEQ ID NO: 2266544 - RNA, 16 nt, Human
guauaguugcuugccu

SEQ ID NO: 2266545 - RNA, 18 nt, Human
guauaguugcuugccuga

SEQ ID NO: 2266546 - RNA, 17 nt, Human
guauaguugcuugccug

SEQ ID NO: 2266547 - RNA, 16 nt, Human
guauauaaaauauuuu

SEQ ID NO: 2266548 - RNA, 18 nt, Human
guauagguagauguucag

SEQ ID NO: 2266549 - RNA, 19 nt, Human
guauaguuaggauagcauu

SEQ ID NO: 2266550 - RNA, 13 nt, Human
guauaguguaaaa

SEQ ID NO: 2266551 - RNA, 14 nt, Human
guauaguguaaaau

SEQ ID NO: 2266552 - RNA, 15 nt, Human
guauaguguaaaaua

SEQ ID NO: 2266553 - RNA, 16 nt, Human
guauaguguaaaauaa

SEQ ID NO: 2266554 - RNA, 14 nt, Human
guauagaaaugcug

SEQ ID NO: 2266555 - RNA, 15 nt, Human
guauagaaaugcugg

SEQ ID NO: 2266556 - RNA, 22 nt, Human
guauagaaaugcugguuuuuca

SEQ ID NO: 2266557 - RNA, 23 nt, Human
guauagaaaugcugguuuuucag

SEQ ID NO: 2266558 - RNA, 19 nt, Human
guauaguacuggcauggua

SEQ ID NO: 2266559 - RNA, 19 nt, Human
guauagcuguauugaauca

SEQ ID NO: 2266560 - RNA, 23 nt, Human
guauagcuguauugaaucaugua

SEQ ID NO: 2266561 - RNA, 15 nt, Human
guauagcuguauuga

SEQ ID NO: 2266562 - RNA, 16 nt, Human
guauagcuguauugaa

SEQ ID NO: 2266563 - RNA, 17 nt, Human
guauagcuguauugaau

SEQ ID NO: 2266564 - RNA, 14 nt, Human
guauagcuguauug

SEQ ID NO: 2266565 - RNA, 16 nt, Human
guauagaugcaagaua

SEQ ID NO: 2266566 - RNA, 16 nt, Human
guauagacuccugaaa

SEQ ID NO: 2266567 - RNA, 15 nt, Human
guauagagauaugca

SEQ ID NO: 2266568 - RNA, 14 nt, Human
guauagaugcaaga

SEQ ID NO: 2266569 - RNA, 18 nt, Human
guauagaugcaagauauu

SEQ ID NO: 2266570 - RNA, 21 nt, Human
uuucuucaacaucaauguuca

SEQ ID NO: 2266571 - RNA, 18 nt, Human
uuucuucaacaucaaugu

SEQ ID NO: 2266572 - RNA, 16 nt, Human
uuucuucaugcaauga

SEQ ID NO: 2266573 - RNA, 21 nt, Human
uuucuucacuguugaaaauua

SEQ ID NO: 2266574 - RNA, 14 nt, Human
uuucuucccaucac

SEQ ID NO: 2266575 - RNA, 22 nt, Human
uuucuucaugcaaugacaucuu

SEQ ID NO: 2266576 - RNA, 19 nt, Human
uuucuucaugcaaugacau

SEQ ID NO: 2266577 - RNA, 18 nt, Human
uuucuucaugcaaugaca

SEQ ID NO: 2266578 - RNA, 18 nt, Human
uuucuucccuguauuuuc

SEQ ID NO: 2266579 - RNA, 11 nt, Human
uuucuuccucu

SEQ ID NO: 2266580 - RNA, 13 nt, Human
uuucuuccucugc

SEQ ID NO: 2266581 - RNA, 12 nt, Human
uuucuucucccu

SEQ ID NO: 2266582 - RNA, 14 nt, Human
uuucuuccucugcu

SEQ ID NO: 2266583 - RNA, 16 nt, Human
uuucuuccucugcuga

SEQ ID NO: 2266584 - RNA, 12 nt, Human
uuucuucuauuu

SEQ ID NO: 2266585 - RNA, 23 nt, Human
uuucuucuguauuuuuuuuucua

SEQ ID NO: 2266586 - RNA, 13 nt, Human
uuucuucucugcu

SEQ ID NO: 2266587 - RNA, 13 nt, Human
uuucuucucccuc

SEQ ID NO: 2266588 - RNA, 17 nt, Human
uuucuuaucuucugcaa

SEQ ID NO: 2266589 - RNA, 18 nt, Human
uuucuuauuuaacuuaac

SEQ ID NO: 2266590 - RNA, 16 nt, Human
uuucuuagugccugug

SEQ ID NO: 2266591 - RNA, 17 nt, Human
uuucuuauuucauuucu

SEQ ID NO: 2266592 - RNA, 23 nt, Human
uuucuuagggaaggauacaaaag

SEQ ID NO: 2266593 - RNA, 18 nt, Human
uuucuuagggaaggauac

SEQ ID NO: 2266594 - RNA, 16 nt, Human
uuucuuaaacaaaugu

SEQ ID NO: 2266595 - RNA, 12 nt, Human
uuucuguuuucu

SEQ ID NO: 2266596 - RNA, 23 nt, Human
uuucuguugucauugcuguuguc

SEQ ID NO: 2266597 - RNA, 16 nt, Human
uuucuuaaaccuucag

SEQ ID NO: 2266598 - RNA, 19 nt, Human
uuucuuagcuuuuuaauug

SEQ ID NO: 2266599 - RNA, 20 nt, Human
uuucuuagcuuuuuaauugu

SEQ ID NO: 2266600 - RNA, 21 nt, Human
uuucuuagcuuuuuaauuguu

SEQ ID NO: 2266601 - RNA, 22 nt, Human
uuucuuagcuuuuuaauuguug

SEQ ID NO: 2266602 - RNA, 14 nt, Human
uuucuguugccaca

SEQ ID NO: 2266603 - RNA, 13 nt, Human
uuucuguugucau

SEQ ID NO: 2266604 - RNA, 17 nt, Human
uuucuguugucauugcu

SEQ ID NO: 2266605 - RNA, 18 nt, Human
uuucuguugucauugcug

SEQ ID NO: 2266606 - RNA, 18 nt, Human
uuucuguuuccuuuuuua

SEQ ID NO: 2266607 - RNA, 15 nt, Human
uuucuguugaaguuu

SEQ ID NO: 2266608 - RNA, 20 nt, Human
uuucugaccaaucacugagu

SEQ ID NO: 2266609 - RNA, 15 nt, Human
uuucuguugguguau

SEQ ID NO: 2266610 - RNA, 16 nt, Human
uuucuugcagaucaaa

SEQ ID NO: 2266611 - RNA, 23 nt, Human
uuucuugccaaugaggucugaaa

SEQ ID NO: 2266612 - RNA, 21 nt, Human
uuucuugaucaacaucuuuuc

SEQ ID NO: 2266613 - RNA, 22 nt, Human
uuucuugacucuuguuuucagu

SEQ ID NO: 2266614 - RNA, 22 nt, Human
uuucuugagguacucugcacau

SEQ ID NO: 2266615 - RNA, 12 nt, Human
uuucuucuuccc

SEQ ID NO: 2266616 - RNA, 13 nt, Human
uuucuucuucccu

SEQ ID NO: 2266617 - RNA, 14 nt, Human
uuugaacucuucaa

SEQ ID NO: 2266618 - RNA, 15 nt, Human
uuugaacugauaaag

SEQ ID NO: 2266619 - RNA, 19 nt, Human
uuugaacugauaaagauga

SEQ ID NO: 2266620 - RNA, 17 nt, Human
uuugaacugauaaagau

SEQ ID NO: 2266621 - RNA, 21 nt, Human
uuugaacucagaucugucuga

SEQ ID NO: 2266622 - RNA, 12 nt, Human
uuucuugccucu

SEQ ID NO: 2266623 - RNA, 16 nt, Human
uuugaacucagaucug

SEQ ID NO: 2266624 - RNA, 18 nt, Human
uuugaagaacaugugaga

SEQ ID NO: 2266625 - RNA, 17 nt, Human
uuugaagaacaugugag

SEQ ID NO: 2266626 - RNA, 15 nt, Human
uuugaagaggaaaau

SEQ ID NO: 2266627 - RNA, 19 nt, Human
uuugaagaaugaacaaauu

SEQ ID NO: 2266628 - RNA, 17 nt, Human
uuugaauccaugcuugg

SEQ ID NO: 2266629 - RNA, 19 nt, Human
uuugaaucaauaauauauu

SEQ ID NO: 2266630 - RNA, 16 nt, Human
uuugaaucuugucuca

SEQ ID NO: 2266631 - RNA, 18 nt, Human
uuugaaucuugucucaau

SEQ ID NO: 2266632 - RNA, 12 nt, Human
uuugaaucuugu

SEQ ID NO: 2266633 - RNA, 19 nt, Human
uuugaauccucucucugug

SEQ ID NO: 2266634 - RNA, 22 nt, Human
uuugaagaugccgcauuuggau

SEQ ID NO: 2266635 - RNA, 19 nt, Human
uuugaauauaaacacuaua

SEQ ID NO: 2266636 - RNA, 18 nt, Human
uuugaaucaucaagucuu

SEQ ID NO: 2266637 - RNA, 13 nt, Human
uuaccaagaagcc

SEQ ID NO: 2266638 - RNA, 14 nt, Human
uuaccaagaagccu

SEQ ID NO: 2266639 - RNA, 13 nt, Human
uuaccaacuuucu

SEQ ID NO: 2266640 - RNA, 20 nt, Human
uuaccaaccuguuaccuacu

SEQ ID NO: 2266641 - RNA, 14 nt, Human
uuaccaacuuucug

SEQ ID NO: 2266642 - RNA, 15 nt, Human
uuaccaacuuucugu

SEQ ID NO: 2266643 - RNA, 16 nt, Human
uuaccaacuuucugua

SEQ ID NO: 2266644 - RNA, 18 nt, Human
uuaccaacuuucuguaaa

SEQ ID NO: 2266645 - RNA, 17 nt, Human
uuaccacagacauacua

SEQ ID NO: 2266646 - RNA, 14 nt, Human
uuaccacagacaua

SEQ ID NO: 2266647 - RNA, 18 nt, Human
uuacauuuuuacaauaaa

SEQ ID NO: 2266648 - RNA, 16 nt, Human
uuacauuuuuacaaua

SEQ ID NO: 2266649 - RNA, 17 nt, Human
uuacauuuuuacaauaa

SEQ ID NO: 2266650 - RNA, 13 nt, Human
uuaccaaccuguu

SEQ ID NO: 2266651 - RNA, 12 nt, Human
uuaccaaccugu

SEQ ID NO: 2266652 - RNA, 13 nt, Human
uuacauuuuuaca

SEQ ID NO: 2266653 - RNA, 14 nt, Human
uuacauuuuuacaa

SEQ ID NO: 2266654 - RNA, 15 nt, Human
uuacauuuuuacaau

SEQ ID NO: 2266655 - RNA, 21 nt, Human
uuacauuuuuacaauaaauaa

SEQ ID NO: 2266656 - RNA, 21 nt, Human
uuuccucaggcugcuggagga

SEQ ID NO: 2266657 - RNA, 12 nt, Human
uuuccucaucug

SEQ ID NO: 2266658 - RNA, 14 nt, Human
uuuccucaucuguc

SEQ ID NO: 2266659 - RNA, 13 nt, Human
uuaccacccccac

SEQ ID NO: 2266660 - RNA, 12 nt, Human
uuaccaccccca

SEQ ID NO: 2266661 - RNA, 15 nt, Human
uuaccacccccacac

SEQ ID NO: 2266662 - RNA, 14 nt, Human
uuuccuccccagca

SEQ ID NO: 2266663 - RNA, 12 nt, Human
uuuccuccccag

SEQ ID NO: 2266664 - RNA, 19 nt, Human
uuuccucauuccugaaaga

SEQ ID NO: 2266665 - RNA, 16 nt, Human
uuuccucaucugucca

SEQ ID NO: 2266666 - RNA, 16 nt, Human
uuuccuccccagcagg

SEQ ID NO: 2266667 - RNA, 11 nt, Human
uuuccucccuu

SEQ ID NO: 2266668 - RNA, 13 nt, Human
uuuccucccucag

SEQ ID NO: 2266669 - RNA, 17 nt, Human
uuuccucccuucugcua

SEQ ID NO: 2266670 - RNA, 14 nt, Human
uuuccucccuucug

SEQ ID NO: 2266671 - RNA, 13 nt, Human
uuuccucccuucu

SEQ ID NO: 2266672 - RNA, 12 nt, Human
uuuccucccuuc

SEQ ID NO: 2266673 - RNA, 13 nt, Human
uuuccugcccugg

SEQ ID NO: 2266674 - RNA, 12 nt, Human
uuuccugcccug

SEQ ID NO: 2266675 - RNA, 16 nt, Human
uuuccugaggcugggc

SEQ ID NO: 2266676 - RNA, 17 nt, Human
uuuccugcccuuccuca

SEQ ID NO: 2266677 - RNA, 16 nt, Human
uuuccugccuucuucu

SEQ ID NO: 2266678 - RNA, 17 nt, Human
uuuccugccuucuucuu

SEQ ID NO: 2266679 - RNA, 16 nt, Human
uuuccuggacacucag

SEQ ID NO: 2266680 - RNA, 20 nt, Human
uuuccuggacacucagaccu

SEQ ID NO: 2266681 - RNA, 20 nt, Human
uuuccuggacauccucuucu

SEQ ID NO: 2266682 - RNA, 21 nt, Human
uuuccuggacauccucuucug

SEQ ID NO: 2266683 - RNA, 16 nt, Human
uuucuacuuuuaaaga

SEQ ID NO: 2266684 - RNA, 22 nt, Human
uuucuacuuugaagucauacca

SEQ ID NO: 2266685 - RNA, 18 nt, Human
uuucuacuuugaagucau

SEQ ID NO: 2266686 - RNA, 15 nt, Human
uuucuacucugaacu

SEQ ID NO: 2266687 - RNA, 17 nt, Human
uuucuacucugaacuaa

SEQ ID NO: 2266688 - RNA, 23 nt, Human
uuucuacucgaguuacagacaaa

SEQ ID NO: 2266689 - RNA, 15 nt, Human
uuucuagacuuucug

SEQ ID NO: 2266690 - RNA, 16 nt, Human
uuucuagacuuucugu

SEQ ID NO: 2266691 - RNA, 16 nt, Human
uuucuagacuugugcu

SEQ ID NO: 2266692 - RNA, 21 nt, Human
uuucuagaauuuaucacacuu

SEQ ID NO: 2266693 - RNA, 22 nt, Human
uuucuagaacaucccugccagc

SEQ ID NO: 2266694 - RNA, 20 nt, Human
uuucuagaacaucccugcca

SEQ ID NO: 2266695 - RNA, 12 nt, Human
uuucuaaaguaa

SEQ ID NO: 2266696 - RNA, 14 nt, Human
uuucuaaaguaaaa

SEQ ID NO: 2266697 - RNA, 21 nt, Human
uuucuaaaggcuaccuuugua

SEQ ID NO: 2266698 - RNA, 20 nt, Human
uuucuaaaggcuaccuuugu

SEQ ID NO: 2266699 - RNA, 15 nt, Human
uuucugaaguggacu

SEQ ID NO: 2266700 - RNA, 15 nt, Human
uuucugagaaagacu

SEQ ID NO: 2266701 - RNA, 20 nt, Human
uuucuguucuuucuggcuau

SEQ ID NO: 2266702 - RNA, 17 nt, Human
uuucucuguauaguacu

SEQ ID NO: 2266703 - RNA, 13 nt, Human
uuucugagaaaga

SEQ ID NO: 2266704 - RNA, 20 nt, Human
uuucucugggguauuugggg

SEQ ID NO: 2266705 - RNA, 20 nt, Human
uuucucugauuugcaaaaaa

SEQ ID NO: 2266706 - RNA, 11 nt, Human
uuucucugcca

SEQ ID NO: 2266707 - RNA, 21 nt, Human
uuuuaaagaccugacaccuuu

SEQ ID NO: 2266708 - RNA, 13 nt, Human
uuuuaaagacaug

SEQ ID NO: 2266709 - RNA, 20 nt, Human
uuuuaaagagugaaaaauga

SEQ ID NO: 2266710 - RNA, 18 nt, Human
uuuuaaauauuuuuucuu

SEQ ID NO: 2266711 - RNA, 12 nt, Human
uuuuaaaugcac

SEQ ID NO: 2266712 - RNA, 11 nt, Human
uuuuaaaugca

SEQ ID NO: 2266713 - RNA, 19 nt, Human
uuuuaaauggguagagaaa

SEQ ID NO: 2266714 - RNA, 19 nt, Human
uuuuaaaugcauaaaugca

SEQ ID NO: 2266715 - RNA, 21 nt, Human
uuuuaaaugcaccuggaauau

SEQ ID NO: 2266716 - RNA, 21 nt, Human
uuuuaaauuauaacuuaaaau

SEQ ID NO: 2266717 - RNA, 13 nt, Human
uuuuaauuaaaua

SEQ ID NO: 2266718 - RNA, 19 nt, Human
uuuuaaugugcuguguaaa

SEQ ID NO: 2266719 - RNA, 21 nt, Human
uuuuaaugugcuguguaaagu

SEQ ID NO: 2266720 - RNA, 13 nt, Human
uuuuaaugugcug

SEQ ID NO: 2266721 - RNA, 15 nt, Human
uuuuaaugugcugug

SEQ ID NO: 2266722 - RNA, 17 nt, Human
uuuuaaugugcugugua

SEQ ID NO: 2266723 - RNA, 18 nt, Human
uuuuaaugugcuguguaa

SEQ ID NO: 2266724 - RNA, 11 nt, Human
uuuuaaugugc

SEQ ID NO: 2266725 - RNA, 12 nt, Human
uuuuaaugugcu

SEQ ID NO: 2266726 - RNA, 20 nt, Human
uuuuaauggggguagcagcu

SEQ ID NO: 2266727 - RNA, 22 nt, Human
uuuuaauggggguagcagcugg

SEQ ID NO: 2266728 - RNA, 23 nt, Human
uuuuaauggggguagcagcugga

SEQ ID NO: 2266729 - RNA, 17 nt, Human
uuuuaaugcuccaaaug

SEQ ID NO: 2266730 - RNA, 16 nt, Human
uuuuaaucaugaaauu

SEQ ID NO: 2266731 - RNA, 20 nt, Human
uuuuaaucaugaaauuacuu

SEQ ID NO: 2266732 - RNA, 22 nt, Human
uuuuaaucagacaaaguaauuc

SEQ ID NO: 2266733 - RNA, 12 nt, Human
uuuuaaucauga

SEQ ID NO: 2266734 - RNA, 14 nt, Human
uuuuaaucaugaaa

SEQ ID NO: 2266735 - RNA, 21 nt, Human
uuuuaauagaauauaauuauc

SEQ ID NO: 2266736 - RNA, 18 nt, Human
uuuuaauagaauaaaaua

SEQ ID NO: 2266737 - RNA, 14 nt, Human
uuuuaauauaaauu

SEQ ID NO: 2266738 - RNA, 12 nt, Human
uuuuaauacagg

SEQ ID NO: 2266739 - RNA, 19 nt, Human
uuuuaacaauaacuacugu

SEQ ID NO: 2266740 - RNA, 20 nt, Human
uuuuaauaauguuucaaaca

SEQ ID NO: 2266741 - RNA, 13 nt, Human
uuuuaaauuuuau

SEQ ID NO: 2266742 - RNA, 16 nt, Human
uuuuaacaaaagcaag

SEQ ID NO: 2266743 - RNA, 20 nt, Human
uuuuaacaaaagcaagacug

SEQ ID NO: 2266744 - RNA, 14 nt, Human
uuuguucuuuuuau

SEQ ID NO: 2266745 - RNA, 15 nt, Human
uuuguucuucuuaaa

SEQ ID NO: 2266746 - RNA, 21 nt, Human
uuuguucuggcucuuccaggc

SEQ ID NO: 2266747 - RNA, 19 nt, Human
uuuguuccccuccuccacu

SEQ ID NO: 2266748 - RNA, 16 nt, Human
uuuguucuaguuuuca

SEQ ID NO: 2266749 - RNA, 20 nt, Human
uuuguucgcauggucacaca

SEQ ID NO: 2266750 - RNA, 22 nt, Human
uuuguaaaaacagcauugcuuu

SEQ ID NO: 2266751 - RNA, 21 nt, Human
uuuguaaaagaacaguaaaca

SEQ ID NO: 2266752 - RNA, 23 nt, Human
uuuguaaaagaacaguaaacauu

SEQ ID NO: 2266753 - RNA, 17 nt, Human
uuuguauaguaaaguga

SEQ ID NO: 2266754 - RNA, 22 nt, Human
uuuguaucugcaggcagacacg

SEQ ID NO: 2266755 - RNA, 20 nt, Human
uuuguaucucugaagcaugu

SEQ ID NO: 2266756 - RNA, 21 nt, Human
uuuguaucucugaagcauguu

SEQ ID NO: 2266757 - RNA, 13 nt, Human
uuuguaucugaag

SEQ ID NO: 2266758 - RNA, 21 nt, Human
uuuguaucugcaggcagacac

SEQ ID NO: 2266759 - RNA, 15 nt, Human
uuuguauaguugcuu

SEQ ID NO: 2266760 - RNA, 21 nt, Human
uuuguauaguugcuugccuga

SEQ ID NO: 2266761 - RNA, 12 nt, Human
uuuguauauugu

SEQ ID NO: 2266762 - RNA, 16 nt, Human
uuuguauauuauuucu

SEQ ID NO: 2266763 - RNA, 16 nt, Human
uuuuaaaaguuauuaa

SEQ ID NO: 2266764 - RNA, 12 nt, Human
uuuuaaaaguuu

SEQ ID NO: 2266765 - RNA, 17 nt, Human
uuuuaaagaaugcucuu

SEQ ID NO: 2266766 - RNA, 18 nt, Human
uuuuaaaaguuucaaugu

SEQ ID NO: 2266767 - RNA, 13 nt, Human
uuuuaaaaguuuc

SEQ ID NO: 2266768 - RNA, 15 nt, Human
uuuuaaaaguuucaa

SEQ ID NO: 2266769 - RNA, 18 nt, Human
uuuuaaagacuuuuauga

SEQ ID NO: 2266770 - RNA, 15 nt, Human
uuuguugaaauuaug

SEQ ID NO: 2266771 - RNA, 19 nt, Human
uuuguucucagcucccccu

SEQ ID NO: 2266772 - RNA, 21 nt, Human
uuuuaaaagaaugauuaugaa

SEQ ID NO: 2266773 - RNA, 20 nt, Human
uuuuaaaagaugcaauguag

SEQ ID NO: 2266774 - RNA, 14 nt, Human
uuuuaaaagacaag

SEQ ID NO: 2266775 - RNA, 15 nt, Human
uuuuaaaagacaaga

SEQ ID NO: 2266776 - RNA, 23 nt, Human
uuuuaaaagacaagacuucagua

SEQ ID NO: 2266777 - RNA, 21 nt, Human
uuugaaucuugucucaaugcu

SEQ ID NO: 2266778 - RNA, 14 nt, Human
uuugaaugaaaaau

SEQ ID NO: 2266779 - RNA, 13 nt, Human
uuugaaugaaaaa

SEQ ID NO: 2266780 - RNA, 23 nt, Human
uuugaaugaaaaauuuaagcauu

SEQ ID NO: 2266781 - RNA, 22 nt, Human
uuugaaugaaaaauuuaagcau

SEQ ID NO: 2266782 - RNA, 21 nt, Human
uuugaaugaaaaauuuaagca

SEQ ID NO: 2266783 - RNA, 15 nt, Human
uuugaaugaaaaauu

SEQ ID NO: 2266784 - RNA, 24 nt, Human
uuugaaugaaaaauuuaagcauug

SEQ ID NO: 2266785 - RNA, 14 nt, Human
uuugaaugacaaag

SEQ ID NO: 2266786 - RNA, 13 nt, Human
uuugaaugcauuu

SEQ ID NO: 2266787 - RNA, 16 nt, Human
uuugaaugcuuccuga

SEQ ID NO: 2266788 - RNA, 22 nt, Human
uuugaaugugauuuuaaagagu

SEQ ID NO: 2266789 - RNA, 22 nt, Human
uuugaauguaugcuucauacag

SEQ ID NO: 2266790 - RNA, 17 nt, Human
uuugaauguaugcuuca

SEQ ID NO: 2266791 - RNA, 14 nt, Human
uuugaaugcauuuu

SEQ ID NO: 2266792 - RNA, 16 nt, Human
uuugaaugcauuuugu

SEQ ID NO: 2266793 - RNA, 15 nt, Human
uuugcauauguauga

SEQ ID NO: 2266794 - RNA, 15 nt, Human
uuugcaucugaaaau

SEQ ID NO: 2266795 - RNA, 21 nt, Human
uuugaauguuaaauaaauugu

SEQ ID NO: 2266796 - RNA, 20 nt, Human
uuugaauguuauuuguuauu

SEQ ID NO: 2266797 - RNA, 22 nt, Human
uuugaauguuaaauaaauugua

SEQ ID NO: 2266798 - RNA, 13 nt, Human
uuugaauguuaaa

SEQ ID NO: 2266799 - RNA, 16 nt, Human
uuugaauguuaaauaa

SEQ ID NO: 2266800 - RNA, 18 nt, Human
uuugaauguuaaauaaau

SEQ ID NO: 2266801 - RNA, 22 nt, Human
uuugcuuuuccuuuguuuuuau

SEQ ID NO: 2266802 - RNA, 18 nt, Human
uuugcuuugcuuucugcu

SEQ ID NO: 2266803 - RNA, 15 nt, Human
uuugcuuugcuuucu

SEQ ID NO: 2266804 - RNA, 15 nt, Human
uuugcuuucugcuca

SEQ ID NO: 2266805 - RNA, 15 nt, Human
uuugcuuugcccagc

SEQ ID NO: 2266806 - RNA, 12 nt, Human
uuugcuuuuucu

SEQ ID NO: 2266807 - RNA, 14 nt, Human
uuugcuuuuucuga

SEQ ID NO: 2266808 - RNA, 14 nt, Human
uuugcuuuuugcua

SEQ ID NO: 2266809 - RNA, 12 nt, Human
uuuggaaugcuu

SEQ ID NO: 2266810 - RNA, 14 nt, Human
uuuggaauuuugug

SEQ ID NO: 2266811 - RNA, 16 nt, Human
uuugcuuugugauuuu

SEQ ID NO: 2266812 - RNA, 15 nt, Human
uuugcuuugugauuu

SEQ ID NO: 2266813 - RNA, 21 nt, Human
uuugcauggaauuuguaaguu

SEQ ID NO: 2266814 - RNA, 18 nt, Human
uuugcauggcacuugcau

SEQ ID NO: 2266815 - RNA, 20 nt, Human
uuugcauggcacuugcaucu

SEQ ID NO: 2266816 - RNA, 22 nt, Human
uuugcauggcacuugcaucugu

SEQ ID NO: 2266817 - RNA, 21 nt, Human
uuugcaugugaaaaucaaaua

SEQ ID NO: 2266818 - RNA, 14 nt, Human
uuugcauguuccac

SEQ ID NO: 2266819 - RNA, 23 nt, Human
uuugcauggcacuugcaucugug

SEQ ID NO: 2266820 - RNA, 22 nt, Human
uuugcauggcuccagaaauguc

SEQ ID NO: 2266821 - RNA, 14 nt, Human
uuuggucugggacu

SEQ ID NO: 2266822 - RNA, 20 nt, Human
uuuggucuuuaaugaaaagc

SEQ ID NO: 2266823 - RNA, 21 nt, Human
uuuggucuuuuuuuguauuau

SEQ ID NO: 2266824 - RNA, 20 nt, Human
uuuggauauaggucagugag

SEQ ID NO: 2266825 - RNA, 20 nt, Human
uuuggaguccccucaccucc

SEQ ID NO: 2266826 - RNA, 19 nt, Human
uuuggaugggagugagaca

SEQ ID NO: 2266827 - RNA, 21 nt, Human
uuuggaugggagugagacaga

SEQ ID NO: 2266828 - RNA, 21 nt, Human
uuuggaauuuugugcccccau

SEQ ID NO: 2266829 - RNA, 11 nt, Human
uuuggaaugug

SEQ ID NO: 2266830 - RNA, 18 nt, Human
uuuggagaguuuccugaa

SEQ ID NO: 2266831 - RNA, 20 nt, Human
uuuggagucagacagaugug

SEQ ID NO: 2266832 - RNA, 14 nt, Human
uuuggaggugcuua

SEQ ID NO: 2266833 - RNA, 17 nt, Human
uuuggaguccccucacc

SEQ ID NO: 2266834 - RNA, 21 nt, Human
uuuguaaaaacagcauugcuu

SEQ ID NO: 2266835 - RNA, 21 nt, Human
uuugguuuuguuccccuccuc

SEQ ID NO: 2266836 - RNA, 16 nt, Human
uuugguuuuguucccc

SEQ ID NO: 2266837 - RNA, 19 nt, Human
uuugguuuuguuccccucc

SEQ ID NO: 2266838 - RNA, 13 nt, Human
uuuguauaaaaua

SEQ ID NO: 2266839 - RNA, 14 nt, Human
uuuguauaaaauaa

SEQ ID NO: 2266840 - RNA, 16 nt, Human
uuuguauaaaauaauu

SEQ ID NO: 2266841 - RNA, 15 nt, Human
uuugguggcuuugca

SEQ ID NO: 2266842 - RNA, 20 nt, Human
uuugguggggguagagcuga

SEQ ID NO: 2266843 - RNA, 15 nt, Human
uuugguggagauaaa

SEQ ID NO: 2266844 - RNA, 14 nt, Human
uuugguuuuguucc

SEQ ID NO: 2266845 - RNA, 15 nt, Human
uuugguuuuguuccc

SEQ ID NO: 2266846 - RNA, 22 nt, Human
uuuuuccuuguccccacacucc

SEQ ID NO: 2266847 - RNA, 17 nt, Human
uuuuuccuuguauuuaa

SEQ ID NO: 2266848 - RNA, 11 nt, Human
uuuuuccuuuu

SEQ ID NO: 2266849 - RNA, 18 nt, Human
uuuuucuaaaacuaaaua

SEQ ID NO: 2266850 - RNA, 22 nt, Human
uuuuucuaaaacuaaauagcau

SEQ ID NO: 2266851 - RNA, 11 nt, Human
uuuuuccuuua

SEQ ID NO: 2266852 - RNA, 16 nt, Human
uuuuuccuucccuucu

SEQ ID NO: 2266853 - RNA, 19 nt, Human
uuuuuccuucagugccuua

SEQ ID NO: 2266854 - RNA, 11 nt, Human
uuuuucucuaa

SEQ ID NO: 2266855 - RNA, 19 nt, Human
uuuuucucuaggaaauauu

SEQ ID NO: 2266856 - RNA, 15 nt, Human
uuuuucuaagagaag

SEQ ID NO: 2266857 - RNA, 16 nt, Human
uuuuucuaagagaagu

SEQ ID NO: 2266858 - RNA, 18 nt, Human
uuuuucuacuuuuaaaga

SEQ ID NO: 2266859 - RNA, 16 nt, Human
uuuuucucaaaguuuu

SEQ ID NO: 2266860 - RNA, 19 nt, Human
uuuuucucaugaaucugca

SEQ ID NO: 2266861 - RNA, 18 nt, Human
uuuuucucaaaguuuuga

SEQ ID NO: 2266862 - RNA, 14 nt, Human
uuuuucucccucug

SEQ ID NO: 2266863 - RNA, 14 nt, Human
uuuuuccuguccuu

SEQ ID NO: 2266864 - RNA, 18 nt, Human
uuuuuccuagcccucuca

SEQ ID NO: 2266865 - RNA, 17 nt, Human
uuuuuaagguuauuuau

SEQ ID NO: 2266866 - RNA, 20 nt, Human
uuuuuccuuaauccagcuga

SEQ ID NO: 2266867 - RNA, 15 nt, Human
uuuuuccuuaaucca

SEQ ID NO: 2266868 - RNA, 11 nt, Human
uuuuuccuuca

SEQ ID NO: 2266869 - RNA, 16 nt, Human
uuuuuaaguauuuaua

SEQ ID NO: 2266870 - RNA, 23 nt, Human
uuuuuaagcuguaaaaagagaga

SEQ ID NO: 2266871 - RNA, 18 nt, Human
uuuuuaagcuguuuccau

SEQ ID NO: 2266872 - RNA, 18 nt, Human
uuuuuaagccuuaaagga

SEQ ID NO: 2266873 - RNA, 13 nt, Human
uuuuuaagauuuu

SEQ ID NO: 2266874 - RNA, 16 nt, Human
uuuuuaagauuuuucu

SEQ ID NO: 2266875 - RNA, 14 nt, Human
uuuuuaagcuguaa

SEQ ID NO: 2266876 - RNA, 18 nt, Human
uuuuuaaaguuacuuugu

SEQ ID NO: 2266877 - RNA, 20 nt, Human
uuuuuaagauaauaauauau

SEQ ID NO: 2266878 - RNA, 11 nt, Human
uuuuuaaaugc

SEQ ID NO: 2266879 - RNA, 13 nt, Human
uuuuugaaaacau

SEQ ID NO: 2266880 - RNA, 14 nt, Human
uuuuugaaauaaua

SEQ ID NO: 2266881 - RNA, 23 nt, Human
uuuuugaaaggcauguuccucug

SEQ ID NO: 2266882 - RNA, 17 nt, Human
uuuuucuuuauaaacuu

SEQ ID NO: 2266883 - RNA, 16 nt, Human
uuuuucuuuauaaacu

SEQ ID NO: 2266884 - RNA, 13 nt, Human
uuuuucuuuauaa

SEQ ID NO: 2266885 - RNA, 14 nt, Human
uuuuucuuuaagau

SEQ ID NO: 2266886 - RNA, 13 nt, Human
uuuuucuuguaau

SEQ ID NO: 2266887 - RNA, 18 nt, Human
uuuuucugacuccagugg

SEQ ID NO: 2266888 - RNA, 11 nt, Human
uuuuucugauu

SEQ ID NO: 2266889 - RNA, 12 nt, Human
uuuuuuguuuca

SEQ ID NO: 2266890 - RNA, 13 nt, Human
uuuuuuguauuau

SEQ ID NO: 2266891 - RNA, 23 nt, Human
uuuuuuggggauaugcuuaguaa

SEQ ID NO: 2266892 - RNA, 15 nt, Human
uuuuuugcaagugaa

SEQ ID NO: 2266893 - RNA, 12 nt, Human
uuuuuugauaaa

SEQ ID NO: 2266894 - RNA, 13 nt, Human
uuuuuuguuucau

SEQ ID NO: 2266895 - RNA, 14 nt, Human
uuuuguaauuuaaa

SEQ ID NO: 2266896 - RNA, 15 nt, Human
uuuuguaauuauugu

SEQ ID NO: 2266897 - RNA, 19 nt, Human
uuuuguagagccagggucu

SEQ ID NO: 2266898 - RNA, 22 nt, Human
uuuuguaggggucaaagaaaug

SEQ ID NO: 2266899 - RNA, 14 nt, Human
uuuuguagaugaaa

SEQ ID NO: 2266900 - RNA, 23 nt, Human
uuuuguaggggucaaagaaaugc

SEQ ID NO: 2266901 - RNA, 17 nt, Human
uuuuguaauuauuguga

SEQ ID NO: 2266902 - RNA, 13 nt, Human
uuuuguacuguaa

SEQ ID NO: 2266903 - RNA, 16 nt, Human
uuuuguacuguaaaga

SEQ ID NO: 2266904 - RNA, 17 nt, Human
uuuuguacuguaaagag

SEQ ID NO: 2266905 - RNA, 15 nt, Human
uuuuguauaauugua

SEQ ID NO: 2266906 - RNA, 16 nt, Human
uuuuguauaauuguau

SEQ ID NO: 2266907 - RNA, 17 nt, Human
uuuuguauaguaaagug

SEQ ID NO: 2266908 - RNA, 16 nt, Human
uuuuguauaguaaagu

SEQ ID NO: 2266909 - RNA, 18 nt, Human
uuuuguauaguaaaguga

SEQ ID NO: 2266910 - RNA, 23 nt, Human
uuuuguauaguuguggacauuua

SEQ ID NO: 2266911 - RNA, 14 nt, Human
uuuuguauguaaau

SEQ ID NO: 2266912 - RNA, 14 nt, Human
uuuuguaucuacau

SEQ ID NO: 2266913 - RNA, 13 nt, Human
uuuuguauauauc

SEQ ID NO: 2266914 - RNA, 19 nt, Human
uuuuguaucuacaucuuuu

SEQ ID NO: 2266915 - RNA, 14 nt, Human
uuuuguaagacaaa

SEQ ID NO: 2266916 - RNA, 13 nt, Human
uuuuguaaagugu

SEQ ID NO: 2266917 - RNA, 15 nt, Human
uuuuguaagaugcug

SEQ ID NO: 2266918 - RNA, 20 nt, Human
uuuuguaagaugcuggguug

SEQ ID NO: 2266919 - RNA, 15 nt, Human
uuuuguaaagaugcc

SEQ ID NO: 2266920 - RNA, 21 nt, Human
uuuuguaaagaugccggguuu

SEQ ID NO: 2266921 - RNA, 18 nt, Human
uuuuguaaacucaaaaua

SEQ ID NO: 2266922 - RNA, 20 nt, Human
uuuuggugguuuuagugauu

SEQ ID NO: 2266923 - RNA, 15 nt, Human
uuuugguugaauaaa

SEQ ID NO: 2266924 - RNA, 16 nt, Human
uuuugguucuuaguuc

SEQ ID NO: 2266925 - RNA, 20 nt, Human
uuuugguugaauaaacuaga

SEQ ID NO: 2266926 - RNA, 15 nt, Human
uuuugguugcuuuaa

SEQ ID NO: 2266927 - RNA, 20 nt, Human
uuuugguuuuguuccccucc

SEQ ID NO: 2266928 - RNA, 16 nt, Human
uuuugguuuuguuccc

SEQ ID NO: 2266929 - RNA, 14 nt, Human
uuuugguuuuguuc

SEQ ID NO: 2266930 - RNA, 22 nt, Human
uuuugguugucaauauuaaaua

SEQ ID NO: 2266931 - RNA, 22 nt, Human
uuuugguuugcagaugacaaaa

SEQ ID NO: 2266932 - RNA, 16 nt, Human
uuuugguugcuuuaau

SEQ ID NO: 2266933 - RNA, 12 nt, Human
uuuugguuguau

SEQ ID NO: 2266934 - RNA, 20 nt, Human
uuuugguuguauucuuugau

SEQ ID NO: 2266935 - RNA, 20 nt, Human
uuuuuaaaguguuucuguua

SEQ ID NO: 2266936 - RNA, 16 nt, Human
uuuuuaaauaaaagca

SEQ ID NO: 2266937 - RNA, 18 nt, Human
uuuuuaaagacuuuuaug

SEQ ID NO: 2266938 - RNA, 12 nt, Human
uuuuuaaagacu

SEQ ID NO: 2266939 - RNA, 13 nt, Human
uuuuuaaagacuu

SEQ ID NO: 2266940 - RNA, 17 nt, Human
uuuuuaaagacagaguc

SEQ ID NO: 2266941 - RNA, 16 nt, Human
uuuuuaaaauuuuaau

SEQ ID NO: 2266942 - RNA, 17 nt, Human
uuuuuaaaauauuuauu

SEQ ID NO: 2266943 - RNA, 16 nt, Human
uuuuuaaaauauuuau

SEQ ID NO: 2266944 - RNA, 17 nt, Human
uuuuuaaaauaucuuuu

SEQ ID NO: 2266945 - RNA, 19 nt, Human
uuuuuaaaaguuucaaugu

SEQ ID NO: 2266946 - RNA, 22 nt, Human
uuuuuaaaaguuucaaugugau

SEQ ID NO: 2266947 - RNA, 20 nt, Human
uuuuuaaaaaugcaaauccu

SEQ ID NO: 2266948 - RNA, 23 nt, Human
uuuuuaaaaaucauaaacugugu

SEQ ID NO: 2266949 - RNA, 12 nt, Human
uuuugucuugaa

SEQ ID NO: 2266950 - RNA, 13 nt, Human
uuuugucuugaau

SEQ ID NO: 2266951 - RNA, 18 nt, Human
uuuugugaaaaugucaaa

SEQ ID NO: 2266952 - RNA, 18 nt, Human
uuuuuaaaaaagaaacau

SEQ ID NO: 2266953 - RNA, 13 nt, Human
uuuugucuugugu

SEQ ID NO: 2266954 - RNA, 13 nt, Human
uuuugucuuauau

SEQ ID NO: 2266955 - RNA, 18 nt, Human
uuuuguauuuuuaauggg

SEQ ID NO: 2266956 - RNA, 22 nt, Human
uuuugucgaauuuuuauuauuu

SEQ ID NO: 2266957 - RNA, 18 nt, Human
uuuugucauuuucuccau

SEQ ID NO: 2266958 - RNA, 16 nt, Human
uuuugucauauaagau

SEQ ID NO: 2266959 - RNA, 10 nt, Human
uuuuguauuu

SEQ ID NO: 2266960 - RNA, 19 nt, Human
uuuuguauuuuccaagugu

SEQ ID NO: 2266961 - RNA, 15 nt, Human
uuuuguauuuuuaau

SEQ ID NO: 2266962 - RNA, 17 nt, Human
uuuuguauucucugagc

SEQ ID NO: 2266963 - RNA, 20 nt, Human
uuuuguauguaaaugugcau

SEQ ID NO: 2266964 - RNA, 16 nt, Human
uuuuggauuguauauu

SEQ ID NO: 2266965 - RNA, 16 nt, Human
uuuuggaugcagugcu

SEQ ID NO: 2266966 - RNA, 18 nt, Human
uuuugacacuauaucugu

SEQ ID NO: 2266967 - RNA, 13 nt, Human
uuuugaauguuau

SEQ ID NO: 2266968 - RNA, 16 nt, Human
uuuugacacuauaucu

SEQ ID NO: 2266969 - RNA, 19 nt, Human
uuuugacacuauaucugua

SEQ ID NO: 2266970 - RNA, 19 nt, Human
uuuuggcacugagauauuu

SEQ ID NO: 2266971 - RNA, 19 nt, Human
uuuuggcaaacgcuaaaga

SEQ ID NO: 2266972 - RNA, 19 nt, Human
uuuuggcaaaacucuacuu

SEQ ID NO: 2266973 - RNA, 16 nt, Human
uuuuggccaaaguguu

SEQ ID NO: 2266974 - RNA, 15 nt, Human
uuuuggccaaagugu

SEQ ID NO: 2266975 - RNA, 17 nt, Human
uuuuggccaaaguguua

SEQ ID NO: 2266976 - RNA, 22 nt, Human
uuuugaaugcuuccugacaauc

SEQ ID NO: 2266977 - RNA, 18 nt, Human
uuuugaaugguguuguau

SEQ ID NO: 2266978 - RNA, 14 nt, Human
uuuugaauguuauu

SEQ ID NO: 2266979 - RNA, 16 nt, Human
uuuugaauccaugcuu

SEQ ID NO: 2266980 - RNA, 18 nt, Human
uuuugaaugcuuccugac

SEQ ID NO: 2266981 - RNA, 20 nt, Human
uuuugacaaggggcaguggu

SEQ ID NO: 2266982 - RNA, 13 nt, Human
uuuucuuuucuau

SEQ ID NO: 2266983 - RNA, 13 nt, Human
uuuugaaucaaua

SEQ ID NO: 2266984 - RNA, 22 nt, Human
uuuugggcuccuuuuucucccu

SEQ ID NO: 2266985 - RNA, 18 nt, Human
uuuuggggaagugaggaa

SEQ ID NO: 2266986 - RNA, 23 nt, Human
uuuuggggggccccccuccuugc

SEQ ID NO: 2266987 - RNA, 18 nt, Human
uuuuggggauaugcuuag

SEQ ID NO: 2266988 - RNA, 21 nt, Human
uuuuggggauaugcuuaguaa

SEQ ID NO: 2266989 - RNA, 19 nt, Human
uuuugguaaagacuggcuu

SEQ ID NO: 2266990 - RNA, 19 nt, Human
uuuugggguuguguuguca

SEQ ID NO: 2266991 - RNA, 19 nt, Human
uuuuggcccccgagcuggg

SEQ ID NO: 2266992 - RNA, 22 nt, Human
uuuuggcugaaauucuccugga

SEQ ID NO: 2266993 - RNA, 14 nt, Human
uuuuggcugcugaa

SEQ ID NO: 2266994 - RNA, 15 nt, Human
uuuuggucuguguga

SEQ ID NO: 2266995 - RNA, 18 nt, Human
uuuuggucuggagggaag

SEQ ID NO: 2266996 - RNA, 17 nt, Human
uuuugguauuacacugu

SEQ ID NO: 2266997 - RNA, 19 nt, Human
uuuugguacuuauuacugc

SEQ ID NO: 2266998 - RNA, 23 nt, Human
uuuugguauuacacuguauuugu

SEQ ID NO: 2266999 - RNA, 21 nt, Human
uuuugguccaaguugugcuua

SEQ ID NO: 2267000 - RNA, 14 nt, Human
uuuuggucauugua

SEQ ID NO: 2267001 - RNA, 13 nt, Human
uuuucuacagugg

SEQ ID NO: 2267002 - RNA, 15 nt, Human
uuuucuaagagaagu

SEQ ID NO: 2267003 - RNA, 15 nt, Human
uuuucuaaugugguu

SEQ ID NO: 2267004 - RNA, 21 nt, Human
uuuucuaaugugguuauuucu

SEQ ID NO: 2267005 - RNA, 13 nt, Human
uuuucuaagagaa

SEQ ID NO: 2267006 - RNA, 18 nt, Human
uuuucuaaaguaaaaaca

SEQ ID NO: 2267007 - RNA, 14 nt, Human
uuuucuuugaaauu

SEQ ID NO: 2267008 - RNA, 17 nt, Human
uuuucuuugaaugcuuu

SEQ ID NO: 2267009 - RNA, 13 nt, Human
uuuucuacaguua

SEQ ID NO: 2267010 - RNA, 14 nt, Human
uuuucuacaguggu

SEQ ID NO: 2267011 - RNA, 18 nt, Human
uuuucuacagugguuuua

SEQ ID NO: 2267012 - RNA, 16 nt, Human
uuuucuacccuagcca

SEQ ID NO: 2267013 - RNA, 17 nt, Human
uuuucuacccuagccau

SEQ ID NO: 2267014 - RNA, 16 nt, Human
uuuucuuuguguagcu

SEQ ID NO: 2267015 - RNA, 19 nt, Human
uuuucuuuguguagcuuug

SEQ ID NO: 2267016 - RNA, 12 nt, Human
uuuucuuugugu

SEQ ID NO: 2267017 - RNA, 20 nt, Human
uuuuaauucaccaaaguauu

SEQ ID NO: 2267018 - RNA, 23 nt, Human
uuuuaauuauuauuuauauaugu

SEQ ID NO: 2267019 - RNA, 17 nt, Human
uuuuaauuauuauucuu

SEQ ID NO: 2267020 - RNA, 20 nt, Human
uuuuaauuauuauuuauaua

SEQ ID NO: 2267021 - RNA, 22 nt, Human
uuuuaauuaaugaaauaucugu

SEQ ID NO: 2267022 - RNA, 13 nt, Human
uuuuaauuaaaug

SEQ ID NO: 2267023 - RNA, 11 nt, Human
uuuuaauuauu

SEQ ID NO: 2267024 - RNA, 16 nt, Human
uuuuaauuauuauucu

SEQ ID NO: 2267025 - RNA, 15 nt, Human
uuuuaauugauuauu

SEQ ID NO: 2267026 - RNA, 18 nt, Human
uuuuaauuccaugaaucg

SEQ ID NO: 2267027 - RNA, 11 nt, Human
uuuuaauucca

SEQ ID NO: 2267028 - RNA, 18 nt, Human
uuuuaauuccaauaugau

SEQ ID NO: 2267029 - RNA, 19 nt, Human
uuuuaauuccaauaugaug

SEQ ID NO: 2267030 - RNA, 22 nt, Human
uuuuaauuccaauaugaugacu

SEQ ID NO: 2267031 - RNA, 15 nt, Human
uuuuaauuccaugaa

SEQ ID NO: 2267032 - RNA, 21 nt, Human
uuuuaauuccaugaaucgcuu

SEQ ID NO: 2267033 - RNA, 17 nt, Human
uuuuaauuuacaaaaau

SEQ ID NO: 2267034 - RNA, 14 nt, Human
uuuuccugaaaacc

SEQ ID NO: 2267035 - RNA, 16 nt, Human
gccucccuggucccuu

SEQ ID NO: 2267036 - RNA, 21 nt, Human
gccucccuguugaagcucugg

SEQ ID NO: 2267037 - RNA, 20 nt, Human
gccucccuguugaagcucug

SEQ ID NO: 2267038 - RNA, 20 nt, Human
gccucccgaguagcugggac

SEQ ID NO: 2267039 - RNA, 18 nt, Human
gccucccgaguagcuggg

SEQ ID NO: 2267040 - RNA, 19 nt, Human
gccucccgaguagcuggga

SEQ ID NO: 2267041 - RNA, 17 nt, Human
gccucccaucacccgcu

SEQ ID NO: 2267042 - RNA, 17 nt, Human
gccucccgaguagcugg

SEQ ID NO: 2267043 - RNA, 16 nt, Human
gccuccguauuucaga

SEQ ID NO: 2267044 - RNA, 23 nt, Human
gccuccggcgucagccuccagcc

SEQ ID NO: 2267045 - RNA, 20 nt, Human
gccuccggcgucagccucca

SEQ ID NO: 2267046 - RNA, 21 nt, Human
gccuccggcgucagccuccag

SEQ ID NO: 2267047 - RNA, 12 nt, Human
gccuccggccuc

SEQ ID NO: 2267048 - RNA, 16 nt, Human
gccuccggccuccccu

SEQ ID NO: 2267049 - RNA, 17 nt, Human
gccuccggcgucagccu

SEQ ID NO: 2267050 - RNA, 18 nt, Human
gccuccggcgucagccuc

SEQ ID NO: 2267051 - RNA, 19 nt, Human
gccuccggcgucagccucc

SEQ ID NO: 2267052 - RNA, 16 nt, Human
gccuccgagagggaga

SEQ ID NO: 2267053 - RNA, 18 nt, Human
gccuccgagagggagaga

SEQ ID NO: 2267054 - RNA, 23 nt, Human
gccucccuucaugcauggaaauu

SEQ ID NO: 2267055 - RNA, 15 nt, Human
gccuccgagagggag

SEQ ID NO: 2267056 - RNA, 22 nt, Human
gccucccuucaugcauggaaau

SEQ ID NO: 2267057 - RNA, 20 nt, Human
gccucccuucaugcauggaa

SEQ ID NO: 2267058 - RNA, 18 nt, Human
gccucccuucaugcaugg

SEQ ID NO: 2267059 - RNA, 15 nt, Human
gccucccuucaugca

SEQ ID NO: 2267060 - RNA, 19 nt, Human
gccucucauuccagaggaa

SEQ ID NO: 2267061 - RNA, 19 nt, Human
gccucucaucaacugaaug

SEQ ID NO: 2267062 - RNA, 18 nt, Human
gccucucaucaacugaau

SEQ ID NO: 2267063 - RNA, 21 nt, Human
gccuccucacccccagcuuug

SEQ ID NO: 2267064 - RNA, 16 nt, Human
gccucucaucaacuga

SEQ ID NO: 2267065 - RNA, 14 nt, Human
gccuccucaccccc

SEQ ID NO: 2267066 - RNA, 20 nt, Human
gccuccuacagcccaccugg

SEQ ID NO: 2267067 - RNA, 19 nt, Human
gccuccucacccccagcuu

SEQ ID NO: 2267068 - RNA, 18 nt, Human
gccuccucacccccagcu

SEQ ID NO: 2267069 - RNA, 17 nt, Human
gccuccucacccccagc

SEQ ID NO: 2267070 - RNA, 16 nt, Human
gccuccucacccccag

SEQ ID NO: 2267071 - RNA, 13 nt, Human
gccucccacuggg

SEQ ID NO: 2267072 - RNA, 16 nt, Human
gccucaagucacuccc

SEQ ID NO: 2267073 - RNA, 15 nt, Human
gccucccaaaugagc

SEQ ID NO: 2267074 - RNA, 14 nt, Human
gccucccacugggg

SEQ ID NO: 2267075 - RNA, 10 nt, Human
gccucccagc

SEQ ID NO: 2267076 - RNA, 14 nt, Human
gccucccagccugg

SEQ ID NO: 2267077 - RNA, 13 nt, Human
gccucccagccug

SEQ ID NO: 2267078 - RNA, 14 nt, Human
gccucccaucaccc

SEQ ID NO: 2267079 - RNA, 16 nt, Human
gccucccaucacccgc

SEQ ID NO: 2267080 - RNA, 16 nt, Human
gccucccaacucaccc

SEQ ID NO: 2267081 - RNA, 17 nt, Human
gccucccaacucacccc

SEQ ID NO: 2267082 - RNA, 18 nt, Human
gccucccaacucacccca

SEQ ID NO: 2267083 - RNA, 19 nt, Human
gccucccaacucaccccag

SEQ ID NO: 2267084 - RNA, 21 nt, Human
gccucacaguccuuaccagca

SEQ ID NO: 2267085 - RNA, 18 nt, Human
gccucacaguccuuacca

SEQ ID NO: 2267086 - RNA, 15 nt, Human
gccucagcauccugg

SEQ ID NO: 2267087 - RNA, 16 nt, Human
gccucagcauccuggc

SEQ ID NO: 2267088 - RNA, 18 nt, Human
gccucccaaagugcuggg

SEQ ID NO: 2267089 - RNA, 19 nt, Human
gccucccaaagugcuggga

SEQ ID NO: 2267090 - RNA, 13 nt, Human
gccucccaacuca

SEQ ID NO: 2267091 - RNA, 20 nt, Human
gccucucauuccagaggaag

SEQ ID NO: 2267092 - RNA, 13 nt, Human
gccucucucaggc

SEQ ID NO: 2267093 - RNA, 14 nt, Human
gccucucucaggcc

SEQ ID NO: 2267094 - RNA, 17 nt, Human
gccucugacacacagcu

SEQ ID NO: 2267095 - RNA, 18 nt, Human
gccucugacacacagcuc

SEQ ID NO: 2267096 - RNA, 16 nt, Human
gccucucucaggccaa

SEQ ID NO: 2267097 - RNA, 12 nt, Human
gccucucuccca

SEQ ID NO: 2267098 - RNA, 16 nt, Human
gccucucucccagucu

SEQ ID NO: 2267099 - RNA, 19 nt, Human
gccucugacacacagcucu

SEQ ID NO: 2267100 - RNA, 20 nt, Human
gccucugacacacagcucug

SEQ ID NO: 2267101 - RNA, 21 nt, Human
gccucugacacacagcucugu

SEQ ID NO: 2267102 - RNA, 13 nt, Human
gccucucucccag

SEQ ID NO: 2267103 - RNA, 15 nt, Human
gccucucucccaguc

SEQ ID NO: 2267104 - RNA, 13 nt, Human
gccucugaccccu

SEQ ID NO: 2267105 - RNA, 14 nt, Human
gccucugaccccuc

SEQ ID NO: 2267106 - RNA, 15 nt, Human
gccucugaccccucc

SEQ ID NO: 2267107 - RNA, 16 nt, Human
gccucugaccccuccu

SEQ ID NO: 2267108 - RNA, 17 nt, Human
gccucugaccccuccuc

SEQ ID NO: 2267109 - RNA, 18 nt, Human
gccucugaccccuccuca

SEQ ID NO: 2267110 - RNA, 14 nt, Human
gccucugcacuccc

SEQ ID NO: 2267111 - RNA, 22 nt, Human
gccucugagggaaagcccagaa

SEQ ID NO: 2267112 - RNA, 19 nt, Human
gccucugacuuaagcugcc

SEQ ID NO: 2267113 - RNA, 19 nt, Human
gccucugaccccuccucac

SEQ ID NO: 2267114 - RNA, 20 nt, Human
gccucugaccccuccucacu

SEQ ID NO: 2267115 - RNA, 21 nt, Human
gccucugaccccuccucacug

SEQ ID NO: 2267116 - RNA, 22 nt, Human
gccucugaccccuccucacugg

SEQ ID NO: 2267117 - RNA, 15 nt, Human
gccucugagauuugg

SEQ ID NO: 2267118 - RNA, 23 nt, Human
gccugagggcgaggggagggugg

SEQ ID NO: 2267119 - RNA, 22 nt, Human
gccugagggccccucugcccag

SEQ ID NO: 2267120 - RNA, 20 nt, Human
gccugagggccccucugccc

SEQ ID NO: 2267121 - RNA, 21 nt, Human
gccugagggccccucugccca

SEQ ID NO: 2267122 - RNA, 16 nt, Human
gccugagggccccucu

SEQ ID NO: 2267123 - RNA, 17 nt, Human
gccugagggccccucug

SEQ ID NO: 2267124 - RNA, 18 nt, Human
gccugagggccccucugc

SEQ ID NO: 2267125 - RNA, 19 nt, Human
gccugagggccccucugcc

SEQ ID NO: 2267126 - RNA, 22 nt, Human
gccugagaggcaggcauagagg

SEQ ID NO: 2267127 - RNA, 15 nt, Human
gccugagggccccuc

SEQ ID NO: 2267128 - RNA, 16 nt, Human
gccugagaggcaggca

SEQ ID NO: 2267129 - RNA, 18 nt, Human
gccugagaggcaggcaua

SEQ ID NO: 2267130 - RNA, 19 nt, Human
gccugagaggcaggcauag

SEQ ID NO: 2267131 - RNA, 20 nt, Human
gccugagaggcaggcauaga

SEQ ID NO: 2267132 - RNA, 12 nt, Human
gccugagggugg

SEQ ID NO: 2267133 - RNA, 14 nt, Human
gccugaggguggag

SEQ ID NO: 2267134 - RNA, 15 nt, Human
gccugaggguggaga

SEQ ID NO: 2267135 - RNA, 17 nt, Human
gccugaggguggagacu

SEQ ID NO: 2267136 - RNA, 21 nt, Human
gccugaggucaggaguucaag

SEQ ID NO: 2267137 - RNA, 17 nt, Human
gccugaggucucgcuga

SEQ ID NO: 2267138 - RNA, 21 nt, Human
gccugaggucucgcugaugcu

SEQ ID NO: 2267139 - RNA, 16 nt, Human
gccugaggucuggcug

SEQ ID NO: 2267140 - RNA, 18 nt, Human
gccugaggucuggcugcu

SEQ ID NO: 2267141 - RNA, 19 nt, Human
gccugaggucuggcugcuu

SEQ ID NO: 2267142 - RNA, 20 nt, Human
gccugaggucuggcugcuug

SEQ ID NO: 2267143 - RNA, 13 nt, Human
gccugcaagggag

SEQ ID NO: 2267144 - RNA, 15 nt, Human
gccugcaagggagug

SEQ ID NO: 2267145 - RNA, 20 nt, Human
gccugcaaacgcugccugcc

SEQ ID NO: 2267146 - RNA, 19 nt, Human
gccugcaaacgcugccugc

SEQ ID NO: 2267147 - RNA, 21 nt, Human
gccugcaaacgcugccugccc

SEQ ID NO: 2267148 - RNA, 21 nt, Human
gccugcaaacucacugcucaa

SEQ ID NO: 2267149 - RNA, 21 nt, Human
gccugaguagaaaggccuuua

SEQ ID NO: 2267150 - RNA, 16 nt, Human
gccugaguagaaaggc

SEQ ID NO: 2267151 - RNA, 13 nt, Human
gccugaggucugu

SEQ ID NO: 2267152 - RNA, 18 nt, Human
gccugaggucuguacguu

SEQ ID NO: 2267153 - RNA, 16 nt, Human
gccucugccccgucuc

SEQ ID NO: 2267154 - RNA, 15 nt, Human
gccucugccccgucu

SEQ ID NO: 2267155 - RNA, 23 nt, Human
gccucugccaaaggaugugauau

SEQ ID NO: 2267156 - RNA, 15 nt, Human
gccucugcauucagg

SEQ ID NO: 2267157 - RNA, 17 nt, Human
gccucugcaaaggaaau

SEQ ID NO: 2267158 - RNA, 20 nt, Human
gccucugagggaaagcccag

SEQ ID NO: 2267159 - RNA, 12 nt, Human
gccucugccucu

SEQ ID NO: 2267160 - RNA, 13 nt, Human
gccucugccucug

SEQ ID NO: 2267161 - RNA, 18 nt, Human
gccucugccucugacaca

SEQ ID NO: 2267162 - RNA, 13 nt, Human
gccugaccuugag

SEQ ID NO: 2267163 - RNA, 13 nt, Human
gccugagaggcag

SEQ ID NO: 2267164 - RNA, 14 nt, Human
gccugagaggcagg

SEQ ID NO: 2267165 - RNA, 15 nt, Human
gccugagaggcaggc

SEQ ID NO: 2267166 - RNA, 22 nt, Human
gccugagaagagagaucaaaug

SEQ ID NO: 2267167 - RNA, 20 nt, Human
gccggucugcaagucagagg

SEQ ID NO: 2267168 - RNA, 17 nt, Human
gccggugagaauaagag

SEQ ID NO: 2267169 - RNA, 18 nt, Human
gccggucugcaagucaga

SEQ ID NO: 2267170 - RNA, 19 nt, Human
gccggucugcaagucagag

SEQ ID NO: 2267171 - RNA, 14 nt, Human
gccguaccccaccc

SEQ ID NO: 2267172 - RNA, 14 nt, Human
gccgguuugaguga

SEQ ID NO: 2267173 - RNA, 22 nt, Human
gccguaccccacccucagcacc

SEQ ID NO: 2267174 - RNA, 15 nt, Human
gccguaccccacccu

SEQ ID NO: 2267175 - RNA, 16 nt, Human
gccguaccccacccuc

SEQ ID NO: 2267176 - RNA, 18 nt, Human
gccguaccccacccucag

SEQ ID NO: 2267177 - RNA, 19 nt, Human
gccguaccccacccucagc

SEQ ID NO: 2267178 - RNA, 18 nt, Human
gccgucagccaaauguaa

SEQ ID NO: 2267179 - RNA, 15 nt, Human
gccgucuaccugagg

SEQ ID NO: 2267180 - RNA, 21 nt, Human
gccguccucccgggcccuccc

SEQ ID NO: 2267181 - RNA, 19 nt, Human
gccguccucccgggcccuc

SEQ ID NO: 2267182 - RNA, 20 nt, Human
gccguccucccgggcccucc

SEQ ID NO: 2267183 - RNA, 14 nt, Human
gccguccucccggg

SEQ ID NO: 2267184 - RNA, 18 nt, Human
gccguccucccgggcccu

SEQ ID NO: 2267185 - RNA, 16 nt, Human
gccgucuaccugaggg

SEQ ID NO: 2267186 - RNA, 17 nt, Human
gccgucuaccugagggg

SEQ ID NO: 2267187 - RNA, 20 nt, Human
gccguggggccgccgccucu

SEQ ID NO: 2267188 - RNA, 23 nt, Human
gccguggggccgccgccucuuuc

SEQ ID NO: 2267189 - RNA, 20 nt, Human
gccguguaaccauggaccca

SEQ ID NO: 2267190 - RNA, 14 nt, Human
gccgugcccugccc

SEQ ID NO: 2267191 - RNA, 20 nt, Human
gccgugcucgccccagcagg

SEQ ID NO: 2267192 - RNA, 15 nt, Human
gccgugggccugggg

SEQ ID NO: 2267193 - RNA, 21 nt, Human
gccguggcuucccgcucagcc

SEQ ID NO: 2267194 - RNA, 22 nt, Human
gccguggcuucccgcucagccc

SEQ ID NO: 2267195 - RNA, 15 nt, Human
gccguggcuucccgc

SEQ ID NO: 2267196 - RNA, 19 nt, Human
gccguggcuucccgcucag

SEQ ID NO: 2267197 - RNA, 21 nt, Human
gccgugcucgccccagcaggu

SEQ ID NO: 2267198 - RNA, 17 nt, Human
gccgugcucgccccagc

SEQ ID NO: 2267199 - RNA, 14 nt, Human
gccgugccuucagc

SEQ ID NO: 2267200 - RNA, 15 nt, Human
gccgugccuucagcu

SEQ ID NO: 2267201 - RNA, 17 nt, Human
gccgugccuucagcucu

SEQ ID NO: 2267202 - RNA, 19 nt, Human
gccgugccuucagcucuac

SEQ ID NO: 2267203 - RNA, 20 nt, Human
gccguuacucuccaaccugg

SEQ ID NO: 2267204 - RNA, 18 nt, Human
gccguuacucuccaaccu

SEQ ID NO: 2267205 - RNA, 15 nt, Human
gccguuacucuccaa

SEQ ID NO: 2267206 - RNA, 14 nt, Human
gccguuacucucca

SEQ ID NO: 2267207 - RNA, 16 nt, Human
gccgugguccuuuggg

SEQ ID NO: 2267208 - RNA, 18 nt, Human
gccguugaagaggaaggg

SEQ ID NO: 2267209 - RNA, 16 nt, Human
gccuaacaccagcguu

SEQ ID NO: 2267210 - RNA, 15 nt, Human
gccuaugaucccagc

SEQ ID NO: 2267211 - RNA, 18 nt, Human
gccuaugaucccagcacu

SEQ ID NO: 2267212 - RNA, 14 nt, Human
gccuaugcacauau

SEQ ID NO: 2267213 - RNA, 23 nt, Human
gccuaugcacauauggacucugc

SEQ ID NO: 2267214 - RNA, 20 nt, Human
gccuaugcacauauggacuc

SEQ ID NO: 2267215 - RNA, 22 nt, Human
gccuaugcacauauggacucug

SEQ ID NO: 2267216 - RNA, 18 nt, Human
gccucaaccuccugggcu

SEQ ID NO: 2267217 - RNA, 19 nt, Human
gccucaaccuccugggcua

SEQ ID NO: 2267218 - RNA, 22 nt, Human
gccuaugugcaugcagcaucua

SEQ ID NO: 2267219 - RNA, 22 nt, Human
gccuauuaguaguuaauucugu

SEQ ID NO: 2267220 - RNA, 15 nt, Human
gccuauuauauuaaa

SEQ ID NO: 2267221 - RNA, 20 nt, Human
gccuauuauauuaaaauaug

SEQ ID NO: 2267222 - RNA, 16 nt, Human
gccucacagaagaaua

SEQ ID NO: 2267223 - RNA, 13 nt, Human
gccucaaggacuu

SEQ ID NO: 2267224 - RNA, 15 nt, Human
gccuauucccacacc

SEQ ID NO: 2267225 - RNA, 17 nt, Human
gccucaaccuccugggc

SEQ ID NO: 2267226 - RNA, 13 nt, Human
gccucacaguccu

SEQ ID NO: 2267227 - RNA, 17 nt, Human
gccucacaguccuuacc

SEQ ID NO: 2267228 - RNA, 13 nt, Human
gccgcaccccaga

SEQ ID NO: 2267229 - RNA, 17 nt, Human
gccgcaagucugcagcc

SEQ ID NO: 2267230 - RNA, 16 nt, Human
gccgcaauacaggaac

SEQ ID NO: 2267231 - RNA, 16 nt, Human
gccgcaccccagagug

SEQ ID NO: 2267232 - RNA, 15 nt, Human
gccgcaccccagagu

SEQ ID NO: 2267233 - RNA, 23 nt, Human
gccgcaccccagagugugggaag

SEQ ID NO: 2267234 - RNA, 11 nt, Human
gccgcagcccu

SEQ ID NO: 2267235 - RNA, 13 nt, Human
gccgcagcccugc

SEQ ID NO: 2267236 - RNA, 12 nt, Human
gccgcagagcug

SEQ ID NO: 2267237 - RNA, 23 nt, Human
gccggccucucuggccucccacc

SEQ ID NO: 2267238 - RNA, 12 nt, Human
gccgcagcccug

SEQ ID NO: 2267239 - RNA, 11 nt, Human
gccgaccucag

SEQ ID NO: 2267240 - RNA, 22 nt, Human
gccgaccgaggcuggagcuggc

SEQ ID NO: 2267241 - RNA, 22 nt, Human
gccgagaucacgccacugcacu

SEQ ID NO: 2267242 - RNA, 20 nt, Human
gccgagaucacgccacugca

SEQ ID NO: 2267243 - RNA, 21 nt, Human
gccgagaucacgccacugcac

SEQ ID NO: 2267244 - RNA, 22 nt, Human
gccgggaacagacaacagaagu

SEQ ID NO: 2267245 - RNA, 18 nt, Human
gccgggaccccgagccug

SEQ ID NO: 2267246 - RNA, 23 nt, Human
gccgggaccccgagccuggcucc

SEQ ID NO: 2267247 - RNA, 19 nt, Human
gccgggaccccgagccugg

SEQ ID NO: 2267248 - RNA, 20 nt, Human
gccgggaacagacaacagaa

SEQ ID NO: 2267249 - RNA, 17 nt, Human
gccggcggcccaagccc

SEQ ID NO: 2267250 - RNA, 19 nt, Human
gccggcuucaugccagcua

SEQ ID NO: 2267251 - RNA, 22 nt, Human
gccggcuggaaaugcugggcug

SEQ ID NO: 2267252 - RNA, 17 nt, Human
gccggcgagcccugugg

SEQ ID NO: 2267253 - RNA, 15 nt, Human
gccggcgagcccugu

SEQ ID NO: 2267254 - RNA, 18 nt, Human
gccggcgagcccugugga

SEQ ID NO: 2267255 - RNA, 13 nt, Human
gccggcuggaaau

SEQ ID NO: 2267256 - RNA, 19 nt, Human
gccgggcgugguggcgggc

SEQ ID NO: 2267257 - RNA, 12 nt, Human
gccgggccuggg

SEQ ID NO: 2267258 - RNA, 21 nt, Human
gccgggcgcgguggcucacgc

SEQ ID NO: 2267259 - RNA, 14 nt, Human
gccgguaccuggga

SEQ ID NO: 2267260 - RNA, 20 nt, Human
gccgggcgugguggugagug

SEQ ID NO: 2267261 - RNA, 16 nt, Human
gcccugcuuugggcug

SEQ ID NO: 2267262 - RNA, 18 nt, Human
gcccugcuuugggcugcc

SEQ ID NO: 2267263 - RNA, 21 nt, Human
gcccugcuggccgccucaccc

SEQ ID NO: 2267264 - RNA, 22 nt, Human
gcccugcuggccgccucacccc

SEQ ID NO: 2267265 - RNA, 23 nt, Human
gcccugcuggccgccucaccccc

SEQ ID NO: 2267266 - RNA, 11 nt, Human
gcccugcuggc

SEQ ID NO: 2267267 - RNA, 14 nt, Human
gcccugcuggccgc

SEQ ID NO: 2267268 - RNA, 18 nt, Human
gcccugcuggccgccuca

SEQ ID NO: 2267269 - RNA, 20 nt, Human
gcccugcuggccgccucacc

SEQ ID NO: 2267270 - RNA, 14 nt, Human
gcccuucucuccag

SEQ ID NO: 2267271 - RNA, 16 nt, Human
gcccuucucuccagcc

SEQ ID NO: 2267272 - RNA, 17 nt, Human
gcccuucucuccagccc

SEQ ID NO: 2267273 - RNA, 18 nt, Human
gcccuucucuccagcccc

SEQ ID NO: 2267274 - RNA, 16 nt, Human
gcccuuggaggccagc

SEQ ID NO: 2267275 - RNA, 16 nt, Human
gcccuugccuccccau

SEQ ID NO: 2267276 - RNA, 12 nt, Human
gcccuuguccca

SEQ ID NO: 2267277 - RNA, 24 nt, Human
gcccuugucccacucaagccaagc

SEQ ID NO: 2267278 - RNA, 21 nt, Human
gcccuugucccacucaagcca

SEQ ID NO: 2267279 - RNA, 13 nt, Human
gcccuugucugag

SEQ ID NO: 2267280 - RNA, 14 nt, Human
gcccuugcccugac

SEQ ID NO: 2267281 - RNA, 15 nt, Human
gcccuugcccugacc

SEQ ID NO: 2267282 - RNA, 16 nt, Human
gcccuugcccugaccu

SEQ ID NO: 2267283 - RNA, 18 nt, Human
gcccuugcccugaccucc

SEQ ID NO: 2267284 - RNA, 21 nt, Human
gcccuugcccugaccucccag

SEQ ID NO: 2267285 - RNA, 13 nt, Human
gcccuugccuccc

SEQ ID NO: 2267286 - RNA, 14 nt, Human
gcccuugccucccc

SEQ ID NO: 2267287 - RNA, 12 nt, Human
gcccuuggccag

SEQ ID NO: 2267288 - RNA, 22 nt, Human
gccgaagaaggguccuucccuc

SEQ ID NO: 2267289 - RNA, 19 nt, Human
gccgaagaaggguccuucc

SEQ ID NO: 2267290 - RNA, 12 nt, Human
gccgaaccagga

SEQ ID NO: 2267291 - RNA, 19 nt, Human
gccgaaccaggagcugcuc

SEQ ID NO: 2267292 - RNA, 17 nt, Human
gccgaccagagccccac

SEQ ID NO: 2267293 - RNA, 14 nt, Human
gccgaaugugcagg

SEQ ID NO: 2267294 - RNA, 14 nt, Human
gccgaccagagccc

SEQ ID NO: 2267295 - RNA, 19 nt, Human
gccgaagcucuggcugaac

SEQ ID NO: 2267296 - RNA, 20 nt, Human
gccgaauccccucccuguca

SEQ ID NO: 2267297 - RNA, 15 nt, Human
gccgaaugcccucag

SEQ ID NO: 2267298 - RNA, 12 nt, Human
gccgaagcucug

SEQ ID NO: 2267299 - RNA, 14 nt, Human
gccgaagcucuggc

SEQ ID NO: 2267300 - RNA, 17 nt, Human
gccgaagcucuggcuga

SEQ ID NO: 2267301 - RNA, 15 nt, Human
gcgaaccaauauuug

SEQ ID NO: 2267302 - RNA, 19 nt, Human
gcgacagagcgagagucug

SEQ ID NO: 2267303 - RNA, 12 nt, Human
gcgacagugaga

SEQ ID NO: 2267304 - RNA, 21 nt, Human
gcgccgcaaaccacacuggac

SEQ ID NO: 2267305 - RNA, 23 nt, Human
gcgccggcaaaacuuuggcacug

SEQ ID NO: 2267306 - RNA, 17 nt, Human
gcgccggcgggcgggcc

SEQ ID NO: 2267307 - RNA, 13 nt, Human
gcgccgucuccag

SEQ ID NO: 2267308 - RNA, 15 nt, Human
gcgccgucuccaggg

SEQ ID NO: 2267309 - RNA, 19 nt, Human
gcgccgcaaaccacacugg

SEQ ID NO: 2267310 - RNA, 23 nt, Human
gcgacagagcgagagucugucuc

SEQ ID NO: 2267311 - RNA, 15 nt, Human
gcgccuacaggagug

SEQ ID NO: 2267312 - RNA, 22 nt, Human
gcgccgucuccaggggcugcuu

SEQ ID NO: 2267313 - RNA, 18 nt, Human
gcgccggcgggcgggccg

SEQ ID NO: 2267314 - RNA, 19 nt, Human
gcgccgugaguucucaggg

SEQ ID NO: 2267315 - RNA, 23 nt, Human
gcgccgugaguucucagggcucc

SEQ ID NO: 2267316 - RNA, 16 nt, Human
gcgccuuucccaacuc

SEQ ID NO: 2267317 - RNA, 20 nt, Human
gcgcgagggccucaaaggcc

SEQ ID NO: 2267318 - RNA, 15 nt, Human
gcgccuuucccaacu

SEQ ID NO: 2267319 - RNA, 14 nt, Human
gcgccuuucccaac

SEQ ID NO: 2267320 - RNA, 20 nt, Human
gcgccgugaguucucagggc

SEQ ID NO: 2267321 - RNA, 22 nt, Human
gcgccgugaguucucagggcuc

SEQ ID NO: 2267322 - RNA, 11 nt, Human
gcggacagcca

SEQ ID NO: 2267323 - RNA, 13 nt, Human
gcggacagccacg

SEQ ID NO: 2267324 - RNA, 16 nt, Human
gcgcuacccacuucua

SEQ ID NO: 2267325 - RNA, 13 nt, Human
gcgcuacccacuu

SEQ ID NO: 2267326 - RNA, 13 nt, Human
gcgcucagggcca

SEQ ID NO: 2267327 - RNA, 22 nt, Human
gcgcucagggccaugcugaggc

SEQ ID NO: 2267328 - RNA, 14 nt, Human
gcgcgccacucgcu

SEQ ID NO: 2267329 - RNA, 13 nt, Human
gcgcggccagccc

SEQ ID NO: 2267330 - RNA, 14 nt, Human
gcgcggccagcccc

SEQ ID NO: 2267331 - RNA, 15 nt, Human
gcgcggccagccccg

SEQ ID NO: 2267332 - RNA, 16 nt, Human
gcgcggccagccccgg

SEQ ID NO: 2267333 - RNA, 15 nt, Human
gcgcgucccccugcc

SEQ ID NO: 2267334 - RNA, 21 nt, Human
gcgcggccagccccggcccug

SEQ ID NO: 2267335 - RNA, 23 nt, Human
gcgcggccagccccggcccuggg

SEQ ID NO: 2267336 - RNA, 17 nt, Human
gcgcggggagcccgucg

SEQ ID NO: 2267337 - RNA, 17 nt, Human
gcgucgcccucccaggc

SEQ ID NO: 2267338 - RNA, 21 nt, Human
gcguagaucaccagaauaaac

SEQ ID NO: 2267339 - RNA, 15 nt, Human
gcguagaaguuuuug

SEQ ID NO: 2267340 - RNA, 19 nt, Human
gcgucucauacucaccuca

SEQ ID NO: 2267341 - RNA, 14 nt, Human
gcgguuuggggagc

SEQ ID NO: 2267342 - RNA, 18 nt, Human
gcggugggcacccacccu

SEQ ID NO: 2267343 - RNA, 18 nt, Human
gcgguggaaggcccgagg

SEQ ID NO: 2267344 - RNA, 14 nt, Human
gcgguggcccuguc

SEQ ID NO: 2267345 - RNA, 15 nt, Human
gcgguggcccugucc

SEQ ID NO: 2267346 - RNA, 23 nt, Human
gcgguuaugaaauucacccccuu

SEQ ID NO: 2267347 - RNA, 20 nt, Human
gcgggucacaggagggaggg

SEQ ID NO: 2267348 - RNA, 19 nt, Human
gcgggucacaggagggagg

SEQ ID NO: 2267349 - RNA, 21 nt, Human
gcgggugaacaaagcagccac

SEQ ID NO: 2267350 - RNA, 22 nt, Human
gcgggugaacaaagcagccacg

SEQ ID NO: 2267351 - RNA, 14 nt, Human
gcgguggaaggccc

SEQ ID NO: 2267352 - RNA, 13 nt, Human
gcggggggaggga

SEQ ID NO: 2267353 - RNA, 15 nt, Human
gcgggggccagggaa

SEQ ID NO: 2267354 - RNA, 15 nt, Human
gcgggucacaggagg

SEQ ID NO: 2267355 - RNA, 13 nt, Human
gcgggucacagga

SEQ ID NO: 2267356 - RNA, 20 nt, Human
gcgggccccucaucgcgucc

SEQ ID NO: 2267357 - RNA, 20 nt, Human
gcgggcgccuguagucccag

SEQ ID NO: 2267358 - RNA, 15 nt, Human
gcgggccagccaggc

SEQ ID NO: 2267359 - RNA, 16 nt, Human
gcgggccagccaggcg

SEQ ID NO: 2267360 - RNA, 19 nt, Human
gcgggccagccaggcgggc

SEQ ID NO: 2267361 - RNA, 21 nt, Human
gcgggccagccaggcgggcuc

SEQ ID NO: 2267362 - RNA, 16 nt, Human
gcgggcagcacagcaa

SEQ ID NO: 2267363 - RNA, 15 nt, Human
gcgggcagcacagca

SEQ ID NO: 2267364 - RNA, 20 nt, Human
gcgggccaaggacugccgac

SEQ ID NO: 2267365 - RNA, 17 nt, Human
gcgggccaaggacugcc

SEQ ID NO: 2267366 - RNA, 15 nt, Human
gcgggccaaggacug

SEQ ID NO: 2267367 - RNA, 13 nt, Human
gcgggccaaggac

SEQ ID NO: 2267368 - RNA, 15 nt, Human
gcggacagccacggc

SEQ ID NO: 2267369 - RNA, 16 nt, Human
gcgcucagggccaugc

SEQ ID NO: 2267370 - RNA, 15 nt, Human
gcgggaugguccugg

SEQ ID NO: 2267371 - RNA, 17 nt, Human
gcgggaugguccugggg

SEQ ID NO: 2267372 - RNA, 16 nt, Human
gcgggaugguccuggg

SEQ ID NO: 2267373 - RNA, 20 nt, Human
gcgggcaccuauagucccag

SEQ ID NO: 2267374 - RNA, 14 nt, Human
gcgggcagcacagc

SEQ ID NO: 2267375 - RNA, 15 nt, Human
gcuaaagcccagaga

SEQ ID NO: 2267376 - RNA, 16 nt, Human
gcuaagaauauuugaa

SEQ ID NO: 2267377 - RNA, 17 nt, Human
gcuaagaauauuugaau

SEQ ID NO: 2267378 - RNA, 13 nt, Human
gcuaagagggagg

SEQ ID NO: 2267379 - RNA, 14 nt, Human
gcuaaagagcccuu

SEQ ID NO: 2267380 - RNA, 13 nt, Human
gcuaaagaaaaag

SEQ ID NO: 2267381 - RNA, 19 nt, Human
gcuaaagcaauaugcauuu

SEQ ID NO: 2267382 - RNA, 17 nt, Human
gcuaaagcaauaugcau

SEQ ID NO: 2267383 - RNA, 18 nt, Human
gcuaaagagcccuugccu

SEQ ID NO: 2267384 - RNA, 22 nt, Human
gcuaaagagcccuugccucccc

SEQ ID NO: 2267385 - RNA, 23 nt, Human
gcuaaagagcccuugccucccca

SEQ ID NO: 2267386 - RNA, 11 nt, Human
gcgucuccugu

SEQ ID NO: 2267387 - RNA, 20 nt, Human
gcgucuccuguuuuucuggg

SEQ ID NO: 2267388 - RNA, 21 nt, Human
gcgucuggaaguccaaugugg

SEQ ID NO: 2267389 - RNA, 21 nt, Human
gcgucuccuguuuuucugggu

SEQ ID NO: 2267390 - RNA, 17 nt, Human
gcgucuggaggggcccc

SEQ ID NO: 2267391 - RNA, 18 nt, Human
gcgucugucuucaagggc

SEQ ID NO: 2267392 - RNA, 17 nt, Human
gcgucuguucccccuuc

SEQ ID NO: 2267393 - RNA, 18 nt, Human
gcgucuggaggggccccu

SEQ ID NO: 2267394 - RNA, 20 nt, Human
gcgucuggaggggccccugc

SEQ ID NO: 2267395 - RNA, 21 nt, Human
gcgucuggaggggccccugcu

SEQ ID NO: 2267396 - RNA, 23 nt, Human
gcgucuggaggggccccugcuuc

SEQ ID NO: 2267397 - RNA, 16 nt, Human
gcgucuguucccccuu

SEQ ID NO: 2267398 - RNA, 21 nt, Human
gcuacaggaagcaccccaugc

SEQ ID NO: 2267399 - RNA, 20 nt, Human
gcuacaggaagcaccccaug

SEQ ID NO: 2267400 - RNA, 19 nt, Human
gcuacaggaagcaccccau

SEQ ID NO: 2267401 - RNA, 20 nt, Human
gcuaagagcuagcgcugccg

SEQ ID NO: 2267402 - RNA, 16 nt, Human
gcuacacagaucacag

SEQ ID NO: 2267403 - RNA, 14 nt, Human
gcuacacagggaug

SEQ ID NO: 2267404 - RNA, 14 nt, Human
gcuacacaggggaa

SEQ ID NO: 2267405 - RNA, 18 nt, Human
gcuaagagcuagcgcugc

SEQ ID NO: 2267406 - RNA, 20 nt, Human
gcuaagagggagggagggcu

SEQ ID NO: 2267407 - RNA, 20 nt, Human
gcuacacacugcauguuugu

SEQ ID NO: 2267408 - RNA, 13 nt, Human
gcuacacacugca

SEQ ID NO: 2267409 - RNA, 12 nt, Human
gcuacagguuac

SEQ ID NO: 2267410 - RNA, 23 nt, Human
gcuacaggggaagguggccucug

SEQ ID NO: 2267411 - RNA, 14 nt, Human
gcuacagguuacaa

SEQ ID NO: 2267412 - RNA, 23 nt, Human
gcuacaggaagcaccccaugcca

SEQ ID NO: 2267413 - RNA, 22 nt, Human
gcuacaggaagcaccccaugcc

SEQ ID NO: 2267414 - RNA, 15 nt, Human
gcuacagguuacaac

SEQ ID NO: 2267415 - RNA, 16 nt, Human
gcuacagguuacaaca

SEQ ID NO: 2267416 - RNA, 18 nt, Human
gcuacagguuacaacaga

SEQ ID NO: 2267417 - RNA, 19 nt, Human
gcuacagguuacaacagau

SEQ ID NO: 2267418 - RNA, 20 nt, Human
gcuacagguuacaacagauu

SEQ ID NO: 2267419 - RNA, 20 nt, Human
gcuaccuuuguauucucucc

SEQ ID NO: 2267420 - RNA, 16 nt, Human
gcuaccuuuguauucu

SEQ ID NO: 2267421 - RNA, 19 nt, Human
gcuagaacucccuuucaac

SEQ ID NO: 2267422 - RNA, 20 nt, Human
gcuaccuugugacccagcac

SEQ ID NO: 2267423 - RNA, 23 nt, Human
gcuauagacccgaggaaacucag

SEQ ID NO: 2267424 - RNA, 19 nt, Human
gcuauagacccgaggaaac

SEQ ID NO: 2267425 - RNA, 22 nt, Human
gcuagcuucugcuuuucugccc

SEQ ID NO: 2267426 - RNA, 17 nt, Human
gcuauagccuggggugg

SEQ ID NO: 2267427 - RNA, 22 nt, Human
gcuaggaaauccaggguggugg

SEQ ID NO: 2267428 - RNA, 16 nt, Human
gcuaggaacacuccuu

SEQ ID NO: 2267429 - RNA, 18 nt, Human
gcuauagcuacaggaagc

SEQ ID NO: 2267430 - RNA, 16 nt, Human
gcuauagcuacaggaa

SEQ ID NO: 2267431 - RNA, 16 nt, Human
gcuauaggcuggagaa

SEQ ID NO: 2267432 - RNA, 16 nt, Human
gcuauagcucaggacc

SEQ ID NO: 2267433 - RNA, 17 nt, Human
gcuauagcucaggaccu

SEQ ID NO: 2267434 - RNA, 13 nt, Human
gcuauaggugcua

SEQ ID NO: 2267435 - RNA, 20 nt, Human
gcuagaagugggccaggaca

SEQ ID NO: 2267436 - RNA, 17 nt, Human
gcuagaaggccacaugu

SEQ ID NO: 2267437 - RNA, 13 nt, Human
gcuagaaggccac

SEQ ID NO: 2267438 - RNA, 15 nt, Human
gcuagaaggccacau

SEQ ID NO: 2267439 - RNA, 21 nt, Human
gcuaccuugugacccagcacu

SEQ ID NO: 2267440 - RNA, 14 nt, Human
gcuagaagcuggag

SEQ ID NO: 2267441 - RNA, 15 nt, Human
gcuagaagcuggagg

SEQ ID NO: 2267442 - RNA, 21 nt, Human
gcuagaagugggccaggacag

SEQ ID NO: 2267443 - RNA, 17 nt, Human
gcuagaauauccuacuu

SEQ ID NO: 2267444 - RNA, 19 nt, Human
gcuagaaucuggagagcua

SEQ ID NO: 2267445 - RNA, 22 nt, Human
gcuagaauucccucucucugac

SEQ ID NO: 2267446 - RNA, 15 nt, Human
gcuagcuucugcuuu

SEQ ID NO: 2267447 - RNA, 19 nt, Human
gcuaggaaauccagggugg

SEQ ID NO: 2267448 - RNA, 17 nt, Human
gcuagcuucugcuuuuc

SEQ ID NO: 2267449 - RNA, 18 nt, Human
gcuagcuucugcuuuucu

SEQ ID NO: 2267450 - RNA, 23 nt, Human
gcuagcuucugcuuuucugcccu

SEQ ID NO: 2267451 - RNA, 15 nt, Human
gcuaggaacacuccu

SEQ ID NO: 2267452 - RNA, 16 nt, Human
gccuuuggcagaguuc

SEQ ID NO: 2267453 - RNA, 13 nt, Human
gccuuuggcaggu

SEQ ID NO: 2267454 - RNA, 15 nt, Human
gccuuuggcaggugc

SEQ ID NO: 2267455 - RNA, 13 nt, Human
gccuuuggcuuca

SEQ ID NO: 2267456 - RNA, 13 nt, Human
gccuuuggcucug

SEQ ID NO: 2267457 - RNA, 15 nt, Human
gccuuuggcucugga

SEQ ID NO: 2267458 - RNA, 23 nt, Human
gcgaaaggauguaaacagugccu

SEQ ID NO: 2267459 - RNA, 23 nt, Human
gcgacaaugcaaaccaucauuga

SEQ ID NO: 2267460 - RNA, 16 nt, Human
gccuuuggcucuggag

SEQ ID NO: 2267461 - RNA, 19 nt, Human
gccuuuuuucacggaaguu

SEQ ID NO: 2267462 - RNA, 20 nt, Human
gccuuuuuucacggaaguuu

SEQ ID NO: 2267463 - RNA, 23 nt, Human
gccuuuuuucacggaaguuuuca

SEQ ID NO: 2267464 - RNA, 23 nt, Human
gccuuggauaaugcuguugccuc

SEQ ID NO: 2267465 - RNA, 19 nt, Human
gccuuggauaaugcuguug

SEQ ID NO: 2267466 - RNA, 21 nt, Human
gccuuggagggucccaagcug

SEQ ID NO: 2267467 - RNA, 21 nt, Human
gccuuggauaaugcuguugcc

SEQ ID NO: 2267468 - RNA, 20 nt, Human
gccuuggccuccccugcuga

SEQ ID NO: 2267469 - RNA, 12 nt, Human
gccuuggcucag

SEQ ID NO: 2267470 - RNA, 16 nt, Human
gccuuggcucagacau

SEQ ID NO: 2267471 - RNA, 15 nt, Human
gccuuggcucagaca

SEQ ID NO: 2267472 - RNA, 14 nt, Human
gccuuggcucagac

SEQ ID NO: 2267473 - RNA, 16 nt, Human
gccuuugaccugccuc

SEQ ID NO: 2267474 - RNA, 14 nt, Human
gccuuugagacagu

SEQ ID NO: 2267475 - RNA, 19 nt, Human
gccuuugagacaguuucuu

SEQ ID NO: 2267476 - RNA, 20 nt, Human
gccuuugagacaguuucuua

SEQ ID NO: 2267477 - RNA, 21 nt, Human
gccuuugagacaguuucuuag

SEQ ID NO: 2267478 - RNA, 23 nt, Human
gccuuugagcccacaaagccuua

SEQ ID NO: 2267479 - RNA, 17 nt, Human
gccuuugaucagguggg

SEQ ID NO: 2267480 - RNA, 22 nt, Human
gccuuugaguuuccucaggcug

SEQ ID NO: 2267481 - RNA, 23 nt, Human
gccuuugagacaguuucuuagcu

SEQ ID NO: 2267482 - RNA, 18 nt, Human
gccuuugagcccacaaag

SEQ ID NO: 2267483 - RNA, 15 nt, Human
gccuuugccuccccg

SEQ ID NO: 2267484 - RNA, 20 nt, Human
gccuuuggaugaccagaaca

SEQ ID NO: 2267485 - RNA, 13 nt, Human
gccuuugcuccuc

SEQ ID NO: 2267486 - RNA, 22 nt, Human
gccuuuggaaacagcucgacuu

SEQ ID NO: 2267487 - RNA, 22 nt, Human
gccuuccacgcugucuccagac

SEQ ID NO: 2267488 - RNA, 19 nt, Human
gccuuccacgcugucucca

SEQ ID NO: 2267489 - RNA, 13 nt, Human
gccuucauuaccu

SEQ ID NO: 2267490 - RNA, 12 nt, Human
gccuuccagggg

SEQ ID NO: 2267491 - RNA, 13 nt, Human
gccuucaucuccc

SEQ ID NO: 2267492 - RNA, 17 nt, Human
gccuuauccucugaucu

SEQ ID NO: 2267493 - RNA, 21 nt, Human
gccuucagggagugagggauu

SEQ ID NO: 2267494 - RNA, 13 nt, Human
gccuucagggagu

SEQ ID NO: 2267495 - RNA, 16 nt, Human
gccuuauggaacacuc

SEQ ID NO: 2267496 - RNA, 18 nt, Human
gccuuauggaacacucug

SEQ ID NO: 2267497 - RNA, 19 nt, Human
gccuuauggaacacucuga

SEQ ID NO: 2267498 - RNA, 20 nt, Human
gccuuauggaacacucugag

SEQ ID NO: 2267499 - RNA, 23 nt, Human
gccuuccacgcugucuccagacc

SEQ ID NO: 2267500 - RNA, 22 nt, Human
gccuuccacuuggcuacacagg

SEQ ID NO: 2267501 - RNA, 13 nt, Human
gccuuccucugca

SEQ ID NO: 2267502 - RNA, 16 nt, Human
gccuuccucugcagcu

SEQ ID NO: 2267503 - RNA, 17 nt, Human
gccuuccucugcagcug

SEQ ID NO: 2267504 - RNA, 19 nt, Human
gccuuccucugcagcugac

SEQ ID NO: 2267505 - RNA, 20 nt, Human
gccuuccucugcagcugacc

SEQ ID NO: 2267506 - RNA, 21 nt, Human
gccuuccucugcagcugaccu

SEQ ID NO: 2267507 - RNA, 18 nt, Human
gccuuccagcacccugca

SEQ ID NO: 2267508 - RNA, 21 nt, Human
gccuuccaggggugggacacc

SEQ ID NO: 2267509 - RNA, 15 nt, Human
gccuuccaggggugg

SEQ ID NO: 2267510 - RNA, 16 nt, Human
gccuuccagggguggg

SEQ ID NO: 2267511 - RNA, 23 nt, Human
gccuucgauacaccgggccugga

SEQ ID NO: 2267512 - RNA, 19 nt, Human
gccuuccugcccuacagag

SEQ ID NO: 2267513 - RNA, 11 nt, Human
gccuuccuugc

SEQ ID NO: 2267514 - RNA, 19 nt, Human
gccuugcuaccucaagggg

SEQ ID NO: 2267515 - RNA, 22 nt, Human
gccuugcucccaaccccacacg

SEQ ID NO: 2267516 - RNA, 14 nt, Human
gccuugcuggacgg

SEQ ID NO: 2267517 - RNA, 19 nt, Human
gccuuggaaguugcauggc

SEQ ID NO: 2267518 - RNA, 19 nt, Human
gccuuggagggucccaagc

SEQ ID NO: 2267519 - RNA, 20 nt, Human
gccuuggagggucccaagcu

SEQ ID NO: 2267520 - RNA, 18 nt, Human
gccuucgauacaccgggc

SEQ ID NO: 2267521 - RNA, 22 nt, Human
gccuucgauacaccgggccugg

SEQ ID NO: 2267522 - RNA, 19 nt, Human
gccuuccuguuuuucacau

SEQ ID NO: 2267523 - RNA, 13 nt, Human
gccuuccuugcua

SEQ ID NO: 2267524 - RNA, 22 nt, Human
gccugggguggggucaugcccu

SEQ ID NO: 2267525 - RNA, 17 nt, Human
gccugguccucacacuc

SEQ ID NO: 2267526 - RNA, 14 nt, Human
gccuggggucugga

SEQ ID NO: 2267527 - RNA, 16 nt, Human
gccuggggugggguca

SEQ ID NO: 2267528 - RNA, 14 nt, Human
gccugggguggggu

SEQ ID NO: 2267529 - RNA, 13 nt, Human
gccugguggcagc

SEQ ID NO: 2267530 - RNA, 13 nt, Human
gccuggugcagug

SEQ ID NO: 2267531 - RNA, 19 nt, Human
gccugguggcagcugcggu

SEQ ID NO: 2267532 - RNA, 21 nt, Human
gccugguggcagcugcggucc

SEQ ID NO: 2267533 - RNA, 18 nt, Human
gccugguggcagcugcgg

SEQ ID NO: 2267534 - RNA, 13 nt, Human
gccuggugcugcu

SEQ ID NO: 2267535 - RNA, 14 nt, Human
gccugguggcagcu

SEQ ID NO: 2267536 - RNA, 22 nt, Human
gccugggggcugggcagaggaa

SEQ ID NO: 2267537 - RNA, 21 nt, Human
gccugggggugccaggaccag

SEQ ID NO: 2267538 - RNA, 15 nt, Human
gccugccaguccuag

SEQ ID NO: 2267539 - RNA, 22 nt, Human
gccugggguaccaagagacucc

SEQ ID NO: 2267540 - RNA, 17 nt, Human
gccugggggugccagga

SEQ ID NO: 2267541 - RNA, 16 nt, Human
gccugggggugccagg

SEQ ID NO: 2267542 - RNA, 18 nt, Human
gccugccagcugcacuga

SEQ ID NO: 2267543 - RNA, 14 nt, Human
gccugccaguccua

SEQ ID NO: 2267544 - RNA, 16 nt, Human
gccugccaguccuagc

SEQ ID NO: 2267545 - RNA, 23 nt, Human
gccugccacucaggcccaaagcc

SEQ ID NO: 2267546 - RNA, 15 nt, Human
gccugccagcugcac

SEQ ID NO: 2267547 - RNA, 14 nt, Human
gccugccagcugca

SEQ ID NO: 2267548 - RNA, 15 nt, Human
gccugccacucaggc

SEQ ID NO: 2267549 - RNA, 15 nt, Human
gccugcaauuucaua

SEQ ID NO: 2267550 - RNA, 23 nt, Human
gccuuaucuccaagaccagagau

SEQ ID NO: 2267551 - RNA, 22 nt, Human
gccuuaucuugcaccccaaagc

SEQ ID NO: 2267552 - RNA, 15 nt, Human
gccuuauccucugau

SEQ ID NO: 2267553 - RNA, 16 nt, Human
gccuuauccucugauc

SEQ ID NO: 2267554 - RNA, 17 nt, Human
gccuuaaaaccaaagag

SEQ ID NO: 2267555 - RNA, 13 nt, Human
gccuuaucaagug

SEQ ID NO: 2267556 - RNA, 14 nt, Human
gccuuaucaagugu

SEQ ID NO: 2267557 - RNA, 17 nt, Human
gccuuaucaagugucuu

SEQ ID NO: 2267558 - RNA, 19 nt, Human
gccuuaucaagugucuucc

SEQ ID NO: 2267559 - RNA, 20 nt, Human
gccuuaucaagugucuucca

SEQ ID NO: 2267560 - RNA, 13 nt, Human
gccuuauccucug

SEQ ID NO: 2267561 - RNA, 10 nt, Human
gccuuaugga

SEQ ID NO: 2267562 - RNA, 14 nt, Human
gccuuauggaacac

SEQ ID NO: 2267563 - RNA, 17 nt, Human
gccuuagaaccuuucuu

SEQ ID NO: 2267564 - RNA, 19 nt, Human
gccuuagaagucacacagu

SEQ ID NO: 2267565 - RNA, 17 nt, Human
gccuuagaagucacaca

SEQ ID NO: 2267566 - RNA, 18 nt, Human
gccuuagaagucacacag

SEQ ID NO: 2267567 - RNA, 12 nt, Human
gccuuaaaacuu

SEQ ID NO: 2267568 - RNA, 14 nt, Human
gccuuaaaaccaaa

SEQ ID NO: 2267569 - RNA, 13 nt, Human
gccuuaaaacuuu

SEQ ID NO: 2267570 - RNA, 20 nt, Human
gccuuacacaaugguuuucu

SEQ ID NO: 2267571 - RNA, 18 nt, Human
gccuuacccucauguucu

SEQ ID NO: 2267572 - RNA, 21 nt, Human
gccuuacacaaugguuuucuu

SEQ ID NO: 2267573 - RNA, 15 nt, Human
gccuggugggccucc

SEQ ID NO: 2267574 - RNA, 13 nt, Human
gccuggugggccu

SEQ ID NO: 2267575 - RNA, 12 nt, Human
gccuguuuaaga

SEQ ID NO: 2267576 - RNA, 20 nt, Human
gccuguuuuagaagguucuc

SEQ ID NO: 2267577 - RNA, 20 nt, Human
gccugguggaaggaggcgca

SEQ ID NO: 2267578 - RNA, 13 nt, Human
gccuguuuaagag

SEQ ID NO: 2267579 - RNA, 14 nt, Human
gccagcugcacuga

SEQ ID NO: 2267580 - RNA, 20 nt, Human
gccagcugcacugaugcugc

SEQ ID NO: 2267581 - RNA, 22 nt, Human
gccagccuggcuucuggagccc

SEQ ID NO: 2267582 - RNA, 21 nt, Human
gccagccuggcuucuggagcc

SEQ ID NO: 2267583 - RNA, 20 nt, Human
gccagccuggcuucuggagc

SEQ ID NO: 2267584 - RNA, 15 nt, Human
gccagcucuguauca

SEQ ID NO: 2267585 - RNA, 23 nt, Human
gccagcucuguaucaggacccag

SEQ ID NO: 2267586 - RNA, 11 nt, Human
gccagccuggc

SEQ ID NO: 2267587 - RNA, 17 nt, Human
gccagccuccucuggac

SEQ ID NO: 2267588 - RNA, 19 nt, Human
gccagccugcuccuuccca

SEQ ID NO: 2267589 - RNA, 15 nt, Human
gccagccuccucugg

SEQ ID NO: 2267590 - RNA, 16 nt, Human
gccagccuccucugga

SEQ ID NO: 2267591 - RNA, 19 nt, Human
gccagccuggcuucuggag

SEQ ID NO: 2267592 - RNA, 18 nt, Human
gccagccuggcuucugga

SEQ ID NO: 2267593 - RNA, 17 nt, Human
gccagccuggcuucugg

SEQ ID NO: 2267594 - RNA, 16 nt, Human
gccagccuggcuucug

SEQ ID NO: 2267595 - RNA, 12 nt, Human
gccagccuggcu

SEQ ID NO: 2267596 - RNA, 17 nt, Human
gccagcugccccagcca

SEQ ID NO: 2267597 - RNA, 15 nt, Human
gccagcugccgacca

SEQ ID NO: 2267598 - RNA, 18 nt, Human
gccagcugccccagccag

SEQ ID NO: 2267599 - RNA, 20 nt, Human
gccagcugccgaccagagcc

SEQ ID NO: 2267600 - RNA, 17 nt, Human
gccagcugcuugggcuu

SEQ ID NO: 2267601 - RNA, 18 nt, Human
gccagcugcuugggcuuc

SEQ ID NO: 2267602 - RNA, 20 nt, Human
gccagcugcuugggcuucau

SEQ ID NO: 2267603 - RNA, 12 nt, Human
gccaggaagcca

SEQ ID NO: 2267604 - RNA, 13 nt, Human
gccaggaagccag

SEQ ID NO: 2267605 - RNA, 14 nt, Human
gccaggaagccagc

SEQ ID NO: 2267606 - RNA, 19 nt, Human
gccaggcuccuuccugucu

SEQ ID NO: 2267607 - RNA, 18 nt, Human
gccaggcuccuuccuguc

SEQ ID NO: 2267608 - RNA, 15 nt, Human
gccaggcuccuuccu

SEQ ID NO: 2267609 - RNA, 14 nt, Human
gccaggcuccuucc

SEQ ID NO: 2267610 - RNA, 21 nt, Human
gccaggcuccuuccugucuuc

SEQ ID NO: 2267611 - RNA, 20 nt, Human
gccaggcuccuuccugucuu

SEQ ID NO: 2267612 - RNA, 12 nt, Human
gccaggcucugu

SEQ ID NO: 2267613 - RNA, 16 nt, Human
gccaggcgagaugggg

SEQ ID NO: 2267614 - RNA, 16 nt, Human
gccaggcgggcucaag

SEQ ID NO: 2267615 - RNA, 19 nt, Human
gccaggagccuccugcccu

SEQ ID NO: 2267616 - RNA, 20 nt, Human
gccaggagccuccugcccuu

SEQ ID NO: 2267617 - RNA, 14 nt, Human
gccaggagccuccu

SEQ ID NO: 2267618 - RNA, 16 nt, Human
gccaggagccuccugc

SEQ ID NO: 2267619 - RNA, 19 nt, Human
gccaggacugagccccgca

SEQ ID NO: 2267620 - RNA, 15 nt, Human
gccaggagcaaaugu

SEQ ID NO: 2267621 - RNA, 20 nt, Human
gccaggagcaaauguuucug

SEQ ID NO: 2267622 - RNA, 22 nt, Human
gccaggagcaaauguuucugca

SEQ ID NO: 2267623 - RNA, 15 nt, Human
gccaggacuccccag

SEQ ID NO: 2267624 - RNA, 22 nt, Human
gccaggaccagucaaccugggc

SEQ ID NO: 2267625 - RNA, 15 nt, Human
gccaggacaggcccg

SEQ ID NO: 2267626 - RNA, 14 nt, Human
gccaggacaggccc

SEQ ID NO: 2267627 - RNA, 22 nt, Human
gccaggaauuucccaggacccu

SEQ ID NO: 2267628 - RNA, 21 nt, Human
gccaggaauuucccaggaccc

SEQ ID NO: 2267629 - RNA, 23 nt, Human
gccaggaauuucccaggacccug

SEQ ID NO: 2267630 - RNA, 17 nt, Human
gccaggacuccccaggc

SEQ ID NO: 2267631 - RNA, 19 nt, Human
gccaggacuccccaggcca

SEQ ID NO: 2267632 - RNA, 21 nt, Human
gccaggacuccccaggccagg

SEQ ID NO: 2267633 - RNA, 22 nt, Human
gccaggacuccccaggccaggc

SEQ ID NO: 2267634 - RNA, 15 nt, Human
gccaggacugagccc

SEQ ID NO: 2267635 - RNA, 16 nt, Human
gccaggacugagcccc

SEQ ID NO: 2267636 - RNA, 17 nt, Human
gccaggacugagccccg

SEQ ID NO: 2267637 - RNA, 15 nt, Human
gccaggaagccagca

SEQ ID NO: 2267638 - RNA, 20 nt, Human
gccaggaauuucccaggacc

SEQ ID NO: 2267639 - RNA, 19 nt, Human
gccaggaauuucccaggac

SEQ ID NO: 2267640 - RNA, 18 nt, Human
gccaggaauuucccagga

SEQ ID NO: 2267641 - RNA, 17 nt, Human
gccaggaauuucccagg

SEQ ID NO: 2267642 - RNA, 14 nt, Human
gccagaggccccca

SEQ ID NO: 2267643 - RNA, 21 nt, Human
gccagagauccaaaagaagcc

SEQ ID NO: 2267644 - RNA, 21 nt, Human
gccagagagccuggugcugcu

SEQ ID NO: 2267645 - RNA, 13 nt, Human
gccagagauccaa

SEQ ID NO: 2267646 - RNA, 20 nt, Human
gccagagauccaaaagaagc

SEQ ID NO: 2267647 - RNA, 16 nt, Human
gccagagauccaaaag

SEQ ID NO: 2267648 - RNA, 22 nt, Human
gccagaggcucguugacuggcu

SEQ ID NO: 2267649 - RNA, 24 nt, Human
gccagaggcccccagcccagggcu

SEQ ID NO: 2267650 - RNA, 20 nt, Human
gccagaggcccccagcccag

SEQ ID NO: 2267651 - RNA, 23 nt, Human
gccagaggcccccagcccagggc

SEQ ID NO: 2267652 - RNA, 15 nt, Human
gccagaggcccccag

SEQ ID NO: 2267653 - RNA, 16 nt, Human
gccagaggcccccagc

SEQ ID NO: 2267654 - RNA, 18 nt, Human
gccagaggcccccagccc

SEQ ID NO: 2267655 - RNA, 19 nt, Human
gccagaggcccccagccca

SEQ ID NO: 2267656 - RNA, 16 nt, Human
gccagauccucuuggu

SEQ ID NO: 2267657 - RNA, 15 nt, Human
gccagauccucuugg

SEQ ID NO: 2267658 - RNA, 14 nt, Human
gccagaugcaccag

SEQ ID NO: 2267659 - RNA, 17 nt, Human
gccagagggagugacag

SEQ ID NO: 2267660 - RNA, 12 nt, Human
gccagaggcugg

SEQ ID NO: 2267661 - RNA, 13 nt, Human
gccagaggcuggg

SEQ ID NO: 2267662 - RNA, 20 nt, Human
gccagauccagccugggguc

SEQ ID NO: 2267663 - RNA, 17 nt, Human
gccagauccagccuggg

SEQ ID NO: 2267664 - RNA, 16 nt, Human
gccagauccagccugg

SEQ ID NO: 2267665 - RNA, 15 nt, Human
gccagauccagccug

SEQ ID NO: 2267666 - RNA, 18 nt, Human
gccagccgugaugcucag

SEQ ID NO: 2267667 - RNA, 20 nt, Human
gccagccgugaugcucaggc

SEQ ID NO: 2267668 - RNA, 21 nt, Human
gccagccgugaugcucaggcu

SEQ ID NO: 2267669 - RNA, 18 nt, Human
gccagccuccgagaggga

SEQ ID NO: 2267670 - RNA, 20 nt, Human
gccagccuccgagagggaga

SEQ ID NO: 2267671 - RNA, 21 nt, Human
gccagccuccgagagggagag

SEQ ID NO: 2267672 - RNA, 12 nt, Human
gccagccuccuc

SEQ ID NO: 2267673 - RNA, 13 nt, Human
gccagccuccucu

SEQ ID NO: 2267674 - RNA, 14 nt, Human
gccagccuccucug

SEQ ID NO: 2267675 - RNA, 22 nt, Human
gccagccgagauagccaaggcc

SEQ ID NO: 2267676 - RNA, 19 nt, Human
gccagauucuuuccugagg

SEQ ID NO: 2267677 - RNA, 15 nt, Human
gccagaugcaccagc

SEQ ID NO: 2267678 - RNA, 20 nt, Human
gccagauucuuuccugaggc

SEQ ID NO: 2267679 - RNA, 24 nt, Human
gccagauucuuuccugaggcuggg

SEQ ID NO: 2267680 - RNA, 13 nt, Human
gccagauuucacu

SEQ ID NO: 2267681 - RNA, 18 nt, Human
gccaaggccuucuccucc

SEQ ID NO: 2267682 - RNA, 14 nt, Human
gccaaggccuucuc

SEQ ID NO: 2267683 - RNA, 15 nt, Human
gccaaggccuucucc

SEQ ID NO: 2267684 - RNA, 16 nt, Human
gccaacacucaagaag

SEQ ID NO: 2267685 - RNA, 18 nt, Human
gccaaggccgaagcucug

SEQ ID NO: 2267686 - RNA, 19 nt, Human
gccaaggccgaagcucugg

SEQ ID NO: 2267687 - RNA, 20 nt, Human
gccaaggccgaagcucuggc

SEQ ID NO: 2267688 - RNA, 21 nt, Human
gccacuccagaccccuggcuu

SEQ ID NO: 2267689 - RNA, 20 nt, Human
gccacuccagaccccuggcu

SEQ ID NO: 2267690 - RNA, 21 nt, Human
gccaaggccagaguggccugg

SEQ ID NO: 2267691 - RNA, 20 nt, Human
gccaaggccagaguggccug

SEQ ID NO: 2267692 - RNA, 19 nt, Human
gccaacagaagcuuccauu

SEQ ID NO: 2267693 - RNA, 24 nt, Human
gccaaggccaaaggaagcacaugc

SEQ ID NO: 2267694 - RNA, 14 nt, Human
gccaaauuuuggcc

SEQ ID NO: 2267695 - RNA, 23 nt, Human
gccaaauuauuuguguaauagaa

SEQ ID NO: 2267696 - RNA, 13 nt, Human
gccaacaaagcug

SEQ ID NO: 2267697 - RNA, 15 nt, Human
gccaacaaagcuguu

SEQ ID NO: 2267698 - RNA, 18 nt, Human
gccaaauuauuuguguaa

SEQ ID NO: 2267699 - RNA, 19 nt, Human
gccaaauuauuuguguaau

SEQ ID NO: 2267700 - RNA, 14 nt, Human
gccaacaccaggga

SEQ ID NO: 2267701 - RNA, 18 nt, Human
gccaacaaagcuguugau

SEQ ID NO: 2267702 - RNA, 16 nt, Human
gccaacaacuucucca

SEQ ID NO: 2267703 - RNA, 20 nt, Human
gccaacacgcaccugccuca

SEQ ID NO: 2267704 - RNA, 17 nt, Human
gccaacacgcaccugcc

SEQ ID NO: 2267705 - RNA, 17 nt, Human
gccaacagaagcuucca

SEQ ID NO: 2267706 - RNA, 20 nt, Human
gccaacacucaagaagcagg

SEQ ID NO: 2267707 - RNA, 23 nt, Human
gccaacacgcaccugccucagga

SEQ ID NO: 2267708 - RNA, 21 nt, Human
gccaacacgcaccugccucag

SEQ ID NO: 2267709 - RNA, 20 nt, Human
gccaaggccaaaggaagcac

SEQ ID NO: 2267710 - RNA, 20 nt, Human
gccacugcaccgggccacag

SEQ ID NO: 2267711 - RNA, 21 nt, Human
gccacugcaccgggccacaga

SEQ ID NO: 2267712 - RNA, 22 nt, Human
gccacuccagaccccuggcuuu

SEQ ID NO: 2267713 - RNA, 21 nt, Human
gccacuccgagaggugggcca

SEQ ID NO: 2267714 - RNA, 17 nt, Human
gccacuccucugacuca

SEQ ID NO: 2267715 - RNA, 15 nt, Human
gccacuccucugacu

SEQ ID NO: 2267716 - RNA, 14 nt, Human
gccacuccucugac

SEQ ID NO: 2267717 - RNA, 13 nt, Human
gccacuccucuga

SEQ ID NO: 2267718 - RNA, 19 nt, Human
gccacugcaccgggccaca

SEQ ID NO: 2267719 - RNA, 21 nt, Human
gccacuccucugacucagggc

SEQ ID NO: 2267720 - RNA, 22 nt, Human
gccacucccggcacuccaugcu

SEQ ID NO: 2267721 - RNA, 20 nt, Human
gccagagacggaagccuuuu

SEQ ID NO: 2267722 - RNA, 22 nt, Human
gccagagacacaagccuucggc

SEQ ID NO: 2267723 - RNA, 22 nt, Human
gccacugcaccgggccacagag

SEQ ID NO: 2267724 - RNA, 21 nt, Human
gccagagacacaagccuucgg

SEQ ID NO: 2267725 - RNA, 21 nt, Human
gccaucugggcuccuccaggg

SEQ ID NO: 2267726 - RNA, 15 nt, Human
gccaucugugggcac

SEQ ID NO: 2267727 - RNA, 13 nt, Human
gccaucugugggc

SEQ ID NO: 2267728 - RNA, 12 nt, Human
gccaucuguggg

SEQ ID NO: 2267729 - RNA, 17 nt, Human
gccaucugugggcacgc

SEQ ID NO: 2267730 - RNA, 17 nt, Human
gccaucuuccagguggg

SEQ ID NO: 2267731 - RNA, 14 nt, Human
gccaucuucccagc

SEQ ID NO: 2267732 - RNA, 14 nt, Human
gccaucuugguaaa

SEQ ID NO: 2267733 - RNA, 15 nt, Human
gccaucuugguaaau

SEQ ID NO: 2267734 - RNA, 16 nt, Human
gccaucuugguaaauu

SEQ ID NO: 2267735 - RNA, 22 nt, Human
gccaucuugguaaauuucccca

SEQ ID NO: 2267736 - RNA, 19 nt, Human
gccauccggcccccagagc

SEQ ID NO: 2267737 - RNA, 22 nt, Human
gccauccggcccccagagcgcc

SEQ ID NO: 2267738 - RNA, 18 nt, Human
gccauccucaaacacugc

SEQ ID NO: 2267739 - RNA, 19 nt, Human
gccauccucaaacacugca

SEQ ID NO: 2267740 - RNA, 20 nt, Human
gccauccucaaacacugcag

SEQ ID NO: 2267741 - RNA, 21 nt, Human
gccauccucaaacacugcagg

SEQ ID NO: 2267742 - RNA, 23 nt, Human
gccauccucaaacacugcaggca

SEQ ID NO: 2267743 - RNA, 14 nt, Human
gccauccagguuca

SEQ ID NO: 2267744 - RNA, 21 nt, Human
gccaucauguuuacagaggac

SEQ ID NO: 2267745 - RNA, 17 nt, Human
gccaucauguuuacaga

SEQ ID NO: 2267746 - RNA, 20 nt, Human
gccauccaaauaagaaaccu

SEQ ID NO: 2267747 - RNA, 19 nt, Human
gccaucaucaguggagcca

SEQ ID NO: 2267748 - RNA, 21 nt, Human
gccauccaaauaagaaaccua

SEQ ID NO: 2267749 - RNA, 14 nt, Human
gccaucccucgugg

SEQ ID NO: 2267750 - RNA, 21 nt, Human
gccaucccucgugguccccaa

SEQ ID NO: 2267751 - RNA, 17 nt, Human
gccaugccucagcccug

SEQ ID NO: 2267752 - RNA, 21 nt, Human
gccaugccucagcccugaccc

SEQ ID NO: 2267753 - RNA, 20 nt, Human
gccaugcgcccccuccgccc

SEQ ID NO: 2267754 - RNA, 14 nt, Human
gccaugcuccuggc

SEQ ID NO: 2267755 - RNA, 13 nt, Human
gccaugccucagc

SEQ ID NO: 2267756 - RNA, 14 nt, Human
gccaugccucagcc

SEQ ID NO: 2267757 - RNA, 20 nt, Human
gccaugauucgcccaaagcc

SEQ ID NO: 2267758 - RNA, 17 nt, Human
gccaugauguggagugg

SEQ ID NO: 2267759 - RNA, 22 nt, Human
gccaugauguggaguggggcag

SEQ ID NO: 2267760 - RNA, 21 nt, Human
gccaugauggugcugaccucu

SEQ ID NO: 2267761 - RNA, 22 nt, Human
gccaugauggugcugaccucug

SEQ ID NO: 2267762 - RNA, 15 nt, Human
gccaugauguggagu

SEQ ID NO: 2267763 - RNA, 20 nt, Human
gccaugaggaguugcuguuu

SEQ ID NO: 2267764 - RNA, 20 nt, Human
gccaugaggaacaaggcaag

SEQ ID NO: 2267765 - RNA, 19 nt, Human
gccaugaggccucagugga

SEQ ID NO: 2267766 - RNA, 16 nt, Human
gccaugaggccucagu

SEQ ID NO: 2267767 - RNA, 20 nt, Human
gccaugaggccucaguggac

SEQ ID NO: 2267768 - RNA, 22 nt, Human
gccaugauggaaauauuuauuu

SEQ ID NO: 2267769 - RNA, 23 nt, Human
gccaugauggcaacagaucugga

SEQ ID NO: 2267770 - RNA, 21 nt, Human
gccaugauggcaacagaucug

SEQ ID NO: 2267771 - RNA, 19 nt, Human
gccaugauggcaacagauc

SEQ ID NO: 2267772 - RNA, 17 nt, Human
gccaugauggcaacaga

SEQ ID NO: 2267773 - RNA, 13 nt, Human
gccaggcuggucu

SEQ ID NO: 2267774 - RNA, 23 nt, Human
gccaggcugggucgcccuggacu

SEQ ID NO: 2267775 - RNA, 17 nt, Human
gccaggcugggucgccc

SEQ ID NO: 2267776 - RNA, 17 nt, Human
gccaggcugaccacagc

SEQ ID NO: 2267777 - RNA, 16 nt, Human
gccaggcugaccacag

SEQ ID NO: 2267778 - RNA, 15 nt, Human
gccaggcugaccaca

SEQ ID NO: 2267779 - RNA, 16 nt, Human
gccaggcucugugcug

SEQ ID NO: 2267780 - RNA, 20 nt, Human
gccaggcucugugcugaccc

SEQ ID NO: 2267781 - RNA, 15 nt, Human
gccaggcuggucuca

SEQ ID NO: 2267782 - RNA, 20 nt, Human
gccaggcugaccacagcaca

SEQ ID NO: 2267783 - RNA, 21 nt, Human
gccaggcucugugcugacccu

SEQ ID NO: 2267784 - RNA, 19 nt, Human
gccaggcugaccacagcac

SEQ ID NO: 2267785 - RNA, 18 nt, Human
gccaggcugaccacagca

SEQ ID NO: 2267786 - RNA, 19 nt, Human
gccaguaacgcgucuuccu

SEQ ID NO: 2267787 - RNA, 23 nt, Human
gccaguaaaugggggugcauuug

SEQ ID NO: 2267788 - RNA, 17 nt, Human
gccaguccugccuggcc

SEQ ID NO: 2267789 - RNA, 16 nt, Human
gccaguccugccuggc

SEQ ID NO: 2267790 - RNA, 23 nt, Human
gccaucaucuccugccuuccucc

SEQ ID NO: 2267791 - RNA, 19 nt, Human
gccaucauaggaagggacc

SEQ ID NO: 2267792 - RNA, 14 nt, Human
gccaguccugccug

SEQ ID NO: 2267793 - RNA, 19 nt, Human
gccaguccuagcugcacag

SEQ ID NO: 2267794 - RNA, 22 nt, Human
gccaguccuagcugcacagggc

SEQ ID NO: 2267795 - RNA, 13 nt, Human
gccagucccaggg

SEQ ID NO: 2267796 - RNA, 16 nt, Human
gccagucccaggggca

SEQ ID NO: 2267797 - RNA, 16 nt, Human
gccaguccuagcugca

SEQ ID NO: 2267798 - RNA, 22 nt, Human
gccagucccugaggcagguccc

SEQ ID NO: 2267799 - RNA, 16 nt, Human
gccagucccugaggca

SEQ ID NO: 2267800 - RNA, 21 nt, Human
gccagucaccccggccaccug

SEQ ID NO: 2267801 - RNA, 13 nt, Human
gccaguccaggcu

SEQ ID NO: 2267802 - RNA, 14 nt, Human
gccaguccaggcug

SEQ ID NO: 2267803 - RNA, 20 nt, Human
gccaguccaggcugccgugg

SEQ ID NO: 2267804 - RNA, 21 nt, Human
gccaguccaggcugccguggg

SEQ ID NO: 2267805 - RNA, 21 nt, Human
gccaguaucuauauaugugua

SEQ ID NO: 2267806 - RNA, 23 nt, Human
gccaguaagggaaauagaaaaac

SEQ ID NO: 2267807 - RNA, 22 nt, Human
gccaguaucuauauauguguau

SEQ ID NO: 2267808 - RNA, 23 nt, Human
gccaguaucuauauauguguaug

SEQ ID NO: 2267809 - RNA, 20 nt, Human
gccaguaacgcgucuuccug

SEQ ID NO: 2267810 - RNA, 21 nt, Human
gccaguaacgcgucuuccuga

SEQ ID NO: 2267811 - RNA, 22 nt, Human
gccaguaacgcgucuuccugag

SEQ ID NO: 2267812 - RNA, 21 nt, Human
gccaguaagggaaauagaaaa

SEQ ID NO: 2267813 - RNA, 15 nt, Human
gcccaaguccaaaug

SEQ ID NO: 2267814 - RNA, 16 nt, Human
gcccaaguccaaaugu

SEQ ID NO: 2267815 - RNA, 19 nt, Human
gcccaaguccaaauguuua

SEQ ID NO: 2267816 - RNA, 13 nt, Human
gcccaagucccug

SEQ ID NO: 2267817 - RNA, 20 nt, Human
gcccacauagugaugguucc

SEQ ID NO: 2267818 - RNA, 15 nt, Human
gcccacaucccaggc

SEQ ID NO: 2267819 - RNA, 14 nt, Human
gcccacaucccagg

SEQ ID NO: 2267820 - RNA, 21 nt, Human
gcccaccaacaucccauugcc

SEQ ID NO: 2267821 - RNA, 13 nt, Human
gcccaccagagcu

SEQ ID NO: 2267822 - RNA, 14 nt, Human
gcccaccagagcug

SEQ ID NO: 2267823 - RNA, 14 nt, Human
gcccaccagugacu

SEQ ID NO: 2267824 - RNA, 13 nt, Human
gcccaccccaccc

SEQ ID NO: 2267825 - RNA, 16 nt, Human
gcccacauuggaccca

SEQ ID NO: 2267826 - RNA, 17 nt, Human
gcccaccaacaucccau

SEQ ID NO: 2267827 - RNA, 20 nt, Human
gcccaagcucagaaggcucu

SEQ ID NO: 2267828 - RNA, 20 nt, Human
gcccaagcccgacuugcugu

SEQ ID NO: 2267829 - RNA, 12 nt, Human
gcccaagcucuu

SEQ ID NO: 2267830 - RNA, 15 nt, Human
gcccaaggcggcccc

SEQ ID NO: 2267831 - RNA, 16 nt, Human
gcccaaggcggccccu

SEQ ID NO: 2267832 - RNA, 19 nt, Human
gcccaagggaucugguccu

SEQ ID NO: 2267833 - RNA, 18 nt, Human
gcccaagggaucuggucc

SEQ ID NO: 2267834 - RNA, 15 nt, Human
gcccaagggaucugg

SEQ ID NO: 2267835 - RNA, 23 nt, Human
gcccaagggaaagaaaaggaagg

SEQ ID NO: 2267836 - RNA, 17 nt, Human
gcccaaggcggccccuc

SEQ ID NO: 2267837 - RNA, 18 nt, Human
gcccaaggcggccccucc

SEQ ID NO: 2267838 - RNA, 15 nt, Human
gcccaagccagaggc

SEQ ID NO: 2267839 - RNA, 13 nt, Human
gcccaagaugcuu

SEQ ID NO: 2267840 - RNA, 16 nt, Human
gcccaagccagaggcu

SEQ ID NO: 2267841 - RNA, 17 nt, Human
gcccaagccagaggcug

SEQ ID NO: 2267842 - RNA, 18 nt, Human
gcccaagccagaggcugg

SEQ ID NO: 2267843 - RNA, 21 nt, Human
gcccaagccagaggcuggguu

SEQ ID NO: 2267844 - RNA, 23 nt, Human
gcccaagccagaggcuggguuca

SEQ ID NO: 2267845 - RNA, 24 nt, Human
gccaugcuccuggcccacugcauc

SEQ ID NO: 2267846 - RNA, 19 nt, Human
gccaugggcacugugggua

SEQ ID NO: 2267847 - RNA, 15 nt, Human
gccaugggccuccug

SEQ ID NO: 2267848 - RNA, 16 nt, Human
gccaugggccuccugu

SEQ ID NO: 2267849 - RNA, 23 nt, Human
gcccaagacagaugccccagagc

SEQ ID NO: 2267850 - RNA, 21 nt, Human
gcccaagacagaugccccaga

SEQ ID NO: 2267851 - RNA, 20 nt, Human
gcccaagacagaugccccag

SEQ ID NO: 2267852 - RNA, 19 nt, Human
gcccaagacagaugcccca

SEQ ID NO: 2267853 - RNA, 21 nt, Human
gcccaagaauagaugcugacu

SEQ ID NO: 2267854 - RNA, 22 nt, Human
gcccaagaauagaugcugacug

SEQ ID NO: 2267855 - RNA, 24 nt, Human
gcccaaccugcucuccucuugcca

SEQ ID NO: 2267856 - RNA, 16 nt, Human
gccaugguacccccuu

SEQ ID NO: 2267857 - RNA, 17 nt, Human
gccaugguacccccuuc

SEQ ID NO: 2267858 - RNA, 19 nt, Human
gccaugguacccccuucug

SEQ ID NO: 2267859 - RNA, 14 nt, Human
gccaugguaccccc

SEQ ID NO: 2267860 - RNA, 13 nt, Human
gcccaccccccuc

SEQ ID NO: 2267861 - RNA, 13 nt, Human
gcccaccuggcca

SEQ ID NO: 2267862 - RNA, 14 nt, Human
gcccaccuggccac

SEQ ID NO: 2267863 - RNA, 16 nt, Human
gcccaccuggccaccu

SEQ ID NO: 2267864 - RNA, 17 nt, Human
gcccaccuggccaccug

SEQ ID NO: 2267865 - RNA, 18 nt, Human
gcccaccuggccaccuga

SEQ ID NO: 2267866 - RNA, 19 nt, Human
gcccaccuggccaccugag

SEQ ID NO: 2267867 - RNA, 20 nt, Human
gcccaccuggccaccugagg

SEQ ID NO: 2267868 - RNA, 14 nt, Human
gcccaccccccuca

SEQ ID NO: 2267869 - RNA, 15 nt, Human
gcccaccuggccucu

SEQ ID NO: 2267870 - RNA, 16 nt, Human
gcccaccuggccucug

SEQ ID NO: 2267871 - RNA, 17 nt, Human
gcccaccuggccucugc

SEQ ID NO: 2267872 - RNA, 20 nt, Human
gcccaccuggccucugcacu

SEQ ID NO: 2267873 - RNA, 21 nt, Human
gcccaccuggccucugcacuc

SEQ ID NO: 2267874 - RNA, 24 nt, Human
gcccaccuggccucugcacucccc

SEQ ID NO: 2267875 - RNA, 21 nt, Human
gcccagacacagaagaggcug

SEQ ID NO: 2267876 - RNA, 18 nt, Human
gcccagaaaaggacagaa

SEQ ID NO: 2267877 - RNA, 17 nt, Human
gcccagaaugaggcugc

SEQ ID NO: 2267878 - RNA, 16 nt, Human
gcccagaaugaggcug

SEQ ID NO: 2267879 - RNA, 20 nt, Human
gcccagaauaaguuauugca

SEQ ID NO: 2267880 - RNA, 23 nt, Human
gcccagaauaaguuauugcaguu

SEQ ID NO: 2267881 - RNA, 22 nt, Human
gcccaccugucaaacaaagcca

SEQ ID NO: 2267882 - RNA, 22 nt, Human
gcccacuugucccacuaucugg

SEQ ID NO: 2267883 - RNA, 16 nt, Human
gcccagaaaaggacag

SEQ ID NO: 2267884 - RNA, 16 nt, Human
gcccagaauaaguuau

SEQ ID NO: 2267885 - RNA, 19 nt, Human
gcccagaaaaggacagaaa

SEQ ID NO: 2267886 - RNA, 14 nt, Human
gcccacuucugcca

SEQ ID NO: 2267887 - RNA, 13 nt, Human
gcccaccuuggcu

SEQ ID NO: 2267888 - RNA, 15 nt, Human
gcccaccuuggcuca

SEQ ID NO: 2267889 - RNA, 16 nt, Human
gcccaccuuggcucaa

SEQ ID NO: 2267890 - RNA, 17 nt, Human
gcccaccuuggcucaag

SEQ ID NO: 2267891 - RNA, 21 nt, Human
gcccucccaggcucucaacag

SEQ ID NO: 2267892 - RNA, 12 nt, Human
gcccucccaggc

SEQ ID NO: 2267893 - RNA, 14 nt, Human
gcccucccaucccg

SEQ ID NO: 2267894 - RNA, 13 nt, Human
gcccuccccagag

SEQ ID NO: 2267895 - RNA, 15 nt, Human
gcccuccccagagca

SEQ ID NO: 2267896 - RNA, 16 nt, Human
gcccuccccagagcac

SEQ ID NO: 2267897 - RNA, 22 nt, Human
gcccuccaucccgacauggacc

SEQ ID NO: 2267898 - RNA, 16 nt, Human
gcccuccaucccgaca

SEQ ID NO: 2267899 - RNA, 21 nt, Human
gcccuccaucuaaacugcccc

SEQ ID NO: 2267900 - RNA, 21 nt, Human
gcccuccacgccggcucuucc

SEQ ID NO: 2267901 - RNA, 20 nt, Human
gcccuccaucuaaacugccc

SEQ ID NO: 2267902 - RNA, 21 nt, Human
gcccuccagcucuuuccuccu

SEQ ID NO: 2267903 - RNA, 17 nt, Human
gcccuccagcucuuucc

SEQ ID NO: 2267904 - RNA, 23 nt, Human
gcccuccacagccgcagccuccc

SEQ ID NO: 2267905 - RNA, 17 nt, Human
gcccuccacaucccuga

SEQ ID NO: 2267906 - RNA, 20 nt, Human
gcccuccacagccgcagccu

SEQ ID NO: 2267907 - RNA, 14 nt, Human
gcccuccacagccg

SEQ ID NO: 2267908 - RNA, 15 nt, Human
gcccuccaaaagcac

SEQ ID NO: 2267909 - RNA, 19 nt, Human
gcccgggcgcggccagccc

SEQ ID NO: 2267910 - RNA, 14 nt, Human
gcccuccaaaagca

SEQ ID NO: 2267911 - RNA, 22 nt, Human
gcccuccaagaccuucuccuuc

SEQ ID NO: 2267912 - RNA, 23 nt, Human
gcccuccaagaccuucuccuuca

SEQ ID NO: 2267913 - RNA, 22 nt, Human
gcccucauggccccucugaccu

SEQ ID NO: 2267914 - RNA, 18 nt, Human
gcccucauggccccucug

SEQ ID NO: 2267915 - RNA, 19 nt, Human
gcccucauggccccucuga

SEQ ID NO: 2267916 - RNA, 18 nt, Human
gcccgggcgcggccagcc

SEQ ID NO: 2267917 - RNA, 23 nt, Human
gcccgggaaggucaccagcacca

SEQ ID NO: 2267918 - RNA, 14 nt, Human
gcccgggagcugcu

SEQ ID NO: 2267919 - RNA, 19 nt, Human
gcccgggagcugcugcccu

SEQ ID NO: 2267920 - RNA, 19 nt, Human
gcccuccaagaccuucucc

SEQ ID NO: 2267921 - RNA, 21 nt, Human
gcccuccaagaccuucuccuu

SEQ ID NO: 2267922 - RNA, 19 nt, Human
gcccgcacccccacccuuu

SEQ ID NO: 2267923 - RNA, 21 nt, Human
gcccgcacccccacccuuugg

SEQ ID NO: 2267924 - RNA, 17 nt, Human
gcccgcacccccacccu

SEQ ID NO: 2267925 - RNA, 16 nt, Human
gcccgcacccccaccc

SEQ ID NO: 2267926 - RNA, 15 nt, Human
gcccgcacccccacc

SEQ ID NO: 2267927 - RNA, 14 nt, Human
gcccggcugguuuu

SEQ ID NO: 2267928 - RNA, 18 nt, Human
gcccgggaaggucaccag

SEQ ID NO: 2267929 - RNA, 20 nt, Human
gcccgggaaggucaccagca

SEQ ID NO: 2267930 - RNA, 17 nt, Human
gcccuccuacccugcgc

SEQ ID NO: 2267931 - RNA, 23 nt, Human
gcccuccgccauucucaagcccu

SEQ ID NO: 2267932 - RNA, 23 nt, Human
gcccucccuuggaaaccugcccu

SEQ ID NO: 2267933 - RNA, 14 nt, Human
gcccuccgacagcc

SEQ ID NO: 2267934 - RNA, 18 nt, Human
gcccuccgacagcccccu

SEQ ID NO: 2267935 - RNA, 22 nt, Human
gcccuccgacagcccccucugc

SEQ ID NO: 2267936 - RNA, 21 nt, Human
gcccucccuguuccccagaga

SEQ ID NO: 2267937 - RNA, 19 nt, Human
gcccucccuuggaaaccug

SEQ ID NO: 2267938 - RNA, 21 nt, Human
gcccucccuuggaaaccugcc

SEQ ID NO: 2267939 - RNA, 22 nt, Human
gcccucccuguuccccagagaa

SEQ ID NO: 2267940 - RNA, 21 nt, Human
gcccucccuguccuccucgga

SEQ ID NO: 2267941 - RNA, 18 nt, Human
gcccucccuguccuccuc

SEQ ID NO: 2267942 - RNA, 16 nt, Human
gcccucccuguccucc

SEQ ID NO: 2267943 - RNA, 14 nt, Human
gcccucccuguccu

SEQ ID NO: 2267944 - RNA, 20 nt, Human
gcccucccuguuccccagag

SEQ ID NO: 2267945 - RNA, 18 nt, Human
gcccucccuguuccccag

SEQ ID NO: 2267946 - RNA, 21 nt, Human
gcccucccugccccucccuuc

SEQ ID NO: 2267947 - RNA, 18 nt, Human
gcccuccccauggagcca

SEQ ID NO: 2267948 - RNA, 17 nt, Human
gcccuccccaucccaug

SEQ ID NO: 2267949 - RNA, 17 nt, Human
gcccuccccagagcacu

SEQ ID NO: 2267950 - RNA, 19 nt, Human
gcccuccccagagcacugg

SEQ ID NO: 2267951 - RNA, 13 nt, Human
gcccucugcccac

SEQ ID NO: 2267952 - RNA, 16 nt, Human
gcccucugcccacucc

SEQ ID NO: 2267953 - RNA, 18 nt, Human
gcccucugcccacucccu

SEQ ID NO: 2267954 - RNA, 19 nt, Human
gcccucugcccacucccug

SEQ ID NO: 2267955 - RNA, 17 nt, Human
gcccugacccuguggaa

SEQ ID NO: 2267956 - RNA, 17 nt, Human
gcccugacauuggagcc

SEQ ID NO: 2267957 - RNA, 12 nt, Human
gcccugaccucc

SEQ ID NO: 2267958 - RNA, 13 nt, Human
gcccugaccuccc

SEQ ID NO: 2267959 - RNA, 15 nt, Human
gcccugaccucccag

SEQ ID NO: 2267960 - RNA, 16 nt, Human
gcccugaccucccagc

SEQ ID NO: 2267961 - RNA, 17 nt, Human
gcccugaccucccagcc

SEQ ID NO: 2267962 - RNA, 14 nt, Human
gcccugacccugug

SEQ ID NO: 2267963 - RNA, 13 nt, Human
gcccugagcucgg

SEQ ID NO: 2267964 - RNA, 19 nt, Human
gcccugaccucccagcccu

SEQ ID NO: 2267965 - RNA, 16 nt, Human
gcccugagcucggugg

SEQ ID NO: 2267966 - RNA, 15 nt, Human
gcccugagcucggug

SEQ ID NO: 2267967 - RNA, 14 nt, Human
gcccugagcuuucu

SEQ ID NO: 2267968 - RNA, 13 nt, Human
gcccugcagaggg

SEQ ID NO: 2267969 - RNA, 14 nt, Human
gcccugcagagggc

SEQ ID NO: 2267970 - RNA, 22 nt, Human
gcccugagcucgguggacccag

SEQ ID NO: 2267971 - RNA, 15 nt, Human
gcccugcagagggca

SEQ ID NO: 2267972 - RNA, 15 nt, Human
gccccuuuacggaca

SEQ ID NO: 2267973 - RNA, 20 nt, Human
gccccuuuacggacaccccc

SEQ ID NO: 2267974 - RNA, 22 nt, Human
gccccuuuacggacacccccuc

SEQ ID NO: 2267975 - RNA, 20 nt, Human
gccccuugcucuccccugcc

SEQ ID NO: 2267976 - RNA, 23 nt, Human
gccccuucugcucagcucugggc

SEQ ID NO: 2267977 - RNA, 20 nt, Human
gccccuucugcucagcucug

SEQ ID NO: 2267978 - RNA, 19 nt, Human
gccccuucugcucagcucu

SEQ ID NO: 2267979 - RNA, 21 nt, Human
gccccuuuuuacuccccuuga

SEQ ID NO: 2267980 - RNA, 23 nt, Human
gccccuuuuucauauguugcuca

SEQ ID NO: 2267981 - RNA, 20 nt, Human
gccccuuuuuacuccccuug

SEQ ID NO: 2267982 - RNA, 19 nt, Human
gccccuuuuuacuccccuu

SEQ ID NO: 2267983 - RNA, 18 nt, Human
gccccuuuuuacuccccu

SEQ ID NO: 2267984 - RNA, 16 nt, Human
gccccuuuuuacuccc

SEQ ID NO: 2267985 - RNA, 21 nt, Human
gccccuuuucacucccuccau

SEQ ID NO: 2267986 - RNA, 12 nt, Human
gcccgacagccu

SEQ ID NO: 2267987 - RNA, 14 nt, Human
gcccgacagccugg

SEQ ID NO: 2267988 - RNA, 15 nt, Human
gcccgacagccuggc

SEQ ID NO: 2267989 - RNA, 13 nt, Human
gcccgaauacaaa

SEQ ID NO: 2267990 - RNA, 21 nt, Human
gcccgaauacaaacaccugga

SEQ ID NO: 2267991 - RNA, 22 nt, Human
gcccgagcuggugcauuacaga

SEQ ID NO: 2267992 - RNA, 14 nt, Human
gcccgcacagagcu

SEQ ID NO: 2267993 - RNA, 22 nt, Human
gccccuguuaccuaauuagagc

SEQ ID NO: 2267994 - RNA, 18 nt, Human
gccccuguggagacuggg

SEQ ID NO: 2267995 - RNA, 13 nt, Human
gccccuguucucu

SEQ ID NO: 2267996 - RNA, 19 nt, Human
gccccugucuagagaggga

SEQ ID NO: 2267997 - RNA, 18 nt, Human
gccccugucuagagaggg

SEQ ID NO: 2267998 - RNA, 22 nt, Human
gccccuggguggguggugggga

SEQ ID NO: 2267999 - RNA, 17 nt, Human
gccccuguauggcacug

SEQ ID NO: 2268000 - RNA, 16 nt, Human
gccccugguccugagg

SEQ ID NO: 2268001 - RNA, 21 nt, Human
gccccugggucagucuggugg

SEQ ID NO: 2268002 - RNA, 20 nt, Human
gccccugggugggugguggg

SEQ ID NO: 2268003 - RNA, 21 nt, Human
gccccuggguggguggugggg

SEQ ID NO: 2268004 - RNA, 17 nt, Human
gccccuguucuggcaga

SEQ ID NO: 2268005 - RNA, 18 nt, Human
gccccuucugcucagcuc

SEQ ID NO: 2268006 - RNA, 17 nt, Human
gccccuucugcucagcu

SEQ ID NO: 2268007 - RNA, 15 nt, Human
gccccuucugcucag

SEQ ID NO: 2268008 - RNA, 14 nt, Human
gccccuucugcuca

SEQ ID NO: 2268009 - RNA, 18 nt, Human
gccccucuugccccccac

SEQ ID NO: 2268010 - RNA, 16 nt, Human
gccccucuugcccccc

SEQ ID NO: 2268011 - RNA, 13 nt, Human
gccccucuugccc

SEQ ID NO: 2268012 - RNA, 21 nt, Human
gccccucugcccagcuugggc

SEQ ID NO: 2268013 - RNA, 20 nt, Human
gccccucuggucgcuccugc

SEQ ID NO: 2268014 - RNA, 22 nt, Human
gccccucuggucgcuccugccc

SEQ ID NO: 2268015 - RNA, 21 nt, Human
gccccucuugccccccacccc

SEQ ID NO: 2268016 - RNA, 19 nt, Human
gccccucuugccccccacc

SEQ ID NO: 2268017 - RNA, 16 nt, Human
gccccugaacaagaau

SEQ ID NO: 2268018 - RNA, 22 nt, Human
gccccugagacaaauggaggcc

SEQ ID NO: 2268019 - RNA, 16 nt, Human
gccccugagaucucug

SEQ ID NO: 2268020 - RNA, 22 nt, Human
gccccugggcuuggccugcugu

SEQ ID NO: 2268021 - RNA, 23 nt, Human
gccccugggcuuggccugcugug

SEQ ID NO: 2268022 - RNA, 18 nt, Human
gccccugggcuuggccug

SEQ ID NO: 2268023 - RNA, 19 nt, Human
gccccugggcuuggccugc

SEQ ID NO: 2268024 - RNA, 20 nt, Human
gccccugggcuuggccugcu

SEQ ID NO: 2268025 - RNA, 21 nt, Human
gccccugggcuuggccugcug

SEQ ID NO: 2268026 - RNA, 21 nt, Human
gccccucccccaacccccacc

SEQ ID NO: 2268027 - RNA, 15 nt, Human
gccccucccccaacc

SEQ ID NO: 2268028 - RNA, 12 nt, Human
gccccuccccca

SEQ ID NO: 2268029 - RNA, 15 nt, Human
gccccucccaccaca

SEQ ID NO: 2268030 - RNA, 14 nt, Human
gccccucccaccac

SEQ ID NO: 2268031 - RNA, 13 nt, Human
gccccucccacca

SEQ ID NO: 2268032 - RNA, 12 nt, Human
gccccucccacc

SEQ ID NO: 2268033 - RNA, 17 nt, Human
gccccucaccugggcac

SEQ ID NO: 2268034 - RNA, 20 nt, Human
gccccucaccugggcaccug

SEQ ID NO: 2268035 - RNA, 14 nt, Human
gccccucaccuggg

SEQ ID NO: 2268036 - RNA, 16 nt, Human
gccccucagggucccu

SEQ ID NO: 2268037 - RNA, 18 nt, Human
gccccucagggucccugg

SEQ ID NO: 2268038 - RNA, 16 nt, Human
gccccucccgccccuu

SEQ ID NO: 2268039 - RNA, 16 nt, Human
gccccucccaccacag

SEQ ID NO: 2268040 - RNA, 13 nt, Human
gccccucccgccc

SEQ ID NO: 2268041 - RNA, 23 nt, Human
gccccucccccaacccccacccc

SEQ ID NO: 2268042 - RNA, 22 nt, Human
gccccucccccaacccccaccc

SEQ ID NO: 2268043 - RNA, 16 nt, Human
gccccucccccugcca

SEQ ID NO: 2268044 - RNA, 20 nt, Human
gccccucugcccagcuuggg

SEQ ID NO: 2268045 - RNA, 14 nt, Human
gccccucuggucgc

SEQ ID NO: 2268046 - RNA, 18 nt, Human
gccccucuggucgcuccu

SEQ ID NO: 2268047 - RNA, 19 nt, Human
gccccucuggucgcuccug

SEQ ID NO: 2268048 - RNA, 22 nt, Human
gcccccuucucccacacugcua

SEQ ID NO: 2268049 - RNA, 20 nt, Human
gcccccuucucccacacugc

SEQ ID NO: 2268050 - RNA, 16 nt, Human
gcccccuuucagaugu

SEQ ID NO: 2268051 - RNA, 18 nt, Human
gcccccuuucagaugucu

SEQ ID NO: 2268052 - RNA, 23 nt, Human
gcccccuuucagaugucuucugc

SEQ ID NO: 2268053 - RNA, 19 nt, Human
gcccccuucucccacacug

SEQ ID NO: 2268054 - RNA, 18 nt, Human
gcccccuucucccacacu

SEQ ID NO: 2268055 - RNA, 17 nt, Human
gcccccuucucccacac

SEQ ID NO: 2268056 - RNA, 16 nt, Human
gcccccuucucccaca

SEQ ID NO: 2268057 - RNA, 15 nt, Human
gcccccuucucccac

SEQ ID NO: 2268058 - RNA, 15 nt, Human
gccccgaggccuucu

SEQ ID NO: 2268059 - RNA, 21 nt, Human
gcccccuuugggcccagggac

SEQ ID NO: 2268060 - RNA, 18 nt, Human
gcccccuuugggcccagg

SEQ ID NO: 2268061 - RNA, 19 nt, Human
gcccccuuugggcccaggg

SEQ ID NO: 2268062 - RNA, 18 nt, Human
gccccgaggccuucucug

SEQ ID NO: 2268063 - RNA, 14 nt, Human
gccccucagggucc

SEQ ID NO: 2268064 - RNA, 18 nt, Human
gccccucacccugccuua

SEQ ID NO: 2268065 - RNA, 21 nt, Human
gccccgaggacccagacccag

SEQ ID NO: 2268066 - RNA, 22 nt, Human
gccccgaggacccagacccagu

SEQ ID NO: 2268067 - RNA, 17 nt, Human
gccccgaggacccagac

SEQ ID NO: 2268068 - RNA, 18 nt, Human
gccccgaggacccagacc

SEQ ID NO: 2268069 - RNA, 19 nt, Human
gccccgaggacccagaccc

SEQ ID NO: 2268070 - RNA, 12 nt, Human
gcccccugcccu

SEQ ID NO: 2268071 - RNA, 18 nt, Human
gcccccugccccccagcc

SEQ ID NO: 2268072 - RNA, 14 nt, Human
gcccccugcccucc

SEQ ID NO: 2268073 - RNA, 19 nt, Human
gcccccugcccuccccucu

SEQ ID NO: 2268074 - RNA, 17 nt, Human
gcccccaccccggggac

SEQ ID NO: 2268075 - RNA, 21 nt, Human
gcccccaccccggggacccug

SEQ ID NO: 2268076 - RNA, 22 nt, Human
gcccccaccccggggacccugu

SEQ ID NO: 2268077 - RNA, 14 nt, Human
gcccccugcccccc

SEQ ID NO: 2268078 - RNA, 21 nt, Human
gcccccaccacuaggacucug

SEQ ID NO: 2268079 - RNA, 22 nt, Human
gcccccaccacggccacuggcc

SEQ ID NO: 2268080 - RNA, 17 nt, Human
gcccccacccacuuccc

SEQ ID NO: 2268081 - RNA, 14 nt, Human
gcccccaagccugc

SEQ ID NO: 2268082 - RNA, 15 nt, Human
gcccccacagugcug

SEQ ID NO: 2268083 - RNA, 23 nt, Human
gcccccacagaaagacugagcuc

SEQ ID NO: 2268084 - RNA, 22 nt, Human
gcccccugguggacaguccugg

SEQ ID NO: 2268085 - RNA, 21 nt, Human
gcccccugguggacaguccug

SEQ ID NO: 2268086 - RNA, 23 nt, Human
gcccccugguggacaguccuggg

SEQ ID NO: 2268087 - RNA, 19 nt, Human
gcccccuggccucugugcc

SEQ ID NO: 2268088 - RNA, 17 nt, Human
gcccccuggccucugug

SEQ ID NO: 2268089 - RNA, 13 nt, Human
gcccccuggucuc

SEQ ID NO: 2268090 - RNA, 14 nt, Human
gcccccuggucucu

SEQ ID NO: 2268091 - RNA, 16 nt, Human
gcccccuggucucugg

SEQ ID NO: 2268092 - RNA, 17 nt, Human
gcccccuggucucuggu

SEQ ID NO: 2268093 - RNA, 15 nt, Human
gcccccugcuggcuc

SEQ ID NO: 2268094 - RNA, 20 nt, Human
gcccccugcuggcucuucug

SEQ ID NO: 2268095 - RNA, 13 nt, Human
gcccccugcuggc

SEQ ID NO: 2268096 - RNA, 16 nt, Human
gcccccuggccucugu

SEQ ID NO: 2268097 - RNA, 15 nt, Human
gcccccuggccucug

SEQ ID NO: 2268098 - RNA, 14 nt, Human
gcccccuggccucu

SEQ ID NO: 2268099 - RNA, 13 nt, Human
gcccccuggccuc

SEQ ID NO: 2268100 - RNA, 22 nt, Human
gccccauucuuuuguaauuuaa

SEQ ID NO: 2268101 - RNA, 20 nt, Human
gccccauuuauccaccucca

SEQ ID NO: 2268102 - RNA, 23 nt, Human
gccccauucuuuuguaauuuaaa

SEQ ID NO: 2268103 - RNA, 15 nt, Human
gcccccaaauaagaa

SEQ ID NO: 2268104 - RNA, 15 nt, Human
gccccauucugccug

SEQ ID NO: 2268105 - RNA, 14 nt, Human
gccccauucugccu

SEQ ID NO: 2268106 - RNA, 16 nt, Human
gccccaugucucucag

SEQ ID NO: 2268107 - RNA, 15 nt, Human
gccccaugucucuca

SEQ ID NO: 2268108 - RNA, 18 nt, Human
gccccaugucucucagaa

SEQ ID NO: 2268109 - RNA, 15 nt, Human
gccccauuccuggga

SEQ ID NO: 2268110 - RNA, 12 nt, Human
gccccauuccug

SEQ ID NO: 2268111 - RNA, 13 nt, Human
gccccauccucug

SEQ ID NO: 2268112 - RNA, 14 nt, Human
gccccauccucugu

SEQ ID NO: 2268113 - RNA, 22 nt, Human
gccccauccucuguacagagcc

SEQ ID NO: 2268114 - RNA, 16 nt, Human
gccccaugcuggagcc

SEQ ID NO: 2268115 - RNA, 17 nt, Human
gccccaugcuggagccu

SEQ ID NO: 2268116 - RNA, 18 nt, Human
gccccaugcuggagccug

SEQ ID NO: 2268117 - RNA, 19 nt, Human
gccccaugcuggagccugu

SEQ ID NO: 2268118 - RNA, 20 nt, Human
gccccaugcuggagccugug

SEQ ID NO: 2268119 - RNA, 21 nt, Human
gccccaugcuggagccugugu

SEQ ID NO: 2268120 - RNA, 22 nt, Human
gccccaugcuggagccugugua

SEQ ID NO: 2268121 - RNA, 23 nt, Human
gccccaugcuggagccuguguaa

SEQ ID NO: 2268122 - RNA, 22 nt, Human
gccccaggcagggccaacccuu

SEQ ID NO: 2268123 - RNA, 14 nt, Human
gccccaggccucug

SEQ ID NO: 2268124 - RNA, 12 nt, Human
gccccaggccug

SEQ ID NO: 2268125 - RNA, 11 nt, Human
gccccagccag

SEQ ID NO: 2268126 - RNA, 10 nt, Human
gccccagcca

SEQ ID NO: 2268127 - RNA, 19 nt, Human
gccccagcacuaacguaaa

SEQ ID NO: 2268128 - RNA, 23 nt, Human
gccccagcacuaaagcaguggac

SEQ ID NO: 2268129 - RNA, 19 nt, Human
gccccagcacuaaagcagu

SEQ ID NO: 2268130 - RNA, 17 nt, Human
gccccagcacuaaagca

SEQ ID NO: 2268131 - RNA, 12 nt, Human
gccccagcacua

SEQ ID NO: 2268132 - RNA, 20 nt, Human
gccccagaucaccagcccgg

SEQ ID NO: 2268133 - RNA, 13 nt, Human
gccccagcacagc

SEQ ID NO: 2268134 - RNA, 20 nt, Human
gccccagcacagcuugaccu

SEQ ID NO: 2268135 - RNA, 12 nt, Human
gccccagaggcc

SEQ ID NO: 2268136 - RNA, 15 nt, Human
gccccagaggccucu

SEQ ID NO: 2268137 - RNA, 19 nt, Human
gccccagaggccucucucu

SEQ ID NO: 2268138 - RNA, 17 nt, Human
gccccagauaccagccc

SEQ ID NO: 2268139 - RNA, 19 nt, Human
gccccagauaccagccccu

SEQ ID NO: 2268140 - RNA, 20 nt, Human
gccccagauaccagccccug

SEQ ID NO: 2268141 - RNA, 18 nt, Human
gccccagaucaccagccc

SEQ ID NO: 2268142 - RNA, 19 nt, Human
gccccagaucaccagcccg

SEQ ID NO: 2268143 - RNA, 21 nt, Human
gccccagggucuucccuaccu

SEQ ID NO: 2268144 - RNA, 20 nt, Human
gccccagggucuucccuacc

SEQ ID NO: 2268145 - RNA, 17 nt, Human
gccccagggucuucccu

SEQ ID NO: 2268146 - RNA, 16 nt, Human
gccccagggucuuccc

SEQ ID NO: 2268147 - RNA, 18 nt, Human
gccccagggcuacccucc

SEQ ID NO: 2268148 - RNA, 16 nt, Human
gccccagggcuacccu

SEQ ID NO: 2268149 - RNA, 15 nt, Human
gccccaggccugaaa

SEQ ID NO: 2268150 - RNA, 23 nt, Human
gccccagggucuucccuaccuca

SEQ ID NO: 2268151 - RNA, 13 nt, Human
gccccagucagcc

SEQ ID NO: 2268152 - RNA, 14 nt, Human
gccccagucagccu

SEQ ID NO: 2268153 - RNA, 15 nt, Human
gccccagucagccuc

SEQ ID NO: 2268154 - RNA, 16 nt, Human
gccccagucagccucu

SEQ ID NO: 2268155 - RNA, 12 nt, Human
gccccagugccc

SEQ ID NO: 2268156 - RNA, 14 nt, Human
gccccagugccaag

SEQ ID NO: 2268157 - RNA, 23 nt, Human
gccccagucagccucucucccag

SEQ ID NO: 2268158 - RNA, 19 nt, Human
gccccaguggcuguucugg

SEQ ID NO: 2268159 - RNA, 17 nt, Human
gccccagucagccucuc

SEQ ID NO: 2268160 - RNA, 18 nt, Human
gccccagucagccucucu

SEQ ID NO: 2268161 - RNA, 20 nt, Human
gccccagucagccucucucc

SEQ ID NO: 2268162 - RNA, 22 nt, Human
gccccagucagccucucuccca

SEQ ID NO: 2268163 - RNA, 13 nt, Human
gccccagugccca

SEQ ID NO: 2268164 - RNA, 14 nt, Human
gccccagugcccac

SEQ ID NO: 2268165 - RNA, 15 nt, Human
gccccaucagcucca

SEQ ID NO: 2268166 - RNA, 18 nt, Human
gccccaguucaaucuccc

SEQ ID NO: 2268167 - RNA, 16 nt, Human
gccccaucagcuccag

SEQ ID NO: 2268168 - RNA, 17 nt, Human
gccccaucagcuccagc

SEQ ID NO: 2268169 - RNA, 21 nt, Human
gccccauaauuuuuuuuuucc

SEQ ID NO: 2268170 - RNA, 19 nt, Human
gccccaguuguauuuauuu

SEQ ID NO: 2268171 - RNA, 18 nt, Human
gccccaucccaaacccuu

SEQ ID NO: 2268172 - RNA, 18 nt, Human
gccccauccuccagcagg

SEQ ID NO: 2268173 - RNA, 17 nt, Human
gccccauccuccagcag

SEQ ID NO: 2268174 - RNA, 16 nt, Human
gccccauccuccagca

SEQ ID NO: 2268175 - RNA, 14 nt, Human
gccccauccuccag

SEQ ID NO: 2268176 - RNA, 14 nt, Human
gccccaucagugcu

SEQ ID NO: 2268177 - RNA, 19 nt, Human
gccccaucaggacucuugu

SEQ ID NO: 2268178 - RNA, 15 nt, Human
gcccaggcuggagug

SEQ ID NO: 2268179 - RNA, 20 nt, Human
gcccaggcuggagugcaaug

SEQ ID NO: 2268180 - RNA, 13 nt, Human
gcccaggccuccu

SEQ ID NO: 2268181 - RNA, 18 nt, Human
gcccagagcaggaagcau

SEQ ID NO: 2268182 - RNA, 21 nt, Human
gcccaggccgggguggagcau

SEQ ID NO: 2268183 - RNA, 22 nt, Human
gcccaggccgggguggagcaug

SEQ ID NO: 2268184 - RNA, 23 nt, Human
gcccaggccgggguggagcaugg

SEQ ID NO: 2268185 - RNA, 13 nt, Human
gcccaggccccuu

SEQ ID NO: 2268186 - RNA, 21 nt, Human
gcccagagaggguggugaccu

SEQ ID NO: 2268187 - RNA, 15 nt, Human
gcccagagagggugg

SEQ ID NO: 2268188 - RNA, 18 nt, Human
gcccagagaugccuccac

SEQ ID NO: 2268189 - RNA, 17 nt, Human
gcccagagaugccucca

SEQ ID NO: 2268190 - RNA, 16 nt, Human
gcccagagaugccucc

SEQ ID NO: 2268191 - RNA, 22 nt, Human
gcccagagaugggacugggagg

SEQ ID NO: 2268192 - RNA, 14 nt, Human
gcccagagcaggaa

SEQ ID NO: 2268193 - RNA, 15 nt, Human
gcccagagcaggaag

SEQ ID NO: 2268194 - RNA, 16 nt, Human
gcccagagcaggaagc

SEQ ID NO: 2268195 - RNA, 21 nt, Human
gcccagagaugggacugggag

SEQ ID NO: 2268196 - RNA, 22 nt, Human
gcccagagaugccuccaccgcu

SEQ ID NO: 2268197 - RNA, 20 nt, Human
gcccagagaugccuccaccg

SEQ ID NO: 2268198 - RNA, 19 nt, Human
gcccagagaugccuccacc

SEQ ID NO: 2268199 - RNA, 23 nt, Human
gcccaggccccugccacccuggg

SEQ ID NO: 2268200 - RNA, 22 nt, Human
gcccagggccacucugccucug

SEQ ID NO: 2268201 - RNA, 18 nt, Human
gcccagggcuccugcacu

SEQ ID NO: 2268202 - RNA, 15 nt, Human
gcccagggcuccugc

SEQ ID NO: 2268203 - RNA, 16 nt, Human
gcccagggcuccugca

SEQ ID NO: 2268204 - RNA, 20 nt, Human
gcccagggccacucugccuc

SEQ ID NO: 2268205 - RNA, 19 nt, Human
gcccagggccacucugccu

SEQ ID NO: 2268206 - RNA, 12 nt, Human
gcccagggcucc

SEQ ID NO: 2268207 - RNA, 14 nt, Human
gcccagggcuccug

SEQ ID NO: 2268208 - RNA, 23 nt, Human
gcccagggagcggaaagcagcuc

SEQ ID NO: 2268209 - RNA, 21 nt, Human
gcccagggagcggaaagcagc

SEQ ID NO: 2268210 - RNA, 18 nt, Human
gcccagggccacucugcc

SEQ ID NO: 2268211 - RNA, 15 nt, Human
gcccagggccacucu

SEQ ID NO: 2268212 - RNA, 13 nt, Human
gcccagggccacu

SEQ ID NO: 2268213 - RNA, 20 nt, Human
gcccagggagcggaaagcag

SEQ ID NO: 2268214 - RNA, 17 nt, Human
gcccagggagcggaaag

SEQ ID NO: 2268215 - RNA, 16 nt, Human
gcccagggagcggaaa

SEQ ID NO: 2268216 - RNA, 19 nt, Human
gcccagggagaggccauga

SEQ ID NO: 2268217 - RNA, 18 nt, Human
gcccagggagaggccaug

SEQ ID NO: 2268218 - RNA, 24 nt, Human
gcccagggacaccagccaggcucu

SEQ ID NO: 2268219 - RNA, 22 nt, Human
gcccagggacaccagccaggcu

SEQ ID NO: 2268220 - RNA, 23 nt, Human
gcccagggacaccagccaggcuc

SEQ ID NO: 2268221 - RNA, 14 nt, Human
gcccaagucccugu

SEQ ID NO: 2268222 - RNA, 13 nt, Human
gcccaggcuggcc

SEQ ID NO: 2268223 - RNA, 14 nt, Human
gcccaggcuggcca

SEQ ID NO: 2268224 - RNA, 15 nt, Human
gcccaggcuggccag

SEQ ID NO: 2268225 - RNA, 16 nt, Human
gcccaggcuggccagc

SEQ ID NO: 2268226 - RNA, 17 nt, Human
gcccaggcuggccagcc

SEQ ID NO: 2268227 - RNA, 18 nt, Human
gcccaggcuggccagccc

SEQ ID NO: 2268228 - RNA, 21 nt, Human
gcccagggacaccagccaggc

SEQ ID NO: 2268229 - RNA, 12 nt, Human
gcccaggcuggc

SEQ ID NO: 2268230 - RNA, 19 nt, Human
gcccaggcuggagugcagu

SEQ ID NO: 2268231 - RNA, 20 nt, Human
gcccaggcuggagugcagug

SEQ ID NO: 2268232 - RNA, 22 nt, Human
gcccaucacaggguugggccca

SEQ ID NO: 2268233 - RNA, 21 nt, Human
gcccaucacaggguugggccc

SEQ ID NO: 2268234 - RNA, 17 nt, Human
gcccaucacaggguugg

SEQ ID NO: 2268235 - RNA, 13 nt, Human
gcccaucacaggg

SEQ ID NO: 2268236 - RNA, 17 nt, Human
gcccaucaauuauagaa

SEQ ID NO: 2268237 - RNA, 14 nt, Human
gccccacccugggc

SEQ ID NO: 2268238 - RNA, 22 nt, Human
gcccaucaguguacccccgccc

SEQ ID NO: 2268239 - RNA, 20 nt, Human
gcccaucaguguacccccgc

SEQ ID NO: 2268240 - RNA, 21 nt, Human
gcccaucaguguacccccgcc

SEQ ID NO: 2268241 - RNA, 15 nt, Human
gccccacccugggcc

SEQ ID NO: 2268242 - RNA, 16 nt, Human
gccccacccugggccc

SEQ ID NO: 2268243 - RNA, 19 nt, Human
gccccacccugggcccugg

SEQ ID NO: 2268244 - RNA, 20 nt, Human
gccccacccugggcccuggg

SEQ ID NO: 2268245 - RNA, 16 nt, Human
gcccaggguuccccca

SEQ ID NO: 2268246 - RNA, 23 nt, Human
gcccaggguggacuuagaaagca

SEQ ID NO: 2268247 - RNA, 14 nt, Human
gcccaggguggacu

SEQ ID NO: 2268248 - RNA, 16 nt, Human
gcccaguuucagggcu

SEQ ID NO: 2268249 - RNA, 17 nt, Human
gcccaguuucagggcua

SEQ ID NO: 2268250 - RNA, 15 nt, Human
gcccaguuucugccu

SEQ ID NO: 2268251 - RNA, 17 nt, Human
gcccaguuucugccucu

SEQ ID NO: 2268252 - RNA, 21 nt, Human
gcccaguuucugccucugagg

SEQ ID NO: 2268253 - RNA, 22 nt, Human
gcccaggggugcccccuccucu

SEQ ID NO: 2268254 - RNA, 19 nt, Human
gcccaggggugcccccucc

SEQ ID NO: 2268255 - RNA, 20 nt, Human
gcccaggggugcccccuccu

SEQ ID NO: 2268256 - RNA, 14 nt, Human
gcccaggggugccc

SEQ ID NO: 2268257 - RNA, 15 nt, Human
gcccaggggugcccc

SEQ ID NO: 2268258 - RNA, 17 nt, Human
gcccaggggugcccccu

SEQ ID NO: 2268259 - RNA, 18 nt, Human
gcccaggggugcccccuc

SEQ ID NO: 2268260 - RNA, 20 nt, Human
gcccaggggcccacagggaa

SEQ ID NO: 2268261 - RNA, 16 nt, Human
gcccaggggagcccuc

SEQ ID NO: 2268262 - RNA, 19 nt, Human
gcccaggggcccacaggga

SEQ ID NO: 2268263 - RNA, 15 nt, Human
gcccaggggagcccu

SEQ ID NO: 2268264 - RNA, 23 nt, Human
gccccagagcuguuuauggccuc

SEQ ID NO: 2268265 - RNA, 22 nt, Human
gccccagagcuguuuauggccu

SEQ ID NO: 2268266 - RNA, 14 nt, Human
gccccagagcuguu

SEQ ID NO: 2268267 - RNA, 13 nt, Human
gccccagagcugu

SEQ ID NO: 2268268 - RNA, 12 nt, Human
gccccagagcug

SEQ ID NO: 2268269 - RNA, 17 nt, Human
gccccagagacucagag

SEQ ID NO: 2268270 - RNA, 22 nt, Human
gccccagagcaggguguuggga

SEQ ID NO: 2268271 - RNA, 15 nt, Human
gccccagagacucag

SEQ ID NO: 2268272 - RNA, 11 nt, Human
gccccagagac

SEQ ID NO: 2268273 - RNA, 18 nt, Human
gccccagaaggcagggaa

SEQ ID NO: 2268274 - RNA, 15 nt, Human
gccccacuggggaaa

SEQ ID NO: 2268275 - RNA, 14 nt, Human
gccccacuggggaa

SEQ ID NO: 2268276 - RNA, 13 nt, Human
gccccacugggga

SEQ ID NO: 2268277 - RNA, 15 nt, Human
gccccagaaggcagg

SEQ ID NO: 2268278 - RNA, 20 nt, Human
gccccaccuuuauuaaaauc

SEQ ID NO: 2268279 - RNA, 15 nt, Human
gccccaccuuuauua

SEQ ID NO: 2268280 - RNA, 24 nt, Human
gccccacccugggcccugggcugg

SEQ ID NO: 2268281 - RNA, 22 nt, Human
gccccacccugggcccugggcu

SEQ ID NO: 2268282 - RNA, 23 nt, Human
gccccacccugggcccugggcug

SEQ ID NO: 2268283 - RNA, 23 nt, Human
gccccaccuuuauuaaaaucuua

SEQ ID NO: 2268284 - RNA, 21 nt, Human
gccccaccuuuauuaaaaucu

SEQ ID NO: 2268285 - RNA, 15 nt, Human
gcaagccccugcucc

SEQ ID NO: 2268286 - RNA, 23 nt, Human
gcaagcccuguugacacaggucu

SEQ ID NO: 2268287 - RNA, 15 nt, Human
gcaagcccuguugac

SEQ ID NO: 2268288 - RNA, 13 nt, Human
gcaagauauuuau

SEQ ID NO: 2268289 - RNA, 20 nt, Human
gcaagccuguaaucccagcu

SEQ ID NO: 2268290 - RNA, 19 nt, Human
gcaagcuagaaccuggagg

SEQ ID NO: 2268291 - RNA, 13 nt, Human
gcaagcucccaag

SEQ ID NO: 2268292 - RNA, 19 nt, Human
gcaagccuguaaucccagc

SEQ ID NO: 2268293 - RNA, 24 nt, Human
gcaagccugcguucuugugacaga

SEQ ID NO: 2268294 - RNA, 11 nt, Human
gcaagccugcg

SEQ ID NO: 2268295 - RNA, 20 nt, Human
gcaagcauuuauguuuauuu

SEQ ID NO: 2268296 - RNA, 13 nt, Human
gcaagaggggugg

SEQ ID NO: 2268297 - RNA, 22 nt, Human
gcaagaggggguggaggggugu

SEQ ID NO: 2268298 - RNA, 23 nt, Human
gcaagaggggguggaggggugug

SEQ ID NO: 2268299 - RNA, 17 nt, Human
gcaagagggguggagac

SEQ ID NO: 2268300 - RNA, 10 nt, Human
gcaagccaga

SEQ ID NO: 2268301 - RNA, 18 nt, Human
gcaaggagauuuacaacu

SEQ ID NO: 2268302 - RNA, 19 nt, Human
gcaagcucccaagggaugg

SEQ ID NO: 2268303 - RNA, 22 nt, Human
gcaaggacuacguuaagggaag

SEQ ID NO: 2268304 - RNA, 13 nt, Human
gcaaggaggcugg

SEQ ID NO: 2268305 - RNA, 14 nt, Human
gcaaggaggcuggc

SEQ ID NO: 2268306 - RNA, 15 nt, Human
gcaaggaggcuggcu

SEQ ID NO: 2268307 - RNA, 16 nt, Human
gcaaggaggcuggcug

SEQ ID NO: 2268308 - RNA, 19 nt, Human
gcaaggaggcuggcugggg

SEQ ID NO: 2268309 - RNA, 20 nt, Human
gcaaggaggcuggcuggggc

SEQ ID NO: 2268310 - RNA, 14 nt, Human
gcaaggcaccugca

SEQ ID NO: 2268311 - RNA, 11 nt, Human
gcaaggcaggu

SEQ ID NO: 2268312 - RNA, 13 nt, Human
gcaaggcaggugc

SEQ ID NO: 2268313 - RNA, 18 nt, Human
gcaaggcaggugccucca

SEQ ID NO: 2268314 - RNA, 19 nt, Human
gcaaggcaggugccuccag

SEQ ID NO: 2268315 - RNA, 20 nt, Human
gcaaggcaggugccuccagg

SEQ ID NO: 2268316 - RNA, 18 nt, Human
gcaaggguucccucaaga

SEQ ID NO: 2268317 - RNA, 16 nt, Human
gcaaggggaaaaucuc

SEQ ID NO: 2268318 - RNA, 16 nt, Human
gcaaggguucccucaa

SEQ ID NO: 2268319 - RNA, 14 nt, Human
gcaagggugauggg

SEQ ID NO: 2268320 - RNA, 15 nt, Human
gcaaggggaaaaucu

SEQ ID NO: 2268321 - RNA, 14 nt, Human
gcaagggcucccca

SEQ ID NO: 2268322 - RNA, 15 nt, Human
gcaagggccaugcug

SEQ ID NO: 2268323 - RNA, 19 nt, Human
gcaagggccaugcugaagg

SEQ ID NO: 2268324 - RNA, 13 nt, Human
gcaaggcugucaa

SEQ ID NO: 2268325 - RNA, 21 nt, Human
gcaaggccgcuguucacccac

SEQ ID NO: 2268326 - RNA, 20 nt, Human
gcaaggccgcuguucaccca

SEQ ID NO: 2268327 - RNA, 11 nt, Human
gcaaggcuguc

SEQ ID NO: 2268328 - RNA, 21 nt, Human
gcaaggcaggugccuccaggu

SEQ ID NO: 2268329 - RNA, 22 nt, Human
gcaaggcaggugccuccaggug

SEQ ID NO: 2268330 - RNA, 17 nt, Human
gcaaucaaaucugcuuu

SEQ ID NO: 2268331 - RNA, 18 nt, Human
gcaauccacaaucugaca

SEQ ID NO: 2268332 - RNA, 19 nt, Human
gcaauauuuccucauguga

SEQ ID NO: 2268333 - RNA, 15 nt, Human
gcaaucaaaucugcu

SEQ ID NO: 2268334 - RNA, 15 nt, Human
gcaaugaccuuucaa

SEQ ID NO: 2268335 - RNA, 17 nt, Human
gcaaugaccuuucaaua

SEQ ID NO: 2268336 - RNA, 20 nt, Human
gcaaugaccuuucaauagga

SEQ ID NO: 2268337 - RNA, 22 nt, Human
gcaaugaccuuucaauaggaaa

SEQ ID NO: 2268338 - RNA, 14 nt, Human
gcaaugauuacucu

SEQ ID NO: 2268339 - RNA, 17 nt, Human
gcaaugauguccagaag

SEQ ID NO: 2268340 - RNA, 10 nt, Human
gcaauccuaa

SEQ ID NO: 2268341 - RNA, 15 nt, Human
gcaaugauguccaga

SEQ ID NO: 2268342 - RNA, 16 nt, Human
gcaaugauuacucuuu

SEQ ID NO: 2268343 - RNA, 11 nt, Human
gcaaugcauuu

SEQ ID NO: 2268344 - RNA, 19 nt, Human
gcaaugccaucaucuccug

SEQ ID NO: 2268345 - RNA, 18 nt, Human
gcaaugccaucaucuccu

SEQ ID NO: 2268346 - RNA, 15 nt, Human
gcaaugccaucaucu

SEQ ID NO: 2268347 - RNA, 22 nt, Human
gcaauccauguuaguuuuuacu

SEQ ID NO: 2268348 - RNA, 21 nt, Human
gcaauccauguuaguuuuuac

SEQ ID NO: 2268349 - RNA, 20 nt, Human
gcaauccauguuaguuuuua

SEQ ID NO: 2268350 - RNA, 13 nt, Human
gcaauccauguua

SEQ ID NO: 2268351 - RNA, 17 nt, Human
gcaaugaugaaugagaa

SEQ ID NO: 2268352 - RNA, 16 nt, Human
gcaaugaugaaugaga

SEQ ID NO: 2268353 - RNA, 23 nt, Human
gcaaugaccuuucaauaggaaaa

SEQ ID NO: 2268354 - RNA, 13 nt, Human
gcaaugcuggcug

SEQ ID NO: 2268355 - RNA, 14 nt, Human
gcaaugcuggcugu

SEQ ID NO: 2268356 - RNA, 22 nt, Human
gcaaugcuggcuguuggcuggg

SEQ ID NO: 2268357 - RNA, 23 nt, Human
gcaaugcuggcuguuggcugggg

SEQ ID NO: 2268358 - RNA, 14 nt, Human
gcaacagagugaga

SEQ ID NO: 2268359 - RNA, 13 nt, Human
gcaacagaaaaaa

SEQ ID NO: 2268360 - RNA, 19 nt, Human
gcaacagagugagacccug

SEQ ID NO: 2268361 - RNA, 13 nt, Human
gcaacagaucugg

SEQ ID NO: 2268362 - RNA, 12 nt, Human
gcaacagaucug

SEQ ID NO: 2268363 - RNA, 17 nt, Human
gcaacacucuauauuua

SEQ ID NO: 2268364 - RNA, 22 nt, Human
gcaaauccuugugggaaaagaa

SEQ ID NO: 2268365 - RNA, 19 nt, Human
gcaaauccuaugugauuuu

SEQ ID NO: 2268366 - RNA, 17 nt, Human
gcaaauccuaugugauu

SEQ ID NO: 2268367 - RNA, 23 nt, Human
gcaaauccuaugugauuuuaacu

SEQ ID NO: 2268368 - RNA, 17 nt, Human
gcaagaaagaaacccga

SEQ ID NO: 2268369 - RNA, 22 nt, Human
gcaacagaucuggaaccucagc

SEQ ID NO: 2268370 - RNA, 20 nt, Human
gcaacagaucuggaaccuca

SEQ ID NO: 2268371 - RNA, 18 nt, Human
gcaacagaucuggaaccu

SEQ ID NO: 2268372 - RNA, 17 nt, Human
gcaacagaucuggaacc

SEQ ID NO: 2268373 - RNA, 16 nt, Human
gcaacagaucuggaac

SEQ ID NO: 2268374 - RNA, 14 nt, Human
gcaacagaucugga

SEQ ID NO: 2268375 - RNA, 14 nt, Human
gcaagaaggaauug

SEQ ID NO: 2268376 - RNA, 20 nt, Human
gauuuucuuuaaaagaaugg

SEQ ID NO: 2268377 - RNA, 19 nt, Human
gcaagaagaucacgcuccc

SEQ ID NO: 2268378 - RNA, 21 nt, Human
gcaagaagaucacgcuccccg

SEQ ID NO: 2268379 - RNA, 17 nt, Human
gcaagaauugaagcagg

SEQ ID NO: 2268380 - RNA, 23 nt, Human
gcaagagccuugguguccaccug

SEQ ID NO: 2268381 - RNA, 22 nt, Human
gcaagagccuugguguccaccu

SEQ ID NO: 2268382 - RNA, 20 nt, Human
gcaagaggggguggaggggu

SEQ ID NO: 2268383 - RNA, 13 nt, Human
gcaagagccuugg

SEQ ID NO: 2268384 - RNA, 14 nt, Human
gcaagagagauguu

SEQ ID NO: 2268385 - RNA, 17 nt, Human
gcaagagagauguuuug

SEQ ID NO: 2268386 - RNA, 19 nt, Human
gcaagagaauugcuugaac

SEQ ID NO: 2268387 - RNA, 20 nt, Human
gcaagagacucuggccucca

SEQ ID NO: 2268388 - RNA, 18 nt, Human
gcaagacuguugcucaaa

SEQ ID NO: 2268389 - RNA, 15 nt, Human
gcaagaauuugaucg

SEQ ID NO: 2268390 - RNA, 23 nt, Human
gcaagacgcugugcugcccugcc

SEQ ID NO: 2268391 - RNA, 14 nt, Human
gcaagacgcugugc

SEQ ID NO: 2268392 - RNA, 20 nt, Human
gcaagacgcugugcugcccu

SEQ ID NO: 2268393 - RNA, 21 nt, Human
gcaagacgcugugcugcccug

SEQ ID NO: 2268394 - RNA, 22 nt, Human
gcaagacgcugugcugcccugc

SEQ ID NO: 2268395 - RNA, 18 nt, Human
gcaaagguggcucuccag

SEQ ID NO: 2268396 - RNA, 21 nt, Human
gcaaagguuccaacuguauau

SEQ ID NO: 2268397 - RNA, 23 nt, Human
gcaaaggggucccauagagguga

SEQ ID NO: 2268398 - RNA, 20 nt, Human
gcaaaggggucccauagagg

SEQ ID NO: 2268399 - RNA, 16 nt, Human
gcaaaguaucccuacu

SEQ ID NO: 2268400 - RNA, 22 nt, Human
gcaaagggcugaaagccauuug

SEQ ID NO: 2268401 - RNA, 20 nt, Human
gcaaaggggcugaaagaaca

SEQ ID NO: 2268402 - RNA, 15 nt, Human
gcaaagggcugaaag

SEQ ID NO: 2268403 - RNA, 19 nt, Human
gcaaagggcugaaagccau

SEQ ID NO: 2268404 - RNA, 22 nt, Human
gcaaagccccaugcuggagccu

SEQ ID NO: 2268405 - RNA, 23 nt, Human
gcaaagccccaugcuggagccug

SEQ ID NO: 2268406 - RNA, 22 nt, Human
gcaaaucagaaacuugugaagu

SEQ ID NO: 2268407 - RNA, 20 nt, Human
gcaaaucagaaacuugugaa

SEQ ID NO: 2268408 - RNA, 18 nt, Human
gcaaaucaguuacuaaga

SEQ ID NO: 2268409 - RNA, 15 nt, Human
gcaaaucauagcugg

SEQ ID NO: 2268410 - RNA, 15 nt, Human
gcaaauccuauguga

SEQ ID NO: 2268411 - RNA, 20 nt, Human
gcaaauccuugugggaaaag

SEQ ID NO: 2268412 - RNA, 15 nt, Human
gcaaaucagaaacuu

SEQ ID NO: 2268413 - RNA, 13 nt, Human
gcaaaucagaaac

SEQ ID NO: 2268414 - RNA, 12 nt, Human
gcaaaucaaugc

SEQ ID NO: 2268415 - RNA, 19 nt, Human
gcaaagguuccaacuguau

SEQ ID NO: 2268416 - RNA, 15 nt, Human
gauuuuugucuugug

SEQ ID NO: 2268417 - RNA, 13 nt, Human
gauuuuugccucu

SEQ ID NO: 2268418 - RNA, 17 nt, Human
gcaaaauugauguguuu

SEQ ID NO: 2268419 - RNA, 15 nt, Human
gauuuuuguaagaca

SEQ ID NO: 2268420 - RNA, 17 nt, Human
gcaaacacacaaaggua

SEQ ID NO: 2268421 - RNA, 16 nt, Human
gcaaaauuuuauagcu

SEQ ID NO: 2268422 - RNA, 21 nt, Human
gcaaaauuugaugccaggaca

SEQ ID NO: 2268423 - RNA, 22 nt, Human
gcaaaauuugaugccaggacac

SEQ ID NO: 2268424 - RNA, 10 nt, Human
gcaaaauuuc

SEQ ID NO: 2268425 - RNA, 21 nt, Human
gcaaaauuguuuuugguugga

SEQ ID NO: 2268426 - RNA, 15 nt, Human
gcaaaauuugaugcc

SEQ ID NO: 2268427 - RNA, 20 nt, Human
gcaaaauuugaugccaggac

SEQ ID NO: 2268428 - RNA, 17 nt, Human
gcaaaauugcaaaucuu

SEQ ID NO: 2268429 - RNA, 13 nt, Human
gcaaaauugcaaa

SEQ ID NO: 2268430 - RNA, 12 nt, Human
gcaaagcauuga

SEQ ID NO: 2268431 - RNA, 13 nt, Human
gcaaagcccagcu

SEQ ID NO: 2268432 - RNA, 21 nt, Human
gcaaagcccagcuugaaaccu

SEQ ID NO: 2268433 - RNA, 18 nt, Human
gcaaagccccaugcugga

SEQ ID NO: 2268434 - RNA, 19 nt, Human
gcaaagccccaugcuggag

SEQ ID NO: 2268435 - RNA, 20 nt, Human
gcaaagccccaugcuggagc

SEQ ID NO: 2268436 - RNA, 21 nt, Human
gcaaagccccaugcuggagcc

SEQ ID NO: 2268437 - RNA, 23 nt, Human
gcaaagcacugacuucuaaguaa

SEQ ID NO: 2268438 - RNA, 23 nt, Human
gcaaacagaggaagaauuuguua

SEQ ID NO: 2268439 - RNA, 22 nt, Human
gauuuccagucuccaccaggaa

SEQ ID NO: 2268440 - RNA, 18 nt, Human
gauuuccagccagggcug

SEQ ID NO: 2268441 - RNA, 19 nt, Human
gauuuccagccagggcugc

SEQ ID NO: 2268442 - RNA, 23 nt, Human
gauugcacguggccucuugagca

SEQ ID NO: 2268443 - RNA, 19 nt, Human
gauugcacguggccucuug

SEQ ID NO: 2268444 - RNA, 20 nt, Human
gauugcacguggccucuuga

SEQ ID NO: 2268445 - RNA, 22 nt, Human
gauugcaauuugcacaaguuuu

SEQ ID NO: 2268446 - RNA, 15 nt, Human
gauugcacguggccu

SEQ ID NO: 2268447 - RNA, 16 nt, Human
gauugcacguggccuc

SEQ ID NO: 2268448 - RNA, 17 nt, Human
gauugcacguggccucu

SEQ ID NO: 2268449 - RNA, 16 nt, Human
gauuucccguggcccc

SEQ ID NO: 2268450 - RNA, 18 nt, Human
gauuucccguggccccag

SEQ ID NO: 2268451 - RNA, 21 nt, Human
gauuucccguggccccagccu

SEQ ID NO: 2268452 - RNA, 22 nt, Human
gauuucccguggccccagccug

SEQ ID NO: 2268453 - RNA, 15 nt, Human
gauuuccguuaaaau

SEQ ID NO: 2268454 - RNA, 20 nt, Human
gauuucucccagcucuagac

SEQ ID NO: 2268455 - RNA, 11 nt, Human
gauuucuccca

SEQ ID NO: 2268456 - RNA, 18 nt, Human
gauuuccguuaaaauacc

SEQ ID NO: 2268457 - RNA, 17 nt, Human
gauuucugcagguucuu

SEQ ID NO: 2268458 - RNA, 13 nt, Human
gauuucugccuuc

SEQ ID NO: 2268459 - RNA, 16 nt, Human
gauuucugccuuccuu

SEQ ID NO: 2268460 - RNA, 17 nt, Human
gauuugcauugaacaca

SEQ ID NO: 2268461 - RNA, 15 nt, Human
gauuugccugugcca

SEQ ID NO: 2268462 - RNA, 21 nt, Human
gauuugcauugaacacaaacu

SEQ ID NO: 2268463 - RNA, 17 nt, Human
gauuucugccuuccuug

SEQ ID NO: 2268464 - RNA, 19 nt, Human
gauuucuguuuagauaaua

SEQ ID NO: 2268465 - RNA, 11 nt, Human
gauuucuguuu

SEQ ID NO: 2268466 - RNA, 21 nt, Human
gauuugcugggcaguuuuucu

SEQ ID NO: 2268467 - RNA, 12 nt, Human
gauuuggaaaaa

SEQ ID NO: 2268468 - RNA, 23 nt, Human
gauuugcucagugucuggcugca

SEQ ID NO: 2268469 - RNA, 15 nt, Human
gauuuggaagggaaa

SEQ ID NO: 2268470 - RNA, 20 nt, Human
gauuuggggcucagaguggg

SEQ ID NO: 2268471 - RNA, 23 nt, Human
gauuugggcuggaacagauucac

SEQ ID NO: 2268472 - RNA, 19 nt, Human
gauuugguguacaauucag

SEQ ID NO: 2268473 - RNA, 13 nt, Human
gauuuggggugga

SEQ ID NO: 2268474 - RNA, 12 nt, Human
gauuugggcugg

SEQ ID NO: 2268475 - RNA, 22 nt, Human
gauuuggucaacacuaacauga

SEQ ID NO: 2268476 - RNA, 20 nt, Human
gauuuuuaccguuucuuccc

SEQ ID NO: 2268477 - RNA, 18 nt, Human
gauuuucuauuguuacuc

SEQ ID NO: 2268478 - RNA, 13 nt, Human
gauuuucuuuaaa

SEQ ID NO: 2268479 - RNA, 21 nt, Human
gauuuuccuuuuuuauacaca

SEQ ID NO: 2268480 - RNA, 12 nt, Human
gauuuucuauug

SEQ ID NO: 2268481 - RNA, 17 nt, Human
gauuuucuauuguuacu

SEQ ID NO: 2268482 - RNA, 22 nt, Human
gauuuucuauuguuacucuggu

SEQ ID NO: 2268483 - RNA, 16 nt, Human
gauuuucuuuaaaaga

SEQ ID NO: 2268484 - RNA, 12 nt, Human
gauuuuucucaa

SEQ ID NO: 2268485 - RNA, 13 nt, Human
gauuuuucucaaa

SEQ ID NO: 2268486 - RNA, 18 nt, Human
gauuuuucucaaaguuuu

SEQ ID NO: 2268487 - RNA, 23 nt, Human
gauuuuucuggagguugauaacu

SEQ ID NO: 2268488 - RNA, 18 nt, Human
gauuuuccuuuuuuauac

SEQ ID NO: 2268489 - RNA, 19 nt, Human
gauuuuccuuuuuuauaca

SEQ ID NO: 2268490 - RNA, 13 nt, Human
gauuuuccaaaug

SEQ ID NO: 2268491 - RNA, 15 nt, Human
gauuuuccugaaaac

SEQ ID NO: 2268492 - RNA, 11 nt, Human
gauuugugaac

SEQ ID NO: 2268493 - RNA, 14 nt, Human
gauuugucccaggu

SEQ ID NO: 2268494 - RNA, 14 nt, Human
gauuuguacugaaa

SEQ ID NO: 2268495 - RNA, 20 nt, Human
gauuugugaacucagccaag

SEQ ID NO: 2268496 - RNA, 19 nt, Human
gauuuuaugcuuuaaacau

SEQ ID NO: 2268497 - RNA, 14 nt, Human
gauuuuaugcuuua

SEQ ID NO: 2268498 - RNA, 15 nt, Human
gauuuuauuugacaa

SEQ ID NO: 2268499 - RNA, 19 nt, Human
gauuuucaaagcuuuuucc

SEQ ID NO: 2268500 - RNA, 18 nt, Human
gauuuucaaagcuuuuuc

SEQ ID NO: 2268501 - RNA, 19 nt, Human
gauucauauuuacuucuua

SEQ ID NO: 2268502 - RNA, 18 nt, Human
gauucauauuuacuucuu

SEQ ID NO: 2268503 - RNA, 17 nt, Human
gauucauauuuacuucu

SEQ ID NO: 2268504 - RNA, 18 nt, Human
gauucagauuguuaucua

SEQ ID NO: 2268505 - RNA, 19 nt, Human
gauucauaguaacuucuua

SEQ ID NO: 2268506 - RNA, 17 nt, Human
gauuccagguggcauca

SEQ ID NO: 2268507 - RNA, 18 nt, Human
gauucccaagcucugcuc

SEQ ID NO: 2268508 - RNA, 22 nt, Human
gauuccauuuggcagagcuucu

SEQ ID NO: 2268509 - RNA, 19 nt, Human
gauuccagagaguggcucc

SEQ ID NO: 2268510 - RNA, 20 nt, Human
gauuccagagaguggcuccu

SEQ ID NO: 2268511 - RNA, 22 nt, Human
gauuccagagaguggcuccucc

SEQ ID NO: 2268512 - RNA, 15 nt, Human
gauucagcucugcaa

SEQ ID NO: 2268513 - RNA, 13 nt, Human
gauucagcucugc

SEQ ID NO: 2268514 - RNA, 23 nt, Human
gauggggucucacaguguugccc

SEQ ID NO: 2268515 - RNA, 19 nt, Human
gauucagacagcugccugg

SEQ ID NO: 2268516 - RNA, 21 nt, Human
gaugggggagucugaagcaga

SEQ ID NO: 2268517 - RNA, 22 nt, Human
gaugggggaacucagauccagg

SEQ ID NO: 2268518 - RNA, 20 nt, Human
gaugggggaacucagaucca

SEQ ID NO: 2268519 - RNA, 19 nt, Human
gaugggggaacucagaucc

SEQ ID NO: 2268520 - RNA, 16 nt, Human
gaugggggaacucaga

SEQ ID NO: 2268521 - RNA, 17 nt, Human
gaugggggaaagcacag

SEQ ID NO: 2268522 - RNA, 21 nt, Human
gaugggggaaagcacaggugg

SEQ ID NO: 2268523 - RNA, 23 nt, Human
gauggggcugcaccggcuggccu

SEQ ID NO: 2268524 - RNA, 21 nt, Human
gauuccuuugaagaggaaaau

SEQ ID NO: 2268525 - RNA, 17 nt, Human
gauuccuuugaagagga

SEQ ID NO: 2268526 - RNA, 18 nt, Human
gauucgcccaaagccaga

SEQ ID NO: 2268527 - RNA, 13 nt, Human
gauucggcugucu

SEQ ID NO: 2268528 - RNA, 16 nt, Human
gauucgguaucccccc

SEQ ID NO: 2268529 - RNA, 17 nt, Human
gauucgguaucccccca

SEQ ID NO: 2268530 - RNA, 12 nt, Human
gauucuuuccug

SEQ ID NO: 2268531 - RNA, 21 nt, Human
gauucccaagcucugcuccuc

SEQ ID NO: 2268532 - RNA, 13 nt, Human
gauuccuuccugu

SEQ ID NO: 2268533 - RNA, 15 nt, Human
gauuccuuccuguuc

SEQ ID NO: 2268534 - RNA, 19 nt, Human
gauucccaagcucugcucc

SEQ ID NO: 2268535 - RNA, 20 nt, Human
gauucccaagcucugcuccu

SEQ ID NO: 2268536 - RNA, 20 nt, Human
gauugcaacaggcugggcuu

SEQ ID NO: 2268537 - RNA, 18 nt, Human
gauucuuuccugaggcug

SEQ ID NO: 2268538 - RNA, 16 nt, Human
gauucuuuccugaggc

SEQ ID NO: 2268539 - RNA, 17 nt, Human
gauucuuuccugaggcu

SEQ ID NO: 2268540 - RNA, 23 nt, Human
gauugcaccacugcacuccagcc

SEQ ID NO: 2268541 - RNA, 16 nt, Human
gauugcaccacugcac

SEQ ID NO: 2268542 - RNA, 21 nt, Human
gauugcaacaggcugggcuuc

SEQ ID NO: 2268543 - RNA, 14 nt, Human
gauugcaauuugca

SEQ ID NO: 2268544 - RNA, 21 nt, Human
gauugcaauuugcacaaguuu

SEQ ID NO: 2268545 - RNA, 20 nt, Human
gaugacaugcacucagcucu

SEQ ID NO: 2268546 - RNA, 14 nt, Human
gaugacagagcgag

SEQ ID NO: 2268547 - RNA, 14 nt, Human
gaugacauugcuaa

SEQ ID NO: 2268548 - RNA, 15 nt, Human
gaugacauugcuaag

SEQ ID NO: 2268549 - RNA, 16 nt, Human
gaugacauugcuaaga

SEQ ID NO: 2268550 - RNA, 18 nt, Human
gaugacauugcuaagaug

SEQ ID NO: 2268551 - RNA, 21 nt, Human
gaugacauugcuaagaugcuc

SEQ ID NO: 2268552 - RNA, 20 nt, Human
gaugacaacuggaauaguuu

SEQ ID NO: 2268553 - RNA, 16 nt, Human
gaugaaguuuuacauu

SEQ ID NO: 2268554 - RNA, 17 nt, Human
gaugacaacuucccagu

SEQ ID NO: 2268555 - RNA, 18 nt, Human
gaugacaugugacuccua

SEQ ID NO: 2268556 - RNA, 16 nt, Human
gaugcaccaccaagcc

SEQ ID NO: 2268557 - RNA, 13 nt, Human
gaugcaccagccc

SEQ ID NO: 2268558 - RNA, 22 nt, Human
gaugcacagaguuguuacauuu

SEQ ID NO: 2268559 - RNA, 21 nt, Human
gaugcacagaguuguuacauu

SEQ ID NO: 2268560 - RNA, 21 nt, Human
gaugcagcauuuuguauuugu

SEQ ID NO: 2268561 - RNA, 23 nt, Human
gaugcagagagccauuuugugaa

SEQ ID NO: 2268562 - RNA, 23 nt, Human
gaugcagagguaaaagugugagc

SEQ ID NO: 2268563 - RNA, 16 nt, Human
gaugcagcauuaugau

SEQ ID NO: 2268564 - RNA, 12 nt, Human
gaugcagccuca

SEQ ID NO: 2268565 - RNA, 19 nt, Human
gaugcagccucacaguccu

SEQ ID NO: 2268566 - RNA, 17 nt, Human
gaugcagcaaaauguga

SEQ ID NO: 2268567 - RNA, 14 nt, Human
gaugcagccucaca

SEQ ID NO: 2268568 - RNA, 17 nt, Human
gaugccacacagagugg

SEQ ID NO: 2268569 - RNA, 22 nt, Human
gaugccaaccucuggagcaaug

SEQ ID NO: 2268570 - RNA, 15 nt, Human
gaugccacaccaagc

SEQ ID NO: 2268571 - RNA, 16 nt, Human
gaugccacaccaagcu

SEQ ID NO: 2268572 - RNA, 19 nt, Human
gaugccacaccaagcugug

SEQ ID NO: 2268573 - RNA, 21 nt, Human
gaugccacaccaagcugugcc

SEQ ID NO: 2268574 - RNA, 22 nt, Human
gaugccacaccaagcugugcca

SEQ ID NO: 2268575 - RNA, 21 nt, Human
gaugccaagaaguuuaaggaa

SEQ ID NO: 2268576 - RNA, 15 nt, Human
gaugccaaccucugg

SEQ ID NO: 2268577 - RNA, 15 nt, Human
gaugccacacaagga

SEQ ID NO: 2268578 - RNA, 19 nt, Human
gaugccaauauuaaaucug

SEQ ID NO: 2268579 - RNA, 20 nt, Human
gaugccaaguuguuugagaa

SEQ ID NO: 2268580 - RNA, 13 nt, Human
gauggccugagaa

SEQ ID NO: 2268581 - RNA, 14 nt, Human
gauggccuggccag

SEQ ID NO: 2268582 - RNA, 20 nt, Human
gauggcaaagaaggagagca

SEQ ID NO: 2268583 - RNA, 14 nt, Human
gauggcgcuaggca

SEQ ID NO: 2268584 - RNA, 20 nt, Human
gauggccuggccagggccug

SEQ ID NO: 2268585 - RNA, 21 nt, Human
gauggccuggccagggccugg

SEQ ID NO: 2268586 - RNA, 14 nt, Human
gauggcgggugggg

SEQ ID NO: 2268587 - RNA, 15 nt, Human
gauggcggguggggg

SEQ ID NO: 2268588 - RNA, 16 nt, Human
gauggcgggugggggu

SEQ ID NO: 2268589 - RNA, 22 nt, Human
gauggauucucagauauuuaua

SEQ ID NO: 2268590 - RNA, 19 nt, Human
gauggauucucagauauuu

SEQ ID NO: 2268591 - RNA, 18 nt, Human
gauggauucucagauauu

SEQ ID NO: 2268592 - RNA, 16 nt, Human
gauggauucucagaua

SEQ ID NO: 2268593 - RNA, 19 nt, Human
gauggauuugccugugcca

SEQ ID NO: 2268594 - RNA, 14 nt, Human
gauggauuugccug

SEQ ID NO: 2268595 - RNA, 17 nt, Human
gauggauucuccacuca

SEQ ID NO: 2268596 - RNA, 15 nt, Human
gauggauuugaagca

SEQ ID NO: 2268597 - RNA, 22 nt, Human
gauggauuuccagccaaagccu

SEQ ID NO: 2268598 - RNA, 14 nt, Human
gauggauucucaga

SEQ ID NO: 2268599 - RNA, 22 nt, Human
gauggauuccaaccccaacucc

SEQ ID NO: 2268600 - RNA, 12 nt, Human
gauggauuccaa

SEQ ID NO: 2268601 - RNA, 21 nt, Human
gauggauuccaaccccaacuc

SEQ ID NO: 2268602 - RNA, 23 nt, Human
gauggaugccaauauuaaaucug

SEQ ID NO: 2268603 - RNA, 20 nt, Human
gaugccugguggcagcugcg

SEQ ID NO: 2268604 - RNA, 18 nt, Human
gaugccugguggcagcug

SEQ ID NO: 2268605 - RNA, 19 nt, Human
gaugccugguggcagcugc

SEQ ID NO: 2268606 - RNA, 21 nt, Human
gauggcuaaaaccaucauagu

SEQ ID NO: 2268607 - RNA, 19 nt, Human
gauggcgugggcugcguga

SEQ ID NO: 2268608 - RNA, 13 nt, Human
gauggcuccucuc

SEQ ID NO: 2268609 - RNA, 12 nt, Human
gauggcuccucu

SEQ ID NO: 2268610 - RNA, 21 nt, Human
gauggcuaguaucaaaagaaa

SEQ ID NO: 2268611 - RNA, 13 nt, Human
gauggcugugccu

SEQ ID NO: 2268612 - RNA, 17 nt, Human
gauggcugugccucugc

SEQ ID NO: 2268613 - RNA, 18 nt, Human
gauggcugugccucugcc

SEQ ID NO: 2268614 - RNA, 19 nt, Human
gauggcugugccucugccu

SEQ ID NO: 2268615 - RNA, 20 nt, Human
gauggcugugccucugccug

SEQ ID NO: 2268616 - RNA, 14 nt, Human
gauggcuccucuca

SEQ ID NO: 2268617 - RNA, 13 nt, Human
gauggggcccugc

SEQ ID NO: 2268618 - RNA, 14 nt, Human
gauggggcccugcc

SEQ ID NO: 2268619 - RNA, 22 nt, Human
gauggggcccugccuccuuugu

SEQ ID NO: 2268620 - RNA, 19 nt, Human
gaugaagcaaacacauuaa

SEQ ID NO: 2268621 - RNA, 16 nt, Human
gaugaagcaaacacau

SEQ ID NO: 2268622 - RNA, 15 nt, Human
gaugaagcaaacaca

SEQ ID NO: 2268623 - RNA, 21 nt, Human
gaugaagagugagagggcaug

SEQ ID NO: 2268624 - RNA, 17 nt, Human
gaugaacuuauucugua

SEQ ID NO: 2268625 - RNA, 19 nt, Human
gaugaacuuauucuguaga

SEQ ID NO: 2268626 - RNA, 13 nt, Human
gaugaacuuucuc

SEQ ID NO: 2268627 - RNA, 14 nt, Human
gaugaagagugaga

SEQ ID NO: 2268628 - RNA, 20 nt, Human
gaugaagaaaagugggccag

SEQ ID NO: 2268629 - RNA, 19 nt, Human
gaugaaagagaaggugggu

SEQ ID NO: 2268630 - RNA, 14 nt, Human
gaugaaagaggagg

SEQ ID NO: 2268631 - RNA, 18 nt, Human
gaugaaauaacuccuucu

SEQ ID NO: 2268632 - RNA, 19 nt, Human
gaugaaaucuuacagcugg

SEQ ID NO: 2268633 - RNA, 20 nt, Human
gaugaaaucuuacagcuggg

SEQ ID NO: 2268634 - RNA, 18 nt, Human
gaugaacucuuagaaaug

SEQ ID NO: 2268635 - RNA, 22 nt, Human
gaugaacucuuagaaaugaagg

SEQ ID NO: 2268636 - RNA, 17 nt, Human
gaugaaaauauuuaaag

SEQ ID NO: 2268637 - RNA, 14 nt, Human
gaugaaaauauuug

SEQ ID NO: 2268638 - RNA, 14 nt, Human
gaugaaaauauuua

SEQ ID NO: 2268639 - RNA, 15 nt, Human
gaucuuuguggccaa

SEQ ID NO: 2268640 - RNA, 16 nt, Human
gaugaaaauauuuaaa

SEQ ID NO: 2268641 - RNA, 15 nt, Human
gaugaaaauauuuaa

SEQ ID NO: 2268642 - RNA, 18 nt, Human
gaucugugccccaugccu

SEQ ID NO: 2268643 - RNA, 14 nt, Human
gaucugugccccau

SEQ ID NO: 2268644 - RNA, 19 nt, Human
gaucugugcccagagaugg

SEQ ID NO: 2268645 - RNA, 18 nt, Human
gaucugugcuuuccagcu

SEQ ID NO: 2268646 - RNA, 19 nt, Human
gaucugugcuuuccagcuc

SEQ ID NO: 2268647 - RNA, 17 nt, Human
gaucuguuuugaaggca

SEQ ID NO: 2268648 - RNA, 13 nt, Human
gaucuguuuugaa

SEQ ID NO: 2268649 - RNA, 20 nt, Human
gaucugugcuuuccagcuca

SEQ ID NO: 2268650 - RNA, 23 nt, Human
gaucugugcuuuccagcucaccc

SEQ ID NO: 2268651 - RNA, 14 nt, Human
gaucuguugcaaac

SEQ ID NO: 2268652 - RNA, 21 nt, Human
gaucuguugcaaacucagccu

SEQ ID NO: 2268653 - RNA, 13 nt, Human
gaucugugcccca

SEQ ID NO: 2268654 - RNA, 16 nt, Human
gaucugugcccagaga

SEQ ID NO: 2268655 - RNA, 21 nt, Human
gaucugugaggggcucucuca

SEQ ID NO: 2268656 - RNA, 13 nt, Human
gaucucagguucu

SEQ ID NO: 2268657 - RNA, 17 nt, Human
gaucucaggggcuguuu

SEQ ID NO: 2268658 - RNA, 18 nt, Human
gaucucaggggcuguuug

SEQ ID NO: 2268659 - RNA, 19 nt, Human
gaucucaggggcuguuuga

SEQ ID NO: 2268660 - RNA, 20 nt, Human
gaucuguuguguacguggag

SEQ ID NO: 2268661 - RNA, 18 nt, Human
gaucuguuuugaaggcaa

SEQ ID NO: 2268662 - RNA, 13 nt, Human
gaucuuuggacag

SEQ ID NO: 2268663 - RNA, 16 nt, Human
gaucuuuguggccaag

SEQ ID NO: 2268664 - RNA, 14 nt, Human
gaucuuuguggcca

SEQ ID NO: 2268665 - RNA, 11 nt, Human
gaucuuugugg

SEQ ID NO: 2268666 - RNA, 21 nt, Human
gaucuuuggacagaagcagcu

SEQ ID NO: 2268667 - RNA, 18 nt, Human
gaucuuugcagacaggca

SEQ ID NO: 2268668 - RNA, 17 nt, Human
gaucuuugcagacaggc

SEQ ID NO: 2268669 - RNA, 21 nt, Human
gaucgcggcggagcuggcccc

SEQ ID NO: 2268670 - RNA, 23 nt, Human
gaucgcgccacuacacuccagcc

SEQ ID NO: 2268671 - RNA, 17 nt, Human
gaucggagccuccucuc

SEQ ID NO: 2268672 - RNA, 22 nt, Human
gaucggaggcuugucagagcug

SEQ ID NO: 2268673 - RNA, 20 nt, Human
gaucggagccuccucucuca

SEQ ID NO: 2268674 - RNA, 17 nt, Human
gauccugcggguggggc

SEQ ID NO: 2268675 - RNA, 18 nt, Human
gauccugcggguggggcu

SEQ ID NO: 2268676 - RNA, 23 nt, Human
gaucgugccguuacucuccaacc

SEQ ID NO: 2268677 - RNA, 22 nt, Human
gaucgugacgcugaauaaaugu

SEQ ID NO: 2268678 - RNA, 19 nt, Human
gaucgugacgcugaauaaa

SEQ ID NO: 2268679 - RNA, 20 nt, Human
gaucgugacgcugaauaaau

SEQ ID NO: 2268680 - RNA, 18 nt, Human
gaucgugcuaaauuuuca

SEQ ID NO: 2268681 - RNA, 16 nt, Human
gaucgugacgcugaau

SEQ ID NO: 2268682 - RNA, 18 nt, Human
gaucgucugacugguguu

SEQ ID NO: 2268683 - RNA, 16 nt, Human
gaucuaucaauaguca

SEQ ID NO: 2268684 - RNA, 15 nt, Human
gaucgugcuaaauuu

SEQ ID NO: 2268685 - RNA, 14 nt, Human
gaucucaggggcug

SEQ ID NO: 2268686 - RNA, 14 nt, Human
gauccccagcuguu

SEQ ID NO: 2268687 - RNA, 13 nt, Human
gauccccucagga

SEQ ID NO: 2268688 - RNA, 14 nt, Human
gauccccucaggac

SEQ ID NO: 2268689 - RNA, 21 nt, Human
gaucccgccucuucuucuuca

SEQ ID NO: 2268690 - RNA, 15 nt, Human
gaucccuagcuguga

SEQ ID NO: 2268691 - RNA, 17 nt, Human
gauccccucaggacugc

SEQ ID NO: 2268692 - RNA, 15 nt, Human
gaucccucauccuca

SEQ ID NO: 2268693 - RNA, 16 nt, Human
gaucccucauccucau

SEQ ID NO: 2268694 - RNA, 21 nt, Human
gaucccuagcugugaccucuc

SEQ ID NO: 2268695 - RNA, 19 nt, Human
gaucccuagcugugaccuc

SEQ ID NO: 2268696 - RNA, 13 nt, Human
gauccuggaaauc

SEQ ID NO: 2268697 - RNA, 21 nt, Human
gauccugagccagauuucacu

SEQ ID NO: 2268698 - RNA, 22 nt, Human
gauccugagccagauuucacuc

SEQ ID NO: 2268699 - RNA, 16 nt, Human
gauaguauugugcaua

SEQ ID NO: 2268700 - RNA, 18 nt, Human
gauaguagcauacauuua

SEQ ID NO: 2268701 - RNA, 14 nt, Human
gauagucuuucagu

SEQ ID NO: 2268702 - RNA, 14 nt, Human
gauagcacuuucua

SEQ ID NO: 2268703 - RNA, 14 nt, Human
gauaguagcuuccu

SEQ ID NO: 2268704 - RNA, 15 nt, Human
gauaguaacaaugaa

SEQ ID NO: 2268705 - RNA, 23 nt, Human
gauagucuuuugcuuuuggcaaa

SEQ ID NO: 2268706 - RNA, 22 nt, Human
gauagucuuucaguuaaggaga

SEQ ID NO: 2268707 - RNA, 18 nt, Human
gaucaaggagaggaggca

SEQ ID NO: 2268708 - RNA, 23 nt, Human
gauagugggcaccccacugcaau

SEQ ID NO: 2268709 - RNA, 16 nt, Human
gaucacgccacugcac

SEQ ID NO: 2268710 - RNA, 18 nt, Human
gaucacgccacugcacua

SEQ ID NO: 2268711 - RNA, 19 nt, Human
gaucaauaaaaugugauuu

SEQ ID NO: 2268712 - RNA, 12 nt, Human
gaucaaugacag

SEQ ID NO: 2268713 - RNA, 13 nt, Human
gaucaaugaaaug

SEQ ID NO: 2268714 - RNA, 14 nt, Human
gaucaaugacagag

SEQ ID NO: 2268715 - RNA, 18 nt, Human
gaucaaugacagagccuu

SEQ ID NO: 2268716 - RNA, 22 nt, Human
gaucaauggcgcagugccucug

SEQ ID NO: 2268717 - RNA, 23 nt, Human
gaucaauggcgcagugccucugg

SEQ ID NO: 2268718 - RNA, 21 nt, Human
gaucaauaaaaugugauuuuu

SEQ ID NO: 2268719 - RNA, 18 nt, Human
gaucaauaaaaugugauu

SEQ ID NO: 2268720 - RNA, 14 nt, Human
gaucaauaaaaugu

SEQ ID NO: 2268721 - RNA, 24 nt, Human
gaucacgccacugcacuccagccu

SEQ ID NO: 2268722 - RNA, 23 nt, Human
gaucacgccacugcacuccagcc

SEQ ID NO: 2268723 - RNA, 16 nt, Human
gaucaauuaaauguag

SEQ ID NO: 2268724 - RNA, 15 nt, Human
gaucaauuaaaugua

SEQ ID NO: 2268725 - RNA, 12 nt, Human
gaucacggcuca

SEQ ID NO: 2268726 - RNA, 23 nt, Human
gaucagauugcaugugacucuga

SEQ ID NO: 2268727 - RNA, 19 nt, Human
gaucagcaaaccggggccu

SEQ ID NO: 2268728 - RNA, 15 nt, Human
gaucagauugcaugu

SEQ ID NO: 2268729 - RNA, 13 nt, Human
gaucacgcucccc

SEQ ID NO: 2268730 - RNA, 14 nt, Human
gaucacgcuccccg

SEQ ID NO: 2268731 - RNA, 22 nt, Human
gaucacgcuccccgccuguucc

SEQ ID NO: 2268732 - RNA, 15 nt, Human
gaucagccugggcaa

SEQ ID NO: 2268733 - RNA, 12 nt, Human
gaucagccuggg

SEQ ID NO: 2268734 - RNA, 14 nt, Human
gaucagguggggag

SEQ ID NO: 2268735 - RNA, 13 nt, Human
gaucaggugggga

SEQ ID NO: 2268736 - RNA, 11 nt, Human
gaucaggucau

SEQ ID NO: 2268737 - RNA, 22 nt, Human
gaucagucugauucccaagcuc

SEQ ID NO: 2268738 - RNA, 15 nt, Human
gaucauuuucccccc

SEQ ID NO: 2268739 - RNA, 14 nt, Human
gaucauuuuccccc

SEQ ID NO: 2268740 - RNA, 18 nt, Human
gaucauuuguuggaauga

SEQ ID NO: 2268741 - RNA, 20 nt, Human
gaucauugugaaauuauuca

SEQ ID NO: 2268742 - RNA, 14 nt, Human
gaucauugugaaau

SEQ ID NO: 2268743 - RNA, 14 nt, Human
gaucauuaucagcc

SEQ ID NO: 2268744 - RNA, 23 nt, Human
gaucauuuuccccccacucuccc

SEQ ID NO: 2268745 - RNA, 21 nt, Human
gaucauuugcccuuaaggaca

SEQ ID NO: 2268746 - RNA, 14 nt, Human
gauccccaagugug

SEQ ID NO: 2268747 - RNA, 18 nt, Human
gauccccaagugugaaca

SEQ ID NO: 2268748 - RNA, 20 nt, Human
gauccccaagugugaacaaa

SEQ ID NO: 2268749 - RNA, 19 nt, Human
gaucauuuuccccccacuc

SEQ ID NO: 2268750 - RNA, 18 nt, Human
gaucauuuuccccccacu

SEQ ID NO: 2268751 - RNA, 13 nt, Human
gaucauuuucuua

SEQ ID NO: 2268752 - RNA, 20 nt, Human
gauccccaagccuggcaagg

SEQ ID NO: 2268753 - RNA, 18 nt, Human
gaucaguuauaaguagca

SEQ ID NO: 2268754 - RNA, 20 nt, Human
gaucaguguaccauuugccu

SEQ ID NO: 2268755 - RNA, 23 nt, Human
gaucaguccuuugaucaguauaa

SEQ ID NO: 2268756 - RNA, 23 nt, Human
gaucagugggccuccaaggaggg

SEQ ID NO: 2268757 - RNA, 20 nt, Human
gaucaguauaauuuuuuaaa

SEQ ID NO: 2268758 - RNA, 17 nt, Human
gaucauccacugugcca

SEQ ID NO: 2268759 - RNA, 19 nt, Human
gaucauccacugugccaug

SEQ ID NO: 2268760 - RNA, 16 nt, Human
gaucauccacugugcc

SEQ ID NO: 2268761 - RNA, 21 nt, Human
gaucauccuuuccagcaugag

SEQ ID NO: 2268762 - RNA, 21 nt, Human
gaucauccacugugccaugug

SEQ ID NO: 2268763 - RNA, 14 nt, Human
gaucaugguguaau

SEQ ID NO: 2268764 - RNA, 14 nt, Human
gaucauggcaucca

SEQ ID NO: 2268765 - RNA, 15 nt, Human
gaucaugguguaaua

SEQ ID NO: 2268766 - RNA, 18 nt, Human
gaucaugguguaauaaga

SEQ ID NO: 2268767 - RNA, 20 nt, Human
gaucaugguguaauaagaca

SEQ ID NO: 2268768 - RNA, 21 nt, Human
gaucaugguguaauaagacau

SEQ ID NO: 2268769 - RNA, 23 nt, Human
gaucaugguguaauaagacauaa

SEQ ID NO: 2268770 - RNA, 15 nt, Human
gaucaugcauuguug

SEQ ID NO: 2268771 - RNA, 14 nt, Human
gaucaugcauuguu

SEQ ID NO: 2268772 - RNA, 13 nt, Human
gaucaugcauugu

SEQ ID NO: 2268773 - RNA, 12 nt, Human
gaucaugcauug

SEQ ID NO: 2268774 - RNA, 22 nt, Human
gauaagaguagaaacugcaggg

SEQ ID NO: 2268775 - RNA, 23 nt, Human
gauaagguaccuuucacauagag

SEQ ID NO: 2268776 - RNA, 22 nt, Human
gauaaauauuauauuauauaua

SEQ ID NO: 2268777 - RNA, 18 nt, Human
gauaaauaaucggcccac

SEQ ID NO: 2268778 - RNA, 16 nt, Human
gauaaaguuucucaga

SEQ ID NO: 2268779 - RNA, 14 nt, Human
gauaaaguuucuca

SEQ ID NO: 2268780 - RNA, 15 nt, Human
gauaaaguuucucag

SEQ ID NO: 2268781 - RNA, 15 nt, Human
gauaaauauuauauu

SEQ ID NO: 2268782 - RNA, 16 nt, Human
gauaaauaacuuuuuu

SEQ ID NO: 2268783 - RNA, 21 nt, Human
gauaaauaacuuuuuuuuaag

SEQ ID NO: 2268784 - RNA, 22 nt, Human
gauaaauaguuuaugauuccac

SEQ ID NO: 2268785 - RNA, 22 nt, Human
gauaaagaugcaaggaccagga

SEQ ID NO: 2268786 - RNA, 13 nt, Human
gauaaagaugauc

SEQ ID NO: 2268787 - RNA, 20 nt, Human
gaggaagcgugaaggccgag

SEQ ID NO: 2268788 - RNA, 19 nt, Human
gaggaagcccuaagacguc

SEQ ID NO: 2268789 - RNA, 22 nt, Human
gaggaagcagaauaaagcaauu

SEQ ID NO: 2268790 - RNA, 22 nt, Human
gaggaagccagguccacggucu

SEQ ID NO: 2268791 - RNA, 16 nt, Human
gauaaagauuucuuga

SEQ ID NO: 2268792 - RNA, 13 nt, Human
gauaaagauuucu

SEQ ID NO: 2268793 - RNA, 19 nt, Human
gauaaaguugguaaaccuu

SEQ ID NO: 2268794 - RNA, 17 nt, Human
gauaaagccacugaaaa

SEQ ID NO: 2268795 - RNA, 19 nt, Human
gauaaagccacugaaaauu

SEQ ID NO: 2268796 - RNA, 15 nt, Human
gauaaaguaguaaaa

SEQ ID NO: 2268797 - RNA, 17 nt, Human
gauaaaguaguaaaaau

SEQ ID NO: 2268798 - RNA, 13 nt, Human
gaggaaggaaacc

SEQ ID NO: 2268799 - RNA, 19 nt, Human
gaggaaggaaacccagcuc

SEQ ID NO: 2268800 - RNA, 20 nt, Human
gaggaaggaaacccagcucu

SEQ ID NO: 2268801 - RNA, 21 nt, Human
gaggaaggaaacccagcucug

SEQ ID NO: 2268802 - RNA, 19 nt, Human
gauagcacugagcaaagca

SEQ ID NO: 2268803 - RNA, 12 nt, Human
gauagcacuuuc

SEQ ID NO: 2268804 - RNA, 20 nt, Human
gauagcacuuucuacaaugu

SEQ ID NO: 2268805 - RNA, 20 nt, Human
gauagcacagacccugcccu

SEQ ID NO: 2268806 - RNA, 13 nt, Human
gauagcagggcau

SEQ ID NO: 2268807 - RNA, 21 nt, Human
gauagcacagacccugcccug

SEQ ID NO: 2268808 - RNA, 22 nt, Human
gauagcacagacccugcccugu

SEQ ID NO: 2268809 - RNA, 18 nt, Human
gauacaggaaaagcugcu

SEQ ID NO: 2268810 - RNA, 22 nt, Human
gauacacugaaguuaacagaga

SEQ ID NO: 2268811 - RNA, 20 nt, Human
gauacacugaaguuaacaga

SEQ ID NO: 2268812 - RNA, 19 nt, Human
gauacaggaaaagcugcug

SEQ ID NO: 2268813 - RNA, 13 nt, Human
gauagaugugugg

SEQ ID NO: 2268814 - RNA, 21 nt, Human
gauagaugcuggcccagggcc

SEQ ID NO: 2268815 - RNA, 20 nt, Human
gauagaugcuggcccagggc

SEQ ID NO: 2268816 - RNA, 18 nt, Human
gauagaugcuggcccagg

SEQ ID NO: 2268817 - RNA, 17 nt, Human
gauagaugcuggcccag

SEQ ID NO: 2268818 - RNA, 16 nt, Human
gauagaugcuggccca

SEQ ID NO: 2268819 - RNA, 12 nt, Human
gauagaugcugg

SEQ ID NO: 2268820 - RNA, 19 nt, Human
gauacaccgggccuggaga

SEQ ID NO: 2268821 - RNA, 16 nt, Human
gauaaguguauuuuuc

SEQ ID NO: 2268822 - RNA, 21 nt, Human
gauacacccaaaguaucagga

SEQ ID NO: 2268823 - RNA, 23 nt, Human
gauagauaggucagugcaaauac

SEQ ID NO: 2268824 - RNA, 22 nt, Human
gauaauacaccacuacauucug

SEQ ID NO: 2268825 - RNA, 21 nt, Human
gauaauacaccacuacauucu

SEQ ID NO: 2268826 - RNA, 18 nt, Human
gauaauacaccacuacau

SEQ ID NO: 2268827 - RNA, 14 nt, Human
gauaauacaccacu

SEQ ID NO: 2268828 - RNA, 13 nt, Human
gcagguccccaga

SEQ ID NO: 2268829 - RNA, 17 nt, Human
gcaggugaccuucuggg

SEQ ID NO: 2268830 - RNA, 19 nt, Human
gcaggucuugaacuccugg

SEQ ID NO: 2268831 - RNA, 20 nt, Human
gcaggucuugaacuccuggc

SEQ ID NO: 2268832 - RNA, 19 nt, Human
gcagguagccagggggacu

SEQ ID NO: 2268833 - RNA, 21 nt, Human
gcagguagccagggggacuag

SEQ ID NO: 2268834 - RNA, 21 nt, Human
gcaggucaacagcuaugcugg

SEQ ID NO: 2268835 - RNA, 22 nt, Human
gcagguccaggguuugaguuca

SEQ ID NO: 2268836 - RNA, 14 nt, Human
gcagguaccacuga

SEQ ID NO: 2268837 - RNA, 15 nt, Human
gcagguaaacaguuc

SEQ ID NO: 2268838 - RNA, 16 nt, Human
gcagguaaacuccugu

SEQ ID NO: 2268839 - RNA, 14 nt, Human
gcaggguguuggga

SEQ ID NO: 2268840 - RNA, 15 nt, Human
gcagggugggaugga

SEQ ID NO: 2268841 - RNA, 17 nt, Human
gcaggguggugcuggga

SEQ ID NO: 2268842 - RNA, 18 nt, Human
gcaggguggugcugggac

SEQ ID NO: 2268843 - RNA, 19 nt, Human
gcaggguggugcugggacu

SEQ ID NO: 2268844 - RNA, 22 nt, Human
gcagggugcaguaucaugcccu

SEQ ID NO: 2268845 - RNA, 15 nt, Human
gcaggguggugcugg

SEQ ID NO: 2268846 - RNA, 15 nt, Human
gcaguggacaccagg

SEQ ID NO: 2268847 - RNA, 17 nt, Human
gcagugccucuggucug

SEQ ID NO: 2268848 - RNA, 15 nt, Human
gcagugccuuccaua

SEQ ID NO: 2268849 - RNA, 15 nt, Human
gcagugcaggcacag

SEQ ID NO: 2268850 - RNA, 18 nt, Human
gcagugcaggcacaguau

SEQ ID NO: 2268851 - RNA, 23 nt, Human
gcagugccccuagcuuagagccu

SEQ ID NO: 2268852 - RNA, 13 nt, Human
gcagugccucugg

SEQ ID NO: 2268853 - RNA, 16 nt, Human
gcagugcaugcugucc

SEQ ID NO: 2268854 - RNA, 20 nt, Human
gcagugcaagagacucuggc

SEQ ID NO: 2268855 - RNA, 22 nt, Human
gcagugcaagagacucuggccu

SEQ ID NO: 2268856 - RNA, 23 nt, Human
gcagugcaagagacucuggccuc

SEQ ID NO: 2268857 - RNA, 19 nt, Human
gcaggugaccuucugggaa

SEQ ID NO: 2268858 - RNA, 17 nt, Human
gcaggugagcaaccagu

SEQ ID NO: 2268859 - RNA, 15 nt, Human
gcagugcaugcuguc

SEQ ID NO: 2268860 - RNA, 21 nt, Human
gcagggccccaggcauugcca

SEQ ID NO: 2268861 - RNA, 17 nt, Human
gcagggccuagcugcua

SEQ ID NO: 2268862 - RNA, 20 nt, Human
gcagggccuagcugcuacaa

SEQ ID NO: 2268863 - RNA, 19 nt, Human
gcagggcucagcggggaca

SEQ ID NO: 2268864 - RNA, 21 nt, Human
gcagggcucagcggggacagc

SEQ ID NO: 2268865 - RNA, 19 nt, Human
gcagggccaacccuucucc

SEQ ID NO: 2268866 - RNA, 22 nt, Human
gcagggcaucuccugugcaugg

SEQ ID NO: 2268867 - RNA, 14 nt, Human
gcagggccaggacu

SEQ ID NO: 2268868 - RNA, 15 nt, Human
gcagggccaggacug

SEQ ID NO: 2268869 - RNA, 19 nt, Human
gcagggccaggacugagcc

SEQ ID NO: 2268870 - RNA, 21 nt, Human
gcagggcaucuccugugcaug

SEQ ID NO: 2268871 - RNA, 19 nt, Human
gcagggcaucuccugugca

SEQ ID NO: 2268872 - RNA, 15 nt, Human
gcagggcaucuccug

SEQ ID NO: 2268873 - RNA, 14 nt, Human
gcagggcaucuccu

SEQ ID NO: 2268874 - RNA, 13 nt, Human
gcagggcagucau

SEQ ID NO: 2268875 - RNA, 15 nt, Human
gcaggcagccaggcc

SEQ ID NO: 2268876 - RNA, 16 nt, Human
gcaggcagccaggcca

SEQ ID NO: 2268877 - RNA, 13 nt, Human
gcaggggccugga

SEQ ID NO: 2268878 - RNA, 14 nt, Human
gcaggggccuggag

SEQ ID NO: 2268879 - RNA, 21 nt, Human
gcagggccuagcugcuacaaa

SEQ ID NO: 2268880 - RNA, 24 nt, Human
gcaggggauggcguggucaagcac

SEQ ID NO: 2268881 - RNA, 14 nt, Human
gcagggcucagcgg

SEQ ID NO: 2268882 - RNA, 22 nt, Human
gcagggcucagcggggacagcu

SEQ ID NO: 2268883 - RNA, 17 nt, Human
gcagggucucacucugu

SEQ ID NO: 2268884 - RNA, 16 nt, Human
gcaggggccuggagau

SEQ ID NO: 2268885 - RNA, 20 nt, Human
gcaggggccuggagauccuc

SEQ ID NO: 2268886 - RNA, 19 nt, Human
gcaggggcguggagggcgu

SEQ ID NO: 2268887 - RNA, 17 nt, Human
gcaggggcuacaagagg

SEQ ID NO: 2268888 - RNA, 19 nt, Human
gcaggggcuacaagaggga

SEQ ID NO: 2268889 - RNA, 12 nt, Human
gcaggggcucug

SEQ ID NO: 2268890 - RNA, 18 nt, Human
gcagggucucacucuguc

SEQ ID NO: 2268891 - RNA, 14 nt, Human
gcagggucugggca

SEQ ID NO: 2268892 - RNA, 17 nt, Human
gcagggucugggcagga

SEQ ID NO: 2268893 - RNA, 20 nt, Human
gcagggucugggcaggacuc

SEQ ID NO: 2268894 - RNA, 15 nt, Human
gcagggucuuuucau

SEQ ID NO: 2268895 - RNA, 16 nt, Human
gcagggucuuuucauc

SEQ ID NO: 2268896 - RNA, 21 nt, Human
gcagggucuuuucaucuggga

SEQ ID NO: 2268897 - RNA, 23 nt, Human
gcagggucuuuucaucugggaaa

SEQ ID NO: 2268898 - RNA, 14 nt, Human
gcaucaaaagacaa

SEQ ID NO: 2268899 - RNA, 14 nt, Human
gcaucaccucaggc

SEQ ID NO: 2268900 - RNA, 17 nt, Human
gcaucaccucaggccag

SEQ ID NO: 2268901 - RNA, 15 nt, Human
gcaucaccucaggcc

SEQ ID NO: 2268902 - RNA, 13 nt, Human
gcaucaaaagaca

SEQ ID NO: 2268903 - RNA, 14 nt, Human
gcauauuuguauag

SEQ ID NO: 2268904 - RNA, 18 nt, Human
gcauauuuguauaguugc

SEQ ID NO: 2268905 - RNA, 23 nt, Human
gcauauuuauagcaauccauguu

SEQ ID NO: 2268906 - RNA, 19 nt, Human
gcauauuuauaaaaauaaa

SEQ ID NO: 2268907 - RNA, 12 nt, Human
gcauaucugccu

SEQ ID NO: 2268908 - RNA, 14 nt, Human
gcauaucugccuuu

SEQ ID NO: 2268909 - RNA, 15 nt, Human
gcauaucugccuuua

SEQ ID NO: 2268910 - RNA, 16 nt, Human
gcauaucugccuuuau

SEQ ID NO: 2268911 - RNA, 18 nt, Human
gcauaucugccuuuauug

SEQ ID NO: 2268912 - RNA, 21 nt, Human
gcauaucugccuuuauugugu

SEQ ID NO: 2268913 - RNA, 22 nt, Human
gcauaucugccuuuauuguguu

SEQ ID NO: 2268914 - RNA, 14 nt, Human
gcauagaaggcagg

SEQ ID NO: 2268915 - RNA, 13 nt, Human
gcauacuuuuuaa

SEQ ID NO: 2268916 - RNA, 15 nt, Human
gcauagaaggcaggu

SEQ ID NO: 2268917 - RNA, 16 nt, Human
gcauagaggcuucucc

SEQ ID NO: 2268918 - RNA, 22 nt, Human
gcauagaggcuucuccgccagc

SEQ ID NO: 2268919 - RNA, 13 nt, Human
gcaguucaccugc

SEQ ID NO: 2268920 - RNA, 22 nt, Human
gcauacuucaaaaguauuuucc

SEQ ID NO: 2268921 - RNA, 15 nt, Human
gcaguugaaaagacu

SEQ ID NO: 2268922 - RNA, 17 nt, Human
gcauagguuuaauaauu

SEQ ID NO: 2268923 - RNA, 18 nt, Human
gcauaguucccauguuaa

SEQ ID NO: 2268924 - RNA, 23 nt, Human
gcauaguauuccauugugugagu

SEQ ID NO: 2268925 - RNA, 22 nt, Human
gcauaguauuccauugugugag

SEQ ID NO: 2268926 - RNA, 21 nt, Human
gcauaguauuccauuguguga

SEQ ID NO: 2268927 - RNA, 20 nt, Human
gcauaguauuccauugugug

SEQ ID NO: 2268928 - RNA, 20 nt, Human
gcauaguaccaaucauuuua

SEQ ID NO: 2268929 - RNA, 16 nt, Human
gcauagaugcagguga

SEQ ID NO: 2268930 - RNA, 21 nt, Human
gcauaggugaucucauuuaau

SEQ ID NO: 2268931 - RNA, 22 nt, Human
gcauagagguaccagcaauaug

SEQ ID NO: 2268932 - RNA, 19 nt, Human
gcauagaugcaggugagcc

SEQ ID NO: 2268933 - RNA, 15 nt, Human
gcauauccugagcca

SEQ ID NO: 2268934 - RNA, 18 nt, Human
gcauauccaccaccuccc

SEQ ID NO: 2268935 - RNA, 16 nt, Human
gcauauccugagccau

SEQ ID NO: 2268936 - RNA, 21 nt, Human
gcauaucagucucugagggcu

SEQ ID NO: 2268937 - RNA, 22 nt, Human
gcauaucagucucugagggcuu

SEQ ID NO: 2268938 - RNA, 14 nt, Human
gcauaucacuugau

SEQ ID NO: 2268939 - RNA, 16 nt, Human
gcagugucuuccauaa

SEQ ID NO: 2268940 - RNA, 15 nt, Human
gcagugucuuccaua

SEQ ID NO: 2268941 - RNA, 14 nt, Human
gcagugucuuccau

SEQ ID NO: 2268942 - RNA, 11 nt, Human
gcagugucuuc

SEQ ID NO: 2268943 - RNA, 12 nt, Human
gcagugugaaaa

SEQ ID NO: 2268944 - RNA, 15 nt, Human
gcagugugaggccag

SEQ ID NO: 2268945 - RNA, 18 nt, Human
gcagugguguggagaagc

SEQ ID NO: 2268946 - RNA, 24 nt, Human
gcagugguuuuggcaaacgcuaaa

SEQ ID NO: 2268947 - RNA, 18 nt, Human
gcagugucaucagaagau

SEQ ID NO: 2268948 - RNA, 18 nt, Human
gcaguguagcccacacuu

SEQ ID NO: 2268949 - RNA, 23 nt, Human
gcaguggugguuuucuguucuuu

SEQ ID NO: 2268950 - RNA, 22 nt, Human
gcaguggugguuuucuguucuu

SEQ ID NO: 2268951 - RNA, 13 nt, Human
gcagugggagcug

SEQ ID NO: 2268952 - RNA, 12 nt, Human
gcagugggagcu

SEQ ID NO: 2268953 - RNA, 14 nt, Human
gcagugggagcugc

SEQ ID NO: 2268954 - RNA, 15 nt, Human
gcagugggagcugcc

SEQ ID NO: 2268955 - RNA, 17 nt, Human
gcaguuauuaacacuaa

SEQ ID NO: 2268956 - RNA, 20 nt, Human
gcagugucuuccauaaugua

SEQ ID NO: 2268957 - RNA, 15 nt, Human
gcaguucugaagaag

SEQ ID NO: 2268958 - RNA, 19 nt, Human
gcaguucugggugcucccu

SEQ ID NO: 2268959 - RNA, 17 nt, Human
gcaguucugaagaagau

SEQ ID NO: 2268960 - RNA, 13 nt, Human
gcauagaaguaaa

SEQ ID NO: 2268961 - RNA, 16 nt, Human
gcaucaaaagacaauu

SEQ ID NO: 2268962 - RNA, 22 nt, Human
gcaucuugguccaggaaaugug

SEQ ID NO: 2268963 - RNA, 22 nt, Human
gcaucuuggggggguggccgcu

SEQ ID NO: 2268964 - RNA, 18 nt, Human
gcaucuuugccuugggcu

SEQ ID NO: 2268965 - RNA, 15 nt, Human
gcaucuuugccuugg

SEQ ID NO: 2268966 - RNA, 13 nt, Human
gcaucuuugccuu

SEQ ID NO: 2268967 - RNA, 14 nt, Human
gcaucuucuccauc

SEQ ID NO: 2268968 - RNA, 17 nt, Human
gcaucuuccagaagugu

SEQ ID NO: 2268969 - RNA, 13 nt, Human
gcaucuucuccau

SEQ ID NO: 2268970 - RNA, 19 nt, Human
gcaucuucuggagucucca

SEQ ID NO: 2268971 - RNA, 20 nt, Human
gcaucuucuggagucuccag

SEQ ID NO: 2268972 - RNA, 23 nt, Human
gcaucuucuggagucuccagugg

SEQ ID NO: 2268973 - RNA, 23 nt, Human
gcaucuuacugaagguaaaauug

SEQ ID NO: 2268974 - RNA, 16 nt, Human
gcaucuuacugaaggu

SEQ ID NO: 2268975 - RNA, 13 nt, Human
gcaucuuccagaa

SEQ ID NO: 2268976 - RNA, 21 nt, Human
gcaucuuccagaagugugauu

SEQ ID NO: 2268977 - RNA, 13 nt, Human
gcaugaagguuuc

SEQ ID NO: 2268978 - RNA, 20 nt, Human
gcaugaacauguacuguucu

SEQ ID NO: 2268979 - RNA, 18 nt, Human
gcaugaaguaauaugcac

SEQ ID NO: 2268980 - RNA, 23 nt, Human
gcaucuuugccuugggcugcucc

SEQ ID NO: 2268981 - RNA, 22 nt, Human
gcaucuuugccuugggcugcuc

SEQ ID NO: 2268982 - RNA, 14 nt, Human
gcaucugaccagca

SEQ ID NO: 2268983 - RNA, 20 nt, Human
gcaucugaccagcagcgccu

SEQ ID NO: 2268984 - RNA, 18 nt, Human
gcaucugaccagcagcgc

SEQ ID NO: 2268985 - RNA, 17 nt, Human
gcaucugaccagcagcg

SEQ ID NO: 2268986 - RNA, 15 nt, Human
gcaucugaccagcag

SEQ ID NO: 2268987 - RNA, 13 nt, Human
gcaucuguucugg

SEQ ID NO: 2268988 - RNA, 12 nt, Human
gcaucugcaccc

SEQ ID NO: 2268989 - RNA, 15 nt, Human
gcaucuuacugaagg

SEQ ID NO: 2268990 - RNA, 17 nt, Human
gcaucugacucacaaga

SEQ ID NO: 2268991 - RNA, 19 nt, Human
gcaucugacucacaagaag

SEQ ID NO: 2268992 - RNA, 21 nt, Human
gcaucucuugaggccaggagu

SEQ ID NO: 2268993 - RNA, 20 nt, Human
gcaucucuugaggccaggag

SEQ ID NO: 2268994 - RNA, 18 nt, Human
gcaucucuugaggccagg

SEQ ID NO: 2268995 - RNA, 17 nt, Human
gcaucucuugaggccag

SEQ ID NO: 2268996 - RNA, 16 nt, Human
gcaucugaaaauugau

SEQ ID NO: 2268997 - RNA, 16 nt, Human
gcaucucuugaggcca

SEQ ID NO: 2268998 - RNA, 14 nt, Human
gcaucucuugaggc

SEQ ID NO: 2268999 - RNA, 12 nt, Human
gcaucagcugcu

SEQ ID NO: 2269000 - RNA, 22 nt, Human
gcaucaccuuaggcagggaagu

SEQ ID NO: 2269001 - RNA, 18 nt, Human
gcaucaccuuaggcaggg

SEQ ID NO: 2269002 - RNA, 15 nt, Human
gcaucaccuccacca

SEQ ID NO: 2269003 - RNA, 20 nt, Human
gcaucaccuuaggcagggaa

SEQ ID NO: 2269004 - RNA, 23 nt, Human
gcaugauagacacauaugagggg

SEQ ID NO: 2269005 - RNA, 20 nt, Human
gcaugauguuaaccagaaua

SEQ ID NO: 2269006 - RNA, 22 nt, Human
gcaugaccugugaccagcacug

SEQ ID NO: 2269007 - RNA, 17 nt, Human
gcaugaccugugaccag

SEQ ID NO: 2269008 - RNA, 21 nt, Human
gcaugagggaucacagggccc

SEQ ID NO: 2269009 - RNA, 20 nt, Human
gcaugagggaucacagggcc

SEQ ID NO: 2269010 - RNA, 19 nt, Human
gcaugagggaucacagggc

SEQ ID NO: 2269011 - RNA, 22 nt, Human
gcaugaggaacuagccaccaac

SEQ ID NO: 2269012 - RNA, 21 nt, Human
gcaugaggaacuagccaccaa

SEQ ID NO: 2269013 - RNA, 21 nt, Human
gcaugcucucugcagccagcc

SEQ ID NO: 2269014 - RNA, 18 nt, Human
gcaugcucucugcagcca

SEQ ID NO: 2269015 - RNA, 17 nt, Human
gcaugcucucugcagcc

SEQ ID NO: 2269016 - RNA, 15 nt, Human
gcaugcucucugcag

SEQ ID NO: 2269017 - RNA, 14 nt, Human
gcaugcucucugca

SEQ ID NO: 2269018 - RNA, 13 nt, Human
gcaugcucucugc

SEQ ID NO: 2269019 - RNA, 15 nt, Human
gcaugcggcccagga

SEQ ID NO: 2269020 - RNA, 13 nt, Human
gcaugcuggggca

SEQ ID NO: 2269021 - RNA, 23 nt, Human
gcaugcucucugcagccagccca

SEQ ID NO: 2269022 - RNA, 22 nt, Human
gcaugcucucugcagccagccc

SEQ ID NO: 2269023 - RNA, 15 nt, Human
gcaugcuggggcaag

SEQ ID NO: 2269024 - RNA, 18 nt, Human
gcauggagauagccccac

SEQ ID NO: 2269025 - RNA, 18 nt, Human
gcaugcgggcuuccuccu

SEQ ID NO: 2269026 - RNA, 15 nt, Human
gcaugauuuuguaac

SEQ ID NO: 2269027 - RNA, 15 nt, Human
gcaugcggcccagcc

SEQ ID NO: 2269028 - RNA, 16 nt, Human
gcaugcggcccagccc

SEQ ID NO: 2269029 - RNA, 17 nt, Human
gcaugcggcccagcccg

SEQ ID NO: 2269030 - RNA, 18 nt, Human
gcaugcggcccagcccgg

SEQ ID NO: 2269031 - RNA, 19 nt, Human
gcaugcggcccagcccggc

SEQ ID NO: 2269032 - RNA, 20 nt, Human
gcaugcggcccagcccggcu

SEQ ID NO: 2269033 - RNA, 24 nt, Human
gcauggaguguguauuguucccag

SEQ ID NO: 2269034 - RNA, 23 nt, Human
gcauggaguguguauuguuccca

SEQ ID NO: 2269035 - RNA, 22 nt, Human
gcauggaguguguauuguuccc

SEQ ID NO: 2269036 - RNA, 20 nt, Human
gcauggauauaguuuuacuu

SEQ ID NO: 2269037 - RNA, 21 nt, Human
gcauggauguuuuagccauug

SEQ ID NO: 2269038 - RNA, 20 nt, Human
gcauggaguguguauuguuc

SEQ ID NO: 2269039 - RNA, 19 nt, Human
gcauggaguguguauuguu

SEQ ID NO: 2269040 - RNA, 18 nt, Human
gcauggaguguguauugu

SEQ ID NO: 2269041 - RNA, 17 nt, Human
gcauggaguguguauug

SEQ ID NO: 2269042 - RNA, 16 nt, Human
gcaugcugcuggacag

SEQ ID NO: 2269043 - RNA, 12 nt, Human
gcauggagcugg

SEQ ID NO: 2269044 - RNA, 15 nt, Human
gcauggagcuggccg

SEQ ID NO: 2269045 - RNA, 15 nt, Human
gcauggcacuugcau

SEQ ID NO: 2269046 - RNA, 20 nt, Human
gcauggcacuugcaucugug

SEQ ID NO: 2269047 - RNA, 20 nt, Human
gcauggcaaggacugcaggg

SEQ ID NO: 2269048 - RNA, 15 nt, Human
gcauguucucugagg

SEQ ID NO: 2269049 - RNA, 21 nt, Human
gcauguucucugaggacacua

SEQ ID NO: 2269050 - RNA, 22 nt, Human
gcauguucucugaggacacuaa

SEQ ID NO: 2269051 - RNA, 13 nt, Human
gcauuauauuuau

SEQ ID NO: 2269052 - RNA, 14 nt, Human
gccaaaaaaagaca

SEQ ID NO: 2269053 - RNA, 21 nt, Human
gcauuuuugugaaaugaaaac

SEQ ID NO: 2269054 - RNA, 18 nt, Human
gcauuuuugugaaaugaa

SEQ ID NO: 2269055 - RNA, 17 nt, Human
gcauuuuugcaggagca

SEQ ID NO: 2269056 - RNA, 21 nt, Human
gcauuuuugauuuaugcaugg

SEQ ID NO: 2269057 - RNA, 16 nt, Human
gcauuuuugcaggagc

SEQ ID NO: 2269058 - RNA, 20 nt, Human
gcauuuuugauuuaugcaug

SEQ ID NO: 2269059 - RNA, 18 nt, Human
gcauuuuguuugguauug

SEQ ID NO: 2269060 - RNA, 21 nt, Human
gcauuuuguuugguauuguau

SEQ ID NO: 2269061 - RNA, 23 nt, Human
gcauuuuguuugguauuguauuu

SEQ ID NO: 2269062 - RNA, 18 nt, Human
gcauuuguuugaacugau

SEQ ID NO: 2269063 - RNA, 16 nt, Human
gccaaaaaaagacagg

SEQ ID NO: 2269064 - RNA, 15 nt, Human
gccaaacccugucug

SEQ ID NO: 2269065 - RNA, 22 nt, Human
gccaaacccaugaggcaauguc

SEQ ID NO: 2269066 - RNA, 13 nt, Human
gccaaaccucugu

SEQ ID NO: 2269067 - RNA, 18 nt, Human
gccaaacccuugucagug

SEQ ID NO: 2269068 - RNA, 14 nt, Human
gccaaacucaccug

SEQ ID NO: 2269069 - RNA, 16 nt, Human
gccaaacucaccugcc

SEQ ID NO: 2269070 - RNA, 19 nt, Human
gccaaagccuccuccagcc

SEQ ID NO: 2269071 - RNA, 16 nt, Human
gccaaagccuccucca

SEQ ID NO: 2269072 - RNA, 13 nt, Human
gccaaagccaaag

SEQ ID NO: 2269073 - RNA, 20 nt, Human
gccaaagccaaagcuaggcc

SEQ ID NO: 2269074 - RNA, 16 nt, Human
gccaaagcuaggccug

SEQ ID NO: 2269075 - RNA, 22 nt, Human
gccaaagcuaggccuggccaga

SEQ ID NO: 2269076 - RNA, 16 nt, Human
gccaaagcuagggugg

SEQ ID NO: 2269077 - RNA, 22 nt, Human
gccaaaccucuguucaguguaa

SEQ ID NO: 2269078 - RNA, 19 nt, Human
gccaaaccucuguucagug

SEQ ID NO: 2269079 - RNA, 17 nt, Human
gccaaaccucuguucag

SEQ ID NO: 2269080 - RNA, 16 nt, Human
gccaaaccucuguuca

SEQ ID NO: 2269081 - RNA, 15 nt, Human
gccaaaccucuguuc

SEQ ID NO: 2269082 - RNA, 14 nt, Human
gccaaaccucuguu

SEQ ID NO: 2269083 - RNA, 20 nt, Human
gccaaagcuaggguggcccu

SEQ ID NO: 2269084 - RNA, 11 nt, Human
gccaaauuauu

SEQ ID NO: 2269085 - RNA, 15 nt, Human
gccaaauuauuugug

SEQ ID NO: 2269086 - RNA, 12 nt, Human
gccaaaggaagc

SEQ ID NO: 2269087 - RNA, 17 nt, Human
gcauuugcugaauacag

SEQ ID NO: 2269088 - RNA, 13 nt, Human
gcauuugugaggc

SEQ ID NO: 2269089 - RNA, 14 nt, Human
gcauuugcugaaua

SEQ ID NO: 2269090 - RNA, 16 nt, Human
gcauuuguuugaacug

SEQ ID NO: 2269091 - RNA, 13 nt, Human
gcauuugcugaau

SEQ ID NO: 2269092 - RNA, 21 nt, Human
gcauuugaggucuguucuuuc

SEQ ID NO: 2269093 - RNA, 23 nt, Human
gcauuugcucuuucaucucugcu

SEQ ID NO: 2269094 - RNA, 14 nt, Human
gcauuugaguuuau

SEQ ID NO: 2269095 - RNA, 19 nt, Human
gcauugaacacaaacugua

SEQ ID NO: 2269096 - RNA, 18 nt, Human
gcauugaacacaaacugu

SEQ ID NO: 2269097 - RNA, 16 nt, Human
gcauugaacacaaacu

SEQ ID NO: 2269098 - RNA, 12 nt, Human
gcauugaacaca

SEQ ID NO: 2269099 - RNA, 20 nt, Human
gcauucuuuuaaaagacaag

SEQ ID NO: 2269100 - RNA, 21 nt, Human
gcauucuuuuaaaagacaaga

SEQ ID NO: 2269101 - RNA, 17 nt, Human
gcauucuugguuggcug

SEQ ID NO: 2269102 - RNA, 13 nt, Human
gcauucuuucugu

SEQ ID NO: 2269103 - RNA, 18 nt, Human
gcauucuuucuguauuga

SEQ ID NO: 2269104 - RNA, 16 nt, Human
gcauucuuuuaaaaga

SEQ ID NO: 2269105 - RNA, 20 nt, Human
gcauucacccagacagcucc

SEQ ID NO: 2269106 - RNA, 19 nt, Human
gcauucacccagacagcuc

SEQ ID NO: 2269107 - RNA, 15 nt, Human
gcauucacccagaca

SEQ ID NO: 2269108 - RNA, 12 nt, Human
gcauucacccag

SEQ ID NO: 2269109 - RNA, 13 nt, Human
gcauucagagagc

SEQ ID NO: 2269110 - RNA, 16 nt, Human
gcauucagagagcagc

SEQ ID NO: 2269111 - RNA, 22 nt, Human
gcauucaauuuauucaagaaaa

SEQ ID NO: 2269112 - RNA, 22 nt, Human
gcauucugccgugugcccucgg

SEQ ID NO: 2269113 - RNA, 20 nt, Human
gcauucugccgugugcccuc

SEQ ID NO: 2269114 - RNA, 21 nt, Human
gcauucuugguuggcuggccu

SEQ ID NO: 2269115 - RNA, 15 nt, Human
gcauuauauaccauu

SEQ ID NO: 2269116 - RNA, 19 nt, Human
gcauuauauaccauuuauc

SEQ ID NO: 2269117 - RNA, 18 nt, Human
gcauuauauuuguaaauu

SEQ ID NO: 2269118 - RNA, 17 nt, Human
gcauuaucuagauacug

SEQ ID NO: 2269119 - RNA, 14 nt, Human
gcauuauugcauua

SEQ ID NO: 2269120 - RNA, 15 nt, Human
gcauuauugcauuau

SEQ ID NO: 2269121 - RNA, 14 nt, Human
gcaggaggauugcu

SEQ ID NO: 2269122 - RNA, 19 nt, Human
gcaggacaacgaggaagcc

SEQ ID NO: 2269123 - RNA, 18 nt, Human
gcaggacaacgaggaagc

SEQ ID NO: 2269124 - RNA, 23 nt, Human
gcaggaggaucacuugaguccag

SEQ ID NO: 2269125 - RNA, 20 nt, Human
gcaggaggaucacuugaguc

SEQ ID NO: 2269126 - RNA, 17 nt, Human
gcaggacaacgaggaag

SEQ ID NO: 2269127 - RNA, 17 nt, Human
gcaggaauguguggcag

SEQ ID NO: 2269128 - RNA, 20 nt, Human
gcaggaaggcugagaggaga

SEQ ID NO: 2269129 - RNA, 23 nt, Human
gcaggaaggagagccugcugcau

SEQ ID NO: 2269130 - RNA, 17 nt, Human
gcaggaaggagagccug

SEQ ID NO: 2269131 - RNA, 16 nt, Human
gcaggaaggagagccu

SEQ ID NO: 2269132 - RNA, 23 nt, Human
gcaggaaaugaaaaugucuugug

SEQ ID NO: 2269133 - RNA, 21 nt, Human
gcaggaaaugaaaaugucuug

SEQ ID NO: 2269134 - RNA, 23 nt, Human
gcaggaaaaggugauauccauuc

SEQ ID NO: 2269135 - RNA, 21 nt, Human
gcagcuuuaaccauuaaaacu

SEQ ID NO: 2269136 - RNA, 22 nt, Human
gcagcuuuaaccauuaaaacug

SEQ ID NO: 2269137 - RNA, 15 nt, Human
gcaggcacauggagg

SEQ ID NO: 2269138 - RNA, 15 nt, Human
gcaggcacagcacag

SEQ ID NO: 2269139 - RNA, 18 nt, Human
gcaggcacagcacaggga

SEQ ID NO: 2269140 - RNA, 20 nt, Human
gcaggcaccuuaguggcuuu

SEQ ID NO: 2269141 - RNA, 15 nt, Human
gcaggcaccuuagug

SEQ ID NO: 2269142 - RNA, 20 nt, Human
gcaggcacucaaugcagcca

SEQ ID NO: 2269143 - RNA, 20 nt, Human
gcaggcagacacggaucuga

SEQ ID NO: 2269144 - RNA, 23 nt, Human
gcaggcagacacggaucugagaa

SEQ ID NO: 2269145 - RNA, 10 nt, Human
gcaggcagac

SEQ ID NO: 2269146 - RNA, 11 nt, Human
gcaggcagaca

SEQ ID NO: 2269147 - RNA, 12 nt, Human
gcaggcagacac

SEQ ID NO: 2269148 - RNA, 13 nt, Human
gcaggcagacacg

SEQ ID NO: 2269149 - RNA, 23 nt, Human
gcaggaggauugcuugagcccag

SEQ ID NO: 2269150 - RNA, 14 nt, Human
gcaggaggccaggc

SEQ ID NO: 2269151 - RNA, 16 nt, Human
gcaggaggccaggccg

SEQ ID NO: 2269152 - RNA, 15 nt, Human
gcaggaggccaggcc

SEQ ID NO: 2269153 - RNA, 22 nt, Human
gcaggaggccccuggcccagcg

SEQ ID NO: 2269154 - RNA, 18 nt, Human
gcaggaggccccuggccc

SEQ ID NO: 2269155 - RNA, 19 nt, Human
gcaggaggccccuggccca

SEQ ID NO: 2269156 - RNA, 17 nt, Human
gcaggaggccaggccgg

SEQ ID NO: 2269157 - RNA, 14 nt, Human
gcaggaggccccug

SEQ ID NO: 2269158 - RNA, 16 nt, Human
gcaggaggccccuggc

SEQ ID NO: 2269159 - RNA, 12 nt, Human
gcaggcagccag

SEQ ID NO: 2269160 - RNA, 13 nt, Human
gcaggcagccagg

SEQ ID NO: 2269161 - RNA, 14 nt, Human
gcaggcagccaggc

SEQ ID NO: 2269162 - RNA, 21 nt, Human
gcagcggggcgaagcccaggc

SEQ ID NO: 2269163 - RNA, 14 nt, Human
gcagcuaguuuucu

SEQ ID NO: 2269164 - RNA, 17 nt, Human
gcagcucaaaggcacag

SEQ ID NO: 2269165 - RNA, 14 nt, Human
gcagcucaaaggca

SEQ ID NO: 2269166 - RNA, 17 nt, Human
gcagcgcggggagcccg

SEQ ID NO: 2269167 - RNA, 14 nt, Human
gcagcucaccucuc

SEQ ID NO: 2269168 - RNA, 17 nt, Human
gcagccuuugccucccc

SEQ ID NO: 2269169 - RNA, 15 nt, Human
gcagccuuuaaugca

SEQ ID NO: 2269170 - RNA, 18 nt, Human
gcagccuuugccuccccg

SEQ ID NO: 2269171 - RNA, 15 nt, Human
gcagcgccuuuccca

SEQ ID NO: 2269172 - RNA, 13 nt, Human
gcagcgaccaccc

SEQ ID NO: 2269173 - RNA, 13 nt, Human
gcagcgccuuucc

SEQ ID NO: 2269174 - RNA, 15 nt, Human
gcagccuuggcaaac

SEQ ID NO: 2269175 - RNA, 15 nt, Human
gcagcucaaaggcac

SEQ ID NO: 2269176 - RNA, 23 nt, Human
gcagcucaagcagcgaccgcccc

SEQ ID NO: 2269177 - RNA, 21 nt, Human
gcagcuugcguuagaaugagg

SEQ ID NO: 2269178 - RNA, 14 nt, Human
gcagcuugccccgg

SEQ ID NO: 2269179 - RNA, 15 nt, Human
gcagcucaccucucc

SEQ ID NO: 2269180 - RNA, 17 nt, Human
gcagcuuuaaacucagg

SEQ ID NO: 2269181 - RNA, 19 nt, Human
gcagcuuuaaacucaggga

SEQ ID NO: 2269182 - RNA, 20 nt, Human
gcagcuuuaaacucagggac

SEQ ID NO: 2269183 - RNA, 21 nt, Human
gcagcuuuaaacucagggaca

SEQ ID NO: 2269184 - RNA, 22 nt, Human
gcagcuuuaaacucagggacag

SEQ ID NO: 2269185 - RNA, 18 nt, Human
gcagcuuuaaccauuaaa

SEQ ID NO: 2269186 - RNA, 22 nt, Human
gcagccuguggcaucuuugccu

SEQ ID NO: 2269187 - RNA, 16 nt, Human
gcagccuguggcaucu

SEQ ID NO: 2269188 - RNA, 14 nt, Human
gcagccuguggcau

SEQ ID NO: 2269189 - RNA, 19 nt, Human
gcagccuguccugggcugg

SEQ ID NO: 2269190 - RNA, 23 nt, Human
gcagccuguccugggcugguggc

SEQ ID NO: 2269191 - RNA, 17 nt, Human
gcagccuggggcuggcc

SEQ ID NO: 2269192 - RNA, 18 nt, Human
gcagccuggguggcuaug

SEQ ID NO: 2269193 - RNA, 14 nt, Human
gcagccuggggcug

SEQ ID NO: 2269194 - RNA, 10 nt, Human
gcagccuggg

SEQ ID NO: 2269195 - RNA, 18 nt, Human
gcagcccuccucaccccg

SEQ ID NO: 2269196 - RNA, 15 nt, Human
gcagcccuccucacc

SEQ ID NO: 2269197 - RNA, 13 nt, Human
gcagcccuccuca

SEQ ID NO: 2269198 - RNA, 13 nt, Human
gcagcccugcuuu

SEQ ID NO: 2269199 - RNA, 14 nt, Human
gcagcccugcagag

SEQ ID NO: 2269200 - RNA, 15 nt, Human
gcagcccugcagagg

SEQ ID NO: 2269201 - RNA, 16 nt, Human
gcagcccugcagaggg

SEQ ID NO: 2269202 - RNA, 17 nt, Human
gcagcccugcagagggc

SEQ ID NO: 2269203 - RNA, 15 nt, Human
gcagauacugucucu

SEQ ID NO: 2269204 - RNA, 18 nt, Human
gcagauaccucacccugc

SEQ ID NO: 2269205 - RNA, 22 nt, Human
gcagauacaggaaaagcugcug

SEQ ID NO: 2269206 - RNA, 19 nt, Human
gcagauaaucagccucuua

SEQ ID NO: 2269207 - RNA, 18 nt, Human
gcagauaaucagccucuu

SEQ ID NO: 2269208 - RNA, 17 nt, Human
gcagauaaucagccucu

SEQ ID NO: 2269209 - RNA, 16 nt, Human
gcagauaaucagccuc

SEQ ID NO: 2269210 - RNA, 20 nt, Human
gcagaguuguaaauauauaa

SEQ ID NO: 2269211 - RNA, 21 nt, Human
gcagaguuguaaauauauaaa

SEQ ID NO: 2269212 - RNA, 23 nt, Human
gcagaguuguaaauauauaaaua

SEQ ID NO: 2269213 - RNA, 18 nt, Human
gcagaguuuccaaaacca

SEQ ID NO: 2269214 - RNA, 20 nt, Human
gcagaguuuguguguugucu

SEQ ID NO: 2269215 - RNA, 24 nt, Human
gcagaguuuguguguugucuugaa

SEQ ID NO: 2269216 - RNA, 23 nt, Human
gcagauuuagugaaagcuagaga

SEQ ID NO: 2269217 - RNA, 20 nt, Human
gcagauuuagugaaagcuag

SEQ ID NO: 2269218 - RNA, 19 nt, Human
gcagauuggagaaacccuu

SEQ ID NO: 2269219 - RNA, 20 nt, Human
gcagauuguguaacaauuuu

SEQ ID NO: 2269220 - RNA, 14 nt, Human
gcagauuggagaaa

SEQ ID NO: 2269221 - RNA, 16 nt, Human
gcagauuugggcugga

SEQ ID NO: 2269222 - RNA, 20 nt, Human
gcagauuuuaggaaaugaau

SEQ ID NO: 2269223 - RNA, 21 nt, Human
gcagauuuucagcaaacucuu

SEQ ID NO: 2269224 - RNA, 19 nt, Human
gcagauucauuuuucuuuc

SEQ ID NO: 2269225 - RNA, 17 nt, Human
gcagauugaaaaggaca

SEQ ID NO: 2269226 - RNA, 20 nt, Human
gcagauucauuuuucuuucu

SEQ ID NO: 2269227 - RNA, 19 nt, Human
gcagacaugugcacuugaa

SEQ ID NO: 2269228 - RNA, 12 nt, Human
gcagacauuguc

SEQ ID NO: 2269229 - RNA, 15 nt, Human
gcagacauugucagc

SEQ ID NO: 2269230 - RNA, 17 nt, Human
gcagacaguuaagagaa

SEQ ID NO: 2269231 - RNA, 13 nt, Human
gcagaccaccccg

SEQ ID NO: 2269232 - RNA, 17 nt, Human
gcagaccaccccgccug

SEQ ID NO: 2269233 - RNA, 21 nt, Human
gcagaccaccccgccugcccu

SEQ ID NO: 2269234 - RNA, 20 nt, Human
gcagaccacgcccguccugc

SEQ ID NO: 2269235 - RNA, 23 nt, Human
gcagaccacgcccguccugccug

SEQ ID NO: 2269236 - RNA, 21 nt, Human
gcagaguugaagacagagcua

SEQ ID NO: 2269237 - RNA, 13 nt, Human
gcagaccucccca

SEQ ID NO: 2269238 - RNA, 15 nt, Human
gcagaccuccccagc

SEQ ID NO: 2269239 - RNA, 16 nt, Human
gcagaccuccccagcc

SEQ ID NO: 2269240 - RNA, 17 nt, Human
gcagaccuccccagccc

SEQ ID NO: 2269241 - RNA, 19 nt, Human
gcagaccuccccagccccu

SEQ ID NO: 2269242 - RNA, 18 nt, Human
gcagauaaacaguaguga

SEQ ID NO: 2269243 - RNA, 20 nt, Human
gcagaguugaagacagagcu

SEQ ID NO: 2269244 - RNA, 13 nt, Human
gcagaguuguaaa

SEQ ID NO: 2269245 - RNA, 14 nt, Human
gcagaguuguaaau

SEQ ID NO: 2269246 - RNA, 16 nt, Human
gcagaguuguaaauau

SEQ ID NO: 2269247 - RNA, 17 nt, Human
gcagaguuguaaauaua

SEQ ID NO: 2269248 - RNA, 14 nt, Human
gcagcacagagagg

SEQ ID NO: 2269249 - RNA, 20 nt, Human
gcagccccgugggguuccuc

SEQ ID NO: 2269250 - RNA, 20 nt, Human
gcagccccuguucuggcaga

SEQ ID NO: 2269251 - RNA, 21 nt, Human
gcagccccuguucuggcagag

SEQ ID NO: 2269252 - RNA, 21 nt, Human
gcagcccguguggccccuuca

SEQ ID NO: 2269253 - RNA, 22 nt, Human
gcagcccuaaggaucucucagg

SEQ ID NO: 2269254 - RNA, 23 nt, Human
gcagcccuaaggaucucucagga

SEQ ID NO: 2269255 - RNA, 24 nt, Human
gcagcccuaaggaucucucaggag

SEQ ID NO: 2269256 - RNA, 20 nt, Human
gcagcccguguggccccuuc

SEQ ID NO: 2269257 - RNA, 19 nt, Human
gcagcccguguggccccuu

SEQ ID NO: 2269258 - RNA, 18 nt, Human
gcagcccguguggccccu

SEQ ID NO: 2269259 - RNA, 17 nt, Human
gcagcccguguggcccc

SEQ ID NO: 2269260 - RNA, 23 nt, Human
gcagccccgcgccuccuuccuug

SEQ ID NO: 2269261 - RNA, 15 nt, Human
gcagcccguguggcc

SEQ ID NO: 2269262 - RNA, 13 nt, Human
gcagcccugcaga

SEQ ID NO: 2269263 - RNA, 13 nt, Human
gcagcccuagagc

SEQ ID NO: 2269264 - RNA, 17 nt, Human
gcagcccuagagccugc

SEQ ID NO: 2269265 - RNA, 18 nt, Human
gcagcccuagagccugcc

SEQ ID NO: 2269266 - RNA, 19 nt, Human
gcagcccuagagccugccu

SEQ ID NO: 2269267 - RNA, 22 nt, Human
gcagcccuagagccugccugga

SEQ ID NO: 2269268 - RNA, 17 nt, Human
gcagccccauucugccu

SEQ ID NO: 2269269 - RNA, 23 nt, Human
gcagcaauaaagcagcguuucua

SEQ ID NO: 2269270 - RNA, 16 nt, Human
gcagcaauaaagcagc

SEQ ID NO: 2269271 - RNA, 18 nt, Human
gcagccccauucugccug

SEQ ID NO: 2269272 - RNA, 19 nt, Human
gcagccccauucugccugc

SEQ ID NO: 2269273 - RNA, 21 nt, Human
gcagccccauucugccugccc

SEQ ID NO: 2269274 - RNA, 24 nt, Human
gcagccccauucugccugcccagg

SEQ ID NO: 2269275 - RNA, 23 nt, Human
gcaccauucugacucgguuucuc

SEQ ID NO: 2269276 - RNA, 22 nt, Human
gcacccaccaucaugucuggcu

SEQ ID NO: 2269277 - RNA, 19 nt, Human
gcacccacccagcacccag

SEQ ID NO: 2269278 - RNA, 16 nt, Human
gcacccgggcucaggg

SEQ ID NO: 2269279 - RNA, 19 nt, Human
gcacccacaagugccacug

SEQ ID NO: 2269280 - RNA, 22 nt, Human
gcacccacccagcacccagcaa

SEQ ID NO: 2269281 - RNA, 18 nt, Human
gcacccggccccugcugg

SEQ ID NO: 2269282 - RNA, 19 nt, Human
gcacccggccccugcuggu

SEQ ID NO: 2269283 - RNA, 15 nt, Human
gcaccauucugacuc

SEQ ID NO: 2269284 - RNA, 17 nt, Human
gcaccauucugacucgg

SEQ ID NO: 2269285 - RNA, 20 nt, Human
gcaccagcuucuccaggcuc

SEQ ID NO: 2269286 - RNA, 16 nt, Human
gcaccagcuucuccag

SEQ ID NO: 2269287 - RNA, 17 nt, Human
gcaccagcuucuccagg

SEQ ID NO: 2269288 - RNA, 18 nt, Human
gcaccagcuucuccaggc

SEQ ID NO: 2269289 - RNA, 19 nt, Human
gcaccagcuucuccaggcu

SEQ ID NO: 2269290 - RNA, 16 nt, Human
gcaccagcagccugga

SEQ ID NO: 2269291 - RNA, 17 nt, Human
gcaccagcgaagggagu

SEQ ID NO: 2269292 - RNA, 18 nt, Human
gcaccagcgaagggagug

SEQ ID NO: 2269293 - RNA, 18 nt, Human
gcaccacuguguauuuaa

SEQ ID NO: 2269294 - RNA, 22 nt, Human
gcaccacugcacuccagccugg

SEQ ID NO: 2269295 - RNA, 21 nt, Human
gcaccacugcacuccagccug

SEQ ID NO: 2269296 - RNA, 23 nt, Human
gcaccacugcacuccagccuggg

SEQ ID NO: 2269297 - RNA, 23 nt, Human
gcaaugccauccucaaacacugc

SEQ ID NO: 2269298 - RNA, 14 nt, Human
gcaccagacaccca

SEQ ID NO: 2269299 - RNA, 15 nt, Human
gcaccagcagccugg

SEQ ID NO: 2269300 - RNA, 12 nt, Human
gcaauggcagcc

SEQ ID NO: 2269301 - RNA, 13 nt, Human
gcaauggcagccu

SEQ ID NO: 2269302 - RNA, 20 nt, Human
gcaccacugcacuccagccu

SEQ ID NO: 2269303 - RNA, 14 nt, Human
gcaauggcagccuu

SEQ ID NO: 2269304 - RNA, 14 nt, Human
gcacggugggccuu

SEQ ID NO: 2269305 - RNA, 12 nt, Human
gcacggcugcug

SEQ ID NO: 2269306 - RNA, 12 nt, Human
gcacggacucuu

SEQ ID NO: 2269307 - RNA, 23 nt, Human
gcacgauguggaaaaaugagaga

SEQ ID NO: 2269308 - RNA, 12 nt, Human
gcacgauuucug

SEQ ID NO: 2269309 - RNA, 23 nt, Human
gcacgaacccaccugcugagaga

SEQ ID NO: 2269310 - RNA, 19 nt, Human
gcacgaacccaccugcuga

SEQ ID NO: 2269311 - RNA, 17 nt, Human
gcacgaacccaccugcu

SEQ ID NO: 2269312 - RNA, 16 nt, Human
gcacgaacccaccugc

SEQ ID NO: 2269313 - RNA, 15 nt, Human
gcacgaacccaccug

SEQ ID NO: 2269314 - RNA, 15 nt, Human
gcacgaaauguuauu

SEQ ID NO: 2269315 - RNA, 19 nt, Human
gcaccuuagacagucccug

SEQ ID NO: 2269316 - RNA, 20 nt, Human
gcaccuugugucuguacacg

SEQ ID NO: 2269317 - RNA, 22 nt, Human
gcaccuugugucuguacacgug

SEQ ID NO: 2269318 - RNA, 21 nt, Human
gcaccuuaccaacuuucugua

SEQ ID NO: 2269319 - RNA, 18 nt, Human
gcaccuuagacagucccu

SEQ ID NO: 2269320 - RNA, 15 nt, Human
gcacccucaggcagg

SEQ ID NO: 2269321 - RNA, 21 nt, Human
gcacccuaguucuaccucagg

SEQ ID NO: 2269322 - RNA, 17 nt, Human
gcacccgggcucaggga

SEQ ID NO: 2269323 - RNA, 21 nt, Human
gcacccgggcucagggaccac

SEQ ID NO: 2269324 - RNA, 22 nt, Human
gcacccgggcucagggaccaca

SEQ ID NO: 2269325 - RNA, 23 nt, Human
gcacccgggcucagggaccacag

SEQ ID NO: 2269326 - RNA, 21 nt, Human
gcaccuggaauauauaaccag

SEQ ID NO: 2269327 - RNA, 18 nt, Human
gcaccuggaauauauaac

SEQ ID NO: 2269328 - RNA, 22 nt, Human
gcaccuggaauauauaaccagu

SEQ ID NO: 2269329 - RNA, 18 nt, Human
gcaccuggcaucgcacca

SEQ ID NO: 2269330 - RNA, 20 nt, Human
gcaccuggcugagccuggcu

SEQ ID NO: 2269331 - RNA, 21 nt, Human
gcaccuggcugagccuggcug

SEQ ID NO: 2269332 - RNA, 20 nt, Human
gcaccuuaccaacuuucugu

SEQ ID NO: 2269333 - RNA, 14 nt, Human
gcaccuuagacagu

SEQ ID NO: 2269334 - RNA, 17 nt, Human
gcaccuuagacaguccc

SEQ ID NO: 2269335 - RNA, 11 nt, Human
gcacugccuga

SEQ ID NO: 2269336 - RNA, 18 nt, Human
gcacugccugauggaccu

SEQ ID NO: 2269337 - RNA, 22 nt, Human
gcacugcuaggcgagugccagg

SEQ ID NO: 2269338 - RNA, 23 nt, Human
gcacugcuaggcgagugccagga

SEQ ID NO: 2269339 - RNA, 20 nt, Human
gcacugcuaggcgagugcca

SEQ ID NO: 2269340 - RNA, 21 nt, Human
gcacugcuaggcgagugccag

SEQ ID NO: 2269341 - RNA, 16 nt, Human
gcacugcuuccaguga

SEQ ID NO: 2269342 - RNA, 18 nt, Human
gcacugcuuccagugagg

SEQ ID NO: 2269343 - RNA, 22 nt, Human
gcacugcuuccagugaggcucu

SEQ ID NO: 2269344 - RNA, 20 nt, Human
gcacugcuuccagugaggcu

SEQ ID NO: 2269345 - RNA, 22 nt, Human
gcacugguggcccgacagccug

SEQ ID NO: 2269346 - RNA, 23 nt, Human
gcacugguggcccgacagccugg

SEQ ID NO: 2269347 - RNA, 24 nt, Human
gcacugguggcccgacagccuggc

SEQ ID NO: 2269348 - RNA, 19 nt, Human
gcacugguggcccgacagc

SEQ ID NO: 2269349 - RNA, 13 nt, Human
gcacgucauggga

SEQ ID NO: 2269350 - RNA, 18 nt, Human
gcacguggagagcuggug

SEQ ID NO: 2269351 - RNA, 16 nt, Human
gcacguggagagcugg

SEQ ID NO: 2269352 - RNA, 15 nt, Human
gcacguggagagcug

SEQ ID NO: 2269353 - RNA, 16 nt, Human
gcacguaguaggguca

SEQ ID NO: 2269354 - RNA, 22 nt, Human
gcacguagcugaggccggaugc

SEQ ID NO: 2269355 - RNA, 20 nt, Human
gcacguaguagggucaggcc

SEQ ID NO: 2269356 - RNA, 21 nt, Human
gcacguaguagggucaggcca

SEQ ID NO: 2269357 - RNA, 19 nt, Human
gcacggugggccuugcugg

SEQ ID NO: 2269358 - RNA, 20 nt, Human
gcacggugggccuugcuggg

SEQ ID NO: 2269359 - RNA, 13 nt, Human
gcacggcugcuga

SEQ ID NO: 2269360 - RNA, 16 nt, Human
gcacggugggccuugc

SEQ ID NO: 2269361 - RNA, 17 nt, Human
gcacggugggccuugcu

SEQ ID NO: 2269362 - RNA, 18 nt, Human
gcacggugggccuugcug

SEQ ID NO: 2269363 - RNA, 23 nt, Human
gcacgugggucuucagggggcca

SEQ ID NO: 2269364 - RNA, 19 nt, Human
gcacguggccucuugagca

SEQ ID NO: 2269365 - RNA, 15 nt, Human
gcacguggccucuug

SEQ ID NO: 2269366 - RNA, 17 nt, Human
gcacguggccucuugag

SEQ ID NO: 2269367 - RNA, 20 nt, Human
gcacguggagagcuggugcc

SEQ ID NO: 2269368 - RNA, 18 nt, Human
gcacguggcauguggccu

SEQ ID NO: 2269369 - RNA, 23 nt, Human
gcacguggcauguggccuguggc

SEQ ID NO: 2269370 - RNA, 13 nt, Human
gcacguggccucu

SEQ ID NO: 2269371 - RNA, 14 nt, Human
gcacguggccucuu

SEQ ID NO: 2269372 - RNA, 21 nt, Human
gcacugcccauggacaggcug

SEQ ID NO: 2269373 - RNA, 14 nt, Human
gcacugccaugcag

SEQ ID NO: 2269374 - RNA, 15 nt, Human
gcacugccaugcagg

SEQ ID NO: 2269375 - RNA, 17 nt, Human
gcacugccaugcagggc

SEQ ID NO: 2269376 - RNA, 18 nt, Human
gcacuuaagagaauauuu

SEQ ID NO: 2269377 - RNA, 19 nt, Human
gcacuuaaggcacucuguu

SEQ ID NO: 2269378 - RNA, 22 nt, Human
gcacuuaacaagcucccaggcc

SEQ ID NO: 2269379 - RNA, 14 nt, Human
gcacuucacagagu

SEQ ID NO: 2269380 - RNA, 15 nt, Human
gcacuucacagagug

SEQ ID NO: 2269381 - RNA, 18 nt, Human
gcacuuauuuaaugccga

SEQ ID NO: 2269382 - RNA, 13 nt, Human
gcacuucacagag

SEQ ID NO: 2269383 - RNA, 16 nt, Human
gcacuuaugauuucau

SEQ ID NO: 2269384 - RNA, 22 nt, Human
gcacuuacugguaggaccaagc

SEQ ID NO: 2269385 - RNA, 17 nt, Human
gcacuuagcuaucagaa

SEQ ID NO: 2269386 - RNA, 19 nt, Human
gcacuuagcuaucagaaga

SEQ ID NO: 2269387 - RNA, 18 nt, Human
gcagaauaaucuuugggu

SEQ ID NO: 2269388 - RNA, 22 nt, Human
gcagaauaaagcaauuuuccuu

SEQ ID NO: 2269389 - RNA, 17 nt, Human
gcagaauacuuuucucu

SEQ ID NO: 2269390 - RNA, 17 nt, Human
gcagaauagcaaggugc

SEQ ID NO: 2269391 - RNA, 23 nt, Human
gcagaauccuaggcuccacccca

SEQ ID NO: 2269392 - RNA, 17 nt, Human
gcagaauguuuuuaaaa

SEQ ID NO: 2269393 - RNA, 17 nt, Human
gcagaauccuggcccuc

SEQ ID NO: 2269394 - RNA, 13 nt, Human
gcagaauguuuuu

SEQ ID NO: 2269395 - RNA, 23 nt, Human
gcacuucauugagaguuuugucu

SEQ ID NO: 2269396 - RNA, 15 nt, Human
gcagaauaaagcaau

SEQ ID NO: 2269397 - RNA, 16 nt, Human
gcagaauaaagcaauu

SEQ ID NO: 2269398 - RNA, 17 nt, Human
gcagaauaaagcaauuu

SEQ ID NO: 2269399 - RNA, 18 nt, Human
gcagaauaaagcaauuuu

SEQ ID NO: 2269400 - RNA, 19 nt, Human
gcagaauaaagcaauuuuc

SEQ ID NO: 2269401 - RNA, 20 nt, Human
gcagaauaaagcaauuuucc

SEQ ID NO: 2269402 - RNA, 21 nt, Human
gcagaauaaagcaauuuuccu

SEQ ID NO: 2269403 - RNA, 23 nt, Human
gcagacaggcaagcaccuccugc

SEQ ID NO: 2269404 - RNA, 20 nt, Human
gcagacaggccccgugaggc

SEQ ID NO: 2269405 - RNA, 15 nt, Human
gcagacagcuccacc

SEQ ID NO: 2269406 - RNA, 19 nt, Human
gcagacacagggacuugaa

SEQ ID NO: 2269407 - RNA, 21 nt, Human
gcagacacagggacuugaagu

SEQ ID NO: 2269408 - RNA, 22 nt, Human
gcagacacagggacuugaaguu

SEQ ID NO: 2269409 - RNA, 19 nt, Human
gcagacaggcaagcaccuc

SEQ ID NO: 2269410 - RNA, 18 nt, Human
gcagacaggaccagggau

SEQ ID NO: 2269411 - RNA, 16 nt, Human
gcagacacagggacuu

SEQ ID NO: 2269412 - RNA, 18 nt, Human
gcagacacagggacuuga

SEQ ID NO: 2269413 - RNA, 12 nt, Human
gcagacaggacc

SEQ ID NO: 2269414 - RNA, 13 nt, Human
gcagacaggacca

SEQ ID NO: 2269415 - RNA, 15 nt, Human
gcagacaggaccagg

SEQ ID NO: 2269416 - RNA, 13 nt, Human
gacacccccucgc

SEQ ID NO: 2269417 - RNA, 17 nt, Human
gacaccccuuauccagg

SEQ ID NO: 2269418 - RNA, 18 nt, Human
gacaccccuuauccagga

SEQ ID NO: 2269419 - RNA, 19 nt, Human
gacaccccuuauccaggac

SEQ ID NO: 2269420 - RNA, 20 nt, Human
gacaccccuuauccaggacu

SEQ ID NO: 2269421 - RNA, 21 nt, Human
gacaccccuuauccaggacuc

SEQ ID NO: 2269422 - RNA, 15 nt, Human
gacacauaugagggg

SEQ ID NO: 2269423 - RNA, 16 nt, Human
gacacauaugaggggg

SEQ ID NO: 2269424 - RNA, 22 nt, Human
gacacauaugcaccuugugucu

SEQ ID NO: 2269425 - RNA, 12 nt, Human
gacacccuguga

SEQ ID NO: 2269426 - RNA, 13 nt, Human
gacacccugugau

SEQ ID NO: 2269427 - RNA, 17 nt, Human
gacacaggcccucccug

SEQ ID NO: 2269428 - RNA, 18 nt, Human
gacacaggcccggcucca

SEQ ID NO: 2269429 - RNA, 20 nt, Human
gacacagggacuugaaguug

SEQ ID NO: 2269430 - RNA, 21 nt, Human
gacacagggacuugaaguugu

SEQ ID NO: 2269431 - RNA, 16 nt, Human
gacacagggacuugaa

SEQ ID NO: 2269432 - RNA, 18 nt, Human
gacacagggacuugaagu

SEQ ID NO: 2269433 - RNA, 19 nt, Human
gacacagggacuugaaguu

SEQ ID NO: 2269434 - RNA, 17 nt, Human
gacacagugaccauacu

SEQ ID NO: 2269435 - RNA, 17 nt, Human
gacacaggucuuuccua

SEQ ID NO: 2269436 - RNA, 16 nt, Human
gacacaggucuuuccu

SEQ ID NO: 2269437 - RNA, 22 nt, Human
gacacaggucuuuccuaaggcu

SEQ ID NO: 2269438 - RNA, 19 nt, Human
gacaccugcaccucccccc

SEQ ID NO: 2269439 - RNA, 17 nt, Human
gacaccugcaccucccc

SEQ ID NO: 2269440 - RNA, 16 nt, Human
gacaccugcaccuccc

SEQ ID NO: 2269441 - RNA, 15 nt, Human
gacaccugcaccucc

SEQ ID NO: 2269442 - RNA, 13 nt, Human
gacaccugcaccu

SEQ ID NO: 2269443 - RNA, 22 nt, Human
gacaccugcaccuccccccacu

SEQ ID NO: 2269444 - RNA, 20 nt, Human
gacaccugcaccucccccca

SEQ ID NO: 2269445 - RNA, 17 nt, Human
gacaccuacugaguggc

SEQ ID NO: 2269446 - RNA, 20 nt, Human
gacaccgggguggugggaac

SEQ ID NO: 2269447 - RNA, 19 nt, Human
gacaccgggccaguaucua

SEQ ID NO: 2269448 - RNA, 22 nt, Human
gacaccgggccaguaucuauau

SEQ ID NO: 2269449 - RNA, 13 nt, Human
gacacccucaacc

SEQ ID NO: 2269450 - RNA, 10 nt, Human
gacacccggc

SEQ ID NO: 2269451 - RNA, 16 nt, Human
gacaccgccacauggc

SEQ ID NO: 2269452 - RNA, 22 nt, Human
gacacccugugauggggcccug

SEQ ID NO: 2269453 - RNA, 23 nt, Human
gacacccugugauggggcccugc

SEQ ID NO: 2269454 - RNA, 12 nt, Human
gacaccuuucau

SEQ ID NO: 2269455 - RNA, 17 nt, Human
gacaccuuugcaggcau

SEQ ID NO: 2269456 - RNA, 15 nt, Human
gacacggggcagugg

SEQ ID NO: 2269457 - RNA, 14 nt, Human
gacacguccacccc

SEQ ID NO: 2269458 - RNA, 19 nt, Human
gacacgaauauugcugaug

SEQ ID NO: 2269459 - RNA, 17 nt, Human
gacacgaauauugcuga

SEQ ID NO: 2269460 - RNA, 18 nt, Human
gacacgaauauugcugau

SEQ ID NO: 2269461 - RNA, 15 nt, Human
gacacuaaccacgcu

SEQ ID NO: 2269462 - RNA, 16 nt, Human
gacacuaaccacgcug

SEQ ID NO: 2269463 - RNA, 17 nt, Human
gacacuaaccacgcugg

SEQ ID NO: 2269464 - RNA, 18 nt, Human
gacacuaaccacgcugga

SEQ ID NO: 2269465 - RNA, 14 nt, Human
gacaccuuggacau

SEQ ID NO: 2269466 - RNA, 15 nt, Human
gacacgaauauugcu

SEQ ID NO: 2269467 - RNA, 18 nt, Human
gacaccuugacagggcac

SEQ ID NO: 2269468 - RNA, 20 nt, Human
gacaccuugacagggcacac

SEQ ID NO: 2269469 - RNA, 15 nt, Human
gacaccuugacaggg

SEQ ID NO: 2269470 - RNA, 17 nt, Human
gacaccuugacagggca

SEQ ID NO: 2269471 - RNA, 15 nt, Human
gacaccugcccugcc

SEQ ID NO: 2269472 - RNA, 14 nt, Human
gacaccugcccugc

SEQ ID NO: 2269473 - RNA, 13 nt, Human
gacaccugcccug

SEQ ID NO: 2269474 - RNA, 22 nt, Human
gacaauuuauauuuaauaaaau

SEQ ID NO: 2269475 - RNA, 15 nt, Human
gacaauugucuuuuu

SEQ ID NO: 2269476 - RNA, 12 nt, Human
gacaauuuauua

SEQ ID NO: 2269477 - RNA, 16 nt, Human
gacaaugcaaaccauc

SEQ ID NO: 2269478 - RNA, 18 nt, Human
gacaaugcaaaccaucau

SEQ ID NO: 2269479 - RNA, 21 nt, Human
gacaaugacuuacuguacaug

SEQ ID NO: 2269480 - RNA, 12 nt, Human
gacaaugcaaac

SEQ ID NO: 2269481 - RNA, 20 nt, Human
gacaaugacuuacuguacau

SEQ ID NO: 2269482 - RNA, 17 nt, Human
gacaaugacuuacugua

SEQ ID NO: 2269483 - RNA, 12 nt, Human
gacacacacaca

SEQ ID NO: 2269484 - RNA, 12 nt, Human
gacacacacacg

SEQ ID NO: 2269485 - RNA, 13 nt, Human
gacacacacacgc

SEQ ID NO: 2269486 - RNA, 14 nt, Human
gacacacacacgca

SEQ ID NO: 2269487 - RNA, 15 nt, Human
gacacacacacgcac

SEQ ID NO: 2269488 - RNA, 22 nt, Human
gacacaagccuucggcgccuua

SEQ ID NO: 2269489 - RNA, 22 nt, Human
gacacaaguggaccuuaggccu

SEQ ID NO: 2269490 - RNA, 20 nt, Human
gacaauuucaaaaaaauaaa

SEQ ID NO: 2269491 - RNA, 19 nt, Human
gacaauuuauuauggcaca

SEQ ID NO: 2269492 - RNA, 13 nt, Human
gacaauuuauuau

SEQ ID NO: 2269493 - RNA, 22 nt, Human
gacacacacacgcacgcacaca

SEQ ID NO: 2269494 - RNA, 23 nt, Human
gacacacacacgcacgcacacac

SEQ ID NO: 2269495 - RNA, 18 nt, Human
gacacacacacgcacgca

SEQ ID NO: 2269496 - RNA, 19 nt, Human
gacacacacacgcacgcac

SEQ ID NO: 2269497 - RNA, 20 nt, Human
gacacacacacgcacgcaca

SEQ ID NO: 2269498 - RNA, 21 nt, Human
gacacacacacgcacgcacac

SEQ ID NO: 2269499 - RNA, 13 nt, Human
gacacacagcucu

SEQ ID NO: 2269500 - RNA, 15 nt, Human
gacacaggcccggcu

SEQ ID NO: 2269501 - RNA, 17 nt, Human
gacacaggcccggcucc

SEQ ID NO: 2269502 - RNA, 22 nt, Human
gacaagguucuucccuuuuaca

SEQ ID NO: 2269503 - RNA, 15 nt, Human
gacaaguggacucag

SEQ ID NO: 2269504 - RNA, 20 nt, Human
gacaagugcugaacagugga

SEQ ID NO: 2269505 - RNA, 20 nt, Human
gacaaguggacucagggcag

SEQ ID NO: 2269506 - RNA, 14 nt, Human
gacaauaaaacauu

SEQ ID NO: 2269507 - RNA, 14 nt, Human
gacaaggccccaga

SEQ ID NO: 2269508 - RNA, 13 nt, Human
gacaaggccccag

SEQ ID NO: 2269509 - RNA, 17 nt, Human
gacaagccccaggcagg

SEQ ID NO: 2269510 - RNA, 16 nt, Human
gacaagccccaggcag

SEQ ID NO: 2269511 - RNA, 17 nt, Human
gacaaggccccagagac

SEQ ID NO: 2269512 - RNA, 16 nt, Human
gacaaggccccagaga

SEQ ID NO: 2269513 - RNA, 23 nt, Human
gacaaggccccagagacucagag

SEQ ID NO: 2269514 - RNA, 21 nt, Human
gacaagguagcccuggccaga

SEQ ID NO: 2269515 - RNA, 14 nt, Human
gacaagguagcccu

SEQ ID NO: 2269516 - RNA, 23 nt, Human
gacaagguagcccuggccagagg

SEQ ID NO: 2269517 - RNA, 21 nt, Human
gacaaucaugaaauaugcauc

SEQ ID NO: 2269518 - RNA, 19 nt, Human
gacaaucaugaaauaugca

SEQ ID NO: 2269519 - RNA, 20 nt, Human
gacaaucaugaaauaugcau

SEQ ID NO: 2269520 - RNA, 16 nt, Human
gacaaugacccagugg

SEQ ID NO: 2269521 - RNA, 17 nt, Human
gacaaucaacucuaaua

SEQ ID NO: 2269522 - RNA, 14 nt, Human
gacaaucagucccc

SEQ ID NO: 2269523 - RNA, 16 nt, Human
gacaaucaguccccuc

SEQ ID NO: 2269524 - RNA, 17 nt, Human
gacaaucaguccccucc

SEQ ID NO: 2269525 - RNA, 18 nt, Human
gacaaucaguccccuccc

SEQ ID NO: 2269526 - RNA, 19 nt, Human
gacaaucaguccccuccca

SEQ ID NO: 2269527 - RNA, 20 nt, Human
gacaaucaguccccucccau

SEQ ID NO: 2269528 - RNA, 19 nt, Human
gacaauaauuucagguuuu

SEQ ID NO: 2269529 - RNA, 13 nt, Human
gacaauaauuuca

SEQ ID NO: 2269530 - RNA, 15 nt, Human
gacaauaaucucacu

SEQ ID NO: 2269531 - RNA, 14 nt, Human
gacaagagauggga

SEQ ID NO: 2269532 - RNA, 20 nt, Human
gacaagagaugggaaugagg

SEQ ID NO: 2269533 - RNA, 16 nt, Human
gacaagacuucaguau

SEQ ID NO: 2269534 - RNA, 19 nt, Human
gacaagacuucaguauguu

SEQ ID NO: 2269535 - RNA, 20 nt, Human
gacaagacuucaguauguug

SEQ ID NO: 2269536 - RNA, 24 nt, Human
gacaagacuucaguauguugucaa

SEQ ID NO: 2269537 - RNA, 16 nt, Human
gaagucuuuguacaga

SEQ ID NO: 2269538 - RNA, 14 nt, Human
gaagucuuuguaca

SEQ ID NO: 2269539 - RNA, 22 nt, Human
gacaaggauugcuacuguccua

SEQ ID NO: 2269540 - RNA, 15 nt, Human
gacaagcucacagac

SEQ ID NO: 2269541 - RNA, 15 nt, Human
gacaagccccaggca

SEQ ID NO: 2269542 - RNA, 23 nt, Human
gacaagccaacuuguaaauacac

SEQ ID NO: 2269543 - RNA, 12 nt, Human
gacaagccccag

SEQ ID NO: 2269544 - RNA, 19 nt, Human
gacaagccaacuuguaaau

SEQ ID NO: 2269545 - RNA, 16 nt, Human
gacaagcacugcuagg

SEQ ID NO: 2269546 - RNA, 22 nt, Human
gacaagccaacuuguaaauaca

SEQ ID NO: 2269547 - RNA, 12 nt, Human
gacaagcagagg

SEQ ID NO: 2269548 - RNA, 19 nt, Human
gacaagcaauuagacaaga

SEQ ID NO: 2269549 - RNA, 18 nt, Human
gacaagagaugggaauga

SEQ ID NO: 2269550 - RNA, 22 nt, Human
gacagcuucucauccugcaggc

SEQ ID NO: 2269551 - RNA, 15 nt, Human
gacagcuugagccgg

SEQ ID NO: 2269552 - RNA, 22 nt, Human
gacagcuugagccgggccccug

SEQ ID NO: 2269553 - RNA, 21 nt, Human
gacagcuucucauccugcagg

SEQ ID NO: 2269554 - RNA, 20 nt, Human
gacaggacgggcuugggcuu

SEQ ID NO: 2269555 - RNA, 15 nt, Human
gacaggaccugacua

SEQ ID NO: 2269556 - RNA, 24 nt, Human
gacaggagaaaugcauccauuccu

SEQ ID NO: 2269557 - RNA, 12 nt, Human
gacaggagaaau

SEQ ID NO: 2269558 - RNA, 11 nt, Human
gacaggagaaa

SEQ ID NO: 2269559 - RNA, 21 nt, Human
gacaggagaccuggcacugga

SEQ ID NO: 2269560 - RNA, 18 nt, Human
gacaggagaccuggcacu

SEQ ID NO: 2269561 - RNA, 17 nt, Human
gacagcugucccuguca

SEQ ID NO: 2269562 - RNA, 16 nt, Human
gacagcugucccuguc

SEQ ID NO: 2269563 - RNA, 15 nt, Human
gacagcugucccugu

SEQ ID NO: 2269564 - RNA, 14 nt, Human
gacagcugucccug

SEQ ID NO: 2269565 - RNA, 19 nt, Human
gacagcugucccugucacc

SEQ ID NO: 2269566 - RNA, 18 nt, Human
gacagcugucccugucac

SEQ ID NO: 2269567 - RNA, 22 nt, Human
gacagcugucccugucaccaag

SEQ ID NO: 2269568 - RNA, 21 nt, Human
gacagcugcuccuagagggag

SEQ ID NO: 2269569 - RNA, 20 nt, Human
gacagcugcuccuagaggga

SEQ ID NO: 2269570 - RNA, 17 nt, Human
gacagcugcuccuagag

SEQ ID NO: 2269571 - RNA, 14 nt, Human
gacagcugcuccua

SEQ ID NO: 2269572 - RNA, 11 nt, Human
gacagcugcuc

SEQ ID NO: 2269573 - RNA, 14 nt, Human
gacagcugccuggg

SEQ ID NO: 2269574 - RNA, 15 nt, Human
gacagcugccuggga

SEQ ID NO: 2269575 - RNA, 14 nt, Human
gacaggcaaugcug

SEQ ID NO: 2269576 - RNA, 16 nt, Human
gacaggcaaugcuggc

SEQ ID NO: 2269577 - RNA, 17 nt, Human
gacaggagggcaagggc

SEQ ID NO: 2269578 - RNA, 16 nt, Human
gacaggaugggggcug

SEQ ID NO: 2269579 - RNA, 24 nt, Human
gacaggcaaugcuggcuguuggcu

SEQ ID NO: 2269580 - RNA, 17 nt, Human
gacaggcaaugcuggcu

SEQ ID NO: 2269581 - RNA, 18 nt, Human
gacaggcauguucucuga

SEQ ID NO: 2269582 - RNA, 19 nt, Human
gacaggcauguucucugag

SEQ ID NO: 2269583 - RNA, 19 nt, Human
gacagccaacuauggccug

SEQ ID NO: 2269584 - RNA, 19 nt, Human
gacagaugccccagagcug

SEQ ID NO: 2269585 - RNA, 18 nt, Human
gacagaugccccagagcu

SEQ ID NO: 2269586 - RNA, 14 nt, Human
gacagaugccccag

SEQ ID NO: 2269587 - RNA, 18 nt, Human
gacagaucaauggcgcag

SEQ ID NO: 2269588 - RNA, 19 nt, Human
gacagaugaaugccgugga

SEQ ID NO: 2269589 - RNA, 20 nt, Human
gacagaugaaugccguggau

SEQ ID NO: 2269590 - RNA, 13 nt, Human
gacagccacggcc

SEQ ID NO: 2269591 - RNA, 22 nt, Human
gacagccaacuauggccugugg

SEQ ID NO: 2269592 - RNA, 12 nt, Human
gacagcugccug

SEQ ID NO: 2269593 - RNA, 13 nt, Human
gacagcugccugg

SEQ ID NO: 2269594 - RNA, 14 nt, Human
gacagacacaggcc

SEQ ID NO: 2269595 - RNA, 15 nt, Human
gacacguccacccca

SEQ ID NO: 2269596 - RNA, 20 nt, Human
gacacuaaccacgcuggacc

SEQ ID NO: 2269597 - RNA, 21 nt, Human
gacacuaaccacgcuggaccu

SEQ ID NO: 2269598 - RNA, 15 nt, Human
gacagacacaggccc

SEQ ID NO: 2269599 - RNA, 16 nt, Human
gacagacacaggcccg

SEQ ID NO: 2269600 - RNA, 23 nt, Human
gacagaucaagcugugagacagu

SEQ ID NO: 2269601 - RNA, 19 nt, Human
gacagaucucugcuuugga

SEQ ID NO: 2269602 - RNA, 21 nt, Human
gacagaucucugcuuuggaaa

SEQ ID NO: 2269603 - RNA, 23 nt, Human
gacagaucucugcuuuggaaauc

SEQ ID NO: 2269604 - RNA, 13 nt, Human
gacaggcagcaga

SEQ ID NO: 2269605 - RNA, 20 nt, Human
gacaggagggcaagggccau

SEQ ID NO: 2269606 - RNA, 23 nt, Human
gacaggaugggggcuggccucug

SEQ ID NO: 2269607 - RNA, 16 nt, Human
gacaggcccaagagau

SEQ ID NO: 2269608 - RNA, 22 nt, Human
gacaggcccaagagaugaagag

SEQ ID NO: 2269609 - RNA, 18 nt, Human
gacaggcccaagagauga

SEQ ID NO: 2269610 - RNA, 15 nt, Human
gacaggcagccugga

SEQ ID NO: 2269611 - RNA, 14 nt, Human
gacaggcagcagag

SEQ ID NO: 2269612 - RNA, 21 nt, Human
gacaggcccaagagaugaaga

SEQ ID NO: 2269613 - RNA, 13 nt, Human
gacaggcucuuag

SEQ ID NO: 2269614 - RNA, 17 nt, Human
gacaggcucuuagcagc

SEQ ID NO: 2269615 - RNA, 18 nt, Human
gacaggcucuuagcagcu

SEQ ID NO: 2269616 - RNA, 19 nt, Human
gacaggcucuuagcagcuu

SEQ ID NO: 2269617 - RNA, 16 nt, Human
gacauacuaaccagca

SEQ ID NO: 2269618 - RNA, 15 nt, Human
gacauacuaaccagc

SEQ ID NO: 2269619 - RNA, 22 nt, Human
gacauaaugggguccuggccau

SEQ ID NO: 2269620 - RNA, 15 nt, Human
gacagggaagagcag

SEQ ID NO: 2269621 - RNA, 16 nt, Human
gacagggaagagcaga

SEQ ID NO: 2269622 - RNA, 23 nt, Human
gacauaacguuuuuccuuuaaaa

SEQ ID NO: 2269623 - RNA, 22 nt, Human
gacaggcuggcuccagaugcag

SEQ ID NO: 2269624 - RNA, 21 nt, Human
gacaggcuggcuccagaugca

SEQ ID NO: 2269625 - RNA, 14 nt, Human
gacaggcuggcucc

SEQ ID NO: 2269626 - RNA, 12 nt, Human
gacaggcuggcu

SEQ ID NO: 2269627 - RNA, 18 nt, Human
gacauagcccaucccugc

SEQ ID NO: 2269628 - RNA, 21 nt, Human
gacauagagagggagaagaag

SEQ ID NO: 2269629 - RNA, 22 nt, Human
gacauagcccaucccugccugg

SEQ ID NO: 2269630 - RNA, 16 nt, Human
gacauaauuucacuga

SEQ ID NO: 2269631 - RNA, 22 nt, Human
gacauagagagggagaagaagu

SEQ ID NO: 2269632 - RNA, 23 nt, Human
gacauacuaaccagcagaaaugc

SEQ ID NO: 2269633 - RNA, 20 nt, Human
gacauauucauuuggaaaua

SEQ ID NO: 2269634 - RNA, 13 nt, Human
gacauauucauuu

SEQ ID NO: 2269635 - RNA, 23 nt, Human
gacauaggccaugaaaaaaauga

SEQ ID NO: 2269636 - RNA, 21 nt, Human
gacaucuucaaagcuugaaga

SEQ ID NO: 2269637 - RNA, 20 nt, Human
gacaucuucaaagcuugaag

SEQ ID NO: 2269638 - RNA, 19 nt, Human
gacaucuuaguauuugcau

SEQ ID NO: 2269639 - RNA, 20 nt, Human
gacaugaagauucuuuccca

SEQ ID NO: 2269640 - RNA, 16 nt, Human
gacaucuuaguauuug

SEQ ID NO: 2269641 - RNA, 16 nt, Human
gacaucucuuugaauu

SEQ ID NO: 2269642 - RNA, 21 nt, Human
gacaucuguuucuaaauguuu

SEQ ID NO: 2269643 - RNA, 22 nt, Human
gacaucuggaaucuggagacca

SEQ ID NO: 2269644 - RNA, 20 nt, Human
gacaucuggaaucuggagac

SEQ ID NO: 2269645 - RNA, 14 nt, Human
gacaucaacagaua

SEQ ID NO: 2269646 - RNA, 19 nt, Human
gacaucuggaaucuggaga

SEQ ID NO: 2269647 - RNA, 18 nt, Human
gacaucuggaaucuggag

SEQ ID NO: 2269648 - RNA, 14 nt, Human
gacaucuggaaucu

SEQ ID NO: 2269649 - RNA, 17 nt, Human
gacaucucugcacccug

SEQ ID NO: 2269650 - RNA, 17 nt, Human
gacauggacccggagcu

SEQ ID NO: 2269651 - RNA, 16 nt, Human
gacauggacccggagc

SEQ ID NO: 2269652 - RNA, 14 nt, Human
gacaugcugacuuu

SEQ ID NO: 2269653 - RNA, 15 nt, Human
gacaugcugaagcca

SEQ ID NO: 2269654 - RNA, 18 nt, Human
gacaugcugaagccaaag

SEQ ID NO: 2269655 - RNA, 19 nt, Human
gacaugcugaagccaaagc

SEQ ID NO: 2269656 - RNA, 17 nt, Human
gacauggagacuccugc

SEQ ID NO: 2269657 - RNA, 19 nt, Human
gacauggagacuccugccc

SEQ ID NO: 2269658 - RNA, 20 nt, Human
gacauggagacuccugcccu

SEQ ID NO: 2269659 - RNA, 22 nt, Human
gacauggagacuccugcccugu

SEQ ID NO: 2269660 - RNA, 14 nt, Human
gacaugcugaagcc

SEQ ID NO: 2269661 - RNA, 23 nt, Human
gacaugcgguagccagcacacag

SEQ ID NO: 2269662 - RNA, 22 nt, Human
gacaugcgguagccagcacaca

SEQ ID NO: 2269663 - RNA, 19 nt, Human
gacaugcgguagccagcac

SEQ ID NO: 2269664 - RNA, 14 nt, Human
gacaugaauaugau

SEQ ID NO: 2269665 - RNA, 18 nt, Human
gacaugcgguagccagca

SEQ ID NO: 2269666 - RNA, 12 nt, Human
gacaugaauaug

SEQ ID NO: 2269667 - RNA, 16 nt, Human
gacauggggaggaagg

SEQ ID NO: 2269668 - RNA, 15 nt, Human
gacauggggaggaag

SEQ ID NO: 2269669 - RNA, 14 nt, Human
gacauggugccuga

SEQ ID NO: 2269670 - RNA, 16 nt, Human
gacauggugccugaga

SEQ ID NO: 2269671 - RNA, 17 nt, Human
gacauggugccugagag

SEQ ID NO: 2269672 - RNA, 18 nt, Human
gacauggugccugagagg

SEQ ID NO: 2269673 - RNA, 19 nt, Human
gacauggugccugagaggc

SEQ ID NO: 2269674 - RNA, 17 nt, Human
gacaugggacauuugcu

SEQ ID NO: 2269675 - RNA, 22 nt, Human
gacaugggacauuugcucaugg

SEQ ID NO: 2269676 - RNA, 15 nt, Human
gacauuuuuucaguc

SEQ ID NO: 2269677 - RNA, 20 nt, Human
gacauuuuuucagucauaua

SEQ ID NO: 2269678 - RNA, 13 nt, Human
gaccaaaccuagc

SEQ ID NO: 2269679 - RNA, 17 nt, Human
gaccaaaccuagccccu

SEQ ID NO: 2269680 - RNA, 13 nt, Human
gaccaaaaucccc

SEQ ID NO: 2269681 - RNA, 17 nt, Human
gaccaaaauccccuucu

SEQ ID NO: 2269682 - RNA, 19 nt, Human
gaccaaaauccccuucuca

SEQ ID NO: 2269683 - RNA, 17 nt, Human
gaccaacauggagaaac

SEQ ID NO: 2269684 - RNA, 23 nt, Human
gaccaaauuccuuggcaugccuu

SEQ ID NO: 2269685 - RNA, 16 nt, Human
gaccaacauggagaaa

SEQ ID NO: 2269686 - RNA, 22 nt, Human
gaccaaauuccuuggcaugccu

SEQ ID NO: 2269687 - RNA, 21 nt, Human
gacaugucuuuucuugcauga

SEQ ID NO: 2269688 - RNA, 17 nt, Human
gacaugucuguucuaca

SEQ ID NO: 2269689 - RNA, 12 nt, Human
gacauguacaga

SEQ ID NO: 2269690 - RNA, 12 nt, Human
gacaugugaaac

SEQ ID NO: 2269691 - RNA, 14 nt, Human
gacaugugaaaccu

SEQ ID NO: 2269692 - RNA, 15 nt, Human
gacaugugaaaccuu

SEQ ID NO: 2269693 - RNA, 18 nt, Human
gacaugugaaaccuuuuu

SEQ ID NO: 2269694 - RNA, 11 nt, Human
gacauguacag

SEQ ID NO: 2269695 - RNA, 15 nt, Human
gacaugucuguucua

SEQ ID NO: 2269696 - RNA, 20 nt, Human
gacauggugccugagaggca

SEQ ID NO: 2269697 - RNA, 21 nt, Human
gacauggugccugagaggcag

SEQ ID NO: 2269698 - RNA, 22 nt, Human
gacauggugccugagaggcagg

SEQ ID NO: 2269699 - RNA, 23 nt, Human
gacauggugccugagaggcaggc

SEQ ID NO: 2269700 - RNA, 17 nt, Human
gacaugucuuuucuugc

SEQ ID NO: 2269701 - RNA, 21 nt, Human
gaccugccaggcagggguggg

SEQ ID NO: 2269702 - RNA, 19 nt, Human
gaccugccaggcaggggug

SEQ ID NO: 2269703 - RNA, 20 nt, Human
gaccugccaggcaggggugg

SEQ ID NO: 2269704 - RNA, 21 nt, Human
gaccugccccuccucucugcc

SEQ ID NO: 2269705 - RNA, 16 nt, Human
gaccugccaggcaggg

SEQ ID NO: 2269706 - RNA, 17 nt, Human
gaccugccaggcagggg

SEQ ID NO: 2269707 - RNA, 18 nt, Human
gaccugccaggcaggggu

SEQ ID NO: 2269708 - RNA, 20 nt, Human
gaccugcaggccaagagcag

SEQ ID NO: 2269709 - RNA, 15 nt, Human
gaccugccaggcagg

SEQ ID NO: 2269710 - RNA, 21 nt, Human
gaccugccccgcccagcugca

SEQ ID NO: 2269711 - RNA, 11 nt, Human
gaccugccucc

SEQ ID NO: 2269712 - RNA, 22 nt, Human
gaccugccucccuucaugcaug

SEQ ID NO: 2269713 - RNA, 13 nt, Human
gaccugccuccug

SEQ ID NO: 2269714 - RNA, 14 nt, Human
gaccugccuccugc

SEQ ID NO: 2269715 - RNA, 15 nt, Human
gaccugccucggccu

SEQ ID NO: 2269716 - RNA, 16 nt, Human
gaccugccuccugccu

SEQ ID NO: 2269717 - RNA, 19 nt, Human
gaccugccuccugccugcc

SEQ ID NO: 2269718 - RNA, 20 nt, Human
gaccugccuccugccugccc

SEQ ID NO: 2269719 - RNA, 22 nt, Human
gaccugccuccugccugccccu

SEQ ID NO: 2269720 - RNA, 13 nt, Human
gaccugcaggcca

SEQ ID NO: 2269721 - RNA, 20 nt, Human
gaccugcacuggggagcccg

SEQ ID NO: 2269722 - RNA, 16 nt, Human
gaccugcacuggggag

SEQ ID NO: 2269723 - RNA, 20 nt, Human
gaccugaggcuccugugcua

SEQ ID NO: 2269724 - RNA, 19 nt, Human
gaccugauuuacaguuuca

SEQ ID NO: 2269725 - RNA, 21 nt, Human
gaccugauccuggaggcccag

SEQ ID NO: 2269726 - RNA, 18 nt, Human
gaccugauccuggaggcc

SEQ ID NO: 2269727 - RNA, 15 nt, Human
gaccugauccuggag

SEQ ID NO: 2269728 - RNA, 14 nt, Human
gaccugauccugga

SEQ ID NO: 2269729 - RNA, 23 nt, Human
gaccugauuucugagcauuuaau

SEQ ID NO: 2269730 - RNA, 18 nt, Human
gaccugaggcccuucucu

SEQ ID NO: 2269731 - RNA, 21 nt, Human
gaccugaggcccuucucucca

SEQ ID NO: 2269732 - RNA, 17 nt, Human
gaccucaggcacuagcc

SEQ ID NO: 2269733 - RNA, 17 nt, Human
gaccucagcugcuucuc

SEQ ID NO: 2269734 - RNA, 18 nt, Human
gaccucaggcacuagccu

SEQ ID NO: 2269735 - RNA, 19 nt, Human
gaccucaggcacuagccuu

SEQ ID NO: 2269736 - RNA, 21 nt, Human
gaccucaggcacuagccuuug

SEQ ID NO: 2269737 - RNA, 14 nt, Human
gaccugaggcuccu

SEQ ID NO: 2269738 - RNA, 18 nt, Human
gaccugaggcuccugugc

SEQ ID NO: 2269739 - RNA, 13 nt, Human
gaccugaggcugu

SEQ ID NO: 2269740 - RNA, 14 nt, Human
gaccugaggcugug

SEQ ID NO: 2269741 - RNA, 15 nt, Human
gaccugaggcugugg

SEQ ID NO: 2269742 - RNA, 17 nt, Human
gaccugaggcugugguc

SEQ ID NO: 2269743 - RNA, 11 nt, Human
gaccucaggcc

SEQ ID NO: 2269744 - RNA, 12 nt, Human
gaccucaggccu

SEQ ID NO: 2269745 - RNA, 13 nt, Human
gaccucaggccug

SEQ ID NO: 2269746 - RNA, 15 nt, Human
gaccugaggcccuuc

SEQ ID NO: 2269747 - RNA, 14 nt, Human
gacccuguggaagc

SEQ ID NO: 2269748 - RNA, 21 nt, Human
gacccugugacauggugccug

SEQ ID NO: 2269749 - RNA, 22 nt, Human
gacccugugacauggugccuga

SEQ ID NO: 2269750 - RNA, 15 nt, Human
gacccuguugcuaag

SEQ ID NO: 2269751 - RNA, 16 nt, Human
gacccuguugcuaagc

SEQ ID NO: 2269752 - RNA, 22 nt, Human
gaccccucaccuugcaacacac

SEQ ID NO: 2269753 - RNA, 20 nt, Human
gacccugugacauggugccu

SEQ ID NO: 2269754 - RNA, 12 nt, Human
gacccugucucu

SEQ ID NO: 2269755 - RNA, 14 nt, Human
gaccccucaccuug

SEQ ID NO: 2269756 - RNA, 13 nt, Human
gaccccucaccuu

SEQ ID NO: 2269757 - RNA, 19 nt, Human
gacccuucccuugagcccu

SEQ ID NO: 2269758 - RNA, 17 nt, Human
gacccuuacagccucug

SEQ ID NO: 2269759 - RNA, 21 nt, Human
gacccuuauuacacggaaaac

SEQ ID NO: 2269760 - RNA, 17 nt, Human
gacccuugacaccugcu

SEQ ID NO: 2269761 - RNA, 21 nt, Human
gacccuguugcuaagccccag

SEQ ID NO: 2269762 - RNA, 20 nt, Human
gacccuuacagccucugacu

SEQ ID NO: 2269763 - RNA, 15 nt, Human
gaccgguacagaaag

SEQ ID NO: 2269764 - RNA, 15 nt, Human
gaccggcggcucgga

SEQ ID NO: 2269765 - RNA, 15 nt, Human
gaccgugaggccaga

SEQ ID NO: 2269766 - RNA, 13 nt, Human
gaccguccucacc

SEQ ID NO: 2269767 - RNA, 14 nt, Human
gaccgugaggccag

SEQ ID NO: 2269768 - RNA, 15 nt, Human
gaccuaccucagguu

SEQ ID NO: 2269769 - RNA, 12 nt, Human
gaccuaccucag

SEQ ID NO: 2269770 - RNA, 13 nt, Human
gaccuaccucagg

SEQ ID NO: 2269771 - RNA, 14 nt, Human
gaccuaccucaggu

SEQ ID NO: 2269772 - RNA, 22 nt, Human
gaccuaaugcuccuuguuccua

SEQ ID NO: 2269773 - RNA, 13 nt, Human
gaccuacaaauca

SEQ ID NO: 2269774 - RNA, 15 nt, Human
gaccuaaugcuccuu

SEQ ID NO: 2269775 - RNA, 14 nt, Human
gaccuaaugcuccu

SEQ ID NO: 2269776 - RNA, 22 nt, Human
gaccuaaaauuugcccucccau

SEQ ID NO: 2269777 - RNA, 20 nt, Human
gaccuaaauggccucaugug

SEQ ID NO: 2269778 - RNA, 21 nt, Human
gaccgugggcggggccuugcg

SEQ ID NO: 2269779 - RNA, 18 nt, Human
gaccgugggcggggccuu

SEQ ID NO: 2269780 - RNA, 20 nt, Human
gaccgugggcggggccuugc

SEQ ID NO: 2269781 - RNA, 16 nt, Human
gaccuaaauggccuca

SEQ ID NO: 2269782 - RNA, 19 nt, Human
gaccuaaaauuugcccucc

SEQ ID NO: 2269783 - RNA, 20 nt, Human
gaccuaaaauuugcccuccc

SEQ ID NO: 2269784 - RNA, 20 nt, Human
gaccucagccuuccccuugc

SEQ ID NO: 2269785 - RNA, 14 nt, Human
gaccucagcugcuu

SEQ ID NO: 2269786 - RNA, 16 nt, Human
gaccucagcugcuucu

SEQ ID NO: 2269787 - RNA, 14 nt, Human
gaccucagccuucc

SEQ ID NO: 2269788 - RNA, 13 nt, Human
gaccucagccuuc

SEQ ID NO: 2269789 - RNA, 19 nt, Human
gaccucagccugugcugcc

SEQ ID NO: 2269790 - RNA, 16 nt, Human
gaccucagccugugcu

SEQ ID NO: 2269791 - RNA, 14 nt, Human
gaccucagccugug

SEQ ID NO: 2269792 - RNA, 13 nt, Human
gaccucagccugu

SEQ ID NO: 2269793 - RNA, 12 nt, Human
gaccucagccug

SEQ ID NO: 2269794 - RNA, 11 nt, Human
gaccucagccu

SEQ ID NO: 2269795 - RNA, 11 nt, Human
gaccucagcca

SEQ ID NO: 2269796 - RNA, 21 nt, Human
gaccucagaguccaggcccca

SEQ ID NO: 2269797 - RNA, 10 nt, Human
gaccucagcc

SEQ ID NO: 2269798 - RNA, 19 nt, Human
gaccucagaguccaggccc

SEQ ID NO: 2269799 - RNA, 18 nt, Human
gaccucagaguccaggcc

SEQ ID NO: 2269800 - RNA, 17 nt, Human
gaccucagaguccaggc

SEQ ID NO: 2269801 - RNA, 14 nt, Human
gaccaacugggccc

SEQ ID NO: 2269802 - RNA, 13 nt, Human
gaccaacugggcc

SEQ ID NO: 2269803 - RNA, 17 nt, Human
gaccaacuagacauucu

SEQ ID NO: 2269804 - RNA, 18 nt, Human
gaccaacuagacauucug

SEQ ID NO: 2269805 - RNA, 19 nt, Human
gaccaacuagacauucugu

SEQ ID NO: 2269806 - RNA, 20 nt, Human
gaccaacuagacauucuguc

SEQ ID NO: 2269807 - RNA, 14 nt, Human
gaccaaccugacca

SEQ ID NO: 2269808 - RNA, 13 nt, Human
gaccaaccugacc

SEQ ID NO: 2269809 - RNA, 18 nt, Human
gaccaacccuguuuccug

SEQ ID NO: 2269810 - RNA, 22 nt, Human
gaccaacauggagaaacccugu

SEQ ID NO: 2269811 - RNA, 21 nt, Human
gaccaacauggagaaacccug

SEQ ID NO: 2269812 - RNA, 16 nt, Human
gaccaacccuguuucc

SEQ ID NO: 2269813 - RNA, 17 nt, Human
gaccaacccuguuuccu

SEQ ID NO: 2269814 - RNA, 14 nt, Human
gaccaagcaggaag

SEQ ID NO: 2269815 - RNA, 16 nt, Human
gaccaagagagaaaga

SEQ ID NO: 2269816 - RNA, 15 nt, Human
gaccaagagagaaag

SEQ ID NO: 2269817 - RNA, 12 nt, Human
gaccaagcagga

SEQ ID NO: 2269818 - RNA, 14 nt, Human
gaccaagagagaaa

SEQ ID NO: 2269819 - RNA, 19 nt, Human
gaccaacugggcccaagac

SEQ ID NO: 2269820 - RNA, 14 nt, Human
gaccaacugucacu

SEQ ID NO: 2269821 - RNA, 18 nt, Human
gaccaagagagaaagaag

SEQ ID NO: 2269822 - RNA, 12 nt, Human
gacccaccccug

SEQ ID NO: 2269823 - RNA, 14 nt, Human
gacccaccccugug

SEQ ID NO: 2269824 - RNA, 11 nt, Human
gacccacugcu

SEQ ID NO: 2269825 - RNA, 22 nt, Human
gacccaccugguggccucugcc

SEQ ID NO: 2269826 - RNA, 17 nt, Human
gacccagcccucauccc

SEQ ID NO: 2269827 - RNA, 15 nt, Human
gacccaccccugugc

SEQ ID NO: 2269828 - RNA, 16 nt, Human
gacccaccccugugcu

SEQ ID NO: 2269829 - RNA, 17 nt, Human
gacccaccccugugcuc

SEQ ID NO: 2269830 - RNA, 18 nt, Human
gacccaccccugugcucc

SEQ ID NO: 2269831 - RNA, 12 nt, Human
gacccacugcuu

SEQ ID NO: 2269832 - RNA, 19 nt, Human
gaccccagcggcugaguca

SEQ ID NO: 2269833 - RNA, 14 nt, Human
gacccagucccugg

SEQ ID NO: 2269834 - RNA, 16 nt, Human
gacccaugcugcccug

SEQ ID NO: 2269835 - RNA, 14 nt, Human
gacccaugcugccc

SEQ ID NO: 2269836 - RNA, 15 nt, Human
gacccaugcugcccu

SEQ ID NO: 2269837 - RNA, 13 nt, Human
gacccaggcuggg

SEQ ID NO: 2269838 - RNA, 19 nt, Human
gacccaggccgcagcucuu

SEQ ID NO: 2269839 - RNA, 14 nt, Human
gacccaggcugggc

SEQ ID NO: 2269840 - RNA, 15 nt, Human
gacccaggcugggca

SEQ ID NO: 2269841 - RNA, 15 nt, Human
gacccagucccuggg

SEQ ID NO: 2269842 - RNA, 11 nt, Human
gacccaggcac

SEQ ID NO: 2269843 - RNA, 16 nt, Human
gacccaggcaccugca

SEQ ID NO: 2269844 - RNA, 11 nt, Human
gacccaggccg

SEQ ID NO: 2269845 - RNA, 13 nt, Human
gacccaggccgca

SEQ ID NO: 2269846 - RNA, 15 nt, Human
gacccaggccgcagc

SEQ ID NO: 2269847 - RNA, 17 nt, Human
gacccaggccgcagcuc

SEQ ID NO: 2269848 - RNA, 22 nt, Human
gacccaggccgcagcucuugcc

SEQ ID NO: 2269849 - RNA, 23 nt, Human
gacccugucucaaaaaaagaaaa

SEQ ID NO: 2269850 - RNA, 16 nt, Human
gacccugcccuguggg

SEQ ID NO: 2269851 - RNA, 13 nt, Human
gacccugcccugu

SEQ ID NO: 2269852 - RNA, 15 nt, Human
gacccugcccugugg

SEQ ID NO: 2269853 - RNA, 19 nt, Human
gacccugaggcccagaggg

SEQ ID NO: 2269854 - RNA, 20 nt, Human
gacccugaggcccagagggc

SEQ ID NO: 2269855 - RNA, 12 nt, Human
gacccugcccug

SEQ ID NO: 2269856 - RNA, 21 nt, Human
gacccugaggcccagagggcc

SEQ ID NO: 2269857 - RNA, 13 nt, Human
gaccccuccaugu

SEQ ID NO: 2269858 - RNA, 23 nt, Human
gaccccucauagcccucacccug

SEQ ID NO: 2269859 - RNA, 18 nt, Human
gacccugaggcccagagg

SEQ ID NO: 2269860 - RNA, 12 nt, Human
gaccccucaccu

SEQ ID NO: 2269861 - RNA, 18 nt, Human
gaccccaucugcccagga

SEQ ID NO: 2269862 - RNA, 22 nt, Human
gaccccucauagcccucacccu

SEQ ID NO: 2269863 - RNA, 20 nt, Human
gaccccgagccuggcuccaa

SEQ ID NO: 2269864 - RNA, 19 nt, Human
gaccccaucugugaauaag

SEQ ID NO: 2269865 - RNA, 16 nt, Human
gaccccaucugugaau

SEQ ID NO: 2269866 - RNA, 15 nt, Human
gaccccaucugccca

SEQ ID NO: 2269867 - RNA, 16 nt, Human
gaccccaucugcccag

SEQ ID NO: 2269868 - RNA, 17 nt, Human
gaccccaucugcccagg

SEQ ID NO: 2269869 - RNA, 12 nt, Human
gaccccagcugg

SEQ ID NO: 2269870 - RNA, 13 nt, Human
gaccccagcuggg

SEQ ID NO: 2269871 - RNA, 14 nt, Human
gaccccagcuggga

SEQ ID NO: 2269872 - RNA, 15 nt, Human
gaccccagcugggag

SEQ ID NO: 2269873 - RNA, 16 nt, Human
gaccccagcugggagg

SEQ ID NO: 2269874 - RNA, 21 nt, Human
gaccccagcugugagccuugg

SEQ ID NO: 2269875 - RNA, 21 nt, Human
gaccccagcugggaggcaaga

SEQ ID NO: 2269876 - RNA, 18 nt, Human
gaccccagcugugagccu

SEQ ID NO: 2269877 - RNA, 22 nt, Human
gaccccagcugugagccuuggc

SEQ ID NO: 2269878 - RNA, 15 nt, Human
gacuaauuguauaac

SEQ ID NO: 2269879 - RNA, 19 nt, Human
gacuaauuguauaacaggu

SEQ ID NO: 2269880 - RNA, 20 nt, Human
gacuaauuguauaacagguu

SEQ ID NO: 2269881 - RNA, 12 nt, Human
gacuaauuucaa

SEQ ID NO: 2269882 - RNA, 21 nt, Human
gacuaauuguauaacagguua

SEQ ID NO: 2269883 - RNA, 22 nt, Human
gacuaauuguauaacagguuau

SEQ ID NO: 2269884 - RNA, 22 nt, Human
gacuaauuucaaaaugcuuuuu

SEQ ID NO: 2269885 - RNA, 13 nt, Human
gacuaauuucaaa

SEQ ID NO: 2269886 - RNA, 18 nt, Human
gacuaauuuaaaaaauaa

SEQ ID NO: 2269887 - RNA, 15 nt, Human
gacuacaccuacgga

SEQ ID NO: 2269888 - RNA, 13 nt, Human
gacuaauuguaua

SEQ ID NO: 2269889 - RNA, 13 nt, Human
gacguuccagccg

SEQ ID NO: 2269890 - RNA, 21 nt, Human
gacuaauuccugcccugccca

SEQ ID NO: 2269891 - RNA, 14 nt, Human
gacguguuuguguu

SEQ ID NO: 2269892 - RNA, 12 nt, Human
gacguuccagcc

SEQ ID NO: 2269893 - RNA, 22 nt, Human
gacguguuaugacuccagaauu

SEQ ID NO: 2269894 - RNA, 17 nt, Human
gacuacucccccaggug

SEQ ID NO: 2269895 - RNA, 12 nt, Human
gacuacaggcac

SEQ ID NO: 2269896 - RNA, 15 nt, Human
gacuagaagggccag

SEQ ID NO: 2269897 - RNA, 16 nt, Human
gacuagaaccuggagg

SEQ ID NO: 2269898 - RNA, 20 nt, Human
gacuagaaccuggagggcug

SEQ ID NO: 2269899 - RNA, 15 nt, Human
gacuagaaccuggag

SEQ ID NO: 2269900 - RNA, 23 nt, Human
gacuacugggcaaagaguguaga

SEQ ID NO: 2269901 - RNA, 20 nt, Human
gacucagggccccagcacua

SEQ ID NO: 2269902 - RNA, 18 nt, Human
gacucagggccccagcac

SEQ ID NO: 2269903 - RNA, 13 nt, Human
gacucagggcucc

SEQ ID NO: 2269904 - RNA, 12 nt, Human
gacucagggcuc

SEQ ID NO: 2269905 - RNA, 19 nt, Human
gacucagggcuccuggguu

SEQ ID NO: 2269906 - RNA, 17 nt, Human
gacucagggcuccuggg

SEQ ID NO: 2269907 - RNA, 16 nt, Human
gacucagggcuccugg

SEQ ID NO: 2269908 - RNA, 14 nt, Human
gacucagggcuccu

SEQ ID NO: 2269909 - RNA, 17 nt, Human
gacucagggccccagca

SEQ ID NO: 2269910 - RNA, 15 nt, Human
gacucagggccccag

SEQ ID NO: 2269911 - RNA, 14 nt, Human
gacucagggcccca

SEQ ID NO: 2269912 - RNA, 21 nt, Human
gacucagggccaugccugccc

SEQ ID NO: 2269913 - RNA, 22 nt, Human
gacucagggccaugccugcccc

SEQ ID NO: 2269914 - RNA, 23 nt, Human
gacucagggcagcgccaggcuga

SEQ ID NO: 2269915 - RNA, 19 nt, Human
gacucagggccaugccugc

SEQ ID NO: 2269916 - RNA, 20 nt, Human
gacucagggccaugccugcc

SEQ ID NO: 2269917 - RNA, 18 nt, Human
gacucagggcagcgccag

SEQ ID NO: 2269918 - RNA, 17 nt, Human
gacucagggcagcgcca

SEQ ID NO: 2269919 - RNA, 23 nt, Human
gacucaggaugcccagggccacu

SEQ ID NO: 2269920 - RNA, 19 nt, Human
gacucaggaugcccagggc

SEQ ID NO: 2269921 - RNA, 18 nt, Human
gacucaggaugcccaggg

SEQ ID NO: 2269922 - RNA, 17 nt, Human
gacucaggaugcccagg

SEQ ID NO: 2269923 - RNA, 16 nt, Human
gacucaggaugcccag

SEQ ID NO: 2269924 - RNA, 15 nt, Human
gacucaggaugccca

SEQ ID NO: 2269925 - RNA, 16 nt, Human
gacucagggcagcgcc

SEQ ID NO: 2269926 - RNA, 13 nt, Human
gacucagggcagc

SEQ ID NO: 2269927 - RNA, 12 nt, Human
gacucagggcag

SEQ ID NO: 2269928 - RNA, 17 nt, Human
gacucaggauccagucc

SEQ ID NO: 2269929 - RNA, 23 nt, Human
gacuagaagggccaguccugccu

SEQ ID NO: 2269930 - RNA, 16 nt, Human
gacuagaauucuagug

SEQ ID NO: 2269931 - RNA, 18 nt, Human
gacuagaauucuagugcu

SEQ ID NO: 2269932 - RNA, 22 nt, Human
gacuagaauucuagugcugcug

SEQ ID NO: 2269933 - RNA, 19 nt, Human
gacuagaauucuagugcug

SEQ ID NO: 2269934 - RNA, 21 nt, Human
gacuagaauucuagugcugcu

SEQ ID NO: 2269935 - RNA, 23 nt, Human
gacuccaugagaagccgugggug

SEQ ID NO: 2269936 - RNA, 20 nt, Human
gacuccaguggggcaagauu

SEQ ID NO: 2269937 - RNA, 22 nt, Human
gacucccauuccugaagaacca

SEQ ID NO: 2269938 - RNA, 13 nt, Human
gacucccauuccu

SEQ ID NO: 2269939 - RNA, 19 nt, Human
gacucccuccucaccucug

SEQ ID NO: 2269940 - RNA, 16 nt, Human
gacucccuccucaccu

SEQ ID NO: 2269941 - RNA, 14 nt, Human
gacucccuccucac

SEQ ID NO: 2269942 - RNA, 13 nt, Human
gacucccuccuca

SEQ ID NO: 2269943 - RNA, 12 nt, Human
gacucccuccuc

SEQ ID NO: 2269944 - RNA, 18 nt, Human
gacuccccaggccaggcc

SEQ ID NO: 2269945 - RNA, 23 nt, Human
gacucccauuccugaagaaccag

SEQ ID NO: 2269946 - RNA, 15 nt, Human
gacuccccaggccag

SEQ ID NO: 2269947 - RNA, 16 nt, Human
gacuccccaggccagg

SEQ ID NO: 2269948 - RNA, 24 nt, Human
gacucccuccucaccucuggacug

SEQ ID NO: 2269949 - RNA, 22 nt, Human
gacucccuuaaaauagaaauaa

SEQ ID NO: 2269950 - RNA, 15 nt, Human
gacuccgcuggaggu

SEQ ID NO: 2269951 - RNA, 23 nt, Human
gacucccuccucaccucuggacu

SEQ ID NO: 2269952 - RNA, 20 nt, Human
gacucccuccucaccucugg

SEQ ID NO: 2269953 - RNA, 14 nt, Human
gacuccugcaggca

SEQ ID NO: 2269954 - RNA, 15 nt, Human
gacuccugcaggcag

SEQ ID NO: 2269955 - RNA, 16 nt, Human
gacuccugcaggcagc

SEQ ID NO: 2269956 - RNA, 15 nt, Human
gacucaguuugucag

SEQ ID NO: 2269957 - RNA, 12 nt, Human
gacucaguguuc

SEQ ID NO: 2269958 - RNA, 21 nt, Human
gacucauauccccuauuuaac

SEQ ID NO: 2269959 - RNA, 15 nt, Human
gacucaguggggagg

SEQ ID NO: 2269960 - RNA, 23 nt, Human
gacucagguuguaguaaagaaau

SEQ ID NO: 2269961 - RNA, 21 nt, Human
gacucagguuguaguaaagaa

SEQ ID NO: 2269962 - RNA, 15 nt, Human
gacucagguugucug

SEQ ID NO: 2269963 - RNA, 16 nt, Human
gacuccagacucucug

SEQ ID NO: 2269964 - RNA, 20 nt, Human
gacuccagccugccuggcag

SEQ ID NO: 2269965 - RNA, 12 nt, Human
gacuccaggaga

SEQ ID NO: 2269966 - RNA, 16 nt, Human
gacuccaggagaggag

SEQ ID NO: 2269967 - RNA, 14 nt, Human
gacuccacccaucc

SEQ ID NO: 2269968 - RNA, 16 nt, Human
gacuccacccauccua

SEQ ID NO: 2269969 - RNA, 17 nt, Human
gacucauucugaaggag

SEQ ID NO: 2269970 - RNA, 20 nt, Human
gacucauucccuagaucuuu

SEQ ID NO: 2269971 - RNA, 16 nt, Human
gacucauucugaagga

SEQ ID NO: 2269972 - RNA, 13 nt, Human
gacucauucugaa

SEQ ID NO: 2269973 - RNA, 12 nt, Human
gaccuggagccc

SEQ ID NO: 2269974 - RNA, 13 nt, Human
gaccuggagcccc

SEQ ID NO: 2269975 - RNA, 14 nt, Human
gaccuggagccccu

SEQ ID NO: 2269976 - RNA, 15 nt, Human
gaccuggagccccug

SEQ ID NO: 2269977 - RNA, 21 nt, Human
gaccugcugagggaccagcca

SEQ ID NO: 2269978 - RNA, 20 nt, Human
gaccugcugagggaccagcc

SEQ ID NO: 2269979 - RNA, 19 nt, Human
gaccugcugagggaccagc

SEQ ID NO: 2269980 - RNA, 23 nt, Human
gaccuugaacuggguacuugugg

SEQ ID NO: 2269981 - RNA, 16 nt, Human
gaccuggagccccugg

SEQ ID NO: 2269982 - RNA, 17 nt, Human
gaccuggagccccuggg

SEQ ID NO: 2269983 - RNA, 18 nt, Human
gaccuggagccccugggu

SEQ ID NO: 2269984 - RNA, 20 nt, Human
gaccuggagccccugggugg

SEQ ID NO: 2269985 - RNA, 15 nt, Human
gaccuggauaacuua

SEQ ID NO: 2269986 - RNA, 17 nt, Human
gaccuggauaacuuagg

SEQ ID NO: 2269987 - RNA, 16 nt, Human
gaccuggcaaggacac

SEQ ID NO: 2269988 - RNA, 17 nt, Human
gaccuggcaaggacaca

SEQ ID NO: 2269989 - RNA, 19 nt, Human
gaccugccucggccuccca

SEQ ID NO: 2269990 - RNA, 18 nt, Human
gaccugccucuucccccu

SEQ ID NO: 2269991 - RNA, 23 nt, Human
gaccugccuccugccugccccuc

SEQ ID NO: 2269992 - RNA, 12 nt, Human
gaccugccugua

SEQ ID NO: 2269993 - RNA, 16 nt, Human
gaccugcggcugcugu

SEQ ID NO: 2269994 - RNA, 20 nt, Human
gaccugcggcugcugugugc

SEQ ID NO: 2269995 - RNA, 19 nt, Human
gaccuugaaggguaaagaa

SEQ ID NO: 2269996 - RNA, 16 nt, Human
gaccuugcaacuucau

SEQ ID NO: 2269997 - RNA, 23 nt, Human
gaccuugcaacuucaugucaacu

SEQ ID NO: 2269998 - RNA, 16 nt, Human
gaccuuguuacuucug

SEQ ID NO: 2269999 - RNA, 21 nt, Human
gaccuuucaauaggaaaaacu

SEQ ID NO: 2270000 - RNA, 14 nt, Human
gaccuuguugcaug

SEQ ID NO: 2270001 - RNA, 20 nt, Human
gaccuuguugcaugauguau

SEQ ID NO: 2270002 - RNA, 17 nt, Human
gaccuuguuacuucuga

SEQ ID NO: 2270003 - RNA, 13 nt, Human
gaccuugugaucu

SEQ ID NO: 2270004 - RNA, 15 nt, Human
gaccuuguucacacu

SEQ ID NO: 2270005 - RNA, 21 nt, Human
gacgaacuuccauggcccuca

SEQ ID NO: 2270006 - RNA, 21 nt, Human
gacgacaagugcugaacagug

SEQ ID NO: 2270007 - RNA, 14 nt, Human
gacgaacuuccaug

SEQ ID NO: 2270008 - RNA, 22 nt, Human
gaccuuuucaacuuggcuuccu

SEQ ID NO: 2270009 - RNA, 21 nt, Human
gaccuuugucaucuuucuucu

SEQ ID NO: 2270010 - RNA, 21 nt, Human
gacgaacauccaaccuuccca

SEQ ID NO: 2270011 - RNA, 17 nt, Human
gaccuuuccugaggaag

SEQ ID NO: 2270012 - RNA, 21 nt, Human
gaccuuuccaccacagccagc

SEQ ID NO: 2270013 - RNA, 23 nt, Human
gaccuuuccaccacagccagcac

SEQ ID NO: 2270014 - RNA, 13 nt, Human
gaccuuuccacca

SEQ ID NO: 2270015 - RNA, 20 nt, Human
gaccuuguuguuguuaaaua

SEQ ID NO: 2270016 - RNA, 17 nt, Human
gaccuuucagcugugaa

SEQ ID NO: 2270017 - RNA, 17 nt, Human
gaccuuuccaccacagc

SEQ ID NO: 2270018 - RNA, 18 nt, Human
gaccuuuccaccacagcc

SEQ ID NO: 2270019 - RNA, 22 nt, Human
gacggcugggcacacgccuccc

SEQ ID NO: 2270020 - RNA, 17 nt, Human
gacggggggccccaguc

SEQ ID NO: 2270021 - RNA, 16 nt, Human
gacggggacuggggau

SEQ ID NO: 2270022 - RNA, 17 nt, Human
gacgggguuucaccaug

SEQ ID NO: 2270023 - RNA, 19 nt, Human
gacgguauuaugcuucuug

SEQ ID NO: 2270024 - RNA, 22 nt, Human
gacggggggccccagucagccu

SEQ ID NO: 2270025 - RNA, 23 nt, Human
gacggggggccccagucagccuc

SEQ ID NO: 2270026 - RNA, 22 nt, Human
gacgcaugcccucaaucccagc

SEQ ID NO: 2270027 - RNA, 19 nt, Human
gacgcagcaggaggccagg

SEQ ID NO: 2270028 - RNA, 23 nt, Human
gacggagucccaccuuggcugca

SEQ ID NO: 2270029 - RNA, 21 nt, Human
gacggagucccaccuuggcug

SEQ ID NO: 2270030 - RNA, 14 nt, Human
gacgaccuuuaccu

SEQ ID NO: 2270031 - RNA, 17 nt, Human
gacgaggcccucgggcc

SEQ ID NO: 2270032 - RNA, 21 nt, Human
gacgaggcccucgggcccagc

SEQ ID NO: 2270033 - RNA, 22 nt, Human
gacgaggcccucgggcccagcc

SEQ ID NO: 2270034 - RNA, 18 nt, Human
gacgaggggugucuuggg

SEQ ID NO: 2270035 - RNA, 14 nt, Human
gacggagucccacc

SEQ ID NO: 2270036 - RNA, 18 nt, Human
gacggagucccaccuugg

SEQ ID NO: 2270037 - RNA, 12 nt, Human
gacgucccucca

SEQ ID NO: 2270038 - RNA, 18 nt, Human
gacgucaagucuccuucc

SEQ ID NO: 2270039 - RNA, 22 nt, Human
gacgucccuccacguucacccc

SEQ ID NO: 2270040 - RNA, 20 nt, Human
gacguaggaacgguaaauuu

SEQ ID NO: 2270041 - RNA, 12 nt, Human
gacguagcugca

SEQ ID NO: 2270042 - RNA, 20 nt, Human
gacguacuccaacagaagaa

SEQ ID NO: 2270043 - RNA, 14 nt, Human
gacgucaagucucc

SEQ ID NO: 2270044 - RNA, 23 nt, Human
gacguaugcuuauuuuaaaauuu

SEQ ID NO: 2270045 - RNA, 21 nt, Human
gacguagcugcaaaggacaga

SEQ ID NO: 2270046 - RNA, 15 nt, Human
gacguaggggagggg

SEQ ID NO: 2270047 - RNA, 17 nt, Human
gacguguuaugacucca

SEQ ID NO: 2270048 - RNA, 20 nt, Human
gacguguuaugacuccagaa

SEQ ID NO: 2270049 - RNA, 15 nt, Human
gacgguucaccagcc

SEQ ID NO: 2270050 - RNA, 17 nt, Human
gacggugcuccaggcag

SEQ ID NO: 2270051 - RNA, 21 nt, Human
gacggugggcauuugugaggc

SEQ ID NO: 2270052 - RNA, 18 nt, Human
gacggugcccaagccaga

SEQ ID NO: 2270053 - RNA, 23 nt, Human
gacggugcccaagccagaggcug

SEQ ID NO: 2270054 - RNA, 16 nt, Human
gacggugcccaagcca

SEQ ID NO: 2270055 - RNA, 23 nt, Human
gacgggugggcggcuggagacca

SEQ ID NO: 2270056 - RNA, 16 nt, Human
gacggugcagucuggg

SEQ ID NO: 2270057 - RNA, 21 nt, Human
gacgguauuaugcuucuugga

SEQ ID NO: 2270058 - RNA, 16 nt, Human
gacggucccacacugg

SEQ ID NO: 2270059 - RNA, 18 nt, Human
gacgguucaccagccucu

SEQ ID NO: 2270060 - RNA, 17 nt, Human
gacgguucaccagccuc

SEQ ID NO: 2270061 - RNA, 19 nt, Human
gacgguucaccagccucuc

SEQ ID NO: 2270062 - RNA, 21 nt, Human
gacguacguaucagcggcccc

SEQ ID NO: 2270063 - RNA, 13 nt, Human
gagccucagcauc

SEQ ID NO: 2270064 - RNA, 17 nt, Human
gagccgugguccuuugg

SEQ ID NO: 2270065 - RNA, 13 nt, Human
gagccgugguccu

SEQ ID NO: 2270066 - RNA, 17 nt, Human
gagccuacccaccccca

SEQ ID NO: 2270067 - RNA, 15 nt, Human
gagccuacccacccc

SEQ ID NO: 2270068 - RNA, 17 nt, Human
gagccucagcauccugg

SEQ ID NO: 2270069 - RNA, 18 nt, Human
gagccucagucucccucc

SEQ ID NO: 2270070 - RNA, 19 nt, Human
gagccucagucucccuccc

SEQ ID NO: 2270071 - RNA, 14 nt, Human
gagccucagcaucc

SEQ ID NO: 2270072 - RNA, 15 nt, Human
gagccucagcauccu

SEQ ID NO: 2270073 - RNA, 22 nt, Human
gagccuccucucucaaacuggg

SEQ ID NO: 2270074 - RNA, 16 nt, Human
gagccucugcucccca

SEQ ID NO: 2270075 - RNA, 13 nt, Human
gagccuccugccc

SEQ ID NO: 2270076 - RNA, 21 nt, Human
gagccucccucaauucccccu

SEQ ID NO: 2270077 - RNA, 20 nt, Human
gagccucccucaauuccccc

SEQ ID NO: 2270078 - RNA, 20 nt, Human
gagccucauccgaggcaggg

SEQ ID NO: 2270079 - RNA, 19 nt, Human
gagccucauccgaggcagg

SEQ ID NO: 2270080 - RNA, 18 nt, Human
gagccucauccgaggcag

SEQ ID NO: 2270081 - RNA, 17 nt, Human
gagccucauccgaggca

SEQ ID NO: 2270082 - RNA, 24 nt, Human
gagccucugucacugcaggcacuc

SEQ ID NO: 2270083 - RNA, 19 nt, Human
gagccugaauuuuguugcu

SEQ ID NO: 2270084 - RNA, 17 nt, Human
gagccucugcuccccag

SEQ ID NO: 2270085 - RNA, 12 nt, Human
gagccucuguca

SEQ ID NO: 2270086 - RNA, 13 nt, Human
gagccucugucac

SEQ ID NO: 2270087 - RNA, 18 nt, Human
gagccucugucacugcag

SEQ ID NO: 2270088 - RNA, 20 nt, Human
gagccucugucacugcaggc

SEQ ID NO: 2270089 - RNA, 21 nt, Human
gagccucugucacugcaggca

SEQ ID NO: 2270090 - RNA, 22 nt, Human
gagccucugucacugcaggcac

SEQ ID NO: 2270091 - RNA, 12 nt, Human
gagccugcaguu

SEQ ID NO: 2270092 - RNA, 10 nt, Human
gagccugagg

SEQ ID NO: 2270093 - RNA, 15 nt, Human
gagccugagggaucu

SEQ ID NO: 2270094 - RNA, 12 nt, Human
gagccugaggga

SEQ ID NO: 2270095 - RNA, 19 nt, Human
gagccgagaucacgccacu

SEQ ID NO: 2270096 - RNA, 20 nt, Human
gagccgagaucacgccacug

SEQ ID NO: 2270097 - RNA, 11 nt, Human
gagcccacugu

SEQ ID NO: 2270098 - RNA, 20 nt, Human
gagcccacugcccacccccu

SEQ ID NO: 2270099 - RNA, 21 nt, Human
gagcccacugcccacccccuc

SEQ ID NO: 2270100 - RNA, 23 nt, Human
gagcccacugcccacccccucaa

SEQ ID NO: 2270101 - RNA, 15 nt, Human
gagcccuugccuccc

SEQ ID NO: 2270102 - RNA, 16 nt, Human
gagcccuugccucccc

SEQ ID NO: 2270103 - RNA, 17 nt, Human
gagcccuugccucccca

SEQ ID NO: 2270104 - RNA, 18 nt, Human
gagcccacuguacuugcu

SEQ ID NO: 2270105 - RNA, 21 nt, Human
gagcccacuguacuugcucuu

SEQ ID NO: 2270106 - RNA, 18 nt, Human
gagcccacgcccccacug

SEQ ID NO: 2270107 - RNA, 19 nt, Human
gagcccacugcccaccccc

SEQ ID NO: 2270108 - RNA, 16 nt, Human
gagcccacaaagccuu

SEQ ID NO: 2270109 - RNA, 21 nt, Human
gagccgagaucacgccacugc

SEQ ID NO: 2270110 - RNA, 22 nt, Human
gagccgagaucacgccacugca

SEQ ID NO: 2270111 - RNA, 22 nt, Human
gagccgcaucuucuccaucugg

SEQ ID NO: 2270112 - RNA, 21 nt, Human
gagccgcaucuucuccaucug

SEQ ID NO: 2270113 - RNA, 22 nt, Human
gagcccuugccuccccauuucc

SEQ ID NO: 2270114 - RNA, 20 nt, Human
gagccgagaucgcgccacug

SEQ ID NO: 2270115 - RNA, 14 nt, Human
gagccgcuggcaga

SEQ ID NO: 2270116 - RNA, 19 nt, Human
gagccgcuggcagaaggga

SEQ ID NO: 2270117 - RNA, 19 nt, Human
gagccgcugugagccccug

SEQ ID NO: 2270118 - RNA, 20 nt, Human
gagccgcugugagccccugg

SEQ ID NO: 2270119 - RNA, 22 nt, Human
gagccggacuuucggaguuggg

SEQ ID NO: 2270120 - RNA, 12 nt, Human
gagccggagccu

SEQ ID NO: 2270121 - RNA, 16 nt, Human
gagccggagccuccag

SEQ ID NO: 2270122 - RNA, 14 nt, Human
gagccgugaugccu

SEQ ID NO: 2270123 - RNA, 20 nt, Human
gagccggguggaucgccuga

SEQ ID NO: 2270124 - RNA, 22 nt, Human
gagccgggucugccucuucugg

SEQ ID NO: 2270125 - RNA, 21 nt, Human
gagccgggucugccucuucug

SEQ ID NO: 2270126 - RNA, 20 nt, Human
gagccgggucugccucuucu

SEQ ID NO: 2270127 - RNA, 17 nt, Human
gagccgggucugccucu

SEQ ID NO: 2270128 - RNA, 22 nt, Human
gagccgggaaagaagagccgga

SEQ ID NO: 2270129 - RNA, 16 nt, Human
gagccgggccccuggg

SEQ ID NO: 2270130 - RNA, 15 nt, Human
gagccgggccccugg

SEQ ID NO: 2270131 - RNA, 13 nt, Human
gagccgggccugg

SEQ ID NO: 2270132 - RNA, 14 nt, Human
gagccgggccuggg

SEQ ID NO: 2270133 - RNA, 20 nt, Human
gagccgggccuggggcuccu

SEQ ID NO: 2270134 - RNA, 22 nt, Human
gagccggggaguuucuuuccug

SEQ ID NO: 2270135 - RNA, 18 nt, Human
gagccggggaguuucuuu

SEQ ID NO: 2270136 - RNA, 19 nt, Human
gagccggggaguuucuuuc

SEQ ID NO: 2270137 - RNA, 15 nt, Human
gagauauauuuuuaa

SEQ ID NO: 2270138 - RNA, 18 nt, Human
gagauaucugagggagga

SEQ ID NO: 2270139 - RNA, 12 nt, Human
gagauauauuuu

SEQ ID NO: 2270140 - RNA, 23 nt, Human
gagcagagaccaucccugaaggc

SEQ ID NO: 2270141 - RNA, 19 nt, Human
gagcagagaccaucccuga

SEQ ID NO: 2270142 - RNA, 21 nt, Human
gagcagagaccaucccugaag

SEQ ID NO: 2270143 - RNA, 18 nt, Human
gagcagagcaagucugca

SEQ ID NO: 2270144 - RNA, 13 nt, Human
gagcagaggcagc

SEQ ID NO: 2270145 - RNA, 21 nt, Human
gagcagccacauuccugaugc

SEQ ID NO: 2270146 - RNA, 22 nt, Human
gagcagccacauuccugaugcu

SEQ ID NO: 2270147 - RNA, 15 nt, Human
gagcagaggggcuga

SEQ ID NO: 2270148 - RNA, 16 nt, Human
gagcagcccuggaguc

SEQ ID NO: 2270149 - RNA, 20 nt, Human
gagcagcccuggagucaugc

SEQ ID NO: 2270150 - RNA, 17 nt, Human
gagcagccucagaacaa

SEQ ID NO: 2270151 - RNA, 15 nt, Human
gagauaauaugagaa

SEQ ID NO: 2270152 - RNA, 21 nt, Human
gagauaauguuagagguuuua

SEQ ID NO: 2270153 - RNA, 18 nt, Human
gagagugcaacaguagca

SEQ ID NO: 2270154 - RNA, 15 nt, Human
gagaguuuugucuug

SEQ ID NO: 2270155 - RNA, 14 nt, Human
gagaguuuuggaug

SEQ ID NO: 2270156 - RNA, 22 nt, Human
gagaguuuugucuugaaugucu

SEQ ID NO: 2270157 - RNA, 17 nt, Human
gagaguuuugucuugaa

SEQ ID NO: 2270158 - RNA, 15 nt, Human
gagauaaaucuagua

SEQ ID NO: 2270159 - RNA, 20 nt, Human
gagauagccaaggccaaagg

SEQ ID NO: 2270160 - RNA, 21 nt, Human
gagauagccaaggccaaagga

SEQ ID NO: 2270161 - RNA, 17 nt, Human
gagcagagaccaucccu

SEQ ID NO: 2270162 - RNA, 18 nt, Human
gagcagagaccaucccug

SEQ ID NO: 2270163 - RNA, 16 nt, Human
gagcagagaccauccc

SEQ ID NO: 2270164 - RNA, 19 nt, Human
gagauagccaaggccaaag

SEQ ID NO: 2270165 - RNA, 21 nt, Human
gagccagcccucccuguccuc

SEQ ID NO: 2270166 - RNA, 20 nt, Human
gagccagcccucccuguccu

SEQ ID NO: 2270167 - RNA, 15 nt, Human
gagccagccugcucc

SEQ ID NO: 2270168 - RNA, 19 nt, Human
gagccagcccucccugucc

SEQ ID NO: 2270169 - RNA, 13 nt, Human
gagccagauuuca

SEQ ID NO: 2270170 - RNA, 18 nt, Human
gagccagcucccucuauu

SEQ ID NO: 2270171 - RNA, 13 nt, Human
gagccagcucccu

SEQ ID NO: 2270172 - RNA, 22 nt, Human
gagccaggccugggucuguguc

SEQ ID NO: 2270173 - RNA, 21 nt, Human
gagccaggccugggucugugu

SEQ ID NO: 2270174 - RNA, 12 nt, Human
gagccaggccug

SEQ ID NO: 2270175 - RNA, 13 nt, Human
gagccaggcacac

SEQ ID NO: 2270176 - RNA, 12 nt, Human
gagccaggcaca

SEQ ID NO: 2270177 - RNA, 13 nt, Human
gagcccaccuugg

SEQ ID NO: 2270178 - RNA, 15 nt, Human
gagcccaccuuggcu

SEQ ID NO: 2270179 - RNA, 17 nt, Human
gagcccaccuuggcuca

SEQ ID NO: 2270180 - RNA, 18 nt, Human
gagccacugcaccgggcc

SEQ ID NO: 2270181 - RNA, 19 nt, Human
gagccacugcaccgggcca

SEQ ID NO: 2270182 - RNA, 15 nt, Human
gagcagccuguggca

SEQ ID NO: 2270183 - RNA, 14 nt, Human
gagcagccuguggc

SEQ ID NO: 2270184 - RNA, 13 nt, Human
gagcagccugugg

SEQ ID NO: 2270185 - RNA, 11 nt, Human
gagcagccugu

SEQ ID NO: 2270186 - RNA, 18 nt, Human
gagcagccuguggcaucu

SEQ ID NO: 2270187 - RNA, 16 nt, Human
gagcagccuguggcau

SEQ ID NO: 2270188 - RNA, 13 nt, Human
gagccacugcacc

SEQ ID NO: 2270189 - RNA, 20 nt, Human
gagccacugcaccgggccac

SEQ ID NO: 2270190 - RNA, 15 nt, Human
gagccagauuucacu

SEQ ID NO: 2270191 - RNA, 18 nt, Human
gagccagauuucacucuc

SEQ ID NO: 2270192 - RNA, 19 nt, Human
gagccagauuucacucucc

SEQ ID NO: 2270193 - RNA, 14 nt, Human
gagcuagcgcugcc

SEQ ID NO: 2270194 - RNA, 18 nt, Human
gagcuagaagcuggagga

SEQ ID NO: 2270195 - RNA, 23 nt, Human
gagcuagcgcugccgcaccccag

SEQ ID NO: 2270196 - RNA, 19 nt, Human
gagcuagcgcugccgcacc

SEQ ID NO: 2270197 - RNA, 18 nt, Human
gagcuagcgcugccgcac

SEQ ID NO: 2270198 - RNA, 17 nt, Human
gagcuagcagcagggag

SEQ ID NO: 2270199 - RNA, 15 nt, Human
gagcuagcagcaggg

SEQ ID NO: 2270200 - RNA, 15 nt, Human
gagccugcaguuauu

SEQ ID NO: 2270201 - RNA, 13 nt, Human
gagccugccugga

SEQ ID NO: 2270202 - RNA, 14 nt, Human
gagccugccuggag

SEQ ID NO: 2270203 - RNA, 15 nt, Human
gagccugccuggagc

SEQ ID NO: 2270204 - RNA, 22 nt, Human
gagcuagaaccuagaagggcua

SEQ ID NO: 2270205 - RNA, 14 nt, Human
gagcuagaaccugg

SEQ ID NO: 2270206 - RNA, 17 nt, Human
gagcuagaaccuggaga

SEQ ID NO: 2270207 - RNA, 19 nt, Human
gagcuagaaccuggagagc

SEQ ID NO: 2270208 - RNA, 17 nt, Human
gagcuagaaccuggagg

SEQ ID NO: 2270209 - RNA, 21 nt, Human
gagcuagaaccuggagggcua

SEQ ID NO: 2270210 - RNA, 15 nt, Human
gagcuagaagcugga

SEQ ID NO: 2270211 - RNA, 21 nt, Human
gagcucagacccccacucuca

SEQ ID NO: 2270212 - RNA, 18 nt, Human
gagcucagagagggcagg

SEQ ID NO: 2270213 - RNA, 20 nt, Human
gagcucagacccccacucuc

SEQ ID NO: 2270214 - RNA, 18 nt, Human
gagcucagacccccacuc

SEQ ID NO: 2270215 - RNA, 14 nt, Human
gagcucagaccccc

SEQ ID NO: 2270216 - RNA, 15 nt, Human
gagcucagaccccca

SEQ ID NO: 2270217 - RNA, 20 nt, Human
gagcucagagagggcaggca

SEQ ID NO: 2270218 - RNA, 21 nt, Human
gagcucagagagggcaggcau

SEQ ID NO: 2270219 - RNA, 22 nt, Human
gagcuccagacccccagcaacc

SEQ ID NO: 2270220 - RNA, 19 nt, Human
gagcuccagacccccagca

SEQ ID NO: 2270221 - RNA, 17 nt, Human
gagcuccagacccccag

SEQ ID NO: 2270222 - RNA, 15 nt, Human
gagcuccagaccccc

SEQ ID NO: 2270223 - RNA, 13 nt, Human
gagcuccagaccc

SEQ ID NO: 2270224 - RNA, 22 nt, Human
gagcuccacucugcuucucuga

SEQ ID NO: 2270225 - RNA, 14 nt, Human
gagcuauguauuaa

SEQ ID NO: 2270226 - RNA, 13 nt, Human
gagcuauugcugu

SEQ ID NO: 2270227 - RNA, 13 nt, Human
gagcuauuuccau

SEQ ID NO: 2270228 - RNA, 18 nt, Human
gagcuauuuccauuccag

SEQ ID NO: 2270229 - RNA, 21 nt, Human
gagcuauuuccauuccagaau

SEQ ID NO: 2270230 - RNA, 19 nt, Human
gagcuauuuccauuccaga

SEQ ID NO: 2270231 - RNA, 20 nt, Human
gagcuauuuccauuccagaa

SEQ ID NO: 2270232 - RNA, 19 nt, Human
gagcucacuguggugucug

SEQ ID NO: 2270233 - RNA, 16 nt, Human
gagcucacucggcacc

SEQ ID NO: 2270234 - RNA, 20 nt, Human
gagcuccagacccccagcaa

SEQ ID NO: 2270235 - RNA, 17 nt, Human
gagcucuugugaggaaa

SEQ ID NO: 2270236 - RNA, 23 nt, Human
gagcucuacccagggccugcagg

SEQ ID NO: 2270237 - RNA, 21 nt, Human
gagcucuacccagggccugca

SEQ ID NO: 2270238 - RNA, 20 nt, Human
gagcucuacccagggccugc

SEQ ID NO: 2270239 - RNA, 15 nt, Human
gagcucuacccaggg

SEQ ID NO: 2270240 - RNA, 14 nt, Human
gagcucuacccagg

SEQ ID NO: 2270241 - RNA, 22 nt, Human
gagcucguguauccuggggcuc

SEQ ID NO: 2270242 - RNA, 23 nt, Human
gagcucguguauccuggggcucc

SEQ ID NO: 2270243 - RNA, 15 nt, Human
gagcucgguggaccc

SEQ ID NO: 2270244 - RNA, 16 nt, Human
gagcucguguauccug

SEQ ID NO: 2270245 - RNA, 18 nt, Human
gagcucguguauccuggg

SEQ ID NO: 2270246 - RNA, 19 nt, Human
gagcucguguauccugggg

SEQ ID NO: 2270247 - RNA, 20 nt, Human
gagcucguguauccuggggc

SEQ ID NO: 2270248 - RNA, 21 nt, Human
gagcucguguauccuggggcu

SEQ ID NO: 2270249 - RNA, 16 nt, Human
gagcucgugggacagu

SEQ ID NO: 2270250 - RNA, 17 nt, Human
gagcugaggcaauucua

SEQ ID NO: 2270251 - RNA, 16 nt, Human
gagcugaggcagcagu

SEQ ID NO: 2270252 - RNA, 17 nt, Human
gagcugaggccacacuc

SEQ ID NO: 2270253 - RNA, 23 nt, Human
gagcugaggggggccgugcccag

SEQ ID NO: 2270254 - RNA, 15 nt, Human
gagcugaguggggga

SEQ ID NO: 2270255 - RNA, 13 nt, Human
gagcugauccaga

SEQ ID NO: 2270256 - RNA, 15 nt, Human
gagcugauccagagc

SEQ ID NO: 2270257 - RNA, 16 nt, Human
gagcugauccagagca

SEQ ID NO: 2270258 - RNA, 20 nt, Human
gagcugauccagagcacaga

SEQ ID NO: 2270259 - RNA, 20 nt, Human
gagcugaaaaaucacauccu

SEQ ID NO: 2270260 - RNA, 21 nt, Human
gagcucuugugaggaaaguca

SEQ ID NO: 2270261 - RNA, 17 nt, Human
gagcugaaaugcugcau

SEQ ID NO: 2270262 - RNA, 22 nt, Human
gagcugaaaaaucacauccugg

SEQ ID NO: 2270263 - RNA, 19 nt, Human
gagcugaacccauuuugag

SEQ ID NO: 2270264 - RNA, 22 nt, Human
gagcugaacccauuuugaguga

SEQ ID NO: 2270265 - RNA, 18 nt, Human
gagcugacacaaaccugc

SEQ ID NO: 2270266 - RNA, 23 nt, Human
gagcugaacccauuuugagugac

SEQ ID NO: 2270267 - RNA, 22 nt, Human
gagcugacacaaaccugccugg

SEQ ID NO: 2270268 - RNA, 23 nt, Human
gagcugacacaaaccugccuggg

SEQ ID NO: 2270269 - RNA, 13 nt, Human
gagcugagcaggg

SEQ ID NO: 2270270 - RNA, 17 nt, Human
gagcugagccucucacc

SEQ ID NO: 2270271 - RNA, 13 nt, Human
gagcugagaugga

SEQ ID NO: 2270272 - RNA, 16 nt, Human
gagcugagcagggaga

SEQ ID NO: 2270273 - RNA, 13 nt, Human
gagcugagaucgu

SEQ ID NO: 2270274 - RNA, 10 nt, Human
gagcugagau

SEQ ID NO: 2270275 - RNA, 16 nt, Human
gagcugacacaggaug

SEQ ID NO: 2270276 - RNA, 17 nt, Human
gagcugacacaggauga

SEQ ID NO: 2270277 - RNA, 18 nt, Human
gaggaaacaacagcuuua

SEQ ID NO: 2270278 - RNA, 14 nt, Human
gaggaaacucaccu

SEQ ID NO: 2270279 - RNA, 22 nt, Human
gaggaaaaguaaccaucacugg

SEQ ID NO: 2270280 - RNA, 21 nt, Human
gaggaaaaguaaggugcaguu

SEQ ID NO: 2270281 - RNA, 22 nt, Human
gaggaaacucaccugcuggccc

SEQ ID NO: 2270282 - RNA, 20 nt, Human
gaggaaacucaccugcuggc

SEQ ID NO: 2270283 - RNA, 17 nt, Human
gaggaaacucaccugcu

SEQ ID NO: 2270284 - RNA, 16 nt, Human
gaggaaagaaugaaag

SEQ ID NO: 2270285 - RNA, 16 nt, Human
gaggaaagcaaaggag

SEQ ID NO: 2270286 - RNA, 17 nt, Human
gaggaaagcaaaggaga

SEQ ID NO: 2270287 - RNA, 22 nt, Human
gaggaaaaaaaucguccaggga

SEQ ID NO: 2270288 - RNA, 18 nt, Human
gagcuuuuuucuuuaaga

SEQ ID NO: 2270289 - RNA, 20 nt, Human
gaggaaaaccaagccguggc

SEQ ID NO: 2270290 - RNA, 21 nt, Human
gaggaaaaccaagccguggcu

SEQ ID NO: 2270291 - RNA, 23 nt, Human
gaggaaaaccaagccguggcuuc

SEQ ID NO: 2270292 - RNA, 15 nt, Human
gagcuuuucuaggcu

SEQ ID NO: 2270293 - RNA, 19 nt, Human
gagcuuugcauguuccacu

SEQ ID NO: 2270294 - RNA, 21 nt, Human
gagcuuugcauguuccacuaa

SEQ ID NO: 2270295 - RNA, 12 nt, Human
gagcuuugcugc

SEQ ID NO: 2270296 - RNA, 13 nt, Human
gagcuuugcugcu

SEQ ID NO: 2270297 - RNA, 14 nt, Human
gagcuuugcugcua

SEQ ID NO: 2270298 - RNA, 17 nt, Human
gagcuuugcugcuacag

SEQ ID NO: 2270299 - RNA, 15 nt, Human
gagcuuggccagaag

SEQ ID NO: 2270300 - RNA, 14 nt, Human
gagcuuggccagaa

SEQ ID NO: 2270301 - RNA, 13 nt, Human
gagcuugggaaug

SEQ ID NO: 2270302 - RNA, 22 nt, Human
gagcuugaaacccguggcgcuu

SEQ ID NO: 2270303 - RNA, 18 nt, Human
gagcuuucaaagaaggaa

SEQ ID NO: 2270304 - RNA, 15 nt, Human
gagcuuucaaagaag

SEQ ID NO: 2270305 - RNA, 22 nt, Human
gagcuuuauguaauaaugugaa

SEQ ID NO: 2270306 - RNA, 20 nt, Human
gagcuugggggaugacuaga

SEQ ID NO: 2270307 - RNA, 17 nt, Human
gagcuuuccauguugcu

SEQ ID NO: 2270308 - RNA, 18 nt, Human
gagcuuuccauguugcug

SEQ ID NO: 2270309 - RNA, 19 nt, Human
gagcuuuccauguugcugc

SEQ ID NO: 2270310 - RNA, 21 nt, Human
gagcuuuccauguugcugcca

SEQ ID NO: 2270311 - RNA, 22 nt, Human
gagcuuucugcuaucaaagagg

SEQ ID NO: 2270312 - RNA, 23 nt, Human
gagcuuucuguccuuuuggcacu

SEQ ID NO: 2270313 - RNA, 21 nt, Human
gagcuuucuguccuuuuggca

SEQ ID NO: 2270314 - RNA, 20 nt, Human
gagcuuugaaaauucagugg

SEQ ID NO: 2270315 - RNA, 21 nt, Human
gaggaagaugggggcaagaag

SEQ ID NO: 2270316 - RNA, 12 nt, Human
gaggaagcagaa

SEQ ID NO: 2270317 - RNA, 19 nt, Human
gaggaagagcaggcacaug

SEQ ID NO: 2270318 - RNA, 17 nt, Human
gaggaagagcaggcaca

SEQ ID NO: 2270319 - RNA, 13 nt, Human
gaggaagagcagg

SEQ ID NO: 2270320 - RNA, 20 nt, Human
gaggaagaagcuuaggcagg

SEQ ID NO: 2270321 - RNA, 17 nt, Human
gaggaagagaaaaaaua

SEQ ID NO: 2270322 - RNA, 13 nt, Human
gaggaagccgcug

SEQ ID NO: 2270323 - RNA, 13 nt, Human
gaggaagcagaau

SEQ ID NO: 2270324 - RNA, 14 nt, Human
gaggaagcagaaua

SEQ ID NO: 2270325 - RNA, 15 nt, Human
gaggaagcagaauaa

SEQ ID NO: 2270326 - RNA, 16 nt, Human
gaggaagcagaauaaa

SEQ ID NO: 2270327 - RNA, 17 nt, Human
gaggaagcagaauaaag

SEQ ID NO: 2270328 - RNA, 19 nt, Human
gaggaagcagaauaaagca

SEQ ID NO: 2270329 - RNA, 20 nt, Human
gaggaagcagaauaaagcaa

SEQ ID NO: 2270330 - RNA, 21 nt, Human
gaggaagcagaauaaagcaau

SEQ ID NO: 2270331 - RNA, 14 nt, Human
gaggaagccgcugg

SEQ ID NO: 2270332 - RNA, 17 nt, Human
gaggaagccgcuggggc

SEQ ID NO: 2270333 - RNA, 18 nt, Human
gaggaagccgcuggggcc

SEQ ID NO: 2270334 - RNA, 20 nt, Human
gaggaacuagccaccaacuc

SEQ ID NO: 2270335 - RNA, 15 nt, Human
gaggaacuguccaga

SEQ ID NO: 2270336 - RNA, 16 nt, Human
gaggaacuguccagag

SEQ ID NO: 2270337 - RNA, 17 nt, Human
gaggaacuguccagaga

SEQ ID NO: 2270338 - RNA, 18 nt, Human
gaggaacuguccagagag

SEQ ID NO: 2270339 - RNA, 19 nt, Human
gaggaagaacggggcucuu

SEQ ID NO: 2270340 - RNA, 19 nt, Human
gaggaacuguccagagagc

SEQ ID NO: 2270341 - RNA, 21 nt, Human
gaggaacuguccagagagcaa

SEQ ID NO: 2270342 - RNA, 23 nt, Human
gaggaagaacggggcucuucuca

SEQ ID NO: 2270343 - RNA, 23 nt, Human
gaggaacuucagacacaaaaguc

SEQ ID NO: 2270344 - RNA, 17 nt, Human
gaggaagaagcuuaggc

SEQ ID NO: 2270345 - RNA, 22 nt, Human
gaggaaccagagccauggacuc

SEQ ID NO: 2270346 - RNA, 18 nt, Human
gaggaaccagagccaugg

SEQ ID NO: 2270347 - RNA, 15 nt, Human
gaggaaccagagcca

SEQ ID NO: 2270348 - RNA, 14 nt, Human
gaggaaccagagcc

SEQ ID NO: 2270349 - RNA, 16 nt, Human
gaggaacaaggcaagg

SEQ ID NO: 2270350 - RNA, 23 nt, Human
gaggaaaggccagcuggcagcag

SEQ ID NO: 2270351 - RNA, 19 nt, Human
gaggaaagguuugagaagc

SEQ ID NO: 2270352 - RNA, 12 nt, Human
gaggaaagucau

SEQ ID NO: 2270353 - RNA, 18 nt, Human
gaggaaagucauuggcuu

SEQ ID NO: 2270354 - RNA, 20 nt, Human
gaggaaagucauuggcuuua

SEQ ID NO: 2270355 - RNA, 14 nt, Human
gaggaaacucagag

SEQ ID NO: 2270356 - RNA, 23 nt, Human
gaggaaacucaccugcuggcccc

SEQ ID NO: 2270357 - RNA, 19 nt, Human
gaggaaaggccagcuggca

SEQ ID NO: 2270358 - RNA, 14 nt, Human
gaggaaaggccagc

SEQ ID NO: 2270359 - RNA, 13 nt, Human
gaggaaaggccag

SEQ ID NO: 2270360 - RNA, 21 nt, Human
gaggaaauaagaaaaaucaug

SEQ ID NO: 2270361 - RNA, 14 nt, Human
gaggaacaaggcaa

SEQ ID NO: 2270362 - RNA, 21 nt, Human
gagagggcaugcgcacaaggc

SEQ ID NO: 2270363 - RNA, 23 nt, Human
gagagggaggucacuggaaaggg

SEQ ID NO: 2270364 - RNA, 14 nt, Human
gagagggcagaggg

SEQ ID NO: 2270365 - RNA, 16 nt, Human
gagagggcaggcauga

SEQ ID NO: 2270366 - RNA, 18 nt, Human
gagagggcaguguuuccu

SEQ ID NO: 2270367 - RNA, 19 nt, Human
gagagccuggugcugcugc

SEQ ID NO: 2270368 - RNA, 19 nt, Human
gagagggaggcaagcccug

SEQ ID NO: 2270369 - RNA, 17 nt, Human
gagagccuggugcugcu

SEQ ID NO: 2270370 - RNA, 13 nt, Human
gagagccuggugc

SEQ ID NO: 2270371 - RNA, 13 nt, Human
gagagccuuccag

SEQ ID NO: 2270372 - RNA, 14 nt, Human
gagagccuuccagg

SEQ ID NO: 2270373 - RNA, 13 nt, Human
gagaggggaacag

SEQ ID NO: 2270374 - RNA, 18 nt, Human
gagaggggaacagacugg

SEQ ID NO: 2270375 - RNA, 21 nt, Human
gagagggugggagugggccca

SEQ ID NO: 2270376 - RNA, 11 nt, Human
gagagggcuuu

SEQ ID NO: 2270377 - RNA, 17 nt, Human
gagaggucuuuuuuaaa

SEQ ID NO: 2270378 - RNA, 13 nt, Human
gagaggugccagc

SEQ ID NO: 2270379 - RNA, 14 nt, Human
gagaggugccagca

SEQ ID NO: 2270380 - RNA, 21 nt, Human
gagaggugccagcaacugaau

SEQ ID NO: 2270381 - RNA, 24 nt, Human
gagaggucaagcccaggaggacug

SEQ ID NO: 2270382 - RNA, 19 nt, Human
gagaggucaagcccaggag

SEQ ID NO: 2270383 - RNA, 18 nt, Human
gagaggucaagcccagga

SEQ ID NO: 2270384 - RNA, 14 nt, Human
gagaggugggccag

SEQ ID NO: 2270385 - RNA, 22 nt, Human
gagaggugggccagucugugga

SEQ ID NO: 2270386 - RNA, 23 nt, Human
gagaggugggccagucuguggau

SEQ ID NO: 2270387 - RNA, 12 nt, Human
gagagguggagc

SEQ ID NO: 2270388 - RNA, 16 nt, Human
gagagguuaaggugca

SEQ ID NO: 2270389 - RNA, 19 nt, Human
gagagguuauaggucacuc

SEQ ID NO: 2270390 - RNA, 14 nt, Human
gagagucugucuca

SEQ ID NO: 2270391 - RNA, 11 nt, Human
gagaguaacuu

SEQ ID NO: 2270392 - RNA, 15 nt, Human
gagagugaacaaauu

SEQ ID NO: 2270393 - RNA, 17 nt, Human
gagauacagaauuuuau

SEQ ID NO: 2270394 - RNA, 19 nt, Human
gagagugaacaaauuuaca

SEQ ID NO: 2270395 - RNA, 14 nt, Human
gagaguuuccugaa

SEQ ID NO: 2270396 - RNA, 15 nt, Human
gagagugagguggaa

SEQ ID NO: 2270397 - RNA, 13 nt, Human
gagagaggcagag

SEQ ID NO: 2270398 - RNA, 13 nt, Human
gagagaggacagc

SEQ ID NO: 2270399 - RNA, 15 nt, Human
gagagaggcagagag

SEQ ID NO: 2270400 - RNA, 18 nt, Human
gagagaagugccccugcu

SEQ ID NO: 2270401 - RNA, 21 nt, Human
gagagaagugccccugcugcc

SEQ ID NO: 2270402 - RNA, 19 nt, Human
gagagacacacugaagaag

SEQ ID NO: 2270403 - RNA, 13 nt, Human
gagagaagugccc

SEQ ID NO: 2270404 - RNA, 16 nt, Human
gagagaaggggaggag

SEQ ID NO: 2270405 - RNA, 17 nt, Human
gagagaaggggaggagg

SEQ ID NO: 2270406 - RNA, 15 nt, Human
gagagaaggggagga

SEQ ID NO: 2270407 - RNA, 12 nt, Human
gagagaagggga

SEQ ID NO: 2270408 - RNA, 20 nt, Human
gagagaaaacuuauuugagu

SEQ ID NO: 2270409 - RNA, 13 nt, Human
gagagaaaauaaa

SEQ ID NO: 2270410 - RNA, 14 nt, Human
gagagaaaauaaaa

SEQ ID NO: 2270411 - RNA, 22 nt, Human
gagacuuuuaaucagacaaagu

SEQ ID NO: 2270412 - RNA, 14 nt, Human
gagagaaaaacaaa

SEQ ID NO: 2270413 - RNA, 17 nt, Human
gagagaagagaaugcac

SEQ ID NO: 2270414 - RNA, 23 nt, Human
gagagaaaacagaccuaaugcuc

SEQ ID NO: 2270415 - RNA, 13 nt, Human
gagagaaaacuua

SEQ ID NO: 2270416 - RNA, 22 nt, Human
gagagaaaacagaccuaaugcu

SEQ ID NO: 2270417 - RNA, 18 nt, Human
gagagaaaacagaccuaa

SEQ ID NO: 2270418 - RNA, 12 nt, Human
gagagaaaauaa

SEQ ID NO: 2270419 - RNA, 11 nt, Human
gagagaaaaua

SEQ ID NO: 2270420 - RNA, 12 nt, Human
gagagaggggaa

SEQ ID NO: 2270421 - RNA, 16 nt, Human
gagagaggcagagagc

SEQ ID NO: 2270422 - RNA, 17 nt, Human
gagagaggcagagagcg

SEQ ID NO: 2270423 - RNA, 23 nt, Human
gagagcaggcuggcagcucucca

SEQ ID NO: 2270424 - RNA, 16 nt, Human
gagagaguugaaccua

SEQ ID NO: 2270425 - RNA, 16 nt, Human
gagagccaccaagagg

SEQ ID NO: 2270426 - RNA, 10 nt, Human
gagagcccag

SEQ ID NO: 2270427 - RNA, 17 nt, Human
gagagccauuuugugaa

SEQ ID NO: 2270428 - RNA, 14 nt, Human
gagagcccagaggu

SEQ ID NO: 2270429 - RNA, 20 nt, Human
gagagccagcccucccuguc

SEQ ID NO: 2270430 - RNA, 14 nt, Human
gagagccagcccuc

SEQ ID NO: 2270431 - RNA, 14 nt, Human
gagagccauuuugu

SEQ ID NO: 2270432 - RNA, 13 nt, Human
gagagccagcccu

SEQ ID NO: 2270433 - RNA, 12 nt, Human
gagagccagccc

SEQ ID NO: 2270434 - RNA, 11 nt, Human
gagagccagcc

SEQ ID NO: 2270435 - RNA, 22 nt, Human
gagagccagagaagugacaggg

SEQ ID NO: 2270436 - RNA, 16 nt, Human
gagagccagaaccugg

SEQ ID NO: 2270437 - RNA, 15 nt, Human
gagagccagagaagu

SEQ ID NO: 2270438 - RNA, 19 nt, Human
gagagccagagaagugaca

SEQ ID NO: 2270439 - RNA, 14 nt, Human
gagagccugcugca

SEQ ID NO: 2270440 - RNA, 13 nt, Human
gagagccugcugc

SEQ ID NO: 2270441 - RNA, 12 nt, Human
gagagccugcug

SEQ ID NO: 2270442 - RNA, 13 nt, Human
gagagccugcugg

SEQ ID NO: 2270443 - RNA, 14 nt, Human
gagagccugcuggc

SEQ ID NO: 2270444 - RNA, 15 nt, Human
gagagccugcuggca

SEQ ID NO: 2270445 - RNA, 23 nt, Human
gagagccugcucccccacccccu

SEQ ID NO: 2270446 - RNA, 11 nt, Human
gagagcccagc

SEQ ID NO: 2270447 - RNA, 21 nt, Human
gagagcccagagguaacagaa

SEQ ID NO: 2270448 - RNA, 23 nt, Human
gagagcccagagguaacagaaca

SEQ ID NO: 2270449 - RNA, 14 nt, Human
gagaccagccuggc

SEQ ID NO: 2270450 - RNA, 18 nt, Human
gagaccaaggcgggagca

SEQ ID NO: 2270451 - RNA, 19 nt, Human
gagaccagccugggcagca

SEQ ID NO: 2270452 - RNA, 16 nt, Human
gagaccagccugggca

SEQ ID NO: 2270453 - RNA, 13 nt, Human
gagaccagccugg

SEQ ID NO: 2270454 - RNA, 23 nt, Human
gagaccaagacucugaaaucuca

SEQ ID NO: 2270455 - RNA, 22 nt, Human
gagaccaagacucugaaaucuc

SEQ ID NO: 2270456 - RNA, 17 nt, Human
gagaccaaccugaccaa

SEQ ID NO: 2270457 - RNA, 16 nt, Human
gagaccaaccugacca

SEQ ID NO: 2270458 - RNA, 12 nt, Human
gagaccaucccu

SEQ ID NO: 2270459 - RNA, 20 nt, Human
gagaccaguugggagcacug

SEQ ID NO: 2270460 - RNA, 21 nt, Human
gagaccaguugggagcacugg

SEQ ID NO: 2270461 - RNA, 22 nt, Human
gagaccaguugggagcacugga

SEQ ID NO: 2270462 - RNA, 16 nt, Human
gagaccagggagccuu

SEQ ID NO: 2270463 - RNA, 14 nt, Human
gagaccaggcaaag

SEQ ID NO: 2270464 - RNA, 17 nt, Human
gagaccaggagggcacu

SEQ ID NO: 2270465 - RNA, 18 nt, Human
gagaccaggcaaagcaag

SEQ ID NO: 2270466 - RNA, 16 nt, Human
gagacucgcgacaaug

SEQ ID NO: 2270467 - RNA, 18 nt, Human
gagacucgcgacaaugca

SEQ ID NO: 2270468 - RNA, 22 nt, Human
gagacuccugcaggcagccagg

SEQ ID NO: 2270469 - RNA, 14 nt, Human
gagacucgagaacu

SEQ ID NO: 2270470 - RNA, 17 nt, Human
gagacuccugcccuguu

SEQ ID NO: 2270471 - RNA, 15 nt, Human
gagacucgagaacuu

SEQ ID NO: 2270472 - RNA, 16 nt, Human
gagacucgagaacuuu

SEQ ID NO: 2270473 - RNA, 17 nt, Human
gagacucgagaacuuuc

SEQ ID NO: 2270474 - RNA, 20 nt, Human
gagacucgagaacuuucauu

SEQ ID NO: 2270475 - RNA, 23 nt, Human
gagacucuguggggccuugguuc

SEQ ID NO: 2270476 - RNA, 12 nt, Human
gagacucugugg

SEQ ID NO: 2270477 - RNA, 19 nt, Human
gagacugcgggaugguccu

SEQ ID NO: 2270478 - RNA, 15 nt, Human
gagacugcccagcua

SEQ ID NO: 2270479 - RNA, 14 nt, Human
gagacucugucuca

SEQ ID NO: 2270480 - RNA, 22 nt, Human
gagacugucucaagagggcacu

SEQ ID NO: 2270481 - RNA, 14 nt, Human
gagacugcuuccca

SEQ ID NO: 2270482 - RNA, 17 nt, Human
gagacugcuucccaucc

SEQ ID NO: 2270483 - RNA, 20 nt, Human
gagacugcuucccauccuac

SEQ ID NO: 2270484 - RNA, 22 nt, Human
gagacugcuucccauccuaccc

SEQ ID NO: 2270485 - RNA, 23 nt, Human
gagacugcgggaugguccugggg

SEQ ID NO: 2270486 - RNA, 22 nt, Human
gagacugcgggaugguccuggg

SEQ ID NO: 2270487 - RNA, 23 nt, Human
gagaccaguugggagcacuggag

SEQ ID NO: 2270488 - RNA, 23 nt, Human
gagacugucucaagagggcacug

SEQ ID NO: 2270489 - RNA, 16 nt, Human
gagacuggagcaucug

SEQ ID NO: 2270490 - RNA, 23 nt, Human
gagacugcuucccauccuacccu

SEQ ID NO: 2270491 - RNA, 12 nt, Human
gagacuggagca

SEQ ID NO: 2270492 - RNA, 17 nt, Human
gagacuguuuugaauuu

SEQ ID NO: 2270493 - RNA, 18 nt, Human
gagacuuagggcaccagg

SEQ ID NO: 2270494 - RNA, 21 nt, Human
gagacuuagggcaccaggggu

SEQ ID NO: 2270495 - RNA, 13 nt, Human
gagacuuguauga

SEQ ID NO: 2270496 - RNA, 14 nt, Human
gagacuugcucucu

SEQ ID NO: 2270497 - RNA, 20 nt, Human
gagacuuccaaaccugacag

SEQ ID NO: 2270498 - RNA, 18 nt, Human
gagacauuccugggcaca

SEQ ID NO: 2270499 - RNA, 14 nt, Human
gagacaugugacau

SEQ ID NO: 2270500 - RNA, 15 nt, Human
gagaccaaccugacc

SEQ ID NO: 2270501 - RNA, 14 nt, Human
gagaccaaccugac

SEQ ID NO: 2270502 - RNA, 19 nt, Human
gagacauuccugggcacag

SEQ ID NO: 2270503 - RNA, 13 nt, Human
gagacaugugaca

SEQ ID NO: 2270504 - RNA, 21 nt, Human
gagacauacuugaagggccag

SEQ ID NO: 2270505 - RNA, 20 nt, Human
gagacauacuugaagggcca

SEQ ID NO: 2270506 - RNA, 18 nt, Human
gagacauacuugaagggc

SEQ ID NO: 2270507 - RNA, 15 nt, Human
gagacauacuugaag

SEQ ID NO: 2270508 - RNA, 13 nt, Human
gagacagccccag

SEQ ID NO: 2270509 - RNA, 14 nt, Human
gagacagccccaga

SEQ ID NO: 2270510 - RNA, 15 nt, Human
gagacagccccagag

SEQ ID NO: 2270511 - RNA, 18 nt, Human
gagacagccccagagcag

SEQ ID NO: 2270512 - RNA, 19 nt, Human
gagacagccccagagcagg

SEQ ID NO: 2270513 - RNA, 21 nt, Human
gagacaguuucuuagcuuuuu

SEQ ID NO: 2270514 - RNA, 22 nt, Human
gagacaguuucuuagcuuuuua

SEQ ID NO: 2270515 - RNA, 24 nt, Human
gagacagcccgggcucugccuccc

SEQ ID NO: 2270516 - RNA, 13 nt, Human
gagacagcucugc

SEQ ID NO: 2270517 - RNA, 18 nt, Human
gagacagcucugcauacu

SEQ ID NO: 2270518 - RNA, 15 nt, Human
gagacagcucugcau

SEQ ID NO: 2270519 - RNA, 14 nt, Human
gagacagcccgggc

SEQ ID NO: 2270520 - RNA, 17 nt, Human
gagacagcccgggcucu

SEQ ID NO: 2270521 - RNA, 18 nt, Human
gagacagcccgggcucug

SEQ ID NO: 2270522 - RNA, 19 nt, Human
gagacagcccgggcucugc

SEQ ID NO: 2270523 - RNA, 20 nt, Human
gagacagcccgggcucugcc

SEQ ID NO: 2270524 - RNA, 21 nt, Human
gagacagcccgggcucugccu

SEQ ID NO: 2270525 - RNA, 22 nt, Human
gagacagcccgggcucugccuc

SEQ ID NO: 2270526 - RNA, 23 nt, Human
gagacagcccgggcucugccucc

SEQ ID NO: 2270527 - RNA, 14 nt, Human
gacuccggcccucc

SEQ ID NO: 2270528 - RNA, 15 nt, Human
gacucgggcuccugu

SEQ ID NO: 2270529 - RNA, 16 nt, Human
gacucgggcuccugug

SEQ ID NO: 2270530 - RNA, 17 nt, Human
gacucgggcuccugugc

SEQ ID NO: 2270531 - RNA, 18 nt, Human
gacucgggcuccugugcc

SEQ ID NO: 2270532 - RNA, 19 nt, Human
gacucgcgacaaugcaaac

SEQ ID NO: 2270533 - RNA, 17 nt, Human
gacuccugcaggcagcc

SEQ ID NO: 2270534 - RNA, 18 nt, Human
gacucgcgacaaugcaaa

SEQ ID NO: 2270535 - RNA, 14 nt, Human
gacuuggaagcucc

SEQ ID NO: 2270536 - RNA, 16 nt, Human
gacucgggggugggga

SEQ ID NO: 2270537 - RNA, 14 nt, Human
gacucggggguggg

SEQ ID NO: 2270538 - RNA, 19 nt, Human
gacucgggcuccugugccc

SEQ ID NO: 2270539 - RNA, 20 nt, Human
gacucgggcuccugugcccu

SEQ ID NO: 2270540 - RNA, 15 nt, Human
gacuuggaagcuccg

SEQ ID NO: 2270541 - RNA, 16 nt, Human
gacuuggaagcuccgc

SEQ ID NO: 2270542 - RNA, 18 nt, Human
gacuuguuuuaugcucag

SEQ ID NO: 2270543 - RNA, 15 nt, Human
gacuuguuuuugcac

SEQ ID NO: 2270544 - RNA, 16 nt, Human
gacuuguuuuugcaca

SEQ ID NO: 2270545 - RNA, 18 nt, Human
gagaaaauaaaaaguuaa

SEQ ID NO: 2270546 - RNA, 21 nt, Human
gagaaaauggacguguuauga

SEQ ID NO: 2270547 - RNA, 14 nt, Human
gagaaacagagaca

SEQ ID NO: 2270548 - RNA, 13 nt, Human
gagaaacagagac

SEQ ID NO: 2270549 - RNA, 17 nt, Human
gagaaacaauaaagaga

SEQ ID NO: 2270550 - RNA, 18 nt, Human
gagaaaauccccauugaa

SEQ ID NO: 2270551 - RNA, 19 nt, Human
gagaaaauaaaaaguuaaa

SEQ ID NO: 2270552 - RNA, 16 nt, Human
gacuugugucucugug

SEQ ID NO: 2270553 - RNA, 13 nt, Human
gacuugugucucu

SEQ ID NO: 2270554 - RNA, 13 nt, Human
gacuuguguccca

SEQ ID NO: 2270555 - RNA, 18 nt, Human
gacuugugucccaugauc

SEQ ID NO: 2270556 - RNA, 13 nt, Human
gacucgguuucuc

SEQ ID NO: 2270557 - RNA, 19 nt, Human
gacuuguauauuuuaagaa

SEQ ID NO: 2270558 - RNA, 19 nt, Human
gagaaacagagacaggccc

SEQ ID NO: 2270559 - RNA, 12 nt, Human
gagaaacccugu

SEQ ID NO: 2270560 - RNA, 21 nt, Human
gagaaaccuuauuguaccucu

SEQ ID NO: 2270561 - RNA, 23 nt, Human
gagaaaccuuauuguaccucucu

SEQ ID NO: 2270562 - RNA, 17 nt, Human
gagaaacucuugagauc

SEQ ID NO: 2270563 - RNA, 18 nt, Human
gagaaagacuauucaaac

SEQ ID NO: 2270564 - RNA, 17 nt, Human
gagaaagacuauucaaa

SEQ ID NO: 2270565 - RNA, 15 nt, Human
gagaaagacuauuca

SEQ ID NO: 2270566 - RNA, 13 nt, Human
gagaaagacuauu

SEQ ID NO: 2270567 - RNA, 19 nt, Human
gagaaccacuacaugcagc

SEQ ID NO: 2270568 - RNA, 18 nt, Human
gagaaccaaaucuggaag

SEQ ID NO: 2270569 - RNA, 13 nt, Human
gagaaccaaaucu

SEQ ID NO: 2270570 - RNA, 17 nt, Human
gagaaccaaaucuggaa

SEQ ID NO: 2270571 - RNA, 22 nt, Human
gagaacacagccgauucaccug

SEQ ID NO: 2270572 - RNA, 14 nt, Human
gagaaauuuauaaa

SEQ ID NO: 2270573 - RNA, 17 nt, Human
gagaacaaacagaucga

SEQ ID NO: 2270574 - RNA, 18 nt, Human
gagaaagugugagcaaac

SEQ ID NO: 2270575 - RNA, 16 nt, Human
gagaaagaggaagcuu

SEQ ID NO: 2270576 - RNA, 20 nt, Human
gagaaagugauuucuagaaa

SEQ ID NO: 2270577 - RNA, 23 nt, Human
gagaaauaaaguuugcuuagaaa

SEQ ID NO: 2270578 - RNA, 20 nt, Human
gagaaauauggacacuuaau

SEQ ID NO: 2270579 - RNA, 18 nt, Human
gagaaagaaguaggcaug

SEQ ID NO: 2270580 - RNA, 18 nt, Human
gagaaagagcacuuaaga

SEQ ID NO: 2270581 - RNA, 19 nt, Human
gagaaagagcacuuaagag

SEQ ID NO: 2270582 - RNA, 13 nt, Human
gagaaagaagaga

SEQ ID NO: 2270583 - RNA, 18 nt, Human
gagaaagaagagacagga

SEQ ID NO: 2270584 - RNA, 23 nt, Human
gagaaaguacuucuccacccugc

SEQ ID NO: 2270585 - RNA, 23 nt, Human
gagaagcaagaaagaaacccgac

SEQ ID NO: 2270586 - RNA, 16 nt, Human
gagaagagggccugug

SEQ ID NO: 2270587 - RNA, 19 nt, Human
gagaagagggccuguggga

SEQ ID NO: 2270588 - RNA, 13 nt, Human
gagaagaggcugg

SEQ ID NO: 2270589 - RNA, 21 nt, Human
gagaagaggcuggugcugugg

SEQ ID NO: 2270590 - RNA, 14 nt, Human
gagaagagggccug

SEQ ID NO: 2270591 - RNA, 15 nt, Human
gagaagagggccugu

SEQ ID NO: 2270592 - RNA, 22 nt, Human
gagaagagcuguucacagccag

SEQ ID NO: 2270593 - RNA, 15 nt, Human
gagaagagcuguuca

SEQ ID NO: 2270594 - RNA, 13 nt, Human
gagaagaacugaa

SEQ ID NO: 2270595 - RNA, 14 nt, Human
gagaagaacugaaa

SEQ ID NO: 2270596 - RNA, 16 nt, Human
gagaagaacugaaauc

SEQ ID NO: 2270597 - RNA, 20 nt, Human
gagaacccugcguggggaca

SEQ ID NO: 2270598 - RNA, 21 nt, Human
gagaacccugcguggggacag

SEQ ID NO: 2270599 - RNA, 20 nt, Human
gagaaccgagcaaagaucaa

SEQ ID NO: 2270600 - RNA, 22 nt, Human
gagaaccgagcaaagaucaaaa

SEQ ID NO: 2270601 - RNA, 23 nt, Human
gagaaccgagcaaagaucaaaau

SEQ ID NO: 2270602 - RNA, 16 nt, Human
gagaauucuuacaugu

SEQ ID NO: 2270603 - RNA, 17 nt, Human
gagaaugagggccaaga

SEQ ID NO: 2270604 - RNA, 13 nt, Human
gagaaugaggguc

SEQ ID NO: 2270605 - RNA, 13 nt, Human
gagaaugagccuc

SEQ ID NO: 2270606 - RNA, 22 nt, Human
gagaaugcacaaacagaggccg

SEQ ID NO: 2270607 - RNA, 20 nt, Human
gagaaugcacaaacagaggc

SEQ ID NO: 2270608 - RNA, 21 nt, Human
gagaaugcacaaacagaggcc

SEQ ID NO: 2270609 - RNA, 22 nt, Human
gagaagccagcuuuccucauca

SEQ ID NO: 2270610 - RNA, 12 nt, Human
gagaagccagga

SEQ ID NO: 2270611 - RNA, 23 nt, Human
gagaagccaggaauuucccagga

SEQ ID NO: 2270612 - RNA, 22 nt, Human
gagaagccaggaauuucccagg

SEQ ID NO: 2270613 - RNA, 20 nt, Human
gagaagccagugcggcaggu

SEQ ID NO: 2270614 - RNA, 11 nt, Human
gagaagccauu

SEQ ID NO: 2270615 - RNA, 15 nt, Human
gagaagccauugucu

SEQ ID NO: 2270616 - RNA, 20 nt, Human
gagaagccauugucuucgga

SEQ ID NO: 2270617 - RNA, 15 nt, Human
gagaagccccuuccc

SEQ ID NO: 2270618 - RNA, 21 nt, Human
gagaagccccuuccccauggg

SEQ ID NO: 2270619 - RNA, 22 nt, Human
gagaagccccuuccccauggga

SEQ ID NO: 2270620 - RNA, 14 nt, Human
gagaagcccgugug

SEQ ID NO: 2270621 - RNA, 15 nt, Human
gagaagcccguguga

SEQ ID NO: 2270622 - RNA, 16 nt, Human
gagaagcccgugugag

SEQ ID NO: 2270623 - RNA, 18 nt, Human
gagacaaaucuaugccac

SEQ ID NO: 2270624 - RNA, 20 nt, Human
gagacacaacaacuccuagg

SEQ ID NO: 2270625 - RNA, 18 nt, Human
gagacacacugaagaagc

SEQ ID NO: 2270626 - RNA, 15 nt, Human
gagacacaagccuuc

SEQ ID NO: 2270627 - RNA, 17 nt, Human
gagacacaagccuucgg

SEQ ID NO: 2270628 - RNA, 16 nt, Human
gagacaaauggaggcc

SEQ ID NO: 2270629 - RNA, 17 nt, Human
gagacaagaaaucccug

SEQ ID NO: 2270630 - RNA, 19 nt, Human
gagacaaacaccucccagg

SEQ ID NO: 2270631 - RNA, 22 nt, Human
gagacaaacaccucccaggaga

SEQ ID NO: 2270632 - RNA, 20 nt, Human
gagacaaacaccucccagga

SEQ ID NO: 2270633 - RNA, 21 nt, Human
gagaauuguaucauuugaaca

SEQ ID NO: 2270634 - RNA, 15 nt, Human
gagaauuguaucauu

SEQ ID NO: 2270635 - RNA, 17 nt, Human
gagaauugggauuacau

SEQ ID NO: 2270636 - RNA, 16 nt, Human
gagaauuuuaaauuau

SEQ ID NO: 2270637 - RNA, 15 nt, Human
gagaauuuuaaauua

SEQ ID NO: 2270638 - RNA, 21 nt, Human
gagaauuucuaccauuucaga

SEQ ID NO: 2270639 - RNA, 22 nt, Human
gagaauucuuacauguuuucuu

SEQ ID NO: 2270640 - RNA, 18 nt, Human
gagaauucuuacauguuu

SEQ ID NO: 2270641 - RNA, 18 nt, Human
gagaauugcuugaaccca

SEQ ID NO: 2270642 - RNA, 14 nt, Human
gagaauugggggcu

SEQ ID NO: 2270643 - RNA, 22 nt, Human
gagacagagaggacgugggcgg

SEQ ID NO: 2270644 - RNA, 16 nt, Human
gagacagaagcaggcu

SEQ ID NO: 2270645 - RNA, 17 nt, Human
gagacacuggccccuca

SEQ ID NO: 2270646 - RNA, 17 nt, Human
gagacacuugccuucuu

SEQ ID NO: 2270647 - RNA, 12 nt, Human
gagacagaagca

SEQ ID NO: 2270648 - RNA, 15 nt, Human
gagacagaagcaggc

SEQ ID NO: 2270649 - RNA, 19 nt, Human
gagacaccugcaccucccc

SEQ ID NO: 2270650 - RNA, 18 nt, Human
gagacaccugcaccuccc

SEQ ID NO: 2270651 - RNA, 17 nt, Human
gagacaccugcaccucc

SEQ ID NO: 2270652 - RNA, 15 nt, Human
gagacaccugcaccu

SEQ ID NO: 2270653 - RNA, 13 nt, Human
gagacaccugcac

SEQ ID NO: 2270654 - RNA, 20 nt, Human
gagacacuaacgacuucagg

SEQ ID NO: 2270655 - RNA, 15 nt, Human
gagacacuggccccu

SEQ ID NO: 2270656 - RNA, 21 nt, Human
gagacaccugcaccucccccc

SEQ ID NO: 2270657 - RNA, 20 nt, Human
gagacaccugcaccuccccc

SEQ ID NO: 2270658 - RNA, 16 nt, Human
gagacacggagcccag

SEQ ID NO: 2270659 - RNA, 19 nt, Human
gagacagaguuuucacucu

SEQ ID NO: 2270660 - RNA, 14 nt, Human
gagacagagcuggu

SEQ ID NO: 2270661 - RNA, 16 nt, Human
gagacagccaacuaug

SEQ ID NO: 2270662 - RNA, 12 nt, Human
gagacagcccgg

SEQ ID NO: 2270663 - RNA, 23 nt, Human
gaacuuucucuucauacuuuuuu

SEQ ID NO: 2270664 - RNA, 21 nt, Human
gaacuuucucuucauacuuuu

SEQ ID NO: 2270665 - RNA, 14 nt, Human
gaacuuugaaggac

SEQ ID NO: 2270666 - RNA, 17 nt, Human
gaagaaagagaaggagc

SEQ ID NO: 2270667 - RNA, 18 nt, Human
gaagaaaggccaucagag

SEQ ID NO: 2270668 - RNA, 21 nt, Human
gaagaaaggccaucagagcaa

SEQ ID NO: 2270669 - RNA, 17 nt, Human
gaagaaaggguguuuuu

SEQ ID NO: 2270670 - RNA, 22 nt, Human
gaacuuugaccucugcagcaau

SEQ ID NO: 2270671 - RNA, 16 nt, Human
gaacuuugaccucugc

SEQ ID NO: 2270672 - RNA, 18 nt, Human
gaagaagcuuaggcaggg

SEQ ID NO: 2270673 - RNA, 16 nt, Human
gaagaagcuuaggcag

SEQ ID NO: 2270674 - RNA, 17 nt, Human
gaagaagcuuaggcagg

SEQ ID NO: 2270675 - RNA, 14 nt, Human
gaagaagcucucuc

SEQ ID NO: 2270676 - RNA, 20 nt, Human
gaagaacauccaaggagaaa

SEQ ID NO: 2270677 - RNA, 17 nt, Human
gaagaacauccaaggag

SEQ ID NO: 2270678 - RNA, 16 nt, Human
gaagaacauccaagga

SEQ ID NO: 2270679 - RNA, 13 nt, Human
gaagaacauagaa

SEQ ID NO: 2270680 - RNA, 13 nt, Human
gaagaaccagucc

SEQ ID NO: 2270681 - RNA, 22 nt, Human
gaagaacaucuuuaugguaaag

SEQ ID NO: 2270682 - RNA, 18 nt, Human
gaagaaaucacagaauca

SEQ ID NO: 2270683 - RNA, 22 nt, Human
gaagaaaucacagaaucauaug

SEQ ID NO: 2270684 - RNA, 15 nt, Human
gaagaaaguggaaaa

SEQ ID NO: 2270685 - RNA, 21 nt, Human
gaagaaaggguguuuuucugu

SEQ ID NO: 2270686 - RNA, 15 nt, Human
gaagaaaucacagaa

SEQ ID NO: 2270687 - RNA, 14 nt, Human
gaagaaauuccugu

SEQ ID NO: 2270688 - RNA, 15 nt, Human
gaagaaauuccugua

SEQ ID NO: 2270689 - RNA, 18 nt, Human
gaagaacacccucuaaau

SEQ ID NO: 2270690 - RNA, 18 nt, Human
gaagaaauuccuguagca

SEQ ID NO: 2270691 - RNA, 22 nt, Human
gaagaaauuccuguagcaucuu

SEQ ID NO: 2270692 - RNA, 24 nt, Human
gaacuuuccacauucagagcuuac

SEQ ID NO: 2270693 - RNA, 14 nt, Human
gaacuuucauuuuu

SEQ ID NO: 2270694 - RNA, 23 nt, Human
gaacuuucauuuuuuuccaggcu

SEQ ID NO: 2270695 - RNA, 17 nt, Human
gaacuuuccaggaaggc

SEQ ID NO: 2270696 - RNA, 15 nt, Human
gaacuuguuuucugg

SEQ ID NO: 2270697 - RNA, 12 nt, Human
gaacuuucauuu

SEQ ID NO: 2270698 - RNA, 13 nt, Human
gaacuuucauuuu

SEQ ID NO: 2270699 - RNA, 17 nt, Human
gaacuugggccacugug

SEQ ID NO: 2270700 - RNA, 18 nt, Human
gaacuuggcgcugccccu

SEQ ID NO: 2270701 - RNA, 17 nt, Human
gaacuuggggaacaagg

SEQ ID NO: 2270702 - RNA, 22 nt, Human
gaacuuggggaguuaagaccug

SEQ ID NO: 2270703 - RNA, 22 nt, Human
gaacuuguaaaggaauuuaaaa

SEQ ID NO: 2270704 - RNA, 18 nt, Human
gaacuuaaauaaauguca

SEQ ID NO: 2270705 - RNA, 15 nt, Human
gaacuuaaauaaaug

SEQ ID NO: 2270706 - RNA, 13 nt, Human
gaacuuaaaauga

SEQ ID NO: 2270707 - RNA, 23 nt, Human
gaacuucgcaucaaaagacaauu

SEQ ID NO: 2270708 - RNA, 13 nt, Human
gaacuucuaauau

SEQ ID NO: 2270709 - RNA, 15 nt, Human
gaacuucuaauauau

SEQ ID NO: 2270710 - RNA, 17 nt, Human
gaacuuaaauaauguga

SEQ ID NO: 2270711 - RNA, 20 nt, Human
gaacuguuguauaaauuuau

SEQ ID NO: 2270712 - RNA, 16 nt, Human
gaacuguuguauaaau

SEQ ID NO: 2270713 - RNA, 15 nt, Human
gaacuguuguauaaa

SEQ ID NO: 2270714 - RNA, 14 nt, Human
gaacuguuguauaa

SEQ ID NO: 2270715 - RNA, 14 nt, Human
gaacuuaaauaaug

SEQ ID NO: 2270716 - RNA, 14 nt, Human
gaacuucuaauaua

SEQ ID NO: 2270717 - RNA, 17 nt, Human
gaacuucucucagacuu

SEQ ID NO: 2270718 - RNA, 17 nt, Human
gaacuuggcgcugcccc

SEQ ID NO: 2270719 - RNA, 15 nt, Human
gaacuccuaaaucaa

SEQ ID NO: 2270720 - RNA, 16 nt, Human
gaacucccuuucaaca

SEQ ID NO: 2270721 - RNA, 17 nt, Human
gaacugugccuuugagu

SEQ ID NO: 2270722 - RNA, 13 nt, Human
gaaccaauauuug

SEQ ID NO: 2270723 - RNA, 20 nt, Human
gaacuguguuucaaguucaa

SEQ ID NO: 2270724 - RNA, 13 nt, Human
gaacuguuguaua

SEQ ID NO: 2270725 - RNA, 16 nt, Human
gaacuccuaaaucaag

SEQ ID NO: 2270726 - RNA, 13 nt, Human
gaacuccugaccu

SEQ ID NO: 2270727 - RNA, 24 nt, Human
gaaccaaguggaccuugagaccac

SEQ ID NO: 2270728 - RNA, 23 nt, Human
gaaccaaguggaccuugagacca

SEQ ID NO: 2270729 - RNA, 20 nt, Human
gaaccacaucuugcucugcu

SEQ ID NO: 2270730 - RNA, 18 nt, Human
gaaccacaucuugcucug

SEQ ID NO: 2270731 - RNA, 14 nt, Human
gaaccacaagacug

SEQ ID NO: 2270732 - RNA, 15 nt, Human
gaaccacaagacugc

SEQ ID NO: 2270733 - RNA, 15 nt, Human
gaagaucuuaaauuu

SEQ ID NO: 2270734 - RNA, 18 nt, Human
gaagaucguuaguaucua

SEQ ID NO: 2270735 - RNA, 13 nt, Human
gaagauccuaccc

SEQ ID NO: 2270736 - RNA, 14 nt, Human
gaagauccugcggg

SEQ ID NO: 2270737 - RNA, 22 nt, Human
gaagauccugcggguggggcuu

SEQ ID NO: 2270738 - RNA, 21 nt, Human
gaagaucauauacgugaaaau

SEQ ID NO: 2270739 - RNA, 16 nt, Human
gaagaucacgcucccc

SEQ ID NO: 2270740 - RNA, 17 nt, Human
gaagaucacgcuccccg

SEQ ID NO: 2270741 - RNA, 15 nt, Human
gaagauccccucagg

SEQ ID NO: 2270742 - RNA, 18 nt, Human
gaagaucacgcuccccgc

SEQ ID NO: 2270743 - RNA, 16 nt, Human
gaagauccccucagga

SEQ ID NO: 2270744 - RNA, 20 nt, Human
gaagauccccucaggacugc

SEQ ID NO: 2270745 - RNA, 17 nt, Human
gaagauccuaaaacaaa

SEQ ID NO: 2270746 - RNA, 18 nt, Human
gaagauaggcucugcaca

SEQ ID NO: 2270747 - RNA, 20 nt, Human
gaagauaggcucugcacaga

SEQ ID NO: 2270748 - RNA, 22 nt, Human
gaagauauaacuauugcccagg

SEQ ID NO: 2270749 - RNA, 14 nt, Human
gaagauaucuugaa

SEQ ID NO: 2270750 - RNA, 21 nt, Human
gaagauauaacuauugcccag

SEQ ID NO: 2270751 - RNA, 14 nt, Human
gaagauauuuuucc

SEQ ID NO: 2270752 - RNA, 16 nt, Human
gaagagugagagggca

SEQ ID NO: 2270753 - RNA, 14 nt, Human
gaagagugagaggg

SEQ ID NO: 2270754 - RNA, 18 nt, Human
gaagaguggguuucacaa

SEQ ID NO: 2270755 - RNA, 17 nt, Human
gaagaguggguuucaca

SEQ ID NO: 2270756 - RNA, 14 nt, Human
gaagaguguacugg

SEQ ID NO: 2270757 - RNA, 15 nt, Human
gaagaguguacuggg

SEQ ID NO: 2270758 - RNA, 17 nt, Human
gaagaguguacuggggg

SEQ ID NO: 2270759 - RNA, 17 nt, Human
gaagauucuccugugcu

SEQ ID NO: 2270760 - RNA, 12 nt, Human
gaagaugggggc

SEQ ID NO: 2270761 - RNA, 18 nt, Human
gaagaugggggcaagaag

SEQ ID NO: 2270762 - RNA, 17 nt, Human
gaagauguagaggagaa

SEQ ID NO: 2270763 - RNA, 13 nt, Human
gaagaugaucaga

SEQ ID NO: 2270764 - RNA, 16 nt, Human
gaagaugaucagaccu

SEQ ID NO: 2270765 - RNA, 21 nt, Human
gaagaugcagcaaaaugugaa

SEQ ID NO: 2270766 - RNA, 14 nt, Human
gaagaugaaucaau

SEQ ID NO: 2270767 - RNA, 13 nt, Human
gaagaugaaagag

SEQ ID NO: 2270768 - RNA, 17 nt, Human
gaagaugaaagaggagg

SEQ ID NO: 2270769 - RNA, 16 nt, Human
gaagauggcauccugu

SEQ ID NO: 2270770 - RNA, 20 nt, Human
gaagauggcauccugugaag

SEQ ID NO: 2270771 - RNA, 14 nt, Human
gaagaugcagcuca

SEQ ID NO: 2270772 - RNA, 13 nt, Human
gaagaugcagcuc

SEQ ID NO: 2270773 - RNA, 20 nt, Human
gaagauuugaugcuggagag

SEQ ID NO: 2270774 - RNA, 22 nt, Human
gaagauuugaugcuggagaggu

SEQ ID NO: 2270775 - RNA, 13 nt, Human
gaagauugugaau

SEQ ID NO: 2270776 - RNA, 14 nt, Human
gaagauucuuuccc

SEQ ID NO: 2270777 - RNA, 18 nt, Human
gaagcauuuacuuugugu

SEQ ID NO: 2270778 - RNA, 17 nt, Human
gaagauugagauguguu

SEQ ID NO: 2270779 - RNA, 22 nt, Human
gaagauugagauguguucacaa

SEQ ID NO: 2270780 - RNA, 16 nt, Human
gaagaguccucugaau

SEQ ID NO: 2270781 - RNA, 14 nt, Human
gaagaguccucuga

SEQ ID NO: 2270782 - RNA, 23 nt, Human
gaagaguaagucaaccugccuga

SEQ ID NO: 2270783 - RNA, 16 nt, Human
gaagaguagcauuuca

SEQ ID NO: 2270784 - RNA, 20 nt, Human
gaagaguagcauuucauucu

SEQ ID NO: 2270785 - RNA, 10 nt, Human
gaagaggacu

SEQ ID NO: 2270786 - RNA, 15 nt, Human
gaagaggaaaaugaa

SEQ ID NO: 2270787 - RNA, 18 nt, Human
gaagaggaaaaugaauaa

SEQ ID NO: 2270788 - RNA, 14 nt, Human
gaagaggaaaauga

SEQ ID NO: 2270789 - RNA, 23 nt, Human
gaagagcuguucacagccagacu

SEQ ID NO: 2270790 - RNA, 17 nt, Human
gaagagcuauuauauaa

SEQ ID NO: 2270791 - RNA, 13 nt, Human
gaagagcuguuca

SEQ ID NO: 2270792 - RNA, 20 nt, Human
gaagagcuguucacagccag

SEQ ID NO: 2270793 - RNA, 15 nt, Human
gaagagcuguucaca

SEQ ID NO: 2270794 - RNA, 12 nt, Human
gaagagccuugc

SEQ ID NO: 2270795 - RNA, 19 nt, Human
gaagaauacaaacauauuu

SEQ ID NO: 2270796 - RNA, 18 nt, Human
gaagaauacaaacauauu

SEQ ID NO: 2270797 - RNA, 16 nt, Human
gaagagccggagccuc

SEQ ID NO: 2270798 - RNA, 18 nt, Human
gaagagccugcaggugcu

SEQ ID NO: 2270799 - RNA, 17 nt, Human
gaagacuucaucccucu

SEQ ID NO: 2270800 - RNA, 19 nt, Human
gaagacuucaucccucugg

SEQ ID NO: 2270801 - RNA, 15 nt, Human
gaagacuucaucccu

SEQ ID NO: 2270802 - RNA, 16 nt, Human
gaagacuucaucccuc

SEQ ID NO: 2270803 - RNA, 13 nt, Human
gaagaaguguguc

SEQ ID NO: 2270804 - RNA, 14 nt, Human
gaagaagucagaga

SEQ ID NO: 2270805 - RNA, 16 nt, Human
gaagaagggcacccua

SEQ ID NO: 2270806 - RNA, 18 nt, Human
gaagaagggagaagaaag

SEQ ID NO: 2270807 - RNA, 19 nt, Human
gaagaagggagaagaaagg

SEQ ID NO: 2270808 - RNA, 14 nt, Human
gaagaagggagaag

SEQ ID NO: 2270809 - RNA, 15 nt, Human
gaagaagggagaaga

SEQ ID NO: 2270810 - RNA, 16 nt, Human
gaagaagggagaagaa

SEQ ID NO: 2270811 - RNA, 17 nt, Human
gaagaagggagaagaaa

SEQ ID NO: 2270812 - RNA, 23 nt, Human
gaaguccccaggccccaggaagc

SEQ ID NO: 2270813 - RNA, 17 nt, Human
gaaguccaauguggcaa

SEQ ID NO: 2270814 - RNA, 14 nt, Human
gaaguccaaugugg

SEQ ID NO: 2270815 - RNA, 23 nt, Human
gaaguccaagcauuuagauguau

SEQ ID NO: 2270816 - RNA, 16 nt, Human
gaaguccccaggcccc

SEQ ID NO: 2270817 - RNA, 17 nt, Human
gaaguccccaggcccca

SEQ ID NO: 2270818 - RNA, 22 nt, Human
gaaguccccuuccaucccagag

SEQ ID NO: 2270819 - RNA, 18 nt, Human
gaagucuuagauguauau

SEQ ID NO: 2270820 - RNA, 18 nt, Human
gaagucgucuuaacucac

SEQ ID NO: 2270821 - RNA, 13 nt, Human
gaagucagagagg

SEQ ID NO: 2270822 - RNA, 15 nt, Human
gaagucacugcacag

SEQ ID NO: 2270823 - RNA, 17 nt, Human
gaaguaagugggguugc

SEQ ID NO: 2270824 - RNA, 16 nt, Human
gaagucaaagcaagga

SEQ ID NO: 2270825 - RNA, 15 nt, Human
gaagucaaagcaagg

SEQ ID NO: 2270826 - RNA, 21 nt, Human
gaaguaauaugcacacauuuu

SEQ ID NO: 2270827 - RNA, 19 nt, Human
gaaguauuuugcuggaaua

SEQ ID NO: 2270828 - RNA, 13 nt, Human
gaagucacacagu

SEQ ID NO: 2270829 - RNA, 20 nt, Human
gaagucaagcccagccacgu

SEQ ID NO: 2270830 - RNA, 20 nt, Human
gaaguaauaugcacacauuu

SEQ ID NO: 2270831 - RNA, 19 nt, Human
gaaguaauaugcacacauu

SEQ ID NO: 2270832 - RNA, 14 nt, Human
gaaguaacaguaac

SEQ ID NO: 2270833 - RNA, 19 nt, Human
gaaguaaccauuugcacug

SEQ ID NO: 2270834 - RNA, 21 nt, Human
gaaggugaggagcuugaaacc

SEQ ID NO: 2270835 - RNA, 20 nt, Human
gaagggggccaugaggccuc

SEQ ID NO: 2270836 - RNA, 16 nt, Human
gaagggggauaugaau

SEQ ID NO: 2270837 - RNA, 14 nt, Human
gaagggggccauga

SEQ ID NO: 2270838 - RNA, 17 nt, Human
gaaggucaccugagccc

SEQ ID NO: 2270839 - RNA, 14 nt, Human
gaaggucaccagca

SEQ ID NO: 2270840 - RNA, 21 nt, Human
gaaggucacucuuccugcaag

SEQ ID NO: 2270841 - RNA, 22 nt, Human
gaagggggccaugaggccucag

SEQ ID NO: 2270842 - RNA, 14 nt, Human
gaaggucggaggcu

SEQ ID NO: 2270843 - RNA, 15 nt, Human
gaaggucggaggcuu

SEQ ID NO: 2270844 - RNA, 16 nt, Human
gaagguccugcuauua

SEQ ID NO: 2270845 - RNA, 23 nt, Human
gaaggucacucuuccugcaagga

SEQ ID NO: 2270846 - RNA, 18 nt, Human
gaaggucggaggcuuggg

SEQ ID NO: 2270847 - RNA, 21 nt, Human
gaaggcauaucagucucugag

SEQ ID NO: 2270848 - RNA, 22 nt, Human
gaaggcagggggaagguggggu

SEQ ID NO: 2270849 - RNA, 17 nt, Human
gaaggcaucagucccua

SEQ ID NO: 2270850 - RNA, 14 nt, Human
gaaggggccagagg

SEQ ID NO: 2270851 - RNA, 17 nt, Human
gaaggggccagaggcuc

SEQ ID NO: 2270852 - RNA, 16 nt, Human
gaaggggccagaggcu

SEQ ID NO: 2270853 - RNA, 23 nt, Human
gaaggggcccugguccuuccagg

SEQ ID NO: 2270854 - RNA, 22 nt, Human
gaaggggccucaccgagugggg

SEQ ID NO: 2270855 - RNA, 13 nt, Human
gaagggggauaug

SEQ ID NO: 2270856 - RNA, 21 nt, Human
gaaggggcgucuguucccccu

SEQ ID NO: 2270857 - RNA, 13 nt, Human
gaagggggcuggg

SEQ ID NO: 2270858 - RNA, 20 nt, Human
gaaggauguacauuuccaaa

SEQ ID NO: 2270859 - RNA, 17 nt, Human
gaaggauguacauuucc

SEQ ID NO: 2270860 - RNA, 16 nt, Human
gaaggauguacauuuc

SEQ ID NO: 2270861 - RNA, 15 nt, Human
gaaggauguacauuu

SEQ ID NO: 2270862 - RNA, 14 nt, Human
gaaggaugagcauu

SEQ ID NO: 2270863 - RNA, 13 nt, Human
gaaggauuguaaa

SEQ ID NO: 2270864 - RNA, 18 nt, Human
gaaggcagggagggccug

SEQ ID NO: 2270865 - RNA, 14 nt, Human
gaaggauuguaaaa

SEQ ID NO: 2270866 - RNA, 21 nt, Human
gaaggcagggggaaggugggg

SEQ ID NO: 2270867 - RNA, 23 nt, Human
gaaggcagggagggccugggccc

SEQ ID NO: 2270868 - RNA, 22 nt, Human
gaaggcagggagggccugggcc

SEQ ID NO: 2270869 - RNA, 20 nt, Human
gaaggcagggagggccuggg

SEQ ID NO: 2270870 - RNA, 22 nt, Human
gaaggaucuguuuuuaaaaauc

SEQ ID NO: 2270871 - RNA, 10 nt, Human
gaaggauccu

SEQ ID NO: 2270872 - RNA, 17 nt, Human
gaaggaggugagggaug

SEQ ID NO: 2270873 - RNA, 10 nt, Human
gaaggauccg

SEQ ID NO: 2270874 - RNA, 16 nt, Human
gaaggaugagcauuua

SEQ ID NO: 2270875 - RNA, 16 nt, Human
gaaggaugccaagaag

SEQ ID NO: 2270876 - RNA, 19 nt, Human
gaaggaggguuagggaggg

SEQ ID NO: 2270877 - RNA, 13 nt, Human
gaaggaggugagg

SEQ ID NO: 2270878 - RNA, 15 nt, Human
gaaggaggugaggga

SEQ ID NO: 2270879 - RNA, 14 nt, Human
gaaggaggcuggcu

SEQ ID NO: 2270880 - RNA, 18 nt, Human
gaaggaggaggaggaggu

SEQ ID NO: 2270881 - RNA, 13 nt, Human
gaagcauuuuaua

SEQ ID NO: 2270882 - RNA, 17 nt, Human
gaagcauuuuauaaauc

SEQ ID NO: 2270883 - RNA, 15 nt, Human
gaagcauuuuauaaa

SEQ ID NO: 2270884 - RNA, 18 nt, Human
gaagccaaaccucuguga

SEQ ID NO: 2270885 - RNA, 10 nt, Human
gaagccaaag

SEQ ID NO: 2270886 - RNA, 14 nt, Human
gaagccgcuggggc

SEQ ID NO: 2270887 - RNA, 13 nt, Human
gaagccaaagagu

SEQ ID NO: 2270888 - RNA, 15 nt, Human
gaagccaacuuggcu

SEQ ID NO: 2270889 - RNA, 17 nt, Human
gaagccaacuuggcuuu

SEQ ID NO: 2270890 - RNA, 12 nt, Human
gaagccaaagaa

SEQ ID NO: 2270891 - RNA, 13 nt, Human
gaagccaaagaaa

SEQ ID NO: 2270892 - RNA, 14 nt, Human
gaagccaaagaaaa

SEQ ID NO: 2270893 - RNA, 16 nt, Human
gaagccaaagaaaaau

SEQ ID NO: 2270894 - RNA, 15 nt, Human
gaagccugcaggagu

SEQ ID NO: 2270895 - RNA, 12 nt, Human
gaagccugcccu

SEQ ID NO: 2270896 - RNA, 13 nt, Human
gaagccugaggcu

SEQ ID NO: 2270897 - RNA, 12 nt, Human
gaagccugaggc

SEQ ID NO: 2270898 - RNA, 21 nt, Human
gaagccucugggucagugguc

SEQ ID NO: 2270899 - RNA, 18 nt, Human
gaagccaacuuggcuuuc

SEQ ID NO: 2270900 - RNA, 14 nt, Human
gaagccgcugcugg

SEQ ID NO: 2270901 - RNA, 13 nt, Human
gaagccucuggga

SEQ ID NO: 2270902 - RNA, 18 nt, Human
gaagccgcuggggccagu

SEQ ID NO: 2270903 - RNA, 20 nt, Human
gaagccgcuggggccaguug

SEQ ID NO: 2270904 - RNA, 15 nt, Human
gaagcuucagaaguu

SEQ ID NO: 2270905 - RNA, 22 nt, Human
gaagcuguuguacauuuaugau

SEQ ID NO: 2270906 - RNA, 16 nt, Human
gaagcuguuguacauu

SEQ ID NO: 2270907 - RNA, 18 nt, Human
gaagcuguuguacauuua

SEQ ID NO: 2270908 - RNA, 19 nt, Human
gaagcuguuguacauuuau

SEQ ID NO: 2270909 - RNA, 21 nt, Human
gaagcuguuguacauuuauga

SEQ ID NO: 2270910 - RNA, 19 nt, Human
gaaggaaacccagcucugg

SEQ ID NO: 2270911 - RNA, 20 nt, Human
gaaggaaacccagcucuggu

SEQ ID NO: 2270912 - RNA, 24 nt, Human
gaagcuguguccuugcaccugcau

SEQ ID NO: 2270913 - RNA, 13 nt, Human
gaagcuguuguac

SEQ ID NO: 2270914 - RNA, 23 nt, Human
gaagcuguguccuugcaccugca

SEQ ID NO: 2270915 - RNA, 14 nt, Human
gaagccuuagccag

SEQ ID NO: 2270916 - RNA, 16 nt, Human
gaagccugcccuuguc

SEQ ID NO: 2270917 - RNA, 13 nt, Human
gaagccuggaaca

SEQ ID NO: 2270918 - RNA, 22 nt, Human
gaagccuguuuuguuggaaggu

SEQ ID NO: 2270919 - RNA, 20 nt, Human
gaagccuguuuuguuggaag

SEQ ID NO: 2270920 - RNA, 19 nt, Human
gaaggacauugcggacagc

SEQ ID NO: 2270921 - RNA, 15 nt, Human
gaaggaauugacuuc

SEQ ID NO: 2270922 - RNA, 19 nt, Human
gaaggaauauauggcagag

SEQ ID NO: 2270923 - RNA, 20 nt, Human
gaaggaauauauggcagagu

SEQ ID NO: 2270924 - RNA, 22 nt, Human
gaaggaauaaauugcuccuuga

SEQ ID NO: 2270925 - RNA, 20 nt, Human
gaaggacauugcggacagcc

SEQ ID NO: 2270926 - RNA, 21 nt, Human
gaaggacauugcggacagcca

SEQ ID NO: 2270927 - RNA, 15 nt, Human
gaaggaggaggagga

SEQ ID NO: 2270928 - RNA, 16 nt, Human
gaaggacaaggcuaga

SEQ ID NO: 2270929 - RNA, 15 nt, Human
gaaggacacuuccug

SEQ ID NO: 2270930 - RNA, 18 nt, Human
gaaggacacuuccugccu

SEQ ID NO: 2270931 - RNA, 17 nt, Human
gaaggacacuuccugcc

SEQ ID NO: 2270932 - RNA, 16 nt, Human
gaaggaccacauuuua

SEQ ID NO: 2270933 - RNA, 20 nt, Human
gaaggaccacauuuuauauu

SEQ ID NO: 2270934 - RNA, 22 nt, Human
gaaggaccacauuuuauauuua

SEQ ID NO: 2270935 - RNA, 22 nt, Human
gaaggacccggaggggccuggc

SEQ ID NO: 2270936 - RNA, 16 nt, Human
gaaggaagugaagagg

SEQ ID NO: 2270937 - RNA, 23 nt, Human
gaaggaaggagacucaccucugc

SEQ ID NO: 2270938 - RNA, 22 nt, Human
gaaggaacucuggcuuccaggu

SEQ ID NO: 2270939 - RNA, 23 nt, Human
gaaggaacucuggcuuccaggua

SEQ ID NO: 2270940 - RNA, 15 nt, Human
gaaggaacucuggcu

SEQ ID NO: 2270941 - RNA, 20 nt, Human
gaaggaacucuggcuuccag

SEQ ID NO: 2270942 - RNA, 23 nt, Human
gaaggaaccaaagcgaauuuuaa

SEQ ID NO: 2270943 - RNA, 19 nt, Human
gaaggaagacuucaucccu

SEQ ID NO: 2270944 - RNA, 13 nt, Human
gaagcuuccaguc

SEQ ID NO: 2270945 - RNA, 16 nt, Human
gaagcuuccaguccaa

SEQ ID NO: 2270946 - RNA, 19 nt, Human
gaaggaaagaaagaaggaa

SEQ ID NO: 2270947 - RNA, 22 nt, Human
gaagcuucuggugaccuuccaa

SEQ ID NO: 2270948 - RNA, 15 nt, Human
gaaggaacguccccu

SEQ ID NO: 2270949 - RNA, 21 nt, Human
gaaggaaacccagcucugguc

SEQ ID NO: 2270950 - RNA, 22 nt, Human
gaaggaaacccagcucuggucc

SEQ ID NO: 2270951 - RNA, 16 nt, Human
gaaagugaaaguccag

SEQ ID NO: 2270952 - RNA, 19 nt, Human
gaaagugaagcaaaucaga

SEQ ID NO: 2270953 - RNA, 13 nt, Human
gaaagugaauuug

SEQ ID NO: 2270954 - RNA, 21 nt, Human
gaaagugauaucccccagccu

SEQ ID NO: 2270955 - RNA, 22 nt, Human
gaaagugauuucuagaaagccu

SEQ ID NO: 2270956 - RNA, 23 nt, Human
gaaagugaauuugaaugaaaaau

SEQ ID NO: 2270957 - RNA, 19 nt, Human
gaaagugaauuugaaugaa

SEQ ID NO: 2270958 - RNA, 17 nt, Human
gaaagugaauuugaaug

SEQ ID NO: 2270959 - RNA, 16 nt, Human
gaaagugaauuugaau

SEQ ID NO: 2270960 - RNA, 21 nt, Human
gaaaguggccaugccacccug

SEQ ID NO: 2270961 - RNA, 21 nt, Human
gaaagugggugagaugcugga

SEQ ID NO: 2270962 - RNA, 23 nt, Human
gaaagugggugagaugcuggaga

SEQ ID NO: 2270963 - RNA, 16 nt, Human
gaaaguggugcucagu

SEQ ID NO: 2270964 - RNA, 18 nt, Human
gaaaguggugcucaguug

SEQ ID NO: 2270965 - RNA, 20 nt, Human
gaaaguggugcucaguugua

SEQ ID NO: 2270966 - RNA, 12 nt, Human
gaaaguguaaag

SEQ ID NO: 2270967 - RNA, 13 nt, Human
gaaaguguaaagc

SEQ ID NO: 2270968 - RNA, 14 nt, Human
gaaaguguaaagca

SEQ ID NO: 2270969 - RNA, 15 nt, Human
gaaaguguaaagcau

SEQ ID NO: 2270970 - RNA, 16 nt, Human
gaaaguguaaagcauu

SEQ ID NO: 2270971 - RNA, 23 nt, Human
gaaaguguaaagcauuccaacaa

SEQ ID NO: 2270972 - RNA, 17 nt, Human
gaaaguuccuuauguau

SEQ ID NO: 2270973 - RNA, 19 nt, Human
gaaaguugcacggcugcug

SEQ ID NO: 2270974 - RNA, 20 nt, Human
gaaaguugcacggcugcuga

SEQ ID NO: 2270975 - RNA, 16 nt, Human
gaaaguuuacaggaaa

SEQ ID NO: 2270976 - RNA, 17 nt, Human
gaaaguuacaaauugcu

SEQ ID NO: 2270977 - RNA, 18 nt, Human
gaaaguugcacggcugcu

SEQ ID NO: 2270978 - RNA, 14 nt, Human
gaaaguuuacagga

SEQ ID NO: 2270979 - RNA, 18 nt, Human
gaaauaaaaccuuucaaa

SEQ ID NO: 2270980 - RNA, 17 nt, Human
gaaauaaaaccuuucaa

SEQ ID NO: 2270981 - RNA, 16 nt, Human
gaaauaaaaccuuuca

SEQ ID NO: 2270982 - RNA, 15 nt, Human
gaaauaaaaccuuuc

SEQ ID NO: 2270983 - RNA, 19 nt, Human
gaaauaaaaggaagccaaa

SEQ ID NO: 2270984 - RNA, 18 nt, Human
gaaauaaaaggaagccaa

SEQ ID NO: 2270985 - RNA, 17 nt, Human
gaaauaaaaggaagcca

SEQ ID NO: 2270986 - RNA, 16 nt, Human
gaaauaaaaggaagcc

SEQ ID NO: 2270987 - RNA, 22 nt, Human
gaaaguuuucagaaccucuucc

SEQ ID NO: 2270988 - RNA, 14 nt, Human
gaaauaaaaccuuu

SEQ ID NO: 2270989 - RNA, 13 nt, Human
gaaaggagacuag

SEQ ID NO: 2270990 - RNA, 23 nt, Human
gaaaggacucugggguuuuuacu

SEQ ID NO: 2270991 - RNA, 14 nt, Human
gaaaggagaggaaa

SEQ ID NO: 2270992 - RNA, 20 nt, Human
gaaaggauguaaacagugcc

SEQ ID NO: 2270993 - RNA, 16 nt, Human
gaaaggaguagaaaaa

SEQ ID NO: 2270994 - RNA, 15 nt, Human
gaaaggaguagaaaa

SEQ ID NO: 2270995 - RNA, 11 nt, Human
gaaaggagacu

SEQ ID NO: 2270996 - RNA, 21 nt, Human
gaaaggacucugggguuuuua

SEQ ID NO: 2270997 - RNA, 21 nt, Human
gaaaggaagugggacuggcac

SEQ ID NO: 2270998 - RNA, 18 nt, Human
gaaaggaagcuccacugu

SEQ ID NO: 2270999 - RNA, 22 nt, Human
gaaaggaagcuccacugucacc

SEQ ID NO: 2271000 - RNA, 14 nt, Human
gaaagucauuggcu

SEQ ID NO: 2271001 - RNA, 17 nt, Human
gaaagucauuggcuuua

SEQ ID NO: 2271002 - RNA, 18 nt, Human
gaaagucauuggcuuuau

SEQ ID NO: 2271003 - RNA, 21 nt, Human
gaaagucauuggcuuuauccu

SEQ ID NO: 2271004 - RNA, 22 nt, Human
gaaagucgaauuaauagcuuuu

SEQ ID NO: 2271005 - RNA, 20 nt, Human
gaaagucagaugcccagagg

SEQ ID NO: 2271006 - RNA, 17 nt, Human
gaaagucagaugcccag

SEQ ID NO: 2271007 - RNA, 16 nt, Human
gaaaggcauucucuga

SEQ ID NO: 2271008 - RNA, 22 nt, Human
gaaaggauguaaacagugccug

SEQ ID NO: 2271009 - RNA, 22 nt, Human
gaaaguacuucuccacccugcu

SEQ ID NO: 2271010 - RNA, 14 nt, Human
gaaaggauucaugu

SEQ ID NO: 2271011 - RNA, 17 nt, Human
gaaaggagaggaaagaa

SEQ ID NO: 2271012 - RNA, 16 nt, Human
gaaagccagugacucc

SEQ ID NO: 2271013 - RNA, 23 nt, Human
gaaagccaggcagguagccaggg

SEQ ID NO: 2271014 - RNA, 17 nt, Human
gaaagccagugacucca

SEQ ID NO: 2271015 - RNA, 19 nt, Human
gaaagccagugacuccagg

SEQ ID NO: 2271016 - RNA, 20 nt, Human
gaaagccagugacuccagga

SEQ ID NO: 2271017 - RNA, 14 nt, Human
gaaagccauuuguu

SEQ ID NO: 2271018 - RNA, 21 nt, Human
gaaagcuugcccuggugccuc

SEQ ID NO: 2271019 - RNA, 11 nt, Human
gaaaggaaaga

SEQ ID NO: 2271020 - RNA, 16 nt, Human
gaaaggaaagaggcuc

SEQ ID NO: 2271021 - RNA, 22 nt, Human
gaaagcauguggcauguucauc

SEQ ID NO: 2271022 - RNA, 14 nt, Human
gaaagccaccucuc

SEQ ID NO: 2271023 - RNA, 15 nt, Human
gaaagccaccucucc

SEQ ID NO: 2271024 - RNA, 18 nt, Human
gaaagccaccucucccuc

SEQ ID NO: 2271025 - RNA, 19 nt, Human
gaaagccaccucucccuca

SEQ ID NO: 2271026 - RNA, 20 nt, Human
gaaagccaccucucccucaa

SEQ ID NO: 2271027 - RNA, 11 nt, Human
gaaagccaggc

SEQ ID NO: 2271028 - RNA, 14 nt, Human
gaaagccaggcagg

SEQ ID NO: 2271029 - RNA, 18 nt, Human
gaaagcauuugaaugcau

SEQ ID NO: 2271030 - RNA, 20 nt, Human
gaaagcauuugaaugcauuu

SEQ ID NO: 2271031 - RNA, 21 nt, Human
gaaagcauuugaaugcauuuu

SEQ ID NO: 2271032 - RNA, 13 nt, Human
gaaagccaccucu

SEQ ID NO: 2271033 - RNA, 21 nt, Human
gaaagcauguggcauguucau

SEQ ID NO: 2271034 - RNA, 21 nt, Human
gaaagcacugcaugaauaaaa

SEQ ID NO: 2271035 - RNA, 12 nt, Human
gaaagcauuuga

SEQ ID NO: 2271036 - RNA, 15 nt, Human
gaaagcacagguggg

SEQ ID NO: 2271037 - RNA, 23 nt, Human
gaaagcacaggugggcuucccag

SEQ ID NO: 2271038 - RNA, 14 nt, Human
gaaagcauuugaau

SEQ ID NO: 2271039 - RNA, 15 nt, Human
gaaagcauuugaaug

SEQ ID NO: 2271040 - RNA, 16 nt, Human
gaaagcauuugaaugc

SEQ ID NO: 2271041 - RNA, 17 nt, Human
gaaagcauuugaaugca

SEQ ID NO: 2271042 - RNA, 23 nt, Human
gaaaccuuuuuuaagauuuuucu

SEQ ID NO: 2271043 - RNA, 21 nt, Human
gaaaccuuuuuuaagauuuuu

SEQ ID NO: 2271044 - RNA, 22 nt, Human
gaaaccuuuuuuaagauuuuuc

SEQ ID NO: 2271045 - RNA, 20 nt, Human
gaaacuaggugcauauuuau

SEQ ID NO: 2271046 - RNA, 18 nt, Human
gaaacucaccugcuggcc

SEQ ID NO: 2271047 - RNA, 21 nt, Human
gaaacucacccccaaggggca

SEQ ID NO: 2271048 - RNA, 20 nt, Human
gaaacucaccauguaaaaga

SEQ ID NO: 2271049 - RNA, 17 nt, Human
gaaacucaccauguaaa

SEQ ID NO: 2271050 - RNA, 19 nt, Human
gaaacuaggugcauauuua

SEQ ID NO: 2271051 - RNA, 23 nt, Human
gaaacucauaauagacuucccac

SEQ ID NO: 2271052 - RNA, 17 nt, Human
gaaacuccacaucugcc

SEQ ID NO: 2271053 - RNA, 18 nt, Human
gaaacuccacaucugccu

SEQ ID NO: 2271054 - RNA, 19 nt, Human
gaaacucuuuuugggcucc

SEQ ID NO: 2271055 - RNA, 14 nt, Human
gaaacugaaugcuc

SEQ ID NO: 2271056 - RNA, 22 nt, Human
gaaacucaccugcuggccccuc

SEQ ID NO: 2271057 - RNA, 21 nt, Human
gaaacucaccugcuggccccu

SEQ ID NO: 2271058 - RNA, 20 nt, Human
gaaacucaccugcuggcccc

SEQ ID NO: 2271059 - RNA, 19 nt, Human
gaaacucaccugcuggccc

SEQ ID NO: 2271060 - RNA, 22 nt, Human
gaaacucagagucggaacggag

SEQ ID NO: 2271061 - RNA, 23 nt, Human
gaaacucaccugcuggccccuca

SEQ ID NO: 2271062 - RNA, 16 nt, Human
gaaacuccacaucugc

SEQ ID NO: 2271063 - RNA, 15 nt, Human
gaaacugccagcaac

SEQ ID NO: 2271064 - RNA, 13 nt, Human
gaaacugccagca

SEQ ID NO: 2271065 - RNA, 22 nt, Human
gaaaaagcaguaacugacaacu

SEQ ID NO: 2271066 - RNA, 17 nt, Human
gaaaaagcacaagaagc

SEQ ID NO: 2271067 - RNA, 16 nt, Human
gaaaaagcacaagaag

SEQ ID NO: 2271068 - RNA, 20 nt, Human
gaaaaaugcccuuaaaucau

SEQ ID NO: 2271069 - RNA, 16 nt, Human
gaaaaaucuaagugau

SEQ ID NO: 2271070 - RNA, 18 nt, Human
gaaaaaugagagaaggga

SEQ ID NO: 2271071 - RNA, 20 nt, Human
gaaaaaucuaagugauauaa

SEQ ID NO: 2271072 - RNA, 16 nt, Human
gaaaaaugagccuggc

SEQ ID NO: 2271073 - RNA, 14 nt, Human
gaaaaauguguaau

SEQ ID NO: 2271074 - RNA, 13 nt, Human
gaaaaauguguaa

SEQ ID NO: 2271075 - RNA, 22 nt, Human
gaaaccuugguguaguugaacu

SEQ ID NO: 2271076 - RNA, 17 nt, Human
gaaaccuuuagggcagc

SEQ ID NO: 2271077 - RNA, 18 nt, Human
gaaaccuuuagggcagcu

SEQ ID NO: 2271078 - RNA, 17 nt, Human
gaaaccuugguguaguu

SEQ ID NO: 2271079 - RNA, 19 nt, Human
gaaaccuuuagggcagcuu

SEQ ID NO: 2271080 - RNA, 20 nt, Human
gaaaccuuuagggcagcuug

SEQ ID NO: 2271081 - RNA, 21 nt, Human
gaaaccuuuagggcagcuugc

SEQ ID NO: 2271082 - RNA, 14 nt, Human
gaaaccuuuuuuaa

SEQ ID NO: 2271083 - RNA, 17 nt, Human
gaaaccuuuuuuaagau

SEQ ID NO: 2271084 - RNA, 18 nt, Human
gaaaccuuuuuuaagauu

SEQ ID NO: 2271085 - RNA, 19 nt, Human
gaaaccuuuuuuaagauuu

SEQ ID NO: 2271086 - RNA, 20 nt, Human
gaaaccuuuuuuaagauuuu

SEQ ID NO: 2271087 - RNA, 14 nt, Human
gaaagcaauaaaug

SEQ ID NO: 2271088 - RNA, 23 nt, Human
gaaagauggcugugccucugccu

SEQ ID NO: 2271089 - RNA, 14 nt, Human
gaaagcagaacagu

SEQ ID NO: 2271090 - RNA, 13 nt, Human
gaaagcagaacag

SEQ ID NO: 2271091 - RNA, 16 nt, Human
gaaagaucaaaagguu

SEQ ID NO: 2271092 - RNA, 22 nt, Human
gaaagauggcugugccucugcc

SEQ ID NO: 2271093 - RNA, 14 nt, Human
gaaagauaacuagg

SEQ ID NO: 2271094 - RNA, 17 nt, Human
gaaagaugagcuuuucu

SEQ ID NO: 2271095 - RNA, 23 nt, Human
gaaagagcacuuaagagaauauu

SEQ ID NO: 2271096 - RNA, 16 nt, Human
gaaagagcacuuaaga

SEQ ID NO: 2271097 - RNA, 18 nt, Human
gaaagagcacuuaagaga

SEQ ID NO: 2271098 - RNA, 21 nt, Human
gaaagagcacuuaagagaaua

SEQ ID NO: 2271099 - RNA, 22 nt, Human
gaaagagcacuuaagagaauau

SEQ ID NO: 2271100 - RNA, 19 nt, Human
gaaagagagagaauucuuu

SEQ ID NO: 2271101 - RNA, 14 nt, Human
gaaagacugagcuc

SEQ ID NO: 2271102 - RNA, 11 nt, Human
gaaagagagaa

SEQ ID NO: 2271103 - RNA, 15 nt, Human
gaaagagagaaaaua

SEQ ID NO: 2271104 - RNA, 14 nt, Human
gaaagagagaaaau

SEQ ID NO: 2271105 - RNA, 13 nt, Human
gaaagagagaaaa

SEQ ID NO: 2271106 - RNA, 12 nt, Human
gaaagagagaaa

SEQ ID NO: 2271107 - RNA, 23 nt, Human
gaaagagagaaaauaaaaaguua

SEQ ID NO: 2271108 - RNA, 22 nt, Human
gaaagagagaaaauaaaaaguu

SEQ ID NO: 2271109 - RNA, 21 nt, Human
gaaagagagaaaauaaaaagu

SEQ ID NO: 2271110 - RNA, 20 nt, Human
gaaagagagaaaauaaaaag

SEQ ID NO: 2271111 - RNA, 18 nt, Human
gaaagagagaaaauaaaa

SEQ ID NO: 2271112 - RNA, 17 nt, Human
gaaagagagaaaauaaa

SEQ ID NO: 2271113 - RNA, 16 nt, Human
gaaagagagaaaauaa

SEQ ID NO: 2271114 - RNA, 15 nt, Human
gaaacugcagggaaa

SEQ ID NO: 2271115 - RNA, 22 nt, Human
gaaacugaggaauuuucuuugu

SEQ ID NO: 2271116 - RNA, 18 nt, Human
gaaacugaggaauuuucu

SEQ ID NO: 2271117 - RNA, 19 nt, Human
gaaagacuauucaaacagu

SEQ ID NO: 2271118 - RNA, 23 nt, Human
gaaagacuauucaaacagucuca

SEQ ID NO: 2271119 - RNA, 22 nt, Human
gaaagacuauucaaacagucuc

SEQ ID NO: 2271120 - RNA, 16 nt, Human
gaaaugagaucaggcu

SEQ ID NO: 2271121 - RNA, 17 nt, Human
gaaaugagaaggcagcc

SEQ ID NO: 2271122 - RNA, 18 nt, Human
gaaaugagaaggcagcca

SEQ ID NO: 2271123 - RNA, 19 nt, Human
gaaaugagaaggcagccac

SEQ ID NO: 2271124 - RNA, 18 nt, Human
gaaaugagaucaggcucu

SEQ ID NO: 2271125 - RNA, 11 nt, Human
gaaaugagcug

SEQ ID NO: 2271126 - RNA, 14 nt, Human
gaaaugaucaguuu

SEQ ID NO: 2271127 - RNA, 18 nt, Human
gaaaugaggucagagccu

SEQ ID NO: 2271128 - RNA, 23 nt, Human
gaaaugcauccauuccucaggga

SEQ ID NO: 2271129 - RNA, 20 nt, Human
gaaaugcauuauuuugaaug

SEQ ID NO: 2271130 - RNA, 16 nt, Human
gaaaugggcagagcag

SEQ ID NO: 2271131 - RNA, 15 nt, Human
gaaaugggcagagca

SEQ ID NO: 2271132 - RNA, 18 nt, Human
gaaauuacuacaaaauuu

SEQ ID NO: 2271133 - RNA, 16 nt, Human
gaaauguguuucugua

SEQ ID NO: 2271134 - RNA, 13 nt, Human
gaaauguguuucu

SEQ ID NO: 2271135 - RNA, 14 nt, Human
gaaauguguuucug

SEQ ID NO: 2271136 - RNA, 13 nt, Human
gaaaugcugccug

SEQ ID NO: 2271137 - RNA, 14 nt, Human
gaaaugcugccugc

SEQ ID NO: 2271138 - RNA, 17 nt, Human
gaaaugcugcauuuuaa

SEQ ID NO: 2271139 - RNA, 18 nt, Human
gaaaugcugauggauaac

SEQ ID NO: 2271140 - RNA, 17 nt, Human
gaaauguacagcaagga

SEQ ID NO: 2271141 - RNA, 17 nt, Human
gaaaugggcagagcaga

SEQ ID NO: 2271142 - RNA, 19 nt, Human
gaaaugggcagagcagaga

SEQ ID NO: 2271143 - RNA, 17 nt, Human
gaaauauauaugugugu

SEQ ID NO: 2271144 - RNA, 14 nt, Human
gaaauauauaugug

SEQ ID NO: 2271145 - RNA, 23 nt, Human
gaaauauauauguguguguaugu

SEQ ID NO: 2271146 - RNA, 20 nt, Human
gaaauaaaggaugugauugu

SEQ ID NO: 2271147 - RNA, 23 nt, Human
gaaauaucaguuacucagcccug

SEQ ID NO: 2271148 - RNA, 12 nt, Human
gaaauaucauuu

SEQ ID NO: 2271149 - RNA, 21 nt, Human
gaaauaucaguuacucagccc

SEQ ID NO: 2271150 - RNA, 20 nt, Human
gaaauaucaguuacucagcc

SEQ ID NO: 2271151 - RNA, 17 nt, Human
gaaauauaggaacuuaa

SEQ ID NO: 2271152 - RNA, 17 nt, Human
gaaauaaaggaugugau

SEQ ID NO: 2271153 - RNA, 23 nt, Human
gaaauaaaaggaagccaaagagu

SEQ ID NO: 2271154 - RNA, 19 nt, Human
gaaaugacuaaaaaacaaa

SEQ ID NO: 2271155 - RNA, 20 nt, Human
gaaaugaaugugugugguuu

SEQ ID NO: 2271156 - RNA, 15 nt, Human
gaaaugagaaggcag

SEQ ID NO: 2271157 - RNA, 14 nt, Human
gaaaugaccaauau

SEQ ID NO: 2271158 - RNA, 15 nt, Human
gaaaugaauuaaagu

SEQ ID NO: 2271159 - RNA, 12 nt, Human
gaaaugaauaua

SEQ ID NO: 2271160 - RNA, 13 nt, Human
gaaaugaaugugu

SEQ ID NO: 2271161 - RNA, 15 nt, Human
gaaaugaaugugugu

SEQ ID NO: 2271162 - RNA, 22 nt, Human
gaaauaucaguuacucagcccu

SEQ ID NO: 2271163 - RNA, 19 nt, Human
gaaauauuuagcaaauaau

SEQ ID NO: 2271164 - RNA, 15 nt, Human
gaaauauuuauuuua

SEQ ID NO: 2271165 - RNA, 16 nt, Human
gaaauauuuauuuuaa

SEQ ID NO: 2271166 - RNA, 19 nt, Human
gaaauaucugaaaauguau

SEQ ID NO: 2271167 - RNA, 18 nt, Human
gaaauaucugaaaaugua

SEQ ID NO: 2271168 - RNA, 13 nt, Human
gaaauaucauuua

SEQ ID NO: 2271169 - RNA, 14 nt, Human
gaaauaucauuuau

SEQ ID NO: 2271170 - RNA, 20 nt, Human
gaaauaucugaaaauguaug

SEQ ID NO: 2271171 - RNA, 13 nt, Human
gaaauauuuauuu

SEQ ID NO: 2271172 - RNA, 16 nt, Human
gaacauguacacuggu

SEQ ID NO: 2271173 - RNA, 16 nt, Human
gaaccaaaucuggaag

SEQ ID NO: 2271174 - RNA, 17 nt, Human
gaaccaaaucuggaagc

SEQ ID NO: 2271175 - RNA, 15 nt, Human
gaaccaacacuaaca

SEQ ID NO: 2271176 - RNA, 24 nt, Human
gaaccaacaaccucaacugccuac

SEQ ID NO: 2271177 - RNA, 19 nt, Human
gaaccaacaaguaaauauu

SEQ ID NO: 2271178 - RNA, 23 nt, Human
gaaccaaagcgaauuuuaaaaga

SEQ ID NO: 2271179 - RNA, 20 nt, Human
gaaccaaagcgaauuuuaaa

SEQ ID NO: 2271180 - RNA, 19 nt, Human
gaacaugugagagguuuga

SEQ ID NO: 2271181 - RNA, 22 nt, Human
gaacauggacuuguauauuugu

SEQ ID NO: 2271182 - RNA, 15 nt, Human
gaacauggagagcua

SEQ ID NO: 2271183 - RNA, 23 nt, Human
gaacaugaaaacagaaaacgguu

SEQ ID NO: 2271184 - RNA, 17 nt, Human
gaacaucuguccuguga

SEQ ID NO: 2271185 - RNA, 15 nt, Human
gaacaucccugccag

SEQ ID NO: 2271186 - RNA, 13 nt, Human
gaacauccuuccu

SEQ ID NO: 2271187 - RNA, 17 nt, Human
gaacauggacuuguaua

SEQ ID NO: 2271188 - RNA, 19 nt, Human
gaacauggacuuguauauu

SEQ ID NO: 2271189 - RNA, 14 nt, Human
gaacaucccugcca

SEQ ID NO: 2271190 - RNA, 14 nt, Human
gaacaguuuguaca

SEQ ID NO: 2271191 - RNA, 19 nt, Human
gaacauccuuccuucccac

SEQ ID NO: 2271192 - RNA, 21 nt, Human
gaacaguguuucccauaauuu

SEQ ID NO: 2271193 - RNA, 18 nt, Human
gaacaguguuucccauaa

SEQ ID NO: 2271194 - RNA, 17 nt, Human
gaacaguguuucccaua

SEQ ID NO: 2271195 - RNA, 16 nt, Human
gaacaguguuucccau

SEQ ID NO: 2271196 - RNA, 24 nt, Human
gaacaguuaccucugccucagaaa

SEQ ID NO: 2271197 - RNA, 12 nt, Human
gaacaguaaaca

SEQ ID NO: 2271198 - RNA, 14 nt, Human
gaacaguaacugcc

SEQ ID NO: 2271199 - RNA, 13 nt, Human
gaacaguaaacau

SEQ ID NO: 2271200 - RNA, 17 nt, Human
gaacagcuucagguuau

SEQ ID NO: 2271201 - RNA, 19 nt, Human
gaacaggcaagugaagaaa

SEQ ID NO: 2271202 - RNA, 14 nt, Human
gaaauuugauuucu

SEQ ID NO: 2271203 - RNA, 18 nt, Human
gaacagauaaucagugug

SEQ ID NO: 2271204 - RNA, 22 nt, Human
gaacagacuggaagcacagcuu

SEQ ID NO: 2271205 - RNA, 15 nt, Human
gaacagcuguaaucu

SEQ ID NO: 2271206 - RNA, 14 nt, Human
gaacagcuucaggu

SEQ ID NO: 2271207 - RNA, 15 nt, Human
gaacagcuucagguu

SEQ ID NO: 2271208 - RNA, 16 nt, Human
gaacagcuucagguua

SEQ ID NO: 2271209 - RNA, 19 nt, Human
gaaauuagcugugugaaau

SEQ ID NO: 2271210 - RNA, 13 nt, Human
gaaauuagggccc

SEQ ID NO: 2271211 - RNA, 16 nt, Human
gaaauuagcuguguga

SEQ ID NO: 2271212 - RNA, 21 nt, Human
gaaauuacuuaucauccacau

SEQ ID NO: 2271213 - RNA, 13 nt, Human
gaaauuagccggg

SEQ ID NO: 2271214 - RNA, 19 nt, Human
gaaauuacuacaaaauuug

SEQ ID NO: 2271215 - RNA, 23 nt, Human
gaaauuaguacuccccuccuuga

SEQ ID NO: 2271216 - RNA, 17 nt, Human
gaaauuauuuaauaaaa

SEQ ID NO: 2271217 - RNA, 17 nt, Human
gaaauucccuucaucug

SEQ ID NO: 2271218 - RNA, 13 nt, Human
gaaauuauuuaau

SEQ ID NO: 2271219 - RNA, 15 nt, Human
gaaauuauuuaauaa

SEQ ID NO: 2271220 - RNA, 18 nt, Human
gaaauuauguauguuuac

SEQ ID NO: 2271221 - RNA, 21 nt, Human
gaaauuauguauguuuacaua

SEQ ID NO: 2271222 - RNA, 13 nt, Human
gaaauuuccagag

SEQ ID NO: 2271223 - RNA, 12 nt, Human
gaaauuccugua

SEQ ID NO: 2271224 - RNA, 15 nt, Human
gaaauuccuguagca

SEQ ID NO: 2271225 - RNA, 22 nt, Human
gaaauucccuucaucuggaacc

SEQ ID NO: 2271226 - RNA, 21 nt, Human
gaaauucccuucaucuggaac

SEQ ID NO: 2271227 - RNA, 11 nt, Human
gaaauuugaau

SEQ ID NO: 2271228 - RNA, 20 nt, Human
gaacacuccaauuaaggauu

SEQ ID NO: 2271229 - RNA, 17 nt, Human
gaacacuccuucacaga

SEQ ID NO: 2271230 - RNA, 20 nt, Human
gaacagacuggaagcacagc

SEQ ID NO: 2271231 - RNA, 19 nt, Human
gaacagacuggaagcacag

SEQ ID NO: 2271232 - RNA, 15 nt, Human
gaacacuccuucaca

SEQ ID NO: 2271233 - RNA, 16 nt, Human
gaacacuccuucacag

SEQ ID NO: 2271234 - RNA, 23 nt, Human
cuuuuaacaccugauguguacau

SEQ ID NO: 2271235 - RNA, 22 nt, Human
cuuuuaaaggggcagaaaaacu

SEQ ID NO: 2271236 - RNA, 19 nt, Human
cuuuuaacaccugaugugu

SEQ ID NO: 2271237 - RNA, 20 nt, Human
cuuuuaacaccugaugugua

SEQ ID NO: 2271238 - RNA, 21 nt, Human
cuuuuaacaccugauguguac

SEQ ID NO: 2271239 - RNA, 16 nt, Human
cuuuuaauacagggua

SEQ ID NO: 2271240 - RNA, 22 nt, Human
cuuuuaauaaacuuuuuuuuga

SEQ ID NO: 2271241 - RNA, 14 nt, Human
cuuuuaaucagaca

SEQ ID NO: 2271242 - RNA, 23 nt, Human
cuuuuaaaggggcagaaaaacuc

SEQ ID NO: 2271243 - RNA, 22 nt, Human
cuuuuaaaagacaagacuucag

SEQ ID NO: 2271244 - RNA, 15 nt, Human
cuuuuaaacugugua

SEQ ID NO: 2271245 - RNA, 13 nt, Human
cuuuuaaacugug

SEQ ID NO: 2271246 - RNA, 12 nt, Human
cuuuuaaacugu

SEQ ID NO: 2271247 - RNA, 17 nt, Human
cuuuuaaaccauuuucu

SEQ ID NO: 2271248 - RNA, 14 nt, Human
cuuuuaaaagacaa

SEQ ID NO: 2271249 - RNA, 16 nt, Human
cuuuuaaaagacaaga

SEQ ID NO: 2271250 - RNA, 20 nt, Human
cuuuuaaaccucaccuuugu

SEQ ID NO: 2271251 - RNA, 16 nt, Human
cuuuggaccuaaucca

SEQ ID NO: 2271252 - RNA, 21 nt, Human
cuuuggaccuaaauggccuca

SEQ ID NO: 2271253 - RNA, 19 nt, Human
cuuuggagaccauuaucag

SEQ ID NO: 2271254 - RNA, 11 nt, Human
cuuuggaagga

SEQ ID NO: 2271255 - RNA, 16 nt, Human
cuuuggagaucaagga

SEQ ID NO: 2271256 - RNA, 23 nt, Human
cuuuggagaucaaggagaggagg

SEQ ID NO: 2271257 - RNA, 13 nt, Human
cuuuggagcuuuu

SEQ ID NO: 2271258 - RNA, 23 nt, Human
cuuuggagcuuuuuucuuuaaga

SEQ ID NO: 2271259 - RNA, 17 nt, Human
cuuuggaccuaauccaa

SEQ ID NO: 2271260 - RNA, 15 nt, Human
cuuuggaaggaguga

SEQ ID NO: 2271261 - RNA, 23 nt, Human
cuuuguuuuuuuuuccuguccuu

SEQ ID NO: 2271262 - RNA, 18 nt, Human
cuuuuaaaacacuuccau

SEQ ID NO: 2271263 - RNA, 16 nt, Human
cuuuguuuuuuuuucc

SEQ ID NO: 2271264 - RNA, 21 nt, Human
cuuuguuuuuuuuuccugucc

SEQ ID NO: 2271265 - RNA, 18 nt, Human
cuuuguuuuuaugaagaa

SEQ ID NO: 2271266 - RNA, 22 nt, Human
cuuuggaguccccucaccuccu

SEQ ID NO: 2271267 - RNA, 14 nt, Human
cuuuggaggccccu

SEQ ID NO: 2271268 - RNA, 14 nt, Human
cuuuggaguccccu

SEQ ID NO: 2271269 - RNA, 16 nt, Human
cuuuggaguccccuca

SEQ ID NO: 2271270 - RNA, 18 nt, Human
cuuuggaguccccucacc

SEQ ID NO: 2271271 - RNA, 21 nt, Human
cuuuucgcaggauucuuccuc

SEQ ID NO: 2271272 - RNA, 20 nt, Human
cuuuucgcaggauucuuccu

SEQ ID NO: 2271273 - RNA, 21 nt, Human
cuuuuccuuggggcaggcagu

SEQ ID NO: 2271274 - RNA, 17 nt, Human
cuuuuccuuggggcagg

SEQ ID NO: 2271275 - RNA, 13 nt, Human
cuuuuccuugggg

SEQ ID NO: 2271276 - RNA, 18 nt, Human
cuuuuccucucucccgga

SEQ ID NO: 2271277 - RNA, 14 nt, Human
cuuuucccuucuuu

SEQ ID NO: 2271278 - RNA, 16 nt, Human
cuuuucacugcuggcu

SEQ ID NO: 2271279 - RNA, 20 nt, Human
cuuuucacugcugcaaggcc

SEQ ID NO: 2271280 - RNA, 16 nt, Human
cuuuuccuauuuguuu

SEQ ID NO: 2271281 - RNA, 19 nt, Human
cuuuuccuauuuucagccc

SEQ ID NO: 2271282 - RNA, 20 nt, Human
cuuuuccuauuuucagccca

SEQ ID NO: 2271283 - RNA, 13 nt, Human
cuuuuccucccuu

SEQ ID NO: 2271284 - RNA, 15 nt, Human
cuuuuccucccuugg

SEQ ID NO: 2271285 - RNA, 23 nt, Human
cuuuuccucccuuggguucugau

SEQ ID NO: 2271286 - RNA, 16 nt, Human
cuuuuccucucucccg

SEQ ID NO: 2271287 - RNA, 12 nt, Human
cuuuucacugcu

SEQ ID NO: 2271288 - RNA, 19 nt, Human
cuuuucacucccuccauca

SEQ ID NO: 2271289 - RNA, 22 nt, Human
cuuuucauuuaggugaggaagc

SEQ ID NO: 2271290 - RNA, 13 nt, Human
cuuuuccaacccu

SEQ ID NO: 2271291 - RNA, 23 nt, Human
cuuuuccaacccucaucaccaac

SEQ ID NO: 2271292 - RNA, 14 nt, Human
cuuuucacauucuu

SEQ ID NO: 2271293 - RNA, 17 nt, Human
cuuuucacauucuuaua

SEQ ID NO: 2271294 - RNA, 19 nt, Human
cuuuucacauucuuauaaa

SEQ ID NO: 2271295 - RNA, 20 nt, Human
cuuuucacauucuuauaaau

SEQ ID NO: 2271296 - RNA, 14 nt, Human
cuuuucacaaauaa

SEQ ID NO: 2271297 - RNA, 15 nt, Human
cuuuucacaaauaaa

SEQ ID NO: 2271298 - RNA, 13 nt, Human
cuuuucacauucu

SEQ ID NO: 2271299 - RNA, 23 nt, Human
cuuuuaauuaaugaaauaucugu

SEQ ID NO: 2271300 - RNA, 20 nt, Human
cuuuucacauagcugucuag

SEQ ID NO: 2271301 - RNA, 12 nt, Human
cuuuucacaaau

SEQ ID NO: 2271302 - RNA, 13 nt, Human
cuuuucacaaaua

SEQ ID NO: 2271303 - RNA, 20 nt, Human
cuuuuaauuaaaugcucauc

SEQ ID NO: 2271304 - RNA, 16 nt, Human
cuuuuaauuaaugaaa

SEQ ID NO: 2271305 - RNA, 19 nt, Human
cuuuuaauuaaugaaauau

SEQ ID NO: 2271306 - RNA, 22 nt, Human
cuuuuaauuaaugaaauaucug

SEQ ID NO: 2271307 - RNA, 18 nt, Human
cuuuuaaugcuccaaaug

SEQ ID NO: 2271308 - RNA, 19 nt, Human
cuuuuaaugcuccaaaugc

SEQ ID NO: 2271309 - RNA, 14 nt, Human
cuuuuaauuaaaug

SEQ ID NO: 2271310 - RNA, 15 nt, Human
cuuuuaauuaaaugc

SEQ ID NO: 2271311 - RNA, 16 nt, Human
cuuuucgccguggcug

SEQ ID NO: 2271312 - RNA, 20 nt, Human
cuuuuccuuggggcaggcag

SEQ ID NO: 2271313 - RNA, 16 nt, Human
cuuuucuuucuaccaa

SEQ ID NO: 2271314 - RNA, 17 nt, Human
cuuuucuuucagccaag

SEQ ID NO: 2271315 - RNA, 14 nt, Human
cuuuugcaaacuuu

SEQ ID NO: 2271316 - RNA, 22 nt, Human
cuuuugauaaucaacugggcug

SEQ ID NO: 2271317 - RNA, 23 nt, Human
cuuuugauaaucaacugggcuga

SEQ ID NO: 2271318 - RNA, 13 nt, Human
cuuuucuuuucuu

SEQ ID NO: 2271319 - RNA, 17 nt, Human
cuuuucuuuucuacccu

SEQ ID NO: 2271320 - RNA, 20 nt, Human
cuuuucuuuucuacccuagc

SEQ ID NO: 2271321 - RNA, 19 nt, Human
cuuuuuacuccccuugagc

SEQ ID NO: 2271322 - RNA, 15 nt, Human
cuuuuuacuccccuu

SEQ ID NO: 2271323 - RNA, 20 nt, Human
cuuuuuaccaaguuucaggu

SEQ ID NO: 2271324 - RNA, 23 nt, Human
cuuuuuaauuguuguuucuuucu

SEQ ID NO: 2271325 - RNA, 22 nt, Human
cuuuuuaauauugauaugcuua

SEQ ID NO: 2271326 - RNA, 17 nt, Human
cuuuuuaauucaccaaa

SEQ ID NO: 2271327 - RNA, 14 nt, Human
cuuuuuaauuguug

SEQ ID NO: 2271328 - RNA, 15 nt, Human
cuuuuuaauuguugu

SEQ ID NO: 2271329 - RNA, 16 nt, Human
cuuuuuaauuguuguu

SEQ ID NO: 2271330 - RNA, 22 nt, Human
cuuuuuaauuguuguuucuuuc

SEQ ID NO: 2271331 - RNA, 15 nt, Human
cuuuuuaauaaaaag

SEQ ID NO: 2271332 - RNA, 14 nt, Human
cuuuuuaauaaaaa

SEQ ID NO: 2271333 - RNA, 20 nt, Human
cuuuuuaauaaaaaggcacc

SEQ ID NO: 2271334 - RNA, 19 nt, Human
cuuuuuaagcuuauuuaau

SEQ ID NO: 2271335 - RNA, 17 nt, Human
cuuuuuaagcuuauuua

SEQ ID NO: 2271336 - RNA, 23 nt, Human
cuuuuuaaauucaguccuaagaa

SEQ ID NO: 2271337 - RNA, 21 nt, Human
cuuuuuaaauguaaagauauu

SEQ ID NO: 2271338 - RNA, 20 nt, Human
cuuuuuaaauguaaagauau

SEQ ID NO: 2271339 - RNA, 19 nt, Human
cuuuuuaaaguguuucugu

SEQ ID NO: 2271340 - RNA, 23 nt, Human
cuuuuuaaaguguuucuguuauu

SEQ ID NO: 2271341 - RNA, 12 nt, Human
cuuuugcacccc

SEQ ID NO: 2271342 - RNA, 14 nt, Human
cuuuugcaccccuc

SEQ ID NO: 2271343 - RNA, 15 nt, Human
cuuuugcaccccucc

SEQ ID NO: 2271344 - RNA, 16 nt, Human
cuuuugcaccccuccc

SEQ ID NO: 2271345 - RNA, 17 nt, Human
cuuuugcaccccuccca

SEQ ID NO: 2271346 - RNA, 18 nt, Human
cuuuugcaccccucccau

SEQ ID NO: 2271347 - RNA, 22 nt, Human
cuuuugcaccugcucucuugua

SEQ ID NO: 2271348 - RNA, 19 nt, Human
cuuuugcaccccucccauu

SEQ ID NO: 2271349 - RNA, 20 nt, Human
cuuuugcaccccucccauua

SEQ ID NO: 2271350 - RNA, 19 nt, Human
cuuuugcaccugcucucuu

SEQ ID NO: 2271351 - RNA, 17 nt, Human
cuuuuuccccaaagucu

SEQ ID NO: 2271352 - RNA, 13 nt, Human
cuuuuuccagagg

SEQ ID NO: 2271353 - RNA, 17 nt, Human
cuuuuuccuugucccca

SEQ ID NO: 2271354 - RNA, 15 nt, Human
cuuuuuuauacauaa

SEQ ID NO: 2271355 - RNA, 17 nt, Human
cuuuuuuauacauaaac

SEQ ID NO: 2271356 - RNA, 16 nt, Human
cuuuuuuauacauaaa

SEQ ID NO: 2271357 - RNA, 22 nt, Human
cuuuuuccagacacuuuuuuga

SEQ ID NO: 2271358 - RNA, 17 nt, Human
cuuuuucauuugccuau

SEQ ID NO: 2271359 - RNA, 13 nt, Human
cuuuuucauuugc

SEQ ID NO: 2271360 - RNA, 15 nt, Human
cuuuuucauuugccu

SEQ ID NO: 2271361 - RNA, 18 nt, Human
cuuuuucauuugccuauu

SEQ ID NO: 2271362 - RNA, 12 nt, Human
cuuuuucauuug

SEQ ID NO: 2271363 - RNA, 19 nt, Human
cuuuuuagggccaggcagg

SEQ ID NO: 2271364 - RNA, 16 nt, Human
gaaaaagaaaaaauau

SEQ ID NO: 2271365 - RNA, 11 nt, Human
gaaaaagaaaa

SEQ ID NO: 2271366 - RNA, 12 nt, Human
cuuuuuucaaaa

SEQ ID NO: 2271367 - RNA, 15 nt, Human
cuuuuuucacaaauu

SEQ ID NO: 2271368 - RNA, 21 nt, Human
cuuuuuucacggaaguuuuca

SEQ ID NO: 2271369 - RNA, 23 nt, Human
cuuuuuuaugugccguguuauug

SEQ ID NO: 2271370 - RNA, 18 nt, Human
cuuuuuuaugugccgugu

SEQ ID NO: 2271371 - RNA, 19 nt, Human
cuuuuuuaucaugugaaau

SEQ ID NO: 2271372 - RNA, 17 nt, Human
cuuuuucucccucugga

SEQ ID NO: 2271373 - RNA, 14 nt, Human
cuuuuucucccucu

SEQ ID NO: 2271374 - RNA, 18 nt, Human
cuuuuucuaaugugguua

SEQ ID NO: 2271375 - RNA, 21 nt, Human
cuuuuucuccagcugggcucu

SEQ ID NO: 2271376 - RNA, 18 nt, Human
cuuuuuuauacauaaaca

SEQ ID NO: 2271377 - RNA, 18 nt, Human
cuuucaugaguuuuuccc

SEQ ID NO: 2271378 - RNA, 22 nt, Human
cuuucaugaguuuuucccagcu

SEQ ID NO: 2271379 - RNA, 17 nt, Human
cuuucauguaaacugug

SEQ ID NO: 2271380 - RNA, 19 nt, Human
cuuucauggggugaugcug

SEQ ID NO: 2271381 - RNA, 21 nt, Human
cuuucauggggugaugcuggg

SEQ ID NO: 2271382 - RNA, 20 nt, Human
cuuucauuaaagcauuuacu

SEQ ID NO: 2271383 - RNA, 21 nt, Human
cuuucauuaaaggcuucucuc

SEQ ID NO: 2271384 - RNA, 21 nt, Human
cuuucauguaaacugugcacc

SEQ ID NO: 2271385 - RNA, 20 nt, Human
cuuucauguaaacugugcac

SEQ ID NO: 2271386 - RNA, 19 nt, Human
cuuucauguaaacugugca

SEQ ID NO: 2271387 - RNA, 17 nt, Human
cuuucauccugacucug

SEQ ID NO: 2271388 - RNA, 18 nt, Human
cuuucauccugacucugc

SEQ ID NO: 2271389 - RNA, 19 nt, Human
cuuucauccugacucugcc

SEQ ID NO: 2271390 - RNA, 20 nt, Human
cuuucauccugacucugccc

SEQ ID NO: 2271391 - RNA, 21 nt, Human
cuuucauccugacucugcccc

SEQ ID NO: 2271392 - RNA, 22 nt, Human
cuuucauccugacucugccccc

SEQ ID NO: 2271393 - RNA, 23 nt, Human
cuuucaagcagucgugccugugu

SEQ ID NO: 2271394 - RNA, 21 nt, Human
cuuucaaagaaggaauucuag

SEQ ID NO: 2271395 - RNA, 18 nt, Human
cuuucaaagaaggaauuc

SEQ ID NO: 2271396 - RNA, 21 nt, Human
cuuucaaauugagagaaugga

SEQ ID NO: 2271397 - RNA, 15 nt, Human
cuuucaaagaaggaa

SEQ ID NO: 2271398 - RNA, 19 nt, Human
cuuucaaaaccuuuugaaa

SEQ ID NO: 2271399 - RNA, 14 nt, Human
cuuucaaaaacaug

SEQ ID NO: 2271400 - RNA, 15 nt, Human
cuuucaaauuucaca

SEQ ID NO: 2271401 - RNA, 14 nt, Human
cuuucaaauuucac

SEQ ID NO: 2271402 - RNA, 14 nt, Human
cuuucaacuugcau

SEQ ID NO: 2271403 - RNA, 19 nt, Human
cuuucaagcagucgugccu

SEQ ID NO: 2271404 - RNA, 20 nt, Human
cuuucaagcagucgugccug

SEQ ID NO: 2271405 - RNA, 22 nt, Human
cuuucaagcagucgugccugug

SEQ ID NO: 2271406 - RNA, 18 nt, Human
cuuuauuuucugguagau

SEQ ID NO: 2271407 - RNA, 13 nt, Human
cuuuauuuucugg

SEQ ID NO: 2271408 - RNA, 20 nt, Human
cuugugugugggcugugagu

SEQ ID NO: 2271409 - RNA, 11 nt, Human
cuuguguguuu

SEQ ID NO: 2271410 - RNA, 21 nt, Human
cuugugugugggcugugagug

SEQ ID NO: 2271411 - RNA, 19 nt, Human
cuugugugugggcugugag

SEQ ID NO: 2271412 - RNA, 23 nt, Human
cuuuauuuuuuaaguauuuauau

SEQ ID NO: 2271413 - RNA, 22 nt, Human
cuuuauuuuuuaaguauuuaua

SEQ ID NO: 2271414 - RNA, 21 nt, Human
cuuuauuuuuuaaguauuuau

SEQ ID NO: 2271415 - RNA, 18 nt, Human
cuuuauuuuuuaaguauu

SEQ ID NO: 2271416 - RNA, 19 nt, Human
cuuuauuuuguguuuagga

SEQ ID NO: 2271417 - RNA, 13 nt, Human
cuugugucugcgu

SEQ ID NO: 2271418 - RNA, 21 nt, Human
cuugugucucugugcuuuuaa

SEQ ID NO: 2271419 - RNA, 12 nt, Human
cuugugucugua

SEQ ID NO: 2271420 - RNA, 14 nt, Human
cuugugucuguaca

SEQ ID NO: 2271421 - RNA, 15 nt, Human
cuugugucuguacac

SEQ ID NO: 2271422 - RNA, 18 nt, Human
cuugugucuguacacgug

SEQ ID NO: 2271423 - RNA, 17 nt, Human
cuugugugguuuggccc

SEQ ID NO: 2271424 - RNA, 21 nt, Human
cuuguggacacagcucuucuc

SEQ ID NO: 2271425 - RNA, 18 nt, Human
cuugugucucugugcuuu

SEQ ID NO: 2271426 - RNA, 17 nt, Human
cuugugucucugugcuu

SEQ ID NO: 2271427 - RNA, 15 nt, Human
cuugugucucugugc

SEQ ID NO: 2271428 - RNA, 14 nt, Human
cuugucaugugaca

SEQ ID NO: 2271429 - RNA, 19 nt, Human
cuuuccguggcacugcaua

SEQ ID NO: 2271430 - RNA, 17 nt, Human
cuuuccguggcacugca

SEQ ID NO: 2271431 - RNA, 16 nt, Human
cuuuccuaaggcugca

SEQ ID NO: 2271432 - RNA, 15 nt, Human
cuuuccuaaauguuu

SEQ ID NO: 2271433 - RNA, 20 nt, Human
cuuuccuagauggcagucac

SEQ ID NO: 2271434 - RNA, 20 nt, Human
cuuuccuaaggcugcaaggu

SEQ ID NO: 2271435 - RNA, 17 nt, Human
cuuuccuaaggcugcaa

SEQ ID NO: 2271436 - RNA, 21 nt, Human
cuuuccuagauggcagucacu

SEQ ID NO: 2271437 - RNA, 18 nt, Human
cuuuccuaucauggagug

SEQ ID NO: 2271438 - RNA, 19 nt, Human
cuuucccccaccagcuaag

SEQ ID NO: 2271439 - RNA, 14 nt, Human
cuuuccccuguggg

SEQ ID NO: 2271440 - RNA, 21 nt, Human
cuuuccgguguuuaagacauu

SEQ ID NO: 2271441 - RNA, 13 nt, Human
cuuuccccugugg

SEQ ID NO: 2271442 - RNA, 20 nt, Human
cuuucccuuuuccauuugaa

SEQ ID NO: 2271443 - RNA, 22 nt, Human
cuuuccacccccucccuggccu

SEQ ID NO: 2271444 - RNA, 9 nt, Human
cuuuccaga

SEQ ID NO: 2271445 - RNA, 12 nt, Human
cuuuccagcuca

SEQ ID NO: 2271446 - RNA, 13 nt, Human
cuuuccagcucac

SEQ ID NO: 2271447 - RNA, 17 nt, Human
cuuucccauggggaggg

SEQ ID NO: 2271448 - RNA, 21 nt, Human
cuuuccagcucaccccccaca

SEQ ID NO: 2271449 - RNA, 13 nt, Human
cuuuccccagccc

SEQ ID NO: 2271450 - RNA, 14 nt, Human
cuuuccccagccca

SEQ ID NO: 2271451 - RNA, 15 nt, Human
cuuuccccagcccag

SEQ ID NO: 2271452 - RNA, 16 nt, Human
cuuuccccagcccagg

SEQ ID NO: 2271453 - RNA, 17 nt, Human
cuuuccccagcccaggg

SEQ ID NO: 2271454 - RNA, 21 nt, Human
cuuuccccaugucucgacuca

SEQ ID NO: 2271455 - RNA, 20 nt, Human
cuuuccccaugucucgacuc

SEQ ID NO: 2271456 - RNA, 15 nt, Human
cuuuccccaugucuc

SEQ ID NO: 2271457 - RNA, 23 nt, Human
cuuuccacccccucccuggccug

SEQ ID NO: 2271458 - RNA, 23 nt, Human
cuuucauuaaaggcuucucucuc

SEQ ID NO: 2271459 - RNA, 21 nt, Human
cuuuccaaaggccauggagag

SEQ ID NO: 2271460 - RNA, 23 nt, Human
cuuuccaaagccaaugugaacag

SEQ ID NO: 2271461 - RNA, 18 nt, Human
cuuuccacuccuccuagc

SEQ ID NO: 2271462 - RNA, 22 nt, Human
cuuuccacggagccacuccucu

SEQ ID NO: 2271463 - RNA, 21 nt, Human
cuuuccacggagccacuccuc

SEQ ID NO: 2271464 - RNA, 14 nt, Human
cuuuccaggaaggc

SEQ ID NO: 2271465 - RNA, 21 nt, Human
cuuuccacuccuccuagccac

SEQ ID NO: 2271466 - RNA, 16 nt, Human
cuuuccaaaugcccag

SEQ ID NO: 2271467 - RNA, 22 nt, Human
cuuuccaaaguacacuguuuca

SEQ ID NO: 2271468 - RNA, 16 nt, Human
cuuucauuuacugugg

SEQ ID NO: 2271469 - RNA, 17 nt, Human
cuuucauuuacuguggc

SEQ ID NO: 2271470 - RNA, 20 nt, Human
cuuuccaaagccaaugugaa

SEQ ID NO: 2271471 - RNA, 16 nt, Human
cuuuccaaaguacacu

SEQ ID NO: 2271472 - RNA, 17 nt, Human
cuuucuuuaccugagac

SEQ ID NO: 2271473 - RNA, 18 nt, Human
cuuucuuuaccugagacc

SEQ ID NO: 2271474 - RNA, 17 nt, Human
cuuucuuucuaacucca

SEQ ID NO: 2271475 - RNA, 15 nt, Human
cuuucuuucuuagaa

SEQ ID NO: 2271476 - RNA, 16 nt, Human
cuuucuuucuuagaaa

SEQ ID NO: 2271477 - RNA, 17 nt, Human
cuuucuuucuuagaaau

SEQ ID NO: 2271478 - RNA, 21 nt, Human
cuuucuuuucgccguggcugc

SEQ ID NO: 2271479 - RNA, 23 nt, Human
cuuucuuugggaauauuugaauc

SEQ ID NO: 2271480 - RNA, 18 nt, Human
cuuucuuugggaauauuu

SEQ ID NO: 2271481 - RNA, 20 nt, Human
cuuucuuugggaauauuuga

SEQ ID NO: 2271482 - RNA, 21 nt, Human
cuuucuuugggaauauuugaa

SEQ ID NO: 2271483 - RNA, 22 nt, Human
cuuucuuugggaauauuugaau

SEQ ID NO: 2271484 - RNA, 16 nt, Human
cuuugaaaugaauaua

SEQ ID NO: 2271485 - RNA, 14 nt, Human
cuuugaaauguguu

SEQ ID NO: 2271486 - RNA, 18 nt, Human
cuuugaaauguguuucug

SEQ ID NO: 2271487 - RNA, 21 nt, Human
cuuugaaauguguuucuguau

SEQ ID NO: 2271488 - RNA, 22 nt, Human
cuuugaaauguguuucuguaua

SEQ ID NO: 2271489 - RNA, 23 nt, Human
cuuugaaauguguuucuguauaa

SEQ ID NO: 2271490 - RNA, 19 nt, Human
cuuugaaauagucugugug

SEQ ID NO: 2271491 - RNA, 22 nt, Human
cuuucuuuucuggaauguaauc

SEQ ID NO: 2271492 - RNA, 21 nt, Human
cuuugaaauagucugugugaa

SEQ ID NO: 2271493 - RNA, 15 nt, Human
cuuugaaauuguuua

SEQ ID NO: 2271494 - RNA, 13 nt, Human
cuuugaagaggaa

SEQ ID NO: 2271495 - RNA, 14 nt, Human
cuuugaagaggaaa

SEQ ID NO: 2271496 - RNA, 18 nt, Human
cuuugaagaggaaaauga

SEQ ID NO: 2271497 - RNA, 20 nt, Human
cuuugaagaggaaaaugaau

SEQ ID NO: 2271498 - RNA, 22 nt, Human
cuuugaagaggaaaaugaauaa

SEQ ID NO: 2271499 - RNA, 14 nt, Human
cuuugaagcaguug

SEQ ID NO: 2271500 - RNA, 16 nt, Human
cuuugaaggggccuca

SEQ ID NO: 2271501 - RNA, 19 nt, Human
cuuugaagcaguuguguca

SEQ ID NO: 2271502 - RNA, 16 nt, Human
cuuucuguugccacaa

SEQ ID NO: 2271503 - RNA, 15 nt, Human
cuuucuguuggugua

SEQ ID NO: 2271504 - RNA, 14 nt, Human
cuuucuguugucau

SEQ ID NO: 2271505 - RNA, 15 nt, Human
cuuucuguugucauu

SEQ ID NO: 2271506 - RNA, 21 nt, Human
cuuucuguugucauugcuguu

SEQ ID NO: 2271507 - RNA, 22 nt, Human
cuuucuguugucauugcuguug

SEQ ID NO: 2271508 - RNA, 11 nt, Human
cuuucuuagaa

SEQ ID NO: 2271509 - RNA, 13 nt, Human
cuuucuuagaaau

SEQ ID NO: 2271510 - RNA, 14 nt, Human
cuuucuuagaaauu

SEQ ID NO: 2271511 - RNA, 22 nt, Human
cuuucuuacaaggaagguggug

SEQ ID NO: 2271512 - RNA, 17 nt, Human
cuuucuuagaaauuuau

SEQ ID NO: 2271513 - RNA, 17 nt, Human
cuuuccugaggcugggc

SEQ ID NO: 2271514 - RNA, 16 nt, Human
cuuuccugaggcuggg

SEQ ID NO: 2271515 - RNA, 20 nt, Human
cuuuccugaggcugggcucc

SEQ ID NO: 2271516 - RNA, 21 nt, Human
cuuuccugaggcugggcuccc

SEQ ID NO: 2271517 - RNA, 23 nt, Human
cuuugccccaccuuuauuaaaau

SEQ ID NO: 2271518 - RNA, 22 nt, Human
cuuugcccaacaccagccccug

SEQ ID NO: 2271519 - RNA, 20 nt, Human
cuuugcccugguagggcagu

SEQ ID NO: 2271520 - RNA, 19 nt, Human
cuuuggaaagaguaggaag

SEQ ID NO: 2271521 - RNA, 23 nt, Human
cuuuggaaagaguaggaagacuu

SEQ ID NO: 2271522 - RNA, 18 nt, Human
cuuugccagaaagcauaa

SEQ ID NO: 2271523 - RNA, 17 nt, Human
cuuugccagcugcugcu

SEQ ID NO: 2271524 - RNA, 21 nt, Human
cuuugccacccucaugcugug

SEQ ID NO: 2271525 - RNA, 20 nt, Human
cuuugccagcuuuuccuccc

SEQ ID NO: 2271526 - RNA, 18 nt, Human
cuuugccagcugcugcug

SEQ ID NO: 2271527 - RNA, 13 nt, Human
cuuugccagcuuu

SEQ ID NO: 2271528 - RNA, 23 nt, Human
cuuugcacugagggccacacuau

SEQ ID NO: 2271529 - RNA, 16 nt, Human
cuuugcacugauauau

SEQ ID NO: 2271530 - RNA, 18 nt, Human
cuuugcccaacaccagcc

SEQ ID NO: 2271531 - RNA, 19 nt, Human
cuuugcccaacaccagccc

SEQ ID NO: 2271532 - RNA, 14 nt, Human
cuuugcccacaaug

SEQ ID NO: 2271533 - RNA, 15 nt, Human
cuuugcccagaaaga

SEQ ID NO: 2271534 - RNA, 16 nt, Human
cuuugcccaacaccag

SEQ ID NO: 2271535 - RNA, 16 nt, Human
cuuugaaugcggccca

SEQ ID NO: 2271536 - RNA, 15 nt, Human
cuuugaaugacaaag

SEQ ID NO: 2271537 - RNA, 13 nt, Human
cuuugaaugcuuu

SEQ ID NO: 2271538 - RNA, 16 nt, Human
cuuugaaugcuuuuug

SEQ ID NO: 2271539 - RNA, 23 nt, Human
cuuugaaugcuuuuugaauguua

SEQ ID NO: 2271540 - RNA, 23 nt, Human
cuuugaauccucucucuguguua

SEQ ID NO: 2271541 - RNA, 19 nt, Human
cuuugaauccucucucugu

SEQ ID NO: 2271542 - RNA, 18 nt, Human
cuuugaauccucucucug

SEQ ID NO: 2271543 - RNA, 16 nt, Human
cuuugaagucauacca

SEQ ID NO: 2271544 - RNA, 17 nt, Human
cuuugaauaaaaaugca

SEQ ID NO: 2271545 - RNA, 18 nt, Human
cuuugaaggggccucacc

SEQ ID NO: 2271546 - RNA, 18 nt, Human
cuuugaauaaaaaugcac

SEQ ID NO: 2271547 - RNA, 14 nt, Human
cuuugcagacaggc

SEQ ID NO: 2271548 - RNA, 15 nt, Human
cuuugcagacaggca

SEQ ID NO: 2271549 - RNA, 14 nt, Human
cuuugcacugaggg

SEQ ID NO: 2271550 - RNA, 15 nt, Human
cuuugcacugagggc

SEQ ID NO: 2271551 - RNA, 16 nt, Human
cuuugcacugagggcc

SEQ ID NO: 2271552 - RNA, 18 nt, Human
cuuugcacugagggccac

SEQ ID NO: 2271553 - RNA, 19 nt, Human
cuuugcacugagggccaca

SEQ ID NO: 2271554 - RNA, 22 nt, Human
cuuugcacugagggccacacua

SEQ ID NO: 2271555 - RNA, 12 nt, Human
cuuugaauuuuc

SEQ ID NO: 2271556 - RNA, 14 nt, Human
cuugcauugcagag

SEQ ID NO: 2271557 - RNA, 12 nt, Human
cuugcauuuuug

SEQ ID NO: 2271558 - RNA, 18 nt, Human
cuugcauugaauauauua

SEQ ID NO: 2271559 - RNA, 14 nt, Human
cuugcauucccagu

SEQ ID NO: 2271560 - RNA, 16 nt, Human
cuugcauucccagugg

SEQ ID NO: 2271561 - RNA, 12 nt, Human
cuugcauuccca

SEQ ID NO: 2271562 - RNA, 17 nt, Human
cuugccaaauauaaaua

SEQ ID NO: 2271563 - RNA, 15 nt, Human
cuugcugccuucugg

SEQ ID NO: 2271564 - RNA, 19 nt, Human
cuugcugccuucuggauuc

SEQ ID NO: 2271565 - RNA, 21 nt, Human
cuugcuggacggggacugggg

SEQ ID NO: 2271566 - RNA, 17 nt, Human
cuugcuggacggggacu

SEQ ID NO: 2271567 - RNA, 20 nt, Human
cuugcugccuucuggauucu

SEQ ID NO: 2271568 - RNA, 21 nt, Human
cuugcauuuuugcaggagcag

SEQ ID NO: 2271569 - RNA, 20 nt, Human
cuugcauuuuugcaggagca

SEQ ID NO: 2271570 - RNA, 14 nt, Human
cuugcauuuuugca

SEQ ID NO: 2271571 - RNA, 13 nt, Human
cuugcauuuuugc

SEQ ID NO: 2271572 - RNA, 15 nt, Human
cuuggacauccuccu

SEQ ID NO: 2271573 - RNA, 16 nt, Human
cuuggacauccuccuc

SEQ ID NO: 2271574 - RNA, 15 nt, Human
cuugcuuuuaaaauc

SEQ ID NO: 2271575 - RNA, 22 nt, Human
cuuggacauccuccucccaccc

SEQ ID NO: 2271576 - RNA, 17 nt, Human
cuuggacauccuccucc

SEQ ID NO: 2271577 - RNA, 19 nt, Human
cuuggacauccuccuccca

SEQ ID NO: 2271578 - RNA, 20 nt, Human
cuuggacauccuccucccac

SEQ ID NO: 2271579 - RNA, 21 nt, Human
cuuggacauccuccucccacc

SEQ ID NO: 2271580 - RNA, 21 nt, Human
cuugcuuguugggauuccuga

SEQ ID NO: 2271581 - RNA, 22 nt, Human
cuugcuuguugggauuccugac

SEQ ID NO: 2271582 - RNA, 15 nt, Human
cuugcuguccuaggc

SEQ ID NO: 2271583 - RNA, 22 nt, Human
cuugcuggacggggacugggga

SEQ ID NO: 2271584 - RNA, 14 nt, Human
cuugcuuggcugcu

SEQ ID NO: 2271585 - RNA, 18 nt, Human
cuugcuuggcugcuuggc

SEQ ID NO: 2271586 - RNA, 14 nt, Human
cuugcuguccuagg

SEQ ID NO: 2271587 - RNA, 16 nt, Human
cuugcuguauaugcag

SEQ ID NO: 2271588 - RNA, 23 nt, Human
cuugcuggggacggggggcccca

SEQ ID NO: 2271589 - RNA, 17 nt, Human
cuugcugguuuucugga

SEQ ID NO: 2271590 - RNA, 13 nt, Human
cuugcuugcuuuu

SEQ ID NO: 2271591 - RNA, 24 nt, Human
cuuggcucacugcaacuucugccu

SEQ ID NO: 2271592 - RNA, 21 nt, Human
cuuggcucaauccucuaagcu

SEQ ID NO: 2271593 - RNA, 12 nt, Human
cuuggcucagac

SEQ ID NO: 2271594 - RNA, 23 nt, Human
cuuggcucaaguccucuuuucug

SEQ ID NO: 2271595 - RNA, 17 nt, Human
cuuggcuacacagggau

SEQ ID NO: 2271596 - RNA, 14 nt, Human
cuuggauugucccc

SEQ ID NO: 2271597 - RNA, 13 nt, Human
cuuggauuguccc

SEQ ID NO: 2271598 - RNA, 12 nt, Human
cuuggcugcagg

SEQ ID NO: 2271599 - RNA, 13 nt, Human
cuuggcugcaggg

SEQ ID NO: 2271600 - RNA, 16 nt, Human
cuuggcucagacaugu

SEQ ID NO: 2271601 - RNA, 14 nt, Human
cuuggcucagacau

SEQ ID NO: 2271602 - RNA, 18 nt, Human
cuuggcucgaaucucugu

SEQ ID NO: 2271603 - RNA, 19 nt, Human
cuuggcucgaaucucugug

SEQ ID NO: 2271604 - RNA, 20 nt, Human
cuuggcucgaaucucugugc

SEQ ID NO: 2271605 - RNA, 21 nt, Human
cuuggcucgaaucucugugcc

SEQ ID NO: 2271606 - RNA, 22 nt, Human
cuuggcucgaaucucugugccu

SEQ ID NO: 2271607 - RNA, 22 nt, Human
cuuggauaaugcuguugccuca

SEQ ID NO: 2271608 - RNA, 18 nt, Human
cuuggauaaugcuguugc

SEQ ID NO: 2271609 - RNA, 12 nt, Human
cuuggagcugag

SEQ ID NO: 2271610 - RNA, 20 nt, Human
cuuggagccugcagagcugc

SEQ ID NO: 2271611 - RNA, 19 nt, Human
cuuggagccugcagagcug

SEQ ID NO: 2271612 - RNA, 23 nt, Human
cuuggauaaugcuguugccucau

SEQ ID NO: 2271613 - RNA, 15 nt, Human
cuuggauguauaugu

SEQ ID NO: 2271614 - RNA, 18 nt, Human
cuuggauguaccugcccc

SEQ ID NO: 2271615 - RNA, 21 nt, Human
cuuggauuauuuuaaaucauu

SEQ ID NO: 2271616 - RNA, 21 nt, Human
cuuggagccccagugccaagc

SEQ ID NO: 2271617 - RNA, 16 nt, Human
cuuggaccucugcucu

SEQ ID NO: 2271618 - RNA, 14 nt, Human
cuuggagccggacu

SEQ ID NO: 2271619 - RNA, 21 nt, Human
cuuggagccggacuuucggag

SEQ ID NO: 2271620 - RNA, 13 nt, Human
cuuggagccugca

SEQ ID NO: 2271621 - RNA, 12 nt, Human
cuuggaccucug

SEQ ID NO: 2271622 - RNA, 13 nt, Human
cuuggaccucugc

SEQ ID NO: 2271623 - RNA, 14 nt, Human
cuuggaccucugcu

SEQ ID NO: 2271624 - RNA, 15 nt, Human
cuuggaccucugcuc

SEQ ID NO: 2271625 - RNA, 18 nt, Human
cuuggagccugcagagcu

SEQ ID NO: 2271626 - RNA, 17 nt, Human
cuuggagccugcagagc

SEQ ID NO: 2271627 - RNA, 16 nt, Human
cuuggagccugcagag

SEQ ID NO: 2271628 - RNA, 15 nt, Human
cuuggagccugcaga

SEQ ID NO: 2271629 - RNA, 22 nt, Human
cuuguauuaaguuguuaauaaa

SEQ ID NO: 2271630 - RNA, 23 nt, Human
cuuguauuaaguuguuaauaaaa

SEQ ID NO: 2271631 - RNA, 13 nt, Human
cuuguauuaugug

SEQ ID NO: 2271632 - RNA, 13 nt, Human
cuuguauuaaguu

SEQ ID NO: 2271633 - RNA, 17 nt, Human
cuuguauuaaguuguua

SEQ ID NO: 2271634 - RNA, 17 nt, Human
cuuguauuaaagacaga

SEQ ID NO: 2271635 - RNA, 14 nt, Human
cuuguauuaagaau

SEQ ID NO: 2271636 - RNA, 23 nt, Human
cuuguauuaaacucuucacaaaa

SEQ ID NO: 2271637 - RNA, 13 nt, Human
cuuguauuaaacu

SEQ ID NO: 2271638 - RNA, 21 nt, Human
cuuguaacuccaccaacccau

SEQ ID NO: 2271639 - RNA, 20 nt, Human
cuuguaaugauauagccaga

SEQ ID NO: 2271640 - RNA, 17 nt, Human
cuuguaacuccaccaac

SEQ ID NO: 2271641 - RNA, 15 nt, Human
cuuguaacuccacca

SEQ ID NO: 2271642 - RNA, 21 nt, Human
cuuguaugaaagauggcugug

SEQ ID NO: 2271643 - RNA, 20 nt, Human
cuuguaucaacacuguuacu

SEQ ID NO: 2271644 - RNA, 21 nt, Human
cuuguaaugauauagccagaa

SEQ ID NO: 2271645 - RNA, 23 nt, Human
cuuguauauuuuaagaaauaaca

SEQ ID NO: 2271646 - RNA, 19 nt, Human
cuuguaucaacacuguuac

SEQ ID NO: 2271647 - RNA, 14 nt, Human
cuuguaacuccacc

SEQ ID NO: 2271648 - RNA, 20 nt, Human
cuuguauuuaaauauuaaau

SEQ ID NO: 2271649 - RNA, 18 nt, Human
cuuguauuuaaauauuaa

SEQ ID NO: 2271650 - RNA, 12 nt, Human
cuuguauuuaaa

SEQ ID NO: 2271651 - RNA, 15 nt, Human
cuuguauuaagaaug

SEQ ID NO: 2271652 - RNA, 18 nt, Human
cuuguauuauguguguuu

SEQ ID NO: 2271653 - RNA, 14 nt, Human
cuuguauuuuguga

SEQ ID NO: 2271654 - RNA, 14 nt, Human
cuugucaaagaagg

SEQ ID NO: 2271655 - RNA, 23 nt, Human
cuugucacugguagaccaaaaua

SEQ ID NO: 2271656 - RNA, 15 nt, Human
cuugucacugguaga

SEQ ID NO: 2271657 - RNA, 17 nt, Human
cuuguggacacagcucu

SEQ ID NO: 2271658 - RNA, 18 nt, Human
cuuguggacacagcucuu

SEQ ID NO: 2271659 - RNA, 15 nt, Human
cuugucagagcuggg

SEQ ID NO: 2271660 - RNA, 14 nt, Human
cuugucagagcugg

SEQ ID NO: 2271661 - RNA, 21 nt, Human
cuugucagagcugggaggggu

SEQ ID NO: 2271662 - RNA, 13 nt, Human
cuugucagagcug

SEQ ID NO: 2271663 - RNA, 13 nt, Human
cuugucaaagaag

SEQ ID NO: 2271664 - RNA, 22 nt, Human
cuugucacugguagaccaaaau

SEQ ID NO: 2271665 - RNA, 20 nt, Human
cuuggcuucaggggaguccc

SEQ ID NO: 2271666 - RNA, 20 nt, Human
cuuggcuguuggcagugagu

SEQ ID NO: 2271667 - RNA, 16 nt, Human
cuuggcuuccuuucuu

SEQ ID NO: 2271668 - RNA, 18 nt, Human
cuuggcuuccuuucuugg

SEQ ID NO: 2271669 - RNA, 23 nt, Human
cuuggcuucucauacguccacca

SEQ ID NO: 2271670 - RNA, 16 nt, Human
cuuggcuucucauacg

SEQ ID NO: 2271671 - RNA, 22 nt, Human
cuuggcuguagaaggagacaga

SEQ ID NO: 2271672 - RNA, 12 nt, Human
cuuggcugugag

SEQ ID NO: 2271673 - RNA, 13 nt, Human
cuuggcugugagg

SEQ ID NO: 2271674 - RNA, 21 nt, Human
cuuggcugugaggccccugga

SEQ ID NO: 2271675 - RNA, 17 nt, Human
cuuggcuguagaaggag

SEQ ID NO: 2271676 - RNA, 16 nt, Human
cuuggcuggugcaccu

SEQ ID NO: 2271677 - RNA, 16 nt, Human
cuuggggaccagagcu

SEQ ID NO: 2271678 - RNA, 14 nt, Human
cuuggcuugcccac

SEQ ID NO: 2271679 - RNA, 14 nt, Human
cuuggcuucuucuu

SEQ ID NO: 2271680 - RNA, 17 nt, Human
cuuggggaccagagcug

SEQ ID NO: 2271681 - RNA, 18 nt, Human
cuuggggaccagagcugc

SEQ ID NO: 2271682 - RNA, 19 nt, Human
cuuggggaccagagcugcc

SEQ ID NO: 2271683 - RNA, 15 nt, Human
cuuggggcaggcagu

SEQ ID NO: 2271684 - RNA, 14 nt, Human
cuuggggcaggcag

SEQ ID NO: 2271685 - RNA, 21 nt, Human
cuuggggauucuuccaucuga

SEQ ID NO: 2271686 - RNA, 19 nt, Human
cuuggggauucuuccaucu

SEQ ID NO: 2271687 - RNA, 20 nt, Human
cuugguuuguaaauuaacuu

SEQ ID NO: 2271688 - RNA, 21 nt, Human
cuuggggaguuaagaccuggc

SEQ ID NO: 2271689 - RNA, 23 nt, Human
cuuggggaguuaagaccuggcag

SEQ ID NO: 2271690 - RNA, 22 nt, Human
cuuggggaguuaagaccuggca

SEQ ID NO: 2271691 - RNA, 21 nt, Human
cuuguaaauagcucagguguc

SEQ ID NO: 2271692 - RNA, 18 nt, Human
cuuguaaagacuguagaa

SEQ ID NO: 2271693 - RNA, 18 nt, Human
cuuguaaaggaauuuaaa

SEQ ID NO: 2271694 - RNA, 14 nt, Human
cuuggcuuucaugu

SEQ ID NO: 2271695 - RNA, 18 nt, Human
cuuguaaaaauuaaaagu

SEQ ID NO: 2271696 - RNA, 14 nt, Human
cuucuuuucacauu

SEQ ID NO: 2271697 - RNA, 16 nt, Human
cuucuuuucacauucu

SEQ ID NO: 2271698 - RNA, 20 nt, Human
cuucuuuucacauucuuaua

SEQ ID NO: 2271699 - RNA, 17 nt, Human
cuucuuuucacauucuu

SEQ ID NO: 2271700 - RNA, 12 nt, Human
cuucuuuugagc

SEQ ID NO: 2271701 - RNA, 13 nt, Human
cuucuuuuacuca

SEQ ID NO: 2271702 - RNA, 19 nt, Human
cuucuuuuaaaccauuuuc

SEQ ID NO: 2271703 - RNA, 13 nt, Human
cuucuuugcuugc

SEQ ID NO: 2271704 - RNA, 15 nt, Human
cuucuuugcuugccu

SEQ ID NO: 2271705 - RNA, 19 nt, Human
cuucuuugcuuugcccagc

SEQ ID NO: 2271706 - RNA, 18 nt, Human
cuucuuuggguaaacgug

SEQ ID NO: 2271707 - RNA, 20 nt, Human
cuucuuuuuauuuucuuuug

SEQ ID NO: 2271708 - RNA, 15 nt, Human
cuucuuuuuauuuuc

SEQ ID NO: 2271709 - RNA, 13 nt, Human
cuucuuuugugaa

SEQ ID NO: 2271710 - RNA, 14 nt, Human
cuucuuuugcucuu

SEQ ID NO: 2271711 - RNA, 14 nt, Human
cuucuuuugauuau

SEQ ID NO: 2271712 - RNA, 13 nt, Human
cuucuuuugauua

SEQ ID NO: 2271713 - RNA, 16 nt, Human
cuucuuuugauuaugu

SEQ ID NO: 2271714 - RNA, 13 nt, Human
cuucuuuugcucu

SEQ ID NO: 2271715 - RNA, 22 nt, Human
cuugaaaugaaaguauaacuga

SEQ ID NO: 2271716 - RNA, 16 nt, Human
cuucuuuuugcuguug

SEQ ID NO: 2271717 - RNA, 21 nt, Human
cuugaaauuaagaaggcaaaa

SEQ ID NO: 2271718 - RNA, 19 nt, Human
cuugaaauauaggaacuua

SEQ ID NO: 2271719 - RNA, 23 nt, Human
cuucuuuuuauuuucuuuuguaa

SEQ ID NO: 2271720 - RNA, 15 nt, Human
cuucuuuuggcuucc

SEQ ID NO: 2271721 - RNA, 15 nt, Human
cuucuuuuugcuguu

SEQ ID NO: 2271722 - RNA, 14 nt, Human
cuucuuuuugcugu

SEQ ID NO: 2271723 - RNA, 12 nt, Human
cugucucuucca

SEQ ID NO: 2271724 - RNA, 14 nt, Human
cugucucugucaug

SEQ ID NO: 2271725 - RNA, 15 nt, Human
cugucucuuccauau

SEQ ID NO: 2271726 - RNA, 16 nt, Human
cugucugaagccaaug

SEQ ID NO: 2271727 - RNA, 19 nt, Human
cugucugaaggacacuucc

SEQ ID NO: 2271728 - RNA, 20 nt, Human
cugucugaaggacacuuccu

SEQ ID NO: 2271729 - RNA, 22 nt, Human
cugucugaaggacacuuccugc

SEQ ID NO: 2271730 - RNA, 13 nt, Human
cugucucuccauc

SEQ ID NO: 2271731 - RNA, 16 nt, Human
cugucucuccaucugu

SEQ ID NO: 2271732 - RNA, 13 nt, Human
cugucucugccuc

SEQ ID NO: 2271733 - RNA, 18 nt, Human
cugucucugccucccuca

SEQ ID NO: 2271734 - RNA, 16 nt, Human
cugucucugccucccu

SEQ ID NO: 2271735 - RNA, 13 nt, Human
cugucucuggccu

SEQ ID NO: 2271736 - RNA, 20 nt, Human
cugucugacaaccucuuggu

SEQ ID NO: 2271737 - RNA, 14 nt, Human
cuucuuuauacugu

SEQ ID NO: 2271738 - RNA, 20 nt, Human
cuucuuuauacuguaauuua

SEQ ID NO: 2271739 - RNA, 22 nt, Human
cuucuuuauaauucuacuuuga

SEQ ID NO: 2271740 - RNA, 13 nt, Human
cuucuuuccacag

SEQ ID NO: 2271741 - RNA, 14 nt, Human
cuucuuugauaaug

SEQ ID NO: 2271742 - RNA, 18 nt, Human
cuucuuugcagccugggu

SEQ ID NO: 2271743 - RNA, 17 nt, Human
cuucuuugauaauguua

SEQ ID NO: 2271744 - RNA, 19 nt, Human
cuucuuugauaauguuaaa

SEQ ID NO: 2271745 - RNA, 21 nt, Human
cuucuuucuuugggaauauuu

SEQ ID NO: 2271746 - RNA, 11 nt, Human
cuucuuuccuc

SEQ ID NO: 2271747 - RNA, 14 nt, Human
cuucuuuccucuuc

SEQ ID NO: 2271748 - RNA, 15 nt, Human
cuucuuuccucuucc

SEQ ID NO: 2271749 - RNA, 16 nt, Human
cuucuuuccucuuccc

SEQ ID NO: 2271750 - RNA, 14 nt, Human
cuucuuucauuuuc

SEQ ID NO: 2271751 - RNA, 19 nt, Human
cuucuuuccacagaagcuc

SEQ ID NO: 2271752 - RNA, 19 nt, Human
cuugaacuccuggccucaa

SEQ ID NO: 2271753 - RNA, 20 nt, Human
cuugaaauuaagaaggcaaa

SEQ ID NO: 2271754 - RNA, 13 nt, Human
cuugaaauuuuaa

SEQ ID NO: 2271755 - RNA, 14 nt, Human
cuugaaauuuuaac

SEQ ID NO: 2271756 - RNA, 19 nt, Human
cuugaaauuuuaaacuaua

SEQ ID NO: 2271757 - RNA, 16 nt, Human
cuugaacuggguacuu

SEQ ID NO: 2271758 - RNA, 19 nt, Human
cuugaacugagcuuggaag

SEQ ID NO: 2271759 - RNA, 17 nt, Human
cuugaacugagcuugga

SEQ ID NO: 2271760 - RNA, 23 nt, Human
cuugaccagcagaucccagcuca

SEQ ID NO: 2271761 - RNA, 15 nt, Human
cuugaccaggccugg

SEQ ID NO: 2271762 - RNA, 17 nt, Human
cuugaccaggccugggc

SEQ ID NO: 2271763 - RNA, 15 nt, Human
cuugaacuuugaccu

SEQ ID NO: 2271764 - RNA, 18 nt, Human
cuugaacuggguacuugu

SEQ ID NO: 2271765 - RNA, 20 nt, Human
cuugaacuggguacuugugg

SEQ ID NO: 2271766 - RNA, 14 nt, Human
cuugaacuccuggc

SEQ ID NO: 2271767 - RNA, 15 nt, Human
cuugaacuccuggcc

SEQ ID NO: 2271768 - RNA, 17 nt, Human
cuugaacuccuggccuc

SEQ ID NO: 2271769 - RNA, 18 nt, Human
cuugaacuccuggccuca

SEQ ID NO: 2271770 - RNA, 20 nt, Human
cuugaacccgggaggcagag

SEQ ID NO: 2271771 - RNA, 19 nt, Human
cuugaacccgggaggcaga

SEQ ID NO: 2271772 - RNA, 14 nt, Human
cuugaacccgggag

SEQ ID NO: 2271773 - RNA, 23 nt, Human
cuugaggucuuuugacaugugga

SEQ ID NO: 2271774 - RNA, 22 nt, Human
cuugaggucuuuugacaugugg

SEQ ID NO: 2271775 - RNA, 18 nt, Human
cuugaggucuuuugacau

SEQ ID NO: 2271776 - RNA, 17 nt, Human
cuugaggucuuuugaca

SEQ ID NO: 2271777 - RNA, 14 nt, Human
cuugaggucuuuug

SEQ ID NO: 2271778 - RNA, 16 nt, Human
cuugagggcccagagc

SEQ ID NO: 2271779 - RNA, 17 nt, Human
cuugagggcccagagca

SEQ ID NO: 2271780 - RNA, 18 nt, Human
cuugagggcccagagcag

SEQ ID NO: 2271781 - RNA, 19 nt, Human
cuugagggcccagagcagg

SEQ ID NO: 2271782 - RNA, 14 nt, Human
cuugaggccaggag

SEQ ID NO: 2271783 - RNA, 17 nt, Human
cuugaggauuuugagua

SEQ ID NO: 2271784 - RNA, 16 nt, Human
cuugagggagcuuagc

SEQ ID NO: 2271785 - RNA, 24 nt, Human
cuugaggcuuagcuuugcucugcc

SEQ ID NO: 2271786 - RNA, 14 nt, Human
cuugagggcccaga

SEQ ID NO: 2271787 - RNA, 22 nt, Human
cuugaggagugugagaaucaaa

SEQ ID NO: 2271788 - RNA, 16 nt, Human
cuugaggauuuugagu

SEQ ID NO: 2271789 - RNA, 14 nt, Human
cuugaggaguguga

SEQ ID NO: 2271790 - RNA, 22 nt, Human
cuugaggaggggcagguaaacu

SEQ ID NO: 2271791 - RNA, 12 nt, Human
cuugagcccagg

SEQ ID NO: 2271792 - RNA, 13 nt, Human
cuugagcucagga

SEQ ID NO: 2271793 - RNA, 22 nt, Human
cuugagccuugaacuuugaccu

SEQ ID NO: 2271794 - RNA, 20 nt, Human
cuugagccuugaacuuugac

SEQ ID NO: 2271795 - RNA, 14 nt, Human
cuugagagggugga

SEQ ID NO: 2271796 - RNA, 21 nt, Human
cuugaccauucuccaccugcc

SEQ ID NO: 2271797 - RNA, 17 nt, Human
cuugaccauucuccacc

SEQ ID NO: 2271798 - RNA, 20 nt, Human
cuugaccauucuccaccugc

SEQ ID NO: 2271799 - RNA, 15 nt, Human
cuugagaugucuucu

SEQ ID NO: 2271800 - RNA, 19 nt, Human
cuugagcaaguuccuucug

SEQ ID NO: 2271801 - RNA, 22 nt, Human
cuugagaguaucaggucuccca

SEQ ID NO: 2271802 - RNA, 20 nt, Human
cuugagaguagaugguuuga

SEQ ID NO: 2271803 - RNA, 13 nt, Human
cuugagcaguggc

SEQ ID NO: 2271804 - RNA, 20 nt, Human
cuugagcaaguuccuucugg

SEQ ID NO: 2271805 - RNA, 21 nt, Human
cuugagcaaguuccuucuggu

SEQ ID NO: 2271806 - RNA, 14 nt, Human
cuugagcaguggcu

SEQ ID NO: 2271807 - RNA, 16 nt, Human
cuugagcaguggcugg

SEQ ID NO: 2271808 - RNA, 21 nt, Human
cuugagcaguggcugguccag

SEQ ID NO: 2271809 - RNA, 13 nt, Human
cuugagccaguaa

SEQ ID NO: 2271810 - RNA, 16 nt, Human
cuugagccaguaauug

SEQ ID NO: 2271811 - RNA, 19 nt, Human
cuugagccuugaacuuuga

SEQ ID NO: 2271812 - RNA, 21 nt, Human
cuugcaugguuuagaaagcuu

SEQ ID NO: 2271813 - RNA, 21 nt, Human
cuugcaugaggcuaguguggu

SEQ ID NO: 2271814 - RNA, 23 nt, Human
cuugcaucaauuuuucuuauuuc

SEQ ID NO: 2271815 - RNA, 18 nt, Human
cuugcagacucuacagag

SEQ ID NO: 2271816 - RNA, 14 nt, Human
cuugcaguagauuu

SEQ ID NO: 2271817 - RNA, 20 nt, Human
cuugcaggucucaacccuuu

SEQ ID NO: 2271818 - RNA, 18 nt, Human
cuugcaguucagcaccac

SEQ ID NO: 2271819 - RNA, 22 nt, Human
cuugcaguagauuuucuuuaaa

SEQ ID NO: 2271820 - RNA, 17 nt, Human
cuugcaguagauuuucu

SEQ ID NO: 2271821 - RNA, 21 nt, Human
cuugcaguagauuuucuuuaa

SEQ ID NO: 2271822 - RNA, 22 nt, Human
cuugcaguucagcaccacccua

SEQ ID NO: 2271823 - RNA, 20 nt, Human
cuugcauaauaagcuaaaga

SEQ ID NO: 2271824 - RNA, 22 nt, Human
cuugcauaauaagcuaaagagg

SEQ ID NO: 2271825 - RNA, 21 nt, Human
cuugcauaauaagcuaaagag

SEQ ID NO: 2271826 - RNA, 22 nt, Human
cuugagugggguuaucucugug

SEQ ID NO: 2271827 - RNA, 23 nt, Human
cuugagugggguuaucucugugu

SEQ ID NO: 2271828 - RNA, 21 nt, Human
cuugagugggguuaucucugu

SEQ ID NO: 2271829 - RNA, 14 nt, Human
cuugcaagaaucag

SEQ ID NO: 2271830 - RNA, 20 nt, Human
cuugcaacuucaugucaacu

SEQ ID NO: 2271831 - RNA, 19 nt, Human
cuugcaacacacagacaca

SEQ ID NO: 2271832 - RNA, 17 nt, Human
cuugcaacacacagaca

SEQ ID NO: 2271833 - RNA, 15 nt, Human
cuugcaacacacaga

SEQ ID NO: 2271834 - RNA, 14 nt, Human
cuugcaacacacag

SEQ ID NO: 2271835 - RNA, 22 nt, Human
cuugcaaaguaucccuacugua

SEQ ID NO: 2271836 - RNA, 21 nt, Human
cuugcacuaaaguauguaaag

SEQ ID NO: 2271837 - RNA, 14 nt, Human
cuugcaccugcauc

SEQ ID NO: 2271838 - RNA, 13 nt, Human
cuugcaccugcau

SEQ ID NO: 2271839 - RNA, 19 nt, Human
cuugcacgcccauguguga

SEQ ID NO: 2271840 - RNA, 14 nt, Human
cuugcaauggcagc

SEQ ID NO: 2271841 - RNA, 18 nt, Human
cuugcaagaaucagugca

SEQ ID NO: 2271842 - RNA, 22 nt, Human
cuugcaagaaucagugcaaaga

SEQ ID NO: 2271843 - RNA, 12 nt, Human
cuugcaccugca

SEQ ID NO: 2271844 - RNA, 18 nt, Human
cugcgcccaguccuucca

SEQ ID NO: 2271845 - RNA, 20 nt, Human
cugcgcccaccccgcucugc

SEQ ID NO: 2271846 - RNA, 22 nt, Human
cugcgcccaccccgcucugcau

SEQ ID NO: 2271847 - RNA, 19 nt, Human
cugcgcccaguccuuccac

SEQ ID NO: 2271848 - RNA, 23 nt, Human
cugcgcccaguccuuccaccucg

SEQ ID NO: 2271849 - RNA, 15 nt, Human
cugcgcccaccccgc

SEQ ID NO: 2271850 - RNA, 17 nt, Human
cugcgcccaccccgcuc

SEQ ID NO: 2271851 - RNA, 18 nt, Human
cugcgcccaccccgcucu

SEQ ID NO: 2271852 - RNA, 20 nt, Human
cugccuucgcuucuugccuc

SEQ ID NO: 2271853 - RNA, 21 nt, Human
cugccuuccuccugggcccuc

SEQ ID NO: 2271854 - RNA, 18 nt, Human
cugccuuccuccugggcc

SEQ ID NO: 2271855 - RNA, 12 nt, Human
cugccuuccuug

SEQ ID NO: 2271856 - RNA, 13 nt, Human
cugccuuccuugc

SEQ ID NO: 2271857 - RNA, 14 nt, Human
cugccuuccuugcu

SEQ ID NO: 2271858 - RNA, 15 nt, Human
cugccuuccuugcua

SEQ ID NO: 2271859 - RNA, 13 nt, Human
cugccuucgcuuc

SEQ ID NO: 2271860 - RNA, 14 nt, Human
cugccuucgcuucu

SEQ ID NO: 2271861 - RNA, 15 nt, Human
cugccuucgcuucuu

SEQ ID NO: 2271862 - RNA, 17 nt, Human
cugccuucgcuucuugc

SEQ ID NO: 2271863 - RNA, 23 nt, Human
cugccugcuuuucacugcugcaa

SEQ ID NO: 2271864 - RNA, 11 nt, Human
cugccuucccu

SEQ ID NO: 2271865 - RNA, 12 nt, Human
cugccuucccua

SEQ ID NO: 2271866 - RNA, 15 nt, Human
cugccuucccuagcu

SEQ ID NO: 2271867 - RNA, 16 nt, Human
cugccuucccuagcuu

SEQ ID NO: 2271868 - RNA, 17 nt, Human
cugccuucccuagcuuu

SEQ ID NO: 2271869 - RNA, 16 nt, Human
cugccuuccuccuggg

SEQ ID NO: 2271870 - RNA, 15 nt, Human
cugccuuccuccugg

SEQ ID NO: 2271871 - RNA, 14 nt, Human
cugccuuccuccug

SEQ ID NO: 2271872 - RNA, 13 nt, Human
cugccuuccuccu

SEQ ID NO: 2271873 - RNA, 22 nt, Human
cugccugcuuuuuauggccugu

SEQ ID NO: 2271874 - RNA, 20 nt, Human
cugccugcuuuucacugcug

SEQ ID NO: 2271875 - RNA, 22 nt, Human
cugccugcuuuucacugcugca

SEQ ID NO: 2271876 - RNA, 23 nt, Human
cugcgguccacccaggagccccg

SEQ ID NO: 2271877 - RNA, 23 nt, Human
cugcgggucacaggagggagggg

SEQ ID NO: 2271878 - RNA, 22 nt, Human
cugcgggucacaggagggaggg

SEQ ID NO: 2271879 - RNA, 18 nt, Human
cugcggugcuaucucccc

SEQ ID NO: 2271880 - RNA, 19 nt, Human
cugcggugcuaucuccccc

SEQ ID NO: 2271881 - RNA, 14 nt, Human
cugcgcccuucccc

SEQ ID NO: 2271882 - RNA, 13 nt, Human
cugcgcccuuccc

SEQ ID NO: 2271883 - RNA, 17 nt, Human
cugcgcccuuaccuucc

SEQ ID NO: 2271884 - RNA, 18 nt, Human
cugcgcccuuaccuuccc

SEQ ID NO: 2271885 - RNA, 13 nt, Human
cugcgcccugggc

SEQ ID NO: 2271886 - RNA, 14 nt, Human
cugcgcccugggcu

SEQ ID NO: 2271887 - RNA, 16 nt, Human
cugcgcccuuccccag

SEQ ID NO: 2271888 - RNA, 19 nt, Human
cugcgccgccgccggaguc

SEQ ID NO: 2271889 - RNA, 15 nt, Human
cugcggggcuuggcu

SEQ ID NO: 2271890 - RNA, 13 nt, Human
cugcgcuugcuuu

SEQ ID NO: 2271891 - RNA, 22 nt, Human
cugcgggcuggguguggucucc

SEQ ID NO: 2271892 - RNA, 21 nt, Human
cugcgggucacaggagggagg

SEQ ID NO: 2271893 - RNA, 15 nt, Human
cugcgggucacagga

SEQ ID NO: 2271894 - RNA, 18 nt, Human
cugcccugcccuagcucc

SEQ ID NO: 2271895 - RNA, 21 nt, Human
cugcccugcccaccuggccuc

SEQ ID NO: 2271896 - RNA, 18 nt, Human
cugccugaagucacacag

SEQ ID NO: 2271897 - RNA, 16 nt, Human
cugccugaagucacac

SEQ ID NO: 2271898 - RNA, 20 nt, Human
cugcccugcccaccuggccu

SEQ ID NO: 2271899 - RNA, 17 nt, Human
cugcccugcccaccugg

SEQ ID NO: 2271900 - RNA, 12 nt, Human
cugccugcccac

SEQ ID NO: 2271901 - RNA, 13 nt, Human
cugccugcccaca

SEQ ID NO: 2271902 - RNA, 21 nt, Human
cugccugccagcugcacugau

SEQ ID NO: 2271903 - RNA, 20 nt, Human
cugccugccagcugcacuga

SEQ ID NO: 2271904 - RNA, 16 nt, Human
cugccugccagcugca

SEQ ID NO: 2271905 - RNA, 15 nt, Human
cugccugccagcugc

SEQ ID NO: 2271906 - RNA, 23 nt, Human
cugccugcagaggucugugcuga

SEQ ID NO: 2271907 - RNA, 16 nt, Human
cugccugccuuggccu

SEQ ID NO: 2271908 - RNA, 18 nt, Human
cugccugcgcccaccccg

SEQ ID NO: 2271909 - RNA, 16 nt, Human
cugccugccugucugu

SEQ ID NO: 2271910 - RNA, 14 nt, Human
cugccugccugucu

SEQ ID NO: 2271911 - RNA, 15 nt, Human
cugccugccugucug

SEQ ID NO: 2271912 - RNA, 12 nt, Human
cugccugccugu

SEQ ID NO: 2271913 - RNA, 23 nt, Human
cugccugccgguaaacacgccug

SEQ ID NO: 2271914 - RNA, 19 nt, Human
cugccugaagucacacagu

SEQ ID NO: 2271915 - RNA, 12 nt, Human
cugcccugccug

SEQ ID NO: 2271916 - RNA, 15 nt, Human
cugccugcaccccug

SEQ ID NO: 2271917 - RNA, 13 nt, Human
cugcccugccuga

SEQ ID NO: 2271918 - RNA, 15 nt, Human
cugcccugccugagg

SEQ ID NO: 2271919 - RNA, 16 nt, Human
cugccugcagaggucu

SEQ ID NO: 2271920 - RNA, 19 nt, Human
cugccugcagaggucugug

SEQ ID NO: 2271921 - RNA, 21 nt, Human
cugccugcagaggucugugcu

SEQ ID NO: 2271922 - RNA, 22 nt, Human
cugccugcagaggucugugcug

SEQ ID NO: 2271923 - RNA, 20 nt, Human
cugccugcaguacuuuaccu

SEQ ID NO: 2271924 - RNA, 21 nt, Human
cugccugcaguacuuuaccuc

SEQ ID NO: 2271925 - RNA, 19 nt, Human
cugcugccuccccaacccu

SEQ ID NO: 2271926 - RNA, 15 nt, Human
cugcugccuccccaa

SEQ ID NO: 2271927 - RNA, 21 nt, Human
cugcugccgccucccagccug

SEQ ID NO: 2271928 - RNA, 14 nt, Human
cugcugccucccca

SEQ ID NO: 2271929 - RNA, 21 nt, Human
cugcugcaggggcucuggaga

SEQ ID NO: 2271930 - RNA, 14 nt, Human
cugcugccugcuuu

SEQ ID NO: 2271931 - RNA, 23 nt, Human
cugcugccugcuuuuuauggccu

SEQ ID NO: 2271932 - RNA, 15 nt, Human
cugcugcaguugcca

SEQ ID NO: 2271933 - RNA, 14 nt, Human
cugcugcaguugcc

SEQ ID NO: 2271934 - RNA, 10 nt, Human
cugcugcagu

SEQ ID NO: 2271935 - RNA, 13 nt, Human
cugcugcaguugc

SEQ ID NO: 2271936 - RNA, 12 nt, Human
cugcucugguua

SEQ ID NO: 2271937 - RNA, 15 nt, Human
cugcucugugcccac

SEQ ID NO: 2271938 - RNA, 19 nt, Human
cugcucuggaauuugcaag

SEQ ID NO: 2271939 - RNA, 19 nt, Human
cugcucuugaacuccugac

SEQ ID NO: 2271940 - RNA, 18 nt, Human
cugcucuugaacuccuga

SEQ ID NO: 2271941 - RNA, 16 nt, Human
cugcucuugaacuccu

SEQ ID NO: 2271942 - RNA, 11 nt, Human
cugcucugccc

SEQ ID NO: 2271943 - RNA, 20 nt, Human
cugcucugaugaagaggagu

SEQ ID NO: 2271944 - RNA, 20 nt, Human
cugcucuccaagucucagug

SEQ ID NO: 2271945 - RNA, 13 nt, Human
cugcucuggaaaa

SEQ ID NO: 2271946 - RNA, 18 nt, Human
cugcucuggaauuugcaa

SEQ ID NO: 2271947 - RNA, 22 nt, Human
cugcucugcccuuguucccuag

SEQ ID NO: 2271948 - RNA, 20 nt, Human
cugcucugcgugucaccugu

SEQ ID NO: 2271949 - RNA, 22 nt, Human
cugcucugcgugucaccugugc

SEQ ID NO: 2271950 - RNA, 21 nt, Human
cugcucugcgugucaccugug

SEQ ID NO: 2271951 - RNA, 17 nt, Human
cugcucccccacccccu

SEQ ID NO: 2271952 - RNA, 14 nt, Human
cugcucccccaccc

SEQ ID NO: 2271953 - RNA, 13 nt, Human
cugcucccccacc

SEQ ID NO: 2271954 - RNA, 12 nt, Human
cugcucccccac

SEQ ID NO: 2271955 - RNA, 16 nt, Human
cugcuccccaggggag

SEQ ID NO: 2271956 - RNA, 19 nt, Human
cugcuccccagcccuggcu

SEQ ID NO: 2271957 - RNA, 20 nt, Human
cugcuccccagcccuggcuc

SEQ ID NO: 2271958 - RNA, 20 nt, Human
cugcuccccagcagcggaac

SEQ ID NO: 2271959 - RNA, 22 nt, Human
cugcucccagcagcccuaagga

SEQ ID NO: 2271960 - RNA, 16 nt, Human
cugcuccccagcccug

SEQ ID NO: 2271961 - RNA, 17 nt, Human
cugcuccccagcccugg

SEQ ID NO: 2271962 - RNA, 18 nt, Human
cugcuccccagcccuggc

SEQ ID NO: 2271963 - RNA, 23 nt, Human
cugcgggugaacaaagcagccac

SEQ ID NO: 2271964 - RNA, 22 nt, Human
cugcgggugaacaaagcagcca

SEQ ID NO: 2271965 - RNA, 22 nt, Human
cugcgguuuguuggaucuucaa

SEQ ID NO: 2271966 - RNA, 14 nt, Human
cugcucccagcagc

SEQ ID NO: 2271967 - RNA, 15 nt, Human
cugcucccagcagcc

SEQ ID NO: 2271968 - RNA, 16 nt, Human
cugcucccagcagccc

SEQ ID NO: 2271969 - RNA, 17 nt, Human
cugcucccagcagcccu

SEQ ID NO: 2271970 - RNA, 21 nt, Human
cugcucccagcagcccuaagg

SEQ ID NO: 2271971 - RNA, 20 nt, Human
cugcggugcuaucuccccca

SEQ ID NO: 2271972 - RNA, 21 nt, Human
cugcggugcuaucucccccag

SEQ ID NO: 2271973 - RNA, 22 nt, Human
cugcggugcuaucucccccagc

SEQ ID NO: 2271974 - RNA, 23 nt, Human
cugcggugcuaucucccccagcc

SEQ ID NO: 2271975 - RNA, 23 nt, Human
cugcuccucuccccagcaaguga

SEQ ID NO: 2271976 - RNA, 22 nt, Human
cugcucccccacccccucccca

SEQ ID NO: 2271977 - RNA, 21 nt, Human
cugcucccccacccccucccc

SEQ ID NO: 2271978 - RNA, 23 nt, Human
cugcucccccacccccuccccag

SEQ ID NO: 2271979 - RNA, 19 nt, Human
cugcuccucuccccagcaa

SEQ ID NO: 2271980 - RNA, 20 nt, Human
cugcuccucuccccagcaag

SEQ ID NO: 2271981 - RNA, 15 nt, Human
cugcucuauuguagc

SEQ ID NO: 2271982 - RNA, 15 nt, Human
cugcucuccgaccag

SEQ ID NO: 2271983 - RNA, 23 nt, Human
cugcucuauuguagcauuucuug

SEQ ID NO: 2271984 - RNA, 21 nt, Human
cugcugguuaacuuguuuggc

SEQ ID NO: 2271985 - RNA, 18 nt, Human
cugcuggugcagagcuga

SEQ ID NO: 2271986 - RNA, 22 nt, Human
cugcuggugcagagcugaagau

SEQ ID NO: 2271987 - RNA, 11 nt, Human
cugcuguccag

SEQ ID NO: 2271988 - RNA, 14 nt, Human
cugcuguccagaca

SEQ ID NO: 2271989 - RNA, 15 nt, Human
cugcuguccagacag

SEQ ID NO: 2271990 - RNA, 16 nt, Human
cugcuguccagacagc

SEQ ID NO: 2271991 - RNA, 17 nt, Human
cugcuguccagacagcc

SEQ ID NO: 2271992 - RNA, 18 nt, Human
cugcuguccagacagccu

SEQ ID NO: 2271993 - RNA, 19 nt, Human
cugcuguccagacagccug

SEQ ID NO: 2271994 - RNA, 20 nt, Human
cugcuguccagacagccugu

SEQ ID NO: 2271995 - RNA, 21 nt, Human
cugcuguccagacagccugua

SEQ ID NO: 2271996 - RNA, 13 nt, Human
cugcuguccccuc

SEQ ID NO: 2271997 - RNA, 14 nt, Human
cugcuguccccucu

SEQ ID NO: 2271998 - RNA, 18 nt, Human
cugcuguccccucuugcc

SEQ ID NO: 2271999 - RNA, 19 nt, Human
cugcuguccccucuugccc

SEQ ID NO: 2272000 - RNA, 19 nt, Human
cugcuuccugucuuuggga

SEQ ID NO: 2272001 - RNA, 17 nt, Human
cugcugucccucccccu

SEQ ID NO: 2272002 - RNA, 20 nt, Human
cugcugucccucccccuugu

SEQ ID NO: 2272003 - RNA, 20 nt, Human
cugcuguccccucuugcccc

SEQ ID NO: 2272004 - RNA, 21 nt, Human
cugcuguccccucuugcccca

SEQ ID NO: 2272005 - RNA, 22 nt, Human
cugcuguccccucuugccccaa

SEQ ID NO: 2272006 - RNA, 23 nt, Human
cugcuguccccucuugccccaac

SEQ ID NO: 2272007 - RNA, 14 nt, Human
cugcuucuccagcc

SEQ ID NO: 2272008 - RNA, 15 nt, Human
cugcuucuccagccu

SEQ ID NO: 2272009 - RNA, 16 nt, Human
cugcuucuccagccug

SEQ ID NO: 2272010 - RNA, 19 nt, Human
cugcuucuccauggccacc

SEQ ID NO: 2272011 - RNA, 18 nt, Human
cugcuucucccacuuggc

SEQ ID NO: 2272012 - RNA, 20 nt, Human
cugcuucucccacuuggcca

SEQ ID NO: 2272013 - RNA, 21 nt, Human
cugcuucucccacuuggccaa

SEQ ID NO: 2272014 - RNA, 16 nt, Human
cugcuucuuaacccca

SEQ ID NO: 2272015 - RNA, 17 nt, Human
cugcuugacaacaucug

SEQ ID NO: 2272016 - RNA, 23 nt, Human
cugcuucucugacuucugccugg

SEQ ID NO: 2272017 - RNA, 21 nt, Human
cugcuucucugacuucugccu

SEQ ID NO: 2272018 - RNA, 22 nt, Human
cugcuucucugacuucugccug

SEQ ID NO: 2272019 - RNA, 13 nt, Human
cugcuucucugac

SEQ ID NO: 2272020 - RNA, 14 nt, Human
cugcuucucugacu

SEQ ID NO: 2272021 - RNA, 15 nt, Human
cugcuucucugacuu

SEQ ID NO: 2272022 - RNA, 16 nt, Human
cugcuucucugacuuc

SEQ ID NO: 2272023 - RNA, 17 nt, Human
cugcuucucugacuucu

SEQ ID NO: 2272024 - RNA, 19 nt, Human
cugcuucucugacuucugc

SEQ ID NO: 2272025 - RNA, 20 nt, Human
cugcuucucugacuucugcc

SEQ ID NO: 2272026 - RNA, 21 nt, Human
cugcuugaggcaacucaucuu

SEQ ID NO: 2272027 - RNA, 20 nt, Human
cugcuugaggcaacucaucu

SEQ ID NO: 2272028 - RNA, 13 nt, Human
cugcuugaggcaa

SEQ ID NO: 2272029 - RNA, 16 nt, Human
cugcuugaggaaaaca

SEQ ID NO: 2272030 - RNA, 14 nt, Human
cugcuugaggaaaa

SEQ ID NO: 2272031 - RNA, 13 nt, Human
cugcuugaggaaa

SEQ ID NO: 2272032 - RNA, 12 nt, Human
cugcuugaggaa

SEQ ID NO: 2272033 - RNA, 19 nt, Human
cugcuggguuuuccuccgg

SEQ ID NO: 2272034 - RNA, 21 nt, Human
cugcuggguggcccauccccc

SEQ ID NO: 2272035 - RNA, 18 nt, Human
cugcuggguggcccaucc

SEQ ID NO: 2272036 - RNA, 19 nt, Human
cugcuggguggcccauccc

SEQ ID NO: 2272037 - RNA, 14 nt, Human
cugcuggguggccc

SEQ ID NO: 2272038 - RNA, 15 nt, Human
cugcuggguggccca

SEQ ID NO: 2272039 - RNA, 16 nt, Human
cugcuggguggcccau

SEQ ID NO: 2272040 - RNA, 17 nt, Human
cugcuggguggcccauc

SEQ ID NO: 2272041 - RNA, 17 nt, Human
cugcuggguguggcgca

SEQ ID NO: 2272042 - RNA, 20 nt, Human
cugcuggucacagccuccuc

SEQ ID NO: 2272043 - RNA, 17 nt, Human
cugcuggucacagccuc

SEQ ID NO: 2272044 - RNA, 18 nt, Human
cugcuggucacagccucc

SEQ ID NO: 2272045 - RNA, 20 nt, Human
cugcugguaauuuguaucug

SEQ ID NO: 2272046 - RNA, 22 nt, Human
cugcugguaauuuguaucugaa

SEQ ID NO: 2272047 - RNA, 15 nt, Human
cugcuggucacagcc

SEQ ID NO: 2272048 - RNA, 16 nt, Human
cugcuggucacagccu

SEQ ID NO: 2272049 - RNA, 16 nt, Human
cugcugguccguggga

SEQ ID NO: 2272050 - RNA, 17 nt, Human
cugcugguccgugggac

SEQ ID NO: 2272051 - RNA, 14 nt, Human
cugcugggcucucc

SEQ ID NO: 2272052 - RNA, 11 nt, Human
cugcugggugg

SEQ ID NO: 2272053 - RNA, 12 nt, Human
cugcuggguggc

SEQ ID NO: 2272054 - RNA, 14 nt, Human
cugcuggguguggc

SEQ ID NO: 2272055 - RNA, 15 nt, Human
cugcuggguguggcg

SEQ ID NO: 2272056 - RNA, 13 nt, Human
cugcuggcugccu

SEQ ID NO: 2272057 - RNA, 14 nt, Human
cugcugcuggcugg

SEQ ID NO: 2272058 - RNA, 14 nt, Human
cugcuggcugccuu

SEQ ID NO: 2272059 - RNA, 15 nt, Human
cugcuggcugccuua

SEQ ID NO: 2272060 - RNA, 17 nt, Human
cugcugggacuggccag

SEQ ID NO: 2272061 - RNA, 16 nt, Human
cugcuggcuugcagug

SEQ ID NO: 2272062 - RNA, 14 nt, Human
cugcuggcuugcag

SEQ ID NO: 2272063 - RNA, 12 nt, Human
cugcuggcugcc

SEQ ID NO: 2272064 - RNA, 19 nt, Human
cugcugggacuggccaggu

SEQ ID NO: 2272065 - RNA, 15 nt, Human
cugcugcugcugcug

SEQ ID NO: 2272066 - RNA, 15 nt, Human
cugcugcuggaucac

SEQ ID NO: 2272067 - RNA, 14 nt, Human
cugcugcugcugug

SEQ ID NO: 2272068 - RNA, 15 nt, Human
cugcugcugcgcccu

SEQ ID NO: 2272069 - RNA, 16 nt, Human
cugcugcugcgcccuu

SEQ ID NO: 2272070 - RNA, 20 nt, Human
cugcugcugcgcccuuaccu

SEQ ID NO: 2272071 - RNA, 16 nt, Human
cugcugcugcugcgcc

SEQ ID NO: 2272072 - RNA, 12 nt, Human
cugcugcuggcu

SEQ ID NO: 2272073 - RNA, 13 nt, Human
cugcugcuggcug

SEQ ID NO: 2272074 - RNA, 20 nt, Human
cugcuugcuugcuuuuuaau

SEQ ID NO: 2272075 - RNA, 22 nt, Human
cugcuugaggcaacucaucuua

SEQ ID NO: 2272076 - RNA, 13 nt, Human
cugcuugauuuuu

SEQ ID NO: 2272077 - RNA, 20 nt, Human
cugcuugauuuuugccucuu

SEQ ID NO: 2272078 - RNA, 20 nt, Human
cugcuuggguggagaagcca

SEQ ID NO: 2272079 - RNA, 21 nt, Human
cugcuuggguggagaagccau

SEQ ID NO: 2272080 - RNA, 14 nt, Human
cugcuuggguggag

SEQ ID NO: 2272081 - RNA, 18 nt, Human
cugcuuggguggagaagc

SEQ ID NO: 2272082 - RNA, 19 nt, Human
cugcuugugaaaggaaaga

SEQ ID NO: 2272083 - RNA, 19 nt, Human
cugcuugggcuucauccuc

SEQ ID NO: 2272084 - RNA, 13 nt, Human
cugcuugggcuuc

SEQ ID NO: 2272085 - RNA, 15 nt, Human
cugcuugggcuucau

SEQ ID NO: 2272086 - RNA, 17 nt, Human
cugcuugggcuucaucc

SEQ ID NO: 2272087 - RNA, 18 nt, Human
cugcuugggcuucauccu

SEQ ID NO: 2272088 - RNA, 19 nt, Human
cuggaaggggcccguggga

SEQ ID NO: 2272089 - RNA, 17 nt, Human
cuggaaggggcccgugg

SEQ ID NO: 2272090 - RNA, 19 nt, Human
cuggaaggggaagggacac

SEQ ID NO: 2272091 - RNA, 16 nt, Human
cuggaagggcagagua

SEQ ID NO: 2272092 - RNA, 15 nt, Human
cuggaagggcuagaa

SEQ ID NO: 2272093 - RNA, 22 nt, Human
cuggaagggcuagaaccuguag

SEQ ID NO: 2272094 - RNA, 19 nt, Human
cuggaaguccaauguggca

SEQ ID NO: 2272095 - RNA, 16 nt, Human
cuggaaguccaaugug

SEQ ID NO: 2272096 - RNA, 18 nt, Human
cuggaagugacuuuggcu

SEQ ID NO: 2272097 - RNA, 15 nt, Human
cuggaagugacuuug

SEQ ID NO: 2272098 - RNA, 22 nt, Human
cuggaagcuguguccuugcacc

SEQ ID NO: 2272099 - RNA, 16 nt, Human
cuggaagcuguguccu

SEQ ID NO: 2272100 - RNA, 17 nt, Human
cuggaaggagugagagg

SEQ ID NO: 2272101 - RNA, 12 nt, Human
cuggaagcugug

SEQ ID NO: 2272102 - RNA, 22 nt, Human
cuggaagcuaauuugcauuaaa

SEQ ID NO: 2272103 - RNA, 22 nt, Human
cuggaagccggcggcccaagcc

SEQ ID NO: 2272104 - RNA, 19 nt, Human
cuggaagcuaauuugcauu

SEQ ID NO: 2272105 - RNA, 18 nt, Human
cuggaagcuaauuugcau

SEQ ID NO: 2272106 - RNA, 17 nt, Human
cuggaagcuaauuugca

SEQ ID NO: 2272107 - RNA, 18 nt, Human
cuggaagccggcggccca

SEQ ID NO: 2272108 - RNA, 17 nt, Human
cuggaagccagcuuucc

SEQ ID NO: 2272109 - RNA, 16 nt, Human
cuggaagccagcuuuc

SEQ ID NO: 2272110 - RNA, 15 nt, Human
cuggaagccagcuuu

SEQ ID NO: 2272111 - RNA, 22 nt, Human
cuggaagccaaaauguaggcuu

SEQ ID NO: 2272112 - RNA, 24 nt, Human
cugcuuuucugcccuggcugcugc

SEQ ID NO: 2272113 - RNA, 17 nt, Human
cugcuuuuggucugugu

SEQ ID NO: 2272114 - RNA, 22 nt, Human
cugcuuugacugagcagacugg

SEQ ID NO: 2272115 - RNA, 20 nt, Human
cugcuuugggaagccgugcu

SEQ ID NO: 2272116 - RNA, 16 nt, Human
cugcuuugggcugccc

SEQ ID NO: 2272117 - RNA, 23 nt, Human
cugcuuugacugagcagacuggu

SEQ ID NO: 2272118 - RNA, 21 nt, Human
cugcuuugcucuucaagaaau

SEQ ID NO: 2272119 - RNA, 13 nt, Human
cugcuuuggaaau

SEQ ID NO: 2272120 - RNA, 15 nt, Human
cugcuuuuggucugu

SEQ ID NO: 2272121 - RNA, 17 nt, Human
cugcuuugggcugcccu

SEQ ID NO: 2272122 - RNA, 19 nt, Human
cugcuuuucugcccuggcu

SEQ ID NO: 2272123 - RNA, 20 nt, Human
cugcuuuucugcccuggcug

SEQ ID NO: 2272124 - RNA, 21 nt, Human
cugcuuuucugcccuggcugc

SEQ ID NO: 2272125 - RNA, 22 nt, Human
cugcuuuucugcccuggcugcu

SEQ ID NO: 2272126 - RNA, 21 nt, Human
cugcuuugacugagcagacug

SEQ ID NO: 2272127 - RNA, 20 nt, Human
cugcuuugacugagcagacu

SEQ ID NO: 2272128 - RNA, 16 nt, Human
cugcuuucuguuguca

SEQ ID NO: 2272129 - RNA, 13 nt, Human
cugcuuguuuccu

SEQ ID NO: 2272130 - RNA, 22 nt, Human
cugcuuggguggagaagccauu

SEQ ID NO: 2272131 - RNA, 19 nt, Human
cugcuugugucccuccugg

SEQ ID NO: 2272132 - RNA, 14 nt, Human
cugcuuguuuccua

SEQ ID NO: 2272133 - RNA, 17 nt, Human
cugcagucuggcugagc

SEQ ID NO: 2272134 - RNA, 20 nt, Human
cugcagucuggcugagcccu

SEQ ID NO: 2272135 - RNA, 21 nt, Human
cugcagucuggcugagcccug

SEQ ID NO: 2272136 - RNA, 9 nt, Human
cugcaguga

SEQ ID NO: 2272137 - RNA, 22 nt, Human
cugcagugaaagacaagcugca

SEQ ID NO: 2272138 - RNA, 21 nt, Human
cugcagucagucaugauggca

SEQ ID NO: 2272139 - RNA, 19 nt, Human
cugcagucacuucguggga

SEQ ID NO: 2272140 - RNA, 22 nt, Human
cugcagucacuucgugggaucu

SEQ ID NO: 2272141 - RNA, 13 nt, Human
cugcagucacagc

SEQ ID NO: 2272142 - RNA, 14 nt, Human
cugcagucacagcu

SEQ ID NO: 2272143 - RNA, 22 nt, Human
cugcagucaucuugaccaagca

SEQ ID NO: 2272144 - RNA, 13 nt, Human
cugcaguccugga

SEQ ID NO: 2272145 - RNA, 21 nt, Human
cugcaguuugagacaggagac

SEQ ID NO: 2272146 - RNA, 19 nt, Human
cugcaguuugagacaggag

SEQ ID NO: 2272147 - RNA, 13 nt, Human
cugcaguugccag

SEQ ID NO: 2272148 - RNA, 16 nt, Human
cugcaguugccaguca

SEQ ID NO: 2272149 - RNA, 19 nt, Human
cugcaggucccuaauaaag

SEQ ID NO: 2272150 - RNA, 20 nt, Human
cugcaggucccuaauaaagc

SEQ ID NO: 2272151 - RNA, 21 nt, Human
cugcaggucccuaauaaagcu

SEQ ID NO: 2272152 - RNA, 22 nt, Human
cugcaggucccuaauaaagcug

SEQ ID NO: 2272153 - RNA, 23 nt, Human
cugcaggucccuaauaaagcugu

SEQ ID NO: 2272154 - RNA, 22 nt, Human
cugcaggguggugcugggacug

SEQ ID NO: 2272155 - RNA, 23 nt, Human
cugcaggguggugcugggacuga

SEQ ID NO: 2272156 - RNA, 14 nt, Human
cugcaggugcugcu

SEQ ID NO: 2272157 - RNA, 17 nt, Human
cugcaggugcugcugcg

SEQ ID NO: 2272158 - RNA, 19 nt, Human
cugcaggugcugcugcgug

SEQ ID NO: 2272159 - RNA, 20 nt, Human
cugcagguucuucuuccuga

SEQ ID NO: 2272160 - RNA, 21 nt, Human
cugcagguucuucuuccugaa

SEQ ID NO: 2272161 - RNA, 17 nt, Human
cugcaguaaaucuuuua

SEQ ID NO: 2272162 - RNA, 14 nt, Human
cugcaguaaaucuu

SEQ ID NO: 2272163 - RNA, 15 nt, Human
cugcagguugggcca

SEQ ID NO: 2272164 - RNA, 20 nt, Human
cugcagguugggccauacug

SEQ ID NO: 2272165 - RNA, 16 nt, Human
cugcaguaugaaaaua

SEQ ID NO: 2272166 - RNA, 17 nt, Human
cugcaguaugaaaauaa

SEQ ID NO: 2272167 - RNA, 15 nt, Human
cugcaguagucucug

SEQ ID NO: 2272168 - RNA, 16 nt, Human
cugcaguagucucugu

SEQ ID NO: 2272169 - RNA, 20 nt, Human
cugcaguagucucugugcuu

SEQ ID NO: 2272170 - RNA, 23 nt, Human
cugcaguagucucugugcuuuga

SEQ ID NO: 2272171 - RNA, 23 nt, Human
cugcagccagcccagcccagcug

SEQ ID NO: 2272172 - RNA, 15 nt, Human
cugcaggggcucugg

SEQ ID NO: 2272173 - RNA, 16 nt, Human
cugcaggggcucugga

SEQ ID NO: 2272174 - RNA, 17 nt, Human
cugcaggggcucuggag

SEQ ID NO: 2272175 - RNA, 22 nt, Human
cugcagccagcccagcccagcu

SEQ ID NO: 2272176 - RNA, 18 nt, Human
cugcagccagcccagccc

SEQ ID NO: 2272177 - RNA, 17 nt, Human
cugcagccagcccagcc

SEQ ID NO: 2272178 - RNA, 16 nt, Human
cugcagccagcccagc

SEQ ID NO: 2272179 - RNA, 15 nt, Human
cugcagccagcccag

SEQ ID NO: 2272180 - RNA, 14 nt, Human
cugcagccagccca

SEQ ID NO: 2272181 - RNA, 12 nt, Human
cugcagccagcc

SEQ ID NO: 2272182 - RNA, 22 nt, Human
cugcagcauguugcugaggagu

SEQ ID NO: 2272183 - RNA, 19 nt, Human
cugcagcaugaccugugac

SEQ ID NO: 2272184 - RNA, 18 nt, Human
cugcagcauguugcugag

SEQ ID NO: 2272185 - RNA, 20 nt, Human
cugcagcauguugcugagga

SEQ ID NO: 2272186 - RNA, 21 nt, Human
cugcagcauguugcugaggag

SEQ ID NO: 2272187 - RNA, 23 nt, Human
cugcagggggugugucugcucag

SEQ ID NO: 2272188 - RNA, 21 nt, Human
cugcaggggcucuggagagaa

SEQ ID NO: 2272189 - RNA, 16 nt, Human
cugcaggguggugcug

SEQ ID NO: 2272190 - RNA, 18 nt, Human
cugcaggguggugcuggg

SEQ ID NO: 2272191 - RNA, 19 nt, Human
cugcaggguggugcuggga

SEQ ID NO: 2272192 - RNA, 20 nt, Human
cugcaggguggugcugggac

SEQ ID NO: 2272193 - RNA, 21 nt, Human
cugcaggguggugcugggacu

SEQ ID NO: 2272194 - RNA, 20 nt, Human
cugcagggggugugucugcu

SEQ ID NO: 2272195 - RNA, 17 nt, Human
cugcagggggugugucu

SEQ ID NO: 2272196 - RNA, 18 nt, Human
cugcaggggcucuggaga

SEQ ID NO: 2272197 - RNA, 19 nt, Human
cugcaggggcucuggagag

SEQ ID NO: 2272198 - RNA, 22 nt, Human
cugcaggggcucuggagagaaa

SEQ ID NO: 2272199 - RNA, 22 nt, Human
cugcagcaugaccugugaccag

SEQ ID NO: 2272200 - RNA, 17 nt, Human
cugcagcaugaccugug

SEQ ID NO: 2272201 - RNA, 11 nt, Human
cugcagcauga

SEQ ID NO: 2272202 - RNA, 18 nt, Human
cugcagcagaggcacugg

SEQ ID NO: 2272203 - RNA, 19 nt, Human
cugcagcagcgguggccuc

SEQ ID NO: 2272204 - RNA, 20 nt, Human
cugcagcagcgguggccucu

SEQ ID NO: 2272205 - RNA, 13 nt, Human
cugcagcagaggc

SEQ ID NO: 2272206 - RNA, 14 nt, Human
cugcagcagaggca

SEQ ID NO: 2272207 - RNA, 23 nt, Human
cugcagaggggaaaccaguguag

SEQ ID NO: 2272208 - RNA, 19 nt, Human
cugcagauuugggcuggaa

SEQ ID NO: 2272209 - RNA, 20 nt, Human
cugcagauuugggcuggaac

SEQ ID NO: 2272210 - RNA, 23 nt, Human
cugcagauuugggcuggaacaga

SEQ ID NO: 2272211 - RNA, 17 nt, Human
cugcagcaauaaagcag

SEQ ID NO: 2272212 - RNA, 11 nt, Human
cugcagguccc

SEQ ID NO: 2272213 - RNA, 12 nt, Human
cugcaggucccu

SEQ ID NO: 2272214 - RNA, 13 nt, Human
cugcaggucccua

SEQ ID NO: 2272215 - RNA, 14 nt, Human
cugcaggucccuaa

SEQ ID NO: 2272216 - RNA, 15 nt, Human
cugcaggucccuaau

SEQ ID NO: 2272217 - RNA, 16 nt, Human
cugcaggucccuaaua

SEQ ID NO: 2272218 - RNA, 17 nt, Human
cugcaggucccuaauaa

SEQ ID NO: 2272219 - RNA, 18 nt, Human
cugcaggucccuaauaaa

SEQ ID NO: 2272220 - RNA, 15 nt, Human
cugcagacucacugu

SEQ ID NO: 2272221 - RNA, 20 nt, Human
cugcagaccuguccuccugg

SEQ ID NO: 2272222 - RNA, 22 nt, Human
cugcagaccuguccuccuggug

SEQ ID NO: 2272223 - RNA, 11 nt, Human
cugcagaccug

SEQ ID NO: 2272224 - RNA, 14 nt, Human
cugcagaccugucc

SEQ ID NO: 2272225 - RNA, 15 nt, Human
cugcagaccuguccu

SEQ ID NO: 2272226 - RNA, 16 nt, Human
cugcagaccuguccuc

SEQ ID NO: 2272227 - RNA, 18 nt, Human
cugcagaccuguccuccu

SEQ ID NO: 2272228 - RNA, 10 nt, Human
cugcagaggg

SEQ ID NO: 2272229 - RNA, 23 nt, Human
cugcagagcugcgggcugggugu

SEQ ID NO: 2272230 - RNA, 11 nt, Human
cugcagaggcc

SEQ ID NO: 2272231 - RNA, 13 nt, Human
cugcagaggccag

SEQ ID NO: 2272232 - RNA, 21 nt, Human
cugcagaggggaaaccagugu

SEQ ID NO: 2272233 - RNA, 21 nt, Human
cugcagaggccagaggccccc

SEQ ID NO: 2272234 - RNA, 17 nt, Human
cugcagaggccagaggc

SEQ ID NO: 2272235 - RNA, 20 nt, Human
cugcagaggccagaggcccc

SEQ ID NO: 2272236 - RNA, 13 nt, Human
cugcagagggcac

SEQ ID NO: 2272237 - RNA, 16 nt, Human
cugcagcaauaaagca

SEQ ID NO: 2272238 - RNA, 15 nt, Human
cugcagcaauaaagc

SEQ ID NO: 2272239 - RNA, 21 nt, Human
cugcacuggaguccagucucu

SEQ ID NO: 2272240 - RNA, 20 nt, Human
cugcacuccggccugaugac

SEQ ID NO: 2272241 - RNA, 18 nt, Human
cugcacuccccugcuggg

SEQ ID NO: 2272242 - RNA, 21 nt, Human
cugcacuccccugcugggugu

SEQ ID NO: 2272243 - RNA, 12 nt, Human
cugcacugucaa

SEQ ID NO: 2272244 - RNA, 16 nt, Human
cugcacuggggagccc

SEQ ID NO: 2272245 - RNA, 22 nt, Human
cugcacuggggagcccgucuca

SEQ ID NO: 2272246 - RNA, 22 nt, Human
cugcagaauuuggguucugccu

SEQ ID NO: 2272247 - RNA, 15 nt, Human
cugcagaccacgccc

SEQ ID NO: 2272248 - RNA, 19 nt, Human
cugcagaaggccaagaauc

SEQ ID NO: 2272249 - RNA, 19 nt, Human
cugcagaaggaaaaaugug

SEQ ID NO: 2272250 - RNA, 20 nt, Human
cugcagaaggaaaaaugugu

SEQ ID NO: 2272251 - RNA, 21 nt, Human
cugcagaaggaaaaaugugua

SEQ ID NO: 2272252 - RNA, 22 nt, Human
cugcagaaggaaaaauguguaa

SEQ ID NO: 2272253 - RNA, 13 nt, Human
cugcagaaggcca

SEQ ID NO: 2272254 - RNA, 14 nt, Human
cugcagaaggccaa

SEQ ID NO: 2272255 - RNA, 15 nt, Human
cugcagaaggccaag

SEQ ID NO: 2272256 - RNA, 16 nt, Human
cugcagaaggccaaga

SEQ ID NO: 2272257 - RNA, 11 nt, Human
cugcacugucc

SEQ ID NO: 2272258 - RNA, 13 nt, Human
cugcacuguccug

SEQ ID NO: 2272259 - RNA, 14 nt, Human
cugcacuguccugc

SEQ ID NO: 2272260 - RNA, 15 nt, Human
cugcacuguccugcu

SEQ ID NO: 2272261 - RNA, 16 nt, Human
cugcacuguccugcuc

SEQ ID NO: 2272262 - RNA, 17 nt, Human
cugcacuguccugcucc

SEQ ID NO: 2272263 - RNA, 14 nt, Human
cugcagaaggaaaa

SEQ ID NO: 2272264 - RNA, 15 nt, Human
cugcagaaggaaaaa

SEQ ID NO: 2272265 - RNA, 23 nt, Human
cugcacuguccugcuccacagug

SEQ ID NO: 2272266 - RNA, 18 nt, Human
cugcacuguccugcucca

SEQ ID NO: 2272267 - RNA, 19 nt, Human
cugcacuguccugcuccac

SEQ ID NO: 2272268 - RNA, 20 nt, Human
cugcacuguccugcuccaca

SEQ ID NO: 2272269 - RNA, 21 nt, Human
cugcacuguccugcuccacag

SEQ ID NO: 2272270 - RNA, 20 nt, Human
cugcacuccagccuggguga

SEQ ID NO: 2272271 - RNA, 20 nt, Human
cugcacuccagucuggguga

SEQ ID NO: 2272272 - RNA, 23 nt, Human
cugcacccuggggccuggaccug

SEQ ID NO: 2272273 - RNA, 18 nt, Human
cugcaccgggccacagag

SEQ ID NO: 2272274 - RNA, 14 nt, Human
cugcacuccccugc

SEQ ID NO: 2272275 - RNA, 13 nt, Human
cugcacuccccug

SEQ ID NO: 2272276 - RNA, 19 nt, Human
cugcacuccccugcugggu

SEQ ID NO: 2272277 - RNA, 20 nt, Human
cugcacuccccugcugggug

SEQ ID NO: 2272278 - RNA, 14 nt, Human
cugcaccgggccac

SEQ ID NO: 2272279 - RNA, 15 nt, Human
cugcaccgggccaca

SEQ ID NO: 2272280 - RNA, 15 nt, Human
cugcaccggcuggcc

SEQ ID NO: 2272281 - RNA, 16 nt, Human
cugcaccggcuggccu

SEQ ID NO: 2272282 - RNA, 22 nt, Human
cugaggcccuucucuccagccc

SEQ ID NO: 2272283 - RNA, 23 nt, Human
cugaggcccuucucuccagcccc

SEQ ID NO: 2272284 - RNA, 21 nt, Human
cugaggccccuucuagguggc

SEQ ID NO: 2272285 - RNA, 16 nt, Human
cugcacccuggggccu

SEQ ID NO: 2272286 - RNA, 21 nt, Human
cugcacccuggggccuggacc

SEQ ID NO: 2272287 - RNA, 22 nt, Human
cugcacccuggggccuggaccu

SEQ ID NO: 2272288 - RNA, 14 nt, Human
cugcaccggcuggc

SEQ ID NO: 2272289 - RNA, 19 nt, Human
cugccacccuaccuguuca

SEQ ID NO: 2272290 - RNA, 11 nt, Human
cugccaccucc

SEQ ID NO: 2272291 - RNA, 21 nt, Human
cugccacccuggggagaaagu

SEQ ID NO: 2272292 - RNA, 14 nt, Human
cugccacccugggg

SEQ ID NO: 2272293 - RNA, 12 nt, Human
cugccacccugg

SEQ ID NO: 2272294 - RNA, 11 nt, Human
cugccagagaa

SEQ ID NO: 2272295 - RNA, 23 nt, Human
cugccagaagauccccucaggac

SEQ ID NO: 2272296 - RNA, 22 nt, Human
cugccagacggcacccacccag

SEQ ID NO: 2272297 - RNA, 19 nt, Human
cugccagacccccuggaga

SEQ ID NO: 2272298 - RNA, 17 nt, Human
cugccagacccccugga

SEQ ID NO: 2272299 - RNA, 17 nt, Human
cugccaccucccugacc

SEQ ID NO: 2272300 - RNA, 18 nt, Human
cugccaccucccugaccc

SEQ ID NO: 2272301 - RNA, 21 nt, Human
cugccagaagauccccucagg

SEQ ID NO: 2272302 - RNA, 22 nt, Human
cugccagaagauccccucagga

SEQ ID NO: 2272303 - RNA, 22 nt, Human
cugccaccuccccuauccaccc

SEQ ID NO: 2272304 - RNA, 14 nt, Human
cugccaccuccccu

SEQ ID NO: 2272305 - RNA, 12 nt, Human
cugccaccuccc

SEQ ID NO: 2272306 - RNA, 13 nt, Human
cugccaccucccc

SEQ ID NO: 2272307 - RNA, 13 nt, Human
cugccaccucccu

SEQ ID NO: 2272308 - RNA, 15 nt, Human
cugccaccucccuga

SEQ ID NO: 2272309 - RNA, 16 nt, Human
cugccaccucccugac

SEQ ID NO: 2272310 - RNA, 16 nt, Human
cugcauaccaaccugg

SEQ ID NO: 2272311 - RNA, 14 nt, Human
cugcauacuuuuua

SEQ ID NO: 2272312 - RNA, 20 nt, Human
cugcauacuuuuuaaaugua

SEQ ID NO: 2272313 - RNA, 15 nt, Human
cugcauaugaaagga

SEQ ID NO: 2272314 - RNA, 15 nt, Human
cugcauaccaaccug

SEQ ID NO: 2272315 - RNA, 14 nt, Human
cugcauacaaucug

SEQ ID NO: 2272316 - RNA, 21 nt, Human
cugcauaguauuccauugugu

SEQ ID NO: 2272317 - RNA, 21 nt, Human
cugcauauguugaauacuuuu

SEQ ID NO: 2272318 - RNA, 14 nt, Human
cugcauauguugaa

SEQ ID NO: 2272319 - RNA, 20 nt, Human
cugcaucaagaugugacaug

SEQ ID NO: 2272320 - RNA, 20 nt, Human
cugccacccaccucccugcc

SEQ ID NO: 2272321 - RNA, 23 nt, Human
cugccacccaccucccugccucc

SEQ ID NO: 2272322 - RNA, 22 nt, Human
cugccacccaccucccugccuc

SEQ ID NO: 2272323 - RNA, 20 nt, Human
cugcaucagcugcugaaaca

SEQ ID NO: 2272324 - RNA, 19 nt, Human
cugccacccaccucccugc

SEQ ID NO: 2272325 - RNA, 15 nt, Human
cugccacccuaccug

SEQ ID NO: 2272326 - RNA, 21 nt, Human
cugccauggaggcacacagcu

SEQ ID NO: 2272327 - RNA, 23 nt, Human
cugccauggaggcacacagcugc

SEQ ID NO: 2272328 - RNA, 21 nt, Human
cugccauggcgugucccucuc

SEQ ID NO: 2272329 - RNA, 14 nt, Human
cugccauggcgugu

SEQ ID NO: 2272330 - RNA, 22 nt, Human
cugccauggcgugucccucucg

SEQ ID NO: 2272331 - RNA, 20 nt, Human
cugccauggaggcacacagc

SEQ ID NO: 2272332 - RNA, 15 nt, Human
cugccauccucccaa

SEQ ID NO: 2272333 - RNA, 21 nt, Human
cugccauccagguucagcuug

SEQ ID NO: 2272334 - RNA, 22 nt, Human
cugccaggaagccagcaggcuc

SEQ ID NO: 2272335 - RNA, 17 nt, Human
cugccagcugcacugau

SEQ ID NO: 2272336 - RNA, 16 nt, Human
cugccagcugcacuga

SEQ ID NO: 2272337 - RNA, 13 nt, Human
cugccagagaagc

SEQ ID NO: 2272338 - RNA, 13 nt, Human
cugccagaugcug

SEQ ID NO: 2272339 - RNA, 20 nt, Human
cugccagagaagcaucggag

SEQ ID NO: 2272340 - RNA, 14 nt, Human
cugccagaugcuga

SEQ ID NO: 2272341 - RNA, 16 nt, Human
cugccagaugcugaug

SEQ ID NO: 2272342 - RNA, 17 nt, Human
cugccagaugcugaugu

SEQ ID NO: 2272343 - RNA, 18 nt, Human
cugccagaugcugauguu

SEQ ID NO: 2272344 - RNA, 15 nt, Human
cugccagcaacgcag

SEQ ID NO: 2272345 - RNA, 23 nt, Human
cugccagaugcugauguucagug

SEQ ID NO: 2272346 - RNA, 17 nt, Human
cugccagcucuguauca

SEQ ID NO: 2272347 - RNA, 21 nt, Human
cugccagaugcugauguucag

SEQ ID NO: 2272348 - RNA, 22 nt, Human
cugccagaugcugauguucagu

SEQ ID NO: 2272349 - RNA, 11 nt, Human
cugccagcugc

SEQ ID NO: 2272350 - RNA, 13 nt, Human
cugccagcugcac

SEQ ID NO: 2272351 - RNA, 12 nt, Human
cugccagcugca

SEQ ID NO: 2272352 - RNA, 13 nt, Human
cugccaggaagcc

SEQ ID NO: 2272353 - RNA, 14 nt, Human
cugccaggaagcca

SEQ ID NO: 2272354 - RNA, 20 nt, Human
cugccaggaagccagcaggc

SEQ ID NO: 2272355 - RNA, 21 nt, Human
cugccaggaagccagcaggcu

SEQ ID NO: 2272356 - RNA, 17 nt, Human
cugcccgagcuggugca

SEQ ID NO: 2272357 - RNA, 13 nt, Human
cugcccgcuccca

SEQ ID NO: 2272358 - RNA, 14 nt, Human
cugcccgcucccag

SEQ ID NO: 2272359 - RNA, 15 nt, Human
cugcccgcucccagu

SEQ ID NO: 2272360 - RNA, 16 nt, Human
cugcccgagcuggugc

SEQ ID NO: 2272361 - RNA, 15 nt, Human
cugcccgagcuggug

SEQ ID NO: 2272362 - RNA, 14 nt, Human
cugcccgagcuggu

SEQ ID NO: 2272363 - RNA, 18 nt, Human
cugccccuguucucuucc

SEQ ID NO: 2272364 - RNA, 21 nt, Human
cugcccgagcuggugcauuac

SEQ ID NO: 2272365 - RNA, 20 nt, Human
cugcccggcaggguccuaga

SEQ ID NO: 2272366 - RNA, 13 nt, Human
cugcccggcaggg

SEQ ID NO: 2272367 - RNA, 16 nt, Human
cugccccuggcucuga

SEQ ID NO: 2272368 - RNA, 13 nt, Human
cugccccuguucu

SEQ ID NO: 2272369 - RNA, 14 nt, Human
cugccccagcucug

SEQ ID NO: 2272370 - RNA, 13 nt, Human
cugcccgagcugg

SEQ ID NO: 2272371 - RNA, 19 nt, Human
cugccccuggcagccccug

SEQ ID NO: 2272372 - RNA, 15 nt, Human
cugccccagcucugg

SEQ ID NO: 2272373 - RNA, 13 nt, Human
cugccccagcucu

SEQ ID NO: 2272374 - RNA, 18 nt, Human
cugccccagcccaagucc

SEQ ID NO: 2272375 - RNA, 19 nt, Human
cugccccagcccaagucca

SEQ ID NO: 2272376 - RNA, 18 nt, Human
cugccccuggcagccccu

SEQ ID NO: 2272377 - RNA, 18 nt, Human
cugcccucguggccagcc

SEQ ID NO: 2272378 - RNA, 19 nt, Human
cugcccucguggccagccc

SEQ ID NO: 2272379 - RNA, 20 nt, Human
cugcccucguggccagcccg

SEQ ID NO: 2272380 - RNA, 23 nt, Human
cugcccucguggccagcccggcu

SEQ ID NO: 2272381 - RNA, 21 nt, Human
cugcccucguggccagcccgg

SEQ ID NO: 2272382 - RNA, 22 nt, Human
cugcccucguggccagcccggc

SEQ ID NO: 2272383 - RNA, 21 nt, Human
cugcccgucuucagccuagcc

SEQ ID NO: 2272384 - RNA, 18 nt, Human
cugcccuacagaggucuc

SEQ ID NO: 2272385 - RNA, 22 nt, Human
cugcccuaaugcgcaggcuggc

SEQ ID NO: 2272386 - RNA, 18 nt, Human
cugcccgucuucagccua

SEQ ID NO: 2272387 - RNA, 17 nt, Human
cugcccgucuucagccu

SEQ ID NO: 2272388 - RNA, 16 nt, Human
cugcccgucuucagcc

SEQ ID NO: 2272389 - RNA, 15 nt, Human
cugcccgucuucagc

SEQ ID NO: 2272390 - RNA, 21 nt, Human
cugcccuaaugcgcaggcugg

SEQ ID NO: 2272391 - RNA, 20 nt, Human
cugcccuaaugcgcaggcug

SEQ ID NO: 2272392 - RNA, 22 nt, Human
cugcccggggcagcugccagag

SEQ ID NO: 2272393 - RNA, 21 nt, Human
cugcccggggcagcugccaga

SEQ ID NO: 2272394 - RNA, 20 nt, Human
cugcccggggcagcugccag

SEQ ID NO: 2272395 - RNA, 19 nt, Human
cugcccggggcagcugcca

SEQ ID NO: 2272396 - RNA, 16 nt, Human
cugcccggggcagcug

SEQ ID NO: 2272397 - RNA, 15 nt, Human
cugcccggggcagcu

SEQ ID NO: 2272398 - RNA, 13 nt, Human
cugcccggggcag

SEQ ID NO: 2272399 - RNA, 21 nt, Human
cugcccgggcgcggccagccc

SEQ ID NO: 2272400 - RNA, 16 nt, Human
cugcccgcucccagug

SEQ ID NO: 2272401 - RNA, 17 nt, Human
cugcccgcucccagugu

SEQ ID NO: 2272402 - RNA, 19 nt, Human
cugcccgcucccagugucu

SEQ ID NO: 2272403 - RNA, 19 nt, Human
cugcccgggcgcggccagc

SEQ ID NO: 2272404 - RNA, 23 nt, Human
cugcccggggcagcugccagaga

SEQ ID NO: 2272405 - RNA, 19 nt, Human
cugcccguaaacacgccug

SEQ ID NO: 2272406 - RNA, 18 nt, Human
cugcccguaaacacgccu

SEQ ID NO: 2272407 - RNA, 21 nt, Human
cugcccguaaacacgccugca

SEQ ID NO: 2272408 - RNA, 18 nt, Human
cugcccgucucucuccca

SEQ ID NO: 2272409 - RNA, 19 nt, Human
cugcccgucucucucccau

SEQ ID NO: 2272410 - RNA, 21 nt, Human
cugcccgucucucucccaugg

SEQ ID NO: 2272411 - RNA, 22 nt, Human
cugcccgucucucucccaugga

SEQ ID NO: 2272412 - RNA, 23 nt, Human
cugcccgucucucucccauggag

SEQ ID NO: 2272413 - RNA, 24 nt, Human
cugcccgucucucucccauggagc

SEQ ID NO: 2272414 - RNA, 17 nt, Human
cugcccacauuggaccc

SEQ ID NO: 2272415 - RNA, 21 nt, Human
cugcccaauuuugcagggagc

SEQ ID NO: 2272416 - RNA, 21 nt, Human
cugcccaauaugcaguucugc

SEQ ID NO: 2272417 - RNA, 16 nt, Human
cugcccaauuggagga

SEQ ID NO: 2272418 - RNA, 16 nt, Human
cugcccacccccucaa

SEQ ID NO: 2272419 - RNA, 19 nt, Human
cugcccacccccucaagcc

SEQ ID NO: 2272420 - RNA, 12 nt, Human
cugcccaccccc

SEQ ID NO: 2272421 - RNA, 13 nt, Human
cugcccacccccu

SEQ ID NO: 2272422 - RNA, 14 nt, Human
cugcccacccccuc

SEQ ID NO: 2272423 - RNA, 15 nt, Human
cugcccacccccuca

SEQ ID NO: 2272424 - RNA, 15 nt, Human
cugccauuucugaga

SEQ ID NO: 2272425 - RNA, 17 nt, Human
cugccauucacuucaua

SEQ ID NO: 2272426 - RNA, 19 nt, Human
cugcccaaccugcucuccu

SEQ ID NO: 2272427 - RNA, 14 nt, Human
cugcccaggccccu

SEQ ID NO: 2272428 - RNA, 15 nt, Human
cugcccaggccccug

SEQ ID NO: 2272429 - RNA, 12 nt, Human
cugcccaccugg

SEQ ID NO: 2272430 - RNA, 20 nt, Human
cugccccaacuccuggaagc

SEQ ID NO: 2272431 - RNA, 18 nt, Human
cugccccaacuccuggaa

SEQ ID NO: 2272432 - RNA, 17 nt, Human
cugccccaacuccugga

SEQ ID NO: 2272433 - RNA, 16 nt, Human
cugccccaacuccugg

SEQ ID NO: 2272434 - RNA, 21 nt, Human
cugccccaacuccuggaagcu

SEQ ID NO: 2272435 - RNA, 14 nt, Human
cugccccaacuccu

SEQ ID NO: 2272436 - RNA, 12 nt, Human
cugcccacccgu

SEQ ID NO: 2272437 - RNA, 17 nt, Human
cugcccaggccugccug

SEQ ID NO: 2272438 - RNA, 12 nt, Human
cugccccaacuc

SEQ ID NO: 2272439 - RNA, 13 nt, Human
cugccccaacucu

SEQ ID NO: 2272440 - RNA, 23 nt, Human
cugccccaccccuccccauuagc

SEQ ID NO: 2272441 - RNA, 13 nt, Human
cugccccagaggc

SEQ ID NO: 2272442 - RNA, 13 nt, Human
cugccccagccag

SEQ ID NO: 2272443 - RNA, 14 nt, Human
cugccccagccaga

SEQ ID NO: 2272444 - RNA, 13 nt, Human
cugccccagccca

SEQ ID NO: 2272445 - RNA, 16 nt, Human
cugccccagcccaagu

SEQ ID NO: 2272446 - RNA, 17 nt, Human
cugccccagcccaaguc

SEQ ID NO: 2272447 - RNA, 16 nt, Human
cugcccaggccccugc

SEQ ID NO: 2272448 - RNA, 18 nt, Human
cugcccaggccccugcca

SEQ ID NO: 2272449 - RNA, 19 nt, Human
cugcccaggccccugccac

SEQ ID NO: 2272450 - RNA, 20 nt, Human
cugcccaggccccugccacc

SEQ ID NO: 2272451 - RNA, 16 nt, Human
cuggcauuacagcugg

SEQ ID NO: 2272452 - RNA, 15 nt, Human
cuggcauuacagcug

SEQ ID NO: 2272453 - RNA, 24 nt, Human
cuggcaugggaaugaaugucagug

SEQ ID NO: 2272454 - RNA, 18 nt, Human
cuggcauuagaauuauuu

SEQ ID NO: 2272455 - RNA, 19 nt, Human
cuggcauuagaauuauuua

SEQ ID NO: 2272456 - RNA, 13 nt, Human
cuggccaccaccc

SEQ ID NO: 2272457 - RNA, 14 nt, Human
cuggccaccacccc

SEQ ID NO: 2272458 - RNA, 16 nt, Human
cuggccaccacccccc

SEQ ID NO: 2272459 - RNA, 19 nt, Human
cuggccaccaccccccacu

SEQ ID NO: 2272460 - RNA, 20 nt, Human
cuggccaccaccccccacuc

SEQ ID NO: 2272461 - RNA, 21 nt, Human
cuggccaccaccccccacucu

SEQ ID NO: 2272462 - RNA, 18 nt, Human
cuggccaccugagguggg

SEQ ID NO: 2272463 - RNA, 20 nt, Human
cuggccaccugaggugggcc

SEQ ID NO: 2272464 - RNA, 21 nt, Human
cuggccaccugaggugggccc

SEQ ID NO: 2272465 - RNA, 22 nt, Human
cuggccaccugaggugggccca

SEQ ID NO: 2272466 - RNA, 13 nt, Human
cuggccagcccca

SEQ ID NO: 2272467 - RNA, 14 nt, Human
cuggccagccccac

SEQ ID NO: 2272468 - RNA, 15 nt, Human
cuggccagccccaca

SEQ ID NO: 2272469 - RNA, 16 nt, Human
cuggccagccccacag

SEQ ID NO: 2272470 - RNA, 13 nt, Human
cuggccaccaggc

SEQ ID NO: 2272471 - RNA, 15 nt, Human
cuggccaccaggcug

SEQ ID NO: 2272472 - RNA, 16 nt, Human
cuggccaccaggcugg

SEQ ID NO: 2272473 - RNA, 17 nt, Human
cuggccaccaggcuggc

SEQ ID NO: 2272474 - RNA, 18 nt, Human
cuggccaccaggcuggcg

SEQ ID NO: 2272475 - RNA, 19 nt, Human
cuggccaccaggcuggcgc

SEQ ID NO: 2272476 - RNA, 20 nt, Human
cuggccaccaggcuggcgca

SEQ ID NO: 2272477 - RNA, 21 nt, Human
cuggccaccaggcuggcgcag

SEQ ID NO: 2272478 - RNA, 22 nt, Human
cuggccaccaggcuggcgcagc

SEQ ID NO: 2272479 - RNA, 23 nt, Human
cuggccaccaggcuggcgcagcc

SEQ ID NO: 2272480 - RNA, 16 nt, Human
cuggccaccucucucc

SEQ ID NO: 2272481 - RNA, 18 nt, Human
cuggccaccucucuccuu

SEQ ID NO: 2272482 - RNA, 11 nt, Human
cuggccaccug

SEQ ID NO: 2272483 - RNA, 15 nt, Human
cuggccaccugaggu

SEQ ID NO: 2272484 - RNA, 16 nt, Human
cuggccaccugaggug

SEQ ID NO: 2272485 - RNA, 17 nt, Human
cuggccaccugaggugg

SEQ ID NO: 2272486 - RNA, 21 nt, Human
cuggcacgguggcucaggccu

SEQ ID NO: 2272487 - RNA, 17 nt, Human
cuggcaccgccuucucu

SEQ ID NO: 2272488 - RNA, 20 nt, Human
cuggcaauaguguguucuga

SEQ ID NO: 2272489 - RNA, 22 nt, Human
cuggcacuauaauguaagcucu

SEQ ID NO: 2272490 - RNA, 16 nt, Human
cuggcacuauaaugua

SEQ ID NO: 2272491 - RNA, 15 nt, Human
cuggcacuauaaugu

SEQ ID NO: 2272492 - RNA, 16 nt, Human
cuggcaugggaaugaa

SEQ ID NO: 2272493 - RNA, 18 nt, Human
cuggcaugggaaugaaug

SEQ ID NO: 2272494 - RNA, 19 nt, Human
cuggcaugggaaugaaugu

SEQ ID NO: 2272495 - RNA, 22 nt, Human
cuggcaugggaaugaaugucag

SEQ ID NO: 2272496 - RNA, 14 nt, Human
cuggcaagaaugug

SEQ ID NO: 2272497 - RNA, 17 nt, Human
cuggcaacaucuuuauc

SEQ ID NO: 2272498 - RNA, 19 nt, Human
cuggcaagcuagaaccugg

SEQ ID NO: 2272499 - RNA, 22 nt, Human
cuggcaagcuagaaccuggagg

SEQ ID NO: 2272500 - RNA, 16 nt, Human
cuggcaaggacacaga

SEQ ID NO: 2272501 - RNA, 24 nt, Human
cuggaaucuggagaccagggagcc

SEQ ID NO: 2272502 - RNA, 19 nt, Human
cuggaaucuggagagcuag

SEQ ID NO: 2272503 - RNA, 20 nt, Human
cuggaaucuggagagcuaga

SEQ ID NO: 2272504 - RNA, 19 nt, Human
cuggcaaagggagcagaac

SEQ ID NO: 2272505 - RNA, 14 nt, Human
cuggcaacaucuuu

SEQ ID NO: 2272506 - RNA, 22 nt, Human
cuggcaaagggagcagaacuga

SEQ ID NO: 2272507 - RNA, 18 nt, Human
cuggcaaagguggcucuc

SEQ ID NO: 2272508 - RNA, 21 nt, Human
cuggcaaagguggcucuccag

SEQ ID NO: 2272509 - RNA, 22 nt, Human
cuggcaaagguggcucuccagu

SEQ ID NO: 2272510 - RNA, 23 nt, Human
cuggaaucaagaugucagacugg

SEQ ID NO: 2272511 - RNA, 23 nt, Human
cuggaaucaggaauauuuuccaa

SEQ ID NO: 2272512 - RNA, 18 nt, Human
cuggaauacaugaaauau

SEQ ID NO: 2272513 - RNA, 20 nt, Human
cuggaagguggggacaggga

SEQ ID NO: 2272514 - RNA, 17 nt, Human
cuggaaucuggagacca

SEQ ID NO: 2272515 - RNA, 19 nt, Human
cuggaaucuggagaccagg

SEQ ID NO: 2272516 - RNA, 18 nt, Human
cuggaaucuggagaccag

SEQ ID NO: 2272517 - RNA, 20 nt, Human
cuggaagugcuaauuuugaa

SEQ ID NO: 2272518 - RNA, 18 nt, Human
cuggaauauauaaccagu

SEQ ID NO: 2272519 - RNA, 16 nt, Human
cuggcacccggccccu

SEQ ID NO: 2272520 - RNA, 17 nt, Human
cuggcacccggccccug

SEQ ID NO: 2272521 - RNA, 18 nt, Human
cuggcacccggccccugc

SEQ ID NO: 2272522 - RNA, 22 nt, Human
cuggcacccggccccugcuggu

SEQ ID NO: 2272523 - RNA, 19 nt, Human
cuggcaauaguguguucug

SEQ ID NO: 2272524 - RNA, 15 nt, Human
cuggcaauagugugu

SEQ ID NO: 2272525 - RNA, 15 nt, Human
cuggcacagggcagu

SEQ ID NO: 2272526 - RNA, 16 nt, Human
cuggcacagggcagug

SEQ ID NO: 2272527 - RNA, 17 nt, Human
cuggcaaggacacagau

SEQ ID NO: 2272528 - RNA, 18 nt, Human
cuggcaaggacacagaug

SEQ ID NO: 2272529 - RNA, 14 nt, Human
cuggccucccacag

SEQ ID NO: 2272530 - RNA, 12 nt, Human
cuggccucccac

SEQ ID NO: 2272531 - RNA, 13 nt, Human
cuggccucccaca

SEQ ID NO: 2272532 - RNA, 16 nt, Human
cuggccucccaaauga

SEQ ID NO: 2272533 - RNA, 12 nt, Human
cuggccucugca

SEQ ID NO: 2272534 - RNA, 22 nt, Human
cuggccucaggugggccgcagg

SEQ ID NO: 2272535 - RNA, 14 nt, Human
cuggccucccaaau

SEQ ID NO: 2272536 - RNA, 13 nt, Human
cuggccuccacag

SEQ ID NO: 2272537 - RNA, 16 nt, Human
cuggccccaugucucu

SEQ ID NO: 2272538 - RNA, 17 nt, Human
cuggccccauggucagc

SEQ ID NO: 2272539 - RNA, 21 nt, Human
cuggccccaggaccuggcugc

SEQ ID NO: 2272540 - RNA, 15 nt, Human
cuggcccccagcugu

SEQ ID NO: 2272541 - RNA, 21 nt, Human
cuggccccaugucucucagaa

SEQ ID NO: 2272542 - RNA, 19 nt, Human
cuggccccaugucucucag

SEQ ID NO: 2272543 - RNA, 23 nt, Human
cuggccucaagugauucuccugc

SEQ ID NO: 2272544 - RNA, 11 nt, Human
cuggccaggca

SEQ ID NO: 2272545 - RNA, 23 nt, Human
cuggccaggauggaggggugguc

SEQ ID NO: 2272546 - RNA, 12 nt, Human
cuggccaggaug

SEQ ID NO: 2272547 - RNA, 22 nt, Human
cuggccaggagcucuucaggcc

SEQ ID NO: 2272548 - RNA, 20 nt, Human
cuggccaggagcucuucagg

SEQ ID NO: 2272549 - RNA, 17 nt, Human
cuggccaggagcucuuc

SEQ ID NO: 2272550 - RNA, 15 nt, Human
cuggccaggagcucu

SEQ ID NO: 2272551 - RNA, 13 nt, Human
cuggccaggagcu

SEQ ID NO: 2272552 - RNA, 12 nt, Human
cuggccaggagc

SEQ ID NO: 2272553 - RNA, 17 nt, Human
cuggccagccccacagc

SEQ ID NO: 2272554 - RNA, 18 nt, Human
cuggccagccccacagcc

SEQ ID NO: 2272555 - RNA, 19 nt, Human
cuggccagccccacagccc

SEQ ID NO: 2272556 - RNA, 20 nt, Human
cuggccagccccacagccca

SEQ ID NO: 2272557 - RNA, 21 nt, Human
cuggccagccccacagcccac

SEQ ID NO: 2272558 - RNA, 22 nt, Human
cuggccaggcagaucugugccc

SEQ ID NO: 2272559 - RNA, 21 nt, Human
cuggccaggcagaucugugcc

SEQ ID NO: 2272560 - RNA, 14 nt, Human
cuggccaggcagau

SEQ ID NO: 2272561 - RNA, 13 nt, Human
cuggccaggcaga

SEQ ID NO: 2272562 - RNA, 14 nt, Human
cuggccagggccug

SEQ ID NO: 2272563 - RNA, 20 nt, Human
cuggccccaggaccuggcug

SEQ ID NO: 2272564 - RNA, 16 nt, Human
cuggccccaggaccug

SEQ ID NO: 2272565 - RNA, 17 nt, Human
cuggccaguccaggcug

SEQ ID NO: 2272566 - RNA, 18 nt, Human
cuggccaguccaggcugc

SEQ ID NO: 2272567 - RNA, 15 nt, Human
cuggccaguccaggc

SEQ ID NO: 2272568 - RNA, 16 nt, Human
cuggccaguccaggcu

SEQ ID NO: 2272569 - RNA, 15 nt, Human
cuggccagggccugg

SEQ ID NO: 2272570 - RNA, 16 nt, Human
cuggccagggccugga

SEQ ID NO: 2272571 - RNA, 23 nt, Human
cuggccagggccuggaagacaga

SEQ ID NO: 2272572 - RNA, 20 nt, Human
cuggccugaggucucgcuga

SEQ ID NO: 2272573 - RNA, 24 nt, Human
cuggccugaggucucgcugaugcu

SEQ ID NO: 2272574 - RNA, 19 nt, Human
cuggccugcacggugggcc

SEQ ID NO: 2272575 - RNA, 15 nt, Human
cuggccugagcuggg

SEQ ID NO: 2272576 - RNA, 18 nt, Human
cuggccugagcugggaug

SEQ ID NO: 2272577 - RNA, 20 nt, Human
cuggccugcugggcucucca

SEQ ID NO: 2272578 - RNA, 19 nt, Human
cuggccugcugggcucucc

SEQ ID NO: 2272579 - RNA, 15 nt, Human
cuggccugcugggcu

SEQ ID NO: 2272580 - RNA, 13 nt, Human
cuggccuggcccc

SEQ ID NO: 2272581 - RNA, 14 nt, Human
cuggccuggccccu

SEQ ID NO: 2272582 - RNA, 13 nt, Human
cuggccucugcac

SEQ ID NO: 2272583 - RNA, 14 nt, Human
cuggccucugcacu

SEQ ID NO: 2272584 - RNA, 16 nt, Human
cuggccugagcuggga

SEQ ID NO: 2272585 - RNA, 16 nt, Human
cuggccuggccccuca

SEQ ID NO: 2272586 - RNA, 17 nt, Human
cuggccuggccccucag

SEQ ID NO: 2272587 - RNA, 15 nt, Human
cuggccuucggccuc

SEQ ID NO: 2272588 - RNA, 21 nt, Human
cuggccuucggccuccauccu

SEQ ID NO: 2272589 - RNA, 18 nt, Human
cuggccuucggccuccau

SEQ ID NO: 2272590 - RNA, 17 nt, Human
cuggccuucggccucca

SEQ ID NO: 2272591 - RNA, 16 nt, Human
cuggccuucggccucc

SEQ ID NO: 2272592 - RNA, 20 nt, Human
cugggaugggaggagaggac

SEQ ID NO: 2272593 - RNA, 15 nt, Human
cugggaugggccugc

SEQ ID NO: 2272594 - RNA, 17 nt, Human
cugggauccuaagggcu

SEQ ID NO: 2272595 - RNA, 17 nt, Human
cugggaugagccgcugu

SEQ ID NO: 2272596 - RNA, 21 nt, Human
cugggaugagccgcugugagc

SEQ ID NO: 2272597 - RNA, 22 nt, Human
cugggaugagccgcugugagcc

SEQ ID NO: 2272598 - RNA, 17 nt, Human
cugggauuacaggugug

SEQ ID NO: 2272599 - RNA, 20 nt, Human
cugggauuacaggugugaac

SEQ ID NO: 2272600 - RNA, 18 nt, Human
cugggauuacagguguga

SEQ ID NO: 2272601 - RNA, 16 nt, Human
cugggauuacaggugu

SEQ ID NO: 2272602 - RNA, 13 nt, Human
cugggauccuaag

SEQ ID NO: 2272603 - RNA, 14 nt, Human
cugggaguccccuu

SEQ ID NO: 2272604 - RNA, 20 nt, Human
cugggaucacauguggacuu

SEQ ID NO: 2272605 - RNA, 18 nt, Human
cugggaugauuggagggg

SEQ ID NO: 2272606 - RNA, 20 nt, Human
cugggaucccucauccucau

SEQ ID NO: 2272607 - RNA, 13 nt, Human
cugggaguccccu

SEQ ID NO: 2272608 - RNA, 18 nt, Human
cugggccccaccaccuag

SEQ ID NO: 2272609 - RNA, 16 nt, Human
cugggccccaccaccu

SEQ ID NO: 2272610 - RNA, 12 nt, Human
cugggccccagc

SEQ ID NO: 2272611 - RNA, 13 nt, Human
cugggccccagcc

SEQ ID NO: 2272612 - RNA, 14 nt, Human
cugggccccagccc

SEQ ID NO: 2272613 - RNA, 15 nt, Human
cugggccccagccca

SEQ ID NO: 2272614 - RNA, 16 nt, Human
cugggccccagcccac

SEQ ID NO: 2272615 - RNA, 18 nt, Human
cugggccccagcccaccc

SEQ ID NO: 2272616 - RNA, 14 nt, Human
cugggccccaccac

SEQ ID NO: 2272617 - RNA, 13 nt, Human
cugggccccacca

SEQ ID NO: 2272618 - RNA, 24 nt, Human
cugggccccaaacgggcugcccug

SEQ ID NO: 2272619 - RNA, 19 nt, Human
cugggccccaguuguauuu

SEQ ID NO: 2272620 - RNA, 11 nt, Human
cugggcccugg

SEQ ID NO: 2272621 - RNA, 15 nt, Human
cugggccccaguugu

SEQ ID NO: 2272622 - RNA, 19 nt, Human
cugggccccagcccacccu

SEQ ID NO: 2272623 - RNA, 20 nt, Human
cugggccccagcccacccuc

SEQ ID NO: 2272624 - RNA, 21 nt, Human
cugggccccagcccacccucc

SEQ ID NO: 2272625 - RNA, 15 nt, Human
cugggccgcugccac

SEQ ID NO: 2272626 - RNA, 16 nt, Human
cugggccgcugccacg

SEQ ID NO: 2272627 - RNA, 13 nt, Human
cugggcccugggc

SEQ ID NO: 2272628 - RNA, 14 nt, Human
cugggcccugggcu

SEQ ID NO: 2272629 - RNA, 15 nt, Human
cugggcccugggcug

SEQ ID NO: 2272630 - RNA, 16 nt, Human
cugggcccugggcugg

SEQ ID NO: 2272631 - RNA, 18 nt, Human
cugggcccugggcuggaa

SEQ ID NO: 2272632 - RNA, 21 nt, Human
cugggaguaguugucuuuccu

SEQ ID NO: 2272633 - RNA, 23 nt, Human
cugggaguaguugucuuuccugg

SEQ ID NO: 2272634 - RNA, 21 nt, Human
cugggaggucaaggcugcagu

SEQ ID NO: 2272635 - RNA, 19 nt, Human
cugggaggucaaggcugca

SEQ ID NO: 2272636 - RNA, 17 nt, Human
cugggaggcucuggagc

SEQ ID NO: 2272637 - RNA, 18 nt, Human
cugggaggcucuggagcc

SEQ ID NO: 2272638 - RNA, 22 nt, Human
cugggaggcaagagggguggag

SEQ ID NO: 2272639 - RNA, 23 nt, Human
cugggaggcaagagggguggaga

SEQ ID NO: 2272640 - RNA, 17 nt, Human
cugggaggcaagagggg

SEQ ID NO: 2272641 - RNA, 18 nt, Human
cugggaggcaagaggggu

SEQ ID NO: 2272642 - RNA, 20 nt, Human
cugggaggcaagaggggugg

SEQ ID NO: 2272643 - RNA, 21 nt, Human
cugggaggcaagaggggugga

SEQ ID NO: 2272644 - RNA, 20 nt, Human
cugggaggcucuggagccca

SEQ ID NO: 2272645 - RNA, 21 nt, Human
cugggaggcucuggagcccac

SEQ ID NO: 2272646 - RNA, 21 nt, Human
cugggaggaagcagguugagg

SEQ ID NO: 2272647 - RNA, 17 nt, Human
cugggaggaauggacag

SEQ ID NO: 2272648 - RNA, 21 nt, Human
cugggagcuccacucugcuuc

SEQ ID NO: 2272649 - RNA, 16 nt, Human
cugggagcuccacucu

SEQ ID NO: 2272650 - RNA, 17 nt, Human
cugggagcuccacucug

SEQ ID NO: 2272651 - RNA, 20 nt, Human
cugggagcuccacucugcuu

SEQ ID NO: 2272652 - RNA, 22 nt, Human
cugggaggaauggacagacaga

SEQ ID NO: 2272653 - RNA, 19 nt, Human
cugggaggaauggacagac

SEQ ID NO: 2272654 - RNA, 14 nt, Human
cugggaggagggag

SEQ ID NO: 2272655 - RNA, 15 nt, Human
cugggaggagggaga

SEQ ID NO: 2272656 - RNA, 16 nt, Human
cugggaggagggagag

SEQ ID NO: 2272657 - RNA, 17 nt, Human
cugggaggagggagagg

SEQ ID NO: 2272658 - RNA, 19 nt, Human
cugggaggagggagaggga

SEQ ID NO: 2272659 - RNA, 20 nt, Human
cugggaggagggagagggag

SEQ ID NO: 2272660 - RNA, 23 nt, Human
cugggaggagggagagggagguc

SEQ ID NO: 2272661 - RNA, 16 nt, Human
cugggagccuacccac

SEQ ID NO: 2272662 - RNA, 22 nt, Human
cugggagccuacccacccccag

SEQ ID NO: 2272663 - RNA, 19 nt, Human
cugggagccuacccacccc

SEQ ID NO: 2272664 - RNA, 19 nt, Human
cugggagauucaagggacc

SEQ ID NO: 2272665 - RNA, 22 nt, Human
cugggagcagcccgcugagugg

SEQ ID NO: 2272666 - RNA, 15 nt, Human
cugggagauucaagg

SEQ ID NO: 2272667 - RNA, 20 nt, Human
cugggagaggugccagcaac

SEQ ID NO: 2272668 - RNA, 23 nt, Human
cugggagaggugccagcaacuga

SEQ ID NO: 2272669 - RNA, 18 nt, Human
cugggagaggugccagca

SEQ ID NO: 2272670 - RNA, 19 nt, Human
cugggagaggugccagcaa

SEQ ID NO: 2272671 - RNA, 13 nt, Human
cuggcuggaguga

SEQ ID NO: 2272672 - RNA, 12 nt, Human
cuggcuggagcc

SEQ ID NO: 2272673 - RNA, 15 nt, Human
cuggcuggagccuag

SEQ ID NO: 2272674 - RNA, 18 nt, Human
cuggcuggagccuagaac

SEQ ID NO: 2272675 - RNA, 15 nt, Human
cuggcuggcacagaa

SEQ ID NO: 2272676 - RNA, 17 nt, Human
cuggcuggcugcaguga

SEQ ID NO: 2272677 - RNA, 15 nt, Human
cuggcuggcugcagu

SEQ ID NO: 2272678 - RNA, 16 nt, Human
cuggcugcugccccca

SEQ ID NO: 2272679 - RNA, 17 nt, Human
cuggcugcugcccccac

SEQ ID NO: 2272680 - RNA, 19 nt, Human
cuggcugcugcccccaccc

SEQ ID NO: 2272681 - RNA, 13 nt, Human
cuggcugcuugcc

SEQ ID NO: 2272682 - RNA, 14 nt, Human
cuggcugcuugccc

SEQ ID NO: 2272683 - RNA, 14 nt, Human
cuggcuggaaggga

SEQ ID NO: 2272684 - RNA, 13 nt, Human
cuggcgcagccaa

SEQ ID NO: 2272685 - RNA, 15 nt, Human
cuggcgcagccaagg

SEQ ID NO: 2272686 - RNA, 19 nt, Human
cuggcgcagccaaggccga

SEQ ID NO: 2272687 - RNA, 16 nt, Human
cuggcgcagccaaggc

SEQ ID NO: 2272688 - RNA, 21 nt, Human
cuggcgccaacaacuucucca

SEQ ID NO: 2272689 - RNA, 22 nt, Human
cuggcgccaacaacuucuccau

SEQ ID NO: 2272690 - RNA, 19 nt, Human
cuggcgccaucgccgggac

SEQ ID NO: 2272691 - RNA, 12 nt, Human
cuggccuguucu

SEQ ID NO: 2272692 - RNA, 16 nt, Human
cuggccuuccugcccu

SEQ ID NO: 2272693 - RNA, 17 nt, Human
cuggccuuccacuuggc

SEQ ID NO: 2272694 - RNA, 14 nt, Human
cuggccuuucauau

SEQ ID NO: 2272695 - RNA, 13 nt, Human
cuggccuuuuccu

SEQ ID NO: 2272696 - RNA, 14 nt, Human
cuggccuuuuccua

SEQ ID NO: 2272697 - RNA, 19 nt, Human
cuggcgacaguuuuccuuc

SEQ ID NO: 2272698 - RNA, 22 nt, Human
cuggcgacacguagcagcuuag

SEQ ID NO: 2272699 - RNA, 20 nt, Human
cuggcgacaguuuuccuucu

SEQ ID NO: 2272700 - RNA, 12 nt, Human
cuggcgcagcca

SEQ ID NO: 2272701 - RNA, 23 nt, Human
cuggcugggacguggcucagcca

SEQ ID NO: 2272702 - RNA, 21 nt, Human
cuggcugggacguggcucagc

SEQ ID NO: 2272703 - RNA, 19 nt, Human
cuggcugggacguggcuca

SEQ ID NO: 2272704 - RNA, 16 nt, Human
cuggcugggacguggc

SEQ ID NO: 2272705 - RNA, 12 nt, Human
cuggcugggacg

SEQ ID NO: 2272706 - RNA, 20 nt, Human
cuggcugguuagagguuccc

SEQ ID NO: 2272707 - RNA, 16 nt, Human
cuggcuguuggcuggg

SEQ ID NO: 2272708 - RNA, 17 nt, Human
cuggcuguuggcugggg

SEQ ID NO: 2272709 - RNA, 20 nt, Human
cuggcuguguucuggugagg

SEQ ID NO: 2272710 - RNA, 19 nt, Human
cuggcugucaguaugacau

SEQ ID NO: 2272711 - RNA, 16 nt, Human
cugggaaacagaggcu

SEQ ID NO: 2272712 - RNA, 15 nt, Human
cugggaaacagaggc

SEQ ID NO: 2272713 - RNA, 19 nt, Human
cugggaaagacauccauaa

SEQ ID NO: 2272714 - RNA, 11 nt, Human
cugggaaacag

SEQ ID NO: 2272715 - RNA, 14 nt, Human
cugggaaaauaccc

SEQ ID NO: 2272716 - RNA, 17 nt, Human
cugggaaaauaccccau

SEQ ID NO: 2272717 - RNA, 23 nt, Human
cuggcuuuucacugcuggcugcc

SEQ ID NO: 2272718 - RNA, 14 nt, Human
cuggcuuuuauuaa

SEQ ID NO: 2272719 - RNA, 22 nt, Human
cuggcuuuuauuaaugcacuuu

SEQ ID NO: 2272720 - RNA, 23 nt, Human
cuggcuuuuauuaaugcacuuuc

SEQ ID NO: 2272721 - RNA, 14 nt, Human
cuggcuuuggcuuc

SEQ ID NO: 2272722 - RNA, 11 nt, Human
cuggcuuuggc

SEQ ID NO: 2272723 - RNA, 15 nt, Human
cuggcuuucuccgac

SEQ ID NO: 2272724 - RNA, 22 nt, Human
cuggcuuucuccgacugcuagg

SEQ ID NO: 2272725 - RNA, 14 nt, Human
cuggcuuugagaag

SEQ ID NO: 2272726 - RNA, 19 nt, Human
cuggcuuguaacuccacca

SEQ ID NO: 2272727 - RNA, 17 nt, Human
cuggcuuguaacuccac

SEQ ID NO: 2272728 - RNA, 20 nt, Human
cuggcuuguaacuccaccaa

SEQ ID NO: 2272729 - RNA, 18 nt, Human
cuggcuguuggcuggggg

SEQ ID NO: 2272730 - RNA, 18 nt, Human
cugggagaaccucaggcu

SEQ ID NO: 2272731 - RNA, 17 nt, Human
cugggagaaccucaggc

SEQ ID NO: 2272732 - RNA, 12 nt, Human
cugggagaggau

SEQ ID NO: 2272733 - RNA, 21 nt, Human
cugggagagccuuccaggggu

SEQ ID NO: 2272734 - RNA, 19 nt, Human
cugggagagccuuccaggg

SEQ ID NO: 2272735 - RNA, 20 nt, Human
cugggagagccuuccagggg

SEQ ID NO: 2272736 - RNA, 16 nt, Human
cugggagaaccucagg

SEQ ID NO: 2272737 - RNA, 15 nt, Human
cugggagaaccucag

SEQ ID NO: 2272738 - RNA, 14 nt, Human
cugggagaaccuca

SEQ ID NO: 2272739 - RNA, 12 nt, Human
cugggagaaccu

SEQ ID NO: 2272740 - RNA, 17 nt, Human
cugggagagccuuccag

SEQ ID NO: 2272741 - RNA, 18 nt, Human
cugggagagccuuccagg

SEQ ID NO: 2272742 - RNA, 17 nt, Human
cuguacauagccuauau

SEQ ID NO: 2272743 - RNA, 21 nt, Human
cuguaccucuugagccuugaa

SEQ ID NO: 2272744 - RNA, 19 nt, Human
cuguaccagcccagauguu

SEQ ID NO: 2272745 - RNA, 15 nt, Human
cuguacauagccuau

SEQ ID NO: 2272746 - RNA, 16 nt, Human
cuguacauagccuaua

SEQ ID NO: 2272747 - RNA, 15 nt, Human
cuguacauuguggga

SEQ ID NO: 2272748 - RNA, 23 nt, Human
cuguacaugaaaacacauuuuuc

SEQ ID NO: 2272749 - RNA, 22 nt, Human
cuguacaugaaaacacauuuuu

SEQ ID NO: 2272750 - RNA, 16 nt, Human
cuguaaguuuugaauu

SEQ ID NO: 2272751 - RNA, 23 nt, Human
cuguacagagcccacgcccccac

SEQ ID NO: 2272752 - RNA, 22 nt, Human
cuguaauuugugauacaaugcu

SEQ ID NO: 2272753 - RNA, 21 nt, Human
cuguaauuugugauacaaugc

SEQ ID NO: 2272754 - RNA, 17 nt, Human
cuguaaggcaugaagga

SEQ ID NO: 2272755 - RNA, 16 nt, Human
cuguaaggcaugaagg

SEQ ID NO: 2272756 - RNA, 17 nt, Human
cuguaauuugugauaca

SEQ ID NO: 2272757 - RNA, 18 nt, Human
cuguaauuugugauacaa

SEQ ID NO: 2272758 - RNA, 14 nt, Human
cuguaagcugaagu

SEQ ID NO: 2272759 - RNA, 23 nt, Human
cugguuccagggucccucugugu

SEQ ID NO: 2272760 - RNA, 18 nt, Human
cuguaaggcaaucauggu

SEQ ID NO: 2272761 - RNA, 20 nt, Human
cugguuaacuuguuuggccu

SEQ ID NO: 2272762 - RNA, 13 nt, Human
cugguuccagggu

SEQ ID NO: 2272763 - RNA, 14 nt, Human
cugguuccaggguc

SEQ ID NO: 2272764 - RNA, 15 nt, Human
cugguuccagggucc

SEQ ID NO: 2272765 - RNA, 16 nt, Human
cugguuccaggguccc

SEQ ID NO: 2272766 - RNA, 18 nt, Human
cugguuccagggucccuc

SEQ ID NO: 2272767 - RNA, 22 nt, Human
cugguuccagggucccucugug

SEQ ID NO: 2272768 - RNA, 20 nt, Human
cugguucaggguuggccccu

SEQ ID NO: 2272769 - RNA, 24 nt, Human
cugguguuucuagcacuggccugc

SEQ ID NO: 2272770 - RNA, 23 nt, Human
cugguuaauauuuauaggucacu

SEQ ID NO: 2272771 - RNA, 22 nt, Human
cugguguuucuagcacuggccu

SEQ ID NO: 2272772 - RNA, 23 nt, Human
cugguguuucuagcacuggccug

SEQ ID NO: 2272773 - RNA, 22 nt, Human
cuggucucagcagcgaccaccc

SEQ ID NO: 2272774 - RNA, 16 nt, Human
cuggucuccucagccu

SEQ ID NO: 2272775 - RNA, 14 nt, Human
cuggucucagcagc

SEQ ID NO: 2272776 - RNA, 20 nt, Human
cuggucucagcagcgaccac

SEQ ID NO: 2272777 - RNA, 21 nt, Human
cuggucucagcagcgaccacc

SEQ ID NO: 2272778 - RNA, 21 nt, Human
cuggucucaaacuccugggcu

SEQ ID NO: 2272779 - RNA, 13 nt, Human
cuggucucagcag

SEQ ID NO: 2272780 - RNA, 12 nt, Human
cugguggcagcu

SEQ ID NO: 2272781 - RNA, 16 nt, Human
cuggucucgaacuccu

SEQ ID NO: 2272782 - RNA, 17 nt, Human
cuggucuccucagccuc

SEQ ID NO: 2272783 - RNA, 16 nt, Human
cugguggcagcucacc

SEQ ID NO: 2272784 - RNA, 17 nt, Human
cuggugugaacuaaacu

SEQ ID NO: 2272785 - RNA, 16 nt, Human
cuggugugaccugagg

SEQ ID NO: 2272786 - RNA, 17 nt, Human
cuggugugaccugaggg

SEQ ID NO: 2272787 - RNA, 18 nt, Human
cuggugugaccugagggc

SEQ ID NO: 2272788 - RNA, 13 nt, Human
cugguggcagcuc

SEQ ID NO: 2272789 - RNA, 14 nt, Human
cugguggcagcuca

SEQ ID NO: 2272790 - RNA, 22 nt, Human
cugguccaaaagauugcugaaa

SEQ ID NO: 2272791 - RNA, 15 nt, Human
cugguccaaaagauu

SEQ ID NO: 2272792 - RNA, 13 nt, Human
cuggucagcccaa

SEQ ID NO: 2272793 - RNA, 12 nt, Human
cuggucagccca

SEQ ID NO: 2272794 - RNA, 17 nt, Human
cugguccagggaagcug

SEQ ID NO: 2272795 - RNA, 15 nt, Human
cugguccagggaagc

SEQ ID NO: 2272796 - RNA, 22 nt, Human
cugguccagggaagcuggccga

SEQ ID NO: 2272797 - RNA, 21 nt, Human
cugguccagggaagcuggccg

SEQ ID NO: 2272798 - RNA, 21 nt, Human
cugguccauagagagcaagac

SEQ ID NO: 2272799 - RNA, 17 nt, Human
cugguccaugauggagu

SEQ ID NO: 2272800 - RNA, 16 nt, Human
cugguccaugauggag

SEQ ID NO: 2272801 - RNA, 19 nt, Human
cugguccaugauggaguca

SEQ ID NO: 2272802 - RNA, 13 nt, Human
cuggucccacuca

SEQ ID NO: 2272803 - RNA, 23 nt, Human
cuggucucaaacucuugaccuca

SEQ ID NO: 2272804 - RNA, 14 nt, Human
cuggucccacucag

SEQ ID NO: 2272805 - RNA, 22 nt, Human
cuggucacugccauggaggcac

SEQ ID NO: 2272806 - RNA, 14 nt, Human
cuggucacugccau

SEQ ID NO: 2272807 - RNA, 21 nt, Human
cugguaguuaguagcauguug

SEQ ID NO: 2272808 - RNA, 23 nt, Human
cuggucacagggcaugccccggc

SEQ ID NO: 2272809 - RNA, 19 nt, Human
cugguaguuaguagcaugu

SEQ ID NO: 2272810 - RNA, 12 nt, Human
cugguagggcag

SEQ ID NO: 2272811 - RNA, 20 nt, Human
cuggucacaggacucugccu

SEQ ID NO: 2272812 - RNA, 21 nt, Human
cuggucacaggacucugccuc

SEQ ID NO: 2272813 - RNA, 22 nt, Human
cuggucacaggacucugccucc

SEQ ID NO: 2272814 - RNA, 23 nt, Human
cuggucacaggacucugccuccu

SEQ ID NO: 2272815 - RNA, 14 nt, Human
cugguagagaugga

SEQ ID NO: 2272816 - RNA, 18 nt, Human
cuggguuuggaccccagc

SEQ ID NO: 2272817 - RNA, 16 nt, Human
cuggguuuggacccca

SEQ ID NO: 2272818 - RNA, 23 nt, Human
cugguagauagaaauaaauagcu

SEQ ID NO: 2272819 - RNA, 15 nt, Human
cugguagauagaaau

SEQ ID NO: 2272820 - RNA, 14 nt, Human
cugguagauagaaa

SEQ ID NO: 2272821 - RNA, 13 nt, Human
cugguagcucagg

SEQ ID NO: 2272822 - RNA, 14 nt, Human
cugguagcucaggu

SEQ ID NO: 2272823 - RNA, 16 nt, Human
cugguagcucaggugg

SEQ ID NO: 2272824 - RNA, 15 nt, Human
cugguagcucaggug

SEQ ID NO: 2272825 - RNA, 15 nt, Human
cugguaggaccaagc

SEQ ID NO: 2272826 - RNA, 17 nt, Human
cugguaggaccaagcau

SEQ ID NO: 2272827 - RNA, 19 nt, Human
cuggucacaggacucugcc

SEQ ID NO: 2272828 - RNA, 18 nt, Human
cugguaggaccaagcauc

SEQ ID NO: 2272829 - RNA, 13 nt, Human
cugguagggcagu

SEQ ID NO: 2272830 - RNA, 17 nt, Human
cugggucugugucucuu

SEQ ID NO: 2272831 - RNA, 16 nt, Human
cugggucugugucucu

SEQ ID NO: 2272832 - RNA, 15 nt, Human
cugggucugugucuc

SEQ ID NO: 2272833 - RNA, 22 nt, Human
cugggucucgcuuuguugccca

SEQ ID NO: 2272834 - RNA, 22 nt, Human
cugggucgcccuggacugugug

SEQ ID NO: 2272835 - RNA, 17 nt, Human
cugggucgcccuggacu

SEQ ID NO: 2272836 - RNA, 18 nt, Human
cugggucgcccuggacug

SEQ ID NO: 2272837 - RNA, 18 nt, Human
cuggguuucucuguauag

SEQ ID NO: 2272838 - RNA, 13 nt, Human
cuggguuucuagc

SEQ ID NO: 2272839 - RNA, 15 nt, Human
cuggguuuggacccc

SEQ ID NO: 2272840 - RNA, 18 nt, Human
cuggguuuaaggggagag

SEQ ID NO: 2272841 - RNA, 22 nt, Human
cuggguuuaaggggagaggaaa

SEQ ID NO: 2272842 - RNA, 22 nt, Human
cuggguuuauuacauggcagug

SEQ ID NO: 2272843 - RNA, 23 nt, Human
cuggguuuauuacauggcagugu

SEQ ID NO: 2272844 - RNA, 13 nt, Human
cuggguuggugca

SEQ ID NO: 2272845 - RNA, 14 nt, Human
cuggguuggugcac

SEQ ID NO: 2272846 - RNA, 15 nt, Human
cuggguuggugcaca

SEQ ID NO: 2272847 - RNA, 16 nt, Human
cuggguuggugcacag

SEQ ID NO: 2272848 - RNA, 19 nt, Human
cuggguuggugcacaguga

SEQ ID NO: 2272849 - RNA, 22 nt, Human
cuggguuggugcacagugauuu

SEQ ID NO: 2272850 - RNA, 15 nt, Human
cuggguuggagggug

SEQ ID NO: 2272851 - RNA, 22 nt, Human
cuggguuggcgcacccuccccu

SEQ ID NO: 2272852 - RNA, 23 nt, Human
cuggguuggcgcacccuccccuc

SEQ ID NO: 2272853 - RNA, 16 nt, Human
cugggucuuucauggg

SEQ ID NO: 2272854 - RNA, 16 nt, Human
cuggguuggcgcaccc

SEQ ID NO: 2272855 - RNA, 18 nt, Human
cuggguuggcgcacccuc

SEQ ID NO: 2272856 - RNA, 20 nt, Human
cuggguuggcgcacccuccc

SEQ ID NO: 2272857 - RNA, 19 nt, Human
cuggguacuuguggacaca

SEQ ID NO: 2272858 - RNA, 21 nt, Human
cugggcuccuaaccuuccugu

SEQ ID NO: 2272859 - RNA, 16 nt, Human
cugggucgcccuggac

SEQ ID NO: 2272860 - RNA, 18 nt, Human
cuggguacuuguggacac

SEQ ID NO: 2272861 - RNA, 16 nt, Human
cuggguacuuguggac

SEQ ID NO: 2272862 - RNA, 14 nt, Human
cuggguacuugugg

SEQ ID NO: 2272863 - RNA, 19 nt, Human
cugggcucccuucccaccu

SEQ ID NO: 2272864 - RNA, 20 nt, Human
cugggccuccucacaacaug

SEQ ID NO: 2272865 - RNA, 20 nt, Human
cugggcucccuucccaccuc

SEQ ID NO: 2272866 - RNA, 21 nt, Human
cugggcucccuucccaccucu

SEQ ID NO: 2272867 - RNA, 22 nt, Human
cugggcucccuucccaccucuc

SEQ ID NO: 2272868 - RNA, 20 nt, Human
cugucuccuuaacacugagc

SEQ ID NO: 2272869 - RNA, 20 nt, Human
cugucucauccccagggguc

SEQ ID NO: 2272870 - RNA, 12 nt, Human
cugucuccagac

SEQ ID NO: 2272871 - RNA, 21 nt, Human
cugucucauccccaggggucc

SEQ ID NO: 2272872 - RNA, 19 nt, Human
cugucucauccccaggggu

SEQ ID NO: 2272873 - RNA, 17 nt, Human
cugucucauccccaggg

SEQ ID NO: 2272874 - RNA, 16 nt, Human
cugucucauccccagg

SEQ ID NO: 2272875 - RNA, 15 nt, Human
cugucucauccccag

SEQ ID NO: 2272876 - RNA, 14 nt, Human
cugucucaucccca

SEQ ID NO: 2272877 - RNA, 13 nt, Human
cugucucaucccc

SEQ ID NO: 2272878 - RNA, 17 nt, Human
cugucucaguuucacuu

SEQ ID NO: 2272879 - RNA, 23 nt, Human
cugucuccuuucaccccagggcc

SEQ ID NO: 2272880 - RNA, 22 nt, Human
cugucuccuuucaccccagggc

SEQ ID NO: 2272881 - RNA, 18 nt, Human
cugucucuacuaaaaaua

SEQ ID NO: 2272882 - RNA, 17 nt, Human
cugucucucaugaaccu

SEQ ID NO: 2272883 - RNA, 13 nt, Human
cugucucucauga

SEQ ID NO: 2272884 - RNA, 17 nt, Human
cugucucuagccacuuu

SEQ ID NO: 2272885 - RNA, 20 nt, Human
cugucucuagccacuuuggu

SEQ ID NO: 2272886 - RNA, 15 nt, Human
cugucucuagccacu

SEQ ID NO: 2272887 - RNA, 22 nt, Human
cugucucaaaaaaagaaaaaga

SEQ ID NO: 2272888 - RNA, 22 nt, Human
cugucccuuggagcuguaaacc

SEQ ID NO: 2272889 - RNA, 13 nt, Human
cuguccucacugc

SEQ ID NO: 2272890 - RNA, 14 nt, Human
cuguccucacugcu

SEQ ID NO: 2272891 - RNA, 16 nt, Human
cuguccucacugcucc

SEQ ID NO: 2272892 - RNA, 15 nt, Human
cuguccuaggccaca

SEQ ID NO: 2272893 - RNA, 13 nt, Human
cugucccuuggag

SEQ ID NO: 2272894 - RNA, 21 nt, Human
cuguccuacucugugucaggu

SEQ ID NO: 2272895 - RNA, 18 nt, Human
cugucucaagagggcacu

SEQ ID NO: 2272896 - RNA, 19 nt, Human
cugucucaagagggcacug

SEQ ID NO: 2272897 - RNA, 20 nt, Human
cugucucaagagggcacugg

SEQ ID NO: 2272898 - RNA, 21 nt, Human
cugucucaagagggcacuggu

SEQ ID NO: 2272899 - RNA, 21 nt, Human
cugucucauccaucaucaugu

SEQ ID NO: 2272900 - RNA, 20 nt, Human
cugucucauccaucaucaug

SEQ ID NO: 2272901 - RNA, 17 nt, Human
cugucucauccaucauc

SEQ ID NO: 2272902 - RNA, 16 nt, Human
cugucucauccaucau

SEQ ID NO: 2272903 - RNA, 15 nt, Human
cugucucauccauca

SEQ ID NO: 2272904 - RNA, 12 nt, Human
cugucucaucca

SEQ ID NO: 2272905 - RNA, 16 nt, Human
cugucucaguuucacu

SEQ ID NO: 2272906 - RNA, 19 nt, Human
cuguccucacugcucccug

SEQ ID NO: 2272907 - RNA, 21 nt, Human
cuguccucacugcucccugaa

SEQ ID NO: 2272908 - RNA, 21 nt, Human
cugucccuaguaaaaauacaa

SEQ ID NO: 2272909 - RNA, 19 nt, Human
cugucccuaguaaaaauac

SEQ ID NO: 2272910 - RNA, 17 nt, Human
cugucccuaggucagcu

SEQ ID NO: 2272911 - RNA, 15 nt, Human
cugucccucaaauga

SEQ ID NO: 2272912 - RNA, 12 nt, Human
cugucccucaca

SEQ ID NO: 2272913 - RNA, 16 nt, Human
cugucccucacagcac

SEQ ID NO: 2272914 - RNA, 13 nt, Human
cugucccucacag

SEQ ID NO: 2272915 - RNA, 13 nt, Human
cugucccucacug

SEQ ID NO: 2272916 - RNA, 12 nt, Human
cugucccucacu

SEQ ID NO: 2272917 - RNA, 23 nt, Human
cugucccucaaaugacccaaaga

SEQ ID NO: 2272918 - RNA, 13 nt, Human
cugucccucccac

SEQ ID NO: 2272919 - RNA, 15 nt, Human
cugucccucccaccu

SEQ ID NO: 2272920 - RNA, 16 nt, Human
cugucccucccaccuc

SEQ ID NO: 2272921 - RNA, 12 nt, Human
cugucccuccgg

SEQ ID NO: 2272922 - RNA, 15 nt, Human
cugucccucccccuu

SEQ ID NO: 2272923 - RNA, 17 nt, Human
cugucccucccaccucu

SEQ ID NO: 2272924 - RNA, 18 nt, Human
cugucccucccaccucug

SEQ ID NO: 2272925 - RNA, 19 nt, Human
cugucccucccaccucugu

SEQ ID NO: 2272926 - RNA, 21 nt, Human
cugucccucccaccucuguga

SEQ ID NO: 2272927 - RNA, 13 nt, Human
cugucccccugac

SEQ ID NO: 2272928 - RNA, 14 nt, Human
cugucccccugaca

SEQ ID NO: 2272929 - RNA, 18 nt, Human
cugucccauggacacucc

SEQ ID NO: 2272930 - RNA, 13 nt, Human
cugucccccagcu

SEQ ID NO: 2272931 - RNA, 14 nt, Human
cugucccccagcuc

SEQ ID NO: 2272932 - RNA, 15 nt, Human
cugucccccagcucu

SEQ ID NO: 2272933 - RNA, 16 nt, Human
cugucccccagcucug

SEQ ID NO: 2272934 - RNA, 17 nt, Human
cugucccccagcucugg

SEQ ID NO: 2272935 - RNA, 18 nt, Human
cugucccccagcucuggu

SEQ ID NO: 2272936 - RNA, 16 nt, Human
cugucccuucucuuaa

SEQ ID NO: 2272937 - RNA, 19 nt, Human
cugucccuucccccauaag

SEQ ID NO: 2272938 - RNA, 23 nt, Human
cugucccucccaccucugugacc

SEQ ID NO: 2272939 - RNA, 21 nt, Human
cugucccuucucuuaauuuaa

SEQ ID NO: 2272940 - RNA, 17 nt, Human
cugucccuucugucccu

SEQ ID NO: 2272941 - RNA, 19 nt, Human
cugucccuucugucccuca

SEQ ID NO: 2272942 - RNA, 18 nt, Human
cugucccuucugucccuc

SEQ ID NO: 2272943 - RNA, 13 nt, Human
cugucccuugccu

SEQ ID NO: 2272944 - RNA, 15 nt, Human
cugucccuugccuca

SEQ ID NO: 2272945 - RNA, 16 nt, Human
cugucccuugccucaa

SEQ ID NO: 2272946 - RNA, 20 nt, Human
cugucccuugccucaaugcc

SEQ ID NO: 2272947 - RNA, 21 nt, Human
cugucccuugccucaaugcca

SEQ ID NO: 2272948 - RNA, 16 nt, Human
cuguccuacucugugu

SEQ ID NO: 2272949 - RNA, 17 nt, Human
cuguccuacucuguguc

SEQ ID NO: 2272950 - RNA, 18 nt, Human
cuguccuacucuguguca

SEQ ID NO: 2272951 - RNA, 20 nt, Human
cuguccuacucugugucagg

SEQ ID NO: 2272952 - RNA, 16 nt, Human
cuguauuugagaauau

SEQ ID NO: 2272953 - RNA, 22 nt, Human
cuguauuugccggugccuagga

SEQ ID NO: 2272954 - RNA, 14 nt, Human
cuguauuuguaucu

SEQ ID NO: 2272955 - RNA, 23 nt, Human
cuguauuuaugugugaggagcug

SEQ ID NO: 2272956 - RNA, 18 nt, Human
cuguauuuaugugugagg

SEQ ID NO: 2272957 - RNA, 15 nt, Human
cuguauuaagccacu

SEQ ID NO: 2272958 - RNA, 15 nt, Human
cuguauguuguccaa

SEQ ID NO: 2272959 - RNA, 18 nt, Human
cuguauguuguccaauug

SEQ ID NO: 2272960 - RNA, 19 nt, Human
cuguauuaagagugaaaau

SEQ ID NO: 2272961 - RNA, 13 nt, Human
cuguauguugucc

SEQ ID NO: 2272962 - RNA, 20 nt, Human
cuguaugucucgugguagga

SEQ ID NO: 2272963 - RNA, 12 nt, Human
cuguaugucaga

SEQ ID NO: 2272964 - RNA, 21 nt, Human
cuguauggaauacaauguaau

SEQ ID NO: 2272965 - RNA, 19 nt, Human
cuguaucccaugagccuca

SEQ ID NO: 2272966 - RNA, 13 nt, Human
cuguauauacuuu

SEQ ID NO: 2272967 - RNA, 18 nt, Human
cuguaucccaugagccuc

SEQ ID NO: 2272968 - RNA, 15 nt, Human
cuguaugauucccag

SEQ ID NO: 2272969 - RNA, 15 nt, Human
cuguauaguacuggc

SEQ ID NO: 2272970 - RNA, 22 nt, Human
cuguaccuuuugaggagcccca

SEQ ID NO: 2272971 - RNA, 22 nt, Human
cuguaccucuugagccuugaac

SEQ ID NO: 2272972 - RNA, 14 nt, Human
cuguaccucugccu

SEQ ID NO: 2272973 - RNA, 21 nt, Human
cuguaccuguuccuuagaccu

SEQ ID NO: 2272974 - RNA, 20 nt, Human
cuguaccuuuugaggagccc

SEQ ID NO: 2272975 - RNA, 14 nt, Human
cuguaucccaugag

SEQ ID NO: 2272976 - RNA, 15 nt, Human
cuguaucccaugagc

SEQ ID NO: 2272977 - RNA, 23 nt, Human
cuguauauacaauaacauaauuu

SEQ ID NO: 2272978 - RNA, 19 nt, Human
cuguauauacaauaacaua

SEQ ID NO: 2272979 - RNA, 18 nt, Human
cuguauauacaauaacau

SEQ ID NO: 2272980 - RNA, 15 nt, Human
cuguauauacaauaa

SEQ ID NO: 2272981 - RNA, 16 nt, Human
cuguauaguuaggaua

SEQ ID NO: 2272982 - RNA, 21 nt, Human
cuguauaguuaggauagcauu

SEQ ID NO: 2272983 - RNA, 18 nt, Human
cuguauauaaaauauuuu

SEQ ID NO: 2272984 - RNA, 16 nt, Human
cuguauauaaaggaaa

SEQ ID NO: 2272985 - RNA, 22 nt, Human
cugucccagugccgagaaggaa

SEQ ID NO: 2272986 - RNA, 17 nt, Human
cugucccauggacacuc

SEQ ID NO: 2272987 - RNA, 19 nt, Human
cugucccauggacacucca

SEQ ID NO: 2272988 - RNA, 13 nt, Human
cugucccaccucu

SEQ ID NO: 2272989 - RNA, 14 nt, Human
cugucccaccucuu

SEQ ID NO: 2272990 - RNA, 16 nt, Human
cugucccacccccacc

SEQ ID NO: 2272991 - RNA, 15 nt, Human
cugucccaccucuuc

SEQ ID NO: 2272992 - RNA, 23 nt, Human
cugucccaccucuucucuuccug

SEQ ID NO: 2272993 - RNA, 19 nt, Human
cugucccagguuaucuggg

SEQ ID NO: 2272994 - RNA, 22 nt, Human
cugucccagguuaucugggcau

SEQ ID NO: 2272995 - RNA, 17 nt, Human
cuguccaggcacugcug

SEQ ID NO: 2272996 - RNA, 16 nt, Human
cuguccagacagccug

SEQ ID NO: 2272997 - RNA, 19 nt, Human
cugucccaccaugcagugc

SEQ ID NO: 2272998 - RNA, 14 nt, Human
cugucccaccccca

SEQ ID NO: 2272999 - RNA, 20 nt, Human
cuguccaggcacugcugccc

SEQ ID NO: 2273000 - RNA, 21 nt, Human
cuguccaggcacugcugccca

SEQ ID NO: 2273001 - RNA, 22 nt, Human
cuguccaggcacugcugcccag

SEQ ID NO: 2273002 - RNA, 18 nt, Human
cuguccaggcacugcugc

SEQ ID NO: 2273003 - RNA, 19 nt, Human
cuguccaggcacugcugcc

SEQ ID NO: 2273004 - RNA, 12 nt, Human
cuguccagacag

SEQ ID NO: 2273005 - RNA, 13 nt, Human
cuguccagacagc

SEQ ID NO: 2273006 - RNA, 15 nt, Human
cuguccagacagccu

SEQ ID NO: 2273007 - RNA, 18 nt, Human
cuguccaaaggaggcugg

SEQ ID NO: 2273008 - RNA, 17 nt, Human
cuguccaaaggaggcug

SEQ ID NO: 2273009 - RNA, 15 nt, Human
cuguccaaacugccu

SEQ ID NO: 2273010 - RNA, 20 nt, Human
cuguccaaacugccuaagcc

SEQ ID NO: 2273011 - RNA, 22 nt, Human
cuguccaaaggaggcuggcagg

SEQ ID NO: 2273012 - RNA, 21 nt, Human
cuguccaaaggaggcuggcag

SEQ ID NO: 2273013 - RNA, 20 nt, Human
cuguccaaaggaggcuggca

SEQ ID NO: 2273014 - RNA, 19 nt, Human
cuguccaaaggaggcuggc

SEQ ID NO: 2273015 - RNA, 23 nt, Human
cuguccaaccuaaccccuuuccu

SEQ ID NO: 2273016 - RNA, 20 nt, Human
cuguccaaccuaaccccuuu

SEQ ID NO: 2273017 - RNA, 16 nt, Human
cuguccaaccuaaccc

SEQ ID NO: 2273018 - RNA, 11 nt, Human
cuguccaagga

SEQ ID NO: 2273019 - RNA, 15 nt, Human
cuguccacacccagc

SEQ ID NO: 2273020 - RNA, 20 nt, Human
cuguccacacccagcucagc

SEQ ID NO: 2273021 - RNA, 13 nt, Human
cuguauuuuaaaa

SEQ ID NO: 2273022 - RNA, 16 nt, Human
cuguauuuuaaaagaa

SEQ ID NO: 2273023 - RNA, 23 nt, Human
cuguauuugugacuaauuguaua

SEQ ID NO: 2273024 - RNA, 20 nt, Human
cuguauuugugacuaauugu

SEQ ID NO: 2273025 - RNA, 21 nt, Human
cuguauuugugacuaauugua

SEQ ID NO: 2273026 - RNA, 23 nt, Human
cuguauuuguaucucugaagcau

SEQ ID NO: 2273027 - RNA, 12 nt, Human
cuguauuuguga

SEQ ID NO: 2273028 - RNA, 13 nt, Human
cuguauuugugac

SEQ ID NO: 2273029 - RNA, 14 nt, Human
cuguauuugugacu

SEQ ID NO: 2273030 - RNA, 15 nt, Human
cuguauuugugacua

SEQ ID NO: 2273031 - RNA, 16 nt, Human
cuguauuugugacuaa

SEQ ID NO: 2273032 - RNA, 17 nt, Human
cuguauuugugacuaau

SEQ ID NO: 2273033 - RNA, 19 nt, Human
cuguauuugugacuaauug

SEQ ID NO: 2273034 - RNA, 19 nt, Human
cucugcuuugacugagcag

SEQ ID NO: 2273035 - RNA, 18 nt, Human
cucugcuugagucagguu

SEQ ID NO: 2273036 - RNA, 17 nt, Human
cucugcuugagucaggu

SEQ ID NO: 2273037 - RNA, 15 nt, Human
cucuggacaggcaug

SEQ ID NO: 2273038 - RNA, 14 nt, Human
cucugcuucucacg

SEQ ID NO: 2273039 - RNA, 23 nt, Human
cucugcuguacauauuugagacu

SEQ ID NO: 2273040 - RNA, 13 nt, Human
cucugcugucuaa

SEQ ID NO: 2273041 - RNA, 12 nt, Human
cucugccugccc

SEQ ID NO: 2273042 - RNA, 13 nt, Human
cucugccugcccc

SEQ ID NO: 2273043 - RNA, 15 nt, Human
cucugccugccccgc

SEQ ID NO: 2273044 - RNA, 14 nt, Human
cucugcuggccugg

SEQ ID NO: 2273045 - RNA, 15 nt, Human
cucugcuggccuggc

SEQ ID NO: 2273046 - RNA, 16 nt, Human
cucugcuggccuggcc

SEQ ID NO: 2273047 - RNA, 17 nt, Human
cucugcuggccuggccg

SEQ ID NO: 2273048 - RNA, 21 nt, Human
cucugcuggccuggccggcaa

SEQ ID NO: 2273049 - RNA, 19 nt, Human
cucugcuugacaacaucug

SEQ ID NO: 2273050 - RNA, 21 nt, Human
cucugcuucucugacuucugc

SEQ ID NO: 2273051 - RNA, 16 nt, Human
cucugcuucucugacu

SEQ ID NO: 2273052 - RNA, 17 nt, Human
cucugcuucucugacuu

SEQ ID NO: 2273053 - RNA, 12 nt, Human
cucugcuucucu

SEQ ID NO: 2273054 - RNA, 13 nt, Human
cucugcuucucug

SEQ ID NO: 2273055 - RNA, 14 nt, Human
cucugcuucucuga

SEQ ID NO: 2273056 - RNA, 15 nt, Human
cucugcuucucugac

SEQ ID NO: 2273057 - RNA, 16 nt, Human
cucucugaaccccucc

SEQ ID NO: 2273058 - RNA, 21 nt, Human
cucucucuucugcuccacccu

SEQ ID NO: 2273059 - RNA, 21 nt, Human
cucugccugaagucacacagu

SEQ ID NO: 2273060 - RNA, 22 nt, Human
cucugccugaagucacacagug

SEQ ID NO: 2273061 - RNA, 22 nt, Human
cucugccugcauucugccgugu

SEQ ID NO: 2273062 - RNA, 11 nt, Human
cucugccugcc

SEQ ID NO: 2273063 - RNA, 16 nt, Human
cucugccugcauucug

SEQ ID NO: 2273064 - RNA, 14 nt, Human
cucugccugcauuc

SEQ ID NO: 2273065 - RNA, 18 nt, Human
cucugccugaaccuucca

SEQ ID NO: 2273066 - RNA, 14 nt, Human
cucucucugacucu

SEQ ID NO: 2273067 - RNA, 20 nt, Human
cucucugaagaugaucauuu

SEQ ID NO: 2273068 - RNA, 18 nt, Human
cucucucuucugcuccac

SEQ ID NO: 2273069 - RNA, 12 nt, Human
cucucucuucug

SEQ ID NO: 2273070 - RNA, 15 nt, Human
cucucucucuccccu

SEQ ID NO: 2273071 - RNA, 15 nt, Human
cucucucucucuccc

SEQ ID NO: 2273072 - RNA, 15 nt, Human
cucucucucuuuccu

SEQ ID NO: 2273073 - RNA, 13 nt, Human
cucucucugacuc

SEQ ID NO: 2273074 - RNA, 15 nt, Human
cucucuccuguccaa

SEQ ID NO: 2273075 - RNA, 15 nt, Human
cucucuccuuugcug

SEQ ID NO: 2273076 - RNA, 19 nt, Human
cucucuccuguccaaccua

SEQ ID NO: 2273077 - RNA, 14 nt, Human
cucucuccugucca

SEQ ID NO: 2273078 - RNA, 20 nt, Human
cucucuccuccugcccaccu

SEQ ID NO: 2273079 - RNA, 20 nt, Human
cucucuccuguacuuuuucc

SEQ ID NO: 2273080 - RNA, 13 nt, Human
cucucuccucccu

SEQ ID NO: 2273081 - RNA, 15 nt, Human
cucucuccuguacuu

SEQ ID NO: 2273082 - RNA, 17 nt, Human
cucucuccuccugccca

SEQ ID NO: 2273083 - RNA, 14 nt, Human
cucucuccuccugc

SEQ ID NO: 2273084 - RNA, 19 nt, Human
cucucuccccucaaagucu

SEQ ID NO: 2273085 - RNA, 22 nt, Human
cucucuccccucaaagucugca

SEQ ID NO: 2273086 - RNA, 15 nt, Human
cucuggcccugccuu

SEQ ID NO: 2273087 - RNA, 18 nt, Human
cucuggccucagccgacu

SEQ ID NO: 2273088 - RNA, 18 nt, Human
cucuggcccugccuucuu

SEQ ID NO: 2273089 - RNA, 19 nt, Human
cucuggaugccugauugcc

SEQ ID NO: 2273090 - RNA, 23 nt, Human
cucuggaugccugauugccaagc

SEQ ID NO: 2273091 - RNA, 12 nt, Human
cucuggccuucg

SEQ ID NO: 2273092 - RNA, 15 nt, Human
cucuggcagcucaga

SEQ ID NO: 2273093 - RNA, 16 nt, Human
cucuggcagcucagag

SEQ ID NO: 2273094 - RNA, 19 nt, Human
cucuggcuagaggccagcc

SEQ ID NO: 2273095 - RNA, 17 nt, Human
cucuggccucccacccg

SEQ ID NO: 2273096 - RNA, 13 nt, Human
cucuggccuccca

SEQ ID NO: 2273097 - RNA, 14 nt, Human
cucuggccucccac

SEQ ID NO: 2273098 - RNA, 15 nt, Human
cucuggccucccacc

SEQ ID NO: 2273099 - RNA, 16 nt, Human
cucuggccucccaccc

SEQ ID NO: 2273100 - RNA, 19 nt, Human
cucuggccuucggccucca

SEQ ID NO: 2273101 - RNA, 16 nt, Human
cucuggcuagaggcca

SEQ ID NO: 2273102 - RNA, 22 nt, Human
cucuggcuagaggccagcccca

SEQ ID NO: 2273103 - RNA, 21 nt, Human
cucuggcuagaggccagcccc

SEQ ID NO: 2273104 - RNA, 20 nt, Human
cucuggcuagaggccagccc

SEQ ID NO: 2273105 - RNA, 16 nt, Human
cucuggcuccagcugg

SEQ ID NO: 2273106 - RNA, 15 nt, Human
cucuggcuccagcug

SEQ ID NO: 2273107 - RNA, 24 nt, Human
cucugcuuugacugagcagacugg

SEQ ID NO: 2273108 - RNA, 14 nt, Human
cucuggaggggagg

SEQ ID NO: 2273109 - RNA, 15 nt, Human
cucuggaggggaggg

SEQ ID NO: 2273110 - RNA, 19 nt, Human
cucuggagcccacuguacu

SEQ ID NO: 2273111 - RNA, 14 nt, Human
cucuggacaggcau

SEQ ID NO: 2273112 - RNA, 16 nt, Human
cucuggacaggcaugu

SEQ ID NO: 2273113 - RNA, 22 nt, Human
cucuggacaggcauguucucug

SEQ ID NO: 2273114 - RNA, 12 nt, Human
cucuggcagcuc

SEQ ID NO: 2273115 - RNA, 14 nt, Human
cucuggcagcucag

SEQ ID NO: 2273116 - RNA, 16 nt, Human
cucuggaguggccacu

SEQ ID NO: 2273117 - RNA, 15 nt, Human
cucuggaguggccac

SEQ ID NO: 2273118 - RNA, 14 nt, Human
cucuggaguggcca

SEQ ID NO: 2273119 - RNA, 12 nt, Human
cucuggaguggc

SEQ ID NO: 2273120 - RNA, 20 nt, Human
cucuggaguggccacuaagc

SEQ ID NO: 2273121 - RNA, 22 nt, Human
cucuggaucaaaguaggcagga

SEQ ID NO: 2273122 - RNA, 15 nt, Human
cucuggaugccugau

SEQ ID NO: 2273123 - RNA, 16 nt, Human
cucuggaggggagggg

SEQ ID NO: 2273124 - RNA, 19 nt, Human
cucuggagggguguggcuc

SEQ ID NO: 2273125 - RNA, 20 nt, Human
cucuggagggguguggcucc

SEQ ID NO: 2273126 - RNA, 21 nt, Human
cucuggagggguguggcuccu

SEQ ID NO: 2273127 - RNA, 13 nt, Human
cucugugugcucc

SEQ ID NO: 2273128 - RNA, 17 nt, Human
cucugugucacuggcug

SEQ ID NO: 2273129 - RNA, 18 nt, Human
cucugugucacuggcugc

SEQ ID NO: 2273130 - RNA, 20 nt, Human
cucugugucacuggcugccu

SEQ ID NO: 2273131 - RNA, 23 nt, Human
cucugugucacuggcugccucca

SEQ ID NO: 2273132 - RNA, 20 nt, Human
cucuguguugugaaugucau

SEQ ID NO: 2273133 - RNA, 19 nt, Human
cucuguguuuguuccuaca

SEQ ID NO: 2273134 - RNA, 17 nt, Human
cucuguucaguguaaau

SEQ ID NO: 2273135 - RNA, 15 nt, Human
cucuguucaguguaa

SEQ ID NO: 2273136 - RNA, 14 nt, Human
cucuguucagugua

SEQ ID NO: 2273137 - RNA, 14 nt, Human
cucuguucauuucc

SEQ ID NO: 2273138 - RNA, 13 nt, Human
cucuguucauuuc

SEQ ID NO: 2273139 - RNA, 15 nt, Human
cucugugucaggugg

SEQ ID NO: 2273140 - RNA, 18 nt, Human
cucuguguauuugcuuuu

SEQ ID NO: 2273141 - RNA, 19 nt, Human
cucuguguauuugcuuuuu

SEQ ID NO: 2273142 - RNA, 13 nt, Human
cucugugucacug

SEQ ID NO: 2273143 - RNA, 16 nt, Human
cucugugucacuggcu

SEQ ID NO: 2273144 - RNA, 17 nt, Human
cucugugggcuggcagu

SEQ ID NO: 2273145 - RNA, 17 nt, Human
cucugugggcugcacuc

SEQ ID NO: 2273146 - RNA, 23 nt, Human
cucugugggcugcacucugugcc

SEQ ID NO: 2273147 - RNA, 13 nt, Human
cucugugggcugc

SEQ ID NO: 2273148 - RNA, 14 nt, Human
cucugugggcugca

SEQ ID NO: 2273149 - RNA, 16 nt, Human
cucugugggcugcacu

SEQ ID NO: 2273150 - RNA, 22 nt, Human
cucugugcuuuuaaaugcauaa

SEQ ID NO: 2273151 - RNA, 18 nt, Human
cucugugcuguggaagca

SEQ ID NO: 2273152 - RNA, 18 nt, Human
cucugugcuuugacucac

SEQ ID NO: 2273153 - RNA, 21 nt, Human
cucugugcuuugacucaccug

SEQ ID NO: 2273154 - RNA, 23 nt, Human
cucugugcuuugacucaccuguu

SEQ ID NO: 2273155 - RNA, 16 nt, Human
cucuguucauuuccuc

SEQ ID NO: 2273156 - RNA, 17 nt, Human
cucuguucauuuccuca

SEQ ID NO: 2273157 - RNA, 14 nt, Human
cucuuacugcaaau

SEQ ID NO: 2273158 - RNA, 20 nt, Human
cucuuacgcccaacccuucc

SEQ ID NO: 2273159 - RNA, 16 nt, Human
cucuuacugcaaaugu

SEQ ID NO: 2273160 - RNA, 18 nt, Human
cucuguucaguguaaaua

SEQ ID NO: 2273161 - RNA, 18 nt, Human
cucuuacgcccaacccuu

SEQ ID NO: 2273162 - RNA, 22 nt, Human
cucuuacgcccaacccuucccc

SEQ ID NO: 2273163 - RNA, 15 nt, Human
cucuuagaaaaacca

SEQ ID NO: 2273164 - RNA, 13 nt, Human
cucuuagaaaaac

SEQ ID NO: 2273165 - RNA, 17 nt, Human
cucuuccacucuccuug

SEQ ID NO: 2273166 - RNA, 19 nt, Human
cucuuacugcaaaugucau

SEQ ID NO: 2273167 - RNA, 14 nt, Human
cucuuacugcuaac

SEQ ID NO: 2273168 - RNA, 22 nt, Human
cucuuacuuuccuuuccccagc

SEQ ID NO: 2273169 - RNA, 23 nt, Human
cucuuacuuuccuuuccccagcc

SEQ ID NO: 2273170 - RNA, 13 nt, Human
cucuuccaggcug

SEQ ID NO: 2273171 - RNA, 14 nt, Human
cucuuccaggcugg

SEQ ID NO: 2273172 - RNA, 15 nt, Human
cucuuccaggcuggg

SEQ ID NO: 2273173 - RNA, 20 nt, Human
cucugugcagucacuggagg

SEQ ID NO: 2273174 - RNA, 21 nt, Human
cucugugagcaucacaguuuu

SEQ ID NO: 2273175 - RNA, 18 nt, Human
cucugugagcaucacagu

SEQ ID NO: 2273176 - RNA, 22 nt, Human
cucugugagcaucacaguuuug

SEQ ID NO: 2273177 - RNA, 17 nt, Human
cucugucuucaccugau

SEQ ID NO: 2273178 - RNA, 22 nt, Human
cucugucugcccuucaccccag

SEQ ID NO: 2273179 - RNA, 13 nt, Human
cucugugagacuc

SEQ ID NO: 2273180 - RNA, 17 nt, Human
cucugugagacucgaga

SEQ ID NO: 2273181 - RNA, 18 nt, Human
cucugugagacucgagaa

SEQ ID NO: 2273182 - RNA, 22 nt, Human
cucugugcccacccuccacucu

SEQ ID NO: 2273183 - RNA, 12 nt, Human
cucugugcccau

SEQ ID NO: 2273184 - RNA, 14 nt, Human
cucugugcccaugg

SEQ ID NO: 2273185 - RNA, 13 nt, Human
cucugugccuucg

SEQ ID NO: 2273186 - RNA, 20 nt, Human
cucugugcccccaucacccu

SEQ ID NO: 2273187 - RNA, 16 nt, Human
cucugugcccaugggc

SEQ ID NO: 2273188 - RNA, 20 nt, Human
cucugugcccaugggcacug

SEQ ID NO: 2273189 - RNA, 22 nt, Human
cucugugcccaugggcacugcu

SEQ ID NO: 2273190 - RNA, 23 nt, Human
cucugugcccaugggcacugcug

SEQ ID NO: 2273191 - RNA, 16 nt, Human
cucugugccuucuuuu

SEQ ID NO: 2273192 - RNA, 15 nt, Human
cucugugccuucuuu

SEQ ID NO: 2273193 - RNA, 15 nt, Human
cucugugcugacccu

SEQ ID NO: 2273194 - RNA, 19 nt, Human
cucugugcugacccuccug

SEQ ID NO: 2273195 - RNA, 20 nt, Human
cucugugcugacccuccugu

SEQ ID NO: 2273196 - RNA, 21 nt, Human
cucugugcugacccuccuguu

SEQ ID NO: 2273197 - RNA, 14 nt, Human
cucugugcugugga

SEQ ID NO: 2273198 - RNA, 15 nt, Human
cucugugcuguggaa

SEQ ID NO: 2273199 - RNA, 13 nt, Human
cucugugcugugu

SEQ ID NO: 2273200 - RNA, 14 nt, Human
cucugucucaugug

SEQ ID NO: 2273201 - RNA, 16 nt, Human
cucugucucaugugug

SEQ ID NO: 2273202 - RNA, 20 nt, Human
cucugucucaugugugcucu

SEQ ID NO: 2273203 - RNA, 23 nt, Human
cucugucucaugugugcucuucu

SEQ ID NO: 2273204 - RNA, 22 nt, Human
cucugucugaguaagaaacaga

SEQ ID NO: 2273205 - RNA, 14 nt, Human
cucugucugcccuu

SEQ ID NO: 2273206 - RNA, 17 nt, Human
cucugucugcccuucac

SEQ ID NO: 2273207 - RNA, 19 nt, Human
cucugggaaauaagagaga

SEQ ID NO: 2273208 - RNA, 23 nt, Human
cucugggaaaugagaaggcagcc

SEQ ID NO: 2273209 - RNA, 15 nt, Human
cucugucucauccau

SEQ ID NO: 2273210 - RNA, 14 nt, Human
cucugucucaucca

SEQ ID NO: 2273211 - RNA, 20 nt, Human
cucugggaaaugagaaggca

SEQ ID NO: 2273212 - RNA, 22 nt, Human
cucugggaaaugagaaggcagc

SEQ ID NO: 2273213 - RNA, 23 nt, Human
cucuggcuggcuaacuggaagca

SEQ ID NO: 2273214 - RNA, 13 nt, Human
cucuggcugggga

SEQ ID NO: 2273215 - RNA, 15 nt, Human
cucuggcuggggagc

SEQ ID NO: 2273216 - RNA, 21 nt, Human
cucuggcugguuuggaaugcu

SEQ ID NO: 2273217 - RNA, 22 nt, Human
cucuggcugguuuggaaugcuu

SEQ ID NO: 2273218 - RNA, 12 nt, Human
cucuggcuucca

SEQ ID NO: 2273219 - RNA, 13 nt, Human
cucuggcuuccag

SEQ ID NO: 2273220 - RNA, 14 nt, Human
cucuggcuuccagg

SEQ ID NO: 2273221 - RNA, 17 nt, Human
cucuggcuuccagguau

SEQ ID NO: 2273222 - RNA, 18 nt, Human
cucuggcuuccagguauc

SEQ ID NO: 2273223 - RNA, 13 nt, Human
cucuggcuggcua

SEQ ID NO: 2273224 - RNA, 21 nt, Human
cucuggcugaacccugugcug

SEQ ID NO: 2273225 - RNA, 19 nt, Human
cucuggcugaacccugugc

SEQ ID NO: 2273226 - RNA, 20 nt, Human
cucuggcugaacccugugcu

SEQ ID NO: 2273227 - RNA, 15 nt, Human
cucuggcugaacccu

SEQ ID NO: 2273228 - RNA, 16 nt, Human
cucuggcugaacccug

SEQ ID NO: 2273229 - RNA, 17 nt, Human
cucuggcugaacccugu

SEQ ID NO: 2273230 - RNA, 18 nt, Human
cucuggcugaacccugug

SEQ ID NO: 2273231 - RNA, 12 nt, Human
cucuggcucuca

SEQ ID NO: 2273232 - RNA, 13 nt, Human
cucuggcucucau

SEQ ID NO: 2273233 - RNA, 16 nt, Human
cucuggcucucauggg

SEQ ID NO: 2273234 - RNA, 22 nt, Human
cucuggcuccagcuggccggga

SEQ ID NO: 2273235 - RNA, 13 nt, Human
cugaacucuccag

SEQ ID NO: 2273236 - RNA, 19 nt, Human
cugaacugauggguuucuc

SEQ ID NO: 2273237 - RNA, 23 nt, Human
cugaagaagcaccaaucaugaau

SEQ ID NO: 2273238 - RNA, 16 nt, Human
cugaagaccucgagca

SEQ ID NO: 2273239 - RNA, 16 nt, Human
cugaacugggaccuuu

SEQ ID NO: 2273240 - RNA, 19 nt, Human
cugaagaauugaaaaacca

SEQ ID NO: 2273241 - RNA, 13 nt, Human
cugaacagcugua

SEQ ID NO: 2273242 - RNA, 12 nt, Human
cugaacagugga

SEQ ID NO: 2273243 - RNA, 17 nt, Human
cugaacggggagaaaag

SEQ ID NO: 2273244 - RNA, 17 nt, Human
cugaacucugacaacag

SEQ ID NO: 2273245 - RNA, 16 nt, Human
cugaacucugacaaca

SEQ ID NO: 2273246 - RNA, 13 nt, Human
cugaacucacuuu

SEQ ID NO: 2273247 - RNA, 18 nt, Human
cugaacucaaacugagga

SEQ ID NO: 2273248 - RNA, 15 nt, Human
cugaacucaaacuga

SEQ ID NO: 2273249 - RNA, 22 nt, Human
cugaacuaauaaaucuguugcc

SEQ ID NO: 2273250 - RNA, 14 nt, Human
cugaaauuucacca

SEQ ID NO: 2273251 - RNA, 13 nt, Human
cugaaauuuuaua

SEQ ID NO: 2273252 - RNA, 14 nt, Human
cugaaauuucagau

SEQ ID NO: 2273253 - RNA, 18 nt, Human
cugaacacuccaauuaag

SEQ ID NO: 2273254 - RNA, 19 nt, Human
cugaacacuuuuguuguaa

SEQ ID NO: 2273255 - RNA, 23 nt, Human
cugaacacuccaauuaaggauuu

SEQ ID NO: 2273256 - RNA, 20 nt, Human
cugaacacuuuuguuguaaa

SEQ ID NO: 2273257 - RNA, 19 nt, Human
cugaaaucucagaauuccu

SEQ ID NO: 2273258 - RNA, 16 nt, Human
cugaaaucugaagacc

SEQ ID NO: 2273259 - RNA, 16 nt, Human
cugaaaugcugcauuu

SEQ ID NO: 2273260 - RNA, 13 nt, Human
cugaaaugaagau

SEQ ID NO: 2273261 - RNA, 20 nt, Human
cugaaauucuccuggagguc

SEQ ID NO: 2273262 - RNA, 13 nt, Human
cugaaauuucaga

SEQ ID NO: 2273263 - RNA, 14 nt, Human
cugaaagccagcug

SEQ ID NO: 2273264 - RNA, 21 nt, Human
cugaaagccacguuccuuacu

SEQ ID NO: 2273265 - RNA, 15 nt, Human
cugaaagcccugagc

SEQ ID NO: 2273266 - RNA, 20 nt, Human
cucuuugaauuuucuguguu

SEQ ID NO: 2273267 - RNA, 17 nt, Human
cucuuugaaugacaaag

SEQ ID NO: 2273268 - RNA, 12 nt, Human
cucuuugaauuu

SEQ ID NO: 2273269 - RNA, 22 nt, Human
cucuuugaaauagucuguguga

SEQ ID NO: 2273270 - RNA, 18 nt, Human
cucuuucuucucugcugc

SEQ ID NO: 2273271 - RNA, 14 nt, Human
cucuuugaaugaca

SEQ ID NO: 2273272 - RNA, 23 nt, Human
cucuuugagauagaagaacugca

SEQ ID NO: 2273273 - RNA, 15 nt, Human
cucuuugagauagaa

SEQ ID NO: 2273274 - RNA, 10 nt, Human
cucuuugaga

SEQ ID NO: 2273275 - RNA, 22 nt, Human
cucuuuccuguuguuguuaaug

SEQ ID NO: 2273276 - RNA, 16 nt, Human
cucuuuccuucuugcc

SEQ ID NO: 2273277 - RNA, 11 nt, Human
cucuuuccuug

SEQ ID NO: 2273278 - RNA, 13 nt, Human
cucuuuccuugcu

SEQ ID NO: 2273279 - RNA, 16 nt, Human
cucuuuccuccuucca

SEQ ID NO: 2273280 - RNA, 19 nt, Human
cucuuucugucccuucugu

SEQ ID NO: 2273281 - RNA, 15 nt, Human
cucuuucuguauaua

SEQ ID NO: 2273282 - RNA, 20 nt, Human
cucuuuccuuggcucccauu

SEQ ID NO: 2273283 - RNA, 14 nt, Human
cucuuucuguauau

SEQ ID NO: 2273284 - RNA, 19 nt, Human
cugaaauauacacacagca

SEQ ID NO: 2273285 - RNA, 18 nt, Human
cugaaauauacacacagc

SEQ ID NO: 2273286 - RNA, 22 nt, Human
cugaaauagacccacaagaggc

SEQ ID NO: 2273287 - RNA, 23 nt, Human
cugaaagccagcugccgaccaga

SEQ ID NO: 2273288 - RNA, 23 nt, Human
cugaaagccauuuguuggggcag

SEQ ID NO: 2273289 - RNA, 23 nt, Human
cugaaagcccugagcuuucugcu

SEQ ID NO: 2273290 - RNA, 19 nt, Human
cugaaagcccugagcuuuc

SEQ ID NO: 2273291 - RNA, 18 nt, Human
cugaaagcccugagcuuu

SEQ ID NO: 2273292 - RNA, 17 nt, Human
cugaaagcccugagcuu

SEQ ID NO: 2273293 - RNA, 16 nt, Human
cugaaagcccugagcu

SEQ ID NO: 2273294 - RNA, 16 nt, Human
cucuucuuuuggcuuc

SEQ ID NO: 2273295 - RNA, 19 nt, Human
cucuucuuuuggcuuccau

SEQ ID NO: 2273296 - RNA, 23 nt, Human
cucuucuuuuaaaccauuuucuu

SEQ ID NO: 2273297 - RNA, 24 nt, Human
cucuucuuuauacuguaauuuagu

SEQ ID NO: 2273298 - RNA, 22 nt, Human
cucuugaaauauaggaacuuaa

SEQ ID NO: 2273299 - RNA, 22 nt, Human
cucuucuuuaaagggauggcaa

SEQ ID NO: 2273300 - RNA, 21 nt, Human
cucuucuuuauacuguaauuu

SEQ ID NO: 2273301 - RNA, 22 nt, Human
cucuucuuuauacuguaauuua

SEQ ID NO: 2273302 - RNA, 14 nt, Human
cucuucuucuuucu

SEQ ID NO: 2273303 - RNA, 18 nt, Human
cucuucuugaacacucau

SEQ ID NO: 2273304 - RNA, 23 nt, Human
cucuucuugaacacucaugcuga

SEQ ID NO: 2273305 - RNA, 19 nt, Human
cucuuggguucaagugauu

SEQ ID NO: 2273306 - RNA, 21 nt, Human
cucuuggguucaagcgauucu

SEQ ID NO: 2273307 - RNA, 19 nt, Human
cucuuggguucaagcgauu

SEQ ID NO: 2273308 - RNA, 15 nt, Human
cucuugaacuccuga

SEQ ID NO: 2273309 - RNA, 23 nt, Human
cucuuccggagauguagcaaaac

SEQ ID NO: 2273310 - RNA, 22 nt, Human
cucuuccggagauguagcaaaa

SEQ ID NO: 2273311 - RNA, 19 nt, Human
cucuuccggagauguagca

SEQ ID NO: 2273312 - RNA, 20 nt, Human
cucuuccgugacgucacugg

SEQ ID NO: 2273313 - RNA, 12 nt, Human
cucuuccuaccc

SEQ ID NO: 2273314 - RNA, 15 nt, Human
cucuuccuacccaac

SEQ ID NO: 2273315 - RNA, 22 nt, Human
cucuuccuacccaaccacucaa

SEQ ID NO: 2273316 - RNA, 19 nt, Human
cucuuccuacccaaccacu

SEQ ID NO: 2273317 - RNA, 20 nt, Human
cucuuccuacccaaccacuc

SEQ ID NO: 2273318 - RNA, 20 nt, Human
cucuuccgaaaaauccucuu

SEQ ID NO: 2273319 - RNA, 22 nt, Human
cucuuccgaaaaauccucuucc

SEQ ID NO: 2273320 - RNA, 23 nt, Human
cucuuccgaaaaauccucuuccu

SEQ ID NO: 2273321 - RNA, 14 nt, Human
cucuguuccccuag

SEQ ID NO: 2273322 - RNA, 13 nt, Human
cucuuccagaauc

SEQ ID NO: 2273323 - RNA, 18 nt, Human
cucuuccagaaucccaag

SEQ ID NO: 2273324 - RNA, 19 nt, Human
cucuucuuaacuuaaauuu

SEQ ID NO: 2273325 - RNA, 23 nt, Human
cucuucugugggugacccagguc

SEQ ID NO: 2273326 - RNA, 16 nt, Human
cucuucugugggugac

SEQ ID NO: 2273327 - RNA, 18 nt, Human
cucuucuucuucagaaga

SEQ ID NO: 2273328 - RNA, 17 nt, Human
cucuucuucuucagaag

SEQ ID NO: 2273329 - RNA, 15 nt, Human
cucuucuucuucaga

SEQ ID NO: 2273330 - RNA, 20 nt, Human
cucuucuugaaauuuuaacc

SEQ ID NO: 2273331 - RNA, 15 nt, Human
cucuucuugaaauuu

SEQ ID NO: 2273332 - RNA, 18 nt, Human
cucuuuaaugucacaggc

SEQ ID NO: 2273333 - RNA, 15 nt, Human
cucuuuaacuucucg

SEQ ID NO: 2273334 - RNA, 16 nt, Human
cucuuguuuucaguuu

SEQ ID NO: 2273335 - RNA, 13 nt, Human
cucuuuaaaaaca

SEQ ID NO: 2273336 - RNA, 13 nt, Human
cucuuguggaugu

SEQ ID NO: 2273337 - RNA, 13 nt, Human
cucuugguccugc

SEQ ID NO: 2273338 - RNA, 15 nt, Human
cucuugguccugcug

SEQ ID NO: 2273339 - RNA, 16 nt, Human
cucuugguccugcugc

SEQ ID NO: 2273340 - RNA, 17 nt, Human
cucuugguccugcugca

SEQ ID NO: 2273341 - RNA, 20 nt, Human
cucuuuaaugucacaggcag

SEQ ID NO: 2273342 - RNA, 21 nt, Human
cucuuuaaugucacaggcagg

SEQ ID NO: 2273343 - RNA, 22 nt, Human
cucuuuaaugucacaggcaggu

SEQ ID NO: 2273344 - RNA, 23 nt, Human
cucuuuaaugucacaggcagguc

SEQ ID NO: 2273345 - RNA, 16 nt, Human
cucuuuaaucuucagu

SEQ ID NO: 2273346 - RNA, 12 nt, Human
cucuuuagccag

SEQ ID NO: 2273347 - RNA, 21 nt, Human
cucuuuagaguuagacuguug

SEQ ID NO: 2273348 - RNA, 18 nt, Human
cucuuuagaguuagacug

SEQ ID NO: 2273349 - RNA, 19 nt, Human
cucuuuagaguuagacugu

SEQ ID NO: 2273350 - RNA, 21 nt, Human
cucuuuaagaguuaguuucuu

SEQ ID NO: 2273351 - RNA, 15 nt, Human
cucuuuagaguuaga

SEQ ID NO: 2273352 - RNA, 17 nt, Human
cucuuuagaguuagacu

SEQ ID NO: 2273353 - RNA, 17 nt, Human
cucuuucccucccuucc

SEQ ID NO: 2273354 - RNA, 13 nt, Human
cucuuucccuccc

SEQ ID NO: 2273355 - RNA, 22 nt, Human
cucuuuauauggccucaagauc

SEQ ID NO: 2273356 - RNA, 17 nt, Human
cucuuuaugacuguuuu

SEQ ID NO: 2273357 - RNA, 22 nt, Human
cugagcgccuccauccaaggcc

SEQ ID NO: 2273358 - RNA, 13 nt, Human
cugagcgccucca

SEQ ID NO: 2273359 - RNA, 15 nt, Human
cugagcgccuccauc

SEQ ID NO: 2273360 - RNA, 15 nt, Human
cugagcgccaggaug

SEQ ID NO: 2273361 - RNA, 17 nt, Human
cugagcgauuauuaucu

SEQ ID NO: 2273362 - RNA, 21 nt, Human
cugagccuuguaauucuaaau

SEQ ID NO: 2273363 - RNA, 20 nt, Human
cugagcgaggagaugcuccu

SEQ ID NO: 2273364 - RNA, 23 nt, Human
cugagcgugcuuuccaaaaccca

SEQ ID NO: 2273365 - RNA, 14 nt, Human
cugagcgcuccugc

SEQ ID NO: 2273366 - RNA, 19 nt, Human
cugagcggaugcaucuggg

SEQ ID NO: 2273367 - RNA, 21 nt, Human
cugagcuauuucaucuauuuu

SEQ ID NO: 2273368 - RNA, 16 nt, Human
cugagcuauuucaucu

SEQ ID NO: 2273369 - RNA, 13 nt, Human
cugagcuauuuca

SEQ ID NO: 2273370 - RNA, 19 nt, Human
cugagcuagaagcuggagg

SEQ ID NO: 2273371 - RNA, 23 nt, Human
cugagcuccucugggcaggaccu

SEQ ID NO: 2273372 - RNA, 20 nt, Human
cugagcuccucugggcagga

SEQ ID NO: 2273373 - RNA, 18 nt, Human
cugagcuccucugggcag

SEQ ID NO: 2273374 - RNA, 17 nt, Human
cugagcuccucugggca

SEQ ID NO: 2273375 - RNA, 16 nt, Human
cugagcuccucugggc

SEQ ID NO: 2273376 - RNA, 15 nt, Human
cugagcuccucuggg

SEQ ID NO: 2273377 - RNA, 14 nt, Human
cugagcuccucugg

SEQ ID NO: 2273378 - RNA, 20 nt, Human
cugagcuccccaccacccca

SEQ ID NO: 2273379 - RNA, 20 nt, Human
cugagcucgguggacccagg

SEQ ID NO: 2273380 - RNA, 18 nt, Human
cugagcucgguggaccca

SEQ ID NO: 2273381 - RNA, 17 nt, Human
cugagcucgguggaccc

SEQ ID NO: 2273382 - RNA, 18 nt, Human
cugagcuccccaccaccc

SEQ ID NO: 2273383 - RNA, 22 nt, Human
cugagcuccaugugcccccucu

SEQ ID NO: 2273384 - RNA, 13 nt, Human
cugagcucacucg

SEQ ID NO: 2273385 - RNA, 17 nt, Human
cugagccuucagucuug

SEQ ID NO: 2273386 - RNA, 14 nt, Human
cugagccuggcugg

SEQ ID NO: 2273387 - RNA, 16 nt, Human
cugagccuggcuggca

SEQ ID NO: 2273388 - RNA, 12 nt, Human
cugagccuucag

SEQ ID NO: 2273389 - RNA, 15 nt, Human
cugagccuuguaauu

SEQ ID NO: 2273390 - RNA, 16 nt, Human
cugagccuuguaauuc

SEQ ID NO: 2273391 - RNA, 20 nt, Human
cugagcgacagugagacucu

SEQ ID NO: 2273392 - RNA, 16 nt, Human
cugagcgacagugaga

SEQ ID NO: 2273393 - RNA, 22 nt, Human
cugagccucagucucccucccu

SEQ ID NO: 2273394 - RNA, 12 nt, Human
cugagccucugc

SEQ ID NO: 2273395 - RNA, 13 nt, Human
cugagccucucac

SEQ ID NO: 2273396 - RNA, 21 nt, Human
cugagccucucaccuguacuc

SEQ ID NO: 2273397 - RNA, 18 nt, Human
cugagccucugcucccca

SEQ ID NO: 2273398 - RNA, 16 nt, Human
cugagccucugcuccc

SEQ ID NO: 2273399 - RNA, 15 nt, Human
cugagccucugcucc

SEQ ID NO: 2273400 - RNA, 14 nt, Human
cugagccucugcuc

SEQ ID NO: 2273401 - RNA, 17 nt, Human
cugagccuggccagccu

SEQ ID NO: 2273402 - RNA, 15 nt, Human
cugagccuggccagc

SEQ ID NO: 2273403 - RNA, 14 nt, Human
cugagccuggccag

SEQ ID NO: 2273404 - RNA, 13 nt, Human
cugagccuggcca

SEQ ID NO: 2273405 - RNA, 22 nt, Human
cugagccucucaccuguacucu

SEQ ID NO: 2273406 - RNA, 16 nt, Human
cugagccagugucagg

SEQ ID NO: 2273407 - RNA, 22 nt, Human
cugagccagugucaggaggaag

SEQ ID NO: 2273408 - RNA, 22 nt, Human
cugagccaguucaguaccugga

SEQ ID NO: 2273409 - RNA, 20 nt, Human
cugagacaaauggaggccug

SEQ ID NO: 2273410 - RNA, 15 nt, Human
cugagccagauuuca

SEQ ID NO: 2273411 - RNA, 18 nt, Human
cugagccagucccagggg

SEQ ID NO: 2273412 - RNA, 19 nt, Human
cugagccagucccaggggc

SEQ ID NO: 2273413 - RNA, 21 nt, Human
cugagccucagucucccuccc

SEQ ID NO: 2273414 - RNA, 16 nt, Human
cugagccucagucucc

SEQ ID NO: 2273415 - RNA, 13 nt, Human
cugagcccuggca

SEQ ID NO: 2273416 - RNA, 12 nt, Human
cugagcccuggc

SEQ ID NO: 2273417 - RNA, 11 nt, Human
cugagcccugg

SEQ ID NO: 2273418 - RNA, 16 nt, Human
cugagcccucaaagug

SEQ ID NO: 2273419 - RNA, 17 nt, Human
cugagcccucaaaguga

SEQ ID NO: 2273420 - RNA, 15 nt, Human
cugagcccuggcagg

SEQ ID NO: 2273421 - RNA, 14 nt, Human
cugagcccuggcag

SEQ ID NO: 2273422 - RNA, 16 nt, Human
cugagacagcccgggc

SEQ ID NO: 2273423 - RNA, 17 nt, Human
cugagacagcccgggcu

SEQ ID NO: 2273424 - RNA, 18 nt, Human
cugagacagcccgggcuc

SEQ ID NO: 2273425 - RNA, 17 nt, Human
cugagccagauuucacu

SEQ ID NO: 2273426 - RNA, 18 nt, Human
cugagccagauuucacuc

SEQ ID NO: 2273427 - RNA, 19 nt, Human
cugagccagauuucacucu

SEQ ID NO: 2273428 - RNA, 20 nt, Human
cugagccagauuucacucuc

SEQ ID NO: 2273429 - RNA, 21 nt, Human
cugagccagauuucacucucc

SEQ ID NO: 2273430 - RNA, 19 nt, Human
cugagcucugcauuugucu

SEQ ID NO: 2273431 - RNA, 22 nt, Human
cugagcucgguggacccaggga

SEQ ID NO: 2273432 - RNA, 17 nt, Human
cugaggaucagaguaau

SEQ ID NO: 2273433 - RNA, 13 nt, Human
cugagcugaggca

SEQ ID NO: 2273434 - RNA, 12 nt, Human
cugagcugaggc

SEQ ID NO: 2273435 - RNA, 18 nt, Human
cugaggauuucaagccug

SEQ ID NO: 2273436 - RNA, 17 nt, Human
cugaggauuucaagccu

SEQ ID NO: 2273437 - RNA, 14 nt, Human
cugaggauuucaag

SEQ ID NO: 2273438 - RNA, 18 nt, Human
cugaggaugagcuggaag

SEQ ID NO: 2273439 - RNA, 22 nt, Human
cugaggauuuaagggauggaaa

SEQ ID NO: 2273440 - RNA, 16 nt, Human
cugaggaugagcugga

SEQ ID NO: 2273441 - RNA, 17 nt, Human
cugaggaugagcuggaa

SEQ ID NO: 2273442 - RNA, 13 nt, Human
cugaggcagacag

SEQ ID NO: 2273443 - RNA, 13 nt, Human
cugaggcacgagc

SEQ ID NO: 2273444 - RNA, 12 nt, Human
cugaggcaagag

SEQ ID NO: 2273445 - RNA, 16 nt, Human
cugaggcaagagaauu

SEQ ID NO: 2273446 - RNA, 13 nt, Human
cugaggaugagcu

SEQ ID NO: 2273447 - RNA, 15 nt, Human
cugaggaugagcugg

SEQ ID NO: 2273448 - RNA, 15 nt, Human
cugaggagugaggaa

SEQ ID NO: 2273449 - RNA, 19 nt, Human
cugaggaucagaguaaucc

SEQ ID NO: 2273450 - RNA, 17 nt, Human
cugaggcagacagcagc

SEQ ID NO: 2273451 - RNA, 16 nt, Human
cugaggcagacagcag

SEQ ID NO: 2273452 - RNA, 15 nt, Human
cugaggcagacagca

SEQ ID NO: 2273453 - RNA, 14 nt, Human
cugaggcagacagc

SEQ ID NO: 2273454 - RNA, 22 nt, Human
cugaggcagacagcagcucagg

SEQ ID NO: 2273455 - RNA, 18 nt, Human
cugaggcagacagcagcu

SEQ ID NO: 2273456 - RNA, 17 nt, Human
cugaggcagcaguguga

SEQ ID NO: 2273457 - RNA, 15 nt, Human
cugaggcagcagugu

SEQ ID NO: 2273458 - RNA, 21 nt, Human
cugaggcagggaaguccccag

SEQ ID NO: 2273459 - RNA, 20 nt, Human
cugaggcagggaagucccca

SEQ ID NO: 2273460 - RNA, 16 nt, Human
cugaggcagggaaguc

SEQ ID NO: 2273461 - RNA, 14 nt, Human
cugaggcagggaag

SEQ ID NO: 2273462 - RNA, 15 nt, Human
cugaggcaggaggau

SEQ ID NO: 2273463 - RNA, 15 nt, Human
cugaggcagaagaau

SEQ ID NO: 2273464 - RNA, 24 nt, Human
cugaggcagcagugugaggccagg

SEQ ID NO: 2273465 - RNA, 23 nt, Human
cugaggcagcagugugaggccag

SEQ ID NO: 2273466 - RNA, 22 nt, Human
cugaggcagcagugugaggcca

SEQ ID NO: 2273467 - RNA, 22 nt, Human
cugaggcagggaaguccccagg

SEQ ID NO: 2273468 - RNA, 12 nt, Human
cugaggccacac

SEQ ID NO: 2273469 - RNA, 20 nt, Human
cugaggccacacucagcaca

SEQ ID NO: 2273470 - RNA, 14 nt, Human
cugaggccacacuc

SEQ ID NO: 2273471 - RNA, 24 nt, Human
cugaggccacacucagcacaaggc

SEQ ID NO: 2273472 - RNA, 21 nt, Human
cugaggccacacucagcacaa

SEQ ID NO: 2273473 - RNA, 19 nt, Human
cugaggcagguccccagac

SEQ ID NO: 2273474 - RNA, 18 nt, Human
cugaggcagguccccaga

SEQ ID NO: 2273475 - RNA, 17 nt, Human
cugaggcagguccccag

SEQ ID NO: 2273476 - RNA, 14 nt, Human
cugaggcagguccc

SEQ ID NO: 2273477 - RNA, 12 nt, Human
cugaggcccaga

SEQ ID NO: 2273478 - RNA, 13 nt, Human
cugaggcccagag

SEQ ID NO: 2273479 - RNA, 14 nt, Human
cugaggcccagagg

SEQ ID NO: 2273480 - RNA, 15 nt, Human
cugaggcccagaggg

SEQ ID NO: 2273481 - RNA, 16 nt, Human
cugaggcccagagggc

SEQ ID NO: 2273482 - RNA, 17 nt, Human
cugaggcccagagggcc

SEQ ID NO: 2273483 - RNA, 18 nt, Human
cugaggcccagagggccu

SEQ ID NO: 2273484 - RNA, 19 nt, Human
cugaggcccagagggccug

SEQ ID NO: 2273485 - RNA, 21 nt, Human
cugaggcccagagggccugca

SEQ ID NO: 2273486 - RNA, 23 nt, Human
cugaggcccagagggccugcaag

SEQ ID NO: 2273487 - RNA, 14 nt, Human
cugaggcccuucuc

SEQ ID NO: 2273488 - RNA, 15 nt, Human
cugaggcccuucucu

SEQ ID NO: 2273489 - RNA, 18 nt, Human
cugaggcccuucucucca

SEQ ID NO: 2273490 - RNA, 19 nt, Human
cugaggcccuucucuccag

SEQ ID NO: 2273491 - RNA, 20 nt, Human
cugaggcccuucucuccagc

SEQ ID NO: 2273492 - RNA, 22 nt, Human
cugagaaucuuuauugagaaag

SEQ ID NO: 2273493 - RNA, 14 nt, Human
cugagaaucuuuau

SEQ ID NO: 2273494 - RNA, 17 nt, Human
cugagaauguaagaacu

SEQ ID NO: 2273495 - RNA, 17 nt, Human
cugagacaaauggaggc

SEQ ID NO: 2273496 - RNA, 22 nt, Human
cugagaauuuaaaaauaagaaa

SEQ ID NO: 2273497 - RNA, 19 nt, Human
cugagaauguaagaacuac

SEQ ID NO: 2273498 - RNA, 15 nt, Human
cugagaauuccaagg

SEQ ID NO: 2273499 - RNA, 16 nt, Human
cugagaauuccaagga

SEQ ID NO: 2273500 - RNA, 14 nt, Human
cugagacagcccgg

SEQ ID NO: 2273501 - RNA, 15 nt, Human
cugagacagcccggg

SEQ ID NO: 2273502 - RNA, 20 nt, Human
cugagaauauaauacuguau

SEQ ID NO: 2273503 - RNA, 23 nt, Human
cugagaauauaauacuguauuug

SEQ ID NO: 2273504 - RNA, 15 nt, Human
cugagaauaagaaag

SEQ ID NO: 2273505 - RNA, 17 nt, Human
cugagaagguccuuaau

SEQ ID NO: 2273506 - RNA, 23 nt, Human
cugagaagguccuuaaugauccg

SEQ ID NO: 2273507 - RNA, 22 nt, Human
cugagaagagagaucaaaugga

SEQ ID NO: 2273508 - RNA, 17 nt, Human
cugagaagauugugaau

SEQ ID NO: 2273509 - RNA, 23 nt, Human
cugagaagagagaucaaauggaa

SEQ ID NO: 2273510 - RNA, 14 nt, Human
cugacuuugcucuu

SEQ ID NO: 2273511 - RNA, 21 nt, Human
cugacuuggggagauggaguu

SEQ ID NO: 2273512 - RNA, 22 nt, Human
cugacuuggggagauggaguuc

SEQ ID NO: 2273513 - RNA, 20 nt, Human
cugacuuggggagauggagu

SEQ ID NO: 2273514 - RNA, 23 nt, Human
cugagaaagacuauucaaacagu

SEQ ID NO: 2273515 - RNA, 22 nt, Human
cugagaaagacuauucaaacag

SEQ ID NO: 2273516 - RNA, 17 nt, Human
cugagaacccugcgugg

SEQ ID NO: 2273517 - RNA, 17 nt, Human
cugagaacacugugaaa

SEQ ID NO: 2273518 - RNA, 22 nt, Human
cugagaacacugugaaaacauu

SEQ ID NO: 2273519 - RNA, 23 nt, Human
cugagaacccugcguggggacag

SEQ ID NO: 2273520 - RNA, 18 nt, Human
cugagaacccugcguggg

SEQ ID NO: 2273521 - RNA, 22 nt, Human
cugagaacccugcguggggaca

SEQ ID NO: 2273522 - RNA, 16 nt, Human
cugacuuugcucuuuc

SEQ ID NO: 2273523 - RNA, 22 nt, Human
cugacuuucauuucuugaggua

SEQ ID NO: 2273524 - RNA, 15 nt, Human
cugacuuugcucuuu

SEQ ID NO: 2273525 - RNA, 11 nt, Human
cugagaacacu

SEQ ID NO: 2273526 - RNA, 15 nt, Human
cugagaacacuguga

SEQ ID NO: 2273527 - RNA, 11 nt, Human
cugagaaauuu

SEQ ID NO: 2273528 - RNA, 14 nt, Human
cugagaaauuuaua

SEQ ID NO: 2273529 - RNA, 21 nt, Human
cugacucugcccccugcuggc

SEQ ID NO: 2273530 - RNA, 19 nt, Human
cugacucugcccccugcug

SEQ ID NO: 2273531 - RNA, 20 nt, Human
cugacucugcccccugcugg

SEQ ID NO: 2273532 - RNA, 20 nt, Human
cugacucugaaaucugaaga

SEQ ID NO: 2273533 - RNA, 12 nt, Human
cugacucugccc

SEQ ID NO: 2273534 - RNA, 14 nt, Human
cugacucugccccc

SEQ ID NO: 2273535 - RNA, 15 nt, Human
cugacucugcccccu

SEQ ID NO: 2273536 - RNA, 16 nt, Human
cugacuguuuucucuu

SEQ ID NO: 2273537 - RNA, 18 nt, Human
cugacucucugugaccug

SEQ ID NO: 2273538 - RNA, 16 nt, Human
cugacucucugugacc

SEQ ID NO: 2273539 - RNA, 14 nt, Human
cugacucucaaauc

SEQ ID NO: 2273540 - RNA, 14 nt, Human
cugacucugaaauc

SEQ ID NO: 2273541 - RNA, 15 nt, Human
cugacucugaaaucu

SEQ ID NO: 2273542 - RNA, 17 nt, Human
cugacucugaaaucuga

SEQ ID NO: 2273543 - RNA, 17 nt, Human
cugacucuuaagaagac

SEQ ID NO: 2273544 - RNA, 17 nt, Human
cugacucacaagaagac

SEQ ID NO: 2273545 - RNA, 21 nt, Human
cugacucacaagaagaccaga

SEQ ID NO: 2273546 - RNA, 14 nt, Human
cugacucagggcuc

SEQ ID NO: 2273547 - RNA, 12 nt, Human
cugacucagggc

SEQ ID NO: 2273548 - RNA, 14 nt, Human
cugacucucuguga

SEQ ID NO: 2273549 - RNA, 13 nt, Human
cugacucucugug

SEQ ID NO: 2273550 - RNA, 21 nt, Human
cugacucuaggugcccuugga

SEQ ID NO: 2273551 - RNA, 21 nt, Human
cugacucgucugacugugugu

SEQ ID NO: 2273552 - RNA, 18 nt, Human
cugacucaacauguuacu

SEQ ID NO: 2273553 - RNA, 13 nt, Human
cugacucacaaga

SEQ ID NO: 2273554 - RNA, 14 nt, Human
cugacucacaagaa

SEQ ID NO: 2273555 - RNA, 15 nt, Human
cugacucacaagaag

SEQ ID NO: 2273556 - RNA, 16 nt, Human
cugacucacaagaaga

SEQ ID NO: 2273557 - RNA, 22 nt, Human
cugacuucaggggcugcccgcu

SEQ ID NO: 2273558 - RNA, 11 nt, Human
cugacuucugc

SEQ ID NO: 2273559 - RNA, 23 nt, Human
cugacuucaucucccaccuagca

SEQ ID NO: 2273560 - RNA, 17 nt, Human
cugacuucaucucccac

SEQ ID NO: 2273561 - RNA, 16 nt, Human
cugacuucuaaguaaa

SEQ ID NO: 2273562 - RNA, 12 nt, Human
cugacuucugcc

SEQ ID NO: 2273563 - RNA, 13 nt, Human
cugacuucugccu

SEQ ID NO: 2273564 - RNA, 14 nt, Human
cugacuucugccug

SEQ ID NO: 2273565 - RNA, 15 nt, Human
cugacuucugccugg

SEQ ID NO: 2273566 - RNA, 16 nt, Human
cugacuucugccugga

SEQ ID NO: 2273567 - RNA, 18 nt, Human
cugacuucugccuggaga

SEQ ID NO: 2273568 - RNA, 19 nt, Human
cugacuucugccuggagac

SEQ ID NO: 2273569 - RNA, 18 nt, Human
cugacuguuuucucuuga

SEQ ID NO: 2273570 - RNA, 14 nt, Human
cugacuucaggggc

SEQ ID NO: 2273571 - RNA, 19 nt, Human
cugacuucaggggcugccc

SEQ ID NO: 2273572 - RNA, 20 nt, Human
cugacuucaggggcugcccg

SEQ ID NO: 2273573 - RNA, 21 nt, Human
cugacuucaggggcugcccgc

SEQ ID NO: 2273574 - RNA, 15 nt, Human
cugacuucuaaguaa

SEQ ID NO: 2273575 - RNA, 13 nt, Human
cugacuucuaagu

SEQ ID NO: 2273576 - RNA, 17 nt, Human
cugacaguccucuccac

SEQ ID NO: 2273577 - RNA, 19 nt, Human
cugacaguccucuccaccu

SEQ ID NO: 2273578 - RNA, 21 nt, Human
cugacaguccucuccaccuag

SEQ ID NO: 2273579 - RNA, 15 nt, Human
cugacagucuugugc

SEQ ID NO: 2273580 - RNA, 21 nt, Human
cugacaggcaaugcuggcugu

SEQ ID NO: 2273581 - RNA, 17 nt, Human
cugacagcugcuccuag

SEQ ID NO: 2273582 - RNA, 15 nt, Human
cugacaggcagccug

SEQ ID NO: 2273583 - RNA, 16 nt, Human
cugacagcugcuccua

SEQ ID NO: 2273584 - RNA, 15 nt, Human
cugacagcugcuccu

SEQ ID NO: 2273585 - RNA, 20 nt, Human
cugacaggcagccuggacau

SEQ ID NO: 2273586 - RNA, 23 nt, Human
cugacaggcagccuggacauaga

SEQ ID NO: 2273587 - RNA, 21 nt, Human
cugacaucuuaguauuugcau

SEQ ID NO: 2273588 - RNA, 15 nt, Human
cugacaugauuccuu

SEQ ID NO: 2273589 - RNA, 14 nt, Human
cugacauccccacu

SEQ ID NO: 2273590 - RNA, 16 nt, Human
cugacaucuguguuuc

SEQ ID NO: 2273591 - RNA, 17 nt, Human
cugacaucuguguuuca

SEQ ID NO: 2273592 - RNA, 21 nt, Human
cugacaucuguguuucaagug

SEQ ID NO: 2273593 - RNA, 16 nt, Human
cugacaucuggaaucu

SEQ ID NO: 2273594 - RNA, 16 nt, Human
cugacaucucugcaau

SEQ ID NO: 2273595 - RNA, 15 nt, Human
cugacaucucugcaa

SEQ ID NO: 2273596 - RNA, 14 nt, Human
cugacaucucugca

SEQ ID NO: 2273597 - RNA, 14 nt, Human
cugacauuaacagu

SEQ ID NO: 2273598 - RNA, 16 nt, Human
cugacaugauuccuuc

SEQ ID NO: 2273599 - RNA, 21 nt, Human
cugacauguggggccagguca

SEQ ID NO: 2273600 - RNA, 21 nt, Human
cugacauuguuggccaaagcc

SEQ ID NO: 2273601 - RNA, 20 nt, Human
cugacaugauuccuuccugu

SEQ ID NO: 2273602 - RNA, 14 nt, Human
cugacauguggggc

SEQ ID NO: 2273603 - RNA, 19 nt, Human
cugacauguggggccaggu

SEQ ID NO: 2273604 - RNA, 14 nt, Human
cugaagaguccucu

SEQ ID NO: 2273605 - RNA, 22 nt, Human
cugaagaggcgggccagccagg

SEQ ID NO: 2273606 - RNA, 23 nt, Human
cugaagaggcgggccagccaggc

SEQ ID NO: 2273607 - RNA, 16 nt, Human
cugaagaguccucuga

SEQ ID NO: 2273608 - RNA, 15 nt, Human
cugaagaguccucug

SEQ ID NO: 2273609 - RNA, 18 nt, Human
cugaagaguccucugaau

SEQ ID NO: 2273610 - RNA, 20 nt, Human
cugaagaguggguuucacaa

SEQ ID NO: 2273611 - RNA, 23 nt, Human
cugaagauauaacuauugcccag

SEQ ID NO: 2273612 - RNA, 16 nt, Human
cugaagaugaucauuu

SEQ ID NO: 2273613 - RNA, 17 nt, Human
cugaagaugaucauuug

SEQ ID NO: 2273614 - RNA, 22 nt, Human
cugaagaugcagcaaaauguga

SEQ ID NO: 2273615 - RNA, 15 nt, Human
cugaagaugcagcuc

SEQ ID NO: 2273616 - RNA, 20 nt, Human
cugaagauggcauccuguga

SEQ ID NO: 2273617 - RNA, 16 nt, Human
cugaagaugcagcuca

SEQ ID NO: 2273618 - RNA, 22 nt, Human
cugaagaugcagcucacuaccc

SEQ ID NO: 2273619 - RNA, 23 nt, Human
cugaagauggcauccugugaagu

SEQ ID NO: 2273620 - RNA, 20 nt, Human
cugacagccucccaccccca

SEQ ID NO: 2273621 - RNA, 17 nt, Human
cugacagccucccaccc

SEQ ID NO: 2273622 - RNA, 12 nt, Human
cugacagcugcu

SEQ ID NO: 2273623 - RNA, 14 nt, Human
cugacagcugcucc

SEQ ID NO: 2273624 - RNA, 13 nt, Human
cugacagcugcuc

SEQ ID NO: 2273625 - RNA, 14 nt, Human
cugacagccuccca

SEQ ID NO: 2273626 - RNA, 13 nt, Human
cugacagccuccc

SEQ ID NO: 2273627 - RNA, 12 nt, Human
cugacagccucc

SEQ ID NO: 2273628 - RNA, 18 nt, Human
cugacagaugucagccga

SEQ ID NO: 2273629 - RNA, 15 nt, Human
cugaccaauauugua

SEQ ID NO: 2273630 - RNA, 18 nt, Human
cugaccaauauuguacag

SEQ ID NO: 2273631 - RNA, 17 nt, Human
cugaccaagagagaaag

SEQ ID NO: 2273632 - RNA, 14 nt, Human
cugaccaagagaga

SEQ ID NO: 2273633 - RNA, 16 nt, Human
cugaccaacauggaga

SEQ ID NO: 2273634 - RNA, 19 nt, Human
cugaccaacaguuccuuca

SEQ ID NO: 2273635 - RNA, 20 nt, Human
cugacauuaacaguuuucca

SEQ ID NO: 2273636 - RNA, 18 nt, Human
cugacauuaacaguuuuc

SEQ ID NO: 2273637 - RNA, 15 nt, Human
cugacauuaacaguu

SEQ ID NO: 2273638 - RNA, 21 nt, Human
cugacauuuggaguguucccc

SEQ ID NO: 2273639 - RNA, 18 nt, Human
cugacauuuggaguguuc

SEQ ID NO: 2273640 - RNA, 22 nt, Human
cugacauuguuggccaaagcca

SEQ ID NO: 2273641 - RNA, 19 nt, Human
cugaccaauauuguacagu

SEQ ID NO: 2273642 - RNA, 20 nt, Human
cugaccaauauuguacaguu

SEQ ID NO: 2273643 - RNA, 21 nt, Human
cugaccaauauuguacaguuu

SEQ ID NO: 2273644 - RNA, 20 nt, Human
cugaccacacuuccugucca

SEQ ID NO: 2273645 - RNA, 19 nt, Human
cugaccacacuuccugucc

SEQ ID NO: 2273646 - RNA, 18 nt, Human
cugaccacacuuccuguc

SEQ ID NO: 2273647 - RNA, 17 nt, Human
cugaccacacuuccugu

SEQ ID NO: 2273648 - RNA, 16 nt, Human
cugaccacacuuccug

SEQ ID NO: 2273649 - RNA, 13 nt, Human
cugaccacacuuc

SEQ ID NO: 2273650 - RNA, 12 nt, Human
cugaccacacuu

SEQ ID NO: 2273651 - RNA, 12 nt, Human
cugacccacugc

SEQ ID NO: 2273652 - RNA, 22 nt, Human
cugacuagaagggccaguccug

SEQ ID NO: 2273653 - RNA, 17 nt, Human
cugacccaggccgcagc

SEQ ID NO: 2273654 - RNA, 23 nt, Human
cugacuagaagggccaguccugc

SEQ ID NO: 2273655 - RNA, 18 nt, Human
cugacuagugaggaaaga

SEQ ID NO: 2273656 - RNA, 16 nt, Human
cugacccaugcugccc

SEQ ID NO: 2273657 - RNA, 14 nt, Human
cugacccaugcugc

SEQ ID NO: 2273658 - RNA, 15 nt, Human
cugacccaugcugcc

SEQ ID NO: 2273659 - RNA, 21 nt, Human
cugacccagccccuugagaaa

SEQ ID NO: 2273660 - RNA, 15 nt, Human
cugacccagccuguu

SEQ ID NO: 2273661 - RNA, 12 nt, Human
cugacccaggcc

SEQ ID NO: 2273662 - RNA, 13 nt, Human
cugacccaggccg

SEQ ID NO: 2273663 - RNA, 14 nt, Human
cugacccaggccgc

SEQ ID NO: 2273664 - RNA, 15 nt, Human
cugacccaggccgca

SEQ ID NO: 2273665 - RNA, 16 nt, Human
cugacccaggccgcag

SEQ ID NO: 2273666 - RNA, 13 nt, Human
cugacccaugcug

SEQ ID NO: 2273667 - RNA, 13 nt, Human
cugacccacugcu

SEQ ID NO: 2273668 - RNA, 14 nt, Human
cugacccacugcuu

SEQ ID NO: 2273669 - RNA, 22 nt, Human
cucucuacuccuaccucagccu

SEQ ID NO: 2273670 - RNA, 16 nt, Human
cucuccuuucuuuuuc

SEQ ID NO: 2273671 - RNA, 21 nt, Human
cucuccuuucuuuuucuucuu

SEQ ID NO: 2273672 - RNA, 20 nt, Human
cucucuacuccuaccucagc

SEQ ID NO: 2273673 - RNA, 19 nt, Human
cucucuacuccuaccucag

SEQ ID NO: 2273674 - RNA, 16 nt, Human
cucucuauagcaccag

SEQ ID NO: 2273675 - RNA, 12 nt, Human
cucucucacucc

SEQ ID NO: 2273676 - RNA, 12 nt, Human
cucucucccagu

SEQ ID NO: 2273677 - RNA, 17 nt, Human
cucucuccagauguuuc

SEQ ID NO: 2273678 - RNA, 14 nt, Human
cucucuccagaugu

SEQ ID NO: 2273679 - RNA, 12 nt, Human
cucucuccagga

SEQ ID NO: 2273680 - RNA, 13 nt, Human
cucucucccaguc

SEQ ID NO: 2273681 - RNA, 19 nt, Human
cucucucccagucuaccca

SEQ ID NO: 2273682 - RNA, 23 nt, Human
cucucucccagucuacccagaga

SEQ ID NO: 2273683 - RNA, 14 nt, Human
cucucucccaugga

SEQ ID NO: 2273684 - RNA, 20 nt, Human
cucucucccauggagcccca

SEQ ID NO: 2273685 - RNA, 14 nt, Human
cucucuccccucaa

SEQ ID NO: 2273686 - RNA, 14 nt, Human
cucucuccacccua

SEQ ID NO: 2273687 - RNA, 21 nt, Human
cucucucaauuuuugguugaa

SEQ ID NO: 2273688 - RNA, 12 nt, Human
cucucuccagau

SEQ ID NO: 2273689 - RNA, 13 nt, Human
cucucucaggcca

SEQ ID NO: 2273690 - RNA, 13 nt, Human
cucuccugccuac

SEQ ID NO: 2273691 - RNA, 12 nt, Human
cucuccuggagg

SEQ ID NO: 2273692 - RNA, 13 nt, Human
cucuccuggagga

SEQ ID NO: 2273693 - RNA, 21 nt, Human
cucuccuguccaaccuaaccc

SEQ ID NO: 2273694 - RNA, 16 nt, Human
cucuccuuucuuucua

SEQ ID NO: 2273695 - RNA, 14 nt, Human
cucuccuuucuuuu

SEQ ID NO: 2273696 - RNA, 14 nt, Human
cucuccuuccugug

SEQ ID NO: 2273697 - RNA, 16 nt, Human
cucuccuuccuggagc

SEQ ID NO: 2273698 - RNA, 14 nt, Human
cucuccucuugcca

SEQ ID NO: 2273699 - RNA, 15 nt, Human
cucuccucuugccac

SEQ ID NO: 2273700 - RNA, 16 nt, Human
cucuccucuugccacu

SEQ ID NO: 2273701 - RNA, 17 nt, Human
cucuccucuugccacug

SEQ ID NO: 2273702 - RNA, 12 nt, Human
cucuccugccua

SEQ ID NO: 2273703 - RNA, 16 nt, Human
cucuccagcuccaaga

SEQ ID NO: 2273704 - RNA, 21 nt, Human
cucuccugauagucuuucagu

SEQ ID NO: 2273705 - RNA, 19 nt, Human
cucuccucuugccacugcc

SEQ ID NO: 2273706 - RNA, 22 nt, Human
cucuccucuugccacugccucu

SEQ ID NO: 2273707 - RNA, 13 nt, Human
cucuccucugcug

SEQ ID NO: 2273708 - RNA, 14 nt, Human
cucuccucugcugc

SEQ ID NO: 2273709 - RNA, 15 nt, Human
cucuccucugcugcu

SEQ ID NO: 2273710 - RNA, 18 nt, Human
cucuccucugcugcuggc

SEQ ID NO: 2273711 - RNA, 14 nt, Human
cucuccccagcaag

SEQ ID NO: 2273712 - RNA, 22 nt, Human
cucuccccagcaagugagagcu

SEQ ID NO: 2273713 - RNA, 24 nt, Human
cucuccccagcaagugagagcugg

SEQ ID NO: 2273714 - RNA, 12 nt, Human
cucuccucugcu

SEQ ID NO: 2273715 - RNA, 15 nt, Human
cucuccacugccuuc

SEQ ID NO: 2273716 - RNA, 14 nt, Human
cucuccagccugac

SEQ ID NO: 2273717 - RNA, 19 nt, Human
cucuccagccccuggaugc

SEQ ID NO: 2273718 - RNA, 14 nt, Human
cucuccagcuccaa

SEQ ID NO: 2273719 - RNA, 15 nt, Human
cucuccagcuccaag

SEQ ID NO: 2273720 - RNA, 23 nt, Human
cucuccaagggcuucugcacccu

SEQ ID NO: 2273721 - RNA, 13 nt, Human
cucuccagcuaua

SEQ ID NO: 2273722 - RNA, 13 nt, Human
cucuccagcucca

SEQ ID NO: 2273723 - RNA, 12 nt, Human
cucuccacugcc

SEQ ID NO: 2273724 - RNA, 14 nt, Human
cucuccacugccuu

SEQ ID NO: 2273725 - RNA, 14 nt, Human
cucuccagccccug

SEQ ID NO: 2273726 - RNA, 11 nt, Human
cucuccacugc

SEQ ID NO: 2273727 - RNA, 21 nt, Human
cucuccaagggcuucugcacc

SEQ ID NO: 2273728 - RNA, 22 nt, Human
cucuccaagggcuucugcaccc

SEQ ID NO: 2273729 - RNA, 17 nt, Human
cucuccaagucucagug

SEQ ID NO: 2273730 - RNA, 15 nt, Human
cucuccagccccugg

SEQ ID NO: 2273731 - RNA, 16 nt, Human
cucuccagccccugga

SEQ ID NO: 2273732 - RNA, 17 nt, Human
cucuccagccccuggau

SEQ ID NO: 2273733 - RNA, 18 nt, Human
cucuccagccccuggaug

SEQ ID NO: 2273734 - RNA, 16 nt, Human
cucuccaaccuggaca

SEQ ID NO: 2273735 - RNA, 12 nt, Human
cucuccaagggc

SEQ ID NO: 2273736 - RNA, 14 nt, Human
cucuccaaccugga

SEQ ID NO: 2273737 - RNA, 15 nt, Human
cucuccaaaaaugca

SEQ ID NO: 2273738 - RNA, 13 nt, Human
cucuccaagggcu

SEQ ID NO: 2273739 - RNA, 14 nt, Human
cucuccaagggcuu

SEQ ID NO: 2273740 - RNA, 15 nt, Human
cucuccaagggcuuc

SEQ ID NO: 2273741 - RNA, 17 nt, Human
cucuccaagggcuucug

SEQ ID NO: 2273742 - RNA, 13 nt, Human
cucuccaaccugg

SEQ ID NO: 2273743 - RNA, 20 nt, Human
cucucauuccccagguggcu

SEQ ID NO: 2273744 - RNA, 16 nt, Human
cucucauuccccaggu

SEQ ID NO: 2273745 - RNA, 21 nt, Human
cucucauuccccagguggcug

SEQ ID NO: 2273746 - RNA, 15 nt, Human
cucucauuccccagg

SEQ ID NO: 2273747 - RNA, 14 nt, Human
cucucauuccccag

SEQ ID NO: 2273748 - RNA, 11 nt, Human
cucucauuccc

SEQ ID NO: 2273749 - RNA, 20 nt, Human
cucucauguuuucaacugcc

SEQ ID NO: 2273750 - RNA, 14 nt, Human
cucucaugaaccuc

SEQ ID NO: 2273751 - RNA, 17 nt, Human
cucucaggccagcugcu

SEQ ID NO: 2273752 - RNA, 18 nt, Human
cucucaggccagcugcuu

SEQ ID NO: 2273753 - RNA, 19 nt, Human
cucucaggccagcugcuug

SEQ ID NO: 2273754 - RNA, 21 nt, Human
cucucaggccagcugcuuggg

SEQ ID NO: 2273755 - RNA, 12 nt, Human
cucucaggccaa

SEQ ID NO: 2273756 - RNA, 20 nt, Human
cucucaggccaaacucaccu

SEQ ID NO: 2273757 - RNA, 21 nt, Human
cucucaggccaaacucaccug

SEQ ID NO: 2273758 - RNA, 22 nt, Human
cucucaggccaaacucaccugc

SEQ ID NO: 2273759 - RNA, 23 nt, Human
cucucaggccaaacucaccugcc

SEQ ID NO: 2273760 - RNA, 13 nt, Human
cucucaggccagc

SEQ ID NO: 2273761 - RNA, 15 nt, Human
cucucaggccagcug

SEQ ID NO: 2273762 - RNA, 21 nt, Human
cucuagugcccuccacagccg

SEQ ID NO: 2273763 - RNA, 16 nt, Human
cucuagugccuucuaa

SEQ ID NO: 2273764 - RNA, 14 nt, Human
cucuagugccuucu

SEQ ID NO: 2273765 - RNA, 13 nt, Human
cucuagugcugug

SEQ ID NO: 2273766 - RNA, 12 nt, Human
cucuagugcugu

SEQ ID NO: 2273767 - RNA, 17 nt, Human
cucuagugcugugaaaa

SEQ ID NO: 2273768 - RNA, 16 nt, Human
cucuagugcugugaaa

SEQ ID NO: 2273769 - RNA, 15 nt, Human
cucuagugcugugaa

SEQ ID NO: 2273770 - RNA, 14 nt, Human
cucuagugcuguga

SEQ ID NO: 2273771 - RNA, 20 nt, Human
cucuagugcugugaaaaaaa

SEQ ID NO: 2273772 - RNA, 19 nt, Human
cucuagugcugugaaaaaa

SEQ ID NO: 2273773 - RNA, 18 nt, Human
cucuagugcugugaaaaa

SEQ ID NO: 2273774 - RNA, 15 nt, Human
cucuaguuugauuaa

SEQ ID NO: 2273775 - RNA, 21 nt, Human
cucuaguuugauuaaauucuu

SEQ ID NO: 2273776 - RNA, 18 nt, Human
cucuaguucuuuguucau

SEQ ID NO: 2273777 - RNA, 13 nt, Human
cucuaguucuuug

SEQ ID NO: 2273778 - RNA, 15 nt, Human
cucuaguucuuuguu

SEQ ID NO: 2273779 - RNA, 20 nt, Human
cucuaguuugauuaaauucu

SEQ ID NO: 2273780 - RNA, 19 nt, Human
cucuaguuugauuaaauuc

SEQ ID NO: 2273781 - RNA, 19 nt, Human
cucuacuccuaccucagcc

SEQ ID NO: 2273782 - RNA, 16 nt, Human
cucuacuccuaccuca

SEQ ID NO: 2273783 - RNA, 21 nt, Human
cucuacuaacaaucagcuccu

SEQ ID NO: 2273784 - RNA, 19 nt, Human
cucuacuaaaaauacagaa

SEQ ID NO: 2273785 - RNA, 16 nt, Human
cucuacuaaaaaugca

SEQ ID NO: 2273786 - RNA, 22 nt, Human
cucuacuaaaaauacaaaaauu

SEQ ID NO: 2273787 - RNA, 15 nt, Human
cucuacuaaaaagaa

SEQ ID NO: 2273788 - RNA, 19 nt, Human
cucuacuaaaaagaaggaa

SEQ ID NO: 2273789 - RNA, 20 nt, Human
cucuacguggcaaauuaacu

SEQ ID NO: 2273790 - RNA, 16 nt, Human
cucuacuuagcauguc

SEQ ID NO: 2273791 - RNA, 17 nt, Human
cucuacuuaauccaaug

SEQ ID NO: 2273792 - RNA, 18 nt, Human
cucuacuuaauccaaugg

SEQ ID NO: 2273793 - RNA, 21 nt, Human
cucuacugggagccuacccac

SEQ ID NO: 2273794 - RNA, 18 nt, Human
cucuacugggagccuacc

SEQ ID NO: 2273795 - RNA, 17 nt, Human
cucuacuuagcaugucc

SEQ ID NO: 2273796 - RNA, 19 nt, Human
cucuacuuagcaugucccu

SEQ ID NO: 2273797 - RNA, 15 nt, Human
cucuacuuaaugaga

SEQ ID NO: 2273798 - RNA, 20 nt, Human
cucuacuuagcaugucccua

SEQ ID NO: 2273799 - RNA, 22 nt, Human
cucuaccauuugcagaguccug

SEQ ID NO: 2273800 - RNA, 20 nt, Human
cucuaccauuugcagagucc

SEQ ID NO: 2273801 - RNA, 18 nt, Human
cucuacccagggccugca

SEQ ID NO: 2273802 - RNA, 17 nt, Human
cucuacccagggccugc

SEQ ID NO: 2273803 - RNA, 14 nt, Human
cucuacccagggcc

SEQ ID NO: 2273804 - RNA, 13 nt, Human
cucuacccagggc

SEQ ID NO: 2273805 - RNA, 20 nt, Human
cucuaccauccccuguagag

SEQ ID NO: 2273806 - RNA, 18 nt, Human
cucuaccagacuguguau

SEQ ID NO: 2273807 - RNA, 20 nt, Human
cucuaccaagcuauccuggc

SEQ ID NO: 2273808 - RNA, 17 nt, Human
cucuacaucuucugccu

SEQ ID NO: 2273809 - RNA, 18 nt, Human
cucuacaucuucugccuu

SEQ ID NO: 2273810 - RNA, 18 nt, Human
cucuacccucccaccccc

SEQ ID NO: 2273811 - RNA, 17 nt, Human
cucuacccucccacccc

SEQ ID NO: 2273812 - RNA, 16 nt, Human
cucuacccucccaccc

SEQ ID NO: 2273813 - RNA, 15 nt, Human
cucuacccucccacc

SEQ ID NO: 2273814 - RNA, 14 nt, Human
cucuacccucccac

SEQ ID NO: 2273815 - RNA, 16 nt, Human
cucuacccauauuaca

SEQ ID NO: 2273816 - RNA, 19 nt, Human
cucuacccauauuacagau

SEQ ID NO: 2273817 - RNA, 20 nt, Human
cucuaccucauaucaguuug

SEQ ID NO: 2273818 - RNA, 22 nt, Human
cucuacccucccacccccuucu

SEQ ID NO: 2273819 - RNA, 22 nt, Human
cucuaccugacacucccuuggg

SEQ ID NO: 2273820 - RNA, 12 nt, Human
cucuaccugaca

SEQ ID NO: 2273821 - RNA, 13 nt, Human
cucuacccuggca

SEQ ID NO: 2273822 - RNA, 13 nt, Human
cucuagccugggc

SEQ ID NO: 2273823 - RNA, 19 nt, Human
cucuagccaaaugguuuaa

SEQ ID NO: 2273824 - RNA, 19 nt, Human
cucuagauuuuguuuugcu

SEQ ID NO: 2273825 - RNA, 20 nt, Human
cucuagauuuuguuuugcuu

SEQ ID NO: 2273826 - RNA, 17 nt, Human
cucuagauuuuguuuug

SEQ ID NO: 2273827 - RNA, 14 nt, Human
cucuagccugggca

SEQ ID NO: 2273828 - RNA, 23 nt, Human
cucuagcugggggugggccaggc

SEQ ID NO: 2273829 - RNA, 20 nt, Human
cucuagcugggggugggcca

SEQ ID NO: 2273830 - RNA, 15 nt, Human
cucuaggaaauauuu

SEQ ID NO: 2273831 - RNA, 12 nt, Human
cucuagaaauuu

SEQ ID NO: 2273832 - RNA, 15 nt, Human
cucuagaagccaagg

SEQ ID NO: 2273833 - RNA, 13 nt, Human
cucuacuuugagg

SEQ ID NO: 2273834 - RNA, 22 nt, Human
cucuagaagccaagggaaaggg

SEQ ID NO: 2273835 - RNA, 18 nt, Human
cucuagaagccaagggaa

SEQ ID NO: 2273836 - RNA, 19 nt, Human
cucuagaagccaagggaaa

SEQ ID NO: 2273837 - RNA, 23 nt, Human
cucuagacaacccugcaaaggac

SEQ ID NO: 2273838 - RNA, 18 nt, Human
cucuagacaacccugcaa

SEQ ID NO: 2273839 - RNA, 17 nt, Human
cucuagacaacccugca

SEQ ID NO: 2273840 - RNA, 23 nt, Human
cucuagaauuuuaagugcuuugu

SEQ ID NO: 2273841 - RNA, 20 nt, Human
cucuagaauuuuaagugcuu

SEQ ID NO: 2273842 - RNA, 21 nt, Human
cucuagacacugccacacagg

SEQ ID NO: 2273843 - RNA, 16 nt, Human
cucuagacacugccac

SEQ ID NO: 2273844 - RNA, 13 nt, Human
cucuagagcaggg

SEQ ID NO: 2273845 - RNA, 16 nt, Human
cucuagagcagggauu

SEQ ID NO: 2273846 - RNA, 23 nt, Human
cucuagggaaaaaccagcgugug

SEQ ID NO: 2273847 - RNA, 14 nt, Human
cucuagggaccccu

SEQ ID NO: 2273848 - RNA, 12 nt, Human
cucuaggcuggg

SEQ ID NO: 2273849 - RNA, 13 nt, Human
cucuaggcugggg

SEQ ID NO: 2273850 - RNA, 14 nt, Human
cucuaggcugggga

SEQ ID NO: 2273851 - RNA, 15 nt, Human
cucuaggcuggggaa

SEQ ID NO: 2273852 - RNA, 17 nt, Human
cucuaggaaauauuuau

SEQ ID NO: 2273853 - RNA, 16 nt, Human
cucuagcugugggggu

SEQ ID NO: 2273854 - RNA, 13 nt, Human
cucuagcuggugg

SEQ ID NO: 2273855 - RNA, 17 nt, Human
cucuagcuggugguuuc

SEQ ID NO: 2273856 - RNA, 18 nt, Human
cucuagcuggugguuuca

SEQ ID NO: 2273857 - RNA, 18 nt, Human
cucuagugcccuccacag

SEQ ID NO: 2273858 - RNA, 14 nt, Human
cucuagugcccucc

SEQ ID NO: 2273859 - RNA, 13 nt, Human
cucuagugcccuc

SEQ ID NO: 2273860 - RNA, 15 nt, Human
cucuagguggggcgg

SEQ ID NO: 2273861 - RNA, 15 nt, Human
cucuaguauuccaga

SEQ ID NO: 2273862 - RNA, 22 nt, Human
cucuaggugcccuuggaggcca

SEQ ID NO: 2273863 - RNA, 13 nt, Human
cucuagguggggc

SEQ ID NO: 2273864 - RNA, 14 nt, Human
cucuagguggggcg

SEQ ID NO: 2273865 - RNA, 16 nt, Human
cucuagggaccccucc

SEQ ID NO: 2273866 - RNA, 18 nt, Human
cucuagggaccccuccuc

SEQ ID NO: 2273867 - RNA, 19 nt, Human
cucuagggaccccuccucc

SEQ ID NO: 2273868 - RNA, 20 nt, Human
cucuagggaccccuccuccc

SEQ ID NO: 2273869 - RNA, 22 nt, Human
cucuagggagggacauggcccc

SEQ ID NO: 2273870 - RNA, 14 nt, Human
cucuagggcagugg

SEQ ID NO: 2273871 - RNA, 17 nt, Human
cucuaggggucaggcuc

SEQ ID NO: 2273872 - RNA, 20 nt, Human
cucuaggggucaggcuccau

SEQ ID NO: 2273873 - RNA, 13 nt, Human
cucuacaaaaagc

SEQ ID NO: 2273874 - RNA, 20 nt, Human
cucggaucaccgagaguagc

SEQ ID NO: 2273875 - RNA, 13 nt, Human
cucggcuccugcu

SEQ ID NO: 2273876 - RNA, 14 nt, Human
cucggcuccugcug

SEQ ID NO: 2273877 - RNA, 15 nt, Human
cucggcuccugcugc

SEQ ID NO: 2273878 - RNA, 17 nt, Human
cucggcuuuucucagcu

SEQ ID NO: 2273879 - RNA, 16 nt, Human
cucggcuccugcugca

SEQ ID NO: 2273880 - RNA, 17 nt, Human
cucggcuccugcugcac

SEQ ID NO: 2273881 - RNA, 18 nt, Human
cucggcuuuucucagcug

SEQ ID NO: 2273882 - RNA, 19 nt, Human
cucggcuccugcugcacca

SEQ ID NO: 2273883 - RNA, 15 nt, Human
cucuaaccccaggcc

SEQ ID NO: 2273884 - RNA, 16 nt, Human
cucuaaccccaggccc

SEQ ID NO: 2273885 - RNA, 17 nt, Human
cucuaaccccaggcccc

SEQ ID NO: 2273886 - RNA, 18 nt, Human
cucuaaccccaggccccg

SEQ ID NO: 2273887 - RNA, 15 nt, Human
cucuaacccuaggca

SEQ ID NO: 2273888 - RNA, 19 nt, Human
cucuaaccccaggccccga

SEQ ID NO: 2273889 - RNA, 21 nt, Human
cucuaaccccaggccccgagg

SEQ ID NO: 2273890 - RNA, 13 nt, Human
cucuacagaggcc

SEQ ID NO: 2273891 - RNA, 22 nt, Human
cucuacagagcuucccugacuc

SEQ ID NO: 2273892 - RNA, 20 nt, Human
cucuacagagcuucccugac

SEQ ID NO: 2273893 - RNA, 18 nt, Human
cucuacagagcuucccug

SEQ ID NO: 2273894 - RNA, 17 nt, Human
cucuacagagcuucccu

SEQ ID NO: 2273895 - RNA, 17 nt, Human
cucuaauuggaagaaau

SEQ ID NO: 2273896 - RNA, 20 nt, Human
cucuaauucccauuuugcaa

SEQ ID NO: 2273897 - RNA, 16 nt, Human
cucuacaaacucccac

SEQ ID NO: 2273898 - RNA, 22 nt, Human
cucuaauuggaagaaauuccug

SEQ ID NO: 2273899 - RNA, 16 nt, Human
cucuaauuuauuuugu

SEQ ID NO: 2273900 - RNA, 14 nt, Human
cucuacacugugaa

SEQ ID NO: 2273901 - RNA, 17 nt, Human
cucuacaacugaguccu

SEQ ID NO: 2273902 - RNA, 23 nt, Human
cucuacaacugaguccuuaaaca

SEQ ID NO: 2273903 - RNA, 16 nt, Human
cucuacaacugagucc

SEQ ID NO: 2273904 - RNA, 17 nt, Human
cucuacaaacucccacu

SEQ ID NO: 2273905 - RNA, 19 nt, Human
cucuacagaggccaugggc

SEQ ID NO: 2273906 - RNA, 21 nt, Human
cucuacagcuaaucagcauuc

SEQ ID NO: 2273907 - RNA, 23 nt, Human
cucuacagagcuucccugacuca

SEQ ID NO: 2273908 - RNA, 15 nt, Human
cucuacaucuucugc

SEQ ID NO: 2273909 - RNA, 14 nt, Human
cucuacagaggcca

SEQ ID NO: 2273910 - RNA, 16 nt, Human
cucuacagaggccaug

SEQ ID NO: 2273911 - RNA, 23 nt, Human
cucggagccucauccgaggcagg

SEQ ID NO: 2273912 - RNA, 22 nt, Human
cucggagccucauccgaggcag

SEQ ID NO: 2273913 - RNA, 16 nt, Human
cucggagccucauccg

SEQ ID NO: 2273914 - RNA, 13 nt, Human
cucggagccucau

SEQ ID NO: 2273915 - RNA, 17 nt, Human
cucggaggaagccccca

SEQ ID NO: 2273916 - RNA, 13 nt, Human
cucggaggaagcc

SEQ ID NO: 2273917 - RNA, 12 nt, Human
cucggaggcccc

SEQ ID NO: 2273918 - RNA, 13 nt, Human
cucggaggcccca

SEQ ID NO: 2273919 - RNA, 15 nt, Human
cucggaggccccaaa

SEQ ID NO: 2273920 - RNA, 14 nt, Human
cucgcuucccccau

SEQ ID NO: 2273921 - RNA, 16 nt, Human
cucgcuguugcugaau

SEQ ID NO: 2273922 - RNA, 13 nt, Human
cucgcuguugcug

SEQ ID NO: 2273923 - RNA, 15 nt, Human
cucgcuguugcugaa

SEQ ID NO: 2273924 - RNA, 18 nt, Human
cucgcuucccccauagcc

SEQ ID NO: 2273925 - RNA, 16 nt, Human
cucgcuucccccauag

SEQ ID NO: 2273926 - RNA, 19 nt, Human
cucgcuucccccauagcca

SEQ ID NO: 2273927 - RNA, 17 nt, Human
cucggaguaucugggaa

SEQ ID NO: 2273928 - RNA, 16 nt, Human
cucggaggcugccccc

SEQ ID NO: 2273929 - RNA, 17 nt, Human
cucggagggauuccccu

SEQ ID NO: 2273930 - RNA, 18 nt, Human
cucggaggccccaaagga

SEQ ID NO: 2273931 - RNA, 12 nt, Human
cucggaggcugc

SEQ ID NO: 2273932 - RNA, 13 nt, Human
cucggaggcugcc

SEQ ID NO: 2273933 - RNA, 15 nt, Human
cucggaggcugcccc

SEQ ID NO: 2273934 - RNA, 21 nt, Human
cucggaguaucugggaacugu

SEQ ID NO: 2273935 - RNA, 20 nt, Human
cucggaguaucugggaacug

SEQ ID NO: 2273936 - RNA, 14 nt, Human
cucggcucacugca

SEQ ID NO: 2273937 - RNA, 19 nt, Human
cucggcuccccaugugucc

SEQ ID NO: 2273938 - RNA, 22 nt, Human
cucggcuccccauguguccugg

SEQ ID NO: 2273939 - RNA, 18 nt, Human
cucggcucacugcauccu

SEQ ID NO: 2273940 - RNA, 17 nt, Human
cucggcucacugcaucc

SEQ ID NO: 2273941 - RNA, 19 nt, Human
cucgcuggacucucagucu

SEQ ID NO: 2273942 - RNA, 12 nt, Human
cucgcuguugcu

SEQ ID NO: 2273943 - RNA, 15 nt, Human
cucgcugcuucugug

SEQ ID NO: 2273944 - RNA, 16 nt, Human
cucgcuggacucucag

SEQ ID NO: 2273945 - RNA, 15 nt, Human
cucgcuggacucuca

SEQ ID NO: 2273946 - RNA, 19 nt, Human
cucgcugccagcucuguau

SEQ ID NO: 2273947 - RNA, 20 nt, Human
cucgcugcugcgcccugggc

SEQ ID NO: 2273948 - RNA, 13 nt, Human
cuccuucaccuuu

SEQ ID NO: 2273949 - RNA, 16 nt, Human
cucgcugccagcucug

SEQ ID NO: 2273950 - RNA, 13 nt, Human
cucgcugccagcu

SEQ ID NO: 2273951 - RNA, 19 nt, Human
cuccuucacagaugggugc

SEQ ID NO: 2273952 - RNA, 20 nt, Human
cuccugugugugcgccuaca

SEQ ID NO: 2273953 - RNA, 18 nt, Human
cuccuguguagcugggau

SEQ ID NO: 2273954 - RNA, 14 nt, Human
cuccuguguacagg

SEQ ID NO: 2273955 - RNA, 14 nt, Human
cuccugugugugcg

SEQ ID NO: 2273956 - RNA, 16 nt, Human
cuccuucacagauggg

SEQ ID NO: 2273957 - RNA, 17 nt, Human
cuccuucacagaugggu

SEQ ID NO: 2273958 - RNA, 21 nt, Human
cucccagguaccagcugcgcu

SEQ ID NO: 2273959 - RNA, 22 nt, Human
cucccagguaccagcugcgcuu

SEQ ID NO: 2273960 - RNA, 17 nt, Human
cucccagguaccagcug

SEQ ID NO: 2273961 - RNA, 18 nt, Human
cucccagguaccagcugc

SEQ ID NO: 2273962 - RNA, 19 nt, Human
cucccagguaccagcugcg

SEQ ID NO: 2273963 - RNA, 16 nt, Human
cucccagguaccagcu

SEQ ID NO: 2273964 - RNA, 24 nt, Human
cucccagguaccagcugcgcuugc

SEQ ID NO: 2273965 - RNA, 11 nt, Human
cucccaucugg

SEQ ID NO: 2273966 - RNA, 21 nt, Human
cucccaucucacacaugagca

SEQ ID NO: 2273967 - RNA, 11 nt, Human
cucccaucugu

SEQ ID NO: 2273968 - RNA, 14 nt, Human
cucccaucugugaa

SEQ ID NO: 2273969 - RNA, 15 nt, Human
cucccaucugugaaa

SEQ ID NO: 2273970 - RNA, 18 nt, Human
cucccaucugugaaagga

SEQ ID NO: 2273971 - RNA, 23 nt, Human
cucccaucugugaaaggaaagag

SEQ ID NO: 2273972 - RNA, 22 nt, Human
cucccaaagugcugggauuaca

SEQ ID NO: 2273973 - RNA, 18 nt, Human
cucccaaagugcugggau

SEQ ID NO: 2273974 - RNA, 16 nt, Human
cucccaacucacccca

SEQ ID NO: 2273975 - RNA, 17 nt, Human
cucccaacucaccccag

SEQ ID NO: 2273976 - RNA, 23 nt, Human
cucccagggccagggcccugcag

SEQ ID NO: 2273977 - RNA, 22 nt, Human
cucccagggccagggcccugca

SEQ ID NO: 2273978 - RNA, 18 nt, Human
cucccaaggcugcgucug

SEQ ID NO: 2273979 - RNA, 21 nt, Human
cucccaaggcugcgucuggag

SEQ ID NO: 2273980 - RNA, 22 nt, Human
cucccaaggcugcgucuggagg

SEQ ID NO: 2273981 - RNA, 19 nt, Human
cucccaggggcuggcuuca

SEQ ID NO: 2273982 - RNA, 22 nt, Human
cucccaacucaccccagcccca

SEQ ID NO: 2273983 - RNA, 17 nt, Human
cucccaaagugcuggga

SEQ ID NO: 2273984 - RNA, 13 nt, Human
cuccaugugggcu

SEQ ID NO: 2273985 - RNA, 22 nt, Human
cuccaugucucugagcauuaga

SEQ ID NO: 2273986 - RNA, 13 nt, Human
cuccaugucucug

SEQ ID NO: 2273987 - RNA, 15 nt, Human
cuccauggcuuccuc

SEQ ID NO: 2273988 - RNA, 16 nt, Human
cuccauggcuuccucc

SEQ ID NO: 2273989 - RNA, 17 nt, Human
cuccauggcuuccuccu

SEQ ID NO: 2273990 - RNA, 18 nt, Human
cuccauggcuuccuccuc

SEQ ID NO: 2273991 - RNA, 19 nt, Human
cuccauggcuuccuccucc

SEQ ID NO: 2273992 - RNA, 20 nt, Human
cuccauggcuuccuccuccc

SEQ ID NO: 2273993 - RNA, 21 nt, Human
cuccauggcuuccuccucccu

SEQ ID NO: 2273994 - RNA, 12 nt, Human
cuccaucuuauu

SEQ ID NO: 2273995 - RNA, 12 nt, Human
cuccaucuguuu

SEQ ID NO: 2273996 - RNA, 17 nt, Human
cuccaucuucagcuucu

SEQ ID NO: 2273997 - RNA, 19 nt, Human
cuccaucuucagcuucuuc

SEQ ID NO: 2273998 - RNA, 16 nt, Human
cuccaucuucuuugca

SEQ ID NO: 2273999 - RNA, 17 nt, Human
cuccaucuucuuugcag

SEQ ID NO: 2274000 - RNA, 17 nt, Human
cuccaugaguuuuuucu

SEQ ID NO: 2274001 - RNA, 21 nt, Human
cuccaugagacacaucuccuc

SEQ ID NO: 2274002 - RNA, 13 nt, Human
cuccaugagcacc

SEQ ID NO: 2274003 - RNA, 16 nt, Human
cuccaucuggcagggu

SEQ ID NO: 2274004 - RNA, 18 nt, Human
cuccaucucucuggcccu

SEQ ID NO: 2274005 - RNA, 13 nt, Human
cuccaucucucug

SEQ ID NO: 2274006 - RNA, 15 nt, Human
cuccaucucucuggc

SEQ ID NO: 2274007 - RNA, 16 nt, Human
cuccaucucucuggcc

SEQ ID NO: 2274008 - RNA, 17 nt, Human
cuccaucucucuggccc

SEQ ID NO: 2274009 - RNA, 16 nt, Human
cuccaucuccacucca

SEQ ID NO: 2274010 - RNA, 12 nt, Human
cuccaucucucu

SEQ ID NO: 2274011 - RNA, 14 nt, Human
cuccaucuccacuc

SEQ ID NO: 2274012 - RNA, 18 nt, Human
cuccauccugaggcucca

SEQ ID NO: 2274013 - RNA, 16 nt, Human
cuccauccugaggcuc

SEQ ID NO: 2274014 - RNA, 11 nt, Human
cuccauccuga

SEQ ID NO: 2274015 - RNA, 17 nt, Human
cucacuauccuacccca

SEQ ID NO: 2274016 - RNA, 22 nt, Human
cucacuaugaaucuauuauacu

SEQ ID NO: 2274017 - RNA, 15 nt, Human
cucacuauggugcca

SEQ ID NO: 2274018 - RNA, 18 nt, Human
cucacuauguugcccagg

SEQ ID NO: 2274019 - RNA, 17 nt, Human
cucacuauggugccaau

SEQ ID NO: 2274020 - RNA, 23 nt, Human
cucacuauggugccaauggaacc

SEQ ID NO: 2274021 - RNA, 21 nt, Human
cuccccaggccguggcugccc

SEQ ID NO: 2274022 - RNA, 21 nt, Human
cuccccaggccaggccaccag

SEQ ID NO: 2274023 - RNA, 12 nt, Human
cuccccaggcca

SEQ ID NO: 2274024 - RNA, 15 nt, Human
cuccccaggccaggc

SEQ ID NO: 2274025 - RNA, 17 nt, Human
cuccccaggccaggcca

SEQ ID NO: 2274026 - RNA, 12 nt, Human
cuccccagcuca

SEQ ID NO: 2274027 - RNA, 14 nt, Human
cuccccugcccugg

SEQ ID NO: 2274028 - RNA, 16 nt, Human
cuccccugcccugcug

SEQ ID NO: 2274029 - RNA, 15 nt, Human
cuccccugcccugcu

SEQ ID NO: 2274030 - RNA, 12 nt, Human
cuccccugcugg

SEQ ID NO: 2274031 - RNA, 20 nt, Human
cuccccagcaagugagagcu

SEQ ID NO: 2274032 - RNA, 15 nt, Human
cuccccagcccuggc

SEQ ID NO: 2274033 - RNA, 16 nt, Human
cuccccagcccuggcu

SEQ ID NO: 2274034 - RNA, 19 nt, Human
cuccccagccccuagccca

SEQ ID NO: 2274035 - RNA, 21 nt, Human
cuccccagccccuagcccagg

SEQ ID NO: 2274036 - RNA, 22 nt, Human
cuccccagccccuagcccagga

SEQ ID NO: 2274037 - RNA, 13 nt, Human
cuccccagcccug

SEQ ID NO: 2274038 - RNA, 15 nt, Human
cuccccagagcacug

SEQ ID NO: 2274039 - RNA, 16 nt, Human
cuccccagagcacugg

SEQ ID NO: 2274040 - RNA, 17 nt, Human
cuccccagagcacuggg

SEQ ID NO: 2274041 - RNA, 20 nt, Human
cuccccagaguuccccaugc

SEQ ID NO: 2274042 - RNA, 13 nt, Human
cuccccagccccu

SEQ ID NO: 2274043 - RNA, 15 nt, Human
cuccccagccccuag

SEQ ID NO: 2274044 - RNA, 17 nt, Human
cuccccagccccuagcc

SEQ ID NO: 2274045 - RNA, 12 nt, Human
cuccccagcaag

SEQ ID NO: 2274046 - RNA, 18 nt, Human
cuccccacaggagcccug

SEQ ID NO: 2274047 - RNA, 16 nt, Human
cuccccacugccuacu

SEQ ID NO: 2274048 - RNA, 19 nt, Human
cuccccacugccuacugca

SEQ ID NO: 2274049 - RNA, 15 nt, Human
cuccccaacccugcc

SEQ ID NO: 2274050 - RNA, 14 nt, Human
cuccccaacccugc

SEQ ID NO: 2274051 - RNA, 12 nt, Human
cuccccaacccu

SEQ ID NO: 2274052 - RNA, 19 nt, Human
cuccccaacccugccccug

SEQ ID NO: 2274053 - RNA, 17 nt, Human
cuccccaacccugcccc

SEQ ID NO: 2274054 - RNA, 20 nt, Human
cuccccaacccugccccugc

SEQ ID NO: 2274055 - RNA, 21 nt, Human
cuccccacacuaaccuggguu

SEQ ID NO: 2274056 - RNA, 12 nt, Human
cuccccaaaaac

SEQ ID NO: 2274057 - RNA, 14 nt, Human
cucccauuucuacu

SEQ ID NO: 2274058 - RNA, 16 nt, Human
cucccauuucuacucu

SEQ ID NO: 2274059 - RNA, 12 nt, Human
cucccauuucua

SEQ ID NO: 2274060 - RNA, 21 nt, Human
cuccccaaaucaauacacuag

SEQ ID NO: 2274061 - RNA, 21 nt, Human
cucccaugaccauacugaggg

SEQ ID NO: 2274062 - RNA, 16 nt, Human
cucccaugaccauacu

SEQ ID NO: 2274063 - RNA, 22 nt, Human
cucccaucugggaguccccuuu

SEQ ID NO: 2274064 - RNA, 12 nt, Human
cucccaucuggg

SEQ ID NO: 2274065 - RNA, 13 nt, Human
cucccaucuggga

SEQ ID NO: 2274066 - RNA, 15 nt, Human
cucccaucugggagu

SEQ ID NO: 2274067 - RNA, 20 nt, Human
cucccaucugggaguccccu

SEQ ID NO: 2274068 - RNA, 17 nt, Human
cucccgaauagcuggga

SEQ ID NO: 2274069 - RNA, 16 nt, Human
cucccgaauagcuggg

SEQ ID NO: 2274070 - RNA, 13 nt, Human
cuccccugcuggg

SEQ ID NO: 2274071 - RNA, 16 nt, Human
cuccccugcugaaggu

SEQ ID NO: 2274072 - RNA, 13 nt, Human
cuccccugcugca

SEQ ID NO: 2274073 - RNA, 15 nt, Human
cuccccugcugcagg

SEQ ID NO: 2274074 - RNA, 16 nt, Human
cuccccugcugcaggg

SEQ ID NO: 2274075 - RNA, 15 nt, Human
cucccgaguagcugg

SEQ ID NO: 2274076 - RNA, 18 nt, Human
cucccgaauagcugggac

SEQ ID NO: 2274077 - RNA, 16 nt, Human
cucccgaguagcuggg

SEQ ID NO: 2274078 - RNA, 17 nt, Human
cucccgaguagcuggga

SEQ ID NO: 2274079 - RNA, 19 nt, Human
cucccgaauagcugggacu

SEQ ID NO: 2274080 - RNA, 18 nt, Human
cucccgaguagcugggac

SEQ ID NO: 2274081 - RNA, 20 nt, Human
cucccgcugcccaggggagc

SEQ ID NO: 2274082 - RNA, 18 nt, Human
cuccccugcugcaggggc

SEQ ID NO: 2274083 - RNA, 13 nt, Human
cucccgcugcugc

SEQ ID NO: 2274084 - RNA, 14 nt, Human
cucccgcugcugcu

SEQ ID NO: 2274085 - RNA, 15 nt, Human
cucccgcugcugcug

SEQ ID NO: 2274086 - RNA, 16 nt, Human
cucccgcugcugcugc

SEQ ID NO: 2274087 - RNA, 12 nt, Human
cucccggcgugg

SEQ ID NO: 2274088 - RNA, 19 nt, Human
cucccggcaugggaaagcc

SEQ ID NO: 2274089 - RNA, 18 nt, Human
cucccggcacuccaugcu

SEQ ID NO: 2274090 - RNA, 17 nt, Human
cucccggcaugggaaag

SEQ ID NO: 2274091 - RNA, 15 nt, Human
cucccggagggcccu

SEQ ID NO: 2274092 - RNA, 19 nt, Human
cucccggagguuggguggg

SEQ ID NO: 2274093 - RNA, 20 nt, Human
cucccggagguugggugggc

SEQ ID NO: 2274094 - RNA, 17 nt, Human
cucccgcugcugcugcu

SEQ ID NO: 2274095 - RNA, 14 nt, Human
cucccggcacucca

SEQ ID NO: 2274096 - RNA, 15 nt, Human
cucccuaccaccucc

SEQ ID NO: 2274097 - RNA, 14 nt, Human
cucccuaccaccuc

SEQ ID NO: 2274098 - RNA, 13 nt, Human
cucccuaccaccu

SEQ ID NO: 2274099 - RNA, 20 nt, Human
cucccggcuaugggggcacu

SEQ ID NO: 2274100 - RNA, 16 nt, Human
cucccggcguggugga

SEQ ID NO: 2274101 - RNA, 22 nt, Human
cucccuagugacccggaggcca

SEQ ID NO: 2274102 - RNA, 23 nt, Human
cucccuagugacccggaggccac

SEQ ID NO: 2274103 - RNA, 22 nt, Human
cucccuaccaccuccccagccu

SEQ ID NO: 2274104 - RNA, 21 nt, Human
cucccuagccagcacuuguau

SEQ ID NO: 2274105 - RNA, 21 nt, Human
cucccuagugacccggaggcc

SEQ ID NO: 2274106 - RNA, 17 nt, Human
cucccuauuuuuuuucu

SEQ ID NO: 2274107 - RNA, 23 nt, Human
cucccuaucuaacccucccaugg

SEQ ID NO: 2274108 - RNA, 19 nt, Human
cuccugccuguagcaguga

SEQ ID NO: 2274109 - RNA, 16 nt, Human
cuccugccuuccuccu

SEQ ID NO: 2274110 - RNA, 14 nt, Human
cuccugccuguagc

SEQ ID NO: 2274111 - RNA, 15 nt, Human
cuccugccuguagca

SEQ ID NO: 2274112 - RNA, 16 nt, Human
cuccugccuguagcag

SEQ ID NO: 2274113 - RNA, 18 nt, Human
cuccugccuguagcagug

SEQ ID NO: 2274114 - RNA, 16 nt, Human
cuccugccgacuccug

SEQ ID NO: 2274115 - RNA, 17 nt, Human
cuccugccgacuccugg

SEQ ID NO: 2274116 - RNA, 14 nt, Human
cuccugccugcccc

SEQ ID NO: 2274117 - RNA, 17 nt, Human
cuccugccugccccucu

SEQ ID NO: 2274118 - RNA, 15 nt, Human
cuccugccucagccu

SEQ ID NO: 2274119 - RNA, 17 nt, Human
cuccugcgcgcaugugc

SEQ ID NO: 2274120 - RNA, 21 nt, Human
cuccugccuucuguccuggug

SEQ ID NO: 2274121 - RNA, 22 nt, Human
cuccugccuucuguccuggugu

SEQ ID NO: 2274122 - RNA, 16 nt, Human
cuccugccuucugucc

SEQ ID NO: 2274123 - RNA, 20 nt, Human
cuccugccuuccuccugggc

SEQ ID NO: 2274124 - RNA, 19 nt, Human
cuccugccuuccuccuggg

SEQ ID NO: 2274125 - RNA, 18 nt, Human
cuccugccuuccuccugg

SEQ ID NO: 2274126 - RNA, 23 nt, Human
cuccugucugccagccagcagcc

SEQ ID NO: 2274127 - RNA, 22 nt, Human
cuccugucugccagccagcagc

SEQ ID NO: 2274128 - RNA, 19 nt, Human
cuccugucugccagccagc

SEQ ID NO: 2274129 - RNA, 17 nt, Human
cuccugucugccagcca

SEQ ID NO: 2274130 - RNA, 10 nt, Human
cuccugucuu

SEQ ID NO: 2274131 - RNA, 14 nt, Human
cuccugucuuccca

SEQ ID NO: 2274132 - RNA, 15 nt, Human
cuccugucuucccag

SEQ ID NO: 2274133 - RNA, 17 nt, Human
cuccugucuucccaggg

SEQ ID NO: 2274134 - RNA, 18 nt, Human
cuccugucuucccagggu

SEQ ID NO: 2274135 - RNA, 19 nt, Human
cuccugucuucccagggua

SEQ ID NO: 2274136 - RNA, 21 nt, Human
cuccugucuucccaggguagc

SEQ ID NO: 2274137 - RNA, 16 nt, Human
cuccugugugugcgcc

SEQ ID NO: 2274138 - RNA, 19 nt, Human
cuccugugugugcgccuac

SEQ ID NO: 2274139 - RNA, 11 nt, Human
cuccuguguaa

SEQ ID NO: 2274140 - RNA, 13 nt, Human
cuccuguguacag

SEQ ID NO: 2274141 - RNA, 21 nt, Human
cuccuguggccccacccuggg

SEQ ID NO: 2274142 - RNA, 22 nt, Human
cuccuguggccccacccugggc

SEQ ID NO: 2274143 - RNA, 20 nt, Human
cuccugugcaugggugaagg

SEQ ID NO: 2274144 - RNA, 17 nt, Human
cuccugugcauggguga

SEQ ID NO: 2274145 - RNA, 11 nt, Human
cuccugugccc

SEQ ID NO: 2274146 - RNA, 14 nt, Human
cuccugugcccaca

SEQ ID NO: 2274147 - RNA, 21 nt, Human
cuccugugcccacaucccagg

SEQ ID NO: 2274148 - RNA, 22 nt, Human
cuccugugcccacaucccaggc

SEQ ID NO: 2274149 - RNA, 12 nt, Human
cuccugugcccu

SEQ ID NO: 2274150 - RNA, 13 nt, Human
cuccugugcccuu

SEQ ID NO: 2274151 - RNA, 17 nt, Human
cuccugugcaacuuucc

SEQ ID NO: 2274152 - RNA, 16 nt, Human
cuccugugcaugggug

SEQ ID NO: 2274153 - RNA, 11 nt, Human
cuccugugcua

SEQ ID NO: 2274154 - RNA, 20 nt, Human
cuccugugcuacuuugccuu

SEQ ID NO: 2274155 - RNA, 13 nt, Human
cuccuguggcccc

SEQ ID NO: 2274156 - RNA, 15 nt, Human
cuccugugcuuuccc

SEQ ID NO: 2274157 - RNA, 19 nt, Human
cuccuguggccccacccug

SEQ ID NO: 2274158 - RNA, 20 nt, Human
cuccuguggccccacccugg

SEQ ID NO: 2274159 - RNA, 15 nt, Human
cuccucuccccucua

SEQ ID NO: 2274160 - RNA, 17 nt, Human
cuccucuccccuaccac

SEQ ID NO: 2274161 - RNA, 18 nt, Human
cuccucuccccuaccacu

SEQ ID NO: 2274162 - RNA, 14 nt, Human
cuccucuccccucu

SEQ ID NO: 2274163 - RNA, 15 nt, Human
cuccugcacuuacuu

SEQ ID NO: 2274164 - RNA, 17 nt, Human
cuccugcacuuacuugc

SEQ ID NO: 2274165 - RNA, 23 nt, Human
cuccucuccccagcccagagaca

SEQ ID NO: 2274166 - RNA, 12 nt, Human
cuccucuccccu

SEQ ID NO: 2274167 - RNA, 14 nt, Human
cuccucuccccuac

SEQ ID NO: 2274168 - RNA, 22 nt, Human
cuccucuccccagcccagagac

SEQ ID NO: 2274169 - RNA, 21 nt, Human
cuccucuccccagcccagaga

SEQ ID NO: 2274170 - RNA, 20 nt, Human
cuccucuccccagcccagag

SEQ ID NO: 2274171 - RNA, 19 nt, Human
cuccucuccccagcccaga

SEQ ID NO: 2274172 - RNA, 18 nt, Human
cuccucuccccagcccag

SEQ ID NO: 2274173 - RNA, 17 nt, Human
cuccucuccccagccca

SEQ ID NO: 2274174 - RNA, 11 nt, Human
cuccugcaggc

SEQ ID NO: 2274175 - RNA, 18 nt, Human
cuccugcacuuacuugcu

SEQ ID NO: 2274176 - RNA, 19 nt, Human
cuccugcacuuacuugcuu

SEQ ID NO: 2274177 - RNA, 20 nt, Human
cuccugcacuuacuugcuua

SEQ ID NO: 2274178 - RNA, 22 nt, Human
cuccugcacuuacuugcuuauu

SEQ ID NO: 2274179 - RNA, 16 nt, Human
cuccugcaggcagcca

SEQ ID NO: 2274180 - RNA, 17 nt, Human
cuccugcaggcagccag

SEQ ID NO: 2274181 - RNA, 22 nt, Human
cuccugcccaggagagccagcc

SEQ ID NO: 2274182 - RNA, 20 nt, Human
cuccugcccaggagagccag

SEQ ID NO: 2274183 - RNA, 17 nt, Human
cuccugcccaggagagc

SEQ ID NO: 2274184 - RNA, 16 nt, Human
cuccugcccaggagag

SEQ ID NO: 2274185 - RNA, 13 nt, Human
cuccugcccaguc

SEQ ID NO: 2274186 - RNA, 14 nt, Human
cuccugcccagucc

SEQ ID NO: 2274187 - RNA, 15 nt, Human
cuccugcccaguccc

SEQ ID NO: 2274188 - RNA, 17 nt, Human
cuccugcccaguccccc

SEQ ID NO: 2274189 - RNA, 15 nt, Human
cuccugcccaggaga

SEQ ID NO: 2274190 - RNA, 14 nt, Human
cuccugcccaggag

SEQ ID NO: 2274191 - RNA, 13 nt, Human
cuccugcccagga

SEQ ID NO: 2274192 - RNA, 12 nt, Human
cuccugcccagg

SEQ ID NO: 2274193 - RNA, 14 nt, Human
cuccugcagaccac

SEQ ID NO: 2274194 - RNA, 18 nt, Human
cuccugcaggcagccagg

SEQ ID NO: 2274195 - RNA, 20 nt, Human
cuccugcaggcagccaggcc

SEQ ID NO: 2274196 - RNA, 18 nt, Human
cuccugcccaguccccca

SEQ ID NO: 2274197 - RNA, 12 nt, Human
cuccugcccugu

SEQ ID NO: 2274198 - RNA, 13 nt, Human
cuccugcccuguu

SEQ ID NO: 2274199 - RNA, 15 nt, Human
cuccugccgacuccu

SEQ ID NO: 2274200 - RNA, 11 nt, Human
cuccugcccuu

SEQ ID NO: 2274201 - RNA, 13 nt, Human
cuccugccucagc

SEQ ID NO: 2274202 - RNA, 14 nt, Human
cuccugccucagcc

SEQ ID NO: 2274203 - RNA, 21 nt, Human
cucccuuuuuauaucccauuu

SEQ ID NO: 2274204 - RNA, 16 nt, Human
cucccuuuuuccuugu

SEQ ID NO: 2274205 - RNA, 18 nt, Human
cucccuuuuuccuugucc

SEQ ID NO: 2274206 - RNA, 20 nt, Human
cucccuuuuuccuugucccc

SEQ ID NO: 2274207 - RNA, 21 nt, Human
cucccuuuuuccuugucccca

SEQ ID NO: 2274208 - RNA, 14 nt, Human
cucccuuugaaaug

SEQ ID NO: 2274209 - RNA, 22 nt, Human
cucccucauuucaggagcagcc

SEQ ID NO: 2274210 - RNA, 14 nt, Human
cucccuuuuuauau

SEQ ID NO: 2274211 - RNA, 15 nt, Human
cuccgaccagacacc

SEQ ID NO: 2274212 - RNA, 22 nt, Human
cuccgaacacccucgaagcgcg

SEQ ID NO: 2274213 - RNA, 22 nt, Human
cucccuuuuuccuuguccccac

SEQ ID NO: 2274214 - RNA, 23 nt, Human
cucccuuuuuccuuguccccaca

SEQ ID NO: 2274215 - RNA, 17 nt, Human
cucccuuucuucccuac

SEQ ID NO: 2274216 - RNA, 13 nt, Human
cucccucauucca

SEQ ID NO: 2274217 - RNA, 23 nt, Human
cucccucagugcccucauuuuau

SEQ ID NO: 2274218 - RNA, 14 nt, Human
cucccucagugccc

SEQ ID NO: 2274219 - RNA, 20 nt, Human
cucccuauuuuuuuucuguu

SEQ ID NO: 2274220 - RNA, 19 nt, Human
cucccuauuuuuuuucugu

SEQ ID NO: 2274221 - RNA, 16 nt, Human
cuccucaccucuggac

SEQ ID NO: 2274222 - RNA, 15 nt, Human
cuccucaccucugga

SEQ ID NO: 2274223 - RNA, 14 nt, Human
cuccucaccucugg

SEQ ID NO: 2274224 - RNA, 13 nt, Human
cuccucaccucug

SEQ ID NO: 2274225 - RNA, 21 nt, Human
cuccucaccucuggacuggcu

SEQ ID NO: 2274226 - RNA, 18 nt, Human
cuccucaccucuggacug

SEQ ID NO: 2274227 - RNA, 22 nt, Human
cuccucaccucuggacuggcua

SEQ ID NO: 2274228 - RNA, 20 nt, Human
cuccucaccucaugcccacc

SEQ ID NO: 2274229 - RNA, 12 nt, Human
cuccucaucccg

SEQ ID NO: 2274230 - RNA, 18 nt, Human
cuccucaccccgucuggg

SEQ ID NO: 2274231 - RNA, 15 nt, Human
cuccucaccccgucu

SEQ ID NO: 2274232 - RNA, 12 nt, Human
cuccucaccuca

SEQ ID NO: 2274233 - RNA, 14 nt, Human
cuccucaccucaug

SEQ ID NO: 2274234 - RNA, 15 nt, Human
cuccucaccucaugc

SEQ ID NO: 2274235 - RNA, 16 nt, Human
cuccucaccucaugcc

SEQ ID NO: 2274236 - RNA, 17 nt, Human
cuccucaccucaugccc

SEQ ID NO: 2274237 - RNA, 19 nt, Human
cuccucaccucaugcccac

SEQ ID NO: 2274238 - RNA, 21 nt, Human
cuccucacccccagcuuugcu

SEQ ID NO: 2274239 - RNA, 20 nt, Human
cuccucacccccagcuuugc

SEQ ID NO: 2274240 - RNA, 15 nt, Human
cuccucacccccagc

SEQ ID NO: 2274241 - RNA, 17 nt, Human
cuccucacccccagcuu

SEQ ID NO: 2274242 - RNA, 23 nt, Human
cuccgccauucucaagcccugca

SEQ ID NO: 2274243 - RNA, 15 nt, Human
cuccgccagccuccu

SEQ ID NO: 2274244 - RNA, 18 nt, Human
cuccgccagccuccucug

SEQ ID NO: 2274245 - RNA, 20 nt, Human
cuccgccagccuccucugga

SEQ ID NO: 2274246 - RNA, 13 nt, Human
cuccgccaggcga

SEQ ID NO: 2274247 - RNA, 21 nt, Human
cuccgccagccuccucuggac

SEQ ID NO: 2274248 - RNA, 23 nt, Human
cuccgccaggcgagauggggugg

SEQ ID NO: 2274249 - RNA, 13 nt, Human
cuccgcccugcca

SEQ ID NO: 2274250 - RNA, 14 nt, Human
cuccgcccugccac

SEQ ID NO: 2274251 - RNA, 17 nt, Human
cuccgcccugccacuca

SEQ ID NO: 2274252 - RNA, 15 nt, Human
cuccgcccugccacu

SEQ ID NO: 2274253 - RNA, 16 nt, Human
cuccgcccugccacuc

SEQ ID NO: 2274254 - RNA, 22 nt, Human
cuccuccagggccacgugccag

SEQ ID NO: 2274255 - RNA, 20 nt, Human
cuccuccagggccacgugcc

SEQ ID NO: 2274256 - RNA, 19 nt, Human
cuccuccagggccacgugc

SEQ ID NO: 2274257 - RNA, 14 nt, Human
cuccuccagggcca

SEQ ID NO: 2274258 - RNA, 13 nt, Human
cuccuccagggug

SEQ ID NO: 2274259 - RNA, 18 nt, Human
cuccuccaugggagaaaa

SEQ ID NO: 2274260 - RNA, 15 nt, Human
cuccuccaugggaga

SEQ ID NO: 2274261 - RNA, 13 nt, Human
cuccuccagggcc

SEQ ID NO: 2274262 - RNA, 11 nt, Human
cuccuccaggg

SEQ ID NO: 2274263 - RNA, 16 nt, Human
cuccuccacucucccc

SEQ ID NO: 2274264 - RNA, 22 nt, Human
cuccuccaccgccauggcuucc

SEQ ID NO: 2274265 - RNA, 23 nt, Human
cuccuccaaaggaagucuaggag

SEQ ID NO: 2274266 - RNA, 18 nt, Human
cuccuccaaaggaagucu

SEQ ID NO: 2274267 - RNA, 15 nt, Human
cuccuccaaaggaag

SEQ ID NO: 2274268 - RNA, 21 nt, Human
cuccuccaagacacuguggac

SEQ ID NO: 2274269 - RNA, 14 nt, Human
cuccucaucucuaa

SEQ ID NO: 2274270 - RNA, 15 nt, Human
cuccucaucccgugu

SEQ ID NO: 2274271 - RNA, 11 nt, Human
cuccucaugua

SEQ ID NO: 2274272 - RNA, 20 nt, Human
cuccucauguacauacccug

SEQ ID NO: 2274273 - RNA, 22 nt, Human
cuccuccagccgccaugcuccu

SEQ ID NO: 2274274 - RNA, 14 nt, Human
cuccuccaaaggcc

SEQ ID NO: 2274275 - RNA, 18 nt, Human
cuccuccaaaggcccccu

SEQ ID NO: 2274276 - RNA, 13 nt, Human
cuccuccaccgcc

SEQ ID NO: 2274277 - RNA, 15 nt, Human
cuccuccaccgccau

SEQ ID NO: 2274278 - RNA, 16 nt, Human
cuccuccaccgccaug

SEQ ID NO: 2274279 - RNA, 18 nt, Human
cuccuccaccgccauggc

SEQ ID NO: 2274280 - RNA, 19 nt, Human
cuccuccaccgccauggcu

SEQ ID NO: 2274281 - RNA, 14 nt, Human
cuccucgcaagcug

SEQ ID NO: 2274282 - RNA, 21 nt, Human
cuccucgagggcagggacuuu

SEQ ID NO: 2274283 - RNA, 15 nt, Human
cuccucgagggcagg

SEQ ID NO: 2274284 - RNA, 17 nt, Human
cuccucgagggcaggga

SEQ ID NO: 2274285 - RNA, 16 nt, Human
cuccucgcaagcuggg

SEQ ID NO: 2274286 - RNA, 15 nt, Human
cuccucgcaagcugg

SEQ ID NO: 2274287 - RNA, 15 nt, Human
cuccucuccccagcc

SEQ ID NO: 2274288 - RNA, 22 nt, Human
cuccucuccccagcaagugaga

SEQ ID NO: 2274289 - RNA, 19 nt, Human
cuccuccuuggugccuggc

SEQ ID NO: 2274290 - RNA, 14 nt, Human
cuccucccggugcc

SEQ ID NO: 2274291 - RNA, 15 nt, Human
cuccucccauguuau

SEQ ID NO: 2274292 - RNA, 14 nt, Human
cuccuccccaaauc

SEQ ID NO: 2274293 - RNA, 17 nt, Human
cuccuccccaaaucaau

SEQ ID NO: 2274294 - RNA, 15 nt, Human
cuccucccggugccc

SEQ ID NO: 2274295 - RNA, 17 nt, Human
cuccucccggugcccaa

SEQ ID NO: 2274296 - RNA, 16 nt, Human
cuccuccuucccaaag

SEQ ID NO: 2274297 - RNA, 22 nt, Human
cgcccacuguccugggcgcccu

SEQ ID NO: 2274298 - RNA, 22 nt, Human
cgcccagagacccaagcugccu

SEQ ID NO: 2274299 - RNA, 20 nt, Human
cgcccaggcuggagugcagu

SEQ ID NO: 2274300 - RNA, 15 nt, Human
cgcccaggcuggcca

SEQ ID NO: 2274301 - RNA, 16 nt, Human
cgcccaggcuggccag

SEQ ID NO: 2274302 - RNA, 17 nt, Human
cgcccaggcuggccagc

SEQ ID NO: 2274303 - RNA, 19 nt, Human
cgcccaggcuggccagccc

SEQ ID NO: 2274304 - RNA, 20 nt, Human
cgcccaggcuggccagcccc

SEQ ID NO: 2274305 - RNA, 22 nt, Human
cgcccaggcuggccagccccac

SEQ ID NO: 2274306 - RNA, 14 nt, Human
cgcccaguccuucc

SEQ ID NO: 2274307 - RNA, 15 nt, Human
cgcccaguccuucca

SEQ ID NO: 2274308 - RNA, 22 nt, Human
cgcccaggcuuagucacugaga

SEQ ID NO: 2274309 - RNA, 15 nt, Human
cgcccccugcccucc

SEQ ID NO: 2274310 - RNA, 19 nt, Human
cgcccccugcccuccccuc

SEQ ID NO: 2274311 - RNA, 16 nt, Human
cgcccaguccuuccac

SEQ ID NO: 2274312 - RNA, 14 nt, Human
cgcccccugcccuc

SEQ ID NO: 2274313 - RNA, 12 nt, Human
cgcccagucugg

SEQ ID NO: 2274314 - RNA, 14 nt, Human
cgccccgccccaca

SEQ ID NO: 2274315 - RNA, 13 nt, Human
cgccccgccccac

SEQ ID NO: 2274316 - RNA, 17 nt, Human
cgccccgccccacauuc

SEQ ID NO: 2274317 - RNA, 19 nt, Human
cgccccucccacagcgcug

SEQ ID NO: 2274318 - RNA, 21 nt, Human
cgccccucauuuaucccucaa

SEQ ID NO: 2274319 - RNA, 21 nt, Human
cgccccucccacagcgcuggc

SEQ ID NO: 2274320 - RNA, 14 nt, Human
cgccccugccaccu

SEQ ID NO: 2274321 - RNA, 15 nt, Human
cgcccugcuccuccc

SEQ ID NO: 2274322 - RNA, 17 nt, Human
cgcccugcuccucccug

SEQ ID NO: 2274323 - RNA, 18 nt, Human
cgcccugcuccucccugg

SEQ ID NO: 2274324 - RNA, 21 nt, Human
cgcccugcuccucccuggcug

SEQ ID NO: 2274325 - RNA, 12 nt, Human
cgcccuggaagc

SEQ ID NO: 2274326 - RNA, 13 nt, Human
cgcccuggaagcc

SEQ ID NO: 2274327 - RNA, 12 nt, Human
cgcccugggcuc

SEQ ID NO: 2274328 - RNA, 16 nt, Human
cgcccuggaagccggc

SEQ ID NO: 2274329 - RNA, 22 nt, Human
cgcccuggaagccggcggccca

SEQ ID NO: 2274330 - RNA, 16 nt, Human
cgcccuggacugugug

SEQ ID NO: 2274331 - RNA, 21 nt, Human
cgcgccaaauaaugucucugu

SEQ ID NO: 2274332 - RNA, 23 nt, Human
cgcgccaaauaaugucucuguga

SEQ ID NO: 2274333 - RNA, 19 nt, Human
cgcgccaaauaaugucucu

SEQ ID NO: 2274334 - RNA, 21 nt, Human
cgcccugggcucgucuuugca

SEQ ID NO: 2274335 - RNA, 22 nt, Human
cgcccugggcucgucuuugcag

SEQ ID NO: 2274336 - RNA, 15 nt, Human
cgcccuuaccuuccc

SEQ ID NO: 2274337 - RNA, 12 nt, Human
cgcccuuccucu

SEQ ID NO: 2274338 - RNA, 13 nt, Human
cgcccuuccucuc

SEQ ID NO: 2274339 - RNA, 17 nt, Human
cgcccuuccucuccacc

SEQ ID NO: 2274340 - RNA, 23 nt, Human
cgccaggggaaaaucagccugcu

SEQ ID NO: 2274341 - RNA, 14 nt, Human
cgccaucccagccc

SEQ ID NO: 2274342 - RNA, 16 nt, Human
cgccaucccagcccca

SEQ ID NO: 2274343 - RNA, 20 nt, Human
cgcccacaggaagccugcag

SEQ ID NO: 2274344 - RNA, 21 nt, Human
cgcccacaggaagccugcagu

SEQ ID NO: 2274345 - RNA, 22 nt, Human
cgcccacaggaagccugcaguc

SEQ ID NO: 2274346 - RNA, 18 nt, Human
cgcccaccccgcucugca

SEQ ID NO: 2274347 - RNA, 19 nt, Human
cgcccaccccgcucugcau

SEQ ID NO: 2274348 - RNA, 13 nt, Human
cgcccaccgcaug

SEQ ID NO: 2274349 - RNA, 16 nt, Human
cgcccaccgcaugccc

SEQ ID NO: 2274350 - RNA, 17 nt, Human
cgcccaccgcaugcccc

SEQ ID NO: 2274351 - RNA, 18 nt, Human
cgcccaccgcaugccccc

SEQ ID NO: 2274352 - RNA, 21 nt, Human
cgcccaccgcaugcccccucg

SEQ ID NO: 2274353 - RNA, 23 nt, Human
cgcccaccgcaugcccccucgug

SEQ ID NO: 2274354 - RNA, 11 nt, Human
cgcccaccucc

SEQ ID NO: 2274355 - RNA, 12 nt, Human
cgcccaccuccc

SEQ ID NO: 2274356 - RNA, 14 nt, Human
cgcccaccucccca

SEQ ID NO: 2274357 - RNA, 12 nt, Human
cgcccacugucc

SEQ ID NO: 2274358 - RNA, 14 nt, Human
cgcccacuguccug

SEQ ID NO: 2274359 - RNA, 15 nt, Human
cgcccacuguccugg

SEQ ID NO: 2274360 - RNA, 16 nt, Human
cgcccacuguccuggg

SEQ ID NO: 2274361 - RNA, 17 nt, Human
cgcccacuguccugggc

SEQ ID NO: 2274362 - RNA, 18 nt, Human
cgcccacuguccugggcg

SEQ ID NO: 2274363 - RNA, 19 nt, Human
cgcccacuguccugggcgc

SEQ ID NO: 2274364 - RNA, 20 nt, Human
cgcccacuguccugggcgcc

SEQ ID NO: 2274365 - RNA, 23 nt, Human
cgccagccuccucuggacggcag

SEQ ID NO: 2274366 - RNA, 15 nt, Human
cgccagcgaacuuga

SEQ ID NO: 2274367 - RNA, 22 nt, Human
cgccagcacagaaacagaggag

SEQ ID NO: 2274368 - RNA, 13 nt, Human
cgccagccuccuc

SEQ ID NO: 2274369 - RNA, 14 nt, Human
cgccagccuccucu

SEQ ID NO: 2274370 - RNA, 15 nt, Human
cgccagccuccucug

SEQ ID NO: 2274371 - RNA, 16 nt, Human
cgccagccuccucugg

SEQ ID NO: 2274372 - RNA, 17 nt, Human
cgccagccuccucugga

SEQ ID NO: 2274373 - RNA, 18 nt, Human
cgccagccuccucuggac

SEQ ID NO: 2274374 - RNA, 21 nt, Human
cgccagccuccucuggacggc

SEQ ID NO: 2274375 - RNA, 14 nt, Human
ccucugccccgucu

SEQ ID NO: 2274376 - RNA, 22 nt, Human
ccucugccccauccuccagcag

SEQ ID NO: 2274377 - RNA, 23 nt, Human
ccucugcccagcuugggcccagc

SEQ ID NO: 2274378 - RNA, 19 nt, Human
ccucugccccauccuccag

SEQ ID NO: 2274379 - RNA, 18 nt, Human
ccucugcccagcuugggc

SEQ ID NO: 2274380 - RNA, 20 nt, Human
ccucugcccagcuugggccc

SEQ ID NO: 2274381 - RNA, 22 nt, Human
cgccagauucuuuccugaggcu

SEQ ID NO: 2274382 - RNA, 20 nt, Human
ccucugccaccuccccuauc

SEQ ID NO: 2274383 - RNA, 11 nt, Human
ccucugccaga

SEQ ID NO: 2274384 - RNA, 23 nt, Human
ccucugccagaagauccccucag

SEQ ID NO: 2274385 - RNA, 11 nt, Human
ccucugcccag

SEQ ID NO: 2274386 - RNA, 13 nt, Human
ccucugcccagcu

SEQ ID NO: 2274387 - RNA, 14 nt, Human
ccucugcccagcuu

SEQ ID NO: 2274388 - RNA, 16 nt, Human
ccucugcccagcuugg

SEQ ID NO: 2274389 - RNA, 17 nt, Human
ccucugcccagcuuggg

SEQ ID NO: 2274390 - RNA, 20 nt, Human
ccucugcccacucccugcaa

SEQ ID NO: 2274391 - RNA, 17 nt, Human
ccucugcccacucccug

SEQ ID NO: 2274392 - RNA, 19 nt, Human
ccucugcccacucccugca

SEQ ID NO: 2274393 - RNA, 15 nt, Human
cgcggcggagcuggc

SEQ ID NO: 2274394 - RNA, 12 nt, Human
cgcggccagccc

SEQ ID NO: 2274395 - RNA, 14 nt, Human
cgcggccagccccg

SEQ ID NO: 2274396 - RNA, 15 nt, Human
cgcggccagccccgg

SEQ ID NO: 2274397 - RNA, 22 nt, Human
cgcggccagccccggcccuggg

SEQ ID NO: 2274398 - RNA, 17 nt, Human
cgcggcggagcuggccc

SEQ ID NO: 2274399 - RNA, 18 nt, Human
cgcggcggagcuggcccc

SEQ ID NO: 2274400 - RNA, 21 nt, Human
cgcggcggagcuggccccgcc

SEQ ID NO: 2274401 - RNA, 22 nt, Human
cgcggcggagcuggccccgccg

SEQ ID NO: 2274402 - RNA, 23 nt, Human
cgcggcggagcuggccccgccgc

SEQ ID NO: 2274403 - RNA, 21 nt, Human
cgcuaaucccgauucacccug

SEQ ID NO: 2274404 - RNA, 22 nt, Human
cgcuaagagggagggagggcuc

SEQ ID NO: 2274405 - RNA, 18 nt, Human
cgcgccacucgcuucccc

SEQ ID NO: 2274406 - RNA, 15 nt, Human
cgcgccacucgcuuc

SEQ ID NO: 2274407 - RNA, 23 nt, Human
cgcgccacuacacuccagccuga

SEQ ID NO: 2274408 - RNA, 22 nt, Human
cgcgccacuacacuccagccug

SEQ ID NO: 2274409 - RNA, 22 nt, Human
cgcgccacucgcuucccccaua

SEQ ID NO: 2274410 - RNA, 20 nt, Human
cgcgccacucgcuuccccca

SEQ ID NO: 2274411 - RNA, 15 nt, Human
cgcgcugccugugug

SEQ ID NO: 2274412 - RNA, 19 nt, Human
cgcgcgucccccugccggc

SEQ ID NO: 2274413 - RNA, 13 nt, Human
cgcgcugccugug

SEQ ID NO: 2274414 - RNA, 19 nt, Human
cgcgccuucucccccccgg

SEQ ID NO: 2274415 - RNA, 23 nt, Human
cgcgccuucucccccccggggcu

SEQ ID NO: 2274416 - RNA, 11 nt, Human
cgcuacccacu

SEQ ID NO: 2274417 - RNA, 19 nt, Human
cgcucagggccaugcugag

SEQ ID NO: 2274418 - RNA, 20 nt, Human
cgcucagggccaugcugagg

SEQ ID NO: 2274419 - RNA, 21 nt, Human
cgcucagggccaugcugaggc

SEQ ID NO: 2274420 - RNA, 22 nt, Human
cgcucagggccaugcugaggcc

SEQ ID NO: 2274421 - RNA, 15 nt, Human
cgcucucuggccuuc

SEQ ID NO: 2274422 - RNA, 14 nt, Human
cgcucucuggccuu

SEQ ID NO: 2274423 - RNA, 16 nt, Human
cgcucagcccucccug

SEQ ID NO: 2274424 - RNA, 21 nt, Human
cgcucagcccucccugccccu

SEQ ID NO: 2274425 - RNA, 12 nt, Human
cgcucagcccuc

SEQ ID NO: 2274426 - RNA, 16 nt, Human
cgcuacccgggaaggg

SEQ ID NO: 2274427 - RNA, 17 nt, Human
cgcuugccacuagggcu

SEQ ID NO: 2274428 - RNA, 22 nt, Human
cgcuucuugccucugugcugug

SEQ ID NO: 2274429 - RNA, 18 nt, Human
cgcuucuugccucugugc

SEQ ID NO: 2274430 - RNA, 19 nt, Human
cgcuucuugccucugugcu

SEQ ID NO: 2274431 - RNA, 18 nt, Human
cgcugugcugcccugccc

SEQ ID NO: 2274432 - RNA, 11 nt, Human
cgcuugccucg

SEQ ID NO: 2274433 - RNA, 13 nt, Human
cgcuugccucggc

SEQ ID NO: 2274434 - RNA, 14 nt, Human
cgcuugccucggcu

SEQ ID NO: 2274435 - RNA, 15 nt, Human
cgcuugccucggcuc

SEQ ID NO: 2274436 - RNA, 16 nt, Human
cgcuugccucggcucc

SEQ ID NO: 2274437 - RNA, 18 nt, Human
cgcuugccucggcuccug

SEQ ID NO: 2274438 - RNA, 20 nt, Human
cgcuugccucggcuccugcu

SEQ ID NO: 2274439 - RNA, 18 nt, Human
cgcuugcuuuucuguauu

SEQ ID NO: 2274440 - RNA, 21 nt, Human
cgcuugccucggcuccugcug

SEQ ID NO: 2274441 - RNA, 22 nt, Human
cgcuugccucggcuccugcugc

SEQ ID NO: 2274442 - RNA, 14 nt, Human
cgcuuggagcagag

SEQ ID NO: 2274443 - RNA, 23 nt, Human
cgcuugccucggcuccugcugca

SEQ ID NO: 2274444 - RNA, 20 nt, Human
cgcuuguccagcgccuagug

SEQ ID NO: 2274445 - RNA, 17 nt, Human
cgcuuguccagcgccua

SEQ ID NO: 2274446 - RNA, 17 nt, Human
cgcuugugcagaaaaca

SEQ ID NO: 2274447 - RNA, 18 nt, Human
cgcuugugcagaaaacau

SEQ ID NO: 2274448 - RNA, 16 nt, Human
cgcuuugauucauagu

SEQ ID NO: 2274449 - RNA, 20 nt, Human
cggaaaacaugcuacacacu

SEQ ID NO: 2274450 - RNA, 15 nt, Human
cggaaaacaugcuac

SEQ ID NO: 2274451 - RNA, 23 nt, Human
cgcugucccuaguaaaaauacaa

SEQ ID NO: 2274452 - RNA, 14 nt, Human
cgcugucuccagac

SEQ ID NO: 2274453 - RNA, 15 nt, Human
cgcugucuccagacc

SEQ ID NO: 2274454 - RNA, 15 nt, Human
cgcugugcugcccug

SEQ ID NO: 2274455 - RNA, 16 nt, Human
cgcugugcugcccugc

SEQ ID NO: 2274456 - RNA, 17 nt, Human
cgcugugcugcccugcc

SEQ ID NO: 2274457 - RNA, 23 nt, Human
cgcugguagagauggaggaggag

SEQ ID NO: 2274458 - RNA, 13 nt, Human
cgcugucacaggc

SEQ ID NO: 2274459 - RNA, 15 nt, Human
cgcugguagagaugg

SEQ ID NO: 2274460 - RNA, 22 nt, Human
cgcugucagccauuccuguucc

SEQ ID NO: 2274461 - RNA, 18 nt, Human
cgcucucuggccuucggc

SEQ ID NO: 2274462 - RNA, 14 nt, Human
cgcugggugguacc

SEQ ID NO: 2274463 - RNA, 19 nt, Human
cgcugggugguacccucug

SEQ ID NO: 2274464 - RNA, 22 nt, Human
cgcugggugguacccucuggag

SEQ ID NO: 2274465 - RNA, 15 nt, Human
cggaaaccuuggugu

SEQ ID NO: 2274466 - RNA, 17 nt, Human
cgggagccgcuggcaga

SEQ ID NO: 2274467 - RNA, 18 nt, Human
cgggagccgcuggcagaa

SEQ ID NO: 2274468 - RNA, 22 nt, Human
cgggagcaucucuugaggccag

SEQ ID NO: 2274469 - RNA, 22 nt, Human
cgggagccaugcgcccccuccg

SEQ ID NO: 2274470 - RNA, 14 nt, Human
cgggagcaucucuu

SEQ ID NO: 2274471 - RNA, 23 nt, Human
cgggagcagugucuuccauaaug

SEQ ID NO: 2274472 - RNA, 20 nt, Human
cgggagcagugucuuccaua

SEQ ID NO: 2274473 - RNA, 15 nt, Human
cgggagcagugucuu

SEQ ID NO: 2274474 - RNA, 14 nt, Human
cgggagcagugucu

SEQ ID NO: 2274475 - RNA, 12 nt, Human
cgggagacagca

SEQ ID NO: 2274476 - RNA, 21 nt, Human
cgggagaaucaugugaacccg

SEQ ID NO: 2274477 - RNA, 16 nt, Human
cgggagaaucauguga

SEQ ID NO: 2274478 - RNA, 22 nt, Human
cggccagccccggcccugggcu

SEQ ID NO: 2274479 - RNA, 23 nt, Human
cggcuggccuggccccucagggu

SEQ ID NO: 2274480 - RNA, 21 nt, Human
cggcuggagaccaugcagagc

SEQ ID NO: 2274481 - RNA, 22 nt, Human
cggcuggagaccaugcagagcg

SEQ ID NO: 2274482 - RNA, 22 nt, Human
cggcuggccuggccccucaggg

SEQ ID NO: 2274483 - RNA, 19 nt, Human
cggcuggccuggccccuca

SEQ ID NO: 2274484 - RNA, 20 nt, Human
cgggaggucgaggcaggagg

SEQ ID NO: 2274485 - RNA, 18 nt, Human
cgggaggucgaggcagga

SEQ ID NO: 2274486 - RNA, 18 nt, Human
cgggaugguccuggggcu

SEQ ID NO: 2274487 - RNA, 16 nt, Human
cgggaugguccugggg

SEQ ID NO: 2274488 - RNA, 17 nt, Human
cgggauuaguacacacu

SEQ ID NO: 2274489 - RNA, 22 nt, Human
cggggacagcuccuucuguccu

SEQ ID NO: 2274490 - RNA, 21 nt, Human
cgggcaccuauagucccagcu

SEQ ID NO: 2274491 - RNA, 19 nt, Human
cgggcaccuauagucccag

SEQ ID NO: 2274492 - RNA, 14 nt, Human
cgggcacucagaag

SEQ ID NO: 2274493 - RNA, 22 nt, Human
cgggcacucagaagacacugau

SEQ ID NO: 2274494 - RNA, 16 nt, Human
cggggugcccacaggc

SEQ ID NO: 2274495 - RNA, 22 nt, Human
cggggugaguccauucucccag

SEQ ID NO: 2274496 - RNA, 17 nt, Human
cgggguccuguggcagg

SEQ ID NO: 2274497 - RNA, 19 nt, Human
cgggguccuguggcaggca

SEQ ID NO: 2274498 - RNA, 23 nt, Human
cggggugaguccauucucccagg

SEQ ID NO: 2274499 - RNA, 20 nt, Human
cggggggccccagucagccu

SEQ ID NO: 2274500 - RNA, 12 nt, Human
cggggggaggga

SEQ ID NO: 2274501 - RNA, 18 nt, Human
cgggggcuggccuaggag

SEQ ID NO: 2274502 - RNA, 22 nt, Human
cggggggccccagucagccucu

SEQ ID NO: 2274503 - RNA, 23 nt, Human
cggggggccccagucagccucuc

SEQ ID NO: 2274504 - RNA, 21 nt, Human
cgggguauccugggggaccca

SEQ ID NO: 2274505 - RNA, 16 nt, Human
cgggguauuuuaggca

SEQ ID NO: 2274506 - RNA, 16 nt, Human
cgggguccuguggcag

SEQ ID NO: 2274507 - RNA, 15 nt, Human
cgggguauccugggg

SEQ ID NO: 2274508 - RNA, 15 nt, Human
cggggggacagcucc

SEQ ID NO: 2274509 - RNA, 13 nt, Human
cgggggcuggccu

SEQ ID NO: 2274510 - RNA, 15 nt, Human
cgggggcuggccuag

SEQ ID NO: 2274511 - RNA, 12 nt, Human
cgggggcuggcc

SEQ ID NO: 2274512 - RNA, 12 nt, Human
cgggggcagcug

SEQ ID NO: 2274513 - RNA, 13 nt, Human
cgggggcagcuga

SEQ ID NO: 2274514 - RNA, 15 nt, Human
cgggggcagagaggg

SEQ ID NO: 2274515 - RNA, 10 nt, Human
cggggcuggg

SEQ ID NO: 2274516 - RNA, 12 nt, Human
cggggcuggguu

SEQ ID NO: 2274517 - RNA, 21 nt, Human
cggggcuggguuggcgcaccc

SEQ ID NO: 2274518 - RNA, 15 nt, Human
cggggcuuggcugag

SEQ ID NO: 2274519 - RNA, 14 nt, Human
cggggcuuggcuga

SEQ ID NO: 2274520 - RNA, 23 nt, Human
cggggcuucaaccuugagacagc

SEQ ID NO: 2274521 - RNA, 22 nt, Human
cggggccuggcgggaugggcca

SEQ ID NO: 2274522 - RNA, 22 nt, Human
cggggccuugcgguauccgccc

SEQ ID NO: 2274523 - RNA, 16 nt, Human
cggggcucuucucauu

SEQ ID NO: 2274524 - RNA, 14 nt, Human
cggggcguuucuuu

SEQ ID NO: 2274525 - RNA, 17 nt, Human
cggggcguuucuuugcc

SEQ ID NO: 2274526 - RNA, 17 nt, Human
cggggcucuucucauuu

SEQ ID NO: 2274527 - RNA, 23 nt, Human
cggggcucuucucauuucacccc

SEQ ID NO: 2274528 - RNA, 18 nt, Human
cggggccucgggaccuca

SEQ ID NO: 2274529 - RNA, 21 nt, Human
cggggaggccaagugcaggcu

SEQ ID NO: 2274530 - RNA, 19 nt, Human
cggggaggccaagugcagg

SEQ ID NO: 2274531 - RNA, 14 nt, Human
cggggaggccaagu

SEQ ID NO: 2274532 - RNA, 13 nt, Human
cggggaggccaag

SEQ ID NO: 2274533 - RNA, 18 nt, Human
cggggagcgcccgcgccc

SEQ ID NO: 2274534 - RNA, 22 nt, Human
cggggaggagagagcagcuucu

SEQ ID NO: 2274535 - RNA, 16 nt, Human
cggggagcccccgccc

SEQ ID NO: 2274536 - RNA, 23 nt, Human
cggggacagcuccuucuguccua

SEQ ID NO: 2274537 - RNA, 12 nt, Human
cgggcagcacag

SEQ ID NO: 2274538 - RNA, 14 nt, Human
cgggcagcacagca

SEQ ID NO: 2274539 - RNA, 12 nt, Human
cggggacccugu

SEQ ID NO: 2274540 - RNA, 14 nt, Human
cggggacccuguga

SEQ ID NO: 2274541 - RNA, 20 nt, Human
cggugagaggggaacagacu

SEQ ID NO: 2274542 - RNA, 21 nt, Human
cggugagaggggaacagacug

SEQ ID NO: 2274543 - RNA, 17 nt, Human
cggugccagguuuucug

SEQ ID NO: 2274544 - RNA, 16 nt, Human
cggugcagucugggug

SEQ ID NO: 2274545 - RNA, 16 nt, Human
cggugagaacucugcc

SEQ ID NO: 2274546 - RNA, 13 nt, Human
cggugcagucugg

SEQ ID NO: 2274547 - RNA, 14 nt, Human
cggugcagucuggg

SEQ ID NO: 2274548 - RNA, 14 nt, Human
cggugcccaagcca

SEQ ID NO: 2274549 - RNA, 15 nt, Human
cggugcccaagccag

SEQ ID NO: 2274550 - RNA, 18 nt, Human
cggugcccaagccagagg

SEQ ID NO: 2274551 - RNA, 20 nt, Human
cggugcccaagccagaggcu

SEQ ID NO: 2274552 - RNA, 17 nt, Human
cggugagcuacaaaugc

SEQ ID NO: 2274553 - RNA, 23 nt, Human
cggucccuugagaccucagccau

SEQ ID NO: 2274554 - RNA, 22 nt, Human
cggucccuugagaccucagcca

SEQ ID NO: 2274555 - RNA, 21 nt, Human
cggucccuugagaccucagcc

SEQ ID NO: 2274556 - RNA, 19 nt, Human
cggucccuugagaccucag

SEQ ID NO: 2274557 - RNA, 18 nt, Human
cgguccccuccgccaggc

SEQ ID NO: 2274558 - RNA, 22 nt, Human
cggucggguuuuauuguuuaaa

SEQ ID NO: 2274559 - RNA, 16 nt, Human
cgguauuaugcuucuu

SEQ ID NO: 2274560 - RNA, 17 nt, Human
cgguauuaugcuucuug

SEQ ID NO: 2274561 - RNA, 18 nt, Human
cgguccaagccugcaacu

SEQ ID NO: 2274562 - RNA, 14 nt, Human
cggucccacacugg

SEQ ID NO: 2274563 - RNA, 21 nt, Human
cggucuaaagugagcucuaug

SEQ ID NO: 2274564 - RNA, 11 nt, Human
cggucucaggc

SEQ ID NO: 2274565 - RNA, 20 nt, Human
cggucugcaagucagaggau

SEQ ID NO: 2274566 - RNA, 16 nt, Human
cggucugcaagucaga

SEQ ID NO: 2274567 - RNA, 19 nt, Human
cggucugcaagucagagga

SEQ ID NO: 2274568 - RNA, 18 nt, Human
cggguggcuagucagaga

SEQ ID NO: 2274569 - RNA, 20 nt, Human
cgggugggcggcacagccuu

SEQ ID NO: 2274570 - RNA, 18 nt, Human
cgggugcucagggcugac

SEQ ID NO: 2274571 - RNA, 15 nt, Human
cggguggcaggugga

SEQ ID NO: 2274572 - RNA, 19 nt, Human
cggguggaucaccugaggu

SEQ ID NO: 2274573 - RNA, 18 nt, Human
cggguggaucaccugagg

SEQ ID NO: 2274574 - RNA, 15 nt, Human
cgggugcucagggcu

SEQ ID NO: 2274575 - RNA, 21 nt, Human
cgggugaacaaagcagccacg

SEQ ID NO: 2274576 - RNA, 22 nt, Human
cgggugugcaaugucugaguga

SEQ ID NO: 2274577 - RNA, 17 nt, Human
cggguugugugucuguu

SEQ ID NO: 2274578 - RNA, 16 nt, Human
cggguugugugucugu

SEQ ID NO: 2274579 - RNA, 16 nt, Human
cggguggggcuugggg

SEQ ID NO: 2274580 - RNA, 20 nt, Human
cggguggggcuuggggcuca

SEQ ID NO: 2274581 - RNA, 19 nt, Human
cgggugggcggcacagccu

SEQ ID NO: 2274582 - RNA, 12 nt, Human
cgggugggggug

SEQ ID NO: 2274583 - RNA, 23 nt, Human
cggguggggguggaauaaaauac

SEQ ID NO: 2274584 - RNA, 11 nt, Human
cgggucacagg

SEQ ID NO: 2274585 - RNA, 12 nt, Human
cgggguggagca

SEQ ID NO: 2274586 - RNA, 18 nt, Human
cgggguggugggaaccau

SEQ ID NO: 2274587 - RNA, 19 nt, Human
cgggucacaggagggaggg

SEQ ID NO: 2274588 - RNA, 15 nt, Human
cgggucaucuguacc

SEQ ID NO: 2274589 - RNA, 20 nt, Human
cgggugaacaaagcagccac

SEQ ID NO: 2274590 - RNA, 22 nt, Human
cgggucaucuguaccucugccu

SEQ ID NO: 2274591 - RNA, 13 nt, Human
cgggucugccucu

SEQ ID NO: 2274592 - RNA, 19 nt, Human
cgggguggugggaaccaug

SEQ ID NO: 2274593 - RNA, 14 nt, Human
cgguccacccagga

SEQ ID NO: 2274594 - RNA, 15 nt, Human
cgguccacccaggag

SEQ ID NO: 2274595 - RNA, 16 nt, Human
cgguccacccaggagc

SEQ ID NO: 2274596 - RNA, 20 nt, Human
cgguccacccaggagccccg

SEQ ID NO: 2274597 - RNA, 19 nt, Human
cggguuuggcgggccaagg

SEQ ID NO: 2274598 - RNA, 20 nt, Human
cgguaaaacaccggagacua

SEQ ID NO: 2274599 - RNA, 23 nt, Human
cggguuuggcgggccaaggacug

SEQ ID NO: 2274600 - RNA, 21 nt, Human
cggguuuuauuguuuaaaauc

SEQ ID NO: 2274601 - RNA, 21 nt, Human
cgguagccagcacacagggca

SEQ ID NO: 2274602 - RNA, 15 nt, Human
cgguagccagcacac

SEQ ID NO: 2274603 - RNA, 22 nt, Human
cgguagccagcacacagggcag

SEQ ID NO: 2274604 - RNA, 18 nt, Human
cgguagguucagccaagg

SEQ ID NO: 2274605 - RNA, 18 nt, Human
cgguauccccccaucuug

SEQ ID NO: 2274606 - RNA, 22 nt, Human
cgguauccccccaucuugcuuc

SEQ ID NO: 2274607 - RNA, 12 nt, Human
cgguacucccau

SEQ ID NO: 2274608 - RNA, 14 nt, Human
cgguauuaugcuuc

SEQ ID NO: 2274609 - RNA, 11 nt, Human
cggcagagagg

SEQ ID NO: 2274610 - RNA, 13 nt, Human
cggcagagaggac

SEQ ID NO: 2274611 - RNA, 13 nt, Human
cggcagcagccau

SEQ ID NO: 2274612 - RNA, 14 nt, Human
cggcagcagccauc

SEQ ID NO: 2274613 - RNA, 15 nt, Human
cggcacccacccagc

SEQ ID NO: 2274614 - RNA, 20 nt, Human
cggcacccacaagugccacu

SEQ ID NO: 2274615 - RNA, 14 nt, Human
cggaauaguuggcu

SEQ ID NO: 2274616 - RNA, 21 nt, Human
cggcacagggucugcucuuuc

SEQ ID NO: 2274617 - RNA, 18 nt, Human
cggaaguuuucaaugaug

SEQ ID NO: 2274618 - RNA, 19 nt, Human
cgcuuuugcuggucacugc

SEQ ID NO: 2274619 - RNA, 21 nt, Human
cggaaaacgguggaggccagg

SEQ ID NO: 2274620 - RNA, 20 nt, Human
cggaaaagguuuuauuuugu

SEQ ID NO: 2274621 - RNA, 13 nt, Human
cggaagagccuug

SEQ ID NO: 2274622 - RNA, 18 nt, Human
cggaaggcuggcugggca

SEQ ID NO: 2274623 - RNA, 23 nt, Human
cggaagcagugccuuccauaauu

SEQ ID NO: 2274624 - RNA, 22 nt, Human
cggaagcagugccuuccauaau

SEQ ID NO: 2274625 - RNA, 20 nt, Human
cggaagcagugccuuccaua

SEQ ID NO: 2274626 - RNA, 14 nt, Human
cggaagcagugccu

SEQ ID NO: 2274627 - RNA, 20 nt, Human
cggaagccuuuuuccccaaa

SEQ ID NO: 2274628 - RNA, 12 nt, Human
cggaagggcaca

SEQ ID NO: 2274629 - RNA, 12 nt, Human
cggaaguuuuca

SEQ ID NO: 2274630 - RNA, 13 nt, Human
cggaaguuuucaa

SEQ ID NO: 2274631 - RNA, 21 nt, Human
cggcaggacaacgaggaagcc

SEQ ID NO: 2274632 - RNA, 13 nt, Human
cggcauggcuggg

SEQ ID NO: 2274633 - RNA, 14 nt, Human
cggcauggcuggga

SEQ ID NO: 2274634 - RNA, 21 nt, Human
cggcaugggaaagccaccucu

SEQ ID NO: 2274635 - RNA, 14 nt, Human
cggcauuccugcuu

SEQ ID NO: 2274636 - RNA, 22 nt, Human
cggcaugggaaagccaccucuc

SEQ ID NO: 2274637 - RNA, 15 nt, Human
cggcauuaaagccau

SEQ ID NO: 2274638 - RNA, 14 nt, Human
cggcauuucaaaug

SEQ ID NO: 2274639 - RNA, 11 nt, Human
cggccaccucu

SEQ ID NO: 2274640 - RNA, 11 nt, Human
cggccaccugc

SEQ ID NO: 2274641 - RNA, 15 nt, Human
cggccaccugcggug

SEQ ID NO: 2274642 - RNA, 16 nt, Human
cggccaccugcggugc

SEQ ID NO: 2274643 - RNA, 17 nt, Human
cggccaccugcggugcu

SEQ ID NO: 2274644 - RNA, 15 nt, Human
cggcccacagcuccc

SEQ ID NO: 2274645 - RNA, 22 nt, Human
cggcccaagcccgacuugcugu

SEQ ID NO: 2274646 - RNA, 22 nt, Human
cggcccacagcucccaccccac

SEQ ID NO: 2274647 - RNA, 19 nt, Human
cggcccacagcucccaccc

SEQ ID NO: 2274648 - RNA, 17 nt, Human
cggcccaggauggcuuu

SEQ ID NO: 2274649 - RNA, 13 nt, Human
cggccccugcugg

SEQ ID NO: 2274650 - RNA, 18 nt, Human
cggccccugcugguucag

SEQ ID NO: 2274651 - RNA, 19 nt, Human
cggccccugcugguucagg

SEQ ID NO: 2274652 - RNA, 12 nt, Human
cggcccacagcu

SEQ ID NO: 2274653 - RNA, 15 nt, Human
cggcccaagcccgac

SEQ ID NO: 2274654 - RNA, 16 nt, Human
cggcccaagcccgacu

SEQ ID NO: 2274655 - RNA, 16 nt, Human
cggccagggagaagcu

SEQ ID NO: 2274656 - RNA, 20 nt, Human
cggccagccccggcccuggg

SEQ ID NO: 2274657 - RNA, 13 nt, Human
cggccaggugggc

SEQ ID NO: 2274658 - RNA, 17 nt, Human
cggccagggagaagcuc

SEQ ID NO: 2274659 - RNA, 24 nt, Human
cggccaggccagagggagugacag

SEQ ID NO: 2274660 - RNA, 15 nt, Human
cggccagccaugucu

SEQ ID NO: 2274661 - RNA, 14 nt, Human
cggccacuggccau

SEQ ID NO: 2274662 - RNA, 16 nt, Human
cggccacuggccaucu

SEQ ID NO: 2274663 - RNA, 12 nt, Human
cggccaccucug

SEQ ID NO: 2274664 - RNA, 13 nt, Human
cggccaccucugc

SEQ ID NO: 2274665 - RNA, 14 nt, Human
cggccaccucugcg

SEQ ID NO: 2274666 - RNA, 23 nt, Human
cggcugagucaugaucucccugc

SEQ ID NO: 2274667 - RNA, 22 nt, Human
cggcugagucaugaucucccug

SEQ ID NO: 2274668 - RNA, 14 nt, Human
cggccucagcaccc

SEQ ID NO: 2274669 - RNA, 20 nt, Human
cggcugagucaugaucuccc

SEQ ID NO: 2274670 - RNA, 12 nt, Human
cggcugcagagg

SEQ ID NO: 2274671 - RNA, 15 nt, Human
cggcugcagaggcca

SEQ ID NO: 2274672 - RNA, 20 nt, Human
cggcugcagaggccagaggc

SEQ ID NO: 2274673 - RNA, 18 nt, Human
cggcugcagcucacccag

SEQ ID NO: 2274674 - RNA, 22 nt, Human
cggcugcagcucacccagcccc

SEQ ID NO: 2274675 - RNA, 12 nt, Human
cggcugcccuuu

SEQ ID NO: 2274676 - RNA, 11 nt, Human
cggcugcccuu

SEQ ID NO: 2274677 - RNA, 15 nt, Human
cggcuggacuuggag

SEQ ID NO: 2274678 - RNA, 11 nt, Human
cggcugcugag

SEQ ID NO: 2274679 - RNA, 18 nt, Human
cggcuggaaaugcugggc

SEQ ID NO: 2274680 - RNA, 20 nt, Human
cggcuggaaaugcugggcug

SEQ ID NO: 2274681 - RNA, 17 nt, Human
cggcuggagaccaugca

SEQ ID NO: 2274682 - RNA, 19 nt, Human
cggccgucuucacucgccc

SEQ ID NO: 2274683 - RNA, 23 nt, Human
cggccggccagccccuggcccca

SEQ ID NO: 2274684 - RNA, 16 nt, Human
cggccggccagccccu

SEQ ID NO: 2274685 - RNA, 14 nt, Human
cggccggccagccc

SEQ ID NO: 2274686 - RNA, 13 nt, Human
cggccgcuccagg

SEQ ID NO: 2274687 - RNA, 14 nt, Human
cggccgcuccaggg

SEQ ID NO: 2274688 - RNA, 15 nt, Human
cggccgcuccagggg

SEQ ID NO: 2274689 - RNA, 17 nt, Human
cggcccagcccggcucc

SEQ ID NO: 2274690 - RNA, 16 nt, Human
cggcccgaucuuucua

SEQ ID NO: 2274691 - RNA, 14 nt, Human
cggccuccauccug

SEQ ID NO: 2274692 - RNA, 12 nt, Human
cggccuccaucc

SEQ ID NO: 2274693 - RNA, 15 nt, Human
cuaacaccagacaga

SEQ ID NO: 2274694 - RNA, 17 nt, Human
cuaacacauuaucggga

SEQ ID NO: 2274695 - RNA, 13 nt, Human
cuaacaccagcgu

SEQ ID NO: 2274696 - RNA, 17 nt, Human
cuaacacagcaugugua

SEQ ID NO: 2274697 - RNA, 16 nt, Human
cuaacacagcaugugu

SEQ ID NO: 2274698 - RNA, 14 nt, Human
cuaacacagcaugu

SEQ ID NO: 2274699 - RNA, 16 nt, Human
cuaacacacagcuccc

SEQ ID NO: 2274700 - RNA, 15 nt, Human
cuaacacuauuuuau

SEQ ID NO: 2274701 - RNA, 16 nt, Human
cuaacacuauuuuaug

SEQ ID NO: 2274702 - RNA, 14 nt, Human
cuaacacccagucu

SEQ ID NO: 2274703 - RNA, 21 nt, Human
cuaacaccagcguuugagggg

SEQ ID NO: 2274704 - RNA, 22 nt, Human
cuaacaaucagcuccuuccugg

SEQ ID NO: 2274705 - RNA, 13 nt, Human
cuaacaaugacau

SEQ ID NO: 2274706 - RNA, 15 nt, Human
cuaacaaugacauuu

SEQ ID NO: 2274707 - RNA, 15 nt, Human
cuaacacacagcucc

SEQ ID NO: 2274708 - RNA, 23 nt, Human
cuaaauuugaauguuaagcagau

SEQ ID NO: 2274709 - RNA, 14 nt, Human
cuaacacuggcccc

SEQ ID NO: 2274710 - RNA, 13 nt, Human
cuaacacuggccc

SEQ ID NO: 2274711 - RNA, 15 nt, Human
cuaacacuggccccu

SEQ ID NO: 2274712 - RNA, 15 nt, Human
cuaacaugauuuggg

SEQ ID NO: 2274713 - RNA, 15 nt, Human
cuaacauggaaguac

SEQ ID NO: 2274714 - RNA, 17 nt, Human
cuaacauggaaguacua

SEQ ID NO: 2274715 - RNA, 21 nt, Human
cuaaauggucgcccaggagac

SEQ ID NO: 2274716 - RNA, 20 nt, Human
cuaaauggucgcccaggaga

SEQ ID NO: 2274717 - RNA, 15 nt, Human
cuaaaugcugaaaaa

SEQ ID NO: 2274718 - RNA, 14 nt, Human
cuaaauguaacagu

SEQ ID NO: 2274719 - RNA, 15 nt, Human
cuaaauguaacaguc

SEQ ID NO: 2274720 - RNA, 16 nt, Human
cuaaauguaacagucu

SEQ ID NO: 2274721 - RNA, 19 nt, Human
cuaaauggucgcccaggag

SEQ ID NO: 2274722 - RNA, 18 nt, Human
cuaaauggucgcccagga

SEQ ID NO: 2274723 - RNA, 17 nt, Human
cuaaauggccucaugug

SEQ ID NO: 2274724 - RNA, 19 nt, Human
cuaaauggccucauguggc

SEQ ID NO: 2274725 - RNA, 16 nt, Human
cuaaauguugaaagau

SEQ ID NO: 2274726 - RNA, 18 nt, Human
cuaaauguaacagucuga

SEQ ID NO: 2274727 - RNA, 19 nt, Human
cuaaauguaacagucugau

SEQ ID NO: 2274728 - RNA, 21 nt, Human
cuaaauguggagaaacuguag

SEQ ID NO: 2274729 - RNA, 14 nt, Human
cuaaauuguaaacu

SEQ ID NO: 2274730 - RNA, 18 nt, Human
cuaaauuguaaacuccug

SEQ ID NO: 2274731 - RNA, 19 nt, Human
cuaaauuacaauugucauu

SEQ ID NO: 2274732 - RNA, 23 nt, Human
cuaaauugacacuuaaaaauggu

SEQ ID NO: 2274733 - RNA, 22 nt, Human
cuaaaugcauauccugagccau

SEQ ID NO: 2274734 - RNA, 12 nt, Human
cuaaauggccuc

SEQ ID NO: 2274735 - RNA, 13 nt, Human
cuaaauggccuca

SEQ ID NO: 2274736 - RNA, 16 nt, Human
cuaaauggccucaugu

SEQ ID NO: 2274737 - RNA, 18 nt, Human
cuaaauggaaccacucua

SEQ ID NO: 2274738 - RNA, 17 nt, Human
cuaaauggaaccacucu

SEQ ID NO: 2274739 - RNA, 16 nt, Human
cuaaauggaaccacuc

SEQ ID NO: 2274740 - RNA, 21 nt, Human
cuaaaugcauauccugagcca

SEQ ID NO: 2274741 - RNA, 16 nt, Human
cuaaaugaauguuuac

SEQ ID NO: 2274742 - RNA, 15 nt, Human
cuaaauggaaccacu

SEQ ID NO: 2274743 - RNA, 20 nt, Human
cuaaaucuccaaaauaaaac

SEQ ID NO: 2274744 - RNA, 15 nt, Human
cuaaaugaauguuua

SEQ ID NO: 2274745 - RNA, 16 nt, Human
cuaaaucuagacucaa

SEQ ID NO: 2274746 - RNA, 15 nt, Human
cuaaauauuuccuua

SEQ ID NO: 2274747 - RNA, 22 nt, Human
cuaaauauuuccuuaaacugug

SEQ ID NO: 2274748 - RNA, 14 nt, Human
cuaaauauuuccuu

SEQ ID NO: 2274749 - RNA, 13 nt, Human
cuaaauauuuccu

SEQ ID NO: 2274750 - RNA, 17 nt, Human
cuaaauccuuuacuguu

SEQ ID NO: 2274751 - RNA, 21 nt, Human
cuaaauccuuuacuguuaguc

SEQ ID NO: 2274752 - RNA, 18 nt, Human
cuaaauauauuuuaagac

SEQ ID NO: 2274753 - RNA, 20 nt, Human
cuaaauauauuuuaagacga

SEQ ID NO: 2274754 - RNA, 17 nt, Human
cuaaauauauuuuaaga

SEQ ID NO: 2274755 - RNA, 17 nt, Human
cuaaacggauuccaaag

SEQ ID NO: 2274756 - RNA, 16 nt, Human
cuaaacggauuccaaa

SEQ ID NO: 2274757 - RNA, 15 nt, Human
cuaaacggauuccaa

SEQ ID NO: 2274758 - RNA, 23 nt, Human
cguuuacaagcccccccuuccac

SEQ ID NO: 2274759 - RNA, 14 nt, Human
cguuuacuaugccu

SEQ ID NO: 2274760 - RNA, 17 nt, Human
cguuuacuaugccugug

SEQ ID NO: 2274761 - RNA, 22 nt, Human
cuaaaaauauuauaacuuaaaa

SEQ ID NO: 2274762 - RNA, 22 nt, Human
cuaaaacuaaauagcauguauu

SEQ ID NO: 2274763 - RNA, 16 nt, Human
cuaaaacuaaauagca

SEQ ID NO: 2274764 - RNA, 17 nt, Human
cuaaaacaauaaaauuu

SEQ ID NO: 2274765 - RNA, 15 nt, Human
cuaaaaccugagcua

SEQ ID NO: 2274766 - RNA, 22 nt, Human
cuaaaaccugagcuagaagcug

SEQ ID NO: 2274767 - RNA, 13 nt, Human
cuaaaaaugcaac

SEQ ID NO: 2274768 - RNA, 22 nt, Human
cuaaaaaugggacuucuuuuca

SEQ ID NO: 2274769 - RNA, 12 nt, Human
cuaaaacaauaa

SEQ ID NO: 2274770 - RNA, 20 nt, Human
cuaaaacaaaagcucaucca

SEQ ID NO: 2274771 - RNA, 22 nt, Human
cguuuaagacuguaaugaaucu

SEQ ID NO: 2274772 - RNA, 13 nt, Human
cguugucucccug

SEQ ID NO: 2274773 - RNA, 16 nt, Human
cguugucucccuggcc

SEQ ID NO: 2274774 - RNA, 17 nt, Human
cguugucucccuggccc

SEQ ID NO: 2274775 - RNA, 18 nt, Human
cguugucucccuggcccu

SEQ ID NO: 2274776 - RNA, 11 nt, Human
cguugugaggg

SEQ ID NO: 2274777 - RNA, 18 nt, Human
cguuguuuacuuaaagau

SEQ ID NO: 2274778 - RNA, 20 nt, Human
cguuguuuacuuaaagauuu

SEQ ID NO: 2274779 - RNA, 16 nt, Human
cguuggagaagcccgu

SEQ ID NO: 2274780 - RNA, 21 nt, Human
cguugggccccagccuucuuu

SEQ ID NO: 2274781 - RNA, 23 nt, Human
cguugcugugggaacgagagggg

SEQ ID NO: 2274782 - RNA, 14 nt, Human
cguuguaaaauaua

SEQ ID NO: 2274783 - RNA, 21 nt, Human
cguuguaaaauauagcuguac

SEQ ID NO: 2274784 - RNA, 24 nt, Human
cguuguaaaauauagcuguacaaa

SEQ ID NO: 2274785 - RNA, 21 nt, Human
cuaaacgagucaauccccuca

SEQ ID NO: 2274786 - RNA, 20 nt, Human
cuaaacgagucaauccccuc

SEQ ID NO: 2274787 - RNA, 18 nt, Human
cuaaaccuuaguacugag

SEQ ID NO: 2274788 - RNA, 19 nt, Human
cuaaaccuuaguacugagu

SEQ ID NO: 2274789 - RNA, 16 nt, Human
cuaaacccaauccaaa

SEQ ID NO: 2274790 - RNA, 17 nt, Human
cuaaaccuuaguacuga

SEQ ID NO: 2274791 - RNA, 19 nt, Human
cuaaacccaauccaaaugg

SEQ ID NO: 2274792 - RNA, 15 nt, Human
cuaaacccaauccaa

SEQ ID NO: 2274793 - RNA, 19 nt, Human
cuaaacaaugcugauuugg

SEQ ID NO: 2274794 - RNA, 16 nt, Human
cuaaacagacuauuua

SEQ ID NO: 2274795 - RNA, 18 nt, Human
cuaaacagacuauuuaac

SEQ ID NO: 2274796 - RNA, 12 nt, Human
cuaaacagauau

SEQ ID NO: 2274797 - RNA, 18 nt, Human
cuaaacauccaauauuuu

SEQ ID NO: 2274798 - RNA, 13 nt, Human
cuaaacagauaua

SEQ ID NO: 2274799 - RNA, 17 nt, Human
cuaaacagauauaaaug

SEQ ID NO: 2274800 - RNA, 17 nt, Human
cuaaacauuuuguuauu

SEQ ID NO: 2274801 - RNA, 19 nt, Human
cuaaacaagaaucagucua

SEQ ID NO: 2274802 - RNA, 23 nt, Human
cuaaaauuugcccucccaucccg

SEQ ID NO: 2274803 - RNA, 17 nt, Human
cuaaaauuuuuaaggac

SEQ ID NO: 2274804 - RNA, 21 nt, Human
cuaaacaagaaucagucuauc

SEQ ID NO: 2274805 - RNA, 14 nt, Human
cuaaacaagauuuu

SEQ ID NO: 2274806 - RNA, 22 nt, Human
cuaaacaagauuuuaaagacau

SEQ ID NO: 2274807 - RNA, 23 nt, Human
cuaaacaagauuuuaaagacaug

SEQ ID NO: 2274808 - RNA, 18 nt, Human
cuaaaauuccacugcguu

SEQ ID NO: 2274809 - RNA, 21 nt, Human
cuaaaauuugcccucccaucc

SEQ ID NO: 2274810 - RNA, 18 nt, Human
cuaaaagagauuucaaga

SEQ ID NO: 2274811 - RNA, 16 nt, Human
cuaaaagauauaagug

SEQ ID NO: 2274812 - RNA, 14 nt, Human
cgugcagcauauga

SEQ ID NO: 2274813 - RNA, 17 nt, Human
cgugcagacuggagggg

SEQ ID NO: 2274814 - RNA, 16 nt, Human
cgugcagacuggaggg

SEQ ID NO: 2274815 - RNA, 22 nt, Human
cgugcaguggugcgaucugggu

SEQ ID NO: 2274816 - RNA, 21 nt, Human
cgugcaguggugcgaucuggg

SEQ ID NO: 2274817 - RNA, 13 nt, Human
cgugcaugugcac

SEQ ID NO: 2274818 - RNA, 21 nt, Human
cgugcauuggaagaccccacc

SEQ ID NO: 2274819 - RNA, 22 nt, Human
cgugcauuggaagaccccaccc

SEQ ID NO: 2274820 - RNA, 23 nt, Human
cgugcauaccacuuuuguucuug

SEQ ID NO: 2274821 - RNA, 21 nt, Human
cgugcauugugcuucuuucuu

SEQ ID NO: 2274822 - RNA, 12 nt, Human
cgugcauugugc

SEQ ID NO: 2274823 - RNA, 15 nt, Human
cgugcauugugcuuc

SEQ ID NO: 2274824 - RNA, 22 nt, Human
cgugcacguggagagcuggugc

SEQ ID NO: 2274825 - RNA, 21 nt, Human
cgugcacguggagagcuggug

SEQ ID NO: 2274826 - RNA, 20 nt, Human
cgugcacguggagagcuggu

SEQ ID NO: 2274827 - RNA, 17 nt, Human
cgugcacguggagagcu

SEQ ID NO: 2274828 - RNA, 18 nt, Human
cgugaaaacggagcugaa

SEQ ID NO: 2274829 - RNA, 18 nt, Human
cgugcacacaccagagcc

SEQ ID NO: 2274830 - RNA, 19 nt, Human
cgugcacacaccagagccc

SEQ ID NO: 2274831 - RNA, 16 nt, Human
cgugcacacaccagag

SEQ ID NO: 2274832 - RNA, 17 nt, Human
cgugaaaacggagcuga

SEQ ID NO: 2274833 - RNA, 16 nt, Human
cgugaaaacggagcug

SEQ ID NO: 2274834 - RNA, 15 nt, Human
cgugaaaacggagcu

SEQ ID NO: 2274835 - RNA, 10 nt, Human
cgucuuugca

SEQ ID NO: 2274836 - RNA, 15 nt, Human
cgucuucagccuagc

SEQ ID NO: 2274837 - RNA, 19 nt, Human
cgucuucuguauacugugg

SEQ ID NO: 2274838 - RNA, 23 nt, Human
cgucuucauuaagcccucuucca

SEQ ID NO: 2274839 - RNA, 17 nt, Human
cgucuugcuugggaagg

SEQ ID NO: 2274840 - RNA, 12 nt, Human
cgucuucauuaa

SEQ ID NO: 2274841 - RNA, 14 nt, Human
cgucuugcuuggga

SEQ ID NO: 2274842 - RNA, 19 nt, Human
cgucuugcuugggaagggg

SEQ ID NO: 2274843 - RNA, 20 nt, Human
cgucugacaggcaaugcugg

SEQ ID NO: 2274844 - RNA, 21 nt, Human
cgucugacaggcaaugcuggc

SEQ ID NO: 2274845 - RNA, 14 nt, Human
cgucuucagccuag

SEQ ID NO: 2274846 - RNA, 13 nt, Human
cgucuucagccua

SEQ ID NO: 2274847 - RNA, 15 nt, Human
cgucugacccucucc

SEQ ID NO: 2274848 - RNA, 20 nt, Human
cgucuuagcaagaaguaaaa

SEQ ID NO: 2274849 - RNA, 23 nt, Human
cgucuuagaaguggaccaggaca

SEQ ID NO: 2274850 - RNA, 22 nt, Human
cgucugacaggcaaugcuggcu

SEQ ID NO: 2274851 - RNA, 20 nt, Human
cggugccuggguggggcugc

SEQ ID NO: 2274852 - RNA, 19 nt, Human
cggugccuggguggggcug

SEQ ID NO: 2274853 - RNA, 23 nt, Human
cggugcccaagccagaggcuggg

SEQ ID NO: 2274854 - RNA, 22 nt, Human
cggugccuuuuuucacggaagu

SEQ ID NO: 2274855 - RNA, 18 nt, Human
cggugcuaucucccccag

SEQ ID NO: 2274856 - RNA, 20 nt, Human
cggugcuaucucccccagcc

SEQ ID NO: 2274857 - RNA, 21 nt, Human
cggugcuaucucccccagccc

SEQ ID NO: 2274858 - RNA, 22 nt, Human
cggugcuaucucccccagcccc

SEQ ID NO: 2274859 - RNA, 17 nt, Human
cgucucaaccccucaca

SEQ ID NO: 2274860 - RNA, 21 nt, Human
cgucuacucauuccccggggc

SEQ ID NO: 2274861 - RNA, 11 nt, Human
cgucucagugu

SEQ ID NO: 2274862 - RNA, 23 nt, Human
cgucucaaaaaaaaaaaaaugca

SEQ ID NO: 2274863 - RNA, 14 nt, Human
cgucuccaggggcu

SEQ ID NO: 2274864 - RNA, 19 nt, Human
cgucuccaggggcugcuuc

SEQ ID NO: 2274865 - RNA, 20 nt, Human
cgucuccaggggcugcuucc

SEQ ID NO: 2274866 - RNA, 21 nt, Human
cgucuccaggggcugcuuccu

SEQ ID NO: 2274867 - RNA, 16 nt, Human
cgucucauacucaccu

SEQ ID NO: 2274868 - RNA, 16 nt, Human
cgucuaccugaggggc

SEQ ID NO: 2274869 - RNA, 20 nt, Human
cguccugccaccuggggcag

SEQ ID NO: 2274870 - RNA, 16 nt, Human
cguccugccaccuggg

SEQ ID NO: 2274871 - RNA, 13 nt, Human
cguccugccugug

SEQ ID NO: 2274872 - RNA, 14 nt, Human
cguccugccaccug

SEQ ID NO: 2274873 - RNA, 16 nt, Human
cguccucgagcaacug

SEQ ID NO: 2274874 - RNA, 13 nt, Human
cguccugccaccu

SEQ ID NO: 2274875 - RNA, 15 nt, Human
cguccuccucuguga

SEQ ID NO: 2274876 - RNA, 14 nt, Human
cguccuccucugug

SEQ ID NO: 2274877 - RNA, 13 nt, Human
cguccuccucugu

SEQ ID NO: 2274878 - RNA, 12 nt, Human
cguccuccucug

SEQ ID NO: 2274879 - RNA, 14 nt, Human
cguccugucagugc

SEQ ID NO: 2274880 - RNA, 16 nt, Human
cguccugccuguggcg

SEQ ID NO: 2274881 - RNA, 14 nt, Human
cguccugccugugg

SEQ ID NO: 2274882 - RNA, 15 nt, Human
cguccugccuguggc

SEQ ID NO: 2274883 - RNA, 16 nt, Human
cguccugucagugccg

SEQ ID NO: 2274884 - RNA, 23 nt, Human
cguccuguccacacccagcucag

SEQ ID NO: 2274885 - RNA, 23 nt, Human
cguggggagggccguaccccacc

SEQ ID NO: 2274886 - RNA, 17 nt, Human
cgugggcucccugacug

SEQ ID NO: 2274887 - RNA, 12 nt, Human
cguggggcagca

SEQ ID NO: 2274888 - RNA, 11 nt, Human
cguggggaggu

SEQ ID NO: 2274889 - RNA, 18 nt, Human
cguggggcagcacagaga

SEQ ID NO: 2274890 - RNA, 18 nt, Human
cguugaagaggaagggca

SEQ ID NO: 2274891 - RNA, 16 nt, Human
cguugaggaugaggcc

SEQ ID NO: 2274892 - RNA, 19 nt, Human
cguugaggaugaggccgcu

SEQ ID NO: 2274893 - RNA, 17 nt, Human
cguugauguuggcuggg

SEQ ID NO: 2274894 - RNA, 18 nt, Human
cguugauguuggcuggga

SEQ ID NO: 2274895 - RNA, 12 nt, Human
cguugcaugucg

SEQ ID NO: 2274896 - RNA, 11 nt, Human
cguugcugugg

SEQ ID NO: 2274897 - RNA, 14 nt, Human
cguugcugugggaa

SEQ ID NO: 2274898 - RNA, 15 nt, Human
cguugcugugggaac

SEQ ID NO: 2274899 - RNA, 17 nt, Human
cgugggcggcagagagg

SEQ ID NO: 2274900 - RNA, 20 nt, Human
cgugggaggcgggaguggag

SEQ ID NO: 2274901 - RNA, 17 nt, Human
cgugggcggggccuugc

SEQ ID NO: 2274902 - RNA, 13 nt, Human
cgugggcucccug

SEQ ID NO: 2274903 - RNA, 22 nt, Human
cgugggaggcgggaguggagug

SEQ ID NO: 2274904 - RNA, 23 nt, Human
cgugggaaccccccucccaccca

SEQ ID NO: 2274905 - RNA, 22 nt, Human
cgugggagacaagaaaucccug

SEQ ID NO: 2274906 - RNA, 17 nt, Human
cgugggagagagacgug

SEQ ID NO: 2274907 - RNA, 17 nt, Human
cgugggagcgugggagg

SEQ ID NO: 2274908 - RNA, 22 nt, Human
cgugggaaccccccucccaccc

SEQ ID NO: 2274909 - RNA, 22 nt, Human
cguggccccagccuggcccagc

SEQ ID NO: 2274910 - RNA, 19 nt, Human
cgugggacggugcccaagc

SEQ ID NO: 2274911 - RNA, 20 nt, Human
cgugggacggugcccaagcc

SEQ ID NO: 2274912 - RNA, 20 nt, Human
cguggcuucccgcucagccc

SEQ ID NO: 2274913 - RNA, 21 nt, Human
cguggcuucccgcucagcccu

SEQ ID NO: 2274914 - RNA, 15 nt, Human
cguggcccagagaag

SEQ ID NO: 2274915 - RNA, 15 nt, Human
cguggccagcccggc

SEQ ID NO: 2274916 - RNA, 11 nt, Human
cguggccagcc

SEQ ID NO: 2274917 - RNA, 13 nt, Human
cguggccagcccg

SEQ ID NO: 2274918 - RNA, 19 nt, Human
cguggccagcccggcuggu

SEQ ID NO: 2274919 - RNA, 16 nt, Human
cguggcccagagaagc

SEQ ID NO: 2274920 - RNA, 12 nt, Human
cguggccccagc

SEQ ID NO: 2274921 - RNA, 13 nt, Human
cguggccccagcc

SEQ ID NO: 2274922 - RNA, 14 nt, Human
cguggccccagccu

SEQ ID NO: 2274923 - RNA, 15 nt, Human
cguggccccagccug

SEQ ID NO: 2274924 - RNA, 16 nt, Human
cguggccccagccugg

SEQ ID NO: 2274925 - RNA, 17 nt, Human
cguggccccagccuggc

SEQ ID NO: 2274926 - RNA, 18 nt, Human
cguggcuucccgcucagc

SEQ ID NO: 2274927 - RNA, 19 nt, Human
cguggcuucccgcucagcc

SEQ ID NO: 2274928 - RNA, 18 nt, Human
cguggccccagccuggcc

SEQ ID NO: 2274929 - RNA, 19 nt, Human
cguggccccagccuggccc

SEQ ID NO: 2274930 - RNA, 20 nt, Human
cguggccccagccuggccca

SEQ ID NO: 2274931 - RNA, 21 nt, Human
cguggccccagccuggcccag

SEQ ID NO: 2274932 - RNA, 13 nt, Human
cguggcaucaccu

SEQ ID NO: 2274933 - RNA, 16 nt, Human
cguggcauagcccaga

SEQ ID NO: 2274934 - RNA, 23 nt, Human
cguggcauagcccagacacagaa

SEQ ID NO: 2274935 - RNA, 16 nt, Human
cguggcauguggccug

SEQ ID NO: 2274936 - RNA, 19 nt, Human
cguggcauguggccugugg

SEQ ID NO: 2274937 - RNA, 20 nt, Human
cguggcauguggccuguggc

SEQ ID NO: 2274938 - RNA, 21 nt, Human
cguggcauguggccuguggcc

SEQ ID NO: 2274939 - RNA, 22 nt, Human
cguggcagauaaucagccucuu

SEQ ID NO: 2274940 - RNA, 21 nt, Human
cguggcagauaaucagccucu

SEQ ID NO: 2274941 - RNA, 20 nt, Human
cguggcagauaaucagccuc

SEQ ID NO: 2274942 - RNA, 17 nt, Human
cguggauugcacguggc

SEQ ID NO: 2274943 - RNA, 22 nt, Human
cguggaggagcagugcaggcac

SEQ ID NO: 2274944 - RNA, 20 nt, Human
cguggaacguuuuuccuguu

SEQ ID NO: 2274945 - RNA, 21 nt, Human
cguggaaagggugcugcuucc

SEQ ID NO: 2274946 - RNA, 15 nt, Human
cguggaaagggugcu

SEQ ID NO: 2274947 - RNA, 13 nt, Human
cguggacucugca

SEQ ID NO: 2274948 - RNA, 16 nt, Human
cguggacucugcacau

SEQ ID NO: 2274949 - RNA, 14 nt, Human
cguggaccuuccug

SEQ ID NO: 2274950 - RNA, 15 nt, Human
cguggaccuuccugc

SEQ ID NO: 2274951 - RNA, 17 nt, Human
cguggaccuuccugcca

SEQ ID NO: 2274952 - RNA, 20 nt, Human
cguggacuccagacucucug

SEQ ID NO: 2274953 - RNA, 16 nt, Human
cguggacaggugugcc

SEQ ID NO: 2274954 - RNA, 22 nt, Human
cguggaggaaugcucccccauc

SEQ ID NO: 2274955 - RNA, 16 nt, Human
cguggaggagcagugc

SEQ ID NO: 2274956 - RNA, 17 nt, Human
cguggaggaggaaggca

SEQ ID NO: 2274957 - RNA, 18 nt, Human
cguggaggaaugcucccc

SEQ ID NO: 2274958 - RNA, 14 nt, Human
cguggagcugccug

SEQ ID NO: 2274959 - RNA, 15 nt, Human
cguggagcugccuga

SEQ ID NO: 2274960 - RNA, 17 nt, Human
cguggagcagaaucagu

SEQ ID NO: 2274961 - RNA, 18 nt, Human
cguggagcagaaucagua

SEQ ID NO: 2274962 - RNA, 21 nt, Human
cguggagagggaugaggugcu

SEQ ID NO: 2274963 - RNA, 13 nt, Human
cguggagagggau

SEQ ID NO: 2274964 - RNA, 15 nt, Human
cguggagaugucuuc

SEQ ID NO: 2274965 - RNA, 16 nt, Human
cguggagaugucuucg

SEQ ID NO: 2274966 - RNA, 20 nt, Human
cguggagagcuggugcccgg

SEQ ID NO: 2274967 - RNA, 12 nt, Human
cguggagaggga

SEQ ID NO: 2274968 - RNA, 17 nt, Human
cguggagagcuggugcc

SEQ ID NO: 2274969 - RNA, 22 nt, Human
cguggacuuggggucagagacu

SEQ ID NO: 2274970 - RNA, 22 nt, Human
cguggacuccagacucucugug

SEQ ID NO: 2274971 - RNA, 15 nt, Human
cguggaacguuuuuc

SEQ ID NO: 2274972 - RNA, 22 nt, Human
cgugcuuguuugcucaccuggg

SEQ ID NO: 2274973 - RNA, 14 nt, Human
cgugcuuccucagu

SEQ ID NO: 2274974 - RNA, 18 nt, Human
cgugcuuagccuccugac

SEQ ID NO: 2274975 - RNA, 20 nt, Human
cgugcuuagccuccugaccu

SEQ ID NO: 2274976 - RNA, 16 nt, Human
cgugcugacagcugcu

SEQ ID NO: 2274977 - RNA, 17 nt, Human
cgugcugacagcugcuc

SEQ ID NO: 2274978 - RNA, 15 nt, Human
cgugcugacagcugc

SEQ ID NO: 2274979 - RNA, 14 nt, Human
cgugcuaaauuuuc

SEQ ID NO: 2274980 - RNA, 16 nt, Human
cgugcuccagccuggc

SEQ ID NO: 2274981 - RNA, 17 nt, Human
cgugcuccagccuggcu

SEQ ID NO: 2274982 - RNA, 18 nt, Human
cgugcuccagccuggcuc

SEQ ID NO: 2274983 - RNA, 19 nt, Human
cgugcucgccccagcaggu

SEQ ID NO: 2274984 - RNA, 20 nt, Human
cgugccagucgcgcugccug

SEQ ID NO: 2274985 - RNA, 23 nt, Human
cgugcuacccccaugcuggaggu

SEQ ID NO: 2274986 - RNA, 19 nt, Human
cgugccaggcccggggcug

SEQ ID NO: 2274987 - RNA, 17 nt, Human
cgugccagucgcgcugc

SEQ ID NO: 2274988 - RNA, 23 nt, Human
cgugccuuuugcaccccucccau

SEQ ID NO: 2274989 - RNA, 13 nt, Human
cgugccaggcccg

SEQ ID NO: 2274990 - RNA, 18 nt, Human
cucaacuagcagauacag

SEQ ID NO: 2274991 - RNA, 19 nt, Human
cucaacucuccuccagagu

SEQ ID NO: 2274992 - RNA, 23 nt, Human
cucaacugccuacuccaaaaugu

SEQ ID NO: 2274993 - RNA, 15 nt, Human
cucaacugccuacuc

SEQ ID NO: 2274994 - RNA, 13 nt, Human
cucaacugccuac

SEQ ID NO: 2274995 - RNA, 19 nt, Human
cucaagagggcacuggugg

SEQ ID NO: 2274996 - RNA, 21 nt, Human
cucaagagggcacugguggcc

SEQ ID NO: 2274997 - RNA, 16 nt, Human
cucaagaggcugaggc

SEQ ID NO: 2274998 - RNA, 14 nt, Human
cucaagaggcugag

SEQ ID NO: 2274999 - RNA, 17 nt, Human
cucaagagggcacuggu

SEQ ID NO: 2275000 - RNA, 19 nt, Human
cucaaggacuugaaagcau

SEQ ID NO: 2275001 - RNA, 18 nt, Human
cucaaggacuugaaagca

SEQ ID NO: 2275002 - RNA, 15 nt, Human
cucaaggacuugaaa

SEQ ID NO: 2275003 - RNA, 14 nt, Human
cucaaggaaagggg

SEQ ID NO: 2275004 - RNA, 10 nt, Human
cucaaggacu

SEQ ID NO: 2275005 - RNA, 17 nt, Human
cucaaggaaaggccuga

SEQ ID NO: 2275006 - RNA, 23 nt, Human
cucaaggaauaaugggcuuagag

SEQ ID NO: 2275007 - RNA, 17 nt, Human
cucaagcugcaucuaga

SEQ ID NO: 2275008 - RNA, 17 nt, Human
cucaagaggcugaggca

SEQ ID NO: 2275009 - RNA, 17 nt, Human
cucaagauacugcuacu

SEQ ID NO: 2275010 - RNA, 22 nt, Human
cucaagauacugcuacuguaau

SEQ ID NO: 2275011 - RNA, 21 nt, Human
cucaagauacugcuacuguaa

SEQ ID NO: 2275012 - RNA, 17 nt, Human
cucaagaucaaugaaau

SEQ ID NO: 2275013 - RNA, 18 nt, Human
cucaagaucaaugaaaug

SEQ ID NO: 2275014 - RNA, 22 nt, Human
cucaagcccugcagucacagcu

SEQ ID NO: 2275015 - RNA, 16 nt, Human
cucaagaugaaggcaa

SEQ ID NO: 2275016 - RNA, 17 nt, Human
cucaagcgauucuccug

SEQ ID NO: 2275017 - RNA, 16 nt, Human
cucaagcgauucuccu

SEQ ID NO: 2275018 - RNA, 13 nt, Human
cucaaccugugau

SEQ ID NO: 2275019 - RNA, 21 nt, Human
cucaaccugugaugaggggag

SEQ ID NO: 2275020 - RNA, 21 nt, Human
cucaaccucuucuggcucaaa

SEQ ID NO: 2275021 - RNA, 18 nt, Human
cucaacguugcuccccau

SEQ ID NO: 2275022 - RNA, 17 nt, Human
cucaacguuacauuuuu

SEQ ID NO: 2275023 - RNA, 16 nt, Human
cucaacguauuguuuc

SEQ ID NO: 2275024 - RNA, 15 nt, Human
cucaacguauuguuu

SEQ ID NO: 2275025 - RNA, 20 nt, Human
cucaacucuccuccagaguc

SEQ ID NO: 2275026 - RNA, 21 nt, Human
cucaacucuccuccagaguca

SEQ ID NO: 2275027 - RNA, 23 nt, Human
cucaaauuaaucuuucuuuaccu

SEQ ID NO: 2275028 - RNA, 12 nt, Human
cucaaccucuuc

SEQ ID NO: 2275029 - RNA, 20 nt, Human
cucaaccucuucuggcucaa

SEQ ID NO: 2275030 - RNA, 18 nt, Human
cucaaccucuucuggcuc

SEQ ID NO: 2275031 - RNA, 14 nt, Human
cucaaccucuucug

SEQ ID NO: 2275032 - RNA, 13 nt, Human
cucaaccucuucu

SEQ ID NO: 2275033 - RNA, 21 nt, Human
cucaaauggggccagauccag

SEQ ID NO: 2275034 - RNA, 20 nt, Human
cucaaauggggccagaucca

SEQ ID NO: 2275035 - RNA, 19 nt, Human
cucaaauggggccagaucc

SEQ ID NO: 2275036 - RNA, 16 nt, Human
cucaaauuaaucuuuc

SEQ ID NO: 2275037 - RNA, 17 nt, Human
cuauuuuggauuguaua

SEQ ID NO: 2275038 - RNA, 12 nt, Human
cuauuuuguaaa

SEQ ID NO: 2275039 - RNA, 22 nt, Human
cucaaaugcucagaccagcucu

SEQ ID NO: 2275040 - RNA, 15 nt, Human
cucaaauggggccag

SEQ ID NO: 2275041 - RNA, 17 nt, Human
cucaaauggggccagau

SEQ ID NO: 2275042 - RNA, 16 nt, Human
cucaaauggggccaga

SEQ ID NO: 2275043 - RNA, 18 nt, Human
cuauuuucauuguaaaac

SEQ ID NO: 2275044 - RNA, 16 nt, Human
cuauuuucauuuucug

SEQ ID NO: 2275045 - RNA, 18 nt, Human
cuauuuugaaaaauuccu

SEQ ID NO: 2275046 - RNA, 23 nt, Human
cuauuuguuuucuucuguauguu

SEQ ID NO: 2275047 - RNA, 21 nt, Human
cuaugagaauugggauuacau

SEQ ID NO: 2275048 - RNA, 12 nt, Human
cuauuuuauucc

SEQ ID NO: 2275049 - RNA, 22 nt, Human
cuauuuuaauaaacacucuuga

SEQ ID NO: 2275050 - RNA, 17 nt, Human
cuauuugucuuucagga

SEQ ID NO: 2275051 - RNA, 22 nt, Human
cuauuuguugaugcuuguguca

SEQ ID NO: 2275052 - RNA, 16 nt, Human
cuauuuguuuucaugg

SEQ ID NO: 2275053 - RNA, 18 nt, Human
cuauuuuaauaaacacuc

SEQ ID NO: 2275054 - RNA, 12 nt, Human
cuauuuggaauu

SEQ ID NO: 2275055 - RNA, 16 nt, Human
cuauuuggaauuuaua

SEQ ID NO: 2275056 - RNA, 22 nt, Human
cuauuugccaugggcuucacug

SEQ ID NO: 2275057 - RNA, 23 nt, Human
cuauuugccaugggcuucacugu

SEQ ID NO: 2275058 - RNA, 14 nt, Human
cuaugcauuugaaa

SEQ ID NO: 2275059 - RNA, 16 nt, Human
cucaccccccacacuc

SEQ ID NO: 2275060 - RNA, 19 nt, Human
cucaccccccacacucacu

SEQ ID NO: 2275061 - RNA, 20 nt, Human
cucaccccccacacucacuc

SEQ ID NO: 2275062 - RNA, 16 nt, Human
cucacccaugugccaa

SEQ ID NO: 2275063 - RNA, 14 nt, Human
cucaccccagcccc

SEQ ID NO: 2275064 - RNA, 12 nt, Human
cucaccccagcc

SEQ ID NO: 2275065 - RNA, 13 nt, Human
cucaccccagccc

SEQ ID NO: 2275066 - RNA, 16 nt, Human
cucaccccgucugggg

SEQ ID NO: 2275067 - RNA, 21 nt, Human
cucacccccucgggucuccuc

SEQ ID NO: 2275068 - RNA, 13 nt, Human
cucaccccggcag

SEQ ID NO: 2275069 - RNA, 21 nt, Human
cucacccccuucuccauccac

SEQ ID NO: 2275070 - RNA, 17 nt, Human
cucaccccugcccuggg

SEQ ID NO: 2275071 - RNA, 16 nt, Human
cucaccccugcccugg

SEQ ID NO: 2275072 - RNA, 15 nt, Human
cucaccccugcccug

SEQ ID NO: 2275073 - RNA, 15 nt, Human
cucaccccgucuggg

SEQ ID NO: 2275074 - RNA, 14 nt, Human
cucaccccugguuc

SEQ ID NO: 2275075 - RNA, 17 nt, Human
cucaccccugguucuca

SEQ ID NO: 2275076 - RNA, 20 nt, Human
cucacccccuucuccaucca

SEQ ID NO: 2275077 - RNA, 19 nt, Human
cucacccccuucuccaucc

SEQ ID NO: 2275078 - RNA, 17 nt, Human
cucacccccuucuccau

SEQ ID NO: 2275079 - RNA, 16 nt, Human
cucacccccuucucca

SEQ ID NO: 2275080 - RNA, 13 nt, Human
cucacccccucgg

SEQ ID NO: 2275081 - RNA, 14 nt, Human
cucacccccucggg

SEQ ID NO: 2275082 - RNA, 15 nt, Human
cucacccccuucucc

SEQ ID NO: 2275083 - RNA, 18 nt, Human
cucaccccugcccuggga

SEQ ID NO: 2275084 - RNA, 13 nt, Human
cucaccccugucc

SEQ ID NO: 2275085 - RNA, 15 nt, Human
cucaccccuguccuc

SEQ ID NO: 2275086 - RNA, 18 nt, Human
cucaccccuguccucacu

SEQ ID NO: 2275087 - RNA, 19 nt, Human
cucaccccuguccucacug

SEQ ID NO: 2275088 - RNA, 20 nt, Human
cucaccccuguccucacugc

SEQ ID NO: 2275089 - RNA, 21 nt, Human
cucaccccuguccucacugcu

SEQ ID NO: 2275090 - RNA, 22 nt, Human
cucaccccuguccucacugcuc

SEQ ID NO: 2275091 - RNA, 19 nt, Human
cucaccccugguucucauc

SEQ ID NO: 2275092 - RNA, 20 nt, Human
cucaccccugguucucaucu

SEQ ID NO: 2275093 - RNA, 21 nt, Human
cucaccccugguucucaucuu

SEQ ID NO: 2275094 - RNA, 23 nt, Human
cucaccccugguucucaucuuuc

SEQ ID NO: 2275095 - RNA, 16 nt, Human
cucacuaggcuucugg

SEQ ID NO: 2275096 - RNA, 13 nt, Human
cucacuaggcuuc

SEQ ID NO: 2275097 - RNA, 17 nt, Human
cucaccccuugccauaa

SEQ ID NO: 2275098 - RNA, 16 nt, Human
cucacuauguugccca

SEQ ID NO: 2275099 - RNA, 17 nt, Human
cucacuauguugcccag

SEQ ID NO: 2275100 - RNA, 21 nt, Human
cucacuaucccggcugcccuu

SEQ ID NO: 2275101 - RNA, 20 nt, Human
cucacuaucccggcugcccu

SEQ ID NO: 2275102 - RNA, 20 nt, Human
cucacuaggcuucugguuga

SEQ ID NO: 2275103 - RNA, 17 nt, Human
cucacuauaccaguaua

SEQ ID NO: 2275104 - RNA, 23 nt, Human
cucacuaggcccccacuugccuc

SEQ ID NO: 2275105 - RNA, 23 nt, Human
cucacauggugcuacgccugcau

SEQ ID NO: 2275106 - RNA, 22 nt, Human
cucacaugucaguaccuucaaa

SEQ ID NO: 2275107 - RNA, 20 nt, Human
cucaccagccccagugccca

SEQ ID NO: 2275108 - RNA, 21 nt, Human
cucaccagccccagugcccac

SEQ ID NO: 2275109 - RNA, 20 nt, Human
cucacauagcuuacaagcca

SEQ ID NO: 2275110 - RNA, 22 nt, Human
cucacaguuccucgcccugggu

SEQ ID NO: 2275111 - RNA, 21 nt, Human
cucacaguuccucgcccuggg

SEQ ID NO: 2275112 - RNA, 20 nt, Human
cucacaucuuucacacuucc

SEQ ID NO: 2275113 - RNA, 23 nt, Human
cucacaguuccucgcccuggguc

SEQ ID NO: 2275114 - RNA, 21 nt, Human
cucacauggugcuacgccugc

SEQ ID NO: 2275115 - RNA, 19 nt, Human
cucaccagccccagugccc

SEQ ID NO: 2275116 - RNA, 13 nt, Human
cucacauuuauau

SEQ ID NO: 2275117 - RNA, 20 nt, Human
cucaaggacuugaaagcauc

SEQ ID NO: 2275118 - RNA, 15 nt, Human
cucaaggccucccac

SEQ ID NO: 2275119 - RNA, 16 nt, Human
cucaaggccucccaca

SEQ ID NO: 2275120 - RNA, 17 nt, Human
cucaaggccucccacag

SEQ ID NO: 2275121 - RNA, 16 nt, Human
cucaaggacuuugcag

SEQ ID NO: 2275122 - RNA, 22 nt, Human
cucaaggacuuugcagccggca

SEQ ID NO: 2275123 - RNA, 18 nt, Human
cucaagugauucuccugc

SEQ ID NO: 2275124 - RNA, 19 nt, Human
cucaagugauucuccugcc

SEQ ID NO: 2275125 - RNA, 20 nt, Human
cucaagugauucuccugccu

SEQ ID NO: 2275126 - RNA, 20 nt, Human
cucacagucucuuuaaucuu

SEQ ID NO: 2275127 - RNA, 18 nt, Human
cucacagugggagccagg

SEQ ID NO: 2275128 - RNA, 19 nt, Human
cucacagucucuuuaaucu

SEQ ID NO: 2275129 - RNA, 18 nt, Human
cucaaggccucccacagu

SEQ ID NO: 2275130 - RNA, 23 nt, Human
cucacaguccuuaccagcagagc

SEQ ID NO: 2275131 - RNA, 21 nt, Human
cucacaguguugcccaggcug

SEQ ID NO: 2275132 - RNA, 17 nt, Human
cucacaguguugcccag

SEQ ID NO: 2275133 - RNA, 19 nt, Human
cucacagugggagccaggg

SEQ ID NO: 2275134 - RNA, 22 nt, Human
cucacagugggagccagggcug

SEQ ID NO: 2275135 - RNA, 20 nt, Human
cucacaguuccucgcccugg

SEQ ID NO: 2275136 - RNA, 19 nt, Human
cucacaguuccucgcccug

SEQ ID NO: 2275137 - RNA, 18 nt, Human
cucacaguuccucgcccu

SEQ ID NO: 2275138 - RNA, 17 nt, Human
cucacaguuccucgccc

SEQ ID NO: 2275139 - RNA, 16 nt, Human
cucacaguuccucgcc

SEQ ID NO: 2275140 - RNA, 13 nt, Human
cucacaguuccuc

SEQ ID NO: 2275141 - RNA, 15 nt, Human
cuaugacugcucccc

SEQ ID NO: 2275142 - RNA, 16 nt, Human
cuaugacugcucccca

SEQ ID NO: 2275143 - RNA, 17 nt, Human
cuaugacugcuccccag

SEQ ID NO: 2275144 - RNA, 11 nt, Human
cuaugagaaaa

SEQ ID NO: 2275145 - RNA, 16 nt, Human
cuaugagaaaagaggc

SEQ ID NO: 2275146 - RNA, 12 nt, Human
cuaugcauuuga

SEQ ID NO: 2275147 - RNA, 11 nt, Human
cuaugcauuug

SEQ ID NO: 2275148 - RNA, 21 nt, Human
cuaugcauuugaaaauuuuga

SEQ ID NO: 2275149 - RNA, 15 nt, Human
cuaggauaucuucuc

SEQ ID NO: 2275150 - RNA, 17 nt, Human
cuaggauaucuucucca

SEQ ID NO: 2275151 - RNA, 23 nt, Human
cuaggagggagacacuggccccu

SEQ ID NO: 2275152 - RNA, 13 nt, Human
cuaggcaggacau

SEQ ID NO: 2275153 - RNA, 22 nt, Human
cuaggcaggacaugcugaagcc

SEQ ID NO: 2275154 - RNA, 13 nt, Human
cuaggauuucaug

SEQ ID NO: 2275155 - RNA, 19 nt, Human
cuaggagcugggaggaaaa

SEQ ID NO: 2275156 - RNA, 16 nt, Human
cuaggagcugggagga

SEQ ID NO: 2275157 - RNA, 15 nt, Human
cuaggagcugggagg

SEQ ID NO: 2275158 - RNA, 13 nt, Human
cuaggagcacugu

SEQ ID NO: 2275159 - RNA, 18 nt, Human
cuaggagauaucugaggg

SEQ ID NO: 2275160 - RNA, 19 nt, Human
cuaggagauaucugaggga

SEQ ID NO: 2275161 - RNA, 21 nt, Human
cuaggagauaucugagggagg

SEQ ID NO: 2275162 - RNA, 23 nt, Human
cuaggagauaucugagggaggag

SEQ ID NO: 2275163 - RNA, 17 nt, Human
cuaggaggucucuaaga

SEQ ID NO: 2275164 - RNA, 13 nt, Human
cuaggagggagac

SEQ ID NO: 2275165 - RNA, 18 nt, Human
cuaggagggagacacugg

SEQ ID NO: 2275166 - RNA, 22 nt, Human
cuaggagggagacacuggcccc

SEQ ID NO: 2275167 - RNA, 22 nt, Human
cuaggacucugaggcucuuucu

SEQ ID NO: 2275168 - RNA, 18 nt, Human
cuaggagaaccaaaucug

SEQ ID NO: 2275169 - RNA, 21 nt, Human
cuaggagaaccaaaucuggaa

SEQ ID NO: 2275170 - RNA, 20 nt, Human
cuaggagaccaaggcgggag

SEQ ID NO: 2275171 - RNA, 16 nt, Human
cuaggagaccaaggcg

SEQ ID NO: 2275172 - RNA, 23 nt, Human
cuaggagaaccaaaucuggaagc

SEQ ID NO: 2275173 - RNA, 18 nt, Human
cuaggacgccacccagca

SEQ ID NO: 2275174 - RNA, 23 nt, Human
cuaggagaaggaggggaaccaga

SEQ ID NO: 2275175 - RNA, 14 nt, Human
cuaggacucugagg

SEQ ID NO: 2275176 - RNA, 12 nt, Human
cuaggacucuga

SEQ ID NO: 2275177 - RNA, 22 nt, Human
cuaggacgccacccagcaaaag

SEQ ID NO: 2275178 - RNA, 16 nt, Human
cuaggacucugaggcu

SEQ ID NO: 2275179 - RNA, 15 nt, Human
cuaggacucugaggc

SEQ ID NO: 2275180 - RNA, 15 nt, Human
cuaggaauucccagc

SEQ ID NO: 2275181 - RNA, 17 nt, Human
cuaggaaugaaauccug

SEQ ID NO: 2275182 - RNA, 16 nt, Human
cuaggaaugaaauccu

SEQ ID NO: 2275183 - RNA, 22 nt, Human
cuaggaccccuccaugugggcu

SEQ ID NO: 2275184 - RNA, 23 nt, Human
cuagcagagcaggggcaggguga

SEQ ID NO: 2275185 - RNA, 19 nt, Human
cuagcagagcaggggcagg

SEQ ID NO: 2275186 - RNA, 19 nt, Human
cuagcagcaccguucugug

SEQ ID NO: 2275187 - RNA, 12 nt, Human
cuagcagcaccg

SEQ ID NO: 2275188 - RNA, 17 nt, Human
cuagcagaaaucuagaa

SEQ ID NO: 2275189 - RNA, 16 nt, Human
cuagcacuuggagcca

SEQ ID NO: 2275190 - RNA, 15 nt, Human
cuagcacuggccugc

SEQ ID NO: 2275191 - RNA, 16 nt, Human
cuagcacuggccugca

SEQ ID NO: 2275192 - RNA, 17 nt, Human
cuaggaaauccagggug

SEQ ID NO: 2275193 - RNA, 16 nt, Human
cuaggaaauccagggu

SEQ ID NO: 2275194 - RNA, 21 nt, Human
cuagcagcaccguucugugca

SEQ ID NO: 2275195 - RNA, 20 nt, Human
cuagcagcaccguucugugc

SEQ ID NO: 2275196 - RNA, 21 nt, Human
cuaggaagacuuuggaaagag

SEQ ID NO: 2275197 - RNA, 11 nt, Human
cuagcagagag

SEQ ID NO: 2275198 - RNA, 22 nt, Human
cuagcagcaccguucugugcac

SEQ ID NO: 2275199 - RNA, 13 nt, Human
cuaggaacacucc

SEQ ID NO: 2275200 - RNA, 15 nt, Human
cuaggaacacuccuu

SEQ ID NO: 2275201 - RNA, 13 nt, Human
cuaggcccccacu

SEQ ID NO: 2275202 - RNA, 15 nt, Human
cuaggcccccacuug

SEQ ID NO: 2275203 - RNA, 16 nt, Human
cuaggcccccacuugc

SEQ ID NO: 2275204 - RNA, 22 nt, Human
cuaguacuugggagaccuguaa

SEQ ID NO: 2275205 - RNA, 17 nt, Human
cuaggccacuccuccaa

SEQ ID NO: 2275206 - RNA, 16 nt, Human
cuaggccacuccucca

SEQ ID NO: 2275207 - RNA, 19 nt, Human
cuaggccacuccuccaaag

SEQ ID NO: 2275208 - RNA, 15 nt, Human
cuaggccacuccucc

SEQ ID NO: 2275209 - RNA, 14 nt, Human
cuaggccacuccuc

SEQ ID NO: 2275210 - RNA, 19 nt, Human
cuaggccacaccaucuccu

SEQ ID NO: 2275211 - RNA, 15 nt, Human
cuaggcaggaccugu

SEQ ID NO: 2275212 - RNA, 16 nt, Human
cuaggcaggaccugug

SEQ ID NO: 2275213 - RNA, 14 nt, Human
cuaggcaucccagg

SEQ ID NO: 2275214 - RNA, 18 nt, Human
cuaggcaucccaggggac

SEQ ID NO: 2275215 - RNA, 15 nt, Human
cuaggcaucccaggg

SEQ ID NO: 2275216 - RNA, 19 nt, Human
cuaggcaucccaggggacc

SEQ ID NO: 2275217 - RNA, 21 nt, Human
cuaggcauuugcugaauacag

SEQ ID NO: 2275218 - RNA, 23 nt, Human
cuaguaucaaaagaaagaaaauc

SEQ ID NO: 2275219 - RNA, 23 nt, Human
cuaguauuccagaccugaagaau

SEQ ID NO: 2275220 - RNA, 17 nt, Human
cuaguaguuccugcuac

SEQ ID NO: 2275221 - RNA, 17 nt, Human
cuaguaucaaaagaaag

SEQ ID NO: 2275222 - RNA, 15 nt, Human
cuaguaucaaaagaa

SEQ ID NO: 2275223 - RNA, 22 nt, Human
cuaguauuucuaugaaauauua

SEQ ID NO: 2275224 - RNA, 19 nt, Human
cuaguauuucuaugaaaua

SEQ ID NO: 2275225 - RNA, 20 nt, Human
cuaguauuucuaugaaauau

SEQ ID NO: 2275226 - RNA, 14 nt, Human
cuaguguugcuugg

SEQ ID NO: 2275227 - RNA, 22 nt, Human
cuaguggucuuuguaagagugu

SEQ ID NO: 2275228 - RNA, 23 nt, Human
cuagugugguguuuccuggcacu

SEQ ID NO: 2275229 - RNA, 21 nt, Human
cuagugugguguuuccuggca

SEQ ID NO: 2275230 - RNA, 22 nt, Human
cuagugugguguuuccuggcac

SEQ ID NO: 2275231 - RNA, 12 nt, Human
cuagugcugcug

SEQ ID NO: 2275232 - RNA, 23 nt, Human
cuaguggggucucccucuccugc

SEQ ID NO: 2275233 - RNA, 14 nt, Human
cuaguggucuuugu

SEQ ID NO: 2275234 - RNA, 15 nt, Human
cuaguggucuuugua

SEQ ID NO: 2275235 - RNA, 16 nt, Human
cuaguggucuuuguaa

SEQ ID NO: 2275236 - RNA, 17 nt, Human
cuaguggucuuuguaag

SEQ ID NO: 2275237 - RNA, 18 nt, Human
cuaguggucuuuguaaga

SEQ ID NO: 2275238 - RNA, 19 nt, Human
cuaguggucuuuguaagag

SEQ ID NO: 2275239 - RNA, 20 nt, Human
cuaguggucuuuguaagagu

SEQ ID NO: 2275240 - RNA, 19 nt, Human
cuagugugguguuuccugg

SEQ ID NO: 2275241 - RNA, 19 nt, Human
cuagugcccuccacagccg

SEQ ID NO: 2275242 - RNA, 18 nt, Human
cuagugcccuccacagcc

SEQ ID NO: 2275243 - RNA, 23 nt, Human
cuagugcagcugauuuuaacaau

SEQ ID NO: 2275244 - RNA, 22 nt, Human
cuagugcagcugauuuuaacaa

SEQ ID NO: 2275245 - RNA, 21 nt, Human
cuagugcagcugauuuuaaca

SEQ ID NO: 2275246 - RNA, 20 nt, Human
cuagugcagcugauuuuaac

SEQ ID NO: 2275247 - RNA, 23 nt, Human
cuagugcccuccacagccgcagc

SEQ ID NO: 2275248 - RNA, 17 nt, Human
cuagugccuucuaaagg

SEQ ID NO: 2275249 - RNA, 13 nt, Human
cuagucuuaagaa

SEQ ID NO: 2275250 - RNA, 16 nt, Human
cuagucucucuggggc

SEQ ID NO: 2275251 - RNA, 19 nt, Human
cuagugcagcugauuuuaa

SEQ ID NO: 2275252 - RNA, 15 nt, Human
cuagugcagcugauu

SEQ ID NO: 2275253 - RNA, 14 nt, Human
cuagugcagcugau

SEQ ID NO: 2275254 - RNA, 22 nt, Human
cuagucccuuccccucccuggc

SEQ ID NO: 2275255 - RNA, 18 nt, Human
cuaguccuauucuauugc

SEQ ID NO: 2275256 - RNA, 20 nt, Human
cuagucguggagaugucuuc

SEQ ID NO: 2275257 - RNA, 21 nt, Human
cuagucguggagaugucuucg

SEQ ID NO: 2275258 - RNA, 15 nt, Human
cuagucuccuuugca

SEQ ID NO: 2275259 - RNA, 19 nt, Human
cuagucuccuuugcacuga

SEQ ID NO: 2275260 - RNA, 20 nt, Human
cuagucuccuuugcacugag

SEQ ID NO: 2275261 - RNA, 21 nt, Human
cuagucuccuuugcacugagg

SEQ ID NO: 2275262 - RNA, 23 nt, Human
cuagucuccuuugcacugagggc

SEQ ID NO: 2275263 - RNA, 20 nt, Human
cuagucucuaucauuaaagu

SEQ ID NO: 2275264 - RNA, 21 nt, Human
cuagucucuaucauuaaaguu

SEQ ID NO: 2275265 - RNA, 22 nt, Human
cuagucucuaucauuaaaguuc

SEQ ID NO: 2275266 - RNA, 13 nt, Human
cuagucucucugg

SEQ ID NO: 2275267 - RNA, 14 nt, Human
cuagucucucuggg

SEQ ID NO: 2275268 - RNA, 23 nt, Human
cuagucccuuccccucccuggcu

SEQ ID NO: 2275269 - RNA, 15 nt, Human
cuaguccuuuacuaa

SEQ ID NO: 2275270 - RNA, 21 nt, Human
cuagucccuuccccucccugg

SEQ ID NO: 2275271 - RNA, 20 nt, Human
cuagucccuuccccucccug

SEQ ID NO: 2275272 - RNA, 21 nt, Human
cuaguauuucaugcugggaau

SEQ ID NO: 2275273 - RNA, 21 nt, Human
cuaucuuauauaguuuacuau

SEQ ID NO: 2275274 - RNA, 17 nt, Human
cuaucuugcucuguaau

SEQ ID NO: 2275275 - RNA, 18 nt, Human
cuaucuugcucuguaauc

SEQ ID NO: 2275276 - RNA, 12 nt, Human
cuaucuuugcca

SEQ ID NO: 2275277 - RNA, 21 nt, Human
cuaucuuagugguuccccacc

SEQ ID NO: 2275278 - RNA, 14 nt, Human
cuaucuuaauuuug

SEQ ID NO: 2275279 - RNA, 15 nt, Human
cuaucuuaauuuugg

SEQ ID NO: 2275280 - RNA, 22 nt, Human
cuaucuuaauuuugguuguauu

SEQ ID NO: 2275281 - RNA, 23 nt, Human
cuaucuuaauuuugguuguauuc

SEQ ID NO: 2275282 - RNA, 13 nt, Human
cuaugaaauauua

SEQ ID NO: 2275283 - RNA, 19 nt, Human
cuaucuuugccacccucau

SEQ ID NO: 2275284 - RNA, 18 nt, Human
cuaucuuugccacccuca

SEQ ID NO: 2275285 - RNA, 15 nt, Human
cuaucuuugccaccc

SEQ ID NO: 2275286 - RNA, 14 nt, Human
cuaucuuugccacc

SEQ ID NO: 2275287 - RNA, 14 nt, Human
cuaugacacaugca

SEQ ID NO: 2275288 - RNA, 17 nt, Human
cuaugaauucuaaguga

SEQ ID NO: 2275289 - RNA, 23 nt, Human
cuaugaaugggcaaaacugaauu

SEQ ID NO: 2275290 - RNA, 21 nt, Human
cuaucuuugccacccucaugc

SEQ ID NO: 2275291 - RNA, 22 nt, Human
cuaugaaugggcaaaacugaau

SEQ ID NO: 2275292 - RNA, 18 nt, Human
cuaugaaauauuauguua

SEQ ID NO: 2275293 - RNA, 21 nt, Human
cuaucaaacugaagccagaaa

SEQ ID NO: 2275294 - RNA, 21 nt, Human
cuaucaaagaccuugugugua

SEQ ID NO: 2275295 - RNA, 20 nt, Human
cuaucaaacugaagccagaa

SEQ ID NO: 2275296 - RNA, 16 nt, Human
cuaucaaacugaagcc

SEQ ID NO: 2275297 - RNA, 20 nt, Human
cuaucaaguauuauaccuuu

SEQ ID NO: 2275298 - RNA, 13 nt, Human
cuaucaaacugaa

SEQ ID NO: 2275299 - RNA, 22 nt, Human
cuauauuuuuuguuaaaugauu

SEQ ID NO: 2275300 - RNA, 21 nt, Human
cuaucuguuuacaguguuccg

SEQ ID NO: 2275301 - RNA, 13 nt, Human
cuaucuuaauuuu

SEQ ID NO: 2275302 - RNA, 17 nt, Human
cuaucuguuuacagugu

SEQ ID NO: 2275303 - RNA, 20 nt, Human
cuaucuguuuacaguguucc

SEQ ID NO: 2275304 - RNA, 23 nt, Human
cuaucaagugugcuuuagcuuga

SEQ ID NO: 2275305 - RNA, 14 nt, Human
cuaucaauagucaa

SEQ ID NO: 2275306 - RNA, 16 nt, Human
cuaucaauagucaaga

SEQ ID NO: 2275307 - RNA, 20 nt, Human
cuaucaauagucaagaaaaa

SEQ ID NO: 2275308 - RNA, 21 nt, Human
cuaucaauagucaagaaaaau

SEQ ID NO: 2275309 - RNA, 18 nt, Human
cuaucaauauauaaauuu

SEQ ID NO: 2275310 - RNA, 14 nt, Human
cuaucacacagugg

SEQ ID NO: 2275311 - RNA, 22 nt, Human
cuauauuguuuucaguguacau

SEQ ID NO: 2275312 - RNA, 19 nt, Human
cuauauuguuugcuaagca

SEQ ID NO: 2275313 - RNA, 23 nt, Human
cuauauuguuuucaguguacaug

SEQ ID NO: 2275314 - RNA, 20 nt, Human
cuauauuuuuuguuaaauga

SEQ ID NO: 2275315 - RNA, 21 nt, Human
cuauauccauguacuguaguu

SEQ ID NO: 2275316 - RNA, 19 nt, Human
cuauauccauguacuguag

SEQ ID NO: 2275317 - RNA, 18 nt, Human
cuauauccauguacugua

SEQ ID NO: 2275318 - RNA, 20 nt, Human
cuauauccauguacuguagu

SEQ ID NO: 2275319 - RNA, 15 nt, Human
cuauaugaaaaacaa

SEQ ID NO: 2275320 - RNA, 13 nt, Human
cuauaucuauaua

SEQ ID NO: 2275321 - RNA, 14 nt, Human
cuauaucuauauau

SEQ ID NO: 2275322 - RNA, 15 nt, Human
cuauaucuguauaua

SEQ ID NO: 2275323 - RNA, 16 nt, Human
cuauaucuguauauaa

SEQ ID NO: 2275324 - RNA, 19 nt, Human
cuauaucuguauauaaaau

SEQ ID NO: 2275325 - RNA, 20 nt, Human
cuauaucuguauauaaaaua

SEQ ID NO: 2275326 - RNA, 15 nt, Human
cuauaugaauuuaaa

SEQ ID NO: 2275327 - RNA, 16 nt, Human
cuauaugaauuuaaau

SEQ ID NO: 2275328 - RNA, 20 nt, Human
cuauaugaauuuaaauauaa

SEQ ID NO: 2275329 - RNA, 23 nt, Human
cuauaugaauuuaaauauaauuc

SEQ ID NO: 2275330 - RNA, 13 nt, Human
cuauaugauuuau

SEQ ID NO: 2275331 - RNA, 16 nt, Human
cuauaugauuuauagu

SEQ ID NO: 2275332 - RNA, 17 nt, Human
cuauaugauuuauaguu

SEQ ID NO: 2275333 - RNA, 18 nt, Human
cuauaugauuuauaguuu

SEQ ID NO: 2275334 - RNA, 19 nt, Human
cuauaugauuuauaguuug

SEQ ID NO: 2275335 - RNA, 19 nt, Human
cuaguucauccaauccuca

SEQ ID NO: 2275336 - RNA, 18 nt, Human
cuaguucauccaauccuc

SEQ ID NO: 2275337 - RNA, 12 nt, Human
cuaguucaucca

SEQ ID NO: 2275338 - RNA, 24 nt, Human
cuaguucauccaauccucacuggg

SEQ ID NO: 2275339 - RNA, 22 nt, Human
cuaguucauccaauccucacug

SEQ ID NO: 2275340 - RNA, 21 nt, Human
cuaguucauccaauccucacu

SEQ ID NO: 2275341 - RNA, 20 nt, Human
cuaguucauccaauccucac

SEQ ID NO: 2275342 - RNA, 22 nt, Human
cuaguuauuacccagaguuuuu

SEQ ID NO: 2275343 - RNA, 16 nt, Human
cuauauccauguacug

SEQ ID NO: 2275344 - RNA, 15 nt, Human
cuauauccauguacu

SEQ ID NO: 2275345 - RNA, 14 nt, Human
cuauauccauguac

SEQ ID NO: 2275346 - RNA, 13 nt, Human
cuauauccaugua

SEQ ID NO: 2275347 - RNA, 12 nt, Human
cuauauccaugu

SEQ ID NO: 2275348 - RNA, 17 nt, Human
cuauauauguguaugua

SEQ ID NO: 2275349 - RNA, 13 nt, Human
cuauauaugugua

SEQ ID NO: 2275350 - RNA, 15 nt, Human
cuauauauguguaug

SEQ ID NO: 2275351 - RNA, 23 nt, Human
cuauauaugugaugaucuaccag

SEQ ID NO: 2275352 - RNA, 18 nt, Human
cuauauaugugaugaucu

SEQ ID NO: 2275353 - RNA, 22 nt, Human
cuauauaguuuauugacaauaa

SEQ ID NO: 2275354 - RNA, 13 nt, Human
cuauauauaauuc

SEQ ID NO: 2275355 - RNA, 16 nt, Human
cuauauaguuuauuga

SEQ ID NO: 2275356 - RNA, 16 nt, Human
cuauauauaauucugu

SEQ ID NO: 2275357 - RNA, 17 nt, Human
cuauauauaauucugua

SEQ ID NO: 2275358 - RNA, 18 nt, Human
cuauauauaauucuguac

SEQ ID NO: 2275359 - RNA, 19 nt, Human
cuauauauaauucuguaca

SEQ ID NO: 2275360 - RNA, 21 nt, Human
cuauauauaauucuguacaua

SEQ ID NO: 2275361 - RNA, 14 nt, Human
cuaguuccaccauc

SEQ ID NO: 2275362 - RNA, 17 nt, Human
cuagaggccagccccac

SEQ ID NO: 2275363 - RNA, 18 nt, Human
cuagaggcagggagggga

SEQ ID NO: 2275364 - RNA, 15 nt, Human
cuagaggcagggagg

SEQ ID NO: 2275365 - RNA, 14 nt, Human
cuagaggcagggag

SEQ ID NO: 2275366 - RNA, 19 nt, Human
cuagaggaaccaaccccca

SEQ ID NO: 2275367 - RNA, 16 nt, Human
cuagagccugccugga

SEQ ID NO: 2275368 - RNA, 17 nt, Human
cuagagccugccuggag

SEQ ID NO: 2275369 - RNA, 18 nt, Human
cuagagccugccuggagc

SEQ ID NO: 2275370 - RNA, 19 nt, Human
cuagagccugccuggagcg

SEQ ID NO: 2275371 - RNA, 18 nt, Human
cuagacucccaagcugga

SEQ ID NO: 2275372 - RNA, 15 nt, Human
cuagagccugccugg

SEQ ID NO: 2275373 - RNA, 22 nt, Human
cuagacucaagguucccagaga

SEQ ID NO: 2275374 - RNA, 23 nt, Human
cuagacucaagguucccagagau

SEQ ID NO: 2275375 - RNA, 19 nt, Human
cuagacgcuucaucccaca

SEQ ID NO: 2275376 - RNA, 22 nt, Human
cuacuuuguccuuuuuguuauu

SEQ ID NO: 2275377 - RNA, 21 nt, Human
cuagacccacuggacucaccu

SEQ ID NO: 2275378 - RNA, 21 nt, Human
cuagacgagcaggcuucuucc

SEQ ID NO: 2275379 - RNA, 20 nt, Human
cuacuuuguccuuuuuguua

SEQ ID NO: 2275380 - RNA, 14 nt, Human
cuacuuuguccuuu

SEQ ID NO: 2275381 - RNA, 20 nt, Human
cuagacgagcaggcuucuuc

SEQ ID NO: 2275382 - RNA, 21 nt, Human
cuagagggaccucucccaggg

SEQ ID NO: 2275383 - RNA, 20 nt, Human
cuagagggaccucucccagg

SEQ ID NO: 2275384 - RNA, 19 nt, Human
cuagagggaccucucccag

SEQ ID NO: 2275385 - RNA, 18 nt, Human
cuagagggaccucuccca

SEQ ID NO: 2275386 - RNA, 21 nt, Human
cuagaggccagccccacccag

SEQ ID NO: 2275387 - RNA, 19 nt, Human
cuagaggcagggaggggac

SEQ ID NO: 2275388 - RNA, 20 nt, Human
cuagaggccagccccaccca

SEQ ID NO: 2275389 - RNA, 19 nt, Human
cuagaggccagccccaccc

SEQ ID NO: 2275390 - RNA, 18 nt, Human
cuagaggccagccccacc

SEQ ID NO: 2275391 - RNA, 16 nt, Human
cuagaggguuccugua

SEQ ID NO: 2275392 - RNA, 15 nt, Human
cuagaggguuccugu

SEQ ID NO: 2275393 - RNA, 19 nt, Human
cuagaggguuccuguagac

SEQ ID NO: 2275394 - RNA, 22 nt, Human
cuagagggauacacugaaguua

SEQ ID NO: 2275395 - RNA, 22 nt, Human
cuagaggggggauuuccagcca

SEQ ID NO: 2275396 - RNA, 22 nt, Human
cuagagggaggggccuaggccu

SEQ ID NO: 2275397 - RNA, 21 nt, Human
cuagagggaggggccuaggcc

SEQ ID NO: 2275398 - RNA, 19 nt, Human
cuagagggaggggccuagg

SEQ ID NO: 2275399 - RNA, 16 nt, Human
cuagagggaggggccu

SEQ ID NO: 2275400 - RNA, 15 nt, Human
cuagagggaggggcc

SEQ ID NO: 2275401 - RNA, 17 nt, Human
cuagagggaccucuccc

SEQ ID NO: 2275402 - RNA, 19 nt, Human
cuagaguccucacucccag

SEQ ID NO: 2275403 - RNA, 16 nt, Human
cuagagucugaacagc

SEQ ID NO: 2275404 - RNA, 19 nt, Human
cuagagucugaacagcugu

SEQ ID NO: 2275405 - RNA, 20 nt, Human
cuagagucugaacagcugua

SEQ ID NO: 2275406 - RNA, 15 nt, Human
cuagaguccucacuc

SEQ ID NO: 2275407 - RNA, 17 nt, Human
cuagaguagaguggagg

SEQ ID NO: 2275408 - RNA, 21 nt, Human
cuagagugaacuugggccacu

SEQ ID NO: 2275409 - RNA, 17 nt, Human
cuagagugaacuugggc

SEQ ID NO: 2275410 - RNA, 15 nt, Human
cuagcaccagggacu

SEQ ID NO: 2275411 - RNA, 13 nt, Human
cuagcacuggccu

SEQ ID NO: 2275412 - RNA, 14 nt, Human
cuagcacuggccug

SEQ ID NO: 2275413 - RNA, 17 nt, Human
cuagcacuuugggaggc

SEQ ID NO: 2275414 - RNA, 19 nt, Human
cuagcaagugagagagaug

SEQ ID NO: 2275415 - RNA, 20 nt, Human
cuagcaaucacaacacuggc

SEQ ID NO: 2275416 - RNA, 22 nt, Human
cuagcaaucacaacacuggcug

SEQ ID NO: 2275417 - RNA, 15 nt, Human
cuagcaagugagaga

SEQ ID NO: 2275418 - RNA, 18 nt, Human
cuagcaagugagagagau

SEQ ID NO: 2275419 - RNA, 20 nt, Human
cuagauucuacauauucuuu

SEQ ID NO: 2275420 - RNA, 24 nt, Human
cuagauugagagaagagacaaaca

SEQ ID NO: 2275421 - RNA, 21 nt, Human
cuagauuuuguuuugcuuuuu

SEQ ID NO: 2275422 - RNA, 18 nt, Human
cuagauuuuguuuugcuu

SEQ ID NO: 2275423 - RNA, 20 nt, Human
cuagauuuuguuuugcuuuu

SEQ ID NO: 2275424 - RNA, 12 nt, Human
cuagauuuuguu

SEQ ID NO: 2275425 - RNA, 13 nt, Human
cuagauuuuguuu

SEQ ID NO: 2275426 - RNA, 17 nt, Human
cuagauuuuguuuugcu

SEQ ID NO: 2275427 - RNA, 13 nt, Human
cuagauuuaugaa

SEQ ID NO: 2275428 - RNA, 21 nt, Human
cuagauccacacacagaggaa

SEQ ID NO: 2275429 - RNA, 19 nt, Human
cuagauccacacacagagg

SEQ ID NO: 2275430 - RNA, 18 nt, Human
cuagauccacacacagag

SEQ ID NO: 2275431 - RNA, 17 nt, Human
cuagauccacacacaga

SEQ ID NO: 2275432 - RNA, 13 nt, Human
cuagauccacaca

SEQ ID NO: 2275433 - RNA, 18 nt, Human
cuagaucaugaagaaccu

SEQ ID NO: 2275434 - RNA, 17 nt, Human
cuagaugaaguuuuaca

SEQ ID NO: 2275435 - RNA, 13 nt, Human
cuagaugucuuua

SEQ ID NO: 2275436 - RNA, 21 nt, Human
cuagauuacccccucauuguu

SEQ ID NO: 2275437 - RNA, 17 nt, Human
cuagauggugcugagaa

SEQ ID NO: 2275438 - RNA, 16 nt, Human
cuagauggugcugaga

SEQ ID NO: 2275439 - RNA, 15 nt, Human
cuagauggugcugag

SEQ ID NO: 2275440 - RNA, 14 nt, Human
cuagauggugcuga

SEQ ID NO: 2275441 - RNA, 22 nt, Human
cuagauggugcugagaagcuuu

SEQ ID NO: 2275442 - RNA, 19 nt, Human
cuagauggugcugagaagc

SEQ ID NO: 2275443 - RNA, 13 nt, Human
cuagauggugcug

SEQ ID NO: 2275444 - RNA, 20 nt, Human
cuagaugggcaugggguggg

SEQ ID NO: 2275445 - RNA, 18 nt, Human
cuagauggcuccucucag

SEQ ID NO: 2275446 - RNA, 16 nt, Human
cuagauggcuccucuc

SEQ ID NO: 2275447 - RNA, 15 nt, Human
cuagauggcuccucu

SEQ ID NO: 2275448 - RNA, 14 nt, Human
cuagauggcuccuc

SEQ ID NO: 2275449 - RNA, 16 nt, Human
cuagauggcagucacu

SEQ ID NO: 2275450 - RNA, 20 nt, Human
cuacugugugugugaaugaa

SEQ ID NO: 2275451 - RNA, 19 nt, Human
cuacugugugugugaauga

SEQ ID NO: 2275452 - RNA, 17 nt, Human
cuacugugugugugaau

SEQ ID NO: 2275453 - RNA, 20 nt, Human
cuacuguggaaaaauauuua

SEQ ID NO: 2275454 - RNA, 18 nt, Human
cuacuguggaaaaauauu

SEQ ID NO: 2275455 - RNA, 17 nt, Human
cuacuguggaaaaauau

SEQ ID NO: 2275456 - RNA, 15 nt, Human
cuacuguggaaaaau

SEQ ID NO: 2275457 - RNA, 22 nt, Human
cuacuguggaaaaauauuuaag

SEQ ID NO: 2275458 - RNA, 21 nt, Human
cuacuguggaaaaauauuuaa

SEQ ID NO: 2275459 - RNA, 15 nt, Human
cuacuguguguguga

SEQ ID NO: 2275460 - RNA, 14 nt, Human
cuacuguguuccug

SEQ ID NO: 2275461 - RNA, 13 nt, Human
cuacuguguuccu

SEQ ID NO: 2275462 - RNA, 12 nt, Human
cuacuguguucc

SEQ ID NO: 2275463 - RNA, 19 nt, Human
cuacuguguuccuggcaau

SEQ ID NO: 2275464 - RNA, 15 nt, Human
cuacuguguuccugg

SEQ ID NO: 2275465 - RNA, 20 nt, Human
cuacuguguuccuggcaaua

SEQ ID NO: 2275466 - RNA, 20 nt, Human
cuacuuccuccuccccacuu

SEQ ID NO: 2275467 - RNA, 17 nt, Human
cuacuuccuccucccca

SEQ ID NO: 2275468 - RNA, 19 nt, Human
cuacuuccuccuccccacu

SEQ ID NO: 2275469 - RNA, 20 nt, Human
cuacuuccugugacuucagc

SEQ ID NO: 2275470 - RNA, 16 nt, Human
cuacuucccucaccca

SEQ ID NO: 2275471 - RNA, 20 nt, Human
cuacuuccccuuccuaauuc

SEQ ID NO: 2275472 - RNA, 13 nt, Human
cuacuuccuccuc

SEQ ID NO: 2275473 - RNA, 15 nt, Human
cuacuuccccuuccu

SEQ ID NO: 2275474 - RNA, 14 nt, Human
cuacuuccccuucc

SEQ ID NO: 2275475 - RNA, 15 nt, Human
cuacuuuaagcacua

SEQ ID NO: 2275476 - RNA, 13 nt, Human
cuacuugggccau

SEQ ID NO: 2275477 - RNA, 12 nt, Human
cuacuugggagg

SEQ ID NO: 2275478 - RNA, 19 nt, Human
cuacuugggaggcugagau

SEQ ID NO: 2275479 - RNA, 21 nt, Human
cuacuuugacuuuuugcauuu

SEQ ID NO: 2275480 - RNA, 20 nt, Human
cuacuuugacuuuuugcauu

SEQ ID NO: 2275481 - RNA, 19 nt, Human
cuacuuugacuuuuugcau

SEQ ID NO: 2275482 - RNA, 18 nt, Human
cuacuuugacuuuuugca

SEQ ID NO: 2275483 - RNA, 15 nt, Human
cuacuugagaggcug

SEQ ID NO: 2275484 - RNA, 22 nt, Human
cuacuucuuugcuuugcccagc

SEQ ID NO: 2275485 - RNA, 22 nt, Human
cuacuucuuuugcucuuagcug

SEQ ID NO: 2275486 - RNA, 18 nt, Human
cuacuugggaggcugaga

SEQ ID NO: 2275487 - RNA, 15 nt, Human
cuacuugggaggcug

SEQ ID NO: 2275488 - RNA, 17 nt, Human
cuacugacuuucucagc

SEQ ID NO: 2275489 - RNA, 20 nt, Human
cuacugacauguggggccag

SEQ ID NO: 2275490 - RNA, 14 nt, Human
cuacugacaugugg

SEQ ID NO: 2275491 - RNA, 15 nt, Human
cuacugacauguggg

SEQ ID NO: 2275492 - RNA, 14 nt, Human
cuacugaggugcua

SEQ ID NO: 2275493 - RNA, 21 nt, Human
cuacucuuaaguuucucagcu

SEQ ID NO: 2275494 - RNA, 22 nt, Human
cuacucuuaaguuucucagcuc

SEQ ID NO: 2275495 - RNA, 16 nt, Human
cuacucuuaagccauc

SEQ ID NO: 2275496 - RNA, 17 nt, Human
cuacucuuaagccaucu

SEQ ID NO: 2275497 - RNA, 18 nt, Human
cuacucuuaagccaucuu

SEQ ID NO: 2275498 - RNA, 22 nt, Human
cuacucuuaagccaucuuggua

SEQ ID NO: 2275499 - RNA, 14 nt, Human
cuacuguggaaaaa

SEQ ID NO: 2275500 - RNA, 13 nt, Human
cuacugugacuga

SEQ ID NO: 2275501 - RNA, 22 nt, Human
cuacuguaauaaagaugauugu

SEQ ID NO: 2275502 - RNA, 17 nt, Human
cuacuggucuuguggaa

SEQ ID NO: 2275503 - RNA, 21 nt, Human
cuacuguaagcaagaaaaaua

SEQ ID NO: 2275504 - RNA, 17 nt, Human
cuacuguaauuugugau

SEQ ID NO: 2275505 - RNA, 21 nt, Human
cuacuguaaggcaaucauggu

SEQ ID NO: 2275506 - RNA, 16 nt, Human
cuacuguaauuuguga

SEQ ID NO: 2275507 - RNA, 22 nt, Human
cuacucuguuccuucacauccu

SEQ ID NO: 2275508 - RNA, 15 nt, Human
cuacucuuaagccau

SEQ ID NO: 2275509 - RNA, 19 nt, Human
cuacucuguuccuucacau

SEQ ID NO: 2275510 - RNA, 16 nt, Human
cuacucuguuccuuca

SEQ ID NO: 2275511 - RNA, 15 nt, Human
cuacucuguuccuuc

SEQ ID NO: 2275512 - RNA, 16 nt, Human
cuacucugugucaggu

SEQ ID NO: 2275513 - RNA, 21 nt, Human
cuacucugugucagguggggc

SEQ ID NO: 2275514 - RNA, 14 nt, Human
cuacccgggaaggg

SEQ ID NO: 2275515 - RNA, 15 nt, Human
cuacccgggaagggg

SEQ ID NO: 2275516 - RNA, 20 nt, Human
cuacccgggaagggggcugg

SEQ ID NO: 2275517 - RNA, 21 nt, Human
cuacccgggaagggggcuggg

SEQ ID NO: 2275518 - RNA, 13 nt, Human
cuaaugucuucau

SEQ ID NO: 2275519 - RNA, 22 nt, Human
cuaauguauuuuauuguaacag

SEQ ID NO: 2275520 - RNA, 19 nt, Human
cuaaugucuucauuucauu

SEQ ID NO: 2275521 - RNA, 21 nt, Human
cuaaugucuucauuucauugu

SEQ ID NO: 2275522 - RNA, 22 nt, Human
cuaaugucuucauuucauugua

SEQ ID NO: 2275523 - RNA, 19 nt, Human
cuaaugugccuaguucuuu

SEQ ID NO: 2275524 - RNA, 19 nt, Human
cuaaugugguuauuucucu

SEQ ID NO: 2275525 - RNA, 14 nt, Human
cuaauuaauaaauu

SEQ ID NO: 2275526 - RNA, 20 nt, Human
cuaauguuuaugagccagac

SEQ ID NO: 2275527 - RNA, 18 nt, Human
cuaauguuuaugagccag

SEQ ID NO: 2275528 - RNA, 17 nt, Human
cuaauguuuaugagcca

SEQ ID NO: 2275529 - RNA, 22 nt, Human
cuacaagagcagccuguggcau

SEQ ID NO: 2275530 - RNA, 21 nt, Human
cuacaagagcagccuguggca

SEQ ID NO: 2275531 - RNA, 23 nt, Human
cuacaagagcagccuguggcauc

SEQ ID NO: 2275532 - RNA, 17 nt, Human
cuacaagcuaaaauuag

SEQ ID NO: 2275533 - RNA, 19 nt, Human
cuacaagcuaaaauuagau

SEQ ID NO: 2275534 - RNA, 20 nt, Human
cuacaagagcagccuguggc

SEQ ID NO: 2275535 - RNA, 19 nt, Human
cuacaagagcagccugugg

SEQ ID NO: 2275536 - RNA, 18 nt, Human
cuacaagagcagccugug

SEQ ID NO: 2275537 - RNA, 17 nt, Human
cuacaagagcagccugu

SEQ ID NO: 2275538 - RNA, 15 nt, Human
cuacaagagcagccu

SEQ ID NO: 2275539 - RNA, 15 nt, Human
cuacaagacacagug

SEQ ID NO: 2275540 - RNA, 19 nt, Human
cuaauguaauaacugugaa

SEQ ID NO: 2275541 - RNA, 14 nt, Human
cuaauguacugcau

SEQ ID NO: 2275542 - RNA, 13 nt, Human
cuaaugauguuuu

SEQ ID NO: 2275543 - RNA, 12 nt, Human
cuaaugauguuu

SEQ ID NO: 2275544 - RNA, 15 nt, Human
cuaauguauuuuauu

SEQ ID NO: 2275545 - RNA, 17 nt, Human
cuaauguauuuuauugu

SEQ ID NO: 2275546 - RNA, 18 nt, Human
cuaauguauuuuauugua

SEQ ID NO: 2275547 - RNA, 19 nt, Human
cuaauguauuuuauuguaa

SEQ ID NO: 2275548 - RNA, 20 nt, Human
cuaauguauuuuauuguaac

SEQ ID NO: 2275549 - RNA, 21 nt, Human
cuaauguauuuuauuguaaca

SEQ ID NO: 2275550 - RNA, 16 nt, Human
cuaauguacugcauau

SEQ ID NO: 2275551 - RNA, 19 nt, Human
cuaaugaaugcauaaaaug

SEQ ID NO: 2275552 - RNA, 22 nt, Human
cuaaugaaugcauaaaauguua

SEQ ID NO: 2275553 - RNA, 23 nt, Human
cuaaugaagggaaaggauauuuu

SEQ ID NO: 2275554 - RNA, 18 nt, Human
cuaaugaagggaaaggau

SEQ ID NO: 2275555 - RNA, 22 nt, Human
cuaaugacaucaccacaguuua

SEQ ID NO: 2275556 - RNA, 15 nt, Human
cuaaucuucagggca

SEQ ID NO: 2275557 - RNA, 22 nt, Human
cuaaucuucagggcacugcugc

SEQ ID NO: 2275558 - RNA, 21 nt, Human
cuaaucuguagggcuggaccu

SEQ ID NO: 2275559 - RNA, 22 nt, Human
cuaaucuguagggcuggaccua

SEQ ID NO: 2275560 - RNA, 20 nt, Human
cuaaucccugggcauugcuu

SEQ ID NO: 2275561 - RNA, 19 nt, Human
cuaaucccugggcauugcu

SEQ ID NO: 2275562 - RNA, 18 nt, Human
cuaaucccgauucacccu

SEQ ID NO: 2275563 - RNA, 23 nt, Human
cuaauccaggcagauccaggacu

SEQ ID NO: 2275564 - RNA, 20 nt, Human
cuaauccaggcagauccagg

SEQ ID NO: 2275565 - RNA, 19 nt, Human
cuaauccaggcagauccag

SEQ ID NO: 2275566 - RNA, 18 nt, Human
cuaauccaggcagaucca

SEQ ID NO: 2275567 - RNA, 19 nt, Human
cuaaucagcauucucacuc

SEQ ID NO: 2275568 - RNA, 17 nt, Human
cuaauccaggcagaucc

SEQ ID NO: 2275569 - RNA, 17 nt, Human
cuaaucagcauucucac

SEQ ID NO: 2275570 - RNA, 22 nt, Human
cuaaucuauuggguucauuauu

SEQ ID NO: 2275571 - RNA, 18 nt, Human
cuaaucuauuggguucau

SEQ ID NO: 2275572 - RNA, 17 nt, Human
cuaaucuauuggguuca

SEQ ID NO: 2275573 - RNA, 14 nt, Human
cuaaucuauugggu

SEQ ID NO: 2275574 - RNA, 20 nt, Human
cuaaucuauuggguucauua

SEQ ID NO: 2275575 - RNA, 19 nt, Human
cuaaucuauuggguucauu

SEQ ID NO: 2275576 - RNA, 21 nt, Human
cuaaucuauuggguucauuau

SEQ ID NO: 2275577 - RNA, 13 nt, Human
cuaaucuguaggg

SEQ ID NO: 2275578 - RNA, 14 nt, Human
cuaaucuguagggc

SEQ ID NO: 2275579 - RNA, 18 nt, Human
cuaaucuguagggcugga

SEQ ID NO: 2275580 - RNA, 23 nt, Human
cuaaucccugggcauugcuuucc

SEQ ID NO: 2275581 - RNA, 15 nt, Human
cuaaucgaacuauga

SEQ ID NO: 2275582 - RNA, 22 nt, Human
cuaaucccugggcauugcuuuc

SEQ ID NO: 2275583 - RNA, 21 nt, Human
cuaaucccugggcauugcuuu

SEQ ID NO: 2275584 - RNA, 16 nt, Human
cuaauccucuuuuucu

SEQ ID NO: 2275585 - RNA, 19 nt, Human
cuaaucuagauaucgacuu

SEQ ID NO: 2275586 - RNA, 18 nt, Human
cuaaucuauggucgggag

SEQ ID NO: 2275587 - RNA, 20 nt, Human
cuaaucuauggucgggagac

SEQ ID NO: 2275588 - RNA, 14 nt, Human
cuaauauuuuaugu

SEQ ID NO: 2275589 - RNA, 16 nt, Human
cuaauauuuauugcuu

SEQ ID NO: 2275590 - RNA, 17 nt, Human
cuaauauuuauugcuuu

SEQ ID NO: 2275591 - RNA, 18 nt, Human
cuaauauuuauugcuuua

SEQ ID NO: 2275592 - RNA, 13 nt, Human
cuaauauuaaaaa

SEQ ID NO: 2275593 - RNA, 14 nt, Human
cuaauauuaaaaau

SEQ ID NO: 2275594 - RNA, 16 nt, Human
cuaauauuaaaaauau

SEQ ID NO: 2275595 - RNA, 18 nt, Human
cuaauauuaaaaauaugg

SEQ ID NO: 2275596 - RNA, 13 nt, Human
cuaauaaagcugu

SEQ ID NO: 2275597 - RNA, 16 nt, Human
cuaaggugugcucuga

SEQ ID NO: 2275598 - RNA, 17 nt, Human
cuaagguggauuuucau

SEQ ID NO: 2275599 - RNA, 20 nt, Human
cuaauaaaauuuaaaagucu

SEQ ID NO: 2275600 - RNA, 12 nt, Human
cuaauaaagcug

SEQ ID NO: 2275601 - RNA, 21 nt, Human
cuaauaaaauuuaaaagucuu

SEQ ID NO: 2275602 - RNA, 15 nt, Human
cuacacugacacugg

SEQ ID NO: 2275603 - RNA, 23 nt, Human
cuacaauuuucucccaggaagcu

SEQ ID NO: 2275604 - RNA, 17 nt, Human
cuacacuccagccuggg

SEQ ID NO: 2275605 - RNA, 21 nt, Human
cuacagacuucuccagaccca

SEQ ID NO: 2275606 - RNA, 16 nt, Human
cuacagacuucuccag

SEQ ID NO: 2275607 - RNA, 15 nt, Human
cuacagaggccaugg

SEQ ID NO: 2275608 - RNA, 18 nt, Human
cuacagagcuucccugac

SEQ ID NO: 2275609 - RNA, 17 nt, Human
cuacagagcuucccuga

SEQ ID NO: 2275610 - RNA, 16 nt, Human
cuacagagcuucccug

SEQ ID NO: 2275611 - RNA, 22 nt, Human
cuacagagaaccuggaguuccu

SEQ ID NO: 2275612 - RNA, 16 nt, Human
cuacaauuuaaagcaa

SEQ ID NO: 2275613 - RNA, 19 nt, Human
cuacaaugugaacuuuauu

SEQ ID NO: 2275614 - RNA, 17 nt, Human
cuacaaugugaacuuua

SEQ ID NO: 2275615 - RNA, 13 nt, Human
cuacaaugugaac

SEQ ID NO: 2275616 - RNA, 18 nt, Human
cuacaaugugaacuuuau

SEQ ID NO: 2275617 - RNA, 15 nt, Human
cuacaauuuucuccc

SEQ ID NO: 2275618 - RNA, 16 nt, Human
cuacaauuuucuccca

SEQ ID NO: 2275619 - RNA, 20 nt, Human
cuacaauuuucucccaggaa

SEQ ID NO: 2275620 - RNA, 15 nt, Human
cuacacacugcaugu

SEQ ID NO: 2275621 - RNA, 13 nt, Human
cuacacacugcau

SEQ ID NO: 2275622 - RNA, 18 nt, Human
cuacacuccagccugagc

SEQ ID NO: 2275623 - RNA, 17 nt, Human
cuacacuccagccugag

SEQ ID NO: 2275624 - RNA, 16 nt, Human
cuacacuccagugaga

SEQ ID NO: 2275625 - RNA, 18 nt, Human
cuacacugugcugagucu

SEQ ID NO: 2275626 - RNA, 17 nt, Human
cuacacuccagugagac

SEQ ID NO: 2275627 - RNA, 15 nt, Human
cuacccgcagaguuc

SEQ ID NO: 2275628 - RNA, 17 nt, Human
cuacccgcaucuucugu

SEQ ID NO: 2275629 - RNA, 20 nt, Human
cuaccccugaucugacaucc

SEQ ID NO: 2275630 - RNA, 11 nt, Human
cuaccccuccc

SEQ ID NO: 2275631 - RNA, 13 nt, Human
cuaccccucccag

SEQ ID NO: 2275632 - RNA, 15 nt, Human
cuaccccucccagcu

SEQ ID NO: 2275633 - RNA, 18 nt, Human
cuaccccucccagcugac

SEQ ID NO: 2275634 - RNA, 16 nt, Human
cuaccccucccagcug

SEQ ID NO: 2275635 - RNA, 17 nt, Human
cuaccccucccagcuga

SEQ ID NO: 2275636 - RNA, 12 nt, Human
cuacccaggugc

SEQ ID NO: 2275637 - RNA, 15 nt, Human
cuaccccgcagacac

SEQ ID NO: 2275638 - RNA, 20 nt, Human
cuaccccgcagacaccuugg

SEQ ID NO: 2275639 - RNA, 22 nt, Human
cuacccacuucuaaauagcaau

SEQ ID NO: 2275640 - RNA, 16 nt, Human
cuacccacuucuaaau

SEQ ID NO: 2275641 - RNA, 11 nt, Human
cuacccagggc

SEQ ID NO: 2275642 - RNA, 18 nt, Human
cuacccagagaagccccu

SEQ ID NO: 2275643 - RNA, 21 nt, Human
cuacccagagaagccccuucc

SEQ ID NO: 2275644 - RNA, 19 nt, Human
cuacccagggccugcagga

SEQ ID NO: 2275645 - RNA, 16 nt, Human
cuacccagggccugca

SEQ ID NO: 2275646 - RNA, 15 nt, Human
cuacccagggccugc

SEQ ID NO: 2275647 - RNA, 14 nt, Human
cuacccagggccug

SEQ ID NO: 2275648 - RNA, 20 nt, Human
cuacccagcgagcccuggug

SEQ ID NO: 2275649 - RNA, 19 nt, Human
cuacccagcgagcccuggu

SEQ ID NO: 2275650 - RNA, 15 nt, Human
cuaccagguguucua

SEQ ID NO: 2275651 - RNA, 19 nt, Human
cuaccagcgcccgcugggc

SEQ ID NO: 2275652 - RNA, 20 nt, Human
cuaccagcgcccgcugggcu

SEQ ID NO: 2275653 - RNA, 21 nt, Human
cuaccagcgcccgcugggcug

SEQ ID NO: 2275654 - RNA, 22 nt, Human
cuaccagcgcccgcugggcuga

SEQ ID NO: 2275655 - RNA, 12 nt, Human
cuaccacuccug

SEQ ID NO: 2275656 - RNA, 14 nt, Human
cuaccacuccugcc

SEQ ID NO: 2275657 - RNA, 20 nt, Human
cuacagagcuucccugacuc

SEQ ID NO: 2275658 - RNA, 17 nt, Human
cuaccagcgcccgcugg

SEQ ID NO: 2275659 - RNA, 16 nt, Human
cuaccagacuguguau

SEQ ID NO: 2275660 - RNA, 20 nt, Human
cuaccagacuguguauucau

SEQ ID NO: 2275661 - RNA, 17 nt, Human
cuaccacuccugccaag

SEQ ID NO: 2275662 - RNA, 18 nt, Human
cuaccacugucuucuuca

SEQ ID NO: 2275663 - RNA, 17 nt, Human
cuacccacccuccuuuc

SEQ ID NO: 2275664 - RNA, 14 nt, Human
cuacccacuucuaa

SEQ ID NO: 2275665 - RNA, 23 nt, Human
cuacccacguucucacacccacc

SEQ ID NO: 2275666 - RNA, 14 nt, Human
cuaccaucagggac

SEQ ID NO: 2275667 - RNA, 15 nt, Human
cuaccaucagggaca

SEQ ID NO: 2275668 - RNA, 16 nt, Human
cuaccaucagggacag

SEQ ID NO: 2275669 - RNA, 18 nt, Human
cuaccaucagggacagga

SEQ ID NO: 2275670 - RNA, 22 nt, Human
cuacccacccuccuuucaccac

SEQ ID NO: 2275671 - RNA, 19 nt, Human
cuaaggucauuaccacagg

SEQ ID NO: 2275672 - RNA, 18 nt, Human
cuaaggguguaaguaauu

SEQ ID NO: 2275673 - RNA, 15 nt, Human
cuaaggugugcucug

SEQ ID NO: 2275674 - RNA, 22 nt, Human
cuaaggggcccggccagccaug

SEQ ID NO: 2275675 - RNA, 18 nt, Human
cuaaggggcccggccagc

SEQ ID NO: 2275676 - RNA, 13 nt, Human
cuaaggggcccgg

SEQ ID NO: 2275677 - RNA, 12 nt, Human
cuaaggggcccg

SEQ ID NO: 2275678 - RNA, 23 nt, Human
cuaagggagagugguauuugcag

SEQ ID NO: 2275679 - RNA, 17 nt, Human
cuaagggagagugguau

SEQ ID NO: 2275680 - RNA, 22 nt, Human
cuaagggagagugguauuugca

SEQ ID NO: 2275681 - RNA, 12 nt, Human
cuaaggaucucu

SEQ ID NO: 2275682 - RNA, 15 nt, Human
cuaaggaucucucag

SEQ ID NO: 2275683 - RNA, 17 nt, Human
cuaaggaucucucagga

SEQ ID NO: 2275684 - RNA, 18 nt, Human
cuaaggaucucucaggag

SEQ ID NO: 2275685 - RNA, 20 nt, Human
cuaaggaucucucaggagca

SEQ ID NO: 2275686 - RNA, 23 nt, Human
cuaaggaucucucaggagcacag

SEQ ID NO: 2275687 - RNA, 17 nt, Human
cuaaggaugcuaaaccu

SEQ ID NO: 2275688 - RNA, 18 nt, Human
cuaaggaugcuaaaccuu

SEQ ID NO: 2275689 - RNA, 20 nt, Human
cuaaggaugcuaaaccuuag

SEQ ID NO: 2275690 - RNA, 20 nt, Human
cuaaggaugucacagggcca

SEQ ID NO: 2275691 - RNA, 18 nt, Human
cuaaggaugucacagggc

SEQ ID NO: 2275692 - RNA, 19 nt, Human
cuaaggaugucacagggcc

SEQ ID NO: 2275693 - RNA, 14 nt, Human
cuaaggcugaacuu

SEQ ID NO: 2275694 - RNA, 17 nt, Human
cuaagccuuuccauaag

SEQ ID NO: 2275695 - RNA, 22 nt, Human
cuaagcggaccagccucccugu

SEQ ID NO: 2275696 - RNA, 15 nt, Human
cuaagcuaacccccu

SEQ ID NO: 2275697 - RNA, 14 nt, Human
cuaagcuaggaaug

SEQ ID NO: 2275698 - RNA, 20 nt, Human
cuaagccugaaggggcgucu

SEQ ID NO: 2275699 - RNA, 17 nt, Human
cuaagccugaaggggcg

SEQ ID NO: 2275700 - RNA, 14 nt, Human
cuaagccuccuuuu

SEQ ID NO: 2275701 - RNA, 16 nt, Human
cuaagccuaccugcuc

SEQ ID NO: 2275702 - RNA, 17 nt, Human
cuaagccuaccugcucu

SEQ ID NO: 2275703 - RNA, 20 nt, Human
cuaagccuaccugcucucca

SEQ ID NO: 2275704 - RNA, 23 nt, Human
cuaagccuaccugcucuccaagu

SEQ ID NO: 2275705 - RNA, 15 nt, Human
cuaagccccagcaag

SEQ ID NO: 2275706 - RNA, 16 nt, Human
cuaagccccagcaagc

SEQ ID NO: 2275707 - RNA, 17 nt, Human
cuaagccccagcaagca

SEQ ID NO: 2275708 - RNA, 19 nt, Human
cuaagccccagcaagcaau

SEQ ID NO: 2275709 - RNA, 14 nt, Human
cuaagcccccgcug

SEQ ID NO: 2275710 - RNA, 18 nt, Human
cuaagcccccgcuguaau

SEQ ID NO: 2275711 - RNA, 22 nt, Human
cuaagcccccgcuguaaugaaa

SEQ ID NO: 2275712 - RNA, 12 nt, Human
cuaagcccuguc

SEQ ID NO: 2275713 - RNA, 20 nt, Human
cuaagcccugucgagacacu

SEQ ID NO: 2275714 - RNA, 21 nt, Human
cuaagcccugucgagacacuu

SEQ ID NO: 2275715 - RNA, 14 nt, Human
cuaagccuaccugc

SEQ ID NO: 2275716 - RNA, 21 nt, Human
cuaagcuauucaguaauaacu

SEQ ID NO: 2275717 - RNA, 19 nt, Human
cuaagcuauucaguaauaa

SEQ ID NO: 2275718 - RNA, 22 nt, Human
cuaagcuaggaaugaaauccug

SEQ ID NO: 2275719 - RNA, 17 nt, Human
cuaagcuaggaaugaaa

SEQ ID NO: 2275720 - RNA, 20 nt, Human
cuaagcacgggccauaugaa

SEQ ID NO: 2275721 - RNA, 23 nt, Human
cuaagcacgggccauaugaauaa

SEQ ID NO: 2275722 - RNA, 18 nt, Human
cuaagcaaaaugugauau

SEQ ID NO: 2275723 - RNA, 15 nt, Human
cuaagcaaaauguga

SEQ ID NO: 2275724 - RNA, 18 nt, Human
cuaagccaagggccucuu

SEQ ID NO: 2275725 - RNA, 20 nt, Human
cuaagccacucuuccaaagg

SEQ ID NO: 2275726 - RNA, 14 nt, Human
cuaagccaagggcc

SEQ ID NO: 2275727 - RNA, 11 nt, Human
cuaagccaagg

SEQ ID NO: 2275728 - RNA, 21 nt, Human
cuaagcauagcaaacagagga

SEQ ID NO: 2275729 - RNA, 19 nt, Human
cuaagcagcauuucugaag

SEQ ID NO: 2275730 - RNA, 23 nt, Human
cuaagcagaggaggggccgcugc

SEQ ID NO: 2275731 - RNA, 17 nt, Human
cuaagcagcauuucuga

SEQ ID NO: 2275732 - RNA, 20 nt, Human
cuaagcagaggaggggccgc

SEQ ID NO: 2275733 - RNA, 19 nt, Human
cuaagcagaggaggggccg

SEQ ID NO: 2275734 - RNA, 18 nt, Human
cuaagcagaggaggggcc

SEQ ID NO: 2275735 - RNA, 16 nt, Human
cuaagcagaggagggg

SEQ ID NO: 2275736 - RNA, 15 nt, Human
cuaagcagaggaggg

SEQ ID NO: 2275737 - RNA, 14 nt, Human
cuaagcagaggagg

SEQ ID NO: 2275738 - RNA, 13 nt, Human
cuaagcagaggag

SEQ ID NO: 2275739 - RNA, 12 nt, Human
cuaagcagagga

SEQ ID NO: 2275740 - RNA, 21 nt, Human
cuaaccagggaagcugucccu

SEQ ID NO: 2275741 - RNA, 17 nt, Human
cuaaccagcagaaaugc

SEQ ID NO: 2275742 - RNA, 14 nt, Human
cuaagcaaaaugug

SEQ ID NO: 2275743 - RNA, 21 nt, Human
cuaaccacgucugucuucaca

SEQ ID NO: 2275744 - RNA, 20 nt, Human
cuaaccacgucugucuucac

SEQ ID NO: 2275745 - RNA, 15 nt, Human
cuaacauuauuuauu

SEQ ID NO: 2275746 - RNA, 16 nt, Human
cuaaccagcagaaaug

SEQ ID NO: 2275747 - RNA, 17 nt, Human
cuaacaugcccuguuca

SEQ ID NO: 2275748 - RNA, 17 nt, Human
cuaaccacgcuggaccu

SEQ ID NO: 2275749 - RNA, 16 nt, Human
cuaagccuuuccauaa

SEQ ID NO: 2275750 - RNA, 14 nt, Human
cccuaaaagcacac

SEQ ID NO: 2275751 - RNA, 17 nt, Human
cccuaaaguguauuuuu

SEQ ID NO: 2275752 - RNA, 12 nt, Human
cccuaaacugua

SEQ ID NO: 2275753 - RNA, 22 nt, Human
cccuaaaguguauuuuuuuacu

SEQ ID NO: 2275754 - RNA, 14 nt, Human
cccguuucuggugg

SEQ ID NO: 2275755 - RNA, 12 nt, Human
cccguuucucca

SEQ ID NO: 2275756 - RNA, 16 nt, Human
cccguuucuccaccua

SEQ ID NO: 2275757 - RNA, 12 nt, Human
cccguggcccca

SEQ ID NO: 2275758 - RNA, 13 nt, Human
cccguggccccag

SEQ ID NO: 2275759 - RNA, 14 nt, Human
cccguggccccagc

SEQ ID NO: 2275760 - RNA, 15 nt, Human
cccguggccccagcc

SEQ ID NO: 2275761 - RNA, 17 nt, Human
cccguugucucccuggc

SEQ ID NO: 2275762 - RNA, 19 nt, Human
cccguugucucccuggccc

SEQ ID NO: 2275763 - RNA, 20 nt, Human
cccguugucucccuggcccu

SEQ ID NO: 2275764 - RNA, 22 nt, Human
cccguugucucccuggcccuca

SEQ ID NO: 2275765 - RNA, 18 nt, Human
cccgugcagacuggaggg

SEQ ID NO: 2275766 - RNA, 11 nt, Human
cccguggcccc

SEQ ID NO: 2275767 - RNA, 15 nt, Human
cccgugcagacugga

SEQ ID NO: 2275768 - RNA, 21 nt, Human
cccgugaggaugucacucaga

SEQ ID NO: 2275769 - RNA, 13 nt, Human
cccgugcagacug

SEQ ID NO: 2275770 - RNA, 22 nt, Human
cccgugacagacuccugaggac

SEQ ID NO: 2275771 - RNA, 18 nt, Human
cccgucuucagccuagcc

SEQ ID NO: 2275772 - RNA, 18 nt, Human
cccgugacagacuccuga

SEQ ID NO: 2275773 - RNA, 17 nt, Human
cccgucuucagccuagc

SEQ ID NO: 2275774 - RNA, 16 nt, Human
cccgucuucagccuag

SEQ ID NO: 2275775 - RNA, 15 nt, Human
cccgucuucagccua

SEQ ID NO: 2275776 - RNA, 14 nt, Human
cccgucuucagccu

SEQ ID NO: 2275777 - RNA, 13 nt, Human
cccgucuucagcc

SEQ ID NO: 2275778 - RNA, 16 nt, Human
cccggcaggguccuag

SEQ ID NO: 2275779 - RNA, 13 nt, Human
cccggcagacgcc

SEQ ID NO: 2275780 - RNA, 14 nt, Human
cccggauucuggga

SEQ ID NO: 2275781 - RNA, 20 nt, Human
cccggagcuaacacuggccc

SEQ ID NO: 2275782 - RNA, 18 nt, Human
cccggagguugggugggc

SEQ ID NO: 2275783 - RNA, 16 nt, Human
cccggauucugggagg

SEQ ID NO: 2275784 - RNA, 21 nt, Human
cccggagcuaacacuggcccc

SEQ ID NO: 2275785 - RNA, 19 nt, Human
cccggagauuggacggccu

SEQ ID NO: 2275786 - RNA, 17 nt, Human
cccggaggggccuggca

SEQ ID NO: 2275787 - RNA, 18 nt, Human
cccggaggggccuggcag

SEQ ID NO: 2275788 - RNA, 21 nt, Human
cccuaaggucauuaccacagg

SEQ ID NO: 2275789 - RNA, 19 nt, Human
cccuaaggaucucucagga

SEQ ID NO: 2275790 - RNA, 17 nt, Human
cccuagaaacuuccaaa

SEQ ID NO: 2275791 - RNA, 18 nt, Human
cccuacuucuuuugcucu

SEQ ID NO: 2275792 - RNA, 19 nt, Human
cccuacuucuuuugcucuu

SEQ ID NO: 2275793 - RNA, 15 nt, Human
cccuaauaaagcugu

SEQ ID NO: 2275794 - RNA, 18 nt, Human
cccuaauaaagcugugug

SEQ ID NO: 2275795 - RNA, 17 nt, Human
cccuaagccaagggccu

SEQ ID NO: 2275796 - RNA, 19 nt, Human
cccuaagacuccucggccu

SEQ ID NO: 2275797 - RNA, 12 nt, Human
cccuaauaaagc

SEQ ID NO: 2275798 - RNA, 13 nt, Human
cccuaauaaagcu

SEQ ID NO: 2275799 - RNA, 14 nt, Human
cccuaauaaagcug

SEQ ID NO: 2275800 - RNA, 19 nt, Human
cccuagaggguuccuguag

SEQ ID NO: 2275801 - RNA, 22 nt, Human
cccuagaucuuucuauuccaaa

SEQ ID NO: 2275802 - RNA, 17 nt, Human
cccuagccagcacuugu

SEQ ID NO: 2275803 - RNA, 13 nt, Human
cccuagccauucc

SEQ ID NO: 2275804 - RNA, 15 nt, Human
cccuagccauuccug

SEQ ID NO: 2275805 - RNA, 19 nt, Human
cccuagaaucagccuaggg

SEQ ID NO: 2275806 - RNA, 15 nt, Human
cccuagagccugccu

SEQ ID NO: 2275807 - RNA, 18 nt, Human
cccuagagccugccugga

SEQ ID NO: 2275808 - RNA, 16 nt, Human
cccuagaguguuguug

SEQ ID NO: 2275809 - RNA, 20 nt, Human
cccuagagccugccuggagc

SEQ ID NO: 2275810 - RNA, 21 nt, Human
cccuagagccugccuggagcg

SEQ ID NO: 2275811 - RNA, 15 nt, Human
cccucagggucccug

SEQ ID NO: 2275812 - RNA, 22 nt, Human
cccucagggaucuugcauuccc

SEQ ID NO: 2275813 - RNA, 18 nt, Human
cccuagccauuccuggua

SEQ ID NO: 2275814 - RNA, 13 nt, Human
cccuagcccagga

SEQ ID NO: 2275815 - RNA, 16 nt, Human
cccuagcccaggagag

SEQ ID NO: 2275816 - RNA, 17 nt, Human
cccuagcccaggagaga

SEQ ID NO: 2275817 - RNA, 16 nt, Human
cccucagggucccugg

SEQ ID NO: 2275818 - RNA, 17 nt, Human
cccucagggucccuggu

SEQ ID NO: 2275819 - RNA, 18 nt, Human
cccucagggucccuggug

SEQ ID NO: 2275820 - RNA, 19 nt, Human
cccucagggucccuggugg

SEQ ID NO: 2275821 - RNA, 21 nt, Human
cccuccccuaaugccugcgga

SEQ ID NO: 2275822 - RNA, 14 nt, Human
cccuccccggcccu

SEQ ID NO: 2275823 - RNA, 19 nt, Human
cccuccccggcccuaccag

SEQ ID NO: 2275824 - RNA, 16 nt, Human
cccuccccgcccuuuu

SEQ ID NO: 2275825 - RNA, 17 nt, Human
cccuccccgcccuuuuu

SEQ ID NO: 2275826 - RNA, 17 nt, Human
cccuccccgcacccccc

SEQ ID NO: 2275827 - RNA, 16 nt, Human
cccuccccgcaccccc

SEQ ID NO: 2275828 - RNA, 13 nt, Human
cccucccccuugu

SEQ ID NO: 2275829 - RNA, 15 nt, Human
cccucccccuugucc

SEQ ID NO: 2275830 - RNA, 13 nt, Human
cccucccccuucu

SEQ ID NO: 2275831 - RNA, 17 nt, Human
cccucccccuucuccca

SEQ ID NO: 2275832 - RNA, 12 nt, Human
cccucccccuug

SEQ ID NO: 2275833 - RNA, 13 nt, Human
cccucccacacac

SEQ ID NO: 2275834 - RNA, 14 nt, Human
cccucccccugcca

SEQ ID NO: 2275835 - RNA, 19 nt, Human
cccuccaucuaaacugccc

SEQ ID NO: 2275836 - RNA, 12 nt, Human
cccucccacaca

SEQ ID NO: 2275837 - RNA, 17 nt, Human
cccuccaugugggcuag

SEQ ID NO: 2275838 - RNA, 15 nt, Human
cccuccaucccgaca

SEQ ID NO: 2275839 - RNA, 20 nt, Human
cccuccagcuuguggagccc

SEQ ID NO: 2275840 - RNA, 15 nt, Human
cccuccagcuugugg

SEQ ID NO: 2275841 - RNA, 16 nt, Human
cccuccacagccgcag

SEQ ID NO: 2275842 - RNA, 17 nt, Human
cccuccaaaagcacuua

SEQ ID NO: 2275843 - RNA, 18 nt, Human
cccuccaaaagcacuuac

SEQ ID NO: 2275844 - RNA, 15 nt, Human
cccuccaauccugcc

SEQ ID NO: 2275845 - RNA, 16 nt, Human
cccuccaauccugccc

SEQ ID NO: 2275846 - RNA, 13 nt, Human
cccucccucuuuc

SEQ ID NO: 2275847 - RNA, 23 nt, Human
cccucccucuacugggagccuac

SEQ ID NO: 2275848 - RNA, 12 nt, Human
cccuccccuccc

SEQ ID NO: 2275849 - RNA, 22 nt, Human
cccuccccggcccuaccagcgc

SEQ ID NO: 2275850 - RNA, 16 nt, Human
cccuccccuccccugc

SEQ ID NO: 2275851 - RNA, 17 nt, Human
cccuccccuccccugcu

SEQ ID NO: 2275852 - RNA, 14 nt, Human
cccuccccucucuu

SEQ ID NO: 2275853 - RNA, 15 nt, Human
cccuccccucucuug

SEQ ID NO: 2275854 - RNA, 16 nt, Human
cccuccccucucuugc

SEQ ID NO: 2275855 - RNA, 16 nt, Human
cccuccgccaggcgag

SEQ ID NO: 2275856 - RNA, 20 nt, Human
cccuccgauccuuccuccca

SEQ ID NO: 2275857 - RNA, 14 nt, Human
cccuccgccauucu

SEQ ID NO: 2275858 - RNA, 23 nt, Human
cccucccuuggaaaccugcccug

SEQ ID NO: 2275859 - RNA, 16 nt, Human
cccucccuuucucccc

SEQ ID NO: 2275860 - RNA, 13 nt, Human
cccucccuuucuc

SEQ ID NO: 2275861 - RNA, 14 nt, Human
cccucccuuucucc

SEQ ID NO: 2275862 - RNA, 12 nt, Human
cccucccuugga

SEQ ID NO: 2275863 - RNA, 19 nt, Human
cccucccuuggaaaccugc

SEQ ID NO: 2275864 - RNA, 21 nt, Human
cccucccuuggaaaccugccc

SEQ ID NO: 2275865 - RNA, 22 nt, Human
cccucccuuggaaaccugcccu

SEQ ID NO: 2275866 - RNA, 11 nt, Human
cccucccuguc

SEQ ID NO: 2275867 - RNA, 16 nt, Human
cccucccuggguucag

SEQ ID NO: 2275868 - RNA, 19 nt, Human
cccucccuguuccccagag

SEQ ID NO: 2275869 - RNA, 13 nt, Human
cccucccuccucu

SEQ ID NO: 2275870 - RNA, 13 nt, Human
cccucccuggguu

SEQ ID NO: 2275871 - RNA, 13 nt, Human
cccucccuguccu

SEQ ID NO: 2275872 - RNA, 20 nt, Human
cccucccuguuccccagaga

SEQ ID NO: 2275873 - RNA, 14 nt, Human
cccucccuucaacc

SEQ ID NO: 2275874 - RNA, 12 nt, Human
cccucaugcugu

SEQ ID NO: 2275875 - RNA, 22 nt, Human
cccucauccucauacccacccc

SEQ ID NO: 2275876 - RNA, 17 nt, Human
cccucaucucucugccc

SEQ ID NO: 2275877 - RNA, 21 nt, Human
cccucaucgcguccuccuacc

SEQ ID NO: 2275878 - RNA, 13 nt, Human
cccucaucucucc

SEQ ID NO: 2275879 - RNA, 14 nt, Human
cccucaucuguccc

SEQ ID NO: 2275880 - RNA, 13 nt, Human
cccucaucugucc

SEQ ID NO: 2275881 - RNA, 17 nt, Human
cccucauucaggaaaac

SEQ ID NO: 2275882 - RNA, 15 nt, Human
cccuccaaaagcacu

SEQ ID NO: 2275883 - RNA, 16 nt, Human
cccucauuucaggagc

SEQ ID NO: 2275884 - RNA, 19 nt, Human
cccucauuggcucuugaac

SEQ ID NO: 2275885 - RNA, 21 nt, Human
cccuccaagaccuucuccuuc

SEQ ID NO: 2275886 - RNA, 16 nt, Human
cccucauucaggaaaa

SEQ ID NO: 2275887 - RNA, 15 nt, Human
cccucauucaggaaa

SEQ ID NO: 2275888 - RNA, 12 nt, Human
cccucauuaaug

SEQ ID NO: 2275889 - RNA, 22 nt, Human
cccucauuccaccuucccaugc

SEQ ID NO: 2275890 - RNA, 21 nt, Human
cccucaucuuucaucaaucau

SEQ ID NO: 2275891 - RNA, 21 nt, Human
cccucauggccccucugaccu

SEQ ID NO: 2275892 - RNA, 16 nt, Human
cccucauggccccucu

SEQ ID NO: 2275893 - RNA, 17 nt, Human
cccucauggccccucug

SEQ ID NO: 2275894 - RNA, 20 nt, Human
cccucagucuggcccuuccu

SEQ ID NO: 2275895 - RNA, 21 nt, Human
cccucagggucccugguggca

SEQ ID NO: 2275896 - RNA, 19 nt, Human
cccucaguuucccuaucuc

SEQ ID NO: 2275897 - RNA, 15 nt, Human
cccucauagcccuca

SEQ ID NO: 2275898 - RNA, 13 nt, Human
cccucauagcccu

SEQ ID NO: 2275899 - RNA, 19 nt, Human
cccucauagcccucacccu

SEQ ID NO: 2275900 - RNA, 17 nt, Human
cccucaucccgagcacc

SEQ ID NO: 2275901 - RNA, 22 nt, Human
cccucaucaccaacgucugugc

SEQ ID NO: 2275902 - RNA, 17 nt, Human
cccucauccucauaccc

SEQ ID NO: 2275903 - RNA, 20 nt, Human
cccucauccucauacccacc

SEQ ID NO: 2275904 - RNA, 21 nt, Human
cccgcggggacauugggaagg

SEQ ID NO: 2275905 - RNA, 19 nt, Human
cccgcucagcccucccugc

SEQ ID NO: 2275906 - RNA, 15 nt, Human
cccgcgccuccuucc

SEQ ID NO: 2275907 - RNA, 17 nt, Human
cccgcgcccgcgcccuc

SEQ ID NO: 2275908 - RNA, 19 nt, Human
cccgcgcgcgucccccugc

SEQ ID NO: 2275909 - RNA, 22 nt, Human
cccgcuaagagggagggagggc

SEQ ID NO: 2275910 - RNA, 22 nt, Human
cccgccuggcagaacugagcuc

SEQ ID NO: 2275911 - RNA, 17 nt, Human
cccgccuggcagaacug

SEQ ID NO: 2275912 - RNA, 13 nt, Human
cccgccuguuccc

SEQ ID NO: 2275913 - RNA, 17 nt, Human
cccgccugcccucaugg

SEQ ID NO: 2275914 - RNA, 14 nt, Human
cccgccuguucccc

SEQ ID NO: 2275915 - RNA, 17 nt, Human
cccgcugaguggacugg

SEQ ID NO: 2275916 - RNA, 19 nt, Human
cccgcugaguggacuggag

SEQ ID NO: 2275917 - RNA, 12 nt, Human
cccgcucuggac

SEQ ID NO: 2275918 - RNA, 14 nt, Human
cccgcucuggacca

SEQ ID NO: 2275919 - RNA, 22 nt, Human
cccgcugcccaggggagcccuc

SEQ ID NO: 2275920 - RNA, 12 nt, Human
cccgcugcugcu

SEQ ID NO: 2275921 - RNA, 15 nt, Human
cccgcugcugcugcu

SEQ ID NO: 2275922 - RNA, 16 nt, Human
cccgcugcugcugcug

SEQ ID NO: 2275923 - RNA, 14 nt, Human
cccgcuuggcuucu

SEQ ID NO: 2275924 - RNA, 18 nt, Human
cccgcuuguccagcgccu

SEQ ID NO: 2275925 - RNA, 15 nt, Human
cccgcuuguccagcg

SEQ ID NO: 2275926 - RNA, 14 nt, Human
cccgcuuguccagc

SEQ ID NO: 2275927 - RNA, 16 nt, Human
cccgcuuggcuucuuc

SEQ ID NO: 2275928 - RNA, 14 nt, Human
cccggaacaagccu

SEQ ID NO: 2275929 - RNA, 20 nt, Human
cccgcuuucuugcugguugu

SEQ ID NO: 2275930 - RNA, 23 nt, Human
cccggaagccaaaccucugugag

SEQ ID NO: 2275931 - RNA, 12 nt, Human
cccgcucccagu

SEQ ID NO: 2275932 - RNA, 13 nt, Human
cccgcucccagug

SEQ ID NO: 2275933 - RNA, 14 nt, Human
cccgcucccagugu

SEQ ID NO: 2275934 - RNA, 23 nt, Human
cccgcucagcccucccugccccu

SEQ ID NO: 2275935 - RNA, 21 nt, Human
cccgcucuacaucuucugccu

SEQ ID NO: 2275936 - RNA, 15 nt, Human
cccgcucccaguguc

SEQ ID NO: 2275937 - RNA, 23 nt, Human
cccgcucccagugucuuccugug

SEQ ID NO: 2275938 - RNA, 13 nt, Human
cccgcucugcaug

SEQ ID NO: 2275939 - RNA, 14 nt, Human
cccgcucugcaugc

SEQ ID NO: 2275940 - RNA, 22 nt, Human
cccgcucugcaugcggcccagc

SEQ ID NO: 2275941 - RNA, 11 nt, Human
cccgcucugga

SEQ ID NO: 2275942 - RNA, 22 nt, Human
cccgcaaugugcccccagacgc

SEQ ID NO: 2275943 - RNA, 19 nt, Human
cccgcacagagcuggggcu

SEQ ID NO: 2275944 - RNA, 17 nt, Human
cccgcacccccacccuu

SEQ ID NO: 2275945 - RNA, 16 nt, Human
cccgcacccccacccu

SEQ ID NO: 2275946 - RNA, 13 nt, Human
cccgcacccccac

SEQ ID NO: 2275947 - RNA, 13 nt, Human
cccgccugcccuc

SEQ ID NO: 2275948 - RNA, 14 nt, Human
cccgccugcccuca

SEQ ID NO: 2275949 - RNA, 18 nt, Human
cccgcaaugugcccccag

SEQ ID NO: 2275950 - RNA, 20 nt, Human
cccgcaaacccccuuugugc

SEQ ID NO: 2275951 - RNA, 19 nt, Human
cccgcaaacccccuuugug

SEQ ID NO: 2275952 - RNA, 23 nt, Human
cccgaugcugcuuuccccugugg

SEQ ID NO: 2275953 - RNA, 13 nt, Human
cccgaucuuucua

SEQ ID NO: 2275954 - RNA, 14 nt, Human
cccgaugcugcuuu

SEQ ID NO: 2275955 - RNA, 15 nt, Human
cccgaugcugcuuuc

SEQ ID NO: 2275956 - RNA, 16 nt, Human
cccgaugcugcuuucc

SEQ ID NO: 2275957 - RNA, 20 nt, Human
cccgaugcugcuuuccccug

SEQ ID NO: 2275958 - RNA, 22 nt, Human
cccgaugcugcuuuccccugug

SEQ ID NO: 2275959 - RNA, 13 nt, Human
cccgaggcccgca

SEQ ID NO: 2275960 - RNA, 16 nt, Human
cccgaguuuccccaga

SEQ ID NO: 2275961 - RNA, 19 nt, Human
cccgaguuuggucccuggg

SEQ ID NO: 2275962 - RNA, 23 nt, Human
cccgagucauucguucuguggag

SEQ ID NO: 2275963 - RNA, 20 nt, Human
cccgaggccuucucugaagg

SEQ ID NO: 2275964 - RNA, 12 nt, Human
cccgaggcccgc

SEQ ID NO: 2275965 - RNA, 22 nt, Human
cccgaggacgcucccugcucca

SEQ ID NO: 2275966 - RNA, 15 nt, Human
cccgaggcccgcaug

SEQ ID NO: 2275967 - RNA, 15 nt, Human
cccgaggccuucucu

SEQ ID NO: 2275968 - RNA, 14 nt, Human
ccccuuauccagga

SEQ ID NO: 2275969 - RNA, 15 nt, Human
ccccuuauccaggac

SEQ ID NO: 2275970 - RNA, 16 nt, Human
ccccuuauccaggacu

SEQ ID NO: 2275971 - RNA, 23 nt, Human
ccccuucacuucugaccacacuu

SEQ ID NO: 2275972 - RNA, 22 nt, Human
ccccuucacuucugaccacacu

SEQ ID NO: 2275973 - RNA, 19 nt, Human
ccccuucacuucugaccac

SEQ ID NO: 2275974 - RNA, 17 nt, Human
ccccuucacuucugacc

SEQ ID NO: 2275975 - RNA, 14 nt, Human
ccccuucacaaagc

SEQ ID NO: 2275976 - RNA, 20 nt, Human
ccccuguucuggcagaguug

SEQ ID NO: 2275977 - RNA, 14 nt, Human
ccccuuaccacugc

SEQ ID NO: 2275978 - RNA, 18 nt, Human
ccccugucuagagaggga

SEQ ID NO: 2275979 - RNA, 14 nt, Human
ccccugucuagaga

SEQ ID NO: 2275980 - RNA, 23 nt, Human
ccccuuccccacugccugcccac

SEQ ID NO: 2275981 - RNA, 16 nt, Human
ccccuuccccauggga

SEQ ID NO: 2275982 - RNA, 14 nt, Human
ccccuucagugccc

SEQ ID NO: 2275983 - RNA, 13 nt, Human
ccccuucagugcc

SEQ ID NO: 2275984 - RNA, 12 nt, Human
ccccuucccccu

SEQ ID NO: 2275985 - RNA, 14 nt, Human
ccccuucccugcaa

SEQ ID NO: 2275986 - RNA, 18 nt, Human
ccccuucccugcaaacau

SEQ ID NO: 2275987 - RNA, 13 nt, Human
ccccuucccugca

SEQ ID NO: 2275988 - RNA, 17 nt, Human
ccccuuccuacucccag

SEQ ID NO: 2275989 - RNA, 12 nt, Human
ccccuggccucc

SEQ ID NO: 2275990 - RNA, 19 nt, Human
cccgaggacccagacccag

SEQ ID NO: 2275991 - RNA, 22 nt, Human
ccccuuccuaauuccacagcug

SEQ ID NO: 2275992 - RNA, 21 nt, Human
ccccuuccuaauuccacagcu

SEQ ID NO: 2275993 - RNA, 20 nt, Human
ccccuuccuaauuccacagc

SEQ ID NO: 2275994 - RNA, 14 nt, Human
ccccuguacuccag

SEQ ID NO: 2275995 - RNA, 19 nt, Human
ccccugggggcucucaugu

SEQ ID NO: 2275996 - RNA, 18 nt, Human
ccccugguucucaucuuu

SEQ ID NO: 2275997 - RNA, 23 nt, Human
ccccuggugguucacucuuggag

SEQ ID NO: 2275998 - RNA, 15 nt, Human
ccccugguucucauc

SEQ ID NO: 2275999 - RNA, 19 nt, Human
ccccuggggcuucuccuga

SEQ ID NO: 2276000 - RNA, 20 nt, Human
ccccuggggcuucuccugac

SEQ ID NO: 2276001 - RNA, 22 nt, Human
ccccuguccccgcacugggcuu

SEQ ID NO: 2276002 - RNA, 17 nt, Human
ccccuguccccucagcu

SEQ ID NO: 2276003 - RNA, 20 nt, Human
ccccuguccccucagcucca

SEQ ID NO: 2276004 - RNA, 13 nt, Human
ccccuguccucac

SEQ ID NO: 2276005 - RNA, 14 nt, Human
ccccuguccucacu

SEQ ID NO: 2276006 - RNA, 15 nt, Human
ccccuguccucacug

SEQ ID NO: 2276007 - RNA, 16 nt, Human
ccccuguccucacugc

SEQ ID NO: 2276008 - RNA, 12 nt, Human
ccccuguccuga

SEQ ID NO: 2276009 - RNA, 23 nt, Human
ccccugggcucugccccagcucu

SEQ ID NO: 2276010 - RNA, 21 nt, Human
ccccugggcucugccccagcu

SEQ ID NO: 2276011 - RNA, 17 nt, Human
ccccuggcccagcggcc

SEQ ID NO: 2276012 - RNA, 16 nt, Human
ccccugggcuuggccu

SEQ ID NO: 2276013 - RNA, 18 nt, Human
ccccugggcuuggccugc

SEQ ID NO: 2276014 - RNA, 19 nt, Human
ccccugggcuuggccugcu

SEQ ID NO: 2276015 - RNA, 23 nt, Human
ccccugggcuuggccugcuguga

SEQ ID NO: 2276016 - RNA, 20 nt, Human
ccccugggcuuggccugcug

SEQ ID NO: 2276017 - RNA, 21 nt, Human
ccccugggcuuggccugcugu

SEQ ID NO: 2276018 - RNA, 22 nt, Human
ccccugggcuuggccugcugug

SEQ ID NO: 2276019 - RNA, 18 nt, Human
ccccuggggcuucuccug

SEQ ID NO: 2276020 - RNA, 15 nt, Human
ccccugggcucugcc

SEQ ID NO: 2276021 - RNA, 13 nt, Human
ccccugggcucug

SEQ ID NO: 2276022 - RNA, 11 nt, Human
ccccugggcuc

SEQ ID NO: 2276023 - RNA, 22 nt, Human
ccccuggcuuuucacugcuggc

SEQ ID NO: 2276024 - RNA, 23 nt, Human
ccccuggcuuuucacugcuggcu

SEQ ID NO: 2276025 - RNA, 15 nt, Human
ccccuggcccagcgg

SEQ ID NO: 2276026 - RNA, 16 nt, Human
ccccuggcccagcggc

SEQ ID NO: 2276027 - RNA, 22 nt, Human
ccccuggcccagcggccccucc

SEQ ID NO: 2276028 - RNA, 19 nt, Human
ccccagggucuucccuacc

SEQ ID NO: 2276029 - RNA, 22 nt, Human
ccccaggguugaggggaccaag

SEQ ID NO: 2276030 - RNA, 16 nt, Human
ccccagggucuucccu

SEQ ID NO: 2276031 - RNA, 17 nt, Human
ccccagguccagcucug

SEQ ID NO: 2276032 - RNA, 21 nt, Human
ccccagguccagcucuggagg

SEQ ID NO: 2276033 - RNA, 22 nt, Human
ccccagguccagcucuggaggg

SEQ ID NO: 2276034 - RNA, 22 nt, Human
ccccaggugguuauggagaggg

SEQ ID NO: 2276035 - RNA, 14 nt, Human
ccccaggugccagu

SEQ ID NO: 2276036 - RNA, 23 nt, Human
ccccagguggcugacccaguccc

SEQ ID NO: 2276037 - RNA, 21 nt, Human
ccccagguggcugacccaguc

SEQ ID NO: 2276038 - RNA, 20 nt, Human
ccccagguggcugacccagu

SEQ ID NO: 2276039 - RNA, 13 nt, Human
ccccagguggcug

SEQ ID NO: 2276040 - RNA, 11 nt, Human
ccccuggccca

SEQ ID NO: 2276041 - RNA, 13 nt, Human
ccccuggcccagc

SEQ ID NO: 2276042 - RNA, 14 nt, Human
ccccuggcccagcg

SEQ ID NO: 2276043 - RNA, 15 nt, Human
ccccuggcagccccu

SEQ ID NO: 2276044 - RNA, 12 nt, Human
ccccuggcagcc

SEQ ID NO: 2276045 - RNA, 14 nt, Human
ccccuggcagcccc

SEQ ID NO: 2276046 - RNA, 22 nt, Human
ccccaggggucccagccacccc

SEQ ID NO: 2276047 - RNA, 19 nt, Human
ccccaggggucccagccac

SEQ ID NO: 2276048 - RNA, 17 nt, Human
ccccaggggucccagcc

SEQ ID NO: 2276049 - RNA, 19 nt, Human
ccccaggggaaagaugagc

SEQ ID NO: 2276050 - RNA, 20 nt, Human
ccccaggggaaagaugagcu

SEQ ID NO: 2276051 - RNA, 21 nt, Human
ccccagggccugagccuggcc

SEQ ID NO: 2276052 - RNA, 19 nt, Human
ccccagggccugagccugg

SEQ ID NO: 2276053 - RNA, 16 nt, Human
ccccaggggaaaauga

SEQ ID NO: 2276054 - RNA, 17 nt, Human
ccccaggggaaaaugaa

SEQ ID NO: 2276055 - RNA, 18 nt, Human
ccccaggggaaaaugaag

SEQ ID NO: 2276056 - RNA, 12 nt, Human
ccccagggcacu

SEQ ID NO: 2276057 - RNA, 22 nt, Human
ccccagggcacuucacagagug

SEQ ID NO: 2276058 - RNA, 20 nt, Human
ccccagggcacuucacagag

SEQ ID NO: 2276059 - RNA, 21 nt, Human
ccccagggcacuucacagagu

SEQ ID NO: 2276060 - RNA, 16 nt, Human
ccccagggccugagcc

SEQ ID NO: 2276061 - RNA, 15 nt, Human
ccccagggccugagc

SEQ ID NO: 2276062 - RNA, 14 nt, Human
ccccagggccugag

SEQ ID NO: 2276063 - RNA, 12 nt, Human
ccccaggaggcc

SEQ ID NO: 2276064 - RNA, 13 nt, Human
ccccaggacuggg

SEQ ID NO: 2276065 - RNA, 14 nt, Human
ccccaggacugggc

SEQ ID NO: 2276066 - RNA, 16 nt, Human
ccccaggacugggcca

SEQ ID NO: 2276067 - RNA, 22 nt, Human
ccccaggacugggccacuucug

SEQ ID NO: 2276068 - RNA, 21 nt, Human
ccccaggaccuggcugccaua

SEQ ID NO: 2276069 - RNA, 20 nt, Human
ccccaggaccuggcugccau

SEQ ID NO: 2276070 - RNA, 17 nt, Human
ccccaggaccuggcugc

SEQ ID NO: 2276071 - RNA, 15 nt, Human
ccccaggaccuggcu

SEQ ID NO: 2276072 - RNA, 21 nt, Human
ccccaggaccagcucaggaca

SEQ ID NO: 2276073 - RNA, 19 nt, Human
ccccaggaccagcucagga

SEQ ID NO: 2276074 - RNA, 18 nt, Human
ccccaggaccagcucagg

SEQ ID NO: 2276075 - RNA, 21 nt, Human
ccccagcugggaggcaagagg

SEQ ID NO: 2276076 - RNA, 22 nt, Human
ccccagcugggaggcaagaggg

SEQ ID NO: 2276077 - RNA, 23 nt, Human
ccccacacuuguuccagcucuuu

SEQ ID NO: 2276078 - RNA, 11 nt, Human
ccccacagccc

SEQ ID NO: 2276079 - RNA, 12 nt, Human
ccccacagccca

SEQ ID NO: 2276080 - RNA, 13 nt, Human
ccccacagcccac

SEQ ID NO: 2276081 - RNA, 15 nt, Human
ccccacagcccacgu

SEQ ID NO: 2276082 - RNA, 16 nt, Human
ccccacagcccacguc

SEQ ID NO: 2276083 - RNA, 19 nt, Human
ccccacagcccacguccug

SEQ ID NO: 2276084 - RNA, 23 nt, Human
ccccacaggagguggucugggac

SEQ ID NO: 2276085 - RNA, 22 nt, Human
ccccacagcccacguccuguca

SEQ ID NO: 2276086 - RNA, 21 nt, Human
ccccacagcccacguccuguc

SEQ ID NO: 2276087 - RNA, 23 nt, Human
ccccaccacgauguggcccuggc

SEQ ID NO: 2276088 - RNA, 12 nt, Human
ccccaccaccua

SEQ ID NO: 2276089 - RNA, 14 nt, Human
ccccaccaccccag

SEQ ID NO: 2276090 - RNA, 19 nt, Human
ccccaccaagggcgcaaga

SEQ ID NO: 2276091 - RNA, 21 nt, Human
ccccaccaagggcgcaagagu

SEQ ID NO: 2276092 - RNA, 16 nt, Human
ccccagccccauccca

SEQ ID NO: 2276093 - RNA, 17 nt, Human
ccccaccacuucuuuua

SEQ ID NO: 2276094 - RNA, 17 nt, Human
ccccagcccccuuuggg

SEQ ID NO: 2276095 - RNA, 23 nt, Human
ccccagcccccuuugggcccagg

SEQ ID NO: 2276096 - RNA, 15 nt, Human
ccccagccccauccu

SEQ ID NO: 2276097 - RNA, 15 nt, Human
ccccagccccuagcc

SEQ ID NO: 2276098 - RNA, 13 nt, Human
ccccagccccggg

SEQ ID NO: 2276099 - RNA, 18 nt, Human
ccccagccccuagcccag

SEQ ID NO: 2276100 - RNA, 20 nt, Human
ccccagccccuagcccagga

SEQ ID NO: 2276101 - RNA, 22 nt, Human
ccccagccccuagcccaggaga

SEQ ID NO: 2276102 - RNA, 17 nt, Human
ccccagcucuggcuucc

SEQ ID NO: 2276103 - RNA, 22 nt, Human
ccccagccuggcccagcucccc

SEQ ID NO: 2276104 - RNA, 19 nt, Human
ccccagccuggcccagcuc

SEQ ID NO: 2276105 - RNA, 21 nt, Human
ccccagccuggcccagcuccc

SEQ ID NO: 2276106 - RNA, 15 nt, Human
ccccagccuggccca

SEQ ID NO: 2276107 - RNA, 16 nt, Human
ccccagccuggcccag

SEQ ID NO: 2276108 - RNA, 17 nt, Human
ccccagccuggcccagc

SEQ ID NO: 2276109 - RNA, 18 nt, Human
ccccagccuggcccagcu

SEQ ID NO: 2276110 - RNA, 13 nt, Human
ccccagccugcua

SEQ ID NO: 2276111 - RNA, 11 nt, Human
ccccagccugg

SEQ ID NO: 2276112 - RNA, 12 nt, Human
ccccagccuggc

SEQ ID NO: 2276113 - RNA, 13 nt, Human
ccccagccuggcc

SEQ ID NO: 2276114 - RNA, 21 nt, Human
ccccagcuggggccaggcugg

SEQ ID NO: 2276115 - RNA, 22 nt, Human
ccccagcuggggccaggcuggg

SEQ ID NO: 2276116 - RNA, 14 nt, Human
ccccagcucuggug

SEQ ID NO: 2276117 - RNA, 22 nt, Human
ccccagcucuggugagucuugg

SEQ ID NO: 2276118 - RNA, 10 nt, Human
ccccagcuga

SEQ ID NO: 2276119 - RNA, 16 nt, Human
ccccagcugacaugga

SEQ ID NO: 2276120 - RNA, 13 nt, Human
ccccagcugcuug

SEQ ID NO: 2276121 - RNA, 10 nt, Human
ccccagcugg

SEQ ID NO: 2276122 - RNA, 11 nt, Human
ccccagcuggc

SEQ ID NO: 2276123 - RNA, 12 nt, Human
ccccagcuggcc

SEQ ID NO: 2276124 - RNA, 13 nt, Human
ccccagcuggccc

SEQ ID NO: 2276125 - RNA, 21 nt, Human
ccccagcuggcccgugacaga

SEQ ID NO: 2276126 - RNA, 11 nt, Human
ccccagcuggg

SEQ ID NO: 2276127 - RNA, 12 nt, Human
ccccagcuggga

SEQ ID NO: 2276128 - RNA, 13 nt, Human
ccccagcugggag

SEQ ID NO: 2276129 - RNA, 14 nt, Human
ccccagcugggagg

SEQ ID NO: 2276130 - RNA, 15 nt, Human
ccccagcugggaggc

SEQ ID NO: 2276131 - RNA, 19 nt, Human
cccgcaccccccaagcugu

SEQ ID NO: 2276132 - RNA, 15 nt, Human
cccugccagugccuu

SEQ ID NO: 2276133 - RNA, 14 nt, Human
cccugccagugccu

SEQ ID NO: 2276134 - RNA, 14 nt, Human
cccugccagggcag

SEQ ID NO: 2276135 - RNA, 20 nt, Human
cccugccaucauguuuacag

SEQ ID NO: 2276136 - RNA, 12 nt, Human
cccugccagggc

SEQ ID NO: 2276137 - RNA, 18 nt, Human
cccugccaucuucccagc

SEQ ID NO: 2276138 - RNA, 19 nt, Human
cccugccaucuucccagca

SEQ ID NO: 2276139 - RNA, 13 nt, Human
cccugccaucuuc

SEQ ID NO: 2276140 - RNA, 14 nt, Human
cccugccaucuucc

SEQ ID NO: 2276141 - RNA, 16 nt, Human
cccugccaucuuccca

SEQ ID NO: 2276142 - RNA, 17 nt, Human
cccugccaucuucccag

SEQ ID NO: 2276143 - RNA, 14 nt, Human
cccugccuccuuug

SEQ ID NO: 2276144 - RNA, 11 nt, Human
cccugccucuc

SEQ ID NO: 2276145 - RNA, 18 nt, Human
cccugccucucugcaggu

SEQ ID NO: 2276146 - RNA, 16 nt, Human
cccugccuccuuugug

SEQ ID NO: 2276147 - RNA, 23 nt, Human
cccugccuccuuugugaggaagc

SEQ ID NO: 2276148 - RNA, 17 nt, Human
cccugccacccugggga

SEQ ID NO: 2276149 - RNA, 18 nt, Human
cccugccacccuggggag

SEQ ID NO: 2276150 - RNA, 22 nt, Human
cccugccaggagcuuuggaccu

SEQ ID NO: 2276151 - RNA, 15 nt, Human
cccugccaccaggcc

SEQ ID NO: 2276152 - RNA, 14 nt, Human
cccugccaccuccc

SEQ ID NO: 2276153 - RNA, 17 nt, Human
cccugccaccucccuga

SEQ ID NO: 2276154 - RNA, 12 nt, Human
cccugccacccu

SEQ ID NO: 2276155 - RNA, 21 nt, Human
cccugcauucuuucuguauug

SEQ ID NO: 2276156 - RNA, 14 nt, Human
cccugccaccaggc

SEQ ID NO: 2276157 - RNA, 14 nt, Human
cccugccacccugg

SEQ ID NO: 2276158 - RNA, 15 nt, Human
cccugccacccuggg

SEQ ID NO: 2276159 - RNA, 20 nt, Human
cccugaucaagucaccggag

SEQ ID NO: 2276160 - RNA, 19 nt, Human
cccugauaacaaccuggag

SEQ ID NO: 2276161 - RNA, 23 nt, Human
cccugaguggaucuccaaggacc

SEQ ID NO: 2276162 - RNA, 18 nt, Human
cccugauaacaaccugga

SEQ ID NO: 2276163 - RNA, 16 nt, Human
cccucucaggcaugcc

SEQ ID NO: 2276164 - RNA, 22 nt, Human
cccugaguggaucuccaaggac

SEQ ID NO: 2276165 - RNA, 21 nt, Human
cccucucaggcaugccugugu

SEQ ID NO: 2276166 - RNA, 21 nt, Human
cccugaguggaucuccaagga

SEQ ID NO: 2276167 - RNA, 14 nt, Human
cccucucagcucca

SEQ ID NO: 2276168 - RNA, 17 nt, Human
cccucucagcuccaggu

SEQ ID NO: 2276169 - RNA, 23 nt, Human
cccugauuuaggagaagccagga

SEQ ID NO: 2276170 - RNA, 21 nt, Human
cccugauuuaggagaagccag

SEQ ID NO: 2276171 - RNA, 21 nt, Human
cccugaucugacauccccacu

SEQ ID NO: 2276172 - RNA, 22 nt, Human
cccugaucugacauccccacuc

SEQ ID NO: 2276173 - RNA, 15 nt, Human
cccugauccugugaa

SEQ ID NO: 2276174 - RNA, 19 nt, Human
cccugauuacaccagccuc

SEQ ID NO: 2276175 - RNA, 19 nt, Human
cccucuagaaauuuuucag

SEQ ID NO: 2276176 - RNA, 15 nt, Human
cccucuauuuagcau

SEQ ID NO: 2276177 - RNA, 17 nt, Human
cccucucacugucugag

SEQ ID NO: 2276178 - RNA, 12 nt, Human
cccucucagagc

SEQ ID NO: 2276179 - RNA, 21 nt, Human
cccucucagagcuacuugggc

SEQ ID NO: 2276180 - RNA, 13 nt, Human
cccucucagcucc

SEQ ID NO: 2276181 - RNA, 18 nt, Human
cccuccgccaggcgagau

SEQ ID NO: 2276182 - RNA, 15 nt, Human
cccucuacagagcuu

SEQ ID NO: 2276183 - RNA, 13 nt, Human
cccuccgcccugc

SEQ ID NO: 2276184 - RNA, 21 nt, Human
cccucuacagagcuucccuga

SEQ ID NO: 2276185 - RNA, 18 nt, Human
cccucuacagagcuuccc

SEQ ID NO: 2276186 - RNA, 20 nt, Human
cccucuacugggagccuacc

SEQ ID NO: 2276187 - RNA, 17 nt, Human
cccucuacugggagccu

SEQ ID NO: 2276188 - RNA, 20 nt, Human
cccugcagagggcacagaaa

SEQ ID NO: 2276189 - RNA, 18 nt, Human
cccugcagagggcacaga

SEQ ID NO: 2276190 - RNA, 22 nt, Human
cccugcacuugcagacucuaca

SEQ ID NO: 2276191 - RNA, 12 nt, Human
cccugcagaggg

SEQ ID NO: 2276192 - RNA, 19 nt, Human
cccugcaaaaugagacccu

SEQ ID NO: 2276193 - RNA, 18 nt, Human
cccugauuugcugggcag

SEQ ID NO: 2276194 - RNA, 20 nt, Human
cccugcaaaaggacucucag

SEQ ID NO: 2276195 - RNA, 18 nt, Human
cccugcaaaaggacucuc

SEQ ID NO: 2276196 - RNA, 22 nt, Human
cccugcaaccugauugugucuc

SEQ ID NO: 2276197 - RNA, 16 nt, Human
cccugcaaccugauug

SEQ ID NO: 2276198 - RNA, 13 nt, Human
cccugcugguuca

SEQ ID NO: 2276199 - RNA, 23 nt, Human
cccugccugagggccccucugcc

SEQ ID NO: 2276200 - RNA, 19 nt, Human
cccugccugagggccccuc

SEQ ID NO: 2276201 - RNA, 20 nt, Human
cccugccugagggccccucu

SEQ ID NO: 2276202 - RNA, 21 nt, Human
cccugccugagggccccucug

SEQ ID NO: 2276203 - RNA, 22 nt, Human
cccugccugagggccccucugc

SEQ ID NO: 2276204 - RNA, 16 nt, Human
cccugccucucugcag

SEQ ID NO: 2276205 - RNA, 12 nt, Human
cccugccucuca

SEQ ID NO: 2276206 - RNA, 13 nt, Human
cccugccucuguu

SEQ ID NO: 2276207 - RNA, 13 nt, Human
cccugccugaggg

SEQ ID NO: 2276208 - RNA, 21 nt, Human
cccugccucucugcagguccc

SEQ ID NO: 2276209 - RNA, 22 nt, Human
cccugccucucugcaggucccu

SEQ ID NO: 2276210 - RNA, 19 nt, Human
cccugcugguucaggguug

SEQ ID NO: 2276211 - RNA, 20 nt, Human
cccugcugguucaggguugg

SEQ ID NO: 2276212 - RNA, 23 nt, Human
cccugcuuugggcugcccuggug

SEQ ID NO: 2276213 - RNA, 10 nt, Human
cccugcuguc

SEQ ID NO: 2276214 - RNA, 22 nt, Human
cccugcuuugggcugcccuggu

SEQ ID NO: 2276215 - RNA, 23 nt, Human
cccugccuggggcgggccccuca

SEQ ID NO: 2276216 - RNA, 21 nt, Human
cccuggacugugugcucagga

SEQ ID NO: 2276217 - RNA, 21 nt, Human
cccuggagaggcccucuggag

SEQ ID NO: 2276218 - RNA, 13 nt, Human
cccuggagagaag

SEQ ID NO: 2276219 - RNA, 13 nt, Human
cccuggagaguuc

SEQ ID NO: 2276220 - RNA, 21 nt, Human
cccuggagaguucaauggcug

SEQ ID NO: 2276221 - RNA, 18 nt, Human
cccuggaacugucucuca

SEQ ID NO: 2276222 - RNA, 15 nt, Human
cccuggaacugucuc

SEQ ID NO: 2276223 - RNA, 22 nt, Human
cccugguggcagugggagcugc

SEQ ID NO: 2276224 - RNA, 16 nt, Human
cccuggugggccaaca

SEQ ID NO: 2276225 - RNA, 23 nt, Human
cccugguggagaaagcacugacc

SEQ ID NO: 2276226 - RNA, 19 nt, Human
cccugguggacaguccugg

SEQ ID NO: 2276227 - RNA, 18 nt, Human
cccugguggacaguccug

SEQ ID NO: 2276228 - RNA, 17 nt, Human
cccugguggacaguccu

SEQ ID NO: 2276229 - RNA, 21 nt, Human
cccugguggacaguccuggga

SEQ ID NO: 2276230 - RNA, 20 nt, Human
cccugguggacaguccuggg

SEQ ID NO: 2276231 - RNA, 23 nt, Human
cccugguggacaguccugggaga

SEQ ID NO: 2276232 - RNA, 20 nt, Human
cccugguggagaaagcacug

SEQ ID NO: 2276233 - RNA, 18 nt, Human
cccugggggaagcccugg

SEQ ID NO: 2276234 - RNA, 17 nt, Human
cccugggggaagcccug

SEQ ID NO: 2276235 - RNA, 19 nt, Human
cccuggggcuucuccugac

SEQ ID NO: 2276236 - RNA, 21 nt, Human
cccuggggcuucuccugaccc

SEQ ID NO: 2276237 - RNA, 21 nt, Human
cccuggggcuaggcuggagcc

SEQ ID NO: 2276238 - RNA, 15 nt, Human
cccuggggcuucucc

SEQ ID NO: 2276239 - RNA, 18 nt, Human
cccuggggcuucuccuga

SEQ ID NO: 2276240 - RNA, 20 nt, Human
cccugggggaagcccuggau

SEQ ID NO: 2276241 - RNA, 19 nt, Human
cccugggggaagcccugga

SEQ ID NO: 2276242 - RNA, 17 nt, Human
cccugggugggcucugu

SEQ ID NO: 2276243 - RNA, 18 nt, Human
cccugggugggcucugug

SEQ ID NO: 2276244 - RNA, 20 nt, Human
cccugggugggcucugugca

SEQ ID NO: 2276245 - RNA, 17 nt, Human
cccuggugcugccacac

SEQ ID NO: 2276246 - RNA, 21 nt, Human
cccuggugcugccacacuuca

SEQ ID NO: 2276247 - RNA, 22 nt, Human
cccugggugggugguggggagg

SEQ ID NO: 2276248 - RNA, 16 nt, Human
cccuggguggguggug

SEQ ID NO: 2276249 - RNA, 21 nt, Human
cccugggugggugguggggag

SEQ ID NO: 2276250 - RNA, 23 nt, Human
cccugggugggugguggggaggg

SEQ ID NO: 2276251 - RNA, 14 nt, Human
cccugggccccacc

SEQ ID NO: 2276252 - RNA, 12 nt, Human
cccuggaagccg

SEQ ID NO: 2276253 - RNA, 15 nt, Human
cccugggauguccac

SEQ ID NO: 2276254 - RNA, 13 nt, Human
cccuggaggugcc

SEQ ID NO: 2276255 - RNA, 17 nt, Human
cccugggaggcucugga

SEQ ID NO: 2276256 - RNA, 18 nt, Human
cccugggaggcucuggag

SEQ ID NO: 2276257 - RNA, 23 nt, Human
cccuggagccagacucuggucuu

SEQ ID NO: 2276258 - RNA, 12 nt, Human
cccuggagccca

SEQ ID NO: 2276259 - RNA, 13 nt, Human
cccuggagccaga

SEQ ID NO: 2276260 - RNA, 14 nt, Human
cccuggagccagac

SEQ ID NO: 2276261 - RNA, 20 nt, Human
cccuggagccagacucuggu

SEQ ID NO: 2276262 - RNA, 21 nt, Human
cccuggagccagacucugguc

SEQ ID NO: 2276263 - RNA, 16 nt, Human
cccuggagccaacugc

SEQ ID NO: 2276264 - RNA, 22 nt, Human
cccuggagaguucaauggcugc

SEQ ID NO: 2276265 - RNA, 23 nt, Human
cccuggagaguucaauggcugcu

SEQ ID NO: 2276266 - RNA, 19 nt, Human
cccuggagccaacugcugc

SEQ ID NO: 2276267 - RNA, 20 nt, Human
cccuggagccaacugcugcu

SEQ ID NO: 2276268 - RNA, 21 nt, Human
cccuggagccaacugcugcuu

SEQ ID NO: 2276269 - RNA, 22 nt, Human
cccuggagccaacugcugcuuu

SEQ ID NO: 2276270 - RNA, 15 nt, Human
cccugggaggcucug

SEQ ID NO: 2276271 - RNA, 19 nt, Human
cccuggaggcacugaagug

SEQ ID NO: 2276272 - RNA, 16 nt, Human
cccugggaggcucugg

SEQ ID NO: 2276273 - RNA, 14 nt, Human
cccugguggcagcu

SEQ ID NO: 2276274 - RNA, 21 nt, Human
ccucagagugcaagccccugc

SEQ ID NO: 2276275 - RNA, 14 nt, Human
ccucagagugcaag

SEQ ID NO: 2276276 - RNA, 16 nt, Human
ccucagaucuucugug

SEQ ID NO: 2276277 - RNA, 13 nt, Human
ccucagcaccccu

SEQ ID NO: 2276278 - RNA, 19 nt, Human
ccucagcaccccugucucu

SEQ ID NO: 2276279 - RNA, 14 nt, Human
ccucagcaccccuu

SEQ ID NO: 2276280 - RNA, 19 nt, Human
ccucagaguccaggcccca

SEQ ID NO: 2276281 - RNA, 13 nt, Human
ccucagcccugac

SEQ ID NO: 2276282 - RNA, 15 nt, Human
ccucagcccugaccc

SEQ ID NO: 2276283 - RNA, 23 nt, Human
ccucagccccucuugccccccac

SEQ ID NO: 2276284 - RNA, 20 nt, Human
ccucagccccucuugccccc

SEQ ID NO: 2276285 - RNA, 19 nt, Human
ccucagccccucuugcccc

SEQ ID NO: 2276286 - RNA, 18 nt, Human
ccucagccccucuugccc

SEQ ID NO: 2276287 - RNA, 16 nt, Human
ccucagccccucuugc

SEQ ID NO: 2276288 - RNA, 14 nt, Human
ccucagccccucuu

SEQ ID NO: 2276289 - RNA, 13 nt, Human
ccucagccccucu

SEQ ID NO: 2276290 - RNA, 23 nt, Human
ccucagccauucacugcccccag

SEQ ID NO: 2276291 - RNA, 21 nt, Human
ccucagccaugaggaguugcu

SEQ ID NO: 2276292 - RNA, 16 nt, Human
ccucagccauucacug

SEQ ID NO: 2276293 - RNA, 16 nt, Human
ccucagccaugaggag

SEQ ID NO: 2276294 - RNA, 20 nt, Human
ccucagcaccccuuccaugu

SEQ ID NO: 2276295 - RNA, 22 nt, Human
ccucagcaccccuuccaugugg

SEQ ID NO: 2276296 - RNA, 17 nt, Human
ccucagccagagaagcu

SEQ ID NO: 2276297 - RNA, 15 nt, Human
ccucagcaccccuuc

SEQ ID NO: 2276298 - RNA, 16 nt, Human
ccucagcaccccuucc

SEQ ID NO: 2276299 - RNA, 17 nt, Human
ccucagcaccccuucca

SEQ ID NO: 2276300 - RNA, 18 nt, Human
ccucagcaccccuuccau

SEQ ID NO: 2276301 - RNA, 16 nt, Human
ccucagcccugacccu

SEQ ID NO: 2276302 - RNA, 17 nt, Human
ccucagcccugacccug

SEQ ID NO: 2276303 - RNA, 23 nt, Human
ccucaggccugggggcugggcag

SEQ ID NO: 2276304 - RNA, 18 nt, Human
ccucagcccugacccugu

SEQ ID NO: 2276305 - RNA, 12 nt, Human
ccucaggcugcu

SEQ ID NO: 2276306 - RNA, 19 nt, Human
ccucagcccgccaagguag

SEQ ID NO: 2276307 - RNA, 17 nt, Human
ccucaggcugcuggagg

SEQ ID NO: 2276308 - RNA, 16 nt, Human
ccucaggcugcuggag

SEQ ID NO: 2276309 - RNA, 15 nt, Human
ccucaggcugcugga

SEQ ID NO: 2276310 - RNA, 14 nt, Human
ccucaggcugcugg

SEQ ID NO: 2276311 - RNA, 21 nt, Human
ccucagggacagagacaccug

SEQ ID NO: 2276312 - RNA, 20 nt, Human
ccucagggacagagacaccu

SEQ ID NO: 2276313 - RNA, 11 nt, Human
ccucagggaca

SEQ ID NO: 2276314 - RNA, 18 nt, Human
ccucaggcugcuggagga

SEQ ID NO: 2276315 - RNA, 17 nt, Human
ccucaggcuuccuuggc

SEQ ID NO: 2276316 - RNA, 16 nt, Human
ccucaggcuuccuugg

SEQ ID NO: 2276317 - RNA, 23 nt, Human
ccucagggacagagacaccugca

SEQ ID NO: 2276318 - RNA, 22 nt, Human
ccucagggacagagacaccugc

SEQ ID NO: 2276319 - RNA, 24 nt, Human
ccucagggacagagacaccugcac

SEQ ID NO: 2276320 - RNA, 16 nt, Human
ccucagggucccuggu

SEQ ID NO: 2276321 - RNA, 17 nt, Human
ccucagggucccuggug

SEQ ID NO: 2276322 - RNA, 20 nt, Human
ccucagggucccugguggca

SEQ ID NO: 2276323 - RNA, 23 nt, Human
ccucagggaucuugcauucccag

SEQ ID NO: 2276324 - RNA, 22 nt, Human
ccucagggucccugguggcagc

SEQ ID NO: 2276325 - RNA, 15 nt, Human
ccucacaucuuucac

SEQ ID NO: 2276326 - RNA, 17 nt, Human
ccucacagcuggccguc

SEQ ID NO: 2276327 - RNA, 16 nt, Human
ccucacaucuuucaca

SEQ ID NO: 2276328 - RNA, 13 nt, Human
ccucaccaggggc

SEQ ID NO: 2276329 - RNA, 14 nt, Human
ccucaccaggggca

SEQ ID NO: 2276330 - RNA, 19 nt, Human
ccucaccaggggcaggcac

SEQ ID NO: 2276331 - RNA, 15 nt, Human
ccucacccugagccc

SEQ ID NO: 2276332 - RNA, 18 nt, Human
ccucacccugagccccuu

SEQ ID NO: 2276333 - RNA, 21 nt, Human
ccucacccugagccccuuccu

SEQ ID NO: 2276334 - RNA, 23 nt, Human
ccucaccaggggcaggcacagca

SEQ ID NO: 2276335 - RNA, 20 nt, Human
ccucaccaggggcaggcaca

SEQ ID NO: 2276336 - RNA, 22 nt, Human
ccucaccaggggcaggcacagc

SEQ ID NO: 2276337 - RNA, 14 nt, Human
ccucacccuggggc

SEQ ID NO: 2276338 - RNA, 18 nt, Human
ccucaccgagugggggca

SEQ ID NO: 2276339 - RNA, 14 nt, Human
ccucacccugccuu

SEQ ID NO: 2276340 - RNA, 23 nt, Human
ccucacccugagccccuuccuug

SEQ ID NO: 2276341 - RNA, 11 nt, Human
ccucacccugc

SEQ ID NO: 2276342 - RNA, 15 nt, Human
ccucacccugccuua

SEQ ID NO: 2276343 - RNA, 22 nt, Human
ccucacccugccuuaucuugca

SEQ ID NO: 2276344 - RNA, 20 nt, Human
ccucacucccuucccauaag

SEQ ID NO: 2276345 - RNA, 14 nt, Human
ccucacucccuucu

SEQ ID NO: 2276346 - RNA, 13 nt, Human
ccucaccuccucu

SEQ ID NO: 2276347 - RNA, 23 nt, Human
ccucaccucaugcccacccccug

SEQ ID NO: 2276348 - RNA, 17 nt, Human
ccucacuauucaaguau

SEQ ID NO: 2276349 - RNA, 12 nt, Human
ccucaccucaug

SEQ ID NO: 2276350 - RNA, 14 nt, Human
ccucaccucaugcc

SEQ ID NO: 2276351 - RNA, 15 nt, Human
ccucaccucaugccc

SEQ ID NO: 2276352 - RNA, 16 nt, Human
ccucaccucaugccca

SEQ ID NO: 2276353 - RNA, 17 nt, Human
ccucaccucaugcccac

SEQ ID NO: 2276354 - RNA, 19 nt, Human
ccucaccucaugcccaccc

SEQ ID NO: 2276355 - RNA, 22 nt, Human
ccucaccucaugcccacccccu

SEQ ID NO: 2276356 - RNA, 12 nt, Human
ccucacuccugu

SEQ ID NO: 2276357 - RNA, 17 nt, Human
ccucacucuggccucag

SEQ ID NO: 2276358 - RNA, 15 nt, Human
ccucacucuugccaa

SEQ ID NO: 2276359 - RNA, 13 nt, Human
ccucacuccuguu

SEQ ID NO: 2276360 - RNA, 19 nt, Human
ccucacucccuucuaccug

SEQ ID NO: 2276361 - RNA, 20 nt, Human
ccucacucccuucuaccugc

SEQ ID NO: 2276362 - RNA, 21 nt, Human
ccucacucccuucuaccugcc

SEQ ID NO: 2276363 - RNA, 22 nt, Human
ccucacucccuucuaccugcca

SEQ ID NO: 2276364 - RNA, 21 nt, Human
ccucacuggguggggugagga

SEQ ID NO: 2276365 - RNA, 14 nt, Human
ccucacuggguggg

SEQ ID NO: 2276366 - RNA, 13 nt, Human
ccucacugggugg

SEQ ID NO: 2276367 - RNA, 12 nt, Human
ccucacugggug

SEQ ID NO: 2276368 - RNA, 23 nt, Human
ccucacugggguccuggggccuc

SEQ ID NO: 2276369 - RNA, 20 nt, Human
ccucacugggguccuggggc

SEQ ID NO: 2276370 - RNA, 19 nt, Human
ccucacugggguccugggg

SEQ ID NO: 2276371 - RNA, 18 nt, Human
ccucacuggccaucccuc

SEQ ID NO: 2276372 - RNA, 22 nt, Human
ccucacuggccaucccucgugg

SEQ ID NO: 2276373 - RNA, 16 nt, Human
ccucacucuugccaac

SEQ ID NO: 2276374 - RNA, 17 nt, Human
ccucacucuugccaacc

SEQ ID NO: 2276375 - RNA, 18 nt, Human
ccucacugaaaacaucug

SEQ ID NO: 2276376 - RNA, 20 nt, Human
ccucacugaaaacaucugga

SEQ ID NO: 2276377 - RNA, 17 nt, Human
ccucacugaaugccuca

SEQ ID NO: 2276378 - RNA, 16 nt, Human
ccucacugcucccuga

SEQ ID NO: 2276379 - RNA, 17 nt, Human
ccucacugcucccugaa

SEQ ID NO: 2276380 - RNA, 19 nt, Human
ccucacugcucccugaagc

SEQ ID NO: 2276381 - RNA, 21 nt, Human
ccucacugcucccugaagcca

SEQ ID NO: 2276382 - RNA, 14 nt, Human
ccucacuggaugaa

SEQ ID NO: 2276383 - RNA, 12 nt, Human
ccucacuggcca

SEQ ID NO: 2276384 - RNA, 15 nt, Human
ccucacuggccaucc

SEQ ID NO: 2276385 - RNA, 17 nt, Human
ccucacuggccaucccu

SEQ ID NO: 2276386 - RNA, 19 nt, Human
ccucagacuuaccaggaag

SEQ ID NO: 2276387 - RNA, 22 nt, Human
ccucagacuuaccaggaagcag

SEQ ID NO: 2276388 - RNA, 17 nt, Human
ccucagacuuaccagga

SEQ ID NO: 2276389 - RNA, 19 nt, Human
ccucacuuccauacagcuc

SEQ ID NO: 2276390 - RNA, 21 nt, Human
ccucacuuccauacagcucua

SEQ ID NO: 2276391 - RNA, 14 nt, Human
ccucacuugaaugu

SEQ ID NO: 2276392 - RNA, 16 nt, Human
ccucacuguugaauuu

SEQ ID NO: 2276393 - RNA, 18 nt, Human
ccucagaguccaggcccc

SEQ ID NO: 2276394 - RNA, 17 nt, Human
ccucagaguccaggccc

SEQ ID NO: 2276395 - RNA, 16 nt, Human
ccucagaguccaggcc

SEQ ID NO: 2276396 - RNA, 15 nt, Human
ccucagaguccaggc

SEQ ID NO: 2276397 - RNA, 13 nt, Human
ccucagaguccag

SEQ ID NO: 2276398 - RNA, 16 nt, Human
ccucagagccaccccu

SEQ ID NO: 2276399 - RNA, 11 nt, Human
ccucacacagc

SEQ ID NO: 2276400 - RNA, 12 nt, Human
ccucacacuggg

SEQ ID NO: 2276401 - RNA, 15 nt, Human
ccucacacugggacu

SEQ ID NO: 2276402 - RNA, 13 nt, Human
ccucacacuggga

SEQ ID NO: 2276403 - RNA, 14 nt, Human
ccucacacucaccc

SEQ ID NO: 2276404 - RNA, 17 nt, Human
ccuauugugauuugacu

SEQ ID NO: 2276405 - RNA, 18 nt, Human
ccuauugugauuugacug

SEQ ID NO: 2276406 - RNA, 21 nt, Human
ccuauugugauuugacuguuu

SEQ ID NO: 2276407 - RNA, 16 nt, Human
ccuauucucaccagga

SEQ ID NO: 2276408 - RNA, 19 nt, Human
ccuauucucaccaggaagg

SEQ ID NO: 2276409 - RNA, 15 nt, Human
ccuauucucgggcug

SEQ ID NO: 2276410 - RNA, 22 nt, Human
ccuauugcaaagguuccaacug

SEQ ID NO: 2276411 - RNA, 13 nt, Human
ccuauugucauua

SEQ ID NO: 2276412 - RNA, 15 nt, Human
ccuauugucauuaaa

SEQ ID NO: 2276413 - RNA, 12 nt, Human
ccuauugugauu

SEQ ID NO: 2276414 - RNA, 13 nt, Human
ccuauugugauuu

SEQ ID NO: 2276415 - RNA, 14 nt, Human
ccuauugugauuug

SEQ ID NO: 2276416 - RNA, 15 nt, Human
ccuauugugauuuga

SEQ ID NO: 2276417 - RNA, 24 nt, Human
ccucacaguccuuaccagcagagc

SEQ ID NO: 2276418 - RNA, 22 nt, Human
ccucacagccucugaccccucc

SEQ ID NO: 2276419 - RNA, 23 nt, Human
ccucacagccucugaccccuccu

SEQ ID NO: 2276420 - RNA, 18 nt, Human
ccucacagccucugaccc

SEQ ID NO: 2276421 - RNA, 19 nt, Human
ccucacagccucugacccc

SEQ ID NO: 2276422 - RNA, 20 nt, Human
ccucacagccucugaccccu

SEQ ID NO: 2276423 - RNA, 21 nt, Human
ccucacagccucugaccccuc

SEQ ID NO: 2276424 - RNA, 23 nt, Human
ccucacaguccuuaccagcagag

SEQ ID NO: 2276425 - RNA, 15 nt, Human
ccucacagcacagag

SEQ ID NO: 2276426 - RNA, 19 nt, Human
ccucacagcacagagaaga

SEQ ID NO: 2276427 - RNA, 12 nt, Human
ccucacagccuc

SEQ ID NO: 2276428 - RNA, 13 nt, Human
ccucacagccucu

SEQ ID NO: 2276429 - RNA, 14 nt, Human
ccucacagccucug

SEQ ID NO: 2276430 - RNA, 15 nt, Human
ccucacagccucuga

SEQ ID NO: 2276431 - RNA, 16 nt, Human
ccucacagccucugac

SEQ ID NO: 2276432 - RNA, 17 nt, Human
ccuauuagagaagagau

SEQ ID NO: 2276433 - RNA, 14 nt, Human
ccuauucccacacc

SEQ ID NO: 2276434 - RNA, 21 nt, Human
ccuauucccacaccuccacag

SEQ ID NO: 2276435 - RNA, 22 nt, Human
ccuauucccacaccuccacagu

SEQ ID NO: 2276436 - RNA, 15 nt, Human
ccuauuccuccuggg

SEQ ID NO: 2276437 - RNA, 22 nt, Human
ccuauucuauugcaguuauaga

SEQ ID NO: 2276438 - RNA, 11 nt, Human
ccuauucucac

SEQ ID NO: 2276439 - RNA, 13 nt, Human
ccuauucucacca

SEQ ID NO: 2276440 - RNA, 15 nt, Human
ccuauucucaccagg

SEQ ID NO: 2276441 - RNA, 21 nt, Human
ccuauucaguucccagaauca

SEQ ID NO: 2276442 - RNA, 16 nt, Human
ccuauuagagaagaga

SEQ ID NO: 2276443 - RNA, 22 nt, Human
ccuauguuuuuguucaaagcca

SEQ ID NO: 2276444 - RNA, 11 nt, Human
ccuauguguaa

SEQ ID NO: 2276445 - RNA, 23 nt, Human
ccuaugugauuuuaacucugucu

SEQ ID NO: 2276446 - RNA, 22 nt, Human
ccuaugugauuuuaacucuguc

SEQ ID NO: 2276447 - RNA, 22 nt, Human
ccuaucuguuuacaguguuccg

SEQ ID NO: 2276448 - RNA, 20 nt, Human
ccuaucucgugggagagcca

SEQ ID NO: 2276449 - RNA, 17 nt, Human
ccuaucucgugggagag

SEQ ID NO: 2276450 - RNA, 18 nt, Human
ccuaucucgugggagagc

SEQ ID NO: 2276451 - RNA, 16 nt, Human
ccuaucucgugggaga

SEQ ID NO: 2276452 - RNA, 21 nt, Human
ccuaguggggucucccucucc

SEQ ID NO: 2276453 - RNA, 17 nt, Human
ccuauccacccagccca

SEQ ID NO: 2276454 - RNA, 16 nt, Human
ccuauccacccagccc

SEQ ID NO: 2276455 - RNA, 20 nt, Human
ccuaguggggucucccucuc

SEQ ID NO: 2276456 - RNA, 19 nt, Human
ccuaguggggucucccucu

SEQ ID NO: 2276457 - RNA, 18 nt, Human
ccuaguggggucucccuc

SEQ ID NO: 2276458 - RNA, 17 nt, Human
ccuaguggggucucccu

SEQ ID NO: 2276459 - RNA, 23 nt, Human
ccuaguggcuguccagugcccau

SEQ ID NO: 2276460 - RNA, 19 nt, Human
ccuagugacccggaggcca

SEQ ID NO: 2276461 - RNA, 20 nt, Human
ccuagugacccggaggccac

SEQ ID NO: 2276462 - RNA, 15 nt, Human
ccuaguggcugucca

SEQ ID NO: 2276463 - RNA, 16 nt, Human
ccuaguggcuguccag

SEQ ID NO: 2276464 - RNA, 17 nt, Human
ccuaguggcuguccagu

SEQ ID NO: 2276465 - RNA, 18 nt, Human
ccuaguggcuguccagug

SEQ ID NO: 2276466 - RNA, 19 nt, Human
ccuaguggcuguccagugc

SEQ ID NO: 2276467 - RNA, 21 nt, Human
ccuaguggcuguccagugccc

SEQ ID NO: 2276468 - RNA, 21 nt, Human
ccuauccacccagcccauucu

SEQ ID NO: 2276469 - RNA, 18 nt, Human
ccuauccacccagcccau

SEQ ID NO: 2276470 - RNA, 18 nt, Human
ccuaucuaacccucccau

SEQ ID NO: 2276471 - RNA, 19 nt, Human
ccuauccugguuuuuguag

SEQ ID NO: 2276472 - RNA, 15 nt, Human
ccuaggugacagagu

SEQ ID NO: 2276473 - RNA, 14 nt, Human
ccuagucucuauca

SEQ ID NO: 2276474 - RNA, 23 nt, Human
ccuagugaaggcuucucucugug

SEQ ID NO: 2276475 - RNA, 16 nt, Human
ccuagucucuaucauu

SEQ ID NO: 2276476 - RNA, 18 nt, Human
ccuagugacccggaggcc

SEQ ID NO: 2276477 - RNA, 22 nt, Human
ccuagugaaggcuucucucugu

SEQ ID NO: 2276478 - RNA, 21 nt, Human
ccuagugaaggcuucucucug

SEQ ID NO: 2276479 - RNA, 19 nt, Human
ccuagugaaggcuucucuc

SEQ ID NO: 2276480 - RNA, 18 nt, Human
ccuagugaaggcuucucu

SEQ ID NO: 2276481 - RNA, 15 nt, Human
ccuagucucuaucau

SEQ ID NO: 2276482 - RNA, 21 nt, Human
ccuagucucuaucauuaaagu

SEQ ID NO: 2276483 - RNA, 22 nt, Human
ccucaggugagaagcagaggaa

SEQ ID NO: 2276484 - RNA, 16 nt, Human
ccuaaaccaaaaacug

SEQ ID NO: 2276485 - RNA, 22 nt, Human
ccguuacucuccaaccuggaca

SEQ ID NO: 2276486 - RNA, 14 nt, Human
ccuaaaauuugccc

SEQ ID NO: 2276487 - RNA, 22 nt, Human
ccuaaaauuugcccucccaucc

SEQ ID NO: 2276488 - RNA, 23 nt, Human
ccuaaacagauauaaauggcugg

SEQ ID NO: 2276489 - RNA, 18 nt, Human
ccguuagcuccuguggcc

SEQ ID NO: 2276490 - RNA, 13 nt, Human
ccuaaacauauga

SEQ ID NO: 2276491 - RNA, 16 nt, Human
ccuaaaauucagugga

SEQ ID NO: 2276492 - RNA, 13 nt, Human
ccguuagcuccug

SEQ ID NO: 2276493 - RNA, 14 nt, Human
ccguuagcuccugu

SEQ ID NO: 2276494 - RNA, 15 nt, Human
ccguuagcuccugug

SEQ ID NO: 2276495 - RNA, 17 nt, Human
ccguuagcuccuguggc

SEQ ID NO: 2276496 - RNA, 17 nt, Human
ccguuacucuccaaccu

SEQ ID NO: 2276497 - RNA, 14 nt, Human
ccguuacucuccaa

SEQ ID NO: 2276498 - RNA, 13 nt, Human
ccguuacucucca

SEQ ID NO: 2276499 - RNA, 21 nt, Human
ccguguguucuccgucccugc

SEQ ID NO: 2276500 - RNA, 16 nt, Human
ccguggccccagccug

SEQ ID NO: 2276501 - RNA, 17 nt, Human
ccguggccccagccugg

SEQ ID NO: 2276502 - RNA, 15 nt, Human
ccuacagaggucucu

SEQ ID NO: 2276503 - RNA, 17 nt, Human
ccuacagaggucucugc

SEQ ID NO: 2276504 - RNA, 23 nt, Human
ccuacagaggucucugccggcuc

SEQ ID NO: 2276505 - RNA, 18 nt, Human
ccuaacacagcaugugua

SEQ ID NO: 2276506 - RNA, 13 nt, Human
ccuaacaccagcg

SEQ ID NO: 2276507 - RNA, 14 nt, Human
ccuaaauggccuca

SEQ ID NO: 2276508 - RNA, 18 nt, Human
ccuaaauggccucaugug

SEQ ID NO: 2276509 - RNA, 15 nt, Human
ccuacagcccaccug

SEQ ID NO: 2276510 - RNA, 19 nt, Human
ccuacagcuugaccgugag

SEQ ID NO: 2276511 - RNA, 22 nt, Human
ccuacaguugaaaaacagcuga

SEQ ID NO: 2276512 - RNA, 21 nt, Human
ccuacagcuuugaucccugac

SEQ ID NO: 2276513 - RNA, 20 nt, Human
ccuacagcuuugaucccuga

SEQ ID NO: 2276514 - RNA, 17 nt, Human
ccuacagcuuugauccc

SEQ ID NO: 2276515 - RNA, 16 nt, Human
ccuacagauagucaaa

SEQ ID NO: 2276516 - RNA, 14 nt, Human
ccuacagccccuuu

SEQ ID NO: 2276517 - RNA, 16 nt, Human
ccuagacccuccuccu

SEQ ID NO: 2276518 - RNA, 19 nt, Human
ccuagacuguaaaccucuc

SEQ ID NO: 2276519 - RNA, 19 nt, Human
ccuagaaguuacugaaugc

SEQ ID NO: 2276520 - RNA, 23 nt, Human
ccuagaaguuacugaaugcacca

SEQ ID NO: 2276521 - RNA, 21 nt, Human
ccuagaagagugugaaaagga

SEQ ID NO: 2276522 - RNA, 13 nt, Human
ccuagaagggcua

SEQ ID NO: 2276523 - RNA, 22 nt, Human
ccuagaagggcuagaaccugga

SEQ ID NO: 2276524 - RNA, 13 nt, Human
ccuaggugacaga

SEQ ID NO: 2276525 - RNA, 22 nt, Human
ccuagguauaauucacauugua

SEQ ID NO: 2276526 - RNA, 22 nt, Human
ccuagaaacguuuggaacaauc

SEQ ID NO: 2276527 - RNA, 15 nt, Human
ccuagaaauacaugg

SEQ ID NO: 2276528 - RNA, 21 nt, Human
ccuagaaauuccccacccuga

SEQ ID NO: 2276529 - RNA, 13 nt, Human
ccuacuuccccuu

SEQ ID NO: 2276530 - RNA, 16 nt, Human
ccuacuuccccuuccu

SEQ ID NO: 2276531 - RNA, 18 nt, Human
ccuacccacccuccuuuc

SEQ ID NO: 2276532 - RNA, 19 nt, Human
ccuacccauccccgcagug

SEQ ID NO: 2276533 - RNA, 14 nt, Human
ccuacccauccccg

SEQ ID NO: 2276534 - RNA, 17 nt, Human
ccuaccccaauuccuug

SEQ ID NO: 2276535 - RNA, 18 nt, Human
ccuaccccaauuccuugu

SEQ ID NO: 2276536 - RNA, 17 nt, Human
ccuacccacaccucugc

SEQ ID NO: 2276537 - RNA, 18 nt, Human
ccuacccacaccucugcc

SEQ ID NO: 2276538 - RNA, 19 nt, Human
ccuacccacaccucugcca

SEQ ID NO: 2276539 - RNA, 20 nt, Human
ccuacccacaccucugccag

SEQ ID NO: 2276540 - RNA, 19 nt, Human
ccuacuguaauuugugaua

SEQ ID NO: 2276541 - RNA, 12 nt, Human
ccuaccccacac

SEQ ID NO: 2276542 - RNA, 19 nt, Human
ccuaccccaauuccuugua

SEQ ID NO: 2276543 - RNA, 11 nt, Human
ccuaccccaca

SEQ ID NO: 2276544 - RNA, 13 nt, Human
ccuacccacccuc

SEQ ID NO: 2276545 - RNA, 17 nt, Human
ccuaccaauagauuccc

SEQ ID NO: 2276546 - RNA, 18 nt, Human
ccuaccaauagauucccc

SEQ ID NO: 2276547 - RNA, 18 nt, Human
ccuacaugcuuugugaac

SEQ ID NO: 2276548 - RNA, 22 nt, Human
ccuacauguauuuguuugcaua

SEQ ID NO: 2276549 - RNA, 17 nt, Human
ccuacaugcuuugugaa

SEQ ID NO: 2276550 - RNA, 19 nt, Human
ccuacaugaaacagaaaca

SEQ ID NO: 2276551 - RNA, 22 nt, Human
ccuacaguuggaaauccaucca

SEQ ID NO: 2276552 - RNA, 12 nt, Human
ccguuauuaaaa

SEQ ID NO: 2276553 - RNA, 17 nt, Human
cccuuucagaugucuuc

SEQ ID NO: 2276554 - RNA, 19 nt, Human
cccuuucagaugucuucug

SEQ ID NO: 2276555 - RNA, 20 nt, Human
cccuuucagaugucuucugc

SEQ ID NO: 2276556 - RNA, 21 nt, Human
cccuuuagccaaacccuuguc

SEQ ID NO: 2276557 - RNA, 23 nt, Human
cccuugucugagaugcugguaau

SEQ ID NO: 2276558 - RNA, 13 nt, Human
cccuuguucucua

SEQ ID NO: 2276559 - RNA, 12 nt, Human
cccuugugugug

SEQ ID NO: 2276560 - RNA, 13 nt, Human
cccuugucugaga

SEQ ID NO: 2276561 - RNA, 14 nt, Human
cccuugucugagau

SEQ ID NO: 2276562 - RNA, 17 nt, Human
cccuugugcguggguga

SEQ ID NO: 2276563 - RNA, 22 nt, Human
cccuuguggucccaccccacac

SEQ ID NO: 2276564 - RNA, 15 nt, Human
cccuugucccacuca

SEQ ID NO: 2276565 - RNA, 12 nt, Human
cccuugucugag

SEQ ID NO: 2276566 - RNA, 12 nt, Human
cccuuggccugu

SEQ ID NO: 2276567 - RNA, 14 nt, Human
cccuuggccucaga

SEQ ID NO: 2276568 - RNA, 11 nt, Human
cccuuggccag

SEQ ID NO: 2276569 - RNA, 17 nt, Human
cccuugguggcaagagc

SEQ ID NO: 2276570 - RNA, 22 nt, Human
cccuugguuaggcauuguggga

SEQ ID NO: 2276571 - RNA, 23 nt, Human
cccuugguuaggcauugugggaa

SEQ ID NO: 2276572 - RNA, 11 nt, Human
cccuucuuuuu

SEQ ID NO: 2276573 - RNA, 21 nt, Human
cccuuccuaauuccacagcug

SEQ ID NO: 2276574 - RNA, 17 nt, Human
cccuugaaauuuuaaac

SEQ ID NO: 2276575 - RNA, 15 nt, Human
cccuugacaccgggg

SEQ ID NO: 2276576 - RNA, 19 nt, Human
cccuucuuuuucuucuuuu

SEQ ID NO: 2276577 - RNA, 13 nt, Human
cccuucuuuccuc

SEQ ID NO: 2276578 - RNA, 14 nt, Human
cccuucuuuccucu

SEQ ID NO: 2276579 - RNA, 13 nt, Human
cccuuggccucag

SEQ ID NO: 2276580 - RNA, 12 nt, Human
cccuuggccuca

SEQ ID NO: 2276581 - RNA, 17 nt, Human
cccuuggaggcugucuu

SEQ ID NO: 2276582 - RNA, 18 nt, Human
cccuuggaggccagccag

SEQ ID NO: 2276583 - RNA, 17 nt, Human
cccuuggaggccagcca

SEQ ID NO: 2276584 - RNA, 17 nt, Human
cccuuggauuguccccg

SEQ ID NO: 2276585 - RNA, 15 nt, Human
cccuuggaggccagc

SEQ ID NO: 2276586 - RNA, 13 nt, Human
cccuuggaggcca

SEQ ID NO: 2276587 - RNA, 16 nt, Human
cccuuggacuugagga

SEQ ID NO: 2276588 - RNA, 23 nt, Human
cccuugacgucaagucuccuucc

SEQ ID NO: 2276589 - RNA, 15 nt, Human
cccuugacaccugcu

SEQ ID NO: 2276590 - RNA, 18 nt, Human
cccugguuauauucucac

SEQ ID NO: 2276591 - RNA, 22 nt, Human
cccugguguuucuagcacuggc

SEQ ID NO: 2276592 - RNA, 20 nt, Human
cccugguguuucuagcacug

SEQ ID NO: 2276593 - RNA, 21 nt, Human
cccugguguuucuagcacugg

SEQ ID NO: 2276594 - RNA, 19 nt, Human
cccugguuauauucucacg

SEQ ID NO: 2276595 - RNA, 14 nt, Human
cccugguucucauc

SEQ ID NO: 2276596 - RNA, 13 nt, Human
cccuggugguuca

SEQ ID NO: 2276597 - RNA, 16 nt, Human
cccuggugguugcugu

SEQ ID NO: 2276598 - RNA, 12 nt, Human
cccugguguuuc

SEQ ID NO: 2276599 - RNA, 23 nt, Human
cccuggugggccaacaaagaaca

SEQ ID NO: 2276600 - RNA, 13 nt, Human
cccuguucacucu

SEQ ID NO: 2276601 - RNA, 18 nt, Human
cccuguguugucucuaga

SEQ ID NO: 2276602 - RNA, 21 nt, Human
cccuguguugucucuagagca

SEQ ID NO: 2276603 - RNA, 13 nt, Human
cccuguguugucu

SEQ ID NO: 2276604 - RNA, 15 nt, Human
cccuguguugucucu

SEQ ID NO: 2276605 - RNA, 16 nt, Human
cccuguguugucucua

SEQ ID NO: 2276606 - RNA, 17 nt, Human
cccuguguugucucuag

SEQ ID NO: 2276607 - RNA, 13 nt, Human
cccuucagugccc

SEQ ID NO: 2276608 - RNA, 21 nt, Human
cccuucaguacccucucagcu

SEQ ID NO: 2276609 - RNA, 19 nt, Human
cccuucaguacccucucag

SEQ ID NO: 2276610 - RNA, 20 nt, Human
cccuucaguacccucucagc

SEQ ID NO: 2276611 - RNA, 17 nt, Human
cccuucagugcccacca

SEQ ID NO: 2276612 - RNA, 15 nt, Human
cccuucaucuccagg

SEQ ID NO: 2276613 - RNA, 14 nt, Human
cccuucaucuggaa

SEQ ID NO: 2276614 - RNA, 16 nt, Human
cccuucaucuggaacc

SEQ ID NO: 2276615 - RNA, 23 nt, Human
cccuucacuucugaccacacuuc

SEQ ID NO: 2276616 - RNA, 17 nt, Human
cccuucaguacccucuc

SEQ ID NO: 2276617 - RNA, 23 nt, Human
cccuguguugucucuagagcagg

SEQ ID NO: 2276618 - RNA, 17 nt, Human
cccuguucagcuacucc

SEQ ID NO: 2276619 - RNA, 19 nt, Human
cccuguucagcuacuccca

SEQ ID NO: 2276620 - RNA, 14 nt, Human
cccuguucacucua

SEQ ID NO: 2276621 - RNA, 22 nt, Human
cccuguucacucuacuuagcau

SEQ ID NO: 2276622 - RNA, 11 nt, Human
cccuucauuug

SEQ ID NO: 2276623 - RNA, 16 nt, Human
cccuucaugcauggaa

SEQ ID NO: 2276624 - RNA, 12 nt, Human
cccuucccaccu

SEQ ID NO: 2276625 - RNA, 13 nt, Human
cccuucccaccuc

SEQ ID NO: 2276626 - RNA, 23 nt, Human
cccuucccacaggacauuucucu

SEQ ID NO: 2276627 - RNA, 18 nt, Human
cccuucaucuccagggag

SEQ ID NO: 2276628 - RNA, 16 nt, Human
cccuucccacuggagg

SEQ ID NO: 2276629 - RNA, 14 nt, Human
cccuucccacagga

SEQ ID NO: 2276630 - RNA, 19 nt, Human
cccuucccuugagcccucu

SEQ ID NO: 2276631 - RNA, 15 nt, Human
cccuuccccauggga

SEQ ID NO: 2276632 - RNA, 21 nt, Human
cccuuccccacugccugccca

SEQ ID NO: 2276633 - RNA, 14 nt, Human
cccuuccccauggg

SEQ ID NO: 2276634 - RNA, 11 nt, Human
cccuuccccau

SEQ ID NO: 2276635 - RNA, 12 nt, Human
cccuuccccacu

SEQ ID NO: 2276636 - RNA, 21 nt, Human
cccuucccaugacccaggcug

SEQ ID NO: 2276637 - RNA, 18 nt, Human
cccuucccaucucuuccu

SEQ ID NO: 2276638 - RNA, 20 nt, Human
cccuuccuaauuccacagcu

SEQ ID NO: 2276639 - RNA, 19 nt, Human
cccuuccuaauuccacagc

SEQ ID NO: 2276640 - RNA, 14 nt, Human
cccuuccuaauucc

SEQ ID NO: 2276641 - RNA, 13 nt, Human
cccuuccuaauuc

SEQ ID NO: 2276642 - RNA, 21 nt, Human
ccggagauuggacggccugau

SEQ ID NO: 2276643 - RNA, 20 nt, Human
ccggagauuggacggccuga

SEQ ID NO: 2276644 - RNA, 19 nt, Human
ccggagauuggacggccug

SEQ ID NO: 2276645 - RNA, 17 nt, Human
ccggagauuggacggcc

SEQ ID NO: 2276646 - RNA, 17 nt, Human
ccggagauguagcaaaa

SEQ ID NO: 2276647 - RNA, 14 nt, Human
ccggagauguagca

SEQ ID NO: 2276648 - RNA, 14 nt, Human
ccggagaggaccgg

SEQ ID NO: 2276649 - RNA, 20 nt, Human
ccggacugcaagcagggcuc

SEQ ID NO: 2276650 - RNA, 20 nt, Human
ccggacuuucggaguugggg

SEQ ID NO: 2276651 - RNA, 15 nt, Human
ccggacuuuucugca

SEQ ID NO: 2276652 - RNA, 16 nt, Human
ccggacuuuucugcaa

SEQ ID NO: 2276653 - RNA, 23 nt, Human
ccggacuuucggaguuggggguc

SEQ ID NO: 2276654 - RNA, 15 nt, Human
ccggauccugggugg

SEQ ID NO: 2276655 - RNA, 17 nt, Human
ccggaguccacucccag

SEQ ID NO: 2276656 - RNA, 15 nt, Human
ccggagugagaagcu

SEQ ID NO: 2276657 - RNA, 20 nt, Human
ccggauggcggacaccuggc

SEQ ID NO: 2276658 - RNA, 13 nt, Human
ccggaugugcuuu

SEQ ID NO: 2276659 - RNA, 14 nt, Human
ccggaugugcuuuu

SEQ ID NO: 2276660 - RNA, 15 nt, Human
ccggaugugcuuuuc

SEQ ID NO: 2276661 - RNA, 16 nt, Human
ccggauuggcuugugu

SEQ ID NO: 2276662 - RNA, 22 nt, Human
ccggauuggcuuguguguuuca

SEQ ID NO: 2276663 - RNA, 17 nt, Human
ccggcaaccccaguucu

SEQ ID NO: 2276664 - RNA, 20 nt, Human
ccggcaaccccaguucugcu

SEQ ID NO: 2276665 - RNA, 18 nt, Human
ccggagauguagcaaaac

SEQ ID NO: 2276666 - RNA, 17 nt, Human
ccggagcaaacucugcu

SEQ ID NO: 2276667 - RNA, 18 nt, Human
ccggagcaaacucugcug

SEQ ID NO: 2276668 - RNA, 19 nt, Human
ccggagcaaacucugcugu

SEQ ID NO: 2276669 - RNA, 17 nt, Human
ccggaggggccuggcag

SEQ ID NO: 2276670 - RNA, 17 nt, Human
ccggagguagagguugu

SEQ ID NO: 2276671 - RNA, 18 nt, Human
ccggaggguguuuaugua

SEQ ID NO: 2276672 - RNA, 14 nt, Human
ccggagccuccagc

SEQ ID NO: 2276673 - RNA, 16 nt, Human
ccggagccuccagcug

SEQ ID NO: 2276674 - RNA, 21 nt, Human
ccggaggggccuggcagccgu

SEQ ID NO: 2276675 - RNA, 23 nt, Human
ccggcaaccccaguucugcuccu

SEQ ID NO: 2276676 - RNA, 21 nt, Human
ccggcaaccccaguucugcuc

SEQ ID NO: 2276677 - RNA, 22 nt, Human
ccggcaaccccaguucugcucc

SEQ ID NO: 2276678 - RNA, 22 nt, Human
ccgggaaagaagagccggagcc

SEQ ID NO: 2276679 - RNA, 17 nt, Human
ccgggaagggggcuggg

SEQ ID NO: 2276680 - RNA, 20 nt, Human
ccggggcagcugccagagaa

SEQ ID NO: 2276681 - RNA, 19 nt, Human
ccggggcagcugccagaga

SEQ ID NO: 2276682 - RNA, 18 nt, Human
ccggggcagcugccagag

SEQ ID NO: 2276683 - RNA, 23 nt, Human
ccggggaggagagagcagcuucu

SEQ ID NO: 2276684 - RNA, 15 nt, Human
ccggggaggggcgcu

SEQ ID NO: 2276685 - RNA, 22 nt, Human
ccggggaguuucuuuccugccu

SEQ ID NO: 2276686 - RNA, 15 nt, Human
ccggggacagaggcc

SEQ ID NO: 2276687 - RNA, 15 nt, Human
ccggggacccuguga

SEQ ID NO: 2276688 - RNA, 15 nt, Human
ccggggagcgcccgc

SEQ ID NO: 2276689 - RNA, 18 nt, Human
ccggucccuugagaccuc

SEQ ID NO: 2276690 - RNA, 12 nt, Human
ccgggagagggg

SEQ ID NO: 2276691 - RNA, 15 nt, Human
ccgggagcugcugcc

SEQ ID NO: 2276692 - RNA, 12 nt, Human
ccgggacuccag

SEQ ID NO: 2276693 - RNA, 23 nt, Human
ccgggagccugaucaccugcccu

SEQ ID NO: 2276694 - RNA, 16 nt, Human
ccgggagccugaucac

SEQ ID NO: 2276695 - RNA, 23 nt, Human
ccguggcaucaccuuaggcaggg

SEQ ID NO: 2276696 - RNA, 15 nt, Human
ccguggcacugcaua

SEQ ID NO: 2276697 - RNA, 13 nt, Human
ccguggccccagc

SEQ ID NO: 2276698 - RNA, 14 nt, Human
ccguggccccagcc

SEQ ID NO: 2276699 - RNA, 15 nt, Human
ccguggccccagccu

SEQ ID NO: 2276700 - RNA, 19 nt, Human
ccguggauugcacguggcc

SEQ ID NO: 2276701 - RNA, 20 nt, Human
ccguggauugcacguggccu

SEQ ID NO: 2276702 - RNA, 22 nt, Human
ccguggauugcacguggccucu

SEQ ID NO: 2276703 - RNA, 23 nt, Human
ccguggauugcacguggccucuu

SEQ ID NO: 2276704 - RNA, 23 nt, Human
ccguggagaugggaugcuugccu

SEQ ID NO: 2276705 - RNA, 16 nt, Human
ccguggaggaggaagg

SEQ ID NO: 2276706 - RNA, 20 nt, Human
ccguggaggaggaaggcaag

SEQ ID NO: 2276707 - RNA, 22 nt, Human
ccguggaggaggaaggcaagag

SEQ ID NO: 2276708 - RNA, 14 nt, Human
ccguggaccuuccu

SEQ ID NO: 2276709 - RNA, 15 nt, Human
ccguggaccuuccug

SEQ ID NO: 2276710 - RNA, 16 nt, Human
ccguggaccuuccugc

SEQ ID NO: 2276711 - RNA, 17 nt, Human
ccguggaccuuccugcc

SEQ ID NO: 2276712 - RNA, 23 nt, Human
ccguggaggaggaaggcaagagg

SEQ ID NO: 2276713 - RNA, 17 nt, Human
ccggucugcaagucaga

SEQ ID NO: 2276714 - RNA, 19 nt, Human
ccggucugcaagucagagg

SEQ ID NO: 2276715 - RNA, 20 nt, Human
ccggucugcaagucagagga

SEQ ID NO: 2276716 - RNA, 21 nt, Human
ccggucugcaagucagaggau

SEQ ID NO: 2276717 - RNA, 22 nt, Human
ccggucccuugagaccucagcc

SEQ ID NO: 2276718 - RNA, 20 nt, Human
ccggucccuugagaccucag

SEQ ID NO: 2276719 - RNA, 23 nt, Human
ccggucccuugagaccucagcca

SEQ ID NO: 2276720 - RNA, 16 nt, Human
ccggucugcaagucag

SEQ ID NO: 2276721 - RNA, 17 nt, Human
ccggugugccugcagcc

SEQ ID NO: 2276722 - RNA, 16 nt, Human
ccggugugccugcagc

SEQ ID NO: 2276723 - RNA, 15 nt, Human
ccggugugccugcag

SEQ ID NO: 2276724 - RNA, 11 nt, Human
ccgguguccuu

SEQ ID NO: 2276725 - RNA, 11 nt, Human
ccucucccagg

SEQ ID NO: 2276726 - RNA, 12 nt, Human
ccucucccagga

SEQ ID NO: 2276727 - RNA, 14 nt, Human
ccucucccaggacc

SEQ ID NO: 2276728 - RNA, 13 nt, Human
ccucucccaggac

SEQ ID NO: 2276729 - RNA, 22 nt, Human
ccucucccauugucccucugcc

SEQ ID NO: 2276730 - RNA, 15 nt, Human
ccucuccccagcaag

SEQ ID NO: 2276731 - RNA, 16 nt, Human
ccucuccauaacccca

SEQ ID NO: 2276732 - RNA, 18 nt, Human
ccucuccauaaccccacc

SEQ ID NO: 2276733 - RNA, 19 nt, Human
ccucuccauaaccccaccc

SEQ ID NO: 2276734 - RNA, 22 nt, Human
ccucuccauaaccccacccuug

SEQ ID NO: 2276735 - RNA, 14 nt, Human
ccucuccaucuuca

SEQ ID NO: 2276736 - RNA, 16 nt, Human
ccucuccaucuucagc

SEQ ID NO: 2276737 - RNA, 19 nt, Human
ccucuccaucuucagcuuc

SEQ ID NO: 2276738 - RNA, 17 nt, Human
ccucuacuaaaaagaag

SEQ ID NO: 2276739 - RNA, 24 nt, Human
ccucuacagagcuucccugacuca

SEQ ID NO: 2276740 - RNA, 21 nt, Human
ccucuacagagcuucccugac

SEQ ID NO: 2276741 - RNA, 20 nt, Human
ccucuacagagcuucccuga

SEQ ID NO: 2276742 - RNA, 20 nt, Human
ccucuacuuaaugagauagu

SEQ ID NO: 2276743 - RNA, 14 nt, Human
ccucuacugggagc

SEQ ID NO: 2276744 - RNA, 14 nt, Human
ccucuccagcuaua

SEQ ID NO: 2276745 - RNA, 11 nt, Human
ccucuccaggc

SEQ ID NO: 2276746 - RNA, 12 nt, Human
ccucuccaggca

SEQ ID NO: 2276747 - RNA, 13 nt, Human
ccucuccaggcac

SEQ ID NO: 2276748 - RNA, 14 nt, Human
ccucuccaggcacc

SEQ ID NO: 2276749 - RNA, 17 nt, Human
ccucuccaggcacccuu

SEQ ID NO: 2276750 - RNA, 21 nt, Human
ccucucccugacccuguauau

SEQ ID NO: 2276751 - RNA, 12 nt, Human
ccucucccugac

SEQ ID NO: 2276752 - RNA, 15 nt, Human
ccucucccugacccu

SEQ ID NO: 2276753 - RNA, 15 nt, Human
ccucucccuggcccu

SEQ ID NO: 2276754 - RNA, 13 nt, Human
ccucucccuggcc

SEQ ID NO: 2276755 - RNA, 13 nt, Human
ccucucccuugga

SEQ ID NO: 2276756 - RNA, 22 nt, Human
ccucucccuuggauuguccccg

SEQ ID NO: 2276757 - RNA, 10 nt, Human
ccucucccug

SEQ ID NO: 2276758 - RNA, 23 nt, Human
ccucucccgucagggcccaaguc

SEQ ID NO: 2276759 - RNA, 11 nt, Human
ccucucccuca

SEQ ID NO: 2276760 - RNA, 17 nt, Human
ccucucccucaacaagg

SEQ ID NO: 2276761 - RNA, 22 nt, Human
ccucucccucaacaagggagag

SEQ ID NO: 2276762 - RNA, 14 nt, Human
ccucuccccaagac

SEQ ID NO: 2276763 - RNA, 17 nt, Human
ccucucccgucagggcc

SEQ ID NO: 2276764 - RNA, 19 nt, Human
ccucucccgucagggccca

SEQ ID NO: 2276765 - RNA, 22 nt, Human
ccucucccgucagggcccaagu

SEQ ID NO: 2276766 - RNA, 17 nt, Human
ccucuccccagcccaga

SEQ ID NO: 2276767 - RNA, 22 nt, Human
ccucucccgccagacuguuaga

SEQ ID NO: 2276768 - RNA, 22 nt, Human
ccucuccccaagacuugguguc

SEQ ID NO: 2276769 - RNA, 12 nt, Human
ccucuccccagc

SEQ ID NO: 2276770 - RNA, 16 nt, Human
ccucuccccagcccag

SEQ ID NO: 2276771 - RNA, 14 nt, Human
ccucuccccagccc

SEQ ID NO: 2276772 - RNA, 20 nt, Human
ccucuccccagcaagugaga

SEQ ID NO: 2276773 - RNA, 21 nt, Human
ccuccuccagccgccaugcuc

SEQ ID NO: 2276774 - RNA, 16 nt, Human
ccuccucccacccggc

SEQ ID NO: 2276775 - RNA, 19 nt, Human
ccuccucuaagguugggca

SEQ ID NO: 2276776 - RNA, 21 nt, Human
ccuccuccuucccaaaggacu

SEQ ID NO: 2276777 - RNA, 19 nt, Human
ccuccucccacccggcugc

SEQ ID NO: 2276778 - RNA, 23 nt, Human
ccuccucccacccggcugcagag

SEQ ID NO: 2276779 - RNA, 13 nt, Human
ccuccuccuuccc

SEQ ID NO: 2276780 - RNA, 14 nt, Human
ccuccuugccuccu

SEQ ID NO: 2276781 - RNA, 23 nt, Human
ccuccuucucugucucaugugug

SEQ ID NO: 2276782 - RNA, 16 nt, Human
ccuccucucugcccua

SEQ ID NO: 2276783 - RNA, 19 nt, Human
ccuccucucccaucccccu

SEQ ID NO: 2276784 - RNA, 15 nt, Human
ccuccuucucugucu

SEQ ID NO: 2276785 - RNA, 17 nt, Human
ccuccuucucugucuca

SEQ ID NO: 2276786 - RNA, 22 nt, Human
ccuccuucucugucucaugugu

SEQ ID NO: 2276787 - RNA, 13 nt, Human
ccuccucucccau

SEQ ID NO: 2276788 - RNA, 14 nt, Human
ccuccucucccauc

SEQ ID NO: 2276789 - RNA, 15 nt, Human
ccuccucucccaucc

SEQ ID NO: 2276790 - RNA, 16 nt, Human
ccuccucucccauccc

SEQ ID NO: 2276791 - RNA, 15 nt, Human
ccuccucucugcccu

SEQ ID NO: 2276792 - RNA, 13 nt, Human
ccuccucucugcc

SEQ ID NO: 2276793 - RNA, 18 nt, Human
ccucuacagagcuucccu

SEQ ID NO: 2276794 - RNA, 19 nt, Human
ccucuaagguugggcaggg

SEQ ID NO: 2276795 - RNA, 19 nt, Human
ccucuaagccacucuucca

SEQ ID NO: 2276796 - RNA, 17 nt, Human
ccucguggccagcccgg

SEQ ID NO: 2276797 - RNA, 14 nt, Human
ccucuaagccacuc

SEQ ID NO: 2276798 - RNA, 14 nt, Human
ccucgugccagucg

SEQ ID NO: 2276799 - RNA, 14 nt, Human
ccucguggccagcc

SEQ ID NO: 2276800 - RNA, 15 nt, Human
ccucguggccagccc

SEQ ID NO: 2276801 - RNA, 16 nt, Human
ccucguggccagcccg

SEQ ID NO: 2276802 - RNA, 13 nt, Human
ccucguggccagc

SEQ ID NO: 2276803 - RNA, 12 nt, Human
ccucgugccagu

SEQ ID NO: 2276804 - RNA, 13 nt, Human
ccucgugccaguc

SEQ ID NO: 2276805 - RNA, 20 nt, Human
ccuccuugccuccuguguaa

SEQ ID NO: 2276806 - RNA, 15 nt, Human
ccuccuugcucugca

SEQ ID NO: 2276807 - RNA, 18 nt, Human
ccuccuugcucugcaggc

SEQ ID NO: 2276808 - RNA, 22 nt, Human
ccuccuugcucugcaggcaccu

SEQ ID NO: 2276809 - RNA, 19 nt, Human
ccuccuugccuccugugua

SEQ ID NO: 2276810 - RNA, 18 nt, Human
ccuccuugccuccugugu

SEQ ID NO: 2276811 - RNA, 17 nt, Human
ccuccuugccuccugug

SEQ ID NO: 2276812 - RNA, 15 nt, Human
ccuccuuggugccug

SEQ ID NO: 2276813 - RNA, 12 nt, Human
ccuccuugggca

SEQ ID NO: 2276814 - RNA, 20 nt, Human
ccuccuugggcacuuuuuaa

SEQ ID NO: 2276815 - RNA, 17 nt, Human
ccuccuuggugccuggc

SEQ ID NO: 2276816 - RNA, 15 nt, Human
ccuccuuguccaccc

SEQ ID NO: 2276817 - RNA, 16 nt, Human
ccuccuuguccaccca

SEQ ID NO: 2276818 - RNA, 19 nt, Human
ccucguccucccccugcca

SEQ ID NO: 2276819 - RNA, 17 nt, Human
ccucguccucccccugc

SEQ ID NO: 2276820 - RNA, 16 nt, Human
ccucguccucccccug

SEQ ID NO: 2276821 - RNA, 15 nt, Human
ccucguccucccccu

SEQ ID NO: 2276822 - RNA, 21 nt, Human
ccucguccucccccugccagu

SEQ ID NO: 2276823 - RNA, 20 nt, Human
ccucguccucccccugccag

SEQ ID NO: 2276824 - RNA, 20 nt, Human
ccucugaaugaaccuucugg

SEQ ID NO: 2276825 - RNA, 12 nt, Human
ccucuccugccu

SEQ ID NO: 2276826 - RNA, 14 nt, Human
ccucugacacacag

SEQ ID NO: 2276827 - RNA, 19 nt, Human
ccucugacacacagcucug

SEQ ID NO: 2276828 - RNA, 20 nt, Human
ccucugacacacagcucugu

SEQ ID NO: 2276829 - RNA, 18 nt, Human
ccucuccucauguucugc

SEQ ID NO: 2276830 - RNA, 13 nt, Human
ccucucccuguug

SEQ ID NO: 2276831 - RNA, 13 nt, Human
ccucuccgagcug

SEQ ID NO: 2276832 - RNA, 13 nt, Human
ccucugacacaca

SEQ ID NO: 2276833 - RNA, 11 nt, Human
ccucuccugcc

SEQ ID NO: 2276834 - RNA, 19 nt, Human
ccucugaaacccuggacca

SEQ ID NO: 2276835 - RNA, 16 nt, Human
ccucugaaacccugga

SEQ ID NO: 2276836 - RNA, 12 nt, Human
ccucugaccuau

SEQ ID NO: 2276837 - RNA, 20 nt, Human
ccucugaccccuccucacug

SEQ ID NO: 2276838 - RNA, 22 nt, Human
ccucugaccccuccucacuggc

SEQ ID NO: 2276839 - RNA, 14 nt, Human
ccucugaccugcac

SEQ ID NO: 2276840 - RNA, 16 nt, Human
ccucugaccugcacug

SEQ ID NO: 2276841 - RNA, 13 nt, Human
ccucugaccccuc

SEQ ID NO: 2276842 - RNA, 14 nt, Human
ccucugaccccucc

SEQ ID NO: 2276843 - RNA, 15 nt, Human
ccucugaccccuccu

SEQ ID NO: 2276844 - RNA, 16 nt, Human
ccucugaccccuccuc

SEQ ID NO: 2276845 - RNA, 17 nt, Human
ccucugaccccuccuca

SEQ ID NO: 2276846 - RNA, 18 nt, Human
ccucugaccccuccucac

SEQ ID NO: 2276847 - RNA, 19 nt, Human
ccucugaccccuccucacu

SEQ ID NO: 2276848 - RNA, 21 nt, Human
ccucugacacacagcucuguc

SEQ ID NO: 2276849 - RNA, 17 nt, Human
ccucugaccugcaggcc

SEQ ID NO: 2276850 - RNA, 16 nt, Human
ccucugaccugcaggc

SEQ ID NO: 2276851 - RNA, 15 nt, Human
ccucugaccugcagg

SEQ ID NO: 2276852 - RNA, 17 nt, Human
ccucugaccugcacugg

SEQ ID NO: 2276853 - RNA, 20 nt, Human
ccucugaccugcaggccaag

SEQ ID NO: 2276854 - RNA, 19 nt, Human
ccucugaccugcaggccaa

SEQ ID NO: 2276855 - RNA, 16 nt, Human
ccucugacucagggcu

SEQ ID NO: 2276856 - RNA, 12 nt, Human
ccucugacucag

SEQ ID NO: 2276857 - RNA, 22 nt, Human
ccucugacuuaagcugccucaa

SEQ ID NO: 2276858 - RNA, 19 nt, Human
ccucugagaauuccaagga

SEQ ID NO: 2276859 - RNA, 22 nt, Human
ccucugacucagggcuccuggg

SEQ ID NO: 2276860 - RNA, 21 nt, Human
ccucugacucagggcuccugg

SEQ ID NO: 2276861 - RNA, 19 nt, Human
ccucugacucagggcuccu

SEQ ID NO: 2276862 - RNA, 17 nt, Human
ccucugacucagggcuc

SEQ ID NO: 2276863 - RNA, 14 nt, Human
ccucugauaccuca

SEQ ID NO: 2276864 - RNA, 19 nt, Human
ccucugauacccagagcau

SEQ ID NO: 2276865 - RNA, 20 nt, Human
ccucugauacccagagcauu

SEQ ID NO: 2276866 - RNA, 22 nt, Human
ccucugagggaaagcccagaaa

SEQ ID NO: 2276867 - RNA, 19 nt, Human
ccucugagucaccaucuua

SEQ ID NO: 2276868 - RNA, 15 nt, Human
ccucugauacccaga

SEQ ID NO: 2276869 - RNA, 18 nt, Human
ccucugauacccagagca

SEQ ID NO: 2276870 - RNA, 15 nt, Human
ccucugauaccucaa

SEQ ID NO: 2276871 - RNA, 16 nt, Human
ccucugaucuccaugg

SEQ ID NO: 2276872 - RNA, 15 nt, Human
ccucugcacuccccu

SEQ ID NO: 2276873 - RNA, 16 nt, Human
ccucugcacuccccug

SEQ ID NO: 2276874 - RNA, 17 nt, Human
ccucugcacuccccugc

SEQ ID NO: 2276875 - RNA, 19 nt, Human
ccucugagccccugggacu

SEQ ID NO: 2276876 - RNA, 14 nt, Human
ccucugagcuuugc

SEQ ID NO: 2276877 - RNA, 15 nt, Human
ccucugagcuuugca

SEQ ID NO: 2276878 - RNA, 17 nt, Human
ccucugagcuuugcaug

SEQ ID NO: 2276879 - RNA, 12 nt, Human
ccucugagccuu

SEQ ID NO: 2276880 - RNA, 11 nt, Human
ccucugagccu

SEQ ID NO: 2276881 - RNA, 13 nt, Human
ccucugaggcuga

SEQ ID NO: 2276882 - RNA, 18 nt, Human
ccucugaggcuggauccu

SEQ ID NO: 2276883 - RNA, 17 nt, Human
ccucugaggcuguagga

SEQ ID NO: 2276884 - RNA, 20 nt, Human
ccucugagggaaagcccaga

SEQ ID NO: 2276885 - RNA, 21 nt, Human
ccucugagggaaagcccagaa

SEQ ID NO: 2276886 - RNA, 11 nt, Human
ccucugaggcu

SEQ ID NO: 2276887 - RNA, 16 nt, Human
ccucugccaccucccc

SEQ ID NO: 2276888 - RNA, 15 nt, Human
ccucugccaccuccc

SEQ ID NO: 2276889 - RNA, 14 nt, Human
ccucugccaccucc

SEQ ID NO: 2276890 - RNA, 13 nt, Human
ccucugccaccuc

SEQ ID NO: 2276891 - RNA, 12 nt, Human
ccucugccaccu

SEQ ID NO: 2276892 - RNA, 19 nt, Human
ccucugcagcaauaaagca

SEQ ID NO: 2276893 - RNA, 13 nt, Human
ccucugcccacuc

SEQ ID NO: 2276894 - RNA, 16 nt, Human
ccucugcccacucccu

SEQ ID NO: 2276895 - RNA, 18 nt, Human
ccucugcagcaauaaagc

SEQ ID NO: 2276896 - RNA, 14 nt, Human
ccucugcagcaaua

SEQ ID NO: 2276897 - RNA, 23 nt, Human
ccucugcacuccccugcugggug

SEQ ID NO: 2276898 - RNA, 18 nt, Human
ccucugcacuccccugcu

SEQ ID NO: 2276899 - RNA, 17 nt, Human
ccucuagaaauuuuuca

SEQ ID NO: 2276900 - RNA, 23 nt, Human
ccucagugucauuuaugaaaaga

SEQ ID NO: 2276901 - RNA, 23 nt, Human
ccucaguuuaauccuucuaguuu

SEQ ID NO: 2276902 - RNA, 15 nt, Human
ccuccacuccuuccu

SEQ ID NO: 2276903 - RNA, 16 nt, Human
ccuccacuccuuccug

SEQ ID NO: 2276904 - RNA, 15 nt, Human
ccucaguuucccuau

SEQ ID NO: 2276905 - RNA, 19 nt, Human
ccucaguuuuaucauuuuc

SEQ ID NO: 2276906 - RNA, 14 nt, Human
ccuccacucucccc

SEQ ID NO: 2276907 - RNA, 17 nt, Human
ccuccacucucccccac

SEQ ID NO: 2276908 - RNA, 22 nt, Human
ccucaguucccuuggccucaga

SEQ ID NO: 2276909 - RNA, 21 nt, Human
ccucaguucccuuggccucag

SEQ ID NO: 2276910 - RNA, 20 nt, Human
ccucaguucccuuggccuca

SEQ ID NO: 2276911 - RNA, 19 nt, Human
ccucaguucccuuggccuc

SEQ ID NO: 2276912 - RNA, 18 nt, Human
ccucaguucccuuggccu

SEQ ID NO: 2276913 - RNA, 17 nt, Human
ccucaguucccuuggcc

SEQ ID NO: 2276914 - RNA, 16 nt, Human
ccucaguucccuuggc

SEQ ID NO: 2276915 - RNA, 15 nt, Human
ccucaguucccuugg

SEQ ID NO: 2276916 - RNA, 12 nt, Human
ccucagugucau

SEQ ID NO: 2276917 - RNA, 11 nt, Human
ccucaguguca

SEQ ID NO: 2276918 - RNA, 23 nt, Human
ccucaguggacuuuccacccccu

SEQ ID NO: 2276919 - RNA, 13 nt, Human
ccucaguguauuu

SEQ ID NO: 2276920 - RNA, 21 nt, Human
ccucaguggacuuuccacccc

SEQ ID NO: 2276921 - RNA, 23 nt, Human
ccucagggauggccguuggccac

SEQ ID NO: 2276922 - RNA, 20 nt, Human
ccucaggugagaagcagagg

SEQ ID NO: 2276923 - RNA, 18 nt, Human
ccucaggugagaagcaga

SEQ ID NO: 2276924 - RNA, 17 nt, Human
ccucaggugagaagcag

SEQ ID NO: 2276925 - RNA, 13 nt, Human
ccuccaggcaaaa

SEQ ID NO: 2276926 - RNA, 23 nt, Human
ccuccagggcuggacugaggccu

SEQ ID NO: 2276927 - RNA, 15 nt, Human
ccuccaggaaccaca

SEQ ID NO: 2276928 - RNA, 22 nt, Human
ccuccaggaaugaucucuucuu

SEQ ID NO: 2276929 - RNA, 21 nt, Human
ccuccagcuuguggagcccca

SEQ ID NO: 2276930 - RNA, 22 nt, Human
ccuccagcuuguggagccccac

SEQ ID NO: 2276931 - RNA, 12 nt, Human
ccuccagcuucu

SEQ ID NO: 2276932 - RNA, 21 nt, Human
ccuccagcuucugguacucuc

SEQ ID NO: 2276933 - RNA, 19 nt, Human
ccuccagcuuguggagccc

SEQ ID NO: 2276934 - RNA, 20 nt, Human
ccuccagcuucaggcaggcc

SEQ ID NO: 2276935 - RNA, 19 nt, Human
ccuccagcucuuuccuccu

SEQ ID NO: 2276936 - RNA, 17 nt, Human
ccuccagcucuuuccuc

SEQ ID NO: 2276937 - RNA, 22 nt, Human
ccuccagcucuuuccuccuucc

SEQ ID NO: 2276938 - RNA, 16 nt, Human
ccuccagcucuuuccu

SEQ ID NO: 2276939 - RNA, 15 nt, Human
ccuccagcucuuucc

SEQ ID NO: 2276940 - RNA, 12 nt, Human
ccuccacuguca

SEQ ID NO: 2276941 - RNA, 13 nt, Human
ccuccacugucac

SEQ ID NO: 2276942 - RNA, 13 nt, Human
ccuccacucuccu

SEQ ID NO: 2276943 - RNA, 19 nt, Human
ccuccacucucccccaccc

SEQ ID NO: 2276944 - RNA, 22 nt, Human
ccuccacucucccccacccccu

SEQ ID NO: 2276945 - RNA, 12 nt, Human
ccuccagaagcc

SEQ ID NO: 2276946 - RNA, 22 nt, Human
ccuccagaacucacuggggccu

SEQ ID NO: 2276947 - RNA, 21 nt, Human
ccuccagaacucacuggggcc

SEQ ID NO: 2276948 - RNA, 13 nt, Human
ccuccagaagccu

SEQ ID NO: 2276949 - RNA, 17 nt, Human
ccuccagaagccucugg

SEQ ID NO: 2276950 - RNA, 14 nt, Human
ccuccaucccgaca

SEQ ID NO: 2276951 - RNA, 19 nt, Human
ccuccauauuuucuuuaaa

SEQ ID NO: 2276952 - RNA, 15 nt, Human
ccuccaucccgacau

SEQ ID NO: 2276953 - RNA, 19 nt, Human
ccuccagguuuuucaauua

SEQ ID NO: 2276954 - RNA, 20 nt, Human
ccuccagguuuuucaauuaa

SEQ ID NO: 2276955 - RNA, 22 nt, Human
ccuccagguuuuucaauuaaac

SEQ ID NO: 2276956 - RNA, 23 nt, Human
ccuccaguccaaggaaaccacag

SEQ ID NO: 2276957 - RNA, 21 nt, Human
ccuccagguuuuucaauuaaa

SEQ ID NO: 2276958 - RNA, 17 nt, Human
ccuccaggugcacaagc

SEQ ID NO: 2276959 - RNA, 17 nt, Human
ccuccagggugugugcu

SEQ ID NO: 2276960 - RNA, 17 nt, Human
ccuccagguuuuucaau

SEQ ID NO: 2276961 - RNA, 18 nt, Human
ccuccagguuuuucaauu

SEQ ID NO: 2276962 - RNA, 11 nt, Human
ccuccaggugc

SEQ ID NO: 2276963 - RNA, 12 nt, Human
ccuccaggugca

SEQ ID NO: 2276964 - RNA, 12 nt, Human
ccuccauguggg

SEQ ID NO: 2276965 - RNA, 15 nt, Human
ccuccaugugggcua

SEQ ID NO: 2276966 - RNA, 17 nt, Human
ccucccaaagugcuggg

SEQ ID NO: 2276967 - RNA, 14 nt, Human
ccucccaacucacc

SEQ ID NO: 2276968 - RNA, 11 nt, Human
ccuccauggga

SEQ ID NO: 2276969 - RNA, 19 nt, Human
ccuccaugcugccuccaga

SEQ ID NO: 2276970 - RNA, 16 nt, Human
ccuccaugcugccucc

SEQ ID NO: 2276971 - RNA, 13 nt, Human
ccuccauccugag

SEQ ID NO: 2276972 - RNA, 12 nt, Human
ccuccauccuga

SEQ ID NO: 2276973 - RNA, 23 nt, Human
ccucccaaagugcugggauuaca

SEQ ID NO: 2276974 - RNA, 18 nt, Human
ccuccccccacugcaggc

SEQ ID NO: 2276975 - RNA, 17 nt, Human
ccuccccccacugcagg

SEQ ID NO: 2276976 - RNA, 15 nt, Human
ccucccaacucaccc

SEQ ID NO: 2276977 - RNA, 20 nt, Human
ccuccccccacugcaggccc

SEQ ID NO: 2276978 - RNA, 16 nt, Human
ccucccccgccacucc

SEQ ID NO: 2276979 - RNA, 17 nt, Human
ccucccccucccccuuc

SEQ ID NO: 2276980 - RNA, 17 nt, Human
ccucccccgccacuccu

SEQ ID NO: 2276981 - RNA, 19 nt, Human
ccucccccccaugcacugu

SEQ ID NO: 2276982 - RNA, 17 nt, Human
ccucccccccaugcacu

SEQ ID NO: 2276983 - RNA, 16 nt, Human
ccucccccccaugcac

SEQ ID NO: 2276984 - RNA, 15 nt, Human
ccucccccccaugca

SEQ ID NO: 2276985 - RNA, 13 nt, Human
ccucccccugcca

SEQ ID NO: 2276986 - RNA, 14 nt, Human
ccucccccugccag

SEQ ID NO: 2276987 - RNA, 17 nt, Human
ccucccccugccagugc

SEQ ID NO: 2276988 - RNA, 15 nt, Human
ccucccccugccagu

SEQ ID NO: 2276989 - RNA, 16 nt, Human
ccucccccugccagga

SEQ ID NO: 2276990 - RNA, 19 nt, Human
ccucccccugccagugccu

SEQ ID NO: 2276991 - RNA, 18 nt, Human
ccucccccugccagugcc

SEQ ID NO: 2276992 - RNA, 20 nt, Human
ccucccccugccagugccuu

SEQ ID NO: 2276993 - RNA, 15 nt, Human
ccucccccuucuccc

SEQ ID NO: 2276994 - RNA, 12 nt, Human
ccucccccuucu

SEQ ID NO: 2276995 - RNA, 22 nt, Human
ccuccccuauccacccagccca

SEQ ID NO: 2276996 - RNA, 18 nt, Human
ccuccccuauccacccag

SEQ ID NO: 2276997 - RNA, 17 nt, Human
ccuccccuauccaccca

SEQ ID NO: 2276998 - RNA, 15 nt, Human
ccuccccuauccacc

SEQ ID NO: 2276999 - RNA, 13 nt, Human
ccuccccuaucca

SEQ ID NO: 2277000 - RNA, 21 nt, Human
ccuccccggcccuaccagcgc

SEQ ID NO: 2277001 - RNA, 23 nt, Human
ccuccccggcucgagcaguccug

SEQ ID NO: 2277002 - RNA, 16 nt, Human
ccuccccgcccuuuuu

SEQ ID NO: 2277003 - RNA, 22 nt, Human
ccucccccuucucccaccccug

SEQ ID NO: 2277004 - RNA, 14 nt, Human
ccuccccggcccua

SEQ ID NO: 2277005 - RNA, 21 nt, Human
ccuccccgcaccccccaagcu

SEQ ID NO: 2277006 - RNA, 15 nt, Human
ccuccccgcaccccc

SEQ ID NO: 2277007 - RNA, 15 nt, Human
ccuccccugcccugg

SEQ ID NO: 2277008 - RNA, 14 nt, Human
ccuccccugcccua

SEQ ID NO: 2277009 - RNA, 13 nt, Human
ccuccccugcccu

SEQ ID NO: 2277010 - RNA, 14 nt, Human
ccuccccugccauu

SEQ ID NO: 2277011 - RNA, 18 nt, Human
ccucccgaauagcuggga

SEQ ID NO: 2277012 - RNA, 18 nt, Human
ccuccccugccagggcag

SEQ ID NO: 2277013 - RNA, 16 nt, Human
ccuccccugccagggc

SEQ ID NO: 2277014 - RNA, 13 nt, Human
ccuccccugccag

SEQ ID NO: 2277015 - RNA, 17 nt, Human
ccuccccugccaccagg

SEQ ID NO: 2277016 - RNA, 12 nt, Human
ccuccccugcca

SEQ ID NO: 2277017 - RNA, 14 nt, Human
ccuccccugaggcu

SEQ ID NO: 2277018 - RNA, 22 nt, Human
ccuccccugaggcucagggaaa

SEQ ID NO: 2277019 - RNA, 13 nt, Human
ccuccccugccac

SEQ ID NO: 2277020 - RNA, 14 nt, Human
ccuccccugccacc

SEQ ID NO: 2277021 - RNA, 13 nt, Human
ccuccccucacag

SEQ ID NO: 2277022 - RNA, 15 nt, Human
ccuccccucacagcc

SEQ ID NO: 2277023 - RNA, 16 nt, Human
ccuccccucacagccu

SEQ ID NO: 2277024 - RNA, 21 nt, Human
ccuccccucacagccucugac

SEQ ID NO: 2277025 - RNA, 18 nt, Human
ccuccccucacagccucu

SEQ ID NO: 2277026 - RNA, 19 nt, Human
ccuccccucacagccucug

SEQ ID NO: 2277027 - RNA, 15 nt, Human
ccuccccuccccugc

SEQ ID NO: 2277028 - RNA, 16 nt, Human
ccuccccuccccugcu

SEQ ID NO: 2277029 - RNA, 19 nt, Human
ccuccccuccccugcugca

SEQ ID NO: 2277030 - RNA, 14 nt, Human
ccuccccuccccug

SEQ ID NO: 2277031 - RNA, 15 nt, Human
ccuccccuccuccug

SEQ ID NO: 2277032 - RNA, 23 nt, Human
ccuccccucucuugcacccgccu

SEQ ID NO: 2277033 - RNA, 13 nt, Human
ccuccccucccgu

SEQ ID NO: 2277034 - RNA, 15 nt, Human
ccuccccucccgucu

SEQ ID NO: 2277035 - RNA, 12 nt, Human
ccuccuccagcc

SEQ ID NO: 2277036 - RNA, 16 nt, Human
ccuccuccacucuccc

SEQ ID NO: 2277037 - RNA, 20 nt, Human
ccuccucacuggccaucccu

SEQ ID NO: 2277038 - RNA, 14 nt, Human
ccuccucacuggcc

SEQ ID NO: 2277039 - RNA, 15 nt, Human
ccuccucacuggcca

SEQ ID NO: 2277040 - RNA, 17 nt, Human
ccuccucacuggccauc

SEQ ID NO: 2277041 - RNA, 19 nt, Human
ccuccucacuggccauccc

SEQ ID NO: 2277042 - RNA, 14 nt, Human
ccuccucacucccu

SEQ ID NO: 2277043 - RNA, 22 nt, Human
ccuccucaccucaugcccaccc

SEQ ID NO: 2277044 - RNA, 22 nt, Human
ccuccucaccucuggacuggcu

SEQ ID NO: 2277045 - RNA, 21 nt, Human
ccuccucaccucuggacuggc

SEQ ID NO: 2277046 - RNA, 16 nt, Human
ccuccucaccucugga

SEQ ID NO: 2277047 - RNA, 11 nt, Human
ccuccucagau

SEQ ID NO: 2277048 - RNA, 15 nt, Human
ccuccucaccucugg

SEQ ID NO: 2277049 - RNA, 14 nt, Human
ccuccucaccucug

SEQ ID NO: 2277050 - RNA, 13 nt, Human
ccuccucaccucu

SEQ ID NO: 2277051 - RNA, 17 nt, Human
ccuccucaccucaugcc

SEQ ID NO: 2277052 - RNA, 19 nt, Human
ccuccucaccucaugccca

SEQ ID NO: 2277053 - RNA, 19 nt, Human
ccucccucugaccugcagg

SEQ ID NO: 2277054 - RNA, 14 nt, Human
ccucccucugaggc

SEQ ID NO: 2277055 - RNA, 19 nt, Human
ccucccucugaggcuguag

SEQ ID NO: 2277056 - RNA, 21 nt, Human
ccucccucugaggcuguagga

SEQ ID NO: 2277057 - RNA, 16 nt, Human
ccuccucaccucaugc

SEQ ID NO: 2277058 - RNA, 18 nt, Human
ccucccucugaccugcag

SEQ ID NO: 2277059 - RNA, 14 nt, Human
ccucccucugaccu

SEQ ID NO: 2277060 - RNA, 22 nt, Human
ccucccucucucuucugcucca

SEQ ID NO: 2277061 - RNA, 20 nt, Human
ccucccucucucuucugcuc

SEQ ID NO: 2277062 - RNA, 13 nt, Human
ccucccucuuucc

SEQ ID NO: 2277063 - RNA, 21 nt, Human
ccucccuccugccgacuccug

SEQ ID NO: 2277064 - RNA, 15 nt, Human
ccucccuccugccga

SEQ ID NO: 2277065 - RNA, 12 nt, Human
ccucccuccugc

SEQ ID NO: 2277066 - RNA, 18 nt, Human
ccucccucucucuucugc

SEQ ID NO: 2277067 - RNA, 13 nt, Human
ccucccucucucu

SEQ ID NO: 2277068 - RNA, 13 nt, Human
ccucccucuaauu

SEQ ID NO: 2277069 - RNA, 17 nt, Human
ccucccgaguagcuggg

SEQ ID NO: 2277070 - RNA, 18 nt, Human
ccucccgaguagcuggga

SEQ ID NO: 2277071 - RNA, 16 nt, Human
ccuccccugcccuggu

SEQ ID NO: 2277072 - RNA, 12 nt, Human
ccuccccugcug

SEQ ID NO: 2277073 - RNA, 16 nt, Human
ccuccccugcugaagg

SEQ ID NO: 2277074 - RNA, 13 nt, Human
ccuccccugcugc

SEQ ID NO: 2277075 - RNA, 14 nt, Human
ccuccccugcugca

SEQ ID NO: 2277076 - RNA, 21 nt, Human
ccucccgaauagcugggacua

SEQ ID NO: 2277077 - RNA, 19 nt, Human
ccucccgaauagcugggac

SEQ ID NO: 2277078 - RNA, 20 nt, Human
ccucccgaauagcugggacu

SEQ ID NO: 2277079 - RNA, 16 nt, Human
cccaugaaucaaagac

SEQ ID NO: 2277080 - RNA, 14 nt, Human
cccaugccugucca

SEQ ID NO: 2277081 - RNA, 19 nt, Human
cccaugccuguccagccug

SEQ ID NO: 2277082 - RNA, 16 nt, Human
cccaugccuguccagc

SEQ ID NO: 2277083 - RNA, 20 nt, Human
cccaugagccucagcauccu

SEQ ID NO: 2277084 - RNA, 15 nt, Human
cccaugagccucagc

SEQ ID NO: 2277085 - RNA, 16 nt, Human
cccaugagccucagca

SEQ ID NO: 2277086 - RNA, 20 nt, Human
cccaugccuguccagccugg

SEQ ID NO: 2277087 - RNA, 17 nt, Human
cccaugggcucugacag

SEQ ID NO: 2277088 - RNA, 19 nt, Human
cccauggggagggauucug

SEQ ID NO: 2277089 - RNA, 14 nt, Human
cccaugcugcccug

SEQ ID NO: 2277090 - RNA, 12 nt, Human
cccaugcugccc

SEQ ID NO: 2277091 - RNA, 13 nt, Human
cccaugcugcccu

SEQ ID NO: 2277092 - RNA, 21 nt, Human
cccaucuaugucccuugcugu

SEQ ID NO: 2277093 - RNA, 13 nt, Human
cccaucucacaca

SEQ ID NO: 2277094 - RNA, 18 nt, Human
cccaucucacacaugagc

SEQ ID NO: 2277095 - RNA, 20 nt, Human
cccaucucaugccccuggcu

SEQ ID NO: 2277096 - RNA, 22 nt, Human
cccaugaagacaggacagugcu

SEQ ID NO: 2277097 - RNA, 19 nt, Human
cccaugaagacaggacagu

SEQ ID NO: 2277098 - RNA, 18 nt, Human
cccaugaagacaggacag

SEQ ID NO: 2277099 - RNA, 12 nt, Human
cccaucuugcuu

SEQ ID NO: 2277100 - RNA, 20 nt, Human
cccaugaacacacugugucc

SEQ ID NO: 2277101 - RNA, 22 nt, Human
cccaugaacuuaaaaugaaagu

SEQ ID NO: 2277102 - RNA, 20 nt, Human
cccaucugugaaaggaaaga

SEQ ID NO: 2277103 - RNA, 16 nt, Human
cccaucugugaauaag

SEQ ID NO: 2277104 - RNA, 13 nt, Human
cccaucugugaau

SEQ ID NO: 2277105 - RNA, 14 nt, Human
cccaucucaugccc

SEQ ID NO: 2277106 - RNA, 16 nt, Human
cccaugucucucagaa

SEQ ID NO: 2277107 - RNA, 19 nt, Human
cccaugucgcgcucagcau

SEQ ID NO: 2277108 - RNA, 17 nt, Human
cccaugucucgacucau

SEQ ID NO: 2277109 - RNA, 16 nt, Human
cccaugucucgacuca

SEQ ID NO: 2277110 - RNA, 23 nt, Human
cccauguauuuaucucuauuuaa

SEQ ID NO: 2277111 - RNA, 18 nt, Human
cccaugucgcgcucagca

SEQ ID NO: 2277112 - RNA, 23 nt, Human
cccauguagcccccuggccucug

SEQ ID NO: 2277113 - RNA, 22 nt, Human
cccauguagcccccuggccucu

SEQ ID NO: 2277114 - RNA, 21 nt, Human
cccauguagcccccuggccuc

SEQ ID NO: 2277115 - RNA, 15 nt, Human
cccauguagcccccu

SEQ ID NO: 2277116 - RNA, 14 nt, Human
cccauguagccccc

SEQ ID NO: 2277117 - RNA, 17 nt, Human
cccauguaacagaaagg

SEQ ID NO: 2277118 - RNA, 12 nt, Human
ccccaaagcccc

SEQ ID NO: 2277119 - RNA, 22 nt, Human
ccccaaagagccuggagaagcu

SEQ ID NO: 2277120 - RNA, 16 nt, Human
cccauuaggacaauca

SEQ ID NO: 2277121 - RNA, 15 nt, Human
ccccaaagagccugg

SEQ ID NO: 2277122 - RNA, 19 nt, Human
ccccaaagagccuggagaa

SEQ ID NO: 2277123 - RNA, 16 nt, Human
cccauuagcaaaaauu

SEQ ID NO: 2277124 - RNA, 21 nt, Human
cccauuaggacaaucaguccc

SEQ ID NO: 2277125 - RNA, 18 nt, Human
cccauuagaccaagcuug

SEQ ID NO: 2277126 - RNA, 15 nt, Human
cccauguuucucugg

SEQ ID NO: 2277127 - RNA, 20 nt, Human
cccaugugugagugugugca

SEQ ID NO: 2277128 - RNA, 19 nt, Human
cccaugugugagugugugc

SEQ ID NO: 2277129 - RNA, 14 nt, Human
cccaugugugagug

SEQ ID NO: 2277130 - RNA, 21 nt, Human
cccauguguccugguucccgu

SEQ ID NO: 2277131 - RNA, 13 nt, Human
cccaugugccaag

SEQ ID NO: 2277132 - RNA, 23 nt, Human
ccccaacccugccccugccccgu

SEQ ID NO: 2277133 - RNA, 18 nt, Human
ccccaacccugccccugc

SEQ ID NO: 2277134 - RNA, 17 nt, Human
ccccaacccugccccug

SEQ ID NO: 2277135 - RNA, 15 nt, Human
ccccaacccugcccc

SEQ ID NO: 2277136 - RNA, 13 nt, Human
ccccaacccugcc

SEQ ID NO: 2277137 - RNA, 17 nt, Human
ccccaaccccugaggaa

SEQ ID NO: 2277138 - RNA, 14 nt, Human
ccccaaccccugag

SEQ ID NO: 2277139 - RNA, 16 nt, Human
ccccaaccccugagga

SEQ ID NO: 2277140 - RNA, 22 nt, Human
ccccacacuuguuccagcucuu

SEQ ID NO: 2277141 - RNA, 18 nt, Human
ccccacacuggggugccg

SEQ ID NO: 2277142 - RNA, 15 nt, Human
ccccaacuccuggaa

SEQ ID NO: 2277143 - RNA, 13 nt, Human
ccccacacugggg

SEQ ID NO: 2277144 - RNA, 14 nt, Human
ccccaacuccugga

SEQ ID NO: 2277145 - RNA, 13 nt, Human
ccccaacuccugg

SEQ ID NO: 2277146 - RNA, 14 nt, Human
ccccaaccugcuga

SEQ ID NO: 2277147 - RNA, 17 nt, Human
ccccaaauaagaaggga

SEQ ID NO: 2277148 - RNA, 18 nt, Human
ccccaaauaagaagggau

SEQ ID NO: 2277149 - RNA, 11 nt, Human
ccccaaauccg

SEQ ID NO: 2277150 - RNA, 15 nt, Human
ccccaaaucaauaca

SEQ ID NO: 2277151 - RNA, 20 nt, Human
ccccaaagagccuggagaag

SEQ ID NO: 2277152 - RNA, 19 nt, Human
ccccaaaggaaaaagcaca

SEQ ID NO: 2277153 - RNA, 16 nt, Human
ccccaaagcuuuccug

SEQ ID NO: 2277154 - RNA, 18 nt, Human
ccccaaagcuuuccugcc

SEQ ID NO: 2277155 - RNA, 19 nt, Human
ccccaaagcuuuccugccc

SEQ ID NO: 2277156 - RNA, 21 nt, Human
ccccaaagcuuuccugcccca

SEQ ID NO: 2277157 - RNA, 13 nt, Human
ccccaacccccac

SEQ ID NO: 2277158 - RNA, 23 nt, Human
ccccaacccccagcacccgggcu

SEQ ID NO: 2277159 - RNA, 13 nt, Human
ccccaaccccuga

SEQ ID NO: 2277160 - RNA, 13 nt, Human
ccccaaccccagc

SEQ ID NO: 2277161 - RNA, 14 nt, Human
ccccaaccccagcc

SEQ ID NO: 2277162 - RNA, 23 nt, Human
ccccaaauccgaaccuccucugu

SEQ ID NO: 2277163 - RNA, 19 nt, Human
ccccaaauccgaaccuccu

SEQ ID NO: 2277164 - RNA, 21 nt, Human
ccccaaauggaaaugggcaga

SEQ ID NO: 2277165 - RNA, 14 nt, Human
cccaguccuuccac

SEQ ID NO: 2277166 - RNA, 21 nt, Human
cccaguccuggccuggcuucu

SEQ ID NO: 2277167 - RNA, 22 nt, Human
cccaguccuggccuggcuucuc

SEQ ID NO: 2277168 - RNA, 16 nt, Human
cccaguccuuccaccu

SEQ ID NO: 2277169 - RNA, 17 nt, Human
cccaguccuuccaccuc

SEQ ID NO: 2277170 - RNA, 10 nt, Human
cccagucugg

SEQ ID NO: 2277171 - RNA, 18 nt, Human
cccagucuggaaugcagu

SEQ ID NO: 2277172 - RNA, 19 nt, Human
cccagucuggaaugcagug

SEQ ID NO: 2277173 - RNA, 15 nt, Human
cccagugccgagaag

SEQ ID NO: 2277174 - RNA, 22 nt, Human
cccagugcccccacugaccaga

SEQ ID NO: 2277175 - RNA, 20 nt, Human
cccagucucuggcaguucug

SEQ ID NO: 2277176 - RNA, 20 nt, Human
cccagugcccccacugacca

SEQ ID NO: 2277177 - RNA, 19 nt, Human
cccagugcccccacugacc

SEQ ID NO: 2277178 - RNA, 21 nt, Human
cccagugcccacaggaucagu

SEQ ID NO: 2277179 - RNA, 14 nt, Human
cccagugcccccac

SEQ ID NO: 2277180 - RNA, 16 nt, Human
cccagucuacccagag

SEQ ID NO: 2277181 - RNA, 15 nt, Human
cccagucucuggcag

SEQ ID NO: 2277182 - RNA, 23 nt, Human
cccaguccuggccuggcuucucc

SEQ ID NO: 2277183 - RNA, 15 nt, Human
cccagucuacccaga

SEQ ID NO: 2277184 - RNA, 17 nt, Human
cccagucuacccagaga

SEQ ID NO: 2277185 - RNA, 17 nt, Human
cccagugucuuccugug

SEQ ID NO: 2277186 - RNA, 18 nt, Human
cccagugucuuccugugg

SEQ ID NO: 2277187 - RNA, 21 nt, Human
cccagugucaaguugugcuug

SEQ ID NO: 2277188 - RNA, 22 nt, Human
cccagugucaaguugugcuugu

SEQ ID NO: 2277189 - RNA, 15 nt, Human
cccagugucuuccug

SEQ ID NO: 2277190 - RNA, 16 nt, Human
cccagugucuuccugu

SEQ ID NO: 2277191 - RNA, 22 nt, Human
cccaguucaggagucccaagga

SEQ ID NO: 2277192 - RNA, 22 nt, Human
cccaguucaacucauggagaug

SEQ ID NO: 2277193 - RNA, 19 nt, Human
cccaguucaggagucccaa

SEQ ID NO: 2277194 - RNA, 20 nt, Human
cccagugucuuccugugggg

SEQ ID NO: 2277195 - RNA, 14 nt, Human
cccaguucacccug

SEQ ID NO: 2277196 - RNA, 14 nt, Human
cccaguuagcucuc

SEQ ID NO: 2277197 - RNA, 16 nt, Human
cccaguggcugcugcc

SEQ ID NO: 2277198 - RNA, 17 nt, Human
cccaguggcugcugccc

SEQ ID NO: 2277199 - RNA, 15 nt, Human
cccaguggcugcugc

SEQ ID NO: 2277200 - RNA, 18 nt, Human
cccaguggcugcugccca

SEQ ID NO: 2277201 - RNA, 21 nt, Human
cccaguggcugcugcccaggc

SEQ ID NO: 2277202 - RNA, 18 nt, Human
cccaguggcuguucugga

SEQ ID NO: 2277203 - RNA, 12 nt, Human
cccagugggagg

SEQ ID NO: 2277204 - RNA, 15 nt, Human
cccagugggaggcgc

SEQ ID NO: 2277205 - RNA, 16 nt, Human
cccagugggaggcgcg

SEQ ID NO: 2277206 - RNA, 20 nt, Human
cccagugggaggcgcgagcc

SEQ ID NO: 2277207 - RNA, 14 nt, Human
cccagugggagggg

SEQ ID NO: 2277208 - RNA, 20 nt, Human
cccagugguuccuaauccuc

SEQ ID NO: 2277209 - RNA, 16 nt, Human
cccagugggaggggca

SEQ ID NO: 2277210 - RNA, 17 nt, Human
cccagugggaggggcag

SEQ ID NO: 2277211 - RNA, 18 nt, Human
cccagugggaggggcagg

SEQ ID NO: 2277212 - RNA, 19 nt, Human
cccagugggaggggcaggc

SEQ ID NO: 2277213 - RNA, 20 nt, Human
cccagugggaggggcaggcu

SEQ ID NO: 2277214 - RNA, 21 nt, Human
cccagugggaggggcaggcug

SEQ ID NO: 2277215 - RNA, 22 nt, Human
cccagugggaggggcaggcuga

SEQ ID NO: 2277216 - RNA, 23 nt, Human
cccagucccugggggaagcccug

SEQ ID NO: 2277217 - RNA, 13 nt, Human
cccaguccuggcc

SEQ ID NO: 2277218 - RNA, 14 nt, Human
cccaguccuggccu

SEQ ID NO: 2277219 - RNA, 15 nt, Human
cccaguccuggccug

SEQ ID NO: 2277220 - RNA, 16 nt, Human
cccaguccuggccugg

SEQ ID NO: 2277221 - RNA, 17 nt, Human
cccaguccuggccuggc

SEQ ID NO: 2277222 - RNA, 20 nt, Human
cccaguccuggccuggcuuc

SEQ ID NO: 2277223 - RNA, 16 nt, Human
cccagucccuggggga

SEQ ID NO: 2277224 - RNA, 14 nt, Human
cccagucccugggg

SEQ ID NO: 2277225 - RNA, 13 nt, Human
cccagucccuggg

SEQ ID NO: 2277226 - RNA, 12 nt, Human
cccagucccugg

SEQ ID NO: 2277227 - RNA, 20 nt, Human
cccagucccccaaccccagc

SEQ ID NO: 2277228 - RNA, 22 nt, Human
cccagucccccaaccccagccg

SEQ ID NO: 2277229 - RNA, 13 nt, Human
cccaguccccgug

SEQ ID NO: 2277230 - RNA, 23 nt, Human
cccaguccccgugccccgccucc

SEQ ID NO: 2277231 - RNA, 14 nt, Human
cccaguaagccacu

SEQ ID NO: 2277232 - RNA, 20 nt, Human
cccaguaccuccugucucug

SEQ ID NO: 2277233 - RNA, 21 nt, Human
cccaguaccuccugucucugg

SEQ ID NO: 2277234 - RNA, 22 nt, Human
cccaguaccuccugucucuggc

SEQ ID NO: 2277235 - RNA, 21 nt, Human
cccaguccccaccccugcccc

SEQ ID NO: 2277236 - RNA, 23 nt, Human
cccaguccccaccccugccccca

SEQ ID NO: 2277237 - RNA, 14 nt, Human
cccagucccccaac

SEQ ID NO: 2277238 - RNA, 18 nt, Human
cccaguaaaauugccaua

SEQ ID NO: 2277239 - RNA, 15 nt, Human
cccaguaacucaucu

SEQ ID NO: 2277240 - RNA, 14 nt, Human
cccaguaccuccug

SEQ ID NO: 2277241 - RNA, 13 nt, Human
cccagguuucuau

SEQ ID NO: 2277242 - RNA, 17 nt, Human
cccagguaccagcugcg

SEQ ID NO: 2277243 - RNA, 19 nt, Human
cccagguaccagcugcgcu

SEQ ID NO: 2277244 - RNA, 12 nt, Human
cccaguaaaauu

SEQ ID NO: 2277245 - RNA, 13 nt, Human
cccaguaaaauug

SEQ ID NO: 2277246 - RNA, 16 nt, Human
cccaguaaaauugcca

SEQ ID NO: 2277247 - RNA, 17 nt, Human
cccaguaaaauugccau

SEQ ID NO: 2277248 - RNA, 14 nt, Human
cccaggucauggaa

SEQ ID NO: 2277249 - RNA, 14 nt, Human
cccagguccagcuc

SEQ ID NO: 2277250 - RNA, 13 nt, Human
cccagguuucugg

SEQ ID NO: 2277251 - RNA, 19 nt, Human
cccagguuucuggucucua

SEQ ID NO: 2277252 - RNA, 22 nt, Human
cccagguuucuggucucuaggc

SEQ ID NO: 2277253 - RNA, 18 nt, Human
cccaggguucccccagcc

SEQ ID NO: 2277254 - RNA, 14 nt, Human
cccagguaagcagg

SEQ ID NO: 2277255 - RNA, 17 nt, Human
cccagguaagcaggagg

SEQ ID NO: 2277256 - RNA, 19 nt, Human
cccagguaagcaggaggag

SEQ ID NO: 2277257 - RNA, 14 nt, Human
cccagguaccagcu

SEQ ID NO: 2277258 - RNA, 15 nt, Human
cccagguaccagcug

SEQ ID NO: 2277259 - RNA, 16 nt, Human
cccagguaccagcugc

SEQ ID NO: 2277260 - RNA, 19 nt, Human
cccaggguuaauagggccu

SEQ ID NO: 2277261 - RNA, 18 nt, Human
cccaggguucaguccuca

SEQ ID NO: 2277262 - RNA, 19 nt, Human
cccagggugggaagggcua

SEQ ID NO: 2277263 - RNA, 17 nt, Human
cccaggcauuccccagg

SEQ ID NO: 2277264 - RNA, 18 nt, Human
cccaggcauuccccagga

SEQ ID NO: 2277265 - RNA, 23 nt, Human
cccaggcaggucuugaacuccug

SEQ ID NO: 2277266 - RNA, 15 nt, Human
cccaggcauucccca

SEQ ID NO: 2277267 - RNA, 15 nt, Human
cccaggaggccagcc

SEQ ID NO: 2277268 - RNA, 16 nt, Human
cccaggaggccagccu

SEQ ID NO: 2277269 - RNA, 20 nt, Human
cccagcuacucaggaggcug

SEQ ID NO: 2277270 - RNA, 15 nt, Human
cccagcuacucagga

SEQ ID NO: 2277271 - RNA, 15 nt, Human
cccagcuacuuggga

SEQ ID NO: 2277272 - RNA, 16 nt, Human
cccagcuacuugggaa

SEQ ID NO: 2277273 - RNA, 17 nt, Human
cccagcuauaccugugc

SEQ ID NO: 2277274 - RNA, 18 nt, Human
cccagcuacuugggaagc

SEQ ID NO: 2277275 - RNA, 19 nt, Human
cccagcuacuugggaagcu

SEQ ID NO: 2277276 - RNA, 15 nt, Human
cccagcucagagggu

SEQ ID NO: 2277277 - RNA, 14 nt, Human
cccagcucagaggg

SEQ ID NO: 2277278 - RNA, 12 nt, Human
cccagcucagca

SEQ ID NO: 2277279 - RNA, 23 nt, Human
cccagcucucccucuggcccugc

SEQ ID NO: 2277280 - RNA, 12 nt, Human
cccagcucugaa

SEQ ID NO: 2277281 - RNA, 21 nt, Human
cccagcuaugguucucucgca

SEQ ID NO: 2277282 - RNA, 20 nt, Human
cccagcuauaccugugccuc

SEQ ID NO: 2277283 - RNA, 11 nt, Human
cccagcucaau

SEQ ID NO: 2277284 - RNA, 14 nt, Human
cccagcuacucagg

SEQ ID NO: 2277285 - RNA, 23 nt, Human
cccagccuucuuugcuugccucu

SEQ ID NO: 2277286 - RNA, 21 nt, Human
cccagccuuggcaucuagagc

SEQ ID NO: 2277287 - RNA, 14 nt, Human
cccagcgagcccug

SEQ ID NO: 2277288 - RNA, 21 nt, Human
cccaggacaccacacccagcc

SEQ ID NO: 2277289 - RNA, 22 nt, Human
cccaggacaccacacccagccu

SEQ ID NO: 2277290 - RNA, 23 nt, Human
cccaggacaccacacccagccuc

SEQ ID NO: 2277291 - RNA, 18 nt, Human
cccagcucugguccauag

SEQ ID NO: 2277292 - RNA, 15 nt, Human
cccagcucuggucca

SEQ ID NO: 2277293 - RNA, 16 nt, Human
cccagcucugguccau

SEQ ID NO: 2277294 - RNA, 13 nt, Human
cccagcucuggcu

SEQ ID NO: 2277295 - RNA, 22 nt, Human
cccagcucugaaaccaguguua

SEQ ID NO: 2277296 - RNA, 14 nt, Human
cccagcucugaaac

SEQ ID NO: 2277297 - RNA, 12 nt, Human
cccagcucuggu

SEQ ID NO: 2277298 - RNA, 13 nt, Human
cccagcucugguc

SEQ ID NO: 2277299 - RNA, 14 nt, Human
cccagcucuggucc

SEQ ID NO: 2277300 - RNA, 23 nt, Human
cccaggagagccagcccucccug

SEQ ID NO: 2277301 - RNA, 22 nt, Human
cccaggagagccagcccucccu

SEQ ID NO: 2277302 - RNA, 21 nt, Human
cccaggagagccagcccuccc

SEQ ID NO: 2277303 - RNA, 19 nt, Human
cccaggagagccagcccuc

SEQ ID NO: 2277304 - RNA, 18 nt, Human
cccaggagagccagcccu

SEQ ID NO: 2277305 - RNA, 15 nt, Human
cccaggagagccagc

SEQ ID NO: 2277306 - RNA, 14 nt, Human
cccaggagagccag

SEQ ID NO: 2277307 - RNA, 20 nt, Human
cccaggagagagaaagccag

SEQ ID NO: 2277308 - RNA, 17 nt, Human
cccaggagacaguucaa

SEQ ID NO: 2277309 - RNA, 15 nt, Human
cccaggagacaguuc

SEQ ID NO: 2277310 - RNA, 13 nt, Human
cccaggagagaga

SEQ ID NO: 2277311 - RNA, 14 nt, Human
cccaggagagagaa

SEQ ID NO: 2277312 - RNA, 15 nt, Human
cccaggagagagaaa

SEQ ID NO: 2277313 - RNA, 16 nt, Human
cccaggagagagaaag

SEQ ID NO: 2277314 - RNA, 12 nt, Human
cccaggacuggg

SEQ ID NO: 2277315 - RNA, 13 nt, Human
cccaggacugggc

SEQ ID NO: 2277316 - RNA, 14 nt, Human
cccaggacugggcc

SEQ ID NO: 2277317 - RNA, 15 nt, Human
cccaggacugggcca

SEQ ID NO: 2277318 - RNA, 23 nt, Human
cccaggacggggccggccaggug

SEQ ID NO: 2277319 - RNA, 15 nt, Human
cccaggacggggccg

SEQ ID NO: 2277320 - RNA, 17 nt, Human
cccaggacggggccggc

SEQ ID NO: 2277321 - RNA, 19 nt, Human
cccaggacggggccggcca

SEQ ID NO: 2277322 - RNA, 22 nt, Human
cccaggacggggccggccaggu

SEQ ID NO: 2277323 - RNA, 13 nt, Human
cccaggagccccg

SEQ ID NO: 2277324 - RNA, 14 nt, Human
cccaggagccccga

SEQ ID NO: 2277325 - RNA, 18 nt, Human
cccaggagcauccaccuc

SEQ ID NO: 2277326 - RNA, 22 nt, Human
cccaggagcauccaccuccuuc

SEQ ID NO: 2277327 - RNA, 14 nt, Human
cccaggaggccagc

SEQ ID NO: 2277328 - RNA, 16 nt, Human
cccaggaccccugagu

SEQ ID NO: 2277329 - RNA, 22 nt, Human
cccaggaccagcuggggcgugg

SEQ ID NO: 2277330 - RNA, 19 nt, Human
cccaggaccagcuggggcg

SEQ ID NO: 2277331 - RNA, 21 nt, Human
cccaggaccagcuggggcgug

SEQ ID NO: 2277332 - RNA, 23 nt, Human
cccaggacccugaaggggccaug

SEQ ID NO: 2277333 - RNA, 13 nt, Human
cccaggacccuga

SEQ ID NO: 2277334 - RNA, 12 nt, Human
cccaggacccug

SEQ ID NO: 2277335 - RNA, 11 nt, Human
cccaggacccu

SEQ ID NO: 2277336 - RNA, 16 nt, Human
cccaggaccuggcugc

SEQ ID NO: 2277337 - RNA, 15 nt, Human
cccaggacgcuucug

SEQ ID NO: 2277338 - RNA, 16 nt, Human
cccaggacgcuucuga

SEQ ID NO: 2277339 - RNA, 17 nt, Human
cccaggacgcuucugaa

SEQ ID NO: 2277340 - RNA, 18 nt, Human
cccaggacgcuucugaau

SEQ ID NO: 2277341 - RNA, 19 nt, Human
cccaggacgcuucugaaug

SEQ ID NO: 2277342 - RNA, 20 nt, Human
cccaggacgcuucugaaugc

SEQ ID NO: 2277343 - RNA, 18 nt, Human
cccaggaccuggcugcca

SEQ ID NO: 2277344 - RNA, 22 nt, Human
cccaggaccagcucaggacaga

SEQ ID NO: 2277345 - RNA, 21 nt, Human
cccaggaccagcucaggacag

SEQ ID NO: 2277346 - RNA, 15 nt, Human
cccaggaccagcugg

SEQ ID NO: 2277347 - RNA, 16 nt, Human
cccaggaccagcuggg

SEQ ID NO: 2277348 - RNA, 17 nt, Human
cccaggaccagcugggg

SEQ ID NO: 2277349 - RNA, 18 nt, Human
cccaggaccagcuggggc

SEQ ID NO: 2277350 - RNA, 20 nt, Human
cccaggaccagcucaggaca

SEQ ID NO: 2277351 - RNA, 17 nt, Human
cccaggaccagcucagg

SEQ ID NO: 2277352 - RNA, 16 nt, Human
cccaggaccagcucag

SEQ ID NO: 2277353 - RNA, 15 nt, Human
cccaggaccagcuca

SEQ ID NO: 2277354 - RNA, 14 nt, Human
cccaggaccagcuc

SEQ ID NO: 2277355 - RNA, 13 nt, Human
cccaggaccagcu

SEQ ID NO: 2277356 - RNA, 12 nt, Human
cccaggaccagc

SEQ ID NO: 2277357 - RNA, 15 nt, Human
cccagccucuaggga

SEQ ID NO: 2277358 - RNA, 18 nt, Human
cccagccucccugaagcc

SEQ ID NO: 2277359 - RNA, 17 nt, Human
cccagccucccugaagc

SEQ ID NO: 2277360 - RNA, 16 nt, Human
cccagccucccugaag

SEQ ID NO: 2277361 - RNA, 21 nt, Human
cccagccucuucuagagccgu

SEQ ID NO: 2277362 - RNA, 17 nt, Human
cccagccuggcccagcu

SEQ ID NO: 2277363 - RNA, 15 nt, Human
cccagccucuggcau

SEQ ID NO: 2277364 - RNA, 18 nt, Human
cccagccuggcccagcuc

SEQ ID NO: 2277365 - RNA, 19 nt, Human
cccagccuggcccagcucc

SEQ ID NO: 2277366 - RNA, 20 nt, Human
cccagccuggcccagcuccc

SEQ ID NO: 2277367 - RNA, 22 nt, Human
cccagccuggcccagcuccccc

SEQ ID NO: 2277368 - RNA, 18 nt, Human
cccagccuccaagcucca

SEQ ID NO: 2277369 - RNA, 20 nt, Human
cccagccuccaagcuccauc

SEQ ID NO: 2277370 - RNA, 12 nt, Human
cccagccucagu

SEQ ID NO: 2277371 - RNA, 16 nt, Human
cccagccucaguccuc

SEQ ID NO: 2277372 - RNA, 22 nt, Human
cccagccucaguccuccccuca

SEQ ID NO: 2277373 - RNA, 23 nt, Human
cccagcccuccuuaucaaaggac

SEQ ID NO: 2277374 - RNA, 16 nt, Human
cccagcccucaucccg

SEQ ID NO: 2277375 - RNA, 15 nt, Human
cccagcccucauccc

SEQ ID NO: 2277376 - RNA, 14 nt, Human
cccagcccucaucc

SEQ ID NO: 2277377 - RNA, 16 nt, Human
cccagcccggcuccca

SEQ ID NO: 2277378 - RNA, 17 nt, Human
cccagcccuauggaugu

SEQ ID NO: 2277379 - RNA, 16 nt, Human
cccagcccccuuuggg

SEQ ID NO: 2277380 - RNA, 21 nt, Human
cccagcccccuuugggcccag

SEQ ID NO: 2277381 - RNA, 20 nt, Human
cccagcccggaccuuggcag

SEQ ID NO: 2277382 - RNA, 14 nt, Human
cccagcccggcucc

SEQ ID NO: 2277383 - RNA, 19 nt, Human
cccagcccucaucccgagc

SEQ ID NO: 2277384 - RNA, 18 nt, Human
cccagcccuauggaugug

SEQ ID NO: 2277385 - RNA, 10 nt, Human
cccagcccug

SEQ ID NO: 2277386 - RNA, 11 nt, Human
cccagcccugc

SEQ ID NO: 2277387 - RNA, 12 nt, Human
cccagcccugcu

SEQ ID NO: 2277388 - RNA, 13 nt, Human
cccagcccugcug

SEQ ID NO: 2277389 - RNA, 14 nt, Human
cccagcccugcugg

SEQ ID NO: 2277390 - RNA, 15 nt, Human
cccagcccugcuggc

SEQ ID NO: 2277391 - RNA, 16 nt, Human
cccagcccugcuggcc

SEQ ID NO: 2277392 - RNA, 20 nt, Human
cccagcccugcuggccgccu

SEQ ID NO: 2277393 - RNA, 19 nt, Human
cccagcccugcuggccgcc

SEQ ID NO: 2277394 - RNA, 11 nt, Human
cccagcccugg

SEQ ID NO: 2277395 - RNA, 12 nt, Human
cccagcccuggc

SEQ ID NO: 2277396 - RNA, 11 nt, Human
cccagccucag

SEQ ID NO: 2277397 - RNA, 18 nt, Human
cccagccccauccucugu

SEQ ID NO: 2277398 - RNA, 19 nt, Human
cccagccccauccucugua

SEQ ID NO: 2277399 - RNA, 12 nt, Human
cccagcccccac

SEQ ID NO: 2277400 - RNA, 16 nt, Human
cccagcccccacagug

SEQ ID NO: 2277401 - RNA, 17 nt, Human
cccagcccccacagugc

SEQ ID NO: 2277402 - RNA, 24 nt, Human
cccagcccccacagugcugucuga

SEQ ID NO: 2277403 - RNA, 15 nt, Human
cccagcccccuuugg

SEQ ID NO: 2277404 - RNA, 22 nt, Human
cccagcccccuuugggcccagg

SEQ ID NO: 2277405 - RNA, 13 nt, Human
cccagccccaucc

SEQ ID NO: 2277406 - RNA, 14 nt, Human
cccagccccauccc

SEQ ID NO: 2277407 - RNA, 14 nt, Human
cccagccccauccu

SEQ ID NO: 2277408 - RNA, 15 nt, Human
cccagccccauccuc

SEQ ID NO: 2277409 - RNA, 17 nt, Human
cccagcaacccuccuau

SEQ ID NO: 2277410 - RNA, 13 nt, Human
cccagcaacccuc

SEQ ID NO: 2277411 - RNA, 20 nt, Human
cccagcaacacaagcuggaa

SEQ ID NO: 2277412 - RNA, 22 nt, Human
cccagcaacacaagcuggaagc

SEQ ID NO: 2277413 - RNA, 21 nt, Human
cccagcaacccuccuaucacc

SEQ ID NO: 2277414 - RNA, 19 nt, Human
cccagcaacccuccuauca

SEQ ID NO: 2277415 - RNA, 16 nt, Human
cccagcaacuccaacu

SEQ ID NO: 2277416 - RNA, 17 nt, Human
cccagccccaaugaaca

SEQ ID NO: 2277417 - RNA, 11 nt, Human
cccagccccau

SEQ ID NO: 2277418 - RNA, 12 nt, Human
cccagccccauc

SEQ ID NO: 2277419 - RNA, 18 nt, Human
cccagauuuugcuguaua

SEQ ID NO: 2277420 - RNA, 21 nt, Human
cccagauuuugcuguauauuu

SEQ ID NO: 2277421 - RNA, 19 nt, Human
cccagauuuugcuguauau

SEQ ID NO: 2277422 - RNA, 15 nt, Human
cccagcaacacaagc

SEQ ID NO: 2277423 - RNA, 13 nt, Human
cccagccccaaug

SEQ ID NO: 2277424 - RNA, 16 nt, Human
cccagaggcugcccca

SEQ ID NO: 2277425 - RNA, 17 nt, Human
cccagauuggcucacac

SEQ ID NO: 2277426 - RNA, 14 nt, Human
cccagaggccucuc

SEQ ID NO: 2277427 - RNA, 19 nt, Human
cccagauuggcucacacug

SEQ ID NO: 2277428 - RNA, 20 nt, Human
cccagauuggcucacacuga

SEQ ID NO: 2277429 - RNA, 21 nt, Human
cccagauuggcucacacugag

SEQ ID NO: 2277430 - RNA, 22 nt, Human
cccagauuggcucacacugaga

SEQ ID NO: 2277431 - RNA, 11 nt, Human
cccagagcugu

SEQ ID NO: 2277432 - RNA, 13 nt, Human
cccagagcuguuu

SEQ ID NO: 2277433 - RNA, 21 nt, Human
cccagagcuguggacuuuguu

SEQ ID NO: 2277434 - RNA, 17 nt, Human
cccagagcccagcucca

SEQ ID NO: 2277435 - RNA, 16 nt, Human
cccagagcccagcucc

SEQ ID NO: 2277436 - RNA, 15 nt, Human
cccagagcccagcuc

SEQ ID NO: 2277437 - RNA, 13 nt, Human
cccagagcccagc

SEQ ID NO: 2277438 - RNA, 12 nt, Human
cccagagcccag

SEQ ID NO: 2277439 - RNA, 15 nt, Human
cccagagcagggugu

SEQ ID NO: 2277440 - RNA, 21 nt, Human
cccagagcauuacgugagcca

SEQ ID NO: 2277441 - RNA, 22 nt, Human
cccagagcauuacgugagccag

SEQ ID NO: 2277442 - RNA, 22 nt, Human
cccagagcuguuuauggccuca

SEQ ID NO: 2277443 - RNA, 21 nt, Human
cccagagcuguuuauggccuc

SEQ ID NO: 2277444 - RNA, 23 nt, Human
cccagagcuguuuauggccucag

SEQ ID NO: 2277445 - RNA, 21 nt, Human
cccagaggaaggggccagagg

SEQ ID NO: 2277446 - RNA, 24 nt, Human
cccagaggaaggggccagaggcuc

SEQ ID NO: 2277447 - RNA, 23 nt, Human
cccagaggaaggggccagaggcu

SEQ ID NO: 2277448 - RNA, 22 nt, Human
cccagaggaaggggccagaggc

SEQ ID NO: 2277449 - RNA, 16 nt, Human
cccagaggauugcugc

SEQ ID NO: 2277450 - RNA, 15 nt, Human
cccagaggagggcag

SEQ ID NO: 2277451 - RNA, 23 nt, Human
cccagauugcaacaggcugggcu

SEQ ID NO: 2277452 - RNA, 18 nt, Human
cccaggaggccagccuug

SEQ ID NO: 2277453 - RNA, 20 nt, Human
cccagacucagacauuggca

SEQ ID NO: 2277454 - RNA, 16 nt, Human
cccagacucagacauu

SEQ ID NO: 2277455 - RNA, 13 nt, Human
cccagacucagac

SEQ ID NO: 2277456 - RNA, 12 nt, Human
cccagacucaga

SEQ ID NO: 2277457 - RNA, 21 nt, Human
cccagaccccucuggccagga

SEQ ID NO: 2277458 - RNA, 14 nt, Human
cccagaccugccuc

SEQ ID NO: 2277459 - RNA, 18 nt, Human
cccagaccugccucuucc

SEQ ID NO: 2277460 - RNA, 22 nt, Human
cccagaccuguuagcagacagg

SEQ ID NO: 2277461 - RNA, 21 nt, Human
cccagaccuguuagcagacag

SEQ ID NO: 2277462 - RNA, 21 nt, Human
cccagaccuuuuauccacuua

SEQ ID NO: 2277463 - RNA, 15 nt, Human
cccagacgaugucuu

SEQ ID NO: 2277464 - RNA, 17 nt, Human
cccagacgaugucuuca

SEQ ID NO: 2277465 - RNA, 21 nt, Human
cccagagaugggacugggagg

SEQ ID NO: 2277466 - RNA, 23 nt, Human
cccagagaugccuccaccgcugc

SEQ ID NO: 2277467 - RNA, 21 nt, Human
cccagagaugccuccaccgcu

SEQ ID NO: 2277468 - RNA, 20 nt, Human
cccagagaugggacugggag

SEQ ID NO: 2277469 - RNA, 12 nt, Human
cccagagcacug

SEQ ID NO: 2277470 - RNA, 14 nt, Human
cccagagcaggaag

SEQ ID NO: 2277471 - RNA, 16 nt, Human
cccagagcaggaagca

SEQ ID NO: 2277472 - RNA, 16 nt, Human
cccagagcaggaggcc

SEQ ID NO: 2277473 - RNA, 19 nt, Human
cccagagcaggaggccccu

SEQ ID NO: 2277474 - RNA, 21 nt, Human
cccagagcaggaggccccugg

SEQ ID NO: 2277475 - RNA, 23 nt, Human
cccagagcaggaggccccuggcc

SEQ ID NO: 2277476 - RNA, 14 nt, Human
cccagagcagggug

SEQ ID NO: 2277477 - RNA, 20 nt, Human
cccagagaugccuccaccgc

SEQ ID NO: 2277478 - RNA, 19 nt, Human
cccagagaugccuccaccg

SEQ ID NO: 2277479 - RNA, 18 nt, Human
cccagagaugccuccacc

SEQ ID NO: 2277480 - RNA, 17 nt, Human
cccagagaugccuccac

SEQ ID NO: 2277481 - RNA, 16 nt, Human
cccagagaugccucca

SEQ ID NO: 2277482 - RNA, 14 nt, Human
cccagagaugccuc

SEQ ID NO: 2277483 - RNA, 21 nt, Human
cccagagaggaaucagacuuc

SEQ ID NO: 2277484 - RNA, 19 nt, Human
cccagagaggaaucagacu

SEQ ID NO: 2277485 - RNA, 15 nt, Human
cccagagaggaauca

SEQ ID NO: 2277486 - RNA, 19 nt, Human
cccagacagacaucucugc

SEQ ID NO: 2277487 - RNA, 15 nt, Human
cccagacacagaaga

SEQ ID NO: 2277488 - RNA, 15 nt, Human
cccacgcccccacug

SEQ ID NO: 2277489 - RNA, 18 nt, Human
cccagaaugccuccugca

SEQ ID NO: 2277490 - RNA, 21 nt, Human
cccagacagcucccucugccu

SEQ ID NO: 2277491 - RNA, 20 nt, Human
cccagacagcucccucugcc

SEQ ID NO: 2277492 - RNA, 16 nt, Human
cccagacagcucccuc

SEQ ID NO: 2277493 - RNA, 14 nt, Human
cccagacagcuccc

SEQ ID NO: 2277494 - RNA, 13 nt, Human
cccagacagcucc

SEQ ID NO: 2277495 - RNA, 12 nt, Human
cccagacagcuc

SEQ ID NO: 2277496 - RNA, 20 nt, Human
cccagacagacaucucugca

SEQ ID NO: 2277497 - RNA, 23 nt, Human
cccagacagacaucucugcaccc

SEQ ID NO: 2277498 - RNA, 20 nt, Human
cccagaccccucuggccagg

SEQ ID NO: 2277499 - RNA, 19 nt, Human
cccagaccccucuggccag

SEQ ID NO: 2277500 - RNA, 18 nt, Human
cccagaccccucuggcca

SEQ ID NO: 2277501 - RNA, 14 nt, Human
cccagacccagugg

SEQ ID NO: 2277502 - RNA, 13 nt, Human
cccagacccagug

SEQ ID NO: 2277503 - RNA, 16 nt, Human
cccacgagggucagga

SEQ ID NO: 2277504 - RNA, 17 nt, Human
cccaccuggccaccuga

SEQ ID NO: 2277505 - RNA, 20 nt, Human
cccaccuggccaccugaggu

SEQ ID NO: 2277506 - RNA, 13 nt, Human
cccacgcccccac

SEQ ID NO: 2277507 - RNA, 14 nt, Human
cccacgcccccacu

SEQ ID NO: 2277508 - RNA, 17 nt, Human
ccauuccauuuaucuuu

SEQ ID NO: 2277509 - RNA, 14 nt, Human
ccauucccugccug

SEQ ID NO: 2277510 - RNA, 15 nt, Human
ccauucccugccugg

SEQ ID NO: 2277511 - RNA, 20 nt, Human
ccauucccugccuggggcgg

SEQ ID NO: 2277512 - RNA, 16 nt, Human
ccauuccucagggaca

SEQ ID NO: 2277513 - RNA, 13 nt, Human
ccauuccucaggg

SEQ ID NO: 2277514 - RNA, 12 nt, Human
ccauuccucagg

SEQ ID NO: 2277515 - RNA, 22 nt, Human
ccauuccucaccuuuucccggg

SEQ ID NO: 2277516 - RNA, 16 nt, Human
ccauuccugaagaacc

SEQ ID NO: 2277517 - RNA, 13 nt, Human
ccauuccugaaga

SEQ ID NO: 2277518 - RNA, 16 nt, Human
ccauuccagaauaucu

SEQ ID NO: 2277519 - RNA, 20 nt, Human
ccauucauuccauucuggaa

SEQ ID NO: 2277520 - RNA, 18 nt, Human
ccauucauuccauucugg

SEQ ID NO: 2277521 - RNA, 17 nt, Human
ccaugugguggcacagg

SEQ ID NO: 2277522 - RNA, 18 nt, Human
ccaugugguggcacaggc

SEQ ID NO: 2277523 - RNA, 18 nt, Human
ccauguuggccaggcugg

SEQ ID NO: 2277524 - RNA, 15 nt, Human
ccauguuggccaggc

SEQ ID NO: 2277525 - RNA, 19 nt, Human
ccauguuggccaggcuggu

SEQ ID NO: 2277526 - RNA, 21 nt, Human
ccauguuggccaggcuggucu

SEQ ID NO: 2277527 - RNA, 22 nt, Human
ccauuccuggaaaccacagucc

SEQ ID NO: 2277528 - RNA, 22 nt, Human
ccauuccugggaaauauucccu

SEQ ID NO: 2277529 - RNA, 17 nt, Human
ccauuccugguacccag

SEQ ID NO: 2277530 - RNA, 20 nt, Human
ccauuccugguacccagcca

SEQ ID NO: 2277531 - RNA, 21 nt, Human
ccauuccugguacccagccau

SEQ ID NO: 2277532 - RNA, 19 nt, Human
cccaccugcugagagaccc

SEQ ID NO: 2277533 - RNA, 13 nt, Human
cccaccugcugag

SEQ ID NO: 2277534 - RNA, 12 nt, Human
cccaccugcuga

SEQ ID NO: 2277535 - RNA, 12 nt, Human
cccaccuggcca

SEQ ID NO: 2277536 - RNA, 13 nt, Human
cccaccuggccac

SEQ ID NO: 2277537 - RNA, 15 nt, Human
cccaccuggccaccu

SEQ ID NO: 2277538 - RNA, 16 nt, Human
cccaccuggccaccug

SEQ ID NO: 2277539 - RNA, 12 nt, Human
cccaccuggccu

SEQ ID NO: 2277540 - RNA, 15 nt, Human
cccaccuggccucug

SEQ ID NO: 2277541 - RNA, 16 nt, Human
cccaccuuggcugcag

SEQ ID NO: 2277542 - RNA, 17 nt, Human
cccaccuuggcugcagg

SEQ ID NO: 2277543 - RNA, 19 nt, Human
cccaccuuggcugcaggga

SEQ ID NO: 2277544 - RNA, 20 nt, Human
cccaccuuggcugcagggag

SEQ ID NO: 2277545 - RNA, 14 nt, Human
ccaugcgcccccuc

SEQ ID NO: 2277546 - RNA, 20 nt, Human
ccaugcgcccccuccgcccu

SEQ ID NO: 2277547 - RNA, 13 nt, Human
ccaugcuccuggc

SEQ ID NO: 2277548 - RNA, 18 nt, Human
ccaugccuguccagccug

SEQ ID NO: 2277549 - RNA, 19 nt, Human
ccaugccuguccagccugg

SEQ ID NO: 2277550 - RNA, 17 nt, Human
ccaugccuguccagccu

SEQ ID NO: 2277551 - RNA, 14 nt, Human
ccaugccuguccag

SEQ ID NO: 2277552 - RNA, 13 nt, Human
ccaugccugucca

SEQ ID NO: 2277553 - RNA, 17 nt, Human
ccaugccugagggugga

SEQ ID NO: 2277554 - RNA, 18 nt, Human
ccaugccugaggguggag

SEQ ID NO: 2277555 - RNA, 22 nt, Human
ccaugaaaaugcaacaacaugu

SEQ ID NO: 2277556 - RNA, 23 nt, Human
ccaugaaaacguuuuauuguguu

SEQ ID NO: 2277557 - RNA, 21 nt, Human
ccaugaaaacguuuuauugug

SEQ ID NO: 2277558 - RNA, 20 nt, Human
ccaugaaaacguuuuauugu

SEQ ID NO: 2277559 - RNA, 19 nt, Human
ccaugaaaacguuuuauug

SEQ ID NO: 2277560 - RNA, 21 nt, Human
ccaugaaaaaaaugaucccca

SEQ ID NO: 2277561 - RNA, 13 nt, Human
ccaugaaacaaag

SEQ ID NO: 2277562 - RNA, 12 nt, Human
ccaugaacacac

SEQ ID NO: 2277563 - RNA, 16 nt, Human
ccaugaacacacugug

SEQ ID NO: 2277564 - RNA, 17 nt, Human
ccaugaacacacugugu

SEQ ID NO: 2277565 - RNA, 21 nt, Human
ccaugaacacacuguguccug

SEQ ID NO: 2277566 - RNA, 22 nt, Human
ccaugaacacacuguguccugg

SEQ ID NO: 2277567 - RNA, 15 nt, Human
ccaugaaccaagacc

SEQ ID NO: 2277568 - RNA, 16 nt, Human
ccaugaacagaaaaca

SEQ ID NO: 2277569 - RNA, 22 nt, Human
ccaugaacagaaaacauucuga

SEQ ID NO: 2277570 - RNA, 12 nt, Human
ccaugccugagg

SEQ ID NO: 2277571 - RNA, 13 nt, Human
ccaugccugaggg

SEQ ID NO: 2277572 - RNA, 14 nt, Human
ccaugccugagggu

SEQ ID NO: 2277573 - RNA, 15 nt, Human
ccaugccugagggug

SEQ ID NO: 2277574 - RNA, 16 nt, Human
ccaugccugagggugg

SEQ ID NO: 2277575 - RNA, 18 nt, Human
ccaugcuccuggcccacu

SEQ ID NO: 2277576 - RNA, 15 nt, Human
ccaugcuccuggccc

SEQ ID NO: 2277577 - RNA, 15 nt, Human
ccaugcugcccugug

SEQ ID NO: 2277578 - RNA, 15 nt, Human
ccaugcugaggccug

SEQ ID NO: 2277579 - RNA, 22 nt, Human
ccaugccugccccccucaucuc

SEQ ID NO: 2277580 - RNA, 13 nt, Human
ccaugcugaaggg

SEQ ID NO: 2277581 - RNA, 16 nt, Human
ccaugcugaggccugg

SEQ ID NO: 2277582 - RNA, 17 nt, Human
ccaugcugaggccuggg

SEQ ID NO: 2277583 - RNA, 15 nt, Human
ccaugcuugggugua

SEQ ID NO: 2277584 - RNA, 21 nt, Human
ccaugcuuagucacugccugc

SEQ ID NO: 2277585 - RNA, 22 nt, Human
ccaugcuuagucacugccugca

SEQ ID NO: 2277586 - RNA, 18 nt, Human
ccaugcuuagucacugcc

SEQ ID NO: 2277587 - RNA, 19 nt, Human
ccaugcuuagucacugccu

SEQ ID NO: 2277588 - RNA, 20 nt, Human
ccaugcuuagucacugccug

SEQ ID NO: 2277589 - RNA, 14 nt, Human
ccaugcugccucca

SEQ ID NO: 2277590 - RNA, 16 nt, Human
ccaugcugaagggacc

SEQ ID NO: 2277591 - RNA, 16 nt, Human
ccaugcugcccuguga

SEQ ID NO: 2277592 - RNA, 17 nt, Human
ccaugcugcccugugag

SEQ ID NO: 2277593 - RNA, 23 nt, Human
ccauggcaccuucagacuuugcu

SEQ ID NO: 2277594 - RNA, 23 nt, Human
ccauggcacucuauguucuaaga

SEQ ID NO: 2277595 - RNA, 13 nt, Human
ccaugugccaggu

SEQ ID NO: 2277596 - RNA, 15 nt, Human
ccauggcccucauua

SEQ ID NO: 2277597 - RNA, 16 nt, Human
ccaugugccugaucca

SEQ ID NO: 2277598 - RNA, 21 nt, Human
ccaugugccugauccagccuc

SEQ ID NO: 2277599 - RNA, 13 nt, Human
ccauguuggccag

SEQ ID NO: 2277600 - RNA, 14 nt, Human
ccauguuggccagg

SEQ ID NO: 2277601 - RNA, 13 nt, Human
ccauggaggcaca

SEQ ID NO: 2277602 - RNA, 17 nt, Human
ccauggagccccagccc

SEQ ID NO: 2277603 - RNA, 18 nt, Human
ccauggagccccagcccc

SEQ ID NO: 2277604 - RNA, 19 nt, Human
ccauggagccccagccccc

SEQ ID NO: 2277605 - RNA, 20 nt, Human
ccauggagccccagcccccu

SEQ ID NO: 2277606 - RNA, 21 nt, Human
ccauggaggcacacagcugca

SEQ ID NO: 2277607 - RNA, 17 nt, Human
ccauggaggcacacagc

SEQ ID NO: 2277608 - RNA, 20 nt, Human
ccauggaggcacacagcugc

SEQ ID NO: 2277609 - RNA, 22 nt, Human
ccauggagccagcucccucuau

SEQ ID NO: 2277610 - RNA, 12 nt, Human
ccauggagcccc

SEQ ID NO: 2277611 - RNA, 13 nt, Human
ccauggagcccca

SEQ ID NO: 2277612 - RNA, 14 nt, Human
ccauggagccccag

SEQ ID NO: 2277613 - RNA, 15 nt, Human
ccauggagccccagc

SEQ ID NO: 2277614 - RNA, 16 nt, Human
ccauggagccccagcc

SEQ ID NO: 2277615 - RNA, 18 nt, Human
ccauggagccagcucccu

SEQ ID NO: 2277616 - RNA, 17 nt, Human
ccauggagccagcuccc

SEQ ID NO: 2277617 - RNA, 14 nt, Human
ccauggagccagcu

SEQ ID NO: 2277618 - RNA, 19 nt, Human
ccauggagagcuggagccu

SEQ ID NO: 2277619 - RNA, 22 nt, Human
ccauggagagcuggagccuggu

SEQ ID NO: 2277620 - RNA, 17 nt, Human
ccauggagacaagaagg

SEQ ID NO: 2277621 - RNA, 15 nt, Human
ccauggagagcugga

SEQ ID NO: 2277622 - RNA, 18 nt, Human
ccauggagagcuggagcc

SEQ ID NO: 2277623 - RNA, 21 nt, Human
ccauggacacuccagugccag

SEQ ID NO: 2277624 - RNA, 15 nt, Human
ccauggacaggcugg

SEQ ID NO: 2277625 - RNA, 14 nt, Human
ccauggacaggcug

SEQ ID NO: 2277626 - RNA, 18 nt, Human
ccauggaaugcuugaaaa

SEQ ID NO: 2277627 - RNA, 15 nt, Human
ccauggacacuccag

SEQ ID NO: 2277628 - RNA, 17 nt, Human
ccauggacacuccagug

SEQ ID NO: 2277629 - RNA, 19 nt, Human
ccauggacacuccagugcc

SEQ ID NO: 2277630 - RNA, 12 nt, Human
ccauggaaccug

SEQ ID NO: 2277631 - RNA, 15 nt, Human
ccauggaaugcuuga

SEQ ID NO: 2277632 - RNA, 14 nt, Human
ccauggaaugcuug

SEQ ID NO: 2277633 - RNA, 14 nt, Human
ccauggacacucca

SEQ ID NO: 2277634 - RNA, 20 nt, Human
cccagagcuguuuauggccu

SEQ ID NO: 2277635 - RNA, 11 nt, Human
ccagccuggcc

SEQ ID NO: 2277636 - RNA, 10 nt, Human
ccagccuggc

SEQ ID NO: 2277637 - RNA, 12 nt, Human
ccagccuggcca

SEQ ID NO: 2277638 - RNA, 12 nt, Human
ccagccuggccc

SEQ ID NO: 2277639 - RNA, 13 nt, Human
ccagccuggccca

SEQ ID NO: 2277640 - RNA, 14 nt, Human
ccagccuggcccag

SEQ ID NO: 2277641 - RNA, 15 nt, Human
ccagccuggcccagc

SEQ ID NO: 2277642 - RNA, 12 nt, Human
ccagccugagca

SEQ ID NO: 2277643 - RNA, 11 nt, Human
ccagccugagc

SEQ ID NO: 2277644 - RNA, 19 nt, Human
ccagccucuguuccccuag

SEQ ID NO: 2277645 - RNA, 19 nt, Human
ccagccuggacccccagcu

SEQ ID NO: 2277646 - RNA, 18 nt, Human
ccagccuggacccccagc

SEQ ID NO: 2277647 - RNA, 20 nt, Human
ccagccuggagaugaaaucu

SEQ ID NO: 2277648 - RNA, 13 nt, Human
ccagccuggagau

SEQ ID NO: 2277649 - RNA, 12 nt, Human
ccagcucucagc

SEQ ID NO: 2277650 - RNA, 20 nt, Human
ccagccuggcccagcucccc

SEQ ID NO: 2277651 - RNA, 16 nt, Human
ccagccuggcccagcu

SEQ ID NO: 2277652 - RNA, 17 nt, Human
ccagccuggcccagcuc

SEQ ID NO: 2277653 - RNA, 18 nt, Human
ccagccuggcccagcucc

SEQ ID NO: 2277654 - RNA, 19 nt, Human
ccagccuggcccagcuccc

SEQ ID NO: 2277655 - RNA, 16 nt, Human
ccagcucucccucugg

SEQ ID NO: 2277656 - RNA, 14 nt, Human
ccagcucucccucu

SEQ ID NO: 2277657 - RNA, 15 nt, Human
ccagcucucagccaa

SEQ ID NO: 2277658 - RNA, 14 nt, Human
ccagcucucagcca

SEQ ID NO: 2277659 - RNA, 13 nt, Human
ccagcucucagcc

SEQ ID NO: 2277660 - RNA, 21 nt, Human
ccagcucucccucuggcccug

SEQ ID NO: 2277661 - RNA, 20 nt, Human
ccagcucucccucuggcccu

SEQ ID NO: 2277662 - RNA, 18 nt, Human
ccagcucucccucuggcc

SEQ ID NO: 2277663 - RNA, 17 nt, Human
ccagcucucccucuggc

SEQ ID NO: 2277664 - RNA, 23 nt, Human
ccagcucucccucuggcccugcc

SEQ ID NO: 2277665 - RNA, 22 nt, Human
ccagcucucccucuggcccugc

SEQ ID NO: 2277666 - RNA, 15 nt, Human
ccagcucugaaacca

SEQ ID NO: 2277667 - RNA, 22 nt, Human
ccagcugacccugguucucucu

SEQ ID NO: 2277668 - RNA, 20 nt, Human
ccagcugagcgccaggaugg

SEQ ID NO: 2277669 - RNA, 17 nt, Human
ccagcugagcgccagga

SEQ ID NO: 2277670 - RNA, 15 nt, Human
ccagcugagcgccag

SEQ ID NO: 2277671 - RNA, 23 nt, Human
ccagcugacaguccucuccaccu

SEQ ID NO: 2277672 - RNA, 15 nt, Human
ccagcugacaguccu

SEQ ID NO: 2277673 - RNA, 20 nt, Human
ccagcugacaguccucucca

SEQ ID NO: 2277674 - RNA, 21 nt, Human
ccagcugacaguccucuccac

SEQ ID NO: 2277675 - RNA, 22 nt, Human
ccagcugacaguccucuccacc

SEQ ID NO: 2277676 - RNA, 21 nt, Human
ccagcucugaaaccaguguua

SEQ ID NO: 2277677 - RNA, 20 nt, Human
ccagcucugaaaccaguguu

SEQ ID NO: 2277678 - RNA, 21 nt, Human
ccagcucuguaucaggaccca

SEQ ID NO: 2277679 - RNA, 18 nt, Human
ccagcucuguaucaggac

SEQ ID NO: 2277680 - RNA, 14 nt, Human
ccagcucuguauca

SEQ ID NO: 2277681 - RNA, 14 nt, Human
ccagcucuggaggg

SEQ ID NO: 2277682 - RNA, 21 nt, Human
ccagcugaaauacugaggggu

SEQ ID NO: 2277683 - RNA, 17 nt, Human
ccagcucuuuccuccuu

SEQ ID NO: 2277684 - RNA, 16 nt, Human
ccagcucuuuccuccu

SEQ ID NO: 2277685 - RNA, 14 nt, Human
ccagcucuuuccuc

SEQ ID NO: 2277686 - RNA, 19 nt, Human
ccagcucuucuccccaggu

SEQ ID NO: 2277687 - RNA, 23 nt, Human
ccagcugcaccugccagccuggc

SEQ ID NO: 2277688 - RNA, 22 nt, Human
ccagcugcaccugccagccugg

SEQ ID NO: 2277689 - RNA, 20 nt, Human
ccagcugcaccugccagccu

SEQ ID NO: 2277690 - RNA, 19 nt, Human
ccagcugcaccugccagcc

SEQ ID NO: 2277691 - RNA, 18 nt, Human
ccagcugcaccugccagc

SEQ ID NO: 2277692 - RNA, 17 nt, Human
ccagcugcaccugccag

SEQ ID NO: 2277693 - RNA, 13 nt, Human
ccagcugcuuggg

SEQ ID NO: 2277694 - RNA, 15 nt, Human
ccagcugcuugggcu

SEQ ID NO: 2277695 - RNA, 20 nt, Human
ccagcuggccgggagccuga

SEQ ID NO: 2277696 - RNA, 14 nt, Human
ccagcuggccggga

SEQ ID NO: 2277697 - RNA, 12 nt, Human
ccagcuggccgg

SEQ ID NO: 2277698 - RNA, 13 nt, Human
ccagcugcacuga

SEQ ID NO: 2277699 - RNA, 19 nt, Human
ccagcuggcccgugacaga

SEQ ID NO: 2277700 - RNA, 16 nt, Human
ccagcugcuugggcuu

SEQ ID NO: 2277701 - RNA, 18 nt, Human
ccagcugcuugggcuuca

SEQ ID NO: 2277702 - RNA, 22 nt, Human
ccagcugggaggcaagaggggu

SEQ ID NO: 2277703 - RNA, 11 nt, Human
ccagcugggcu

SEQ ID NO: 2277704 - RNA, 12 nt, Human
ccagcugggcuc

SEQ ID NO: 2277705 - RNA, 14 nt, Human
ccagcugggaggca

SEQ ID NO: 2277706 - RNA, 16 nt, Human
ccagcugggaggcaag

SEQ ID NO: 2277707 - RNA, 19 nt, Human
ccagcugggaggcaagagg

SEQ ID NO: 2277708 - RNA, 21 nt, Human
ccagcugggaggcaagagggg

SEQ ID NO: 2277709 - RNA, 12 nt, Human
ccagcugggagg

SEQ ID NO: 2277710 - RNA, 16 nt, Human
ccagcuggguuggaaa

SEQ ID NO: 2277711 - RNA, 17 nt, Human
ccagcuggguuggaaaa

SEQ ID NO: 2277712 - RNA, 17 nt, Human
ccagcugggucaggcag

SEQ ID NO: 2277713 - RNA, 16 nt, Human
ccagcugggucaggca

SEQ ID NO: 2277714 - RNA, 14 nt, Human
ccagcugggcucug

SEQ ID NO: 2277715 - RNA, 15 nt, Human
ccagcugggcucugc

SEQ ID NO: 2277716 - RNA, 21 nt, Human
ccagcuggggcguggggaggg

SEQ ID NO: 2277717 - RNA, 14 nt, Human
ccagcugugagccu

SEQ ID NO: 2277718 - RNA, 18 nt, Human
ccagcugggucaggcagg

SEQ ID NO: 2277719 - RNA, 22 nt, Human
ccagcuggggcguggggagggc

SEQ ID NO: 2277720 - RNA, 21 nt, Human
ccagcuggugagugaugcggc

SEQ ID NO: 2277721 - RNA, 18 nt, Human
ccagcugugcucuggaca

SEQ ID NO: 2277722 - RNA, 20 nt, Human
ccagcugugcucuggacagg

SEQ ID NO: 2277723 - RNA, 21 nt, Human
ccagcugugcucuggacaggc

SEQ ID NO: 2277724 - RNA, 21 nt, Human
ccagccucucuugguuuccuu

SEQ ID NO: 2277725 - RNA, 15 nt, Human
ccagccucuccccug

SEQ ID NO: 2277726 - RNA, 22 nt, Human
ccagccucuccccugauuacac

SEQ ID NO: 2277727 - RNA, 17 nt, Human
ccagccucuagggaccc

SEQ ID NO: 2277728 - RNA, 20 nt, Human
ccagccucuagggaccccuc

SEQ ID NO: 2277729 - RNA, 13 nt, Human
ccagccucucccc

SEQ ID NO: 2277730 - RNA, 14 nt, Human
ccagccucuccccu

SEQ ID NO: 2277731 - RNA, 24 nt, Human
ccagccucugagccccugggacug

SEQ ID NO: 2277732 - RNA, 21 nt, Human
ccagccucugagccccuggga

SEQ ID NO: 2277733 - RNA, 19 nt, Human
ccagccucugagccccugg

SEQ ID NO: 2277734 - RNA, 22 nt, Human
ccagccucucuugguuuccuuc

SEQ ID NO: 2277735 - RNA, 15 nt, Human
ccagccucuggcauu

SEQ ID NO: 2277736 - RNA, 11 nt, Human
ccagccucugu

SEQ ID NO: 2277737 - RNA, 15 nt, Human
ccagccucuguuccc

SEQ ID NO: 2277738 - RNA, 16 nt, Human
ccagccucgucuucau

SEQ ID NO: 2277739 - RNA, 15 nt, Human
ccagccucuagggac

SEQ ID NO: 2277740 - RNA, 23 nt, Human
ccagccuccucuggacggcaggc

SEQ ID NO: 2277741 - RNA, 16 nt, Human
ccacacacacagaaaa

SEQ ID NO: 2277742 - RNA, 15 nt, Human
ccacacacacagaaa

SEQ ID NO: 2277743 - RNA, 14 nt, Human
ccacacacacagaa

SEQ ID NO: 2277744 - RNA, 13 nt, Human
ccacacacacaga

SEQ ID NO: 2277745 - RNA, 19 nt, Human
ccaggagaaccacuacaug

SEQ ID NO: 2277746 - RNA, 21 nt, Human
ccaggacuuauuuaaacucug

SEQ ID NO: 2277747 - RNA, 14 nt, Human
ccaggacugggcca

SEQ ID NO: 2277748 - RNA, 17 nt, Human
ccaggacugggccacuu

SEQ ID NO: 2277749 - RNA, 12 nt, Human
ccaggacugggc

SEQ ID NO: 2277750 - RNA, 13 nt, Human
ccaggacugggcc

SEQ ID NO: 2277751 - RNA, 14 nt, Human
ccaggacugagccc

SEQ ID NO: 2277752 - RNA, 15 nt, Human
ccaggacugagcccc

SEQ ID NO: 2277753 - RNA, 16 nt, Human
ccaggacugagccccg

SEQ ID NO: 2277754 - RNA, 19 nt, Human
ccaggacugagccccgcag

SEQ ID NO: 2277755 - RNA, 19 nt, Human
ccaggacggggccggccag

SEQ ID NO: 2277756 - RNA, 16 nt, Human
ccaggacggggccggc

SEQ ID NO: 2277757 - RNA, 18 nt, Human
ccaggacggggccggcca

SEQ ID NO: 2277758 - RNA, 19 nt, Human
ccaggacgcuucugaaugc

SEQ ID NO: 2277759 - RNA, 20 nt, Human
ccaggacgcuucugaaugcu

SEQ ID NO: 2277760 - RNA, 22 nt, Human
ccaggacgcuucugaaugcugc

SEQ ID NO: 2277761 - RNA, 23 nt, Human
ccaggacgcuucugaaugcugcu

SEQ ID NO: 2277762 - RNA, 13 nt, Human
ccaggacugagcc

SEQ ID NO: 2277763 - RNA, 23 nt, Human
ccaggagaaccacuacaugcagc

SEQ ID NO: 2277764 - RNA, 21 nt, Human
ccaggagaaccacuacaugca

SEQ ID NO: 2277765 - RNA, 12 nt, Human
ccaggagaacug

SEQ ID NO: 2277766 - RNA, 19 nt, Human
ccaggagcaaauguuucug

SEQ ID NO: 2277767 - RNA, 23 nt, Human
ccaggagcaaauguuucugcagu

SEQ ID NO: 2277768 - RNA, 12 nt, Human
ccaggagcagcc

SEQ ID NO: 2277769 - RNA, 13 nt, Human
ccaggagcagcca

SEQ ID NO: 2277770 - RNA, 23 nt, Human
ccagcuguggguacagagagguc

SEQ ID NO: 2277771 - RNA, 22 nt, Human
ccagcuguggguacagagaggu

SEQ ID NO: 2277772 - RNA, 19 nt, Human
ccagcugugagccuuggcu

SEQ ID NO: 2277773 - RNA, 20 nt, Human
ccagcugugagccuuggcug

SEQ ID NO: 2277774 - RNA, 15 nt, Human
ccagcugugagccuu

SEQ ID NO: 2277775 - RNA, 16 nt, Human
ccagcugugagccuug

SEQ ID NO: 2277776 - RNA, 17 nt, Human
ccagcugugagccuugg

SEQ ID NO: 2277777 - RNA, 18 nt, Human
ccagcugugagccuuggc

SEQ ID NO: 2277778 - RNA, 22 nt, Human
ccagcugugcucuggacaggca

SEQ ID NO: 2277779 - RNA, 23 nt, Human
ccagcugugcucuggacaggcau

SEQ ID NO: 2277780 - RNA, 14 nt, Human
ccaggaagccagca

SEQ ID NO: 2277781 - RNA, 15 nt, Human
ccaggaagccagcag

SEQ ID NO: 2277782 - RNA, 17 nt, Human
ccaggaagccagcaggc

SEQ ID NO: 2277783 - RNA, 19 nt, Human
ccaggaagccagcaggcuc

SEQ ID NO: 2277784 - RNA, 23 nt, Human
ccaggacccugaaggggccauga

SEQ ID NO: 2277785 - RNA, 19 nt, Human
ccaggacccugaaggggcc

SEQ ID NO: 2277786 - RNA, 18 nt, Human
ccaggacccugaaggggc

SEQ ID NO: 2277787 - RNA, 17 nt, Human
ccaggaccuggcugcca

SEQ ID NO: 2277788 - RNA, 15 nt, Human
ccaggaccuggcugc

SEQ ID NO: 2277789 - RNA, 18 nt, Human
ccaggaccuggcugccau

SEQ ID NO: 2277790 - RNA, 15 nt, Human
ccaggacgcuucuga

SEQ ID NO: 2277791 - RNA, 16 nt, Human
ccaggacgcuucugaa

SEQ ID NO: 2277792 - RNA, 17 nt, Human
ccaggacgcuucugaau

SEQ ID NO: 2277793 - RNA, 18 nt, Human
ccaggacgcuucugaaug

SEQ ID NO: 2277794 - RNA, 16 nt, Human
ccaggaccagcucagg

SEQ ID NO: 2277795 - RNA, 15 nt, Human
ccaggaccagcucag

SEQ ID NO: 2277796 - RNA, 14 nt, Human
ccaggaccagcuca

SEQ ID NO: 2277797 - RNA, 13 nt, Human
ccaggaccagcuc

SEQ ID NO: 2277798 - RNA, 20 nt, Human
ccaggaccagcucaggacag

SEQ ID NO: 2277799 - RNA, 17 nt, Human
ccaggaccagcucagga

SEQ ID NO: 2277800 - RNA, 14 nt, Human
ccaggaccagcugg

SEQ ID NO: 2277801 - RNA, 15 nt, Human
ccaggaccagcuggg

SEQ ID NO: 2277802 - RNA, 16 nt, Human
ccaggaccagcugggg

SEQ ID NO: 2277803 - RNA, 16 nt, Human
ccaggacccugaaggg

SEQ ID NO: 2277804 - RNA, 14 nt, Human
ccaggacccugaag

SEQ ID NO: 2277805 - RNA, 15 nt, Human
ccaggaccaucaucc

SEQ ID NO: 2277806 - RNA, 18 nt, Human
ccaggaccagcuggggcg

SEQ ID NO: 2277807 - RNA, 23 nt, Human
ccaggaccagucaaccugggcaa

SEQ ID NO: 2277808 - RNA, 14 nt, Human
ccaggccagaggga

SEQ ID NO: 2277809 - RNA, 21 nt, Human
ccaggccagagggagugacag

SEQ ID NO: 2277810 - RNA, 14 nt, Human
ccaggagcagccac

SEQ ID NO: 2277811 - RNA, 21 nt, Human
ccaggccccugccacccuggg

SEQ ID NO: 2277812 - RNA, 23 nt, Human
ccaggccccugccacccugggga

SEQ ID NO: 2277813 - RNA, 19 nt, Human
ccaggccccugccacccug

SEQ ID NO: 2277814 - RNA, 11 nt, Human
ccaggccagcc

SEQ ID NO: 2277815 - RNA, 12 nt, Human
ccaggccagccu

SEQ ID NO: 2277816 - RNA, 13 nt, Human
ccaggccagccuc

SEQ ID NO: 2277817 - RNA, 14 nt, Human
ccaggccagccucc

SEQ ID NO: 2277818 - RNA, 15 nt, Human
ccaggccagccuccg

SEQ ID NO: 2277819 - RNA, 16 nt, Human
ccaggccagccuccga

SEQ ID NO: 2277820 - RNA, 19 nt, Human
ccaggccagccuccgagag

SEQ ID NO: 2277821 - RNA, 23 nt, Human
ccaggccagccuccgagagggag

SEQ ID NO: 2277822 - RNA, 20 nt, Human
ccaggcccggggcuggcggc

SEQ ID NO: 2277823 - RNA, 21 nt, Human
ccaggccucagucucccuucu

SEQ ID NO: 2277824 - RNA, 13 nt, Human
ccaggccuccuac

SEQ ID NO: 2277825 - RNA, 18 nt, Human
ccaggccuccuacagcuu

SEQ ID NO: 2277826 - RNA, 19 nt, Human
ccaggccuccuacagcuug

SEQ ID NO: 2277827 - RNA, 16 nt, Human
ccaggcccggggcugg

SEQ ID NO: 2277828 - RNA, 20 nt, Human
ccaggccagccuccgagagg

SEQ ID NO: 2277829 - RNA, 15 nt, Human
ccaggcccggggcug

SEQ ID NO: 2277830 - RNA, 16 nt, Human
ccaggcccucugccca

SEQ ID NO: 2277831 - RNA, 17 nt, Human
ccaggcccucugcccac

SEQ ID NO: 2277832 - RNA, 18 nt, Human
ccaggcccucugcccacu

SEQ ID NO: 2277833 - RNA, 19 nt, Human
ccaggcccucugcccacuc

SEQ ID NO: 2277834 - RNA, 14 nt, Human
ccagggagaagcuc

SEQ ID NO: 2277835 - RNA, 13 nt, Human
ccagggagaagcu

SEQ ID NO: 2277836 - RNA, 15 nt, Human
ccagggagaagcucc

SEQ ID NO: 2277837 - RNA, 21 nt, Human
ccagggagacagagcucacaa

SEQ ID NO: 2277838 - RNA, 23 nt, Human
ccagggacagaggggguggccuc

SEQ ID NO: 2277839 - RNA, 22 nt, Human
ccagggacagaggccccagccu

SEQ ID NO: 2277840 - RNA, 21 nt, Human
ccagggacagaggccccagcc

SEQ ID NO: 2277841 - RNA, 23 nt, Human
ccagggacagaggccccagccuc

SEQ ID NO: 2277842 - RNA, 20 nt, Human
ccagggacagaggccccagc

SEQ ID NO: 2277843 - RNA, 18 nt, Human
ccagggacagaggcccca

SEQ ID NO: 2277844 - RNA, 13 nt, Human
ccagggacagagg

SEQ ID NO: 2277845 - RNA, 23 nt, Human
ccagggacaccagccaggcucug

SEQ ID NO: 2277846 - RNA, 16 nt, Human
ccagggaaguccccga

SEQ ID NO: 2277847 - RNA, 17 nt, Human
ccagggaagugcucuga

SEQ ID NO: 2277848 - RNA, 18 nt, Human
ccagggaagugcucugau

SEQ ID NO: 2277849 - RNA, 14 nt, Human
ccagggacaccagc

SEQ ID NO: 2277850 - RNA, 15 nt, Human
ccagggacaccagcc

SEQ ID NO: 2277851 - RNA, 16 nt, Human
ccagggacaccagcca

SEQ ID NO: 2277852 - RNA, 17 nt, Human
ccagggacaccagccag

SEQ ID NO: 2277853 - RNA, 18 nt, Human
ccagggacaccagccagg

SEQ ID NO: 2277854 - RNA, 20 nt, Human
ccagggacaccagccaggcu

SEQ ID NO: 2277855 - RNA, 21 nt, Human
ccagggacaccagccaggcuc

SEQ ID NO: 2277856 - RNA, 22 nt, Human
ccagggacaccagccaggcucu

SEQ ID NO: 2277857 - RNA, 13 nt, Human
ccagggagaccga

SEQ ID NO: 2277858 - RNA, 20 nt, Human
ccagugccuuaccuccugcc

SEQ ID NO: 2277859 - RNA, 19 nt, Human
ccagugccuuaccuccugc

SEQ ID NO: 2277860 - RNA, 18 nt, Human
ccagugccuuaccuccug

SEQ ID NO: 2277861 - RNA, 17 nt, Human
ccagugccuuaccuccu

SEQ ID NO: 2277862 - RNA, 23 nt, Human
ccagugccuuaccuccugcccag

SEQ ID NO: 2277863 - RNA, 15 nt, Human
ccagugcgauucugg

SEQ ID NO: 2277864 - RNA, 22 nt, Human
ccagugccuuaccuccugccca

SEQ ID NO: 2277865 - RNA, 21 nt, Human
ccagugccuuaccuccugccc

SEQ ID NO: 2277866 - RNA, 16 nt, Human
ccagugcgauucugga

SEQ ID NO: 2277867 - RNA, 14 nt, Human
ccagugcggcaggu

SEQ ID NO: 2277868 - RNA, 13 nt, Human
ccagugggaagau

SEQ ID NO: 2277869 - RNA, 21 nt, Human
ccaguggcugcugcccaggcc

SEQ ID NO: 2277870 - RNA, 17 nt, Human
ccaguggcuguucugga

SEQ ID NO: 2277871 - RNA, 11 nt, Human
ccagugggagg

SEQ ID NO: 2277872 - RNA, 14 nt, Human
ccagugggaggcgc

SEQ ID NO: 2277873 - RNA, 12 nt, Human
ccagugggaggg

SEQ ID NO: 2277874 - RNA, 13 nt, Human
ccagugggagggg

SEQ ID NO: 2277875 - RNA, 19 nt, Human
ccaguggcugcugcccagg

SEQ ID NO: 2277876 - RNA, 15 nt, Human
ccagugcggcagguu

SEQ ID NO: 2277877 - RNA, 22 nt, Human
ccagugggaggggcaggcugac

SEQ ID NO: 2277878 - RNA, 23 nt, Human
ccagugggaggggcaggcugaca

SEQ ID NO: 2277879 - RNA, 14 nt, Human
ccagugggaggggc

SEQ ID NO: 2277880 - RNA, 15 nt, Human
ccagugggaggggca

SEQ ID NO: 2277881 - RNA, 16 nt, Human
ccagugggaggggcag

SEQ ID NO: 2277882 - RNA, 17 nt, Human
ccagugggaggggcagg

SEQ ID NO: 2277883 - RNA, 18 nt, Human
ccagugggaggggcaggc

SEQ ID NO: 2277884 - RNA, 19 nt, Human
ccagugggaggggcaggcu

SEQ ID NO: 2277885 - RNA, 20 nt, Human
ccagugggaggggcaggcug

SEQ ID NO: 2277886 - RNA, 21 nt, Human
ccagugggaggggcaggcuga

SEQ ID NO: 2277887 - RNA, 18 nt, Human
ccaggccuuaucuccaag

SEQ ID NO: 2277888 - RNA, 22 nt, Human
ccaggcgagagacuuguggccu

SEQ ID NO: 2277889 - RNA, 20 nt, Human
ccaggccugggucugugucu

SEQ ID NO: 2277890 - RNA, 19 nt, Human
ccaggccugggucuguguc

SEQ ID NO: 2277891 - RNA, 18 nt, Human
ccaggccugggucugugu

SEQ ID NO: 2277892 - RNA, 17 nt, Human
ccaggccugggucugug

SEQ ID NO: 2277893 - RNA, 16 nt, Human
ccaggccugggucugu

SEQ ID NO: 2277894 - RNA, 13 nt, Human
ccaggccugggcc

SEQ ID NO: 2277895 - RNA, 17 nt, Human
ccaggccugggccagag

SEQ ID NO: 2277896 - RNA, 16 nt, Human
ccaggccucuuggcag

SEQ ID NO: 2277897 - RNA, 18 nt, Human
ccaggccucuuggcaguc

SEQ ID NO: 2277898 - RNA, 19 nt, Human
ccaggccucuuggcaguca

SEQ ID NO: 2277899 - RNA, 13 nt, Human
ccaggccucugug

SEQ ID NO: 2277900 - RNA, 15 nt, Human
ccaggccucuguguc

SEQ ID NO: 2277901 - RNA, 16 nt, Human
ccaggccucugugucc

SEQ ID NO: 2277902 - RNA, 17 nt, Human
ccaggccucuguguccu

SEQ ID NO: 2277903 - RNA, 18 nt, Human
ccaggccucuguguccuu

SEQ ID NO: 2277904 - RNA, 12 nt, Human
ccaggccugccu

SEQ ID NO: 2277905 - RNA, 19 nt, Human
ccaggccugaaagaggcug

SEQ ID NO: 2277906 - RNA, 17 nt, Human
ccaucauuauaaacgug

SEQ ID NO: 2277907 - RNA, 16 nt, Human
ccauccugaggcucca

SEQ ID NO: 2277908 - RNA, 21 nt, Human
ccauccucuguacagagccca

SEQ ID NO: 2277909 - RNA, 15 nt, Human
ccauccugaggcucc

SEQ ID NO: 2277910 - RNA, 18 nt, Human
ccaucacuggagcaccag

SEQ ID NO: 2277911 - RNA, 14 nt, Human
ccaucacuggagca

SEQ ID NO: 2277912 - RNA, 18 nt, Human
ccaucagaaacacccuca

SEQ ID NO: 2277913 - RNA, 20 nt, Human
ccaucauguuuacagaggac

SEQ ID NO: 2277914 - RNA, 22 nt, Human
ccaucauguuuacagaggacag

SEQ ID NO: 2277915 - RNA, 20 nt, Human
ccaucagaaacacccucaca

SEQ ID NO: 2277916 - RNA, 14 nt, Human
ccaucaugucuggc

SEQ ID NO: 2277917 - RNA, 16 nt, Human
ccaucaugucuggcua

SEQ ID NO: 2277918 - RNA, 18 nt, Human
ccaucuuugcagguugcu

SEQ ID NO: 2277919 - RNA, 22 nt, Human
ccaucuccaagaaugcugaaac

SEQ ID NO: 2277920 - RNA, 14 nt, Human
ccaucuugguaaau

SEQ ID NO: 2277921 - RNA, 17 nt, Human
ccaucuugguaaauuuc

SEQ ID NO: 2277922 - RNA, 20 nt, Human
ccaucucauguaucaucugg

SEQ ID NO: 2277923 - RNA, 16 nt, Human
ccaucuccaagaaugc

SEQ ID NO: 2277924 - RNA, 18 nt, Human
ccaucuccaagaaugcug

SEQ ID NO: 2277925 - RNA, 19 nt, Human
ccaucuccaagaaugcuga

SEQ ID NO: 2277926 - RNA, 21 nt, Human
ccaucuccaagaaugcugaaa

SEQ ID NO: 2277927 - RNA, 18 nt, Human
ccaucuccacccccagcu

SEQ ID NO: 2277928 - RNA, 21 nt, Human
ccaucucaggccaccugcccc

SEQ ID NO: 2277929 - RNA, 20 nt, Human
ccaucucaggccaccugccc

SEQ ID NO: 2277930 - RNA, 18 nt, Human
ccaucucaggccaccugc

SEQ ID NO: 2277931 - RNA, 17 nt, Human
ccaucucaggccaccug

SEQ ID NO: 2277932 - RNA, 16 nt, Human
ccaucucaggccaccu

SEQ ID NO: 2277933 - RNA, 23 nt, Human
ccaucucaggccaccugcccccu

SEQ ID NO: 2277934 - RNA, 22 nt, Human
ccaucucaggccaccugccccc

SEQ ID NO: 2277935 - RNA, 21 nt, Human
ccaucucaugccccuggcugg

SEQ ID NO: 2277936 - RNA, 20 nt, Human
ccaucucaugccccuggcug

SEQ ID NO: 2277937 - RNA, 20 nt, Human
ccauccuucccugucugcca

SEQ ID NO: 2277938 - RNA, 20 nt, Human
ccauccuuucugccucucaa

SEQ ID NO: 2277939 - RNA, 16 nt, Human
ccauccuuucugccuc

SEQ ID NO: 2277940 - RNA, 17 nt, Human
ccauccuuucugccucu

SEQ ID NO: 2277941 - RNA, 14 nt, Human
ccauccuggcccau

SEQ ID NO: 2277942 - RNA, 16 nt, Human
ccauccuggcccauca

SEQ ID NO: 2277943 - RNA, 17 nt, Human
ccauccuggcccaucag

SEQ ID NO: 2277944 - RNA, 14 nt, Human
ccauccugucccac

SEQ ID NO: 2277945 - RNA, 16 nt, Human
ccauccugucccacca

SEQ ID NO: 2277946 - RNA, 17 nt, Human
ccauccugucccaccau

SEQ ID NO: 2277947 - RNA, 22 nt, Human
ccaucgccgggacuccagaacc

SEQ ID NO: 2277948 - RNA, 14 nt, Human
ccaucgcugugugu

SEQ ID NO: 2277949 - RNA, 12 nt, Human
ccaucgccggga

SEQ ID NO: 2277950 - RNA, 16 nt, Human
ccaucgcugucaucuc

SEQ ID NO: 2277951 - RNA, 22 nt, Human
ccauauucagugcuguggccug

SEQ ID NO: 2277952 - RNA, 12 nt, Human
ccauauuuauuc

SEQ ID NO: 2277953 - RNA, 15 nt, Human
ccaucaaaaauauuc

SEQ ID NO: 2277954 - RNA, 17 nt, Human
ccaucaacaaaaauugu

SEQ ID NO: 2277955 - RNA, 19 nt, Human
ccaucaaaaugcuuuuuau

SEQ ID NO: 2277956 - RNA, 16 nt, Human
ccaucaaaaugcuuuu

SEQ ID NO: 2277957 - RNA, 18 nt, Human
ccaucaacaaaaauuguc

SEQ ID NO: 2277958 - RNA, 12 nt, Human
ccaucacccgcu

SEQ ID NO: 2277959 - RNA, 16 nt, Human
ccaucacgccugugca

SEQ ID NO: 2277960 - RNA, 19 nt, Human
ccaucacgcggccgagaca

SEQ ID NO: 2277961 - RNA, 21 nt, Human
ccauagcaagauugcuuaaaa

SEQ ID NO: 2277962 - RNA, 18 nt, Human
ccauagcaagauugcuua

SEQ ID NO: 2277963 - RNA, 16 nt, Human
ccauagaguuuaacac

SEQ ID NO: 2277964 - RNA, 17 nt, Human
ccauagaguuuaacaca

SEQ ID NO: 2277965 - RNA, 17 nt, Human
ccaguggucucacaugg

SEQ ID NO: 2277966 - RNA, 13 nt, Human
ccauagaguuuaa

SEQ ID NO: 2277967 - RNA, 15 nt, Human
ccagugguauccugu

SEQ ID NO: 2277968 - RNA, 13 nt, Human
ccaguggucucac

SEQ ID NO: 2277969 - RNA, 23 nt, Human
ccauagagagcaagacgcugugc

SEQ ID NO: 2277970 - RNA, 18 nt, Human
ccauagccaccccagaaa

SEQ ID NO: 2277971 - RNA, 21 nt, Human
ccauagaugggucuggcugag

SEQ ID NO: 2277972 - RNA, 15 nt, Human
ccauagcuccugcuc

SEQ ID NO: 2277973 - RNA, 19 nt, Human
ccauauuaccacagacaua

SEQ ID NO: 2277974 - RNA, 15 nt, Human
ccauauucuguuggc

SEQ ID NO: 2277975 - RNA, 18 nt, Human
ccauauucuguuggccag

SEQ ID NO: 2277976 - RNA, 16 nt, Human
ccauagcuccugcucc

SEQ ID NO: 2277977 - RNA, 23 nt, Human
ccauguuggccaggcuggucuca

SEQ ID NO: 2277978 - RNA, 16 nt, Human
ccaucgcuguguguua

SEQ ID NO: 2277979 - RNA, 21 nt, Human
caugcgcccccuccgcccugc

SEQ ID NO: 2277980 - RNA, 23 nt, Human
caugcgcccccuccgcccugcca

SEQ ID NO: 2277981 - RNA, 14 nt, Human
caugcgcucagggc

SEQ ID NO: 2277982 - RNA, 20 nt, Human
caugccuuccagcacccugc

SEQ ID NO: 2277983 - RNA, 21 nt, Human
caugccuuccagcacccugca

SEQ ID NO: 2277984 - RNA, 19 nt, Human
caugccuuccagcacccug

SEQ ID NO: 2277985 - RNA, 15 nt, Human
caugccuuccagcac

SEQ ID NO: 2277986 - RNA, 13 nt, Human
caugccuuccagc

SEQ ID NO: 2277987 - RNA, 23 nt, Human
caugccugugugacaucaguggc

SEQ ID NO: 2277988 - RNA, 14 nt, Human
caugccuggcuucg

SEQ ID NO: 2277989 - RNA, 21 nt, Human
caugccuguccagccugggca

SEQ ID NO: 2277990 - RNA, 23 nt, Human
caugccuguccagccugggcagc

SEQ ID NO: 2277991 - RNA, 20 nt, Human
caugccuguccagccugggc

SEQ ID NO: 2277992 - RNA, 18 nt, Human
caugccuguccagccugg

SEQ ID NO: 2277993 - RNA, 17 nt, Human
caugccuguccagccug

SEQ ID NO: 2277994 - RNA, 16 nt, Human
caugccuguccagccu

SEQ ID NO: 2277995 - RNA, 20 nt, Human
caugccugccccccucaucu

SEQ ID NO: 2277996 - RNA, 13 nt, Human
caugccuggcuuc

SEQ ID NO: 2277997 - RNA, 20 nt, Human
caugccugccccaaacaaau

SEQ ID NO: 2277998 - RNA, 16 nt, Human
caugccugagggugga

SEQ ID NO: 2277999 - RNA, 20 nt, Human
caugccugaggguggagacu

SEQ ID NO: 2278000 - RNA, 23 nt, Human
caugccuggauggggcugcaccg

SEQ ID NO: 2278001 - RNA, 18 nt, Human
caugccuggauggggcug

SEQ ID NO: 2278002 - RNA, 21 nt, Human
caugccuggauggggcugcac

SEQ ID NO: 2278003 - RNA, 17 nt, Human
caugcguguuucugacu

SEQ ID NO: 2278004 - RNA, 13 nt, Human
caugcgcacaagg

SEQ ID NO: 2278005 - RNA, 16 nt, Human
caugcguguuucugac

SEQ ID NO: 2278006 - RNA, 21 nt, Human
caugcgguagccagcacacag

SEQ ID NO: 2278007 - RNA, 19 nt, Human
caugcgguagccagcacac

SEQ ID NO: 2278008 - RNA, 17 nt, Human
caugcgguagccagcac

SEQ ID NO: 2278009 - RNA, 16 nt, Human
caugcgguagccagca

SEQ ID NO: 2278010 - RNA, 15 nt, Human
caugcgguagccagc

SEQ ID NO: 2278011 - RNA, 14 nt, Human
caugcgguagccag

SEQ ID NO: 2278012 - RNA, 13 nt, Human
caugcgguagcca

SEQ ID NO: 2278013 - RNA, 15 nt, Human
caugcgcucagggcc

SEQ ID NO: 2278014 - RNA, 22 nt, Human
caugcugucccuuacgugaguc

SEQ ID NO: 2278015 - RNA, 23 nt, Human
caugcugucuacacuaagagaga

SEQ ID NO: 2278016 - RNA, 22 nt, Human
caugcuaauauaaguuucuuug

SEQ ID NO: 2278017 - RNA, 15 nt, Human
cauggacagaagaag

SEQ ID NO: 2278018 - RNA, 21 nt, Human
cauggacagaagaaggcagca

SEQ ID NO: 2278019 - RNA, 14 nt, Human
cauggacacuccag

SEQ ID NO: 2278020 - RNA, 18 nt, Human
cauggacacuccagugcc

SEQ ID NO: 2278021 - RNA, 19 nt, Human
cauggacacuccagugcca

SEQ ID NO: 2278022 - RNA, 18 nt, Human
cauggacaggcuggcucc

SEQ ID NO: 2278023 - RNA, 16 nt, Human
cauggacaggcuggcu

SEQ ID NO: 2278024 - RNA, 15 nt, Human
cauggacaggcuggc

SEQ ID NO: 2278025 - RNA, 14 nt, Human
cauggacaggcugg

SEQ ID NO: 2278026 - RNA, 18 nt, Human
cauggacaugaucuucuu

SEQ ID NO: 2278027 - RNA, 12 nt, Human
cauggacuugua

SEQ ID NO: 2278028 - RNA, 13 nt, Human
cauggacuuguau

SEQ ID NO: 2278029 - RNA, 16 nt, Human
cauggacuuguauauu

SEQ ID NO: 2278030 - RNA, 22 nt, Human
cauggacuuguauauuuguaca

SEQ ID NO: 2278031 - RNA, 19 nt, Human
cauggaacucauuccugcc

SEQ ID NO: 2278032 - RNA, 17 nt, Human
cauggaacucauuccug

SEQ ID NO: 2278033 - RNA, 21 nt, Human
cauggaacucauuccugccug

SEQ ID NO: 2278034 - RNA, 13 nt, Human
cauggaagauuga

SEQ ID NO: 2278035 - RNA, 16 nt, Human
cauggaauaacaugua

SEQ ID NO: 2278036 - RNA, 12 nt, Human
cauggacacucc

SEQ ID NO: 2278037 - RNA, 21 nt, Human
cauggaaugguuauaaaagug

SEQ ID NO: 2278038 - RNA, 22 nt, Human
cauggaaugguuauaaaaguga

SEQ ID NO: 2278039 - RNA, 15 nt, Human
cauggaaugcuugaa

SEQ ID NO: 2278040 - RNA, 18 nt, Human
cauggaaugcuugaaaaa

SEQ ID NO: 2278041 - RNA, 21 nt, Human
cauggaaugcuugaaaaaugu

SEQ ID NO: 2278042 - RNA, 20 nt, Human
cauggaaugcuugaaaaaug

SEQ ID NO: 2278043 - RNA, 14 nt, Human
cauggaaugguuau

SEQ ID NO: 2278044 - RNA, 15 nt, Human
cauggaaugguuaua

SEQ ID NO: 2278045 - RNA, 17 nt, Human
cauggaaugguuauaaa

SEQ ID NO: 2278046 - RNA, 19 nt, Human
caugcugugauugugccua

SEQ ID NO: 2278047 - RNA, 16 nt, Human
caugcuguugauugcu

SEQ ID NO: 2278048 - RNA, 17 nt, Human
caugcuguugauugcua

SEQ ID NO: 2278049 - RNA, 18 nt, Human
caugcuguugauugcuaa

SEQ ID NO: 2278050 - RNA, 19 nt, Human
caugcuguugauugcuaaa

SEQ ID NO: 2278051 - RNA, 20 nt, Human
caugcuguugauugcuaaau

SEQ ID NO: 2278052 - RNA, 21 nt, Human
caugcuguugauugcuaaaug

SEQ ID NO: 2278053 - RNA, 22 nt, Human
caugcuguugauugcuaaaugu

SEQ ID NO: 2278054 - RNA, 23 nt, Human
caugcuguugauugcuaaaugua

SEQ ID NO: 2278055 - RNA, 15 nt, Human
caugcuuagucacug

SEQ ID NO: 2278056 - RNA, 16 nt, Human
caugcuuagucacugc

SEQ ID NO: 2278057 - RNA, 17 nt, Human
caugcuuagucacugcc

SEQ ID NO: 2278058 - RNA, 21 nt, Human
caugcuuagucacugccugca

SEQ ID NO: 2278059 - RNA, 18 nt, Human
caugcuuagucacugccu

SEQ ID NO: 2278060 - RNA, 19 nt, Human
caugcuuagucacugccug

SEQ ID NO: 2278061 - RNA, 16 nt, Human
cauggaacucauuccu

SEQ ID NO: 2278062 - RNA, 20 nt, Human
cauggaaguacuauaauuua

SEQ ID NO: 2278063 - RNA, 22 nt, Human
cauggaaguacuauaauuuacc

SEQ ID NO: 2278064 - RNA, 12 nt, Human
cauggauguuuu

SEQ ID NO: 2278065 - RNA, 19 nt, Human
cauggaugggggaacucag

SEQ ID NO: 2278066 - RNA, 22 nt, Human
cauggauguuuuagccauuguu

SEQ ID NO: 2278067 - RNA, 22 nt, Human
cauggcaccuucagacuuugcu

SEQ ID NO: 2278068 - RNA, 20 nt, Human
cauggcaccaaagccaccag

SEQ ID NO: 2278069 - RNA, 19 nt, Human
cauggcaccaaagccacca

SEQ ID NO: 2278070 - RNA, 18 nt, Human
caugggaaugaaugucag

SEQ ID NO: 2278071 - RNA, 13 nt, Human
cauggcagaaggc

SEQ ID NO: 2278072 - RNA, 16 nt, Human
cauggcacuugcaucu

SEQ ID NO: 2278073 - RNA, 18 nt, Human
cauggcacuugcaucugu

SEQ ID NO: 2278074 - RNA, 23 nt, Human
cauggcaccuucagacuuugcuu

SEQ ID NO: 2278075 - RNA, 17 nt, Human
cauggaguguguauugu

SEQ ID NO: 2278076 - RNA, 14 nt, Human
cauggaguguguau

SEQ ID NO: 2278077 - RNA, 22 nt, Human
cauggaguguguauuguuccca

SEQ ID NO: 2278078 - RNA, 20 nt, Human
cauggaguguguauuguucc

SEQ ID NO: 2278079 - RNA, 18 nt, Human
cauggaguguguauuguu

SEQ ID NO: 2278080 - RNA, 21 nt, Human
cauggaguguguauuguuccc

SEQ ID NO: 2278081 - RNA, 15 nt, Human
cauggaugagagucc

SEQ ID NO: 2278082 - RNA, 18 nt, Human
cauggauauaguuuuacu

SEQ ID NO: 2278083 - RNA, 16 nt, Human
cauggaguauauguca

SEQ ID NO: 2278084 - RNA, 20 nt, Human
cauggagagcuggagccugg

SEQ ID NO: 2278085 - RNA, 21 nt, Human
cauggagagcuggagccuggu

SEQ ID NO: 2278086 - RNA, 15 nt, Human
cauggagaagcagaa

SEQ ID NO: 2278087 - RNA, 12 nt, Human
cauggagaaguu

SEQ ID NO: 2278088 - RNA, 17 nt, Human
cauggagaaguuaucag

SEQ ID NO: 2278089 - RNA, 15 nt, Human
cauggagacuccugc

SEQ ID NO: 2278090 - RNA, 16 nt, Human
cauggagacuccugcc

SEQ ID NO: 2278091 - RNA, 19 nt, Human
cauggagacuccugcccug

SEQ ID NO: 2278092 - RNA, 20 nt, Human
cauggagacuccugcccugu

SEQ ID NO: 2278093 - RNA, 21 nt, Human
cauggagacuccugcccuguu

SEQ ID NO: 2278094 - RNA, 14 nt, Human
cauggagagcuaga

SEQ ID NO: 2278095 - RNA, 13 nt, Human
cauggagagcugg

SEQ ID NO: 2278096 - RNA, 14 nt, Human
cauggagagcugga

SEQ ID NO: 2278097 - RNA, 16 nt, Human
cauggagagcuggagc

SEQ ID NO: 2278098 - RNA, 17 nt, Human
cauggagagcuggagcc

SEQ ID NO: 2278099 - RNA, 17 nt, Human
cauggagguuugaagau

SEQ ID NO: 2278100 - RNA, 21 nt, Human
cauggagauagccccacagga

SEQ ID NO: 2278101 - RNA, 10 nt, Human
cauggagcca

SEQ ID NO: 2278102 - RNA, 20 nt, Human
cauggagaaacccugucucu

SEQ ID NO: 2278103 - RNA, 17 nt, Human
cauggagaaacccuguc

SEQ ID NO: 2278104 - RNA, 16 nt, Human
cauggagaaacccugu

SEQ ID NO: 2278105 - RNA, 15 nt, Human
cauggagaaacccug

SEQ ID NO: 2278106 - RNA, 14 nt, Human
cauggagaaacccu

SEQ ID NO: 2278107 - RNA, 11 nt, Human
cauggagaaac

SEQ ID NO: 2278108 - RNA, 17 nt, Human
cauggacuuguauauuu

SEQ ID NO: 2278109 - RNA, 11 nt, Human
cauggacuuug

SEQ ID NO: 2278110 - RNA, 13 nt, Human
cauggacuuuguu

SEQ ID NO: 2278111 - RNA, 16 nt, Human
cauggucagcccuagg

SEQ ID NO: 2278112 - RNA, 19 nt, Human
cauggucagcccuagggug

SEQ ID NO: 2278113 - RNA, 21 nt, Human
cauggucacacacugaugcuu

SEQ ID NO: 2278114 - RNA, 17 nt, Human
cauggucacacacugau

SEQ ID NO: 2278115 - RNA, 16 nt, Human
cauggggugggccucu

SEQ ID NO: 2278116 - RNA, 17 nt, Human
cauggggugggccucug

SEQ ID NO: 2278117 - RNA, 18 nt, Human
cauggggugggccucugg

SEQ ID NO: 2278118 - RNA, 19 nt, Human
cauggggugggccucuggu

SEQ ID NO: 2278119 - RNA, 19 nt, Human
caugggggcagggcaugac

SEQ ID NO: 2278120 - RNA, 14 nt, Human
caugggggcagggc

SEQ ID NO: 2278121 - RNA, 13 nt, Human
caugggggcaggg

SEQ ID NO: 2278122 - RNA, 15 nt, Human
caugggguaggagga

SEQ ID NO: 2278123 - RNA, 19 nt, Human
cauggggugaugcugggcu

SEQ ID NO: 2278124 - RNA, 13 nt, Human
cauggggugggcc

SEQ ID NO: 2278125 - RNA, 15 nt, Human
cauggggugggccuc

SEQ ID NO: 2278126 - RNA, 19 nt, Human
cauggcacuugcaucugug

SEQ ID NO: 2278127 - RNA, 11 nt, Human
cauggggaggg

SEQ ID NO: 2278128 - RNA, 20 nt, Human
cauggggagggauucugguu

SEQ ID NO: 2278129 - RNA, 19 nt, Human
cauggggcugauuguauuu

SEQ ID NO: 2278130 - RNA, 23 nt, Human
cauggggagggauucugguucca

SEQ ID NO: 2278131 - RNA, 17 nt, Human
cauggggcugggcagcu

SEQ ID NO: 2278132 - RNA, 16 nt, Human
caugggccuccugugu

SEQ ID NO: 2278133 - RNA, 17 nt, Human
caugggccuccugugug

SEQ ID NO: 2278134 - RNA, 22 nt, Human
cauggcagaauaaucuuugggu

SEQ ID NO: 2278135 - RNA, 21 nt, Human
cauggcagaauaaucuuuggg

SEQ ID NO: 2278136 - RNA, 17 nt, Human
caugggcccaggaaugc

SEQ ID NO: 2278137 - RNA, 15 nt, Human
caugggccuccugug

SEQ ID NO: 2278138 - RNA, 22 nt, Human
caugggaaugaaugucagugug

SEQ ID NO: 2278139 - RNA, 17 nt, Human
caugggacagggaggac

SEQ ID NO: 2278140 - RNA, 19 nt, Human
caugccucagcccugaccc

SEQ ID NO: 2278141 - RNA, 20 nt, Human
caugccucagcccugacccu

SEQ ID NO: 2278142 - RNA, 13 nt, Human
caugccuggaugg

SEQ ID NO: 2278143 - RNA, 11 nt, Human
caugccugagg

SEQ ID NO: 2278144 - RNA, 13 nt, Human
caugccugagggu

SEQ ID NO: 2278145 - RNA, 15 nt, Human
caugccugagggugg

SEQ ID NO: 2278146 - RNA, 16 nt, Human
caugccucucucaggc

SEQ ID NO: 2278147 - RNA, 17 nt, Human
caugccucucucaggcc

SEQ ID NO: 2278148 - RNA, 18 nt, Human
caugccucucucaggcca

SEQ ID NO: 2278149 - RNA, 19 nt, Human
caugccucucucaggccaa

SEQ ID NO: 2278150 - RNA, 11 nt, Human
caugccucagc

SEQ ID NO: 2278151 - RNA, 14 nt, Human
caugccucagcccu

SEQ ID NO: 2278152 - RNA, 16 nt, Human
caugccucagcccuga

SEQ ID NO: 2278153 - RNA, 14 nt, Human
caugccgggcgcag

SEQ ID NO: 2278154 - RNA, 23 nt, Human
caugcccugugcaaccucuuggc

SEQ ID NO: 2278155 - RNA, 20 nt, Human
caugcccuguucagcuacuc

SEQ ID NO: 2278156 - RNA, 14 nt, Human
caugccucucucag

SEQ ID NO: 2278157 - RNA, 15 nt, Human
caugccucucucagg

SEQ ID NO: 2278158 - RNA, 21 nt, Human
caugcccggcuaauuuuugua

SEQ ID NO: 2278159 - RNA, 16 nt, Human
caugccccuggcuggg

SEQ ID NO: 2278160 - RNA, 15 nt, Human
caugccccuggcugg

SEQ ID NO: 2278161 - RNA, 19 nt, Human
caugccccggccaccucug

SEQ ID NO: 2278162 - RNA, 20 nt, Human
caugccccggccaccucugc

SEQ ID NO: 2278163 - RNA, 21 nt, Human
caugccccggccaccucugcg

SEQ ID NO: 2278164 - RNA, 14 nt, Human
caugccccuggcug

SEQ ID NO: 2278165 - RNA, 19 nt, Human
caugcccugugcaaccucu

SEQ ID NO: 2278166 - RNA, 18 nt, Human
caugcccugugcaaccuc

SEQ ID NO: 2278167 - RNA, 14 nt, Human
caugcccugugcaa

SEQ ID NO: 2278168 - RNA, 17 nt, Human
caugcccuccucuccca

SEQ ID NO: 2278169 - RNA, 15 nt, Human
caugcccuccucucc

SEQ ID NO: 2278170 - RNA, 14 nt, Human
caugcccuccucuc

SEQ ID NO: 2278171 - RNA, 13 nt, Human
caugcccuccucu

SEQ ID NO: 2278172 - RNA, 20 nt, Human
caugcccuccucucccauug

SEQ ID NO: 2278173 - RNA, 15 nt, Human
caugcagcugcaccc

SEQ ID NO: 2278174 - RNA, 21 nt, Human
caugcagcugcacccucccuc

SEQ ID NO: 2278175 - RNA, 12 nt, Human
caugcauaaaua

SEQ ID NO: 2278176 - RNA, 20 nt, Human
caugcagcugcacccucccu

SEQ ID NO: 2278177 - RNA, 13 nt, Human
caugcauaaauau

SEQ ID NO: 2278178 - RNA, 15 nt, Human
caugcauaaauaugc

SEQ ID NO: 2278179 - RNA, 16 nt, Human
caugcauaaauaugca

SEQ ID NO: 2278180 - RNA, 17 nt, Human
caugcauaaauaugcag

SEQ ID NO: 2278181 - RNA, 18 nt, Human
caugcauaaauaugcagu

SEQ ID NO: 2278182 - RNA, 19 nt, Human
caugcauaaauaugcagug

SEQ ID NO: 2278183 - RNA, 14 nt, Human
caugcauacacaca

SEQ ID NO: 2278184 - RNA, 13 nt, Human
caugcauacacac

SEQ ID NO: 2278185 - RNA, 12 nt, Human
caugcauacaca

SEQ ID NO: 2278186 - RNA, 11 nt, Human
caugcauacac

SEQ ID NO: 2278187 - RNA, 22 nt, Human
caugcauaaauaugcagugaua

SEQ ID NO: 2278188 - RNA, 16 nt, Human
caugcauacuucaaaa

SEQ ID NO: 2278189 - RNA, 17 nt, Human
caugcauacuucaaaag

SEQ ID NO: 2278190 - RNA, 20 nt, Human
caugcauacuucaaaaguau

SEQ ID NO: 2278191 - RNA, 15 nt, Human
caugcauacuucaaa

SEQ ID NO: 2278192 - RNA, 23 nt, Human
caugcauacacacacacacacag

SEQ ID NO: 2278193 - RNA, 16 nt, Human
caugcauacacacaca

SEQ ID NO: 2278194 - RNA, 15 nt, Human
caugcauacacacac

SEQ ID NO: 2278195 - RNA, 14 nt, Human
caugcaucaaguua

SEQ ID NO: 2278196 - RNA, 16 nt, Human
caugcaucuccaccug

SEQ ID NO: 2278197 - RNA, 17 nt, Human
caugcaucuccaccugc

SEQ ID NO: 2278198 - RNA, 18 nt, Human
caugcaucuccaccugcu

SEQ ID NO: 2278199 - RNA, 15 nt, Human
caugcaucuccaccu

SEQ ID NO: 2278200 - RNA, 21 nt, Human
caugcauacuucaaaaguauu

SEQ ID NO: 2278201 - RNA, 17 nt, Human
caugcaucuuacugaag

SEQ ID NO: 2278202 - RNA, 16 nt, Human
caugcaucuuacugaa

SEQ ID NO: 2278203 - RNA, 14 nt, Human
caugcaucuuacug

SEQ ID NO: 2278204 - RNA, 15 nt, Human
caucuuguguuuuau

SEQ ID NO: 2278205 - RNA, 21 nt, Human
caugcccaccugcccaucaca

SEQ ID NO: 2278206 - RNA, 23 nt, Human
caugcccacccccugcccugcac

SEQ ID NO: 2278207 - RNA, 22 nt, Human
caugcccagucgauaucucacu

SEQ ID NO: 2278208 - RNA, 13 nt, Human
caugccccccuca

SEQ ID NO: 2278209 - RNA, 14 nt, Human
caugccccccucaa

SEQ ID NO: 2278210 - RNA, 19 nt, Human
caugccccccucaaaccuc

SEQ ID NO: 2278211 - RNA, 21 nt, Human
caugccccccucaaaccuccu

SEQ ID NO: 2278212 - RNA, 23 nt, Human
caugccccccucaaaccuccucu

SEQ ID NO: 2278213 - RNA, 15 nt, Human
caugcccccucgugc

SEQ ID NO: 2278214 - RNA, 13 nt, Human
caugccccugaac

SEQ ID NO: 2278215 - RNA, 16 nt, Human
caugcccccucgugcc

SEQ ID NO: 2278216 - RNA, 17 nt, Human
caugcccccucgugcca

SEQ ID NO: 2278217 - RNA, 19 nt, Human
caugcccccucgugccagu

SEQ ID NO: 2278218 - RNA, 15 nt, Human
caugcccccuuucag

SEQ ID NO: 2278219 - RNA, 16 nt, Human
caugccccggccaccu

SEQ ID NO: 2278220 - RNA, 17 nt, Human
caugccccggccaccuc

SEQ ID NO: 2278221 - RNA, 18 nt, Human
caugccccggccaccucu

SEQ ID NO: 2278222 - RNA, 17 nt, Human
caugcccaccugcccau

SEQ ID NO: 2278223 - RNA, 16 nt, Human
caugcccaccugccca

SEQ ID NO: 2278224 - RNA, 14 nt, Human
caugcccaccugcc

SEQ ID NO: 2278225 - RNA, 13 nt, Human
caugcccaccugc

SEQ ID NO: 2278226 - RNA, 15 nt, Human
caugcccacccccug

SEQ ID NO: 2278227 - RNA, 16 nt, Human
caugcccacccccugc

SEQ ID NO: 2278228 - RNA, 17 nt, Human
caugcccacccccugcc

SEQ ID NO: 2278229 - RNA, 18 nt, Human
caugcccacccccugccc

SEQ ID NO: 2278230 - RNA, 19 nt, Human
caugcccacccccugcccu

SEQ ID NO: 2278231 - RNA, 20 nt, Human
caugcccacccccugcccug

SEQ ID NO: 2278232 - RNA, 21 nt, Human
caugcccacccccugcccugc

SEQ ID NO: 2278233 - RNA, 22 nt, Human
caugcccacccccugcccugca

SEQ ID NO: 2278234 - RNA, 19 nt, Human
caugcauuuugcagcagug

SEQ ID NO: 2278235 - RNA, 17 nt, Human
caugccagugacacuuc

SEQ ID NO: 2278236 - RNA, 13 nt, Human
caugcccaccccc

SEQ ID NO: 2278237 - RNA, 20 nt, Human
caugcauuuugcagcaguga

SEQ ID NO: 2278238 - RNA, 22 nt, Human
caugcauuguugagguggucug

SEQ ID NO: 2278239 - RNA, 20 nt, Human
caugcauuguugaggugguc

SEQ ID NO: 2278240 - RNA, 17 nt, Human
caugcauuguugaggug

SEQ ID NO: 2278241 - RNA, 14 nt, Human
caugcauucauaca

SEQ ID NO: 2278242 - RNA, 11 nt, Human
caugcauuguu

SEQ ID NO: 2278243 - RNA, 20 nt, Human
caugcauuacugcaugcacu

SEQ ID NO: 2278244 - RNA, 17 nt, Human
caugcauuacugcaugc

SEQ ID NO: 2278245 - RNA, 15 nt, Human
caugcauuacugcau

SEQ ID NO: 2278246 - RNA, 17 nt, Human
caugcauggaaauuccc

SEQ ID NO: 2278247 - RNA, 16 nt, Human
caugcauguccuguaa

SEQ ID NO: 2278248 - RNA, 15 nt, Human
caugcauggaaauuc

SEQ ID NO: 2278249 - RNA, 21 nt, Human
caugcauguccuguaaagguu

SEQ ID NO: 2278250 - RNA, 14 nt, Human
caugcaugugcuug

SEQ ID NO: 2278251 - RNA, 18 nt, Human
caugcauguuaugcuuua

SEQ ID NO: 2278252 - RNA, 18 nt, Human
caugcauguccuguaaag

SEQ ID NO: 2278253 - RNA, 17 nt, Human
caugcauguccuguaaa

SEQ ID NO: 2278254 - RNA, 19 nt, Human
caugccacuacacuccagc

SEQ ID NO: 2278255 - RNA, 21 nt, Human
caugccaccauggccagccaa

SEQ ID NO: 2278256 - RNA, 21 nt, Human
caugccagcuacuuccuccuc

SEQ ID NO: 2278257 - RNA, 18 nt, Human
caugccaagcacugugcu

SEQ ID NO: 2278258 - RNA, 14 nt, Human
caugcauuuugcag

SEQ ID NO: 2278259 - RNA, 17 nt, Human
caugcauuugaggucaa

SEQ ID NO: 2278260 - RNA, 21 nt, Human
caugccacaaggacuuccugu

SEQ ID NO: 2278261 - RNA, 17 nt, Human
caugccacaaggacuuc

SEQ ID NO: 2278262 - RNA, 20 nt, Human
caugccagcuuaucucaggg

SEQ ID NO: 2278263 - RNA, 19 nt, Human
caugccagcuuaucucagg

SEQ ID NO: 2278264 - RNA, 17 nt, Human
caugugaaaaucaaaua

SEQ ID NO: 2278265 - RNA, 19 nt, Human
caugugaaaaucaaauaca

SEQ ID NO: 2278266 - RNA, 12 nt, Human
caugugaaaccu

SEQ ID NO: 2278267 - RNA, 13 nt, Human
caugugaaaccuu

SEQ ID NO: 2278268 - RNA, 14 nt, Human
caugugaaaccuuu

SEQ ID NO: 2278269 - RNA, 18 nt, Human
caugugaaaccuuuuuua

SEQ ID NO: 2278270 - RNA, 15 nt, Human
caugugaaaucauuc

SEQ ID NO: 2278271 - RNA, 16 nt, Human
caugugaaaucauuca

SEQ ID NO: 2278272 - RNA, 17 nt, Human
caugugaaaucauucau

SEQ ID NO: 2278273 - RNA, 14 nt, Human
caugucuuuucuug

SEQ ID NO: 2278274 - RNA, 19 nt, Human
caugucuuuucuugcauga

SEQ ID NO: 2278275 - RNA, 21 nt, Human
caugucuuuucuugcaugagg

SEQ ID NO: 2278276 - RNA, 23 nt, Human
caugucuuuucuugcaugaggcu

SEQ ID NO: 2278277 - RNA, 21 nt, Human
cauguaauuaaguacuaugua

SEQ ID NO: 2278278 - RNA, 18 nt, Human
cauguaauuaaguacuau

SEQ ID NO: 2278279 - RNA, 15 nt, Human
cauguacaaaaccau

SEQ ID NO: 2278280 - RNA, 14 nt, Human
cauguaaucaguuu

SEQ ID NO: 2278281 - RNA, 23 nt, Human
cauguacaaaaucgauuggcuuu

SEQ ID NO: 2278282 - RNA, 21 nt, Human
cauguacaaaaucgauuggcu

SEQ ID NO: 2278283 - RNA, 13 nt, Human
cauguacagagaa

SEQ ID NO: 2278284 - RNA, 22 nt, Human
cauguacagagaacuaacacua

SEQ ID NO: 2278285 - RNA, 10 nt, Human
cauguacagu

SEQ ID NO: 2278286 - RNA, 11 nt, Human
cauguacagug

SEQ ID NO: 2278287 - RNA, 15 nt, Human
cauguacaguguucu

SEQ ID NO: 2278288 - RNA, 19 nt, Human
cauguacaguguucuguuu

SEQ ID NO: 2278289 - RNA, 20 nt, Human
cauguacaguguucuguuua

SEQ ID NO: 2278290 - RNA, 21 nt, Human
cauguacaguguucuguuuaa

SEQ ID NO: 2278291 - RNA, 22 nt, Human
cauguacaguguucuguuuaau

SEQ ID NO: 2278292 - RNA, 18 nt, Human
caugucgccucugcauuc

SEQ ID NO: 2278293 - RNA, 20 nt, Human
caugucgccucugcauucag

SEQ ID NO: 2278294 - RNA, 23 nt, Human
caugucuuguacauguguagccu

SEQ ID NO: 2278295 - RNA, 19 nt, Human
caugucgcgcucagcaugc

SEQ ID NO: 2278296 - RNA, 22 nt, Human
caugucgcgcucagcaugcauc

SEQ ID NO: 2278297 - RNA, 22 nt, Human
cauguccuuguguguuuugaga

SEQ ID NO: 2278298 - RNA, 21 nt, Human
cauguccuuagcacagggggg

SEQ ID NO: 2278299 - RNA, 17 nt, Human
caugucgcgcucagcau

SEQ ID NO: 2278300 - RNA, 14 nt, Human
caugucgccucugc

SEQ ID NO: 2278301 - RNA, 15 nt, Human
caugucgccucugca

SEQ ID NO: 2278302 - RNA, 19 nt, Human
cauguccuuguguguuuug

SEQ ID NO: 2278303 - RNA, 15 nt, Human
cauguacaugaagaa

SEQ ID NO: 2278304 - RNA, 14 nt, Human
cauggugccugaga

SEQ ID NO: 2278305 - RNA, 13 nt, Human
cauggugccugag

SEQ ID NO: 2278306 - RNA, 22 nt, Human
cauggugccccaggaccagcuc

SEQ ID NO: 2278307 - RNA, 20 nt, Human
cauggugccccaggaccagc

SEQ ID NO: 2278308 - RNA, 19 nt, Human
cauggugccccaggaccag

SEQ ID NO: 2278309 - RNA, 18 nt, Human
cauggugccccaggacca

SEQ ID NO: 2278310 - RNA, 17 nt, Human
cauggugccccaggacc

SEQ ID NO: 2278311 - RNA, 16 nt, Human
cauggugccccaggac

SEQ ID NO: 2278312 - RNA, 20 nt, Human
caugguccgguguccuuuuc

SEQ ID NO: 2278313 - RNA, 16 nt, Human
cauggugaauuaauca

SEQ ID NO: 2278314 - RNA, 17 nt, Human
caugguccgguguccuu

SEQ ID NO: 2278315 - RNA, 19 nt, Human
cauggugcaguugacagca

SEQ ID NO: 2278316 - RNA, 21 nt, Human
cauggugcaguugacagcagg

SEQ ID NO: 2278317 - RNA, 15 nt, Human
cauggugccccagga

SEQ ID NO: 2278318 - RNA, 20 nt, Human
cauggugacuuuugaaaaga

SEQ ID NO: 2278319 - RNA, 16 nt, Human
cauggucggaaaacau

SEQ ID NO: 2278320 - RNA, 22 nt, Human
cauggugugaaagucagaugcc

SEQ ID NO: 2278321 - RNA, 12 nt, Human
cauggugucugg

SEQ ID NO: 2278322 - RNA, 23 nt, Human
cauggugugaaagucagaugccc

SEQ ID NO: 2278323 - RNA, 18 nt, Human
cauggugugaucgucuga

SEQ ID NO: 2278324 - RNA, 15 nt, Human
cauggugccugagag

SEQ ID NO: 2278325 - RNA, 16 nt, Human
cauggugccugagagg

SEQ ID NO: 2278326 - RNA, 17 nt, Human
cauggugccugagaggc

SEQ ID NO: 2278327 - RNA, 15 nt, Human
caugguguaauaaga

SEQ ID NO: 2278328 - RNA, 16 nt, Human
caugguguaauaagac

SEQ ID NO: 2278329 - RNA, 18 nt, Human
caugguguaauaagacau

SEQ ID NO: 2278330 - RNA, 19 nt, Human
caugguguaauaagacaua

SEQ ID NO: 2278331 - RNA, 21 nt, Human
caugguguaauaagacauaac

SEQ ID NO: 2278332 - RNA, 14 nt, Human
caugguugagaaau

SEQ ID NO: 2278333 - RNA, 19 nt, Human
caugguuaagguaaaguaa

SEQ ID NO: 2278334 - RNA, 21 nt, Human
caugguuacaaucauugcuga

SEQ ID NO: 2278335 - RNA, 22 nt, Human
caugguguaauaagacauaacg

SEQ ID NO: 2278336 - RNA, 22 nt, Human
cauguaauaaaaaguauauguu

SEQ ID NO: 2278337 - RNA, 23 nt, Human
cauguaauauaaagauguuaaaa

SEQ ID NO: 2278338 - RNA, 21 nt, Human
cauguaauaaaaaguauaugu

SEQ ID NO: 2278339 - RNA, 12 nt, Human
cauguaauaaaa

SEQ ID NO: 2278340 - RNA, 21 nt, Human
cauguaaugguaucuuaaagu

SEQ ID NO: 2278341 - RNA, 14 nt, Human
cauguaauccucaa

SEQ ID NO: 2278342 - RNA, 18 nt, Human
cauguaagcugaaaauau

SEQ ID NO: 2278343 - RNA, 23 nt, Human
cauguaagcugaaaauauggcaa

SEQ ID NO: 2278344 - RNA, 17 nt, Human
cauguaagcugaaaaua

SEQ ID NO: 2278345 - RNA, 16 nt, Human
cauguaaauuuuguau

SEQ ID NO: 2278346 - RNA, 16 nt, Human
caugguugagaaauga

SEQ ID NO: 2278347 - RNA, 13 nt, Human
cauguaacagaaa

SEQ ID NO: 2278348 - RNA, 14 nt, Human
cauguaacagaaag

SEQ ID NO: 2278349 - RNA, 15 nt, Human
cauguaacagaaagg

SEQ ID NO: 2278350 - RNA, 17 nt, Human
cauguaacagaaagggc

SEQ ID NO: 2278351 - RNA, 17 nt, Human
caugugguuaaugccau

SEQ ID NO: 2278352 - RNA, 21 nt, Human
cauguggugggacagggaccc

SEQ ID NO: 2278353 - RNA, 12 nt, Human
caugugguggga

SEQ ID NO: 2278354 - RNA, 23 nt, Human
caugugguggcacaggcccccuu

SEQ ID NO: 2278355 - RNA, 23 nt, Human
cauguggggccaggucacccuuu

SEQ ID NO: 2278356 - RNA, 18 nt, Human
cauguggggccaggucac

SEQ ID NO: 2278357 - RNA, 22 nt, Human
caugugguggcacaggcccccu

SEQ ID NO: 2278358 - RNA, 20 nt, Human
caugugguuuauagagggcc

SEQ ID NO: 2278359 - RNA, 15 nt, Human
caugugguuuauaga

SEQ ID NO: 2278360 - RNA, 22 nt, Human
caugugguuaaugccauggaca

SEQ ID NO: 2278361 - RNA, 13 nt, Human
caugugugcgugu

SEQ ID NO: 2278362 - RNA, 17 nt, Human
caugugugcucuucuuc

SEQ ID NO: 2278363 - RNA, 19 nt, Human
caugugugcgagugugugc

SEQ ID NO: 2278364 - RNA, 17 nt, Human
caugugugcgagugugu

SEQ ID NO: 2278365 - RNA, 18 nt, Human
caugugugcaacagggua

SEQ ID NO: 2278366 - RNA, 16 nt, Human
cauguguaaucaauaa

SEQ ID NO: 2278367 - RNA, 17 nt, Human
cauguguaaucaauaaa

SEQ ID NO: 2278368 - RNA, 21 nt, Human
caugugugagugugugcaagu

SEQ ID NO: 2278369 - RNA, 12 nt, Human
caugugggagcu

SEQ ID NO: 2278370 - RNA, 13 nt, Human
cauguggcuggaa

SEQ ID NO: 2278371 - RNA, 15 nt, Human
cauguggcuggaaga

SEQ ID NO: 2278372 - RNA, 14 nt, Human
cauguggggccagg

SEQ ID NO: 2278373 - RNA, 15 nt, Human
cauguggggccaggu

SEQ ID NO: 2278374 - RNA, 17 nt, Human
cauguggggccagguca

SEQ ID NO: 2278375 - RNA, 17 nt, Human
cauguggaauauaaaga

SEQ ID NO: 2278376 - RNA, 23 nt, Human
cauguggaaagugaauuugaaug

SEQ ID NO: 2278377 - RNA, 22 nt, Human
cauguggaaagugaauuugaau

SEQ ID NO: 2278378 - RNA, 21 nt, Human
cauguggaaagugaauuugaa

SEQ ID NO: 2278379 - RNA, 20 nt, Human
cauguggaaagugaauuuga

SEQ ID NO: 2278380 - RNA, 18 nt, Human
cauguggaaagugaauuu

SEQ ID NO: 2278381 - RNA, 15 nt, Human
cauguggagaaagga

SEQ ID NO: 2278382 - RNA, 19 nt, Human
cauguggagaaaggaguga

SEQ ID NO: 2278383 - RNA, 14 nt, Human
cauguggccugugg

SEQ ID NO: 2278384 - RNA, 12 nt, Human
cauguggcugga

SEQ ID NO: 2278385 - RNA, 13 nt, Human
caugugaagaggg

SEQ ID NO: 2278386 - RNA, 21 nt, Human
caugugacuccuaugaucuca

SEQ ID NO: 2278387 - RNA, 18 nt, Human
caugugaccacucugucu

SEQ ID NO: 2278388 - RNA, 12 nt, Human
caugugacucug

SEQ ID NO: 2278389 - RNA, 21 nt, Human
caugugccagguuuuuggucu

SEQ ID NO: 2278390 - RNA, 24 nt, Human
caugugccagggcaaugaugaaug

SEQ ID NO: 2278391 - RNA, 16 nt, Human
cauguggaaagugaau

SEQ ID NO: 2278392 - RNA, 17 nt, Human
cauguggaaagugaauu

SEQ ID NO: 2278393 - RNA, 22 nt, Human
caugugccagggcaaugaugaa

SEQ ID NO: 2278394 - RNA, 15 nt, Human
caugugcacaugcac

SEQ ID NO: 2278395 - RNA, 13 nt, Human
caugugacauuua

SEQ ID NO: 2278396 - RNA, 14 nt, Human
caugugacauuuau

SEQ ID NO: 2278397 - RNA, 16 nt, Human
caugugacauuuauau

SEQ ID NO: 2278398 - RNA, 16 nt, Human
caugugaccacucugu

SEQ ID NO: 2278399 - RNA, 16 nt, Human
caugugacacauaugc

SEQ ID NO: 2278400 - RNA, 12 nt, Human
caugugacauuu

SEQ ID NO: 2278401 - RNA, 14 nt, Human
caugugacacauau

SEQ ID NO: 2278402 - RNA, 15 nt, Human
caugugacacauaug

SEQ ID NO: 2278403 - RNA, 12 nt, Human
caugugacacau

SEQ ID NO: 2278404 - RNA, 13 nt, Human
caugugacacaua

SEQ ID NO: 2278405 - RNA, 21 nt, Human
caugugaaaccuuuuuuaaga

SEQ ID NO: 2278406 - RNA, 22 nt, Human
caugugaaaccuuuuuuaagau

SEQ ID NO: 2278407 - RNA, 24 nt, Human
caugugaaaccuuuuuuaagauuu

SEQ ID NO: 2278408 - RNA, 15 nt, Human
caugugaacccggga

SEQ ID NO: 2278409 - RNA, 23 nt, Human
cauguuugauguaucugagcagg

SEQ ID NO: 2278410 - RNA, 22 nt, Human
cauguuucuuuguaaugaaaac

SEQ ID NO: 2278411 - RNA, 20 nt, Human
cauguuugagcucagacccc

SEQ ID NO: 2278412 - RNA, 19 nt, Human
cauguuugagcucagaccc

SEQ ID NO: 2278413 - RNA, 18 nt, Human
cauguuuuaaagcuugcu

SEQ ID NO: 2278414 - RNA, 23 nt, Human
cauguuugagcucagacccccac

SEQ ID NO: 2278415 - RNA, 12 nt, Human
cauguuuuaaca

SEQ ID NO: 2278416 - RNA, 14 nt, Human
cauguuuuaacaaa

SEQ ID NO: 2278417 - RNA, 13 nt, Human
cauguuuuaacaa

SEQ ID NO: 2278418 - RNA, 18 nt, Human
cauguuugagcucagacc

SEQ ID NO: 2278419 - RNA, 16 nt, Human
cauguuugagcucaga

SEQ ID NO: 2278420 - RNA, 21 nt, Human
caugugugugcaagugugugc

SEQ ID NO: 2278421 - RNA, 15 nt, Human
cauguuugugauuga

SEQ ID NO: 2278422 - RNA, 23 nt, Human
cauguuuuagacaaauacucaug

SEQ ID NO: 2278423 - RNA, 20 nt, Human
cauguuuuaacaaaaaccaa

SEQ ID NO: 2278424 - RNA, 17 nt, Human
cauguuuuaacaaaaac

SEQ ID NO: 2278425 - RNA, 16 nt, Human
cauguuuuaacaaaaa

SEQ ID NO: 2278426 - RNA, 15 nt, Human
cauguuuuaacaaaa

SEQ ID NO: 2278427 - RNA, 15 nt, Human
cauguuuucaacugc

SEQ ID NO: 2278428 - RNA, 17 nt, Human
cauguuuucaacugcca

SEQ ID NO: 2278429 - RNA, 16 nt, Human
cauguuuucaacugcc

SEQ ID NO: 2278430 - RNA, 18 nt, Human
cauguuuuccagcuccuc

SEQ ID NO: 2278431 - RNA, 15 nt, Human
cauguuuuccauugu

SEQ ID NO: 2278432 - RNA, 17 nt, Human
cauguuuuccauuguuu

SEQ ID NO: 2278433 - RNA, 21 nt, Human
cauguuuuccauuguuugaaa

SEQ ID NO: 2278434 - RNA, 14 nt, Human
cauguuuugugacu

SEQ ID NO: 2278435 - RNA, 12 nt, Human
cauguuuuguau

SEQ ID NO: 2278436 - RNA, 14 nt, Human
cauguuuuccguga

SEQ ID NO: 2278437 - RNA, 21 nt, Human
cauguuuucugaaaauauaac

SEQ ID NO: 2278438 - RNA, 13 nt, Human
cauguuuugauaa

SEQ ID NO: 2278439 - RNA, 14 nt, Human
cauguuuugauaaa

SEQ ID NO: 2278440 - RNA, 17 nt, Human
cauguuuugauaaagua

SEQ ID NO: 2278441 - RNA, 18 nt, Human
cauguuuugauaaaguag

SEQ ID NO: 2278442 - RNA, 15 nt, Human
caugugugugcucag

SEQ ID NO: 2278443 - RNA, 15 nt, Human
caugugugugcaagu

SEQ ID NO: 2278444 - RNA, 23 nt, Human
cauguguguccacgacugucucc

SEQ ID NO: 2278445 - RNA, 14 nt, Human
caugugugcugaac

SEQ ID NO: 2278446 - RNA, 18 nt, Human
caugugugcucuucuucu

SEQ ID NO: 2278447 - RNA, 20 nt, Human
caugugugcucuucuucuuu

SEQ ID NO: 2278448 - RNA, 14 nt, Human
cauguguggacuca

SEQ ID NO: 2278449 - RNA, 12 nt, Human
caugugugucca

SEQ ID NO: 2278450 - RNA, 22 nt, Human
cauguguguccacgacugucuc

SEQ ID NO: 2278451 - RNA, 21 nt, Human
cauguguguccacgacugucu

SEQ ID NO: 2278452 - RNA, 20 nt, Human
cauguuucuuuguaaugaaa

SEQ ID NO: 2278453 - RNA, 21 nt, Human
cauguuucuuuguaaugaaaa

SEQ ID NO: 2278454 - RNA, 18 nt, Human
cauguuuuucuucucccu

SEQ ID NO: 2278455 - RNA, 22 nt, Human
cauuaaagcauuuacuuugaau

SEQ ID NO: 2278456 - RNA, 12 nt, Human
cauuaaagccau

SEQ ID NO: 2278457 - RNA, 18 nt, Human
cauuaaagcauuuacuuu

SEQ ID NO: 2278458 - RNA, 24 nt, Human
cauuaaaggcuucucucucaccag

SEQ ID NO: 2278459 - RNA, 17 nt, Human
cauuaaaggcuucucuc

SEQ ID NO: 2278460 - RNA, 18 nt, Human
cauuaaaggcuucucucu

SEQ ID NO: 2278461 - RNA, 21 nt, Human
cauuaaagucgagcuuuucua

SEQ ID NO: 2278462 - RNA, 13 nt, Human
cauuaaauucaca

SEQ ID NO: 2278463 - RNA, 21 nt, Human
cauuaaaggcuucucucucac

SEQ ID NO: 2278464 - RNA, 12 nt, Human
cauuaaaguucu

SEQ ID NO: 2278465 - RNA, 15 nt, Human
cauguuuuguuuacg

SEQ ID NO: 2278466 - RNA, 21 nt, Human
cauuaaagccugaguuugcuu

SEQ ID NO: 2278467 - RNA, 15 nt, Human
cauguuuugugacua

SEQ ID NO: 2278468 - RNA, 17 nt, Human
cauguuuugugacuaua

SEQ ID NO: 2278469 - RNA, 23 nt, Human
cauguuuugugacuauauagaga

SEQ ID NO: 2278470 - RNA, 17 nt, Human
cauuaauauuugcugac

SEQ ID NO: 2278471 - RNA, 18 nt, Human
cauuaaucaaucaucugu

SEQ ID NO: 2278472 - RNA, 16 nt, Human
cauuaauauuugcuga

SEQ ID NO: 2278473 - RNA, 20 nt, Human
cauuaacaguuuuccaugaa

SEQ ID NO: 2278474 - RNA, 14 nt, Human
cauuaauaauaaau

SEQ ID NO: 2278475 - RNA, 17 nt, Human
cauuaacaguuuuccau

SEQ ID NO: 2278476 - RNA, 16 nt, Human
cauuaacaguuuucca

SEQ ID NO: 2278477 - RNA, 13 nt, Human
cauuaacaguuuu

SEQ ID NO: 2278478 - RNA, 21 nt, Human
cauuaaauucacaaacuuuua

SEQ ID NO: 2278479 - RNA, 18 nt, Human
cauuaaauucacaaacuu

SEQ ID NO: 2278480 - RNA, 17 nt, Human
cauuaaauucacaaacu

SEQ ID NO: 2278481 - RNA, 14 nt, Human
cauuaaauucacaa

SEQ ID NO: 2278482 - RNA, 23 nt, Human
cauuaccagacgguucaccagcc

SEQ ID NO: 2278483 - RNA, 17 nt, Human
cauuaccgcguuguaaa

SEQ ID NO: 2278484 - RNA, 20 nt, Human
cauuaccagacgguucacca

SEQ ID NO: 2278485 - RNA, 20 nt, Human
cauuaauuauuauugcuguu

SEQ ID NO: 2278486 - RNA, 22 nt, Human
cauuaccucagugagaagccag

SEQ ID NO: 2278487 - RNA, 21 nt, Human
cauuaccucagugagaagcca

SEQ ID NO: 2278488 - RNA, 21 nt, Human
cauuaauuauuauugcuguug

SEQ ID NO: 2278489 - RNA, 19 nt, Human
cauuaauuauuauugcugu

SEQ ID NO: 2278490 - RNA, 23 nt, Human
cauuaauguuaauucagcacuga

SEQ ID NO: 2278491 - RNA, 13 nt, Human
cauuaauguuaau

SEQ ID NO: 2278492 - RNA, 21 nt, Human
cauuaauguuaauucagcacu

SEQ ID NO: 2278493 - RNA, 22 nt, Human
cauuaaucaaucaucuguguga

SEQ ID NO: 2278494 - RNA, 23 nt, Human
cauuaaucaaucaucugugugaa

SEQ ID NO: 2278495 - RNA, 22 nt, Human
cauuauuuauucagcuucauuu

SEQ ID NO: 2278496 - RNA, 13 nt, Human
cauuauuugcaug

SEQ ID NO: 2278497 - RNA, 19 nt, Human
cauuauuugcauguuaccu

SEQ ID NO: 2278498 - RNA, 14 nt, Human
cauuauuugcaugu

SEQ ID NO: 2278499 - RNA, 17 nt, Human
cauuagcaguuugcuuu

SEQ ID NO: 2278500 - RNA, 13 nt, Human
cauuacgugagcc

SEQ ID NO: 2278501 - RNA, 17 nt, Human
cauuaccuuacugugga

SEQ ID NO: 2278502 - RNA, 16 nt, Human
cauuacgugagccagg

SEQ ID NO: 2278503 - RNA, 18 nt, Human
cauuagaccaagcuuguc

SEQ ID NO: 2278504 - RNA, 17 nt, Human
cauuacgugagccaggu

SEQ ID NO: 2278505 - RNA, 13 nt, Human
cauuaccuuacug

SEQ ID NO: 2278506 - RNA, 20 nt, Human
cauuaccuuacuguggagga

SEQ ID NO: 2278507 - RNA, 18 nt, Human
cauuaccgcguuguaaaa

SEQ ID NO: 2278508 - RNA, 22 nt, Human
cauuaccgcguuguaaaauaua

SEQ ID NO: 2278509 - RNA, 23 nt, Human
cauuagagcaggcguucagcuca

SEQ ID NO: 2278510 - RNA, 13 nt, Human
cauuagagcaggc

SEQ ID NO: 2278511 - RNA, 14 nt, Human
cauuagagcaggcg

SEQ ID NO: 2278512 - RNA, 19 nt, Human
cauuagagcccauuucaau

SEQ ID NO: 2278513 - RNA, 11 nt, Human
cauuagagcag

SEQ ID NO: 2278514 - RNA, 12 nt, Human
cauuagagcagg

SEQ ID NO: 2278515 - RNA, 17 nt, Human
cauuagacuccuccucc

SEQ ID NO: 2278516 - RNA, 15 nt, Human
cauuagacuccuccu

SEQ ID NO: 2278517 - RNA, 16 nt, Human
cauuagacuccuccuc

SEQ ID NO: 2278518 - RNA, 17 nt, Human
ccaagacauugucaaua

SEQ ID NO: 2278519 - RNA, 16 nt, Human
ccaagacauugucaau

SEQ ID NO: 2278520 - RNA, 12 nt, Human
ccaagacauugu

SEQ ID NO: 2278521 - RNA, 19 nt, Human
ccaagaccuguugguucca

SEQ ID NO: 2278522 - RNA, 14 nt, Human
ccaagagaugaaga

SEQ ID NO: 2278523 - RNA, 23 nt, Human
ccaagacucccucgucgagcugg

SEQ ID NO: 2278524 - RNA, 19 nt, Human
ccaagagcagaggcagcga

SEQ ID NO: 2278525 - RNA, 12 nt, Human
ccaagagaugaa

SEQ ID NO: 2278526 - RNA, 12 nt, Human
ccaagagccuga

SEQ ID NO: 2278527 - RNA, 11 nt, Human
ccaacccuucu

SEQ ID NO: 2278528 - RNA, 13 nt, Human
ccaacccuucucc

SEQ ID NO: 2278529 - RNA, 21 nt, Human
ccaacccuucuccucuuguaa

SEQ ID NO: 2278530 - RNA, 14 nt, Human
ccaacccuucccca

SEQ ID NO: 2278531 - RNA, 18 nt, Human
ccaaccuaaccccuuucc

SEQ ID NO: 2278532 - RNA, 14 nt, Human
ccaaccuccugacc

SEQ ID NO: 2278533 - RNA, 17 nt, Human
ccaacccugccccugcc

SEQ ID NO: 2278534 - RNA, 18 nt, Human
ccaacccuggcacccagg

SEQ ID NO: 2278535 - RNA, 13 nt, Human
ccaacccugucug

SEQ ID NO: 2278536 - RNA, 12 nt, Human
ccaacccugucu

SEQ ID NO: 2278537 - RNA, 14 nt, Human
ccaacccugucugu

SEQ ID NO: 2278538 - RNA, 16 nt, Human
ccaacccuguuuccug

SEQ ID NO: 2278539 - RNA, 18 nt, Human
ccaacccuguuuccugag

SEQ ID NO: 2278540 - RNA, 12 nt, Human
ccaacccuuccc

SEQ ID NO: 2278541 - RNA, 16 nt, Human
ccaacccugccccugc

SEQ ID NO: 2278542 - RNA, 15 nt, Human
ccaacccugccccug

SEQ ID NO: 2278543 - RNA, 14 nt, Human
ccaacccugccccu

SEQ ID NO: 2278544 - RNA, 15 nt, Human
ccaacauggugaaac

SEQ ID NO: 2278545 - RNA, 23 nt, Human
ccaacauggagaaacccugucuc

SEQ ID NO: 2278546 - RNA, 22 nt, Human
ccaacauggagaaacccugucu

SEQ ID NO: 2278547 - RNA, 15 nt, Human
ccaacauggagaaac

SEQ ID NO: 2278548 - RNA, 15 nt, Human
ccaacccucaucacc

SEQ ID NO: 2278549 - RNA, 21 nt, Human
ccaacaucccauugcccuggu

SEQ ID NO: 2278550 - RNA, 20 nt, Human
ccaacaucccauugcccugg

SEQ ID NO: 2278551 - RNA, 16 nt, Human
ccaacaucucccuccc

SEQ ID NO: 2278552 - RNA, 17 nt, Human
ccaacaucgugaaaccc

SEQ ID NO: 2278553 - RNA, 13 nt, Human
ccaacccucauca

SEQ ID NO: 2278554 - RNA, 22 nt, Human
ccaaccugaccaacauggagaa

SEQ ID NO: 2278555 - RNA, 12 nt, Human
ccaaccugcuga

SEQ ID NO: 2278556 - RNA, 14 nt, Human
ccaaccuggacaac

SEQ ID NO: 2278557 - RNA, 17 nt, Human
ccaaccuggggagccag

SEQ ID NO: 2278558 - RNA, 13 nt, Human
ccaaccuggacaa

SEQ ID NO: 2278559 - RNA, 14 nt, Human
ccaaccuggggggc

SEQ ID NO: 2278560 - RNA, 16 nt, Human
ccaaccuguaauaaau

SEQ ID NO: 2278561 - RNA, 17 nt, Human
ccaaccuguaauaaaua

SEQ ID NO: 2278562 - RNA, 16 nt, Human
ccaaccugaccaacau

SEQ ID NO: 2278563 - RNA, 13 nt, Human
ccaaccugaccaa

SEQ ID NO: 2278564 - RNA, 17 nt, Human
ccaaccugcaaagaucu

SEQ ID NO: 2278565 - RNA, 19 nt, Human
ccaaccugcaaagaucugu

SEQ ID NO: 2278566 - RNA, 18 nt, Human
ccaaccugcaaagaucug

SEQ ID NO: 2278567 - RNA, 12 nt, Human
ccaaccugacca

SEQ ID NO: 2278568 - RNA, 14 nt, Human
ccaaccucuggagc

SEQ ID NO: 2278569 - RNA, 13 nt, Human
ccaaccucuggag

SEQ ID NO: 2278570 - RNA, 15 nt, Human
ccaaccuguuaccua

SEQ ID NO: 2278571 - RNA, 18 nt, Human
ccaaccuguaauaaauau

SEQ ID NO: 2278572 - RNA, 19 nt, Human
ccaaccuguaauaaauaug

SEQ ID NO: 2278573 - RNA, 20 nt, Human
ccaaccuguaauaaauauga

SEQ ID NO: 2278574 - RNA, 21 nt, Human
ccaaccuguaauaaauaugag

SEQ ID NO: 2278575 - RNA, 23 nt, Human
ccaagacagaugccccagagcug

SEQ ID NO: 2278576 - RNA, 22 nt, Human
ccaaccuguaauaaauaugagu

SEQ ID NO: 2278577 - RNA, 12 nt, Human
ccaaccuuccca

SEQ ID NO: 2278578 - RNA, 23 nt, Human
ccaaccuuagauguucuaagucu

SEQ ID NO: 2278579 - RNA, 24 nt, Human
ccaagacagaugccccagagcugu

SEQ ID NO: 2278580 - RNA, 21 nt, Human
ccaagacaugucuguucuaca

SEQ ID NO: 2278581 - RNA, 11 nt, Human
ccaagacauug

SEQ ID NO: 2278582 - RNA, 23 nt, Human
ccaagacaugucuguucuacaua

SEQ ID NO: 2278583 - RNA, 15 nt, Human
ccaagaccuucuccu

SEQ ID NO: 2278584 - RNA, 22 nt, Human
ccaaauucuuucaguggcuacc

SEQ ID NO: 2278585 - RNA, 15 nt, Human
ccaaauucuuucagu

SEQ ID NO: 2278586 - RNA, 22 nt, Human
ccaaagaguagaauugcauuga

SEQ ID NO: 2278587 - RNA, 21 nt, Human
ccaaagauauauacacaggau

SEQ ID NO: 2278588 - RNA, 14 nt, Human
ccaaagcagacagc

SEQ ID NO: 2278589 - RNA, 13 nt, Human
ccaaagcagacag

SEQ ID NO: 2278590 - RNA, 12 nt, Human
ccaaagcagggu

SEQ ID NO: 2278591 - RNA, 15 nt, Human
ccaaagcagggucug

SEQ ID NO: 2278592 - RNA, 16 nt, Human
ccaaagcagggucugg

SEQ ID NO: 2278593 - RNA, 13 nt, Human
ccaacaccaggga

SEQ ID NO: 2278594 - RNA, 16 nt, Human
ccaacaccagccccug

SEQ ID NO: 2278595 - RNA, 17 nt, Human
ccaacaccagccccugc

SEQ ID NO: 2278596 - RNA, 18 nt, Human
ccaacaccagccccugcc

SEQ ID NO: 2278597 - RNA, 14 nt, Human
ccaacacgagcagg

SEQ ID NO: 2278598 - RNA, 20 nt, Human
ccaaauuccuuggcaugccu

SEQ ID NO: 2278599 - RNA, 23 nt, Human
ccaaauuccuuggcaugccuucc

SEQ ID NO: 2278600 - RNA, 22 nt, Human
ccaaauugcuccuaagcuucaa

SEQ ID NO: 2278601 - RNA, 20 nt, Human
ccaaauugcugggauuacag

SEQ ID NO: 2278602 - RNA, 15 nt, Human
ccaacaccagccccu

SEQ ID NO: 2278603 - RNA, 19 nt, Human
ccaacagucaaaacagaga

SEQ ID NO: 2278604 - RNA, 20 nt, Human
ccaacacccugucuaaaaaa

SEQ ID NO: 2278605 - RNA, 19 nt, Human
ccaacagguggcaggacca

SEQ ID NO: 2278606 - RNA, 23 nt, Human
ccaacagguggcaggaccaggac

SEQ ID NO: 2278607 - RNA, 12 nt, Human
ccaacagugagu

SEQ ID NO: 2278608 - RNA, 20 nt, Human
ccaacagugagucugucagc

SEQ ID NO: 2278609 - RNA, 12 nt, Human
ccaacaguguga

SEQ ID NO: 2278610 - RNA, 13 nt, Human
ccaacagugugaa

SEQ ID NO: 2278611 - RNA, 14 nt, Human
ccaacagugugaag

SEQ ID NO: 2278612 - RNA, 15 nt, Human
ccaacagugugaagu

SEQ ID NO: 2278613 - RNA, 16 nt, Human
ccaacagugugaaguu

SEQ ID NO: 2278614 - RNA, 19 nt, Human
ccaacagugugaaguuaga

SEQ ID NO: 2278615 - RNA, 22 nt, Human
ccaacagugugaaguuagaauu

SEQ ID NO: 2278616 - RNA, 20 nt, Human
ccaacaguguuaggccuggc

SEQ ID NO: 2278617 - RNA, 21 nt, Human
ccaacaguguuaggccuggca

SEQ ID NO: 2278618 - RNA, 12 nt, Human
ccaacaccaggg

SEQ ID NO: 2278619 - RNA, 22 nt, Human
ccaacaccagccccugccccag

SEQ ID NO: 2278620 - RNA, 18 nt, Human
ccaacacccaucuguuuu

SEQ ID NO: 2278621 - RNA, 18 nt, Human
ccaacagguggcaggacc

SEQ ID NO: 2278622 - RNA, 16 nt, Human
ccaacacgcaccugcc

SEQ ID NO: 2278623 - RNA, 21 nt, Human
ccaacacgagcaggcuacugu

SEQ ID NO: 2278624 - RNA, 12 nt, Human
ccaacaguuccu

SEQ ID NO: 2278625 - RNA, 23 nt, Human
ccaacaguguuaggccuggcaca

SEQ ID NO: 2278626 - RNA, 14 nt, Human
ccaacauacuccca

SEQ ID NO: 2278627 - RNA, 16 nt, Human
ccaacaucaacaucuu

SEQ ID NO: 2278628 - RNA, 17 nt, Human
ccaacaucccauugccc

SEQ ID NO: 2278629 - RNA, 13 nt, Human
ccaaagaugcagc

SEQ ID NO: 2278630 - RNA, 14 nt, Human
ccaaagaugcagcc

SEQ ID NO: 2278631 - RNA, 9 nt, Human
ccaaagagu

SEQ ID NO: 2278632 - RNA, 17 nt, Human
ccaaagagggcuuccuc

SEQ ID NO: 2278633 - RNA, 19 nt, Human
ccaaagagggcuuccucua

SEQ ID NO: 2278634 - RNA, 22 nt, Human
ccaaagagccuggagaagcuga

SEQ ID NO: 2278635 - RNA, 16 nt, Human
ccaaagagggcuuccu

SEQ ID NO: 2278636 - RNA, 22 nt, Human
ccaagagcugaggcaauucuaa

SEQ ID NO: 2278637 - RNA, 16 nt, Human
ccaagagccugagagu

SEQ ID NO: 2278638 - RNA, 13 nt, Human
ccaagaggcugca

SEQ ID NO: 2278639 - RNA, 12 nt, Human
ccaagaggcugc

SEQ ID NO: 2278640 - RNA, 18 nt, Human
ccaagcaggaagcucaga

SEQ ID NO: 2278641 - RNA, 17 nt, Human
ccaagcaggaagcucag

SEQ ID NO: 2278642 - RNA, 14 nt, Human
ccaagcaggaagcu

SEQ ID NO: 2278643 - RNA, 13 nt, Human
ccaagcaggaagc

SEQ ID NO: 2278644 - RNA, 12 nt, Human
ccaagcaggaag

SEQ ID NO: 2278645 - RNA, 18 nt, Human
ccaagcagccaagcuccu

SEQ ID NO: 2278646 - RNA, 18 nt, Human
ccaagcaggaaaugaaaa

SEQ ID NO: 2278647 - RNA, 16 nt, Human
ccaagcagccaagcuc

SEQ ID NO: 2278648 - RNA, 12 nt, Human
ccaagcagccaa

SEQ ID NO: 2278649 - RNA, 23 nt, Human
ccaagcagagguugggaggccau

SEQ ID NO: 2278650 - RNA, 20 nt, Human
ccaagcaggaagcucagacu

SEQ ID NO: 2278651 - RNA, 14 nt, Human
ccaagccguggcuu

SEQ ID NO: 2278652 - RNA, 14 nt, Human
ccaagcaggacaug

SEQ ID NO: 2278653 - RNA, 15 nt, Human
ccaagccguggcuuc

SEQ ID NO: 2278654 - RNA, 16 nt, Human
ccaagccguggcuucc

SEQ ID NO: 2278655 - RNA, 17 nt, Human
ccaagccguggcuuccc

SEQ ID NO: 2278656 - RNA, 21 nt, Human
ccaagccguggcuucccgcuc

SEQ ID NO: 2278657 - RNA, 14 nt, Human
ccaagcuccaucuc

SEQ ID NO: 2278658 - RNA, 13 nt, Human
ccaaggccagguu

SEQ ID NO: 2278659 - RNA, 13 nt, Human
ccaagcagggagg

SEQ ID NO: 2278660 - RNA, 16 nt, Human
ccaaggccgaagcucu

SEQ ID NO: 2278661 - RNA, 17 nt, Human
ccaaggccgaagcucug

SEQ ID NO: 2278662 - RNA, 20 nt, Human
ccaaggccgaagcucuggcu

SEQ ID NO: 2278663 - RNA, 18 nt, Human
ccaaggcuagaaccaccu

SEQ ID NO: 2278664 - RNA, 18 nt, Human
ccaaggccgaagcucugg

SEQ ID NO: 2278665 - RNA, 14 nt, Human
ccaaggccuucucc

SEQ ID NO: 2278666 - RNA, 16 nt, Human
ccaaggccuucuccuc

SEQ ID NO: 2278667 - RNA, 14 nt, Human
ccaaggcggccccu

SEQ ID NO: 2278668 - RNA, 15 nt, Human
ccaaggcggccccuc

SEQ ID NO: 2278669 - RNA, 21 nt, Human
ccaaggcggccccucccgccc

SEQ ID NO: 2278670 - RNA, 23 nt, Human
ccaagccguggcuucccgcucag

SEQ ID NO: 2278671 - RNA, 16 nt, Human
ccaagcucagaaggcu

SEQ ID NO: 2278672 - RNA, 13 nt, Human
ccaagcuccaagc

SEQ ID NO: 2278673 - RNA, 19 nt, Human
ccaagcucaggaccaggca

SEQ ID NO: 2278674 - RNA, 20 nt, Human
ccaagcucaggaccaggcaa

SEQ ID NO: 2278675 - RNA, 15 nt, Human
ccaagcuccaagccc

SEQ ID NO: 2278676 - RNA, 17 nt, Human
ccaagcuccaagcccca

SEQ ID NO: 2278677 - RNA, 12 nt, Human
ccaagcucccag

SEQ ID NO: 2278678 - RNA, 13 nt, Human
ccaagcucccagg

SEQ ID NO: 2278679 - RNA, 17 nt, Human
ccaaggcugcgucugga

SEQ ID NO: 2278680 - RNA, 16 nt, Human
ccaaggcggccccucc

SEQ ID NO: 2278681 - RNA, 23 nt, Human
ccaaggcguccgcgcgccagcac

SEQ ID NO: 2278682 - RNA, 16 nt, Human
ccaaggcucugagcaa

SEQ ID NO: 2278683 - RNA, 19 nt, Human
ccaaggcugauuaaaccaa

SEQ ID NO: 2278684 - RNA, 14 nt, Human
ccaaggcuggggga

SEQ ID NO: 2278685 - RNA, 18 nt, Human
ccaaggcugcgucuggag

SEQ ID NO: 2278686 - RNA, 19 nt, Human
ccaaggcugcgucuggagg

SEQ ID NO: 2278687 - RNA, 20 nt, Human
ccaaggcugcgucuggaggg

SEQ ID NO: 2278688 - RNA, 22 nt, Human
ccaaggcuucuccaauucugcc

SEQ ID NO: 2278689 - RNA, 23 nt, Human
ccaaggugggcugagcccuggca

SEQ ID NO: 2278690 - RNA, 20 nt, Human
ccaaggugggcugagcccug

SEQ ID NO: 2278691 - RNA, 18 nt, Human
ccaaggugggcugagccc

SEQ ID NO: 2278692 - RNA, 17 nt, Human
ccaaggugggcugagcc

SEQ ID NO: 2278693 - RNA, 20 nt, Human
ccaagguggguagaucacga

SEQ ID NO: 2278694 - RNA, 13 nt, Human
ccaagguggucug

SEQ ID NO: 2278695 - RNA, 15 nt, Human
ccaagguggucugcu

SEQ ID NO: 2278696 - RNA, 23 nt, Human
ccaagguggucugcucgggccca

SEQ ID NO: 2278697 - RNA, 20 nt, Human
ccaagguuuaaacuucucug

SEQ ID NO: 2278698 - RNA, 21 nt, Human
ccaagguuuaaacuucucuga

SEQ ID NO: 2278699 - RNA, 12 nt, Human
ccaagugugugu

SEQ ID NO: 2278700 - RNA, 22 nt, Human
ccaagugugcauauuguacacu

SEQ ID NO: 2278701 - RNA, 20 nt, Human
ccaagugugcauauuguaca

SEQ ID NO: 2278702 - RNA, 21 nt, Human
ccaagugugcauauuguacac

SEQ ID NO: 2278703 - RNA, 14 nt, Human
ccaagugugugugc

SEQ ID NO: 2278704 - RNA, 13 nt, Human
ccaagugugugug

SEQ ID NO: 2278705 - RNA, 15 nt, Human
ccaaguuauaaauca

SEQ ID NO: 2278706 - RNA, 20 nt, Human
ccaauauucauagcagcuua

SEQ ID NO: 2278707 - RNA, 18 nt, Human
ccaagugggggcagaggg

SEQ ID NO: 2278708 - RNA, 15 nt, Human
ccaaguggggugcug

SEQ ID NO: 2278709 - RNA, 16 nt, Human
ccaaguggggugcugg

SEQ ID NO: 2278710 - RNA, 22 nt, Human
ccaaguggggugcugggaggag

SEQ ID NO: 2278711 - RNA, 14 nt, Human
ccaaguggugccua

SEQ ID NO: 2278712 - RNA, 14 nt, Human
ccaagugugaacaa

SEQ ID NO: 2278713 - RNA, 10 nt, Human
ccaagugugc

SEQ ID NO: 2278714 - RNA, 19 nt, Human
ccaagugugcauauuguac

SEQ ID NO: 2278715 - RNA, 16 nt, Human
ccaagugggggcagag

SEQ ID NO: 2278716 - RNA, 19 nt, Human
ccaaguggcagagcuugga

SEQ ID NO: 2278717 - RNA, 17 nt, Human
ccaaguggcagagcuug

SEQ ID NO: 2278718 - RNA, 18 nt, Human
ccaaguggcagagcuugg

SEQ ID NO: 2278719 - RNA, 16 nt, Human
ccaaguggcucccaca

SEQ ID NO: 2278720 - RNA, 16 nt, Human
ccaagugcaggcuggc

SEQ ID NO: 2278721 - RNA, 14 nt, Human
ccaagugccagagg

SEQ ID NO: 2278722 - RNA, 15 nt, Human
ccaagugccagaggu

SEQ ID NO: 2278723 - RNA, 16 nt, Human
ccaagugccagaggug

SEQ ID NO: 2278724 - RNA, 17 nt, Human
ccaagugccagaggugg

SEQ ID NO: 2278725 - RNA, 18 nt, Human
ccaagugccagagguggg

SEQ ID NO: 2278726 - RNA, 21 nt, Human
ccaagugccagaggugggcag

SEQ ID NO: 2278727 - RNA, 22 nt, Human
ccaagugccagaggugggcagg

SEQ ID NO: 2278728 - RNA, 19 nt, Human
ccaagugcaggcuggcacc

SEQ ID NO: 2278729 - RNA, 14 nt, Human
ccaagugcaggcug

SEQ ID NO: 2278730 - RNA, 18 nt, Human
ccaagugaacacuagcca

SEQ ID NO: 2278731 - RNA, 13 nt, Human
ccaaguggcuccc

SEQ ID NO: 2278732 - RNA, 13 nt, Human
ccaaguggcagag

SEQ ID NO: 2278733 - RNA, 14 nt, Human
ccaaguggcagagc

SEQ ID NO: 2278734 - RNA, 15 nt, Human
ccaaguggcagagcu

SEQ ID NO: 2278735 - RNA, 22 nt, Human
ccaagugccagucuugugucug

SEQ ID NO: 2278736 - RNA, 16 nt, Human
ccaagugccagucuug

SEQ ID NO: 2278737 - RNA, 20 nt, Human
ccaaguggaccuugagacca

SEQ ID NO: 2278738 - RNA, 23 nt, Human
ccaagugccagaggugggcaggu

SEQ ID NO: 2278739 - RNA, 22 nt, Human
ccacaaagccuuaucaaguguc

SEQ ID NO: 2278740 - RNA, 23 nt, Human
ccacaaagccuuaucaagugucu

SEQ ID NO: 2278741 - RNA, 18 nt, Human
ccacaaaggagagcuagc

SEQ ID NO: 2278742 - RNA, 18 nt, Human
ccacaacccuguuuuaua

SEQ ID NO: 2278743 - RNA, 13 nt, Human
ccacaacacacag

SEQ ID NO: 2278744 - RNA, 22 nt, Human
ccacaacuccugucuaacugcu

SEQ ID NO: 2278745 - RNA, 16 nt, Human
ccacaagacccuugug

SEQ ID NO: 2278746 - RNA, 13 nt, Human
ccacaagagccca

SEQ ID NO: 2278747 - RNA, 22 nt, Human
ccacaagaaaugaaagcaggga

SEQ ID NO: 2278748 - RNA, 16 nt, Human
ccacaagaaaugaaag

SEQ ID NO: 2278749 - RNA, 17 nt, Human
ccaauuuuucugcacug

SEQ ID NO: 2278750 - RNA, 13 nt, Human
ccaauuuuucugc

SEQ ID NO: 2278751 - RNA, 14 nt, Human
ccaauuuuucugca

SEQ ID NO: 2278752 - RNA, 23 nt, Human
ccacaaaauaaccaauccuggac

SEQ ID NO: 2278753 - RNA, 13 nt, Human
ccacaaaaauuga

SEQ ID NO: 2278754 - RNA, 20 nt, Human
ccacaaagcacaguuugaac

SEQ ID NO: 2278755 - RNA, 14 nt, Human
ccacaaagccuuau

SEQ ID NO: 2278756 - RNA, 20 nt, Human
ccaauuuguaaaaacagcau

SEQ ID NO: 2278757 - RNA, 16 nt, Human
ccaauuucagacuccc

SEQ ID NO: 2278758 - RNA, 18 nt, Human
ccaauucuuacaaacaug

SEQ ID NO: 2278759 - RNA, 19 nt, Human
ccaauucuuacaaacaugu

SEQ ID NO: 2278760 - RNA, 20 nt, Human
ccaaguuauaaaucaauguc

SEQ ID NO: 2278761 - RNA, 17 nt, Human
ccaagugugugugcgug

SEQ ID NO: 2278762 - RNA, 22 nt, Human
ccaauauuggagcauaucaaaa

SEQ ID NO: 2278763 - RNA, 19 nt, Human
ccaauuucaaguuccaagu

SEQ ID NO: 2278764 - RNA, 21 nt, Human
ccaauuguugacaguucugaa

SEQ ID NO: 2278765 - RNA, 22 nt, Human
ccaauuguugacaguucugaag

SEQ ID NO: 2278766 - RNA, 13 nt, Human
ccaauuggaggaa

SEQ ID NO: 2278767 - RNA, 20 nt, Human
ccaauuguugacaguucuga

SEQ ID NO: 2278768 - RNA, 14 nt, Human
ccaauauuguacag

SEQ ID NO: 2278769 - RNA, 15 nt, Human
ccaauauuguacagu

SEQ ID NO: 2278770 - RNA, 16 nt, Human
ccaauauuguacaguu

SEQ ID NO: 2278771 - RNA, 18 nt, Human
ccaauauuguacaguuuu

SEQ ID NO: 2278772 - RNA, 21 nt, Human
ccacaagauucccagagacag

SEQ ID NO: 2278773 - RNA, 20 nt, Human
ccacaagauucccagagaca

SEQ ID NO: 2278774 - RNA, 19 nt, Human
ccacaagauucccagagac

SEQ ID NO: 2278775 - RNA, 18 nt, Human
ccacaagauucccagaga

SEQ ID NO: 2278776 - RNA, 24 nt, Human
ccacaagauucccagagacaggaa

SEQ ID NO: 2278777 - RNA, 17 nt, Human
ccacaagauucccagag

SEQ ID NO: 2278778 - RNA, 16 nt, Human
ccacaagauucccaga

SEQ ID NO: 2278779 - RNA, 15 nt, Human
ccacaagauucccag

SEQ ID NO: 2278780 - RNA, 21 nt, Human
ccacaagaaauuugauuucua

SEQ ID NO: 2278781 - RNA, 15 nt, Human
ccacaagaaauuuga

SEQ ID NO: 2278782 - RNA, 16 nt, Human
ccacaagaaauuugau

SEQ ID NO: 2278783 - RNA, 20 nt, Human
ccacaagagcccaggccucc

SEQ ID NO: 2278784 - RNA, 21 nt, Human
ccacaagagcccaggccuccu

SEQ ID NO: 2278785 - RNA, 16 nt, Human
ccacaagagcccaggc

SEQ ID NO: 2278786 - RNA, 17 nt, Human
ccacaagagcccaggcc

SEQ ID NO: 2278787 - RNA, 18 nt, Human
ccacaagagcccaggccu

SEQ ID NO: 2278788 - RNA, 19 nt, Human
ccacaagagcccaggccuc

SEQ ID NO: 2278789 - RNA, 20 nt, Human
ccacaaguuaaauaaaucau

SEQ ID NO: 2278790 - RNA, 15 nt, Human
ccacaaguuaaauaa

SEQ ID NO: 2278791 - RNA, 21 nt, Human
ccacaaggacuuccuguccag

SEQ ID NO: 2278792 - RNA, 17 nt, Human
ccacaaggacuuccugu

SEQ ID NO: 2278793 - RNA, 17 nt, Human
ccacaaggcuguugcau

SEQ ID NO: 2278794 - RNA, 21 nt, Human
ccacaaguggugguaacccug

SEQ ID NO: 2278795 - RNA, 15 nt, Human
ccacaagugguggua

SEQ ID NO: 2278796 - RNA, 13 nt, Human
ccacacacacaca

SEQ ID NO: 2278797 - RNA, 15 nt, Human
ccacacacacacaca

SEQ ID NO: 2278798 - RNA, 14 nt, Human
ccacacacacacac

SEQ ID NO: 2278799 - RNA, 12 nt, Human
ccacacacacag

SEQ ID NO: 2278800 - RNA, 24 nt, Human
ccacacacacacacaugcauacac

SEQ ID NO: 2278801 - RNA, 21 nt, Human
ccacacacacacacaugcaua

SEQ ID NO: 2278802 - RNA, 17 nt, Human
ccacacacacacacaug

SEQ ID NO: 2278803 - RNA, 22 nt, Human
ccacacaaggauagaugcuggc

SEQ ID NO: 2278804 - RNA, 11 nt, Human
ccacacacaca

SEQ ID NO: 2278805 - RNA, 20 nt, Human
ccacaauauaaaacuguacu

SEQ ID NO: 2278806 - RNA, 22 nt, Human
ccacaaguggugguaacccugg

SEQ ID NO: 2278807 - RNA, 21 nt, Human
ccacaauaaagaucgccccca

SEQ ID NO: 2278808 - RNA, 20 nt, Human
ccacacaaggauagaugcug

SEQ ID NO: 2278809 - RNA, 23 nt, Human
ccacaauccuauucucgggcuga

SEQ ID NO: 2278810 - RNA, 20 nt, Human
ccacaaucuuaaggggcagc

SEQ ID NO: 2278811 - RNA, 19 nt, Human
cauuuuguuugguauugua

SEQ ID NO: 2278812 - RNA, 20 nt, Human
cauuuuguuugguauuguau

SEQ ID NO: 2278813 - RNA, 21 nt, Human
cauuuuguuugguauuguauu

SEQ ID NO: 2278814 - RNA, 22 nt, Human
cauuuuguuugguauuguauuu

SEQ ID NO: 2278815 - RNA, 23 nt, Human
cauuuuguuugguauuguauuua

SEQ ID NO: 2278816 - RNA, 15 nt, Human
cauuuuggugagaaa

SEQ ID NO: 2278817 - RNA, 23 nt, Human
cauuuugggguacccacugcucu

SEQ ID NO: 2278818 - RNA, 19 nt, Human
cauuuuuaguagagacagg

SEQ ID NO: 2278819 - RNA, 18 nt, Human
cauuuuuaguagagacag

SEQ ID NO: 2278820 - RNA, 20 nt, Human
cauuuuuaagugcugcauuu

SEQ ID NO: 2278821 - RNA, 15 nt, Human
cauuuuuaagugcug

SEQ ID NO: 2278822 - RNA, 24 nt, Human
cauuuugcuaaaugugaaugauga

SEQ ID NO: 2278823 - RNA, 20 nt, Human
cauuuugccaaaauuauuaa

SEQ ID NO: 2278824 - RNA, 15 nt, Human
cauuuugcuauugua

SEQ ID NO: 2278825 - RNA, 17 nt, Human
cauuuugcuauuguaaa

SEQ ID NO: 2278826 - RNA, 19 nt, Human
cauuuugcuauuguaaaua

SEQ ID NO: 2278827 - RNA, 21 nt, Human
cauuuugcuaaaugugaauga

SEQ ID NO: 2278828 - RNA, 18 nt, Human
cauuuugcuaaaugugaa

SEQ ID NO: 2278829 - RNA, 20 nt, Human
cauuuuggaaguuuucagga

SEQ ID NO: 2278830 - RNA, 18 nt, Human
cauuuuggaaguuuucag

SEQ ID NO: 2278831 - RNA, 20 nt, Human
cauuuuggagaguuuccuga

SEQ ID NO: 2278832 - RNA, 22 nt, Human
cauuuuggaaguuuucaggacu

SEQ ID NO: 2278833 - RNA, 22 nt, Human
cauuuuggagaguuuccugaaa

SEQ ID NO: 2278834 - RNA, 20 nt, Human
cauuuugggguacccacugc

SEQ ID NO: 2278835 - RNA, 21 nt, Human
cauuuugggguacccacugcu

SEQ ID NO: 2278836 - RNA, 22 nt, Human
cauuuugggguacccacugcuc

SEQ ID NO: 2278837 - RNA, 12 nt, Human
cauuuucugugg

SEQ ID NO: 2278838 - RNA, 14 nt, Human
cauuuuauugcuug

SEQ ID NO: 2278839 - RNA, 21 nt, Human
cauuuuauuuuauuaugcaug

SEQ ID NO: 2278840 - RNA, 19 nt, Human
cauuuuauuuuauuaugca

SEQ ID NO: 2278841 - RNA, 22 nt, Human
cauuuuaauuuauuaauugcuu

SEQ ID NO: 2278842 - RNA, 19 nt, Human
cauuuuaauuuuaaccaaa

SEQ ID NO: 2278843 - RNA, 16 nt, Human
cauuuuauaugucaaa

SEQ ID NO: 2278844 - RNA, 19 nt, Human
cauuuuauaugucaaagca

SEQ ID NO: 2278845 - RNA, 13 nt, Human
cauuuuauugcuu

SEQ ID NO: 2278846 - RNA, 22 nt, Human
cauuuugcagcagugagucucu

SEQ ID NO: 2278847 - RNA, 20 nt, Human
cauuuugcagcagugagucu

SEQ ID NO: 2278848 - RNA, 18 nt, Human
cauuuugcagcagugagu

SEQ ID NO: 2278849 - RNA, 16 nt, Human
cauuuugcagcaguga

SEQ ID NO: 2278850 - RNA, 13 nt, Human
cauuuugcauuca

SEQ ID NO: 2278851 - RNA, 15 nt, Human
cauuuugcauucaaa

SEQ ID NO: 2278852 - RNA, 13 nt, Human
cauuuugccaaaa

SEQ ID NO: 2278853 - RNA, 15 nt, Human
cauuuugccaaaauu

SEQ ID NO: 2278854 - RNA, 15 nt, Human
cauuuugcagcagug

SEQ ID NO: 2278855 - RNA, 17 nt, Human
cauuuugcaaaauuucc

SEQ ID NO: 2278856 - RNA, 15 nt, Human
cauuuugcaaaauuu

SEQ ID NO: 2278857 - RNA, 14 nt, Human
cauuuugcaaaauu

SEQ ID NO: 2278858 - RNA, 13 nt, Human
cauuuugcaaaau

SEQ ID NO: 2278859 - RNA, 12 nt, Human
cauuuugcaaaa

SEQ ID NO: 2278860 - RNA, 17 nt, Human
cauuuugagugacucga

SEQ ID NO: 2278861 - RNA, 20 nt, Human
cauuuugagugacucgaggg

SEQ ID NO: 2278862 - RNA, 14 nt, Human
cauuuugaccuacu

SEQ ID NO: 2278863 - RNA, 21 nt, Human
cauuuugagcugaaaugcugc

SEQ ID NO: 2278864 - RNA, 22 nt, Human
cauuuugagcugaaaugcugca

SEQ ID NO: 2278865 - RNA, 23 nt, Human
cauuuugagcugaaaugcugcau

SEQ ID NO: 2278866 - RNA, 22 nt, Human
cauuuucuucagagagcuaaau

SEQ ID NO: 2278867 - RNA, 15 nt, Human
cauuuuaaauaaaag

SEQ ID NO: 2278868 - RNA, 16 nt, Human
cauuuuaaauaaaaga

SEQ ID NO: 2278869 - RNA, 17 nt, Human
cauuuuaaauaaaagaa

SEQ ID NO: 2278870 - RNA, 17 nt, Human
cauuuuaaauggacaga

SEQ ID NO: 2278871 - RNA, 13 nt, Human
cauuuuaaauaaa

SEQ ID NO: 2278872 - RNA, 23 nt, Human
cauuugagaaaugcauauuguau

SEQ ID NO: 2278873 - RNA, 16 nt, Human
cauuuuaacuuuauca

SEQ ID NO: 2278874 - RNA, 17 nt, Human
cauuuuaauuauuauuc

SEQ ID NO: 2278875 - RNA, 16 nt, Human
cauuuuaacaucugag

SEQ ID NO: 2278876 - RNA, 18 nt, Human
cauuuuaaauaaaagaaa

SEQ ID NO: 2278877 - RNA, 12 nt, Human
cauuuuaaaugg

SEQ ID NO: 2278878 - RNA, 15 nt, Human
cauuuuauauuagaa

SEQ ID NO: 2278879 - RNA, 23 nt, Human
cauuuuaauuuauuaauugcuuu

SEQ ID NO: 2278880 - RNA, 14 nt, Human
cauuuuaauucauc

SEQ ID NO: 2278881 - RNA, 15 nt, Human
cauuuuaaauggaca

SEQ ID NO: 2278882 - RNA, 22 nt, Human
cauuugaggucuguucuuucca

SEQ ID NO: 2278883 - RNA, 16 nt, Human
cauuugcucauggaau

SEQ ID NO: 2278884 - RNA, 15 nt, Human
cauuugcucauggaa

SEQ ID NO: 2278885 - RNA, 14 nt, Human
cauuugcucaugga

SEQ ID NO: 2278886 - RNA, 13 nt, Human
ccaaacgccuccc

SEQ ID NO: 2278887 - RNA, 22 nt, Human
ccaaaccugcaagggcucccca

SEQ ID NO: 2278888 - RNA, 21 nt, Human
ccaaaccucuguucaguguaa

SEQ ID NO: 2278889 - RNA, 15 nt, Human
ccaaaccugacagau

SEQ ID NO: 2278890 - RNA, 14 nt, Human
ccaaacugccuaag

SEQ ID NO: 2278891 - RNA, 19 nt, Human
ccaaacugccuaagcccuc

SEQ ID NO: 2278892 - RNA, 18 nt, Human
ccaaacuuggauuuuuga

SEQ ID NO: 2278893 - RNA, 17 nt, Human
ccaaagaaauguaaggg

SEQ ID NO: 2278894 - RNA, 18 nt, Human
ccaaagagccuggagaag

SEQ ID NO: 2278895 - RNA, 20 nt, Human
ccaaagagccuggagaagcu

SEQ ID NO: 2278896 - RNA, 14 nt, Human
ccaaagagccugga

SEQ ID NO: 2278897 - RNA, 15 nt, Human
ccaaagagccuggag

SEQ ID NO: 2278898 - RNA, 16 nt, Human
ccaaagagccuggaga

SEQ ID NO: 2278899 - RNA, 17 nt, Human
ccaaagagccuggagaa

SEQ ID NO: 2278900 - RNA, 17 nt, Human
ccaaagagacuggagca

SEQ ID NO: 2278901 - RNA, 21 nt, Human
ccaaagagacuggagcaucug

SEQ ID NO: 2278902 - RNA, 20 nt, Human
ccaaagagacuggagcaucu

SEQ ID NO: 2278903 - RNA, 12 nt, Human
ccaaagagccug

SEQ ID NO: 2278904 - RNA, 16 nt, Human
ccaaacuuggauuuuu

SEQ ID NO: 2278905 - RNA, 20 nt, Human
cauuuuuaguagagacaggg

SEQ ID NO: 2278906 - RNA, 21 nt, Human
ccaaaauaaaacuuuuuaaaa

SEQ ID NO: 2278907 - RNA, 18 nt, Human
ccaaaauaaaacuuuuua

SEQ ID NO: 2278908 - RNA, 14 nt, Human
ccaaaccuagcccc

SEQ ID NO: 2278909 - RNA, 17 nt, Human
ccaaaccgccagcgaac

SEQ ID NO: 2278910 - RNA, 19 nt, Human
ccaaaccuccaaaacuccu

SEQ ID NO: 2278911 - RNA, 20 nt, Human
ccaaaccucuguucagugua

SEQ ID NO: 2278912 - RNA, 17 nt, Human
ccaaaccucuguucagu

SEQ ID NO: 2278913 - RNA, 14 nt, Human
ccaaaccucuguuc

SEQ ID NO: 2278914 - RNA, 13 nt, Human
ccaaaccucuguu

SEQ ID NO: 2278915 - RNA, 12 nt, Human
ccaaaccucugu

SEQ ID NO: 2278916 - RNA, 11 nt, Human
ccaaaccucug

SEQ ID NO: 2278917 - RNA, 17 nt, Human
ccaaaccucugugagca

SEQ ID NO: 2278918 - RNA, 17 nt, Human
ccaaaauaagaaaagau

SEQ ID NO: 2278919 - RNA, 16 nt, Human
ccaaaauaagaaaaga

SEQ ID NO: 2278920 - RNA, 14 nt, Human
ccaaaauaagaaaa

SEQ ID NO: 2278921 - RNA, 17 nt, Human
ccaaaaguuuuccugag

SEQ ID NO: 2278922 - RNA, 18 nt, Human
ccaaaaguuuuccugaga

SEQ ID NO: 2278923 - RNA, 18 nt, Human
ccaaaauaagaaaagaug

SEQ ID NO: 2278924 - RNA, 20 nt, Human
ccaaaaucauaagauauuuu

SEQ ID NO: 2278925 - RNA, 16 nt, Human
ccaaaauccccuucuc

SEQ ID NO: 2278926 - RNA, 15 nt, Human
ccaaagagugauagu

SEQ ID NO: 2278927 - RNA, 16 nt, Human
cauuugagcagggcuc

SEQ ID NO: 2278928 - RNA, 17 nt, Human
cauuugaggucuguucu

SEQ ID NO: 2278929 - RNA, 19 nt, Human
cauuugaggucuguucuuu

SEQ ID NO: 2278930 - RNA, 18 nt, Human
cauuugaggucuguucuu

SEQ ID NO: 2278931 - RNA, 14 nt, Human
cauuugagcagggc

SEQ ID NO: 2278932 - RNA, 23 nt, Human
cauuugacugaagaugcagcuca

SEQ ID NO: 2278933 - RNA, 12 nt, Human
cauuugaaugca

SEQ ID NO: 2278934 - RNA, 12 nt, Human
cauuugagaaau

SEQ ID NO: 2278935 - RNA, 15 nt, Human
cauuugagaaaugca

SEQ ID NO: 2278936 - RNA, 17 nt, Human
cauuugagaaaugcaua

SEQ ID NO: 2278937 - RNA, 18 nt, Human
cauuugagaaaugcauau

SEQ ID NO: 2278938 - RNA, 22 nt, Human
cauuugagaaaugcauauugua

SEQ ID NO: 2278939 - RNA, 13 nt, Human
cauuugaaugcau

SEQ ID NO: 2278940 - RNA, 12 nt, Human
cauuucuuagac

SEQ ID NO: 2278941 - RNA, 14 nt, Human
cauuugaaugcauu

SEQ ID NO: 2278942 - RNA, 15 nt, Human
cauuugaaugcauuu

SEQ ID NO: 2278943 - RNA, 18 nt, Human
cauuugaaugcauuuugu

SEQ ID NO: 2278944 - RNA, 23 nt, Human
cauuugaaugcauuuuguuuggu

SEQ ID NO: 2278945 - RNA, 23 nt, Human
cauuucuuccacaagagcccagg

SEQ ID NO: 2278946 - RNA, 16 nt, Human
cauuucucugggguau

SEQ ID NO: 2278947 - RNA, 15 nt, Human
cauuucucuuacugc

SEQ ID NO: 2278948 - RNA, 18 nt, Human
cauuucucuuacugcaaa

SEQ ID NO: 2278949 - RNA, 20 nt, Human
cauuucuccuuugauaaaau

SEQ ID NO: 2278950 - RNA, 14 nt, Human
cauuucucuggggu

SEQ ID NO: 2278951 - RNA, 14 nt, Human
cauuucugaagugg

SEQ ID NO: 2278952 - RNA, 22 nt, Human
cauuucugaguuucauucuccu

SEQ ID NO: 2278953 - RNA, 21 nt, Human
cauuucuuccacaagagccca

SEQ ID NO: 2278954 - RNA, 23 nt, Human
cauuucugcaucagcugcugaaa

SEQ ID NO: 2278955 - RNA, 23 nt, Human
cauuucuauuuauuuacugagcu

SEQ ID NO: 2278956 - RNA, 20 nt, Human
cauuuccccagaccugagcu

SEQ ID NO: 2278957 - RNA, 16 nt, Human
cauuuccccagaccug

SEQ ID NO: 2278958 - RNA, 13 nt, Human
cauuuccccagac

SEQ ID NO: 2278959 - RNA, 20 nt, Human
cauuucccaucugcaccccu

SEQ ID NO: 2278960 - RNA, 19 nt, Human
cauuucuauuucuccucca

SEQ ID NO: 2278961 - RNA, 12 nt, Human
cauuucucaugu

SEQ ID NO: 2278962 - RNA, 12 nt, Human
cauuucucacug

SEQ ID NO: 2278963 - RNA, 13 nt, Human
cauuucucacuga

SEQ ID NO: 2278964 - RNA, 15 nt, Human
cauuucucuaagaga

SEQ ID NO: 2278965 - RNA, 21 nt, Human
cauuucucauguuuuccauug

SEQ ID NO: 2278966 - RNA, 23 nt, Human
cauuuagagaacuguggccguua

SEQ ID NO: 2278967 - RNA, 19 nt, Human
cauuuccacaccaagcagc

SEQ ID NO: 2278968 - RNA, 14 nt, Human
cauuucccaucugc

SEQ ID NO: 2278969 - RNA, 15 nt, Human
cauuucccaucugca

SEQ ID NO: 2278970 - RNA, 17 nt, Human
cauuucccaucugcacc

SEQ ID NO: 2278971 - RNA, 19 nt, Human
cauuuaaagcuuauuaaaa

SEQ ID NO: 2278972 - RNA, 17 nt, Human
cauuuacuuuguguuca

SEQ ID NO: 2278973 - RNA, 21 nt, Human
cauuuacuuuguguucaccuu

SEQ ID NO: 2278974 - RNA, 17 nt, Human
cauugcacagggagacg

SEQ ID NO: 2278975 - RNA, 23 nt, Human
cauugagaacugcauauguuucg

SEQ ID NO: 2278976 - RNA, 19 nt, Human
cauugagaacugcauaugu

SEQ ID NO: 2278977 - RNA, 18 nt, Human
cauugagaacugcauaug

SEQ ID NO: 2278978 - RNA, 18 nt, Human
cauugagaguuuugucuu

SEQ ID NO: 2278979 - RNA, 18 nt, Human
cauugcacuccagccugg

SEQ ID NO: 2278980 - RNA, 16 nt, Human
cauugcacuccagccu

SEQ ID NO: 2278981 - RNA, 17 nt, Human
cauugcacuccagccug

SEQ ID NO: 2278982 - RNA, 16 nt, Human
cauugcauauaacuua

SEQ ID NO: 2278983 - RNA, 15 nt, Human
cauugcacucuagcc

SEQ ID NO: 2278984 - RNA, 18 nt, Human
cauugcacucuagccugg

SEQ ID NO: 2278985 - RNA, 20 nt, Human
cauugcacucuagccugggc

SEQ ID NO: 2278986 - RNA, 12 nt, Human
cauuuaaaauga

SEQ ID NO: 2278987 - RNA, 21 nt, Human
cauuuaaaagauacaguuacu

SEQ ID NO: 2278988 - RNA, 17 nt, Human
cauuuaaaaugauuaga

SEQ ID NO: 2278989 - RNA, 18 nt, Human
cauuuaaaaugauuagaa

SEQ ID NO: 2278990 - RNA, 13 nt, Human
cauuuaaaaugau

SEQ ID NO: 2278991 - RNA, 14 nt, Human
cauuuaaaaugauu

SEQ ID NO: 2278992 - RNA, 15 nt, Human
cauuuaaaaugauua

SEQ ID NO: 2278993 - RNA, 16 nt, Human
cauuuaaaaugauuag

SEQ ID NO: 2278994 - RNA, 16 nt, Human
cauugaaagagaacca

SEQ ID NO: 2278995 - RNA, 19 nt, Human
cauugaaaucuuuuugcuu

SEQ ID NO: 2278996 - RNA, 19 nt, Human
cauugaaagagaaccaguu

SEQ ID NO: 2278997 - RNA, 18 nt, Human
cauugaaauucugagaaa

SEQ ID NO: 2278998 - RNA, 22 nt, Human
cauugaaagagaaccaguuuca

SEQ ID NO: 2278999 - RNA, 15 nt, Human
cauugaacacaaacu

SEQ ID NO: 2279000 - RNA, 14 nt, Human
cauugaacacaaac

SEQ ID NO: 2279001 - RNA, 18 nt, Human
cauugaacacaaacugua

SEQ ID NO: 2279002 - RNA, 17 nt, Human
cauugaacacaaacugu

SEQ ID NO: 2279003 - RNA, 16 nt, Human
cauugaacacaaacug

SEQ ID NO: 2279004 - RNA, 22 nt, Human
cauugaccgcgacuaauuucaa

SEQ ID NO: 2279005 - RNA, 21 nt, Human
cauugaccgcgacuaauuuca

SEQ ID NO: 2279006 - RNA, 14 nt, Human
cauugacauguaca

SEQ ID NO: 2279007 - RNA, 15 nt, Human
cauugacauguacag

SEQ ID NO: 2279008 - RNA, 16 nt, Human
cauugacauguacaga

SEQ ID NO: 2279009 - RNA, 17 nt, Human
cauugacauguacagag

SEQ ID NO: 2279010 - RNA, 19 nt, Human
cauugacauguacagagaa

SEQ ID NO: 2279011 - RNA, 21 nt, Human
cauugacauguacagagaacu

SEQ ID NO: 2279012 - RNA, 22 nt, Human
cauugacauguacagagaacua

SEQ ID NO: 2279013 - RNA, 22 nt, Human
cauugacuaucaaacugaagcc

SEQ ID NO: 2279014 - RNA, 19 nt, Human
cauugacuaucaaacugaa

SEQ ID NO: 2279015 - RNA, 18 nt, Human
cauugacuaucaaacuga

SEQ ID NO: 2279016 - RNA, 13 nt, Human
cauugaccugagg

SEQ ID NO: 2279017 - RNA, 22 nt, Human
cauugaccugaggcccuucucu

SEQ ID NO: 2279018 - RNA, 12 nt, Human
cauauuucaauu

SEQ ID NO: 2279019 - RNA, 22 nt, Human
cauauuuauagcaauccauguu

SEQ ID NO: 2279020 - RNA, 17 nt, Human
cauauuuauaaaaauaa

SEQ ID NO: 2279021 - RNA, 15 nt, Human
cauauuugagacuag

SEQ ID NO: 2279022 - RNA, 16 nt, Human
cauauuuuauagaacu

SEQ ID NO: 2279023 - RNA, 13 nt, Human
cauauuuuagcua

SEQ ID NO: 2279024 - RNA, 17 nt, Human
cauauuuacuucuuaua

SEQ ID NO: 2279025 - RNA, 16 nt, Human
cauauuuacuucuuau

SEQ ID NO: 2279026 - RNA, 20 nt, Human
cauauuuacuucuuauacau

SEQ ID NO: 2279027 - RNA, 12 nt, Human
cauauuuauaaa

SEQ ID NO: 2279028 - RNA, 14 nt, Human
cauauuuacuucuu

SEQ ID NO: 2279029 - RNA, 13 nt, Human
cauaugccugggc

SEQ ID NO: 2279030 - RNA, 16 nt, Human
cauaugcaccuugugu

SEQ ID NO: 2279031 - RNA, 17 nt, Human
cauaugcaccuuguguc

SEQ ID NO: 2279032 - RNA, 18 nt, Human
cauaugcaccuugugucu

SEQ ID NO: 2279033 - RNA, 19 nt, Human
cauaugcaccuugugucug

SEQ ID NO: 2279034 - RNA, 20 nt, Human
cauaugcaccuugugucugu

SEQ ID NO: 2279035 - RNA, 21 nt, Human
cauaugcaccuugugucugua

SEQ ID NO: 2279036 - RNA, 23 nt, Human
cauaugcaccuugugucuguaca

SEQ ID NO: 2279037 - RNA, 13 nt, Human
cauauuuuguaua

SEQ ID NO: 2279038 - RNA, 17 nt, Human
cauauuuuauucuuuua

SEQ ID NO: 2279039 - RNA, 19 nt, Human
cauauuuugauuauuguau

SEQ ID NO: 2279040 - RNA, 18 nt, Human
cauauuuucaccauuuga

SEQ ID NO: 2279041 - RNA, 17 nt, Human
cauauuuuauagaacuu

SEQ ID NO: 2279042 - RNA, 18 nt, Human
caucaaaaacuuuggagu

SEQ ID NO: 2279043 - RNA, 20 nt, Human
cauauuuugauuauuguauu

SEQ ID NO: 2279044 - RNA, 19 nt, Human
caucacaggguugggccca

SEQ ID NO: 2279045 - RNA, 20 nt, Human
caucacagggcagagccggg

SEQ ID NO: 2279046 - RNA, 15 nt, Human
caucacagggcagag

SEQ ID NO: 2279047 - RNA, 13 nt, Human
caucacagggcag

SEQ ID NO: 2279048 - RNA, 22 nt, Human
caucacaggacacggggcagug

SEQ ID NO: 2279049 - RNA, 17 nt, Human
caucacagcuaacaauu

SEQ ID NO: 2279050 - RNA, 12 nt, Human
caucacacacac

SEQ ID NO: 2279051 - RNA, 11 nt, Human
caucacacaca

SEQ ID NO: 2279052 - RNA, 18 nt, Human
caucaauguucauuguaa

SEQ ID NO: 2279053 - RNA, 14 nt, Human
caucaauguucauu

SEQ ID NO: 2279054 - RNA, 11 nt, Human
caucaauguuc

SEQ ID NO: 2279055 - RNA, 15 nt, Human
caucaaucauuguac

SEQ ID NO: 2279056 - RNA, 16 nt, Human
caucaaucauuguaca

SEQ ID NO: 2279057 - RNA, 20 nt, Human
caucaaucauuguacaguuu

SEQ ID NO: 2279058 - RNA, 16 nt, Human
caucaauguucauugu

SEQ ID NO: 2279059 - RNA, 15 nt, Human
caucaauguucauug

SEQ ID NO: 2279060 - RNA, 22 nt, Human
caucaauugaauggucagcguu

SEQ ID NO: 2279061 - RNA, 16 nt, Human
caucaauuauagaaag

SEQ ID NO: 2279062 - RNA, 23 nt, Human
caucaaguuauugacaaacucuc

SEQ ID NO: 2279063 - RNA, 14 nt, Human
caucaaucauugua

SEQ ID NO: 2279064 - RNA, 19 nt, Human
caucaauauugucauuccu

SEQ ID NO: 2279065 - RNA, 22 nt, Human
caucaaguuauugacaaacucu

SEQ ID NO: 2279066 - RNA, 21 nt, Human
caucaaguuauugacaaacuc

SEQ ID NO: 2279067 - RNA, 18 nt, Human
caucaaugaaugaaugaa

SEQ ID NO: 2279068 - RNA, 17 nt, Human
caucaaacucuuaguua

SEQ ID NO: 2279069 - RNA, 20 nt, Human
caucaaaagacaauucuuua

SEQ ID NO: 2279070 - RNA, 15 nt, Human
caucaaaaugcuuuu

SEQ ID NO: 2279071 - RNA, 13 nt, Human
caucaaaaugcuu

SEQ ID NO: 2279072 - RNA, 12 nt, Human
caucaaaagaca

SEQ ID NO: 2279073 - RNA, 14 nt, Human
caucaaaagacaau

SEQ ID NO: 2279074 - RNA, 15 nt, Human
caucaaaagacaauu

SEQ ID NO: 2279075 - RNA, 16 nt, Human
caucaaaagacaauuc

SEQ ID NO: 2279076 - RNA, 18 nt, Human
caucaaaagacaauucuu

SEQ ID NO: 2279077 - RNA, 19 nt, Human
caucaaaagacaauucuuu

SEQ ID NO: 2279078 - RNA, 22 nt, Human
caucaaaagacaauucuuuaua

SEQ ID NO: 2279079 - RNA, 15 nt, Human
caucaagacuggaag

SEQ ID NO: 2279080 - RNA, 16 nt, Human
caucaagacuggaagg

SEQ ID NO: 2279081 - RNA, 23 nt, Human
caucaaagaggcugaggcuggca

SEQ ID NO: 2279082 - RNA, 11 nt, Human
caucaaagagg

SEQ ID NO: 2279083 - RNA, 14 nt, Human
caucaagaugugac

SEQ ID NO: 2279084 - RNA, 23 nt, Human
caucaagcacagaaggaggagga

SEQ ID NO: 2279085 - RNA, 21 nt, Human
caucaagcacagaaggaggag

SEQ ID NO: 2279086 - RNA, 18 nt, Human
caucaagcacagaaggag

SEQ ID NO: 2279087 - RNA, 16 nt, Human
caucaaggcacugccu

SEQ ID NO: 2279088 - RNA, 17 nt, Human
caucaaggcacugccug

SEQ ID NO: 2279089 - RNA, 18 nt, Human
caucaaggcacugccuga

SEQ ID NO: 2279090 - RNA, 22 nt, Human
caucaagucuuucacauuuaaa

SEQ ID NO: 2279091 - RNA, 16 nt, Human
cauaucagucucugag

SEQ ID NO: 2279092 - RNA, 18 nt, Human
cauauccccuauuuaaca

SEQ ID NO: 2279093 - RNA, 18 nt, Human
cauauccaguauuguucc

SEQ ID NO: 2279094 - RNA, 16 nt, Human
cauauccaccaccucc

SEQ ID NO: 2279095 - RNA, 14 nt, Human
cauauccugagcca

SEQ ID NO: 2279096 - RNA, 18 nt, Human
cauauccccucucccccc

SEQ ID NO: 2279097 - RNA, 23 nt, Human
cauauccugagccaucggugaaa

SEQ ID NO: 2279098 - RNA, 20 nt, Human
cauaugacucacaugaugca

SEQ ID NO: 2279099 - RNA, 13 nt, Human
cauaugaggaugc

SEQ ID NO: 2279100 - RNA, 15 nt, Human
cauauccugagccau

SEQ ID NO: 2279101 - RNA, 22 nt, Human
cauaugacucacaugaugcaua

SEQ ID NO: 2279102 - RNA, 14 nt, Human
cauaugagugugga

SEQ ID NO: 2279103 - RNA, 17 nt, Human
cauaugaguguggaagc

SEQ ID NO: 2279104 - RNA, 19 nt, Human
cauaugaguguggaagccg

SEQ ID NO: 2279105 - RNA, 23 nt, Human
cauaugauugugcacauacuuga

SEQ ID NO: 2279106 - RNA, 15 nt, Human
cauaugauucugcuu

SEQ ID NO: 2279107 - RNA, 23 nt, Human
cauaugaguuucauagcuaagaa

SEQ ID NO: 2279108 - RNA, 14 nt, Human
cauaugauucugcu

SEQ ID NO: 2279109 - RNA, 21 nt, Human
cauaugauguacauguacuga

SEQ ID NO: 2279110 - RNA, 15 nt, Human
cauaugauguacaug

SEQ ID NO: 2279111 - RNA, 17 nt, Human
cauaugauguacaugua

SEQ ID NO: 2279112 - RNA, 22 nt, Human
cauauauauguuuuaagaggca

SEQ ID NO: 2279113 - RNA, 13 nt, Human
cauaucaguugag

SEQ ID NO: 2279114 - RNA, 19 nt, Human
cauaucaccucauggccua

SEQ ID NO: 2279115 - RNA, 23 nt, Human
cauaucaaaaaguauuaaaacua

SEQ ID NO: 2279116 - RNA, 17 nt, Human
cauauauaucuaucuua

SEQ ID NO: 2279117 - RNA, 18 nt, Human
cauauauaacuagcuaga

SEQ ID NO: 2279118 - RNA, 17 nt, Human
cauauacagcucagaag

SEQ ID NO: 2279119 - RNA, 24 nt, Human
cauauaaguuugaaggaaacaguu

SEQ ID NO: 2279120 - RNA, 15 nt, Human
cauauaauguuguua

SEQ ID NO: 2279121 - RNA, 22 nt, Human
cauauaaguuugaaggaaacag

SEQ ID NO: 2279122 - RNA, 23 nt, Human
cauauaaguuugaaggaaacagu

SEQ ID NO: 2279123 - RNA, 17 nt, Human
cauauaauguuguuauu

SEQ ID NO: 2279124 - RNA, 18 nt, Human
cauauaauguuguuauuu

SEQ ID NO: 2279125 - RNA, 19 nt, Human
cauaguucccauguuaaau

SEQ ID NO: 2279126 - RNA, 22 nt, Human
cauaguggcuuaaaacaacacu

SEQ ID NO: 2279127 - RNA, 23 nt, Human
cauaguggacauuguuggcagca

SEQ ID NO: 2279128 - RNA, 15 nt, Human
cauaguggugcagag

SEQ ID NO: 2279129 - RNA, 19 nt, Human
cauauaaacaucacacaca

SEQ ID NO: 2279130 - RNA, 17 nt, Human
cauaguuuuuacugaac

SEQ ID NO: 2279131 - RNA, 15 nt, Human
cauauaaguuugaag

SEQ ID NO: 2279132 - RNA, 20 nt, Human
cauauaaguuugaaggaaac

SEQ ID NO: 2279133 - RNA, 21 nt, Human
cauauaaguuugaaggaaaca

SEQ ID NO: 2279134 - RNA, 20 nt, Human
cauauaaacaucacacacac

SEQ ID NO: 2279135 - RNA, 19 nt, Human
cauauaaacuuuuuaaaga

SEQ ID NO: 2279136 - RNA, 18 nt, Human
cauaguaugguggcuggg

SEQ ID NO: 2279137 - RNA, 19 nt, Human
cauaguaugguggcugggu

SEQ ID NO: 2279138 - RNA, 20 nt, Human
cauaguaugguggcuggguu

SEQ ID NO: 2279139 - RNA, 22 nt, Human
cauagugaugguuccccuguuc

SEQ ID NO: 2279140 - RNA, 17 nt, Human
cauagaggugagggaag

SEQ ID NO: 2279141 - RNA, 23 nt, Human
cauagaggcuucuccgccagccu

SEQ ID NO: 2279142 - RNA, 21 nt, Human
cauagaggugagggaagccug

SEQ ID NO: 2279143 - RNA, 19 nt, Human
cauagaggcuucuccgcca

SEQ ID NO: 2279144 - RNA, 20 nt, Human
cauagaggcuucuccgccag

SEQ ID NO: 2279145 - RNA, 21 nt, Human
cauagaggcuucuccgccagc

SEQ ID NO: 2279146 - RNA, 22 nt, Human
cauagaggcuucuccgccagcc

SEQ ID NO: 2279147 - RNA, 22 nt, Human
cauagagagggagaagaaguca

SEQ ID NO: 2279148 - RNA, 17 nt, Human
cauagagaucauccuuu

SEQ ID NO: 2279149 - RNA, 12 nt, Human
cauagaggcuuc

SEQ ID NO: 2279150 - RNA, 15 nt, Human
cauagaggcuucucc

SEQ ID NO: 2279151 - RNA, 14 nt, Human
cauagaguuuaaca

SEQ ID NO: 2279152 - RNA, 15 nt, Human
cauagaguuuaacac

SEQ ID NO: 2279153 - RNA, 18 nt, Human
cauagaguuuaacacaag

SEQ ID NO: 2279154 - RNA, 23 nt, Human
cauagaucagcaaaccggggccu

SEQ ID NO: 2279155 - RNA, 13 nt, Human
cauacuuaucucu

SEQ ID NO: 2279156 - RNA, 16 nt, Human
cauacuuaucucucug

SEQ ID NO: 2279157 - RNA, 17 nt, Human
cauacugugcuggagcc

SEQ ID NO: 2279158 - RNA, 18 nt, Human
cauacugugcuggagcca

SEQ ID NO: 2279159 - RNA, 19 nt, Human
cauacugugcuggagccac

SEQ ID NO: 2279160 - RNA, 13 nt, Human
cauacuggccugg

SEQ ID NO: 2279161 - RNA, 15 nt, Human
cauacuggccuggac

SEQ ID NO: 2279162 - RNA, 18 nt, Human
cauacuggccuggacugu

SEQ ID NO: 2279163 - RNA, 22 nt, Human
cauacuggccuggacuguuuuc

SEQ ID NO: 2279164 - RNA, 11 nt, Human
cauacugcugu

SEQ ID NO: 2279165 - RNA, 20 nt, Human
cauacugagggaccaacugg

SEQ ID NO: 2279166 - RNA, 23 nt, Human
cauacucuagauuuuguuuugcu

SEQ ID NO: 2279167 - RNA, 12 nt, Human
cauacuggccuc

SEQ ID NO: 2279168 - RNA, 13 nt, Human
cauacuggccucg

SEQ ID NO: 2279169 - RNA, 15 nt, Human
cauacuggccucgcc

SEQ ID NO: 2279170 - RNA, 16 nt, Human
cauacuggccucgccu

SEQ ID NO: 2279171 - RNA, 17 nt, Human
cauacuggccucgccug

SEQ ID NO: 2279172 - RNA, 18 nt, Human
cauacuggccucgccugg

SEQ ID NO: 2279173 - RNA, 19 nt, Human
cauacuggccucgccuggc

SEQ ID NO: 2279174 - RNA, 20 nt, Human
cauacuggccucgccuggcc

SEQ ID NO: 2279175 - RNA, 21 nt, Human
cauacuggccucgccuggccu

SEQ ID NO: 2279176 - RNA, 22 nt, Human
cauacuggccucgccuggccug

SEQ ID NO: 2279177 - RNA, 20 nt, Human
cauacuccuuccaucaaaua

SEQ ID NO: 2279178 - RNA, 23 nt, Human
cauacuccaucaguuagagcuga

SEQ ID NO: 2279179 - RNA, 18 nt, Human
cauacuaucuacucuccu

SEQ ID NO: 2279180 - RNA, 19 nt, Human
cauacugagggaccaacug

SEQ ID NO: 2279181 - RNA, 15 nt, Human
cauacugagggacca

SEQ ID NO: 2279182 - RNA, 17 nt, Human
cauacucuagauuuugu

SEQ ID NO: 2279183 - RNA, 22 nt, Human
cauacucuagauuuuguuuugc

SEQ ID NO: 2279184 - RNA, 11 nt, Human
cauacucugcu

SEQ ID NO: 2279185 - RNA, 16 nt, Human
cauacucccaucugug

SEQ ID NO: 2279186 - RNA, 15 nt, Human
cauacucccaucugu

SEQ ID NO: 2279187 - RNA, 18 nt, Human
cauacucccaucugugaa

SEQ ID NO: 2279188 - RNA, 20 nt, Human
cauacucccaucugugaaag

SEQ ID NO: 2279189 - RNA, 15 nt, Human
cauagacccucucaa

SEQ ID NO: 2279190 - RNA, 16 nt, Human
cauagacccucucaag

SEQ ID NO: 2279191 - RNA, 18 nt, Human
cauagagagggagaagaa

SEQ ID NO: 2279192 - RNA, 19 nt, Human
cauagagagggagaagaag

SEQ ID NO: 2279193 - RNA, 23 nt, Human
cauagagagcaagacgcugugcu

SEQ ID NO: 2279194 - RNA, 19 nt, Human
cauagagagcaagacgcug

SEQ ID NO: 2279195 - RNA, 21 nt, Human
cauagagagcaagacgcugug

SEQ ID NO: 2279196 - RNA, 14 nt, Human
cauagaaggcaggu

SEQ ID NO: 2279197 - RNA, 23 nt, Human
cauagaaauguaacuuuuguaag

SEQ ID NO: 2279198 - RNA, 14 nt, Human
cauagaauaaaauu

SEQ ID NO: 2279199 - RNA, 16 nt, Human
cauagaaggcagguga

SEQ ID NO: 2279200 - RNA, 20 nt, Human
cauagaauaaaauuuuuaau

SEQ ID NO: 2279201 - RNA, 22 nt, Human
cauacuuuuuaaauguaaagau

SEQ ID NO: 2279202 - RNA, 14 nt, Human
cauacuuuccugua

SEQ ID NO: 2279203 - RNA, 17 nt, Human
cauacuuucauccugac

SEQ ID NO: 2279204 - RNA, 21 nt, Human
cauacuuucauccugacucug

SEQ ID NO: 2279205 - RNA, 22 nt, Human
cauacuuucauccugacucugc

SEQ ID NO: 2279206 - RNA, 12 nt, Human
cauacuuugucu

SEQ ID NO: 2279207 - RNA, 20 nt, Human
cauacuuuuuaaauguaaag

SEQ ID NO: 2279208 - RNA, 16 nt, Human
cauacuuuuuaaaugu

SEQ ID NO: 2279209 - RNA, 13 nt, Human
cauacuuugucug

SEQ ID NO: 2279210 - RNA, 14 nt, Human
cauacuuugucuga

SEQ ID NO: 2279211 - RNA, 16 nt, Human
cauacuuugucugaaa

SEQ ID NO: 2279212 - RNA, 18 nt, Human
cauacuuugucugaaaaa

SEQ ID NO: 2279213 - RNA, 18 nt, Human
cauacuucaugaaauccu

SEQ ID NO: 2279214 - RNA, 19 nt, Human
cauacuucaaaaguauuuu

SEQ ID NO: 2279215 - RNA, 22 nt, Human
cauacuucaaaaguauuuuccu

SEQ ID NO: 2279216 - RNA, 13 nt, Human
cauacuugaaggg

SEQ ID NO: 2279217 - RNA, 18 nt, Human
cauacuuaucucucugug

SEQ ID NO: 2279218 - RNA, 20 nt, Human
cauacuuaucucucugugcu

SEQ ID NO: 2279219 - RNA, 22 nt, Human
cauacuuaucucucugugcugu

SEQ ID NO: 2279220 - RNA, 14 nt, Human
cauacuucaaaagu

SEQ ID NO: 2279221 - RNA, 15 nt, Human
cauacuucaaaagua

SEQ ID NO: 2279222 - RNA, 16 nt, Human
cauacuucaaaaguau

SEQ ID NO: 2279223 - RNA, 17 nt, Human
cauacuucaaaaguauu

SEQ ID NO: 2279224 - RNA, 18 nt, Human
cauacuucaaaaguauuu

SEQ ID NO: 2279225 - RNA, 23 nt, Human
cauacuugaagggccagagccag

SEQ ID NO: 2279226 - RNA, 14 nt, Human
cauacuuucauccu

SEQ ID NO: 2279227 - RNA, 22 nt, Human
cauacuugaagggccagagcca

SEQ ID NO: 2279228 - RNA, 21 nt, Human
cauacuugaagggccagagcc

SEQ ID NO: 2279229 - RNA, 20 nt, Human
cauacuugaagggccagagc

SEQ ID NO: 2279230 - RNA, 18 nt, Human
cauacuugaagggccaga

SEQ ID NO: 2279231 - RNA, 17 nt, Human
cauacuugaagggccag

SEQ ID NO: 2279232 - RNA, 14 nt, Human
cauacuugaagggc

SEQ ID NO: 2279233 - RNA, 12 nt, Human
caucucaggggc

SEQ ID NO: 2279234 - RNA, 15 nt, Human
caucucaggggccag

SEQ ID NO: 2279235 - RNA, 16 nt, Human
caucucaggggccaga

SEQ ID NO: 2279236 - RNA, 19 nt, Human
caucucaggggccagagga

SEQ ID NO: 2279237 - RNA, 22 nt, Human
caucucaggccaccugcccccu

SEQ ID NO: 2279238 - RNA, 21 nt, Human
caucucaggccaccugccccc

SEQ ID NO: 2279239 - RNA, 20 nt, Human
caucucaggccaccugcccc

SEQ ID NO: 2279240 - RNA, 17 nt, Human
caucucaggccaccugc

SEQ ID NO: 2279241 - RNA, 18 nt, Human
caucucaggccucccuca

SEQ ID NO: 2279242 - RNA, 17 nt, Human
caucucauuccaacuuc

SEQ ID NO: 2279243 - RNA, 23 nt, Human
caucucauguaucaucuggauag

SEQ ID NO: 2279244 - RNA, 22 nt, Human
caucucauucaaaccccacccu

SEQ ID NO: 2279245 - RNA, 14 nt, Human
caucuccaagaaug

SEQ ID NO: 2279246 - RNA, 18 nt, Human
caucucagugcuguaaaa

SEQ ID NO: 2279247 - RNA, 22 nt, Human
caucucaugccccuggcuggga

SEQ ID NO: 2279248 - RNA, 20 nt, Human
caucucauguaucaucugga

SEQ ID NO: 2279249 - RNA, 15 nt, Human
caucucaggccaccu

SEQ ID NO: 2279250 - RNA, 14 nt, Human
caucucaggccacc

SEQ ID NO: 2279251 - RNA, 19 nt, Human
caucucacuggaugcaaag

SEQ ID NO: 2279252 - RNA, 18 nt, Human
caucucagacccuuuagc

SEQ ID NO: 2279253 - RNA, 20 nt, Human
caucucagccuaccaugaga

SEQ ID NO: 2279254 - RNA, 13 nt, Human
caucucagcccac

SEQ ID NO: 2279255 - RNA, 22 nt, Human
caucucaaggaauaaugggcuu

SEQ ID NO: 2279256 - RNA, 20 nt, Human
caucucacacaugagcauca

SEQ ID NO: 2279257 - RNA, 19 nt, Human
caucuaugucccuugcugu

SEQ ID NO: 2279258 - RNA, 16 nt, Human
caucuaucucaauccu

SEQ ID NO: 2279259 - RNA, 14 nt, Human
caucuauuucugag

SEQ ID NO: 2279260 - RNA, 13 nt, Human
caucuauuucuga

SEQ ID NO: 2279261 - RNA, 20 nt, Human
caucuauucucuccaaaaau

SEQ ID NO: 2279262 - RNA, 13 nt, Human
caucuauucucuc

SEQ ID NO: 2279263 - RNA, 14 nt, Human
caucuauaaauugu

SEQ ID NO: 2279264 - RNA, 15 nt, Human
caucuaucucaaucc

SEQ ID NO: 2279265 - RNA, 20 nt, Human
caucuaucucaucuaucuca

SEQ ID NO: 2279266 - RNA, 14 nt, Human
caucuauaaagaag

SEQ ID NO: 2279267 - RNA, 13 nt, Human
caucuaguuuuaa

SEQ ID NO: 2279268 - RNA, 22 nt, Human
caucuagugagcagucaggaaa

SEQ ID NO: 2279269 - RNA, 16 nt, Human
caucucaaccaucccc

SEQ ID NO: 2279270 - RNA, 14 nt, Human
caucucaaccaucc

SEQ ID NO: 2279271 - RNA, 15 nt, Human
caucuauuucugaga

SEQ ID NO: 2279272 - RNA, 16 nt, Human
caucuauuucugagaa

SEQ ID NO: 2279273 - RNA, 16 nt, Human
caucuauuuuggauug

SEQ ID NO: 2279274 - RNA, 14 nt, Human
caucuauuuuggau

SEQ ID NO: 2279275 - RNA, 16 nt, Human
caucucacacaugagc

SEQ ID NO: 2279276 - RNA, 17 nt, Human
caucucacacaugagca

SEQ ID NO: 2279277 - RNA, 20 nt, Human
cauccuccguccagccgcca

SEQ ID NO: 2279278 - RNA, 19 nt, Human
cauccuccguccagccgcc

SEQ ID NO: 2279279 - RNA, 13 nt, Human
cauccuccuccca

SEQ ID NO: 2279280 - RNA, 16 nt, Human
cauccuccucccaccc

SEQ ID NO: 2279281 - RNA, 20 nt, Human
cauccuccucccacccggcu

SEQ ID NO: 2279282 - RNA, 15 nt, Human
cauccucuguacaga

SEQ ID NO: 2279283 - RNA, 18 nt, Human
cauccucuguacagagcc

SEQ ID NO: 2279284 - RNA, 14 nt, Human
caucuaauaaaaaa

SEQ ID NO: 2279285 - RNA, 23 nt, Human
caucuaauagcggguuacuuuca

SEQ ID NO: 2279286 - RNA, 16 nt, Human
caucuaagccugaagg

SEQ ID NO: 2279287 - RNA, 12 nt, Human
caucuaagccug

SEQ ID NO: 2279288 - RNA, 21 nt, Human
cauccucuguacagagcccac

SEQ ID NO: 2279289 - RNA, 19 nt, Human
cauccucuguacagagccc

SEQ ID NO: 2279290 - RNA, 18 nt, Human
caucuagcaaauguuaug

SEQ ID NO: 2279291 - RNA, 14 nt, Human
caucuagcaaaugu

SEQ ID NO: 2279292 - RNA, 19 nt, Human
caucuagagcuugaugcca

SEQ ID NO: 2279293 - RNA, 17 nt, Human
caucuagguaaauuaca

SEQ ID NO: 2279294 - RNA, 18 nt, Human
caucuagguaaauuacag

SEQ ID NO: 2279295 - RNA, 14 nt, Human
caucuagugagcag

SEQ ID NO: 2279296 - RNA, 15 nt, Human
caucuacccuccgau

SEQ ID NO: 2279297 - RNA, 14 nt, Human
caucuacucccaag

SEQ ID NO: 2279298 - RNA, 16 nt, Human
caucuagagcuugaug

SEQ ID NO: 2279299 - RNA, 19 nt, Human
caucuacucccaaguaugg

SEQ ID NO: 2279300 - RNA, 19 nt, Human
caucuagaggcuuccuuca

SEQ ID NO: 2279301 - RNA, 12 nt, Human
caucuaggauuu

SEQ ID NO: 2279302 - RNA, 23 nt, Human
caucuagaggcuuccuucauuuc

SEQ ID NO: 2279303 - RNA, 22 nt, Human
caucuagaggcuuccuucauuu

SEQ ID NO: 2279304 - RNA, 21 nt, Human
caucuagaggcuuccuucauu

SEQ ID NO: 2279305 - RNA, 20 nt, Human
caucuagaggcuuccuucau

SEQ ID NO: 2279306 - RNA, 20 nt, Human
cauccuaaucauccaaugcu

SEQ ID NO: 2279307 - RNA, 13 nt, Human
cauccuacccucg

SEQ ID NO: 2279308 - RNA, 15 nt, Human
cauccuacccucggg

SEQ ID NO: 2279309 - RNA, 19 nt, Human
cauccuacccucgggccca

SEQ ID NO: 2279310 - RNA, 23 nt, Human
cauccuacccucgggcccaccug

SEQ ID NO: 2279311 - RNA, 16 nt, Human
cauccuacaagacaca

SEQ ID NO: 2279312 - RNA, 15 nt, Human
cauccucauacccac

SEQ ID NO: 2279313 - RNA, 16 nt, Human
cauccucauacccacc

SEQ ID NO: 2279314 - RNA, 21 nt, Human
cauccuacccucgggcccacc

SEQ ID NO: 2279315 - RNA, 13 nt, Human
cauccuagucucu

SEQ ID NO: 2279316 - RNA, 20 nt, Human
cauccuagucucuaucauua

SEQ ID NO: 2279317 - RNA, 16 nt, Human
cauccuaucagccugu

SEQ ID NO: 2279318 - RNA, 24 nt, Human
cauccuaucagccugucucuucca

SEQ ID NO: 2279319 - RNA, 15 nt, Human
cauccuaugcaauau

SEQ ID NO: 2279320 - RNA, 16 nt, Human
cauccucaaacacugc

SEQ ID NO: 2279321 - RNA, 17 nt, Human
cauccucaaacacugca

SEQ ID NO: 2279322 - RNA, 18 nt, Human
cauccucaaacacugcag

SEQ ID NO: 2279323 - RNA, 19 nt, Human
cauccucaaacacugcagg

SEQ ID NO: 2279324 - RNA, 16 nt, Human
cauccuccguccagcc

SEQ ID NO: 2279325 - RNA, 21 nt, Human
cauccuccccuucccugcaaa

SEQ ID NO: 2279326 - RNA, 20 nt, Human
cauccuccccuucccugcaa

SEQ ID NO: 2279327 - RNA, 20 nt, Human
cauccuccgccucccggguu

SEQ ID NO: 2279328 - RNA, 19 nt, Human
cauccuccccuucccugca

SEQ ID NO: 2279329 - RNA, 16 nt, Human
cauccuccccuucccu

SEQ ID NO: 2279330 - RNA, 15 nt, Human
cauccuccccuuccc

SEQ ID NO: 2279331 - RNA, 14 nt, Human
cauccuccccuucc

SEQ ID NO: 2279332 - RNA, 13 nt, Human
cauccuccccuuc

SEQ ID NO: 2279333 - RNA, 12 nt, Human
cauccuccccuu

SEQ ID NO: 2279334 - RNA, 11 nt, Human
cauccuccuca

SEQ ID NO: 2279335 - RNA, 12 nt, Human
cauccuccucag

SEQ ID NO: 2279336 - RNA, 15 nt, Human
cauccuccucagauc

SEQ ID NO: 2279337 - RNA, 16 nt, Human
cauccuccucagaucu

SEQ ID NO: 2279338 - RNA, 18 nt, Human
cauccuccucagaucuuc

SEQ ID NO: 2279339 - RNA, 19 nt, Human
cauccuccucagaucuucu

SEQ ID NO: 2279340 - RNA, 13 nt, Human
cauccucccaagg

SEQ ID NO: 2279341 - RNA, 12 nt, Human
cauccuccagcu

SEQ ID NO: 2279342 - RNA, 13 nt, Human
cauccuccagcuu

SEQ ID NO: 2279343 - RNA, 14 nt, Human
cauccuccagcuuc

SEQ ID NO: 2279344 - RNA, 15 nt, Human
cauccuccagcuucu

SEQ ID NO: 2279345 - RNA, 17 nt, Human
cauccuccagcuucugg

SEQ ID NO: 2279346 - RNA, 14 nt, Human
cauccuccagcagg

SEQ ID NO: 2279347 - RNA, 13 nt, Human
cauccuccagcag

SEQ ID NO: 2279348 - RNA, 16 nt, Human
cauccuccagcaggga

SEQ ID NO: 2279349 - RNA, 21 nt, Human
cauccuccacguucugcucau

SEQ ID NO: 2279350 - RNA, 14 nt, Human
cauccuccaagaau

SEQ ID NO: 2279351 - RNA, 20 nt, Human
cauccuccacguucugcuca

SEQ ID NO: 2279352 - RNA, 18 nt, Human
cauccuccacguucugcu

SEQ ID NO: 2279353 - RNA, 22 nt, Human
cauccucaaacacugcaggcau

SEQ ID NO: 2279354 - RNA, 17 nt, Human
cauccucauacccaccc

SEQ ID NO: 2279355 - RNA, 18 nt, Human
cauccucauacccacccc

SEQ ID NO: 2279356 - RNA, 21 nt, Human
cauccucauacccacccccac

SEQ ID NO: 2279357 - RNA, 22 nt, Human
cauccucauacccacccccacc

SEQ ID NO: 2279358 - RNA, 14 nt, Human
caucuuagugccug

SEQ ID NO: 2279359 - RNA, 20 nt, Human
caucuuaguauuugcauauu

SEQ ID NO: 2279360 - RNA, 22 nt, Human
caucugcaccccuucucuccuc

SEQ ID NO: 2279361 - RNA, 23 nt, Human
caucugcaccccuucucuccucc

SEQ ID NO: 2279362 - RNA, 21 nt, Human
caucuucacuucuaaaugcau

SEQ ID NO: 2279363 - RNA, 14 nt, Human
caucuucacuucua

SEQ ID NO: 2279364 - RNA, 13 nt, Human
caucuucagcuuc

SEQ ID NO: 2279365 - RNA, 14 nt, Human
caucuucagcuucu

SEQ ID NO: 2279366 - RNA, 14 nt, Human
caucuucaaagcuu

SEQ ID NO: 2279367 - RNA, 20 nt, Human
caucuuauuuucauguauau

SEQ ID NO: 2279368 - RNA, 12 nt, Human
caucuuccagaa

SEQ ID NO: 2279369 - RNA, 13 nt, Human
caucuuccagaag

SEQ ID NO: 2279370 - RNA, 22 nt, Human
caucuuccaaggguacuaagga

SEQ ID NO: 2279371 - RNA, 19 nt, Human
caucugcaccccccugggc

SEQ ID NO: 2279372 - RNA, 18 nt, Human
caucugcaccccccuggg

SEQ ID NO: 2279373 - RNA, 16 nt, Human
caucugcaccccuucu

SEQ ID NO: 2279374 - RNA, 17 nt, Human
caucugcaccccuucuc

SEQ ID NO: 2279375 - RNA, 19 nt, Human
caucugcaccccuucucuc

SEQ ID NO: 2279376 - RNA, 21 nt, Human
caucugcaccccuucucuccu

SEQ ID NO: 2279377 - RNA, 15 nt, Human
caucugagcaagagc

SEQ ID NO: 2279378 - RNA, 18 nt, Human
caucugagcaagagcugg

SEQ ID NO: 2279379 - RNA, 16 nt, Human
caucucuuguuuaaau

SEQ ID NO: 2279380 - RNA, 23 nt, Human
caucugagaaaagcuuugaaccc

SEQ ID NO: 2279381 - RNA, 14 nt, Human
caucugagaaaagc

SEQ ID NO: 2279382 - RNA, 16 nt, Human
caucuccaucagcugu

SEQ ID NO: 2279383 - RNA, 15 nt, Human
caucuccaucagcug

SEQ ID NO: 2279384 - RNA, 14 nt, Human
caucuccaucagcu

SEQ ID NO: 2279385 - RNA, 22 nt, Human
caucuccagggaguccccuccc

SEQ ID NO: 2279386 - RNA, 17 nt, Human
caucuccagggaguccc

SEQ ID NO: 2279387 - RNA, 19 nt, Human
caucuccagggaguccccu

SEQ ID NO: 2279388 - RNA, 20 nt, Human
caucuccagggaguccccuc

SEQ ID NO: 2279389 - RNA, 21 nt, Human
caucuccagggaguccccucc

SEQ ID NO: 2279390 - RNA, 21 nt, Human
caucucccaccuagcagcacc

SEQ ID NO: 2279391 - RNA, 17 nt, Human
caucuccaucuugaagg

SEQ ID NO: 2279392 - RNA, 18 nt, Human
caucucccagauaaugug

SEQ ID NO: 2279393 - RNA, 17 nt, Human
caucucccagauaaugu

SEQ ID NO: 2279394 - RNA, 14 nt, Human
caucuccacuccag

SEQ ID NO: 2279395 - RNA, 23 nt, Human
caucuccaagaaugcugaaacca

SEQ ID NO: 2279396 - RNA, 16 nt, Human
caucuccaccugcucc

SEQ ID NO: 2279397 - RNA, 20 nt, Human
caucuccaccugcucccagg

SEQ ID NO: 2279398 - RNA, 14 nt, Human
caucuccagggagu

SEQ ID NO: 2279399 - RNA, 16 nt, Human
caucuccaagaaugcu

SEQ ID NO: 2279400 - RNA, 17 nt, Human
caucuccaagaaugcug

SEQ ID NO: 2279401 - RNA, 18 nt, Human
caucuccaagaaugcuga

SEQ ID NO: 2279402 - RNA, 16 nt, Human
caucuccacccccagc

SEQ ID NO: 2279403 - RNA, 19 nt, Human
caucuccaagaaugcugaa

SEQ ID NO: 2279404 - RNA, 20 nt, Human
caucuccaagaaugcugaaa

SEQ ID NO: 2279405 - RNA, 20 nt, Human
caucucuugaggccaggagu

SEQ ID NO: 2279406 - RNA, 15 nt, Human
caucucuugaggcca

SEQ ID NO: 2279407 - RNA, 22 nt, Human
caucucuucuggguuccuuccu

SEQ ID NO: 2279408 - RNA, 19 nt, Human
caucucuuagcuccccucc

SEQ ID NO: 2279409 - RNA, 21 nt, Human
caucucuuagcuccccuccaa

SEQ ID NO: 2279410 - RNA, 23 nt, Human
caucucuuagcuccccuccaacc

SEQ ID NO: 2279411 - RNA, 23 nt, Human
caucucuuccuacccaaccacuc

SEQ ID NO: 2279412 - RNA, 21 nt, Human
caucucuuccuccgaggccag

SEQ ID NO: 2279413 - RNA, 16 nt, Human
caucucuuagcucccc

SEQ ID NO: 2279414 - RNA, 23 nt, Human
caucucuuacgcccaacccuucc

SEQ ID NO: 2279415 - RNA, 17 nt, Human
caucucuuagcuccccu

SEQ ID NO: 2279416 - RNA, 18 nt, Human
caucucuuagcuccccuc

SEQ ID NO: 2279417 - RNA, 22 nt, Human
caucucccagauaaugugaaaa

SEQ ID NO: 2279418 - RNA, 13 nt, Human
caucucuguccca

SEQ ID NO: 2279419 - RNA, 21 nt, Human
caucuucccagcagggccacu

SEQ ID NO: 2279420 - RNA, 12 nt, Human
caucuucccagc

SEQ ID NO: 2279421 - RNA, 14 nt, Human
caucuucccagcag

SEQ ID NO: 2279422 - RNA, 18 nt, Human
caucuuccagaaguguga

SEQ ID NO: 2279423 - RNA, 19 nt, Human
caucuuccagaagugugau

SEQ ID NO: 2279424 - RNA, 20 nt, Human
caucuuccagaagugugauu

SEQ ID NO: 2279425 - RNA, 21 nt, Human
caucuuccagaagugugauug

SEQ ID NO: 2279426 - RNA, 14 nt, Human
caucuuccaggugg

SEQ ID NO: 2279427 - RNA, 16 nt, Human
caucuuccaggugggg

SEQ ID NO: 2279428 - RNA, 21 nt, Human
caucuuccagguggggugagg

SEQ ID NO: 2279429 - RNA, 10 nt, Human
caucuuccca

SEQ ID NO: 2279430 - RNA, 17 nt, Human
caucuucuccaucuggc

SEQ ID NO: 2279431 - RNA, 16 nt, Human
caucuucuccaucugg

SEQ ID NO: 2279432 - RNA, 14 nt, Human
caucuucuccaucu

SEQ ID NO: 2279433 - RNA, 21 nt, Human
caucuucucagcucccauuuc

SEQ ID NO: 2279434 - RNA, 13 nt, Human
caucuucucagcu

SEQ ID NO: 2279435 - RNA, 14 nt, Human
caucuucucagcuc

SEQ ID NO: 2279436 - RNA, 17 nt, Human
caucuucucagcuccca

SEQ ID NO: 2279437 - RNA, 18 nt, Human
caucuucucagcucccau

SEQ ID NO: 2279438 - RNA, 22 nt, Human
caucuucccuagaggguuccug

SEQ ID NO: 2279439 - RNA, 12 nt, Human
caucuucucagc

SEQ ID NO: 2279440 - RNA, 21 nt, Human
caucuucuaaacccaauccaa

SEQ ID NO: 2279441 - RNA, 23 nt, Human
caucuugaucugcucagcccugg

SEQ ID NO: 2279442 - RNA, 21 nt, Human
caucuugaucugcucagcccu

SEQ ID NO: 2279443 - RNA, 22 nt, Human
caucuugaucugcucagcccug

SEQ ID NO: 2279444 - RNA, 24 nt, Human
caucuugaccaagcaggaagcuca

SEQ ID NO: 2279445 - RNA, 23 nt, Human
caucuugaccaagcaggaagcuc

SEQ ID NO: 2279446 - RNA, 19 nt, Human
caucuugaucugcucagcc

SEQ ID NO: 2279447 - RNA, 20 nt, Human
caucuugaucugcucagccc

SEQ ID NO: 2279448 - RNA, 22 nt, Human
caucuugaccaagcaggaagcu

SEQ ID NO: 2279449 - RNA, 21 nt, Human
caucuugaccaagcaggaagc

SEQ ID NO: 2279450 - RNA, 20 nt, Human
caucuugaccaagcaggaag

SEQ ID NO: 2279451 - RNA, 18 nt, Human
caucuugaccaagcagga

SEQ ID NO: 2279452 - RNA, 17 nt, Human
caucuugaccaagcagg

SEQ ID NO: 2279453 - RNA, 16 nt, Human
caucuugaccaagcag

SEQ ID NO: 2279454 - RNA, 15 nt, Human
caucuugaccaagca

SEQ ID NO: 2279455 - RNA, 13 nt, Human
caucuucugccuu

SEQ ID NO: 2279456 - RNA, 13 nt, Human
caucuugcucugc

SEQ ID NO: 2279457 - RNA, 14 nt, Human
caucuugcucugcu

SEQ ID NO: 2279458 - RNA, 13 nt, Human
caucuugcuuccc

SEQ ID NO: 2279459 - RNA, 14 nt, Human
caucuugcuucccu

SEQ ID NO: 2279460 - RNA, 20 nt, Human
caucuugcucugcugacaga

SEQ ID NO: 2279461 - RNA, 15 nt, Human
caucuugcuucccua

SEQ ID NO: 2279462 - RNA, 16 nt, Human
caucuuggagggacca

SEQ ID NO: 2279463 - RNA, 15 nt, Human
caucuuggggacauc

SEQ ID NO: 2279464 - RNA, 16 nt, Human
caucuuggggacaucu

SEQ ID NO: 2279465 - RNA, 18 nt, Human
caucuuggggacaucucu

SEQ ID NO: 2279466 - RNA, 20 nt, Human
caucuuggggacaucucuuu

SEQ ID NO: 2279467 - RNA, 11 nt, Human
caucuuggggg

SEQ ID NO: 2279468 - RNA, 12 nt, Human
caucuugguaaa

SEQ ID NO: 2279469 - RNA, 13 nt, Human
caucuugguaaau

SEQ ID NO: 2279470 - RNA, 14 nt, Human
caucuugguaaauu

SEQ ID NO: 2279471 - RNA, 16 nt, Human
cauccguaguucccug

SEQ ID NO: 2279472 - RNA, 22 nt, Human
caucccugaaggccccgcccag

SEQ ID NO: 2279473 - RNA, 21 nt, Human
cauccguaguucccugaaaac

SEQ ID NO: 2279474 - RNA, 18 nt, Human
cauccguaguucccugaa

SEQ ID NO: 2279475 - RNA, 17 nt, Human
cauccguaguucccuga

SEQ ID NO: 2279476 - RNA, 14 nt, Human
cauccuaacuccau

SEQ ID NO: 2279477 - RNA, 21 nt, Human
cauccuaacuccaugucucug

SEQ ID NO: 2279478 - RNA, 17 nt, Human
caucccugaaggccccg

SEQ ID NO: 2279479 - RNA, 18 nt, Human
caucccugaaggccccgc

SEQ ID NO: 2279480 - RNA, 19 nt, Human
caucccugaaggccccgcc

SEQ ID NO: 2279481 - RNA, 21 nt, Human
caucccugaaggccccgccca

SEQ ID NO: 2279482 - RNA, 15 nt, Human
cauccaaccccccac

SEQ ID NO: 2279483 - RNA, 21 nt, Human
cauccaaagcagacagcucca

SEQ ID NO: 2279484 - RNA, 18 nt, Human
cauccaaagcagacagcu

SEQ ID NO: 2279485 - RNA, 17 nt, Human
cauccaaagcagacagc

SEQ ID NO: 2279486 - RNA, 19 nt, Human
cauccaaccccccaccugc

SEQ ID NO: 2279487 - RNA, 16 nt, Human
cauccaaccccccacc

SEQ ID NO: 2279488 - RNA, 21 nt, Human
cauccaaccccccaccugcca

SEQ ID NO: 2279489 - RNA, 14 nt, Human
cauccaaccuuccc

SEQ ID NO: 2279490 - RNA, 14 nt, Human
cauccaaggagaaa

SEQ ID NO: 2279491 - RNA, 17 nt, Human
cauccaagagugcgccg

SEQ ID NO: 2279492 - RNA, 15 nt, Human
cauccaacuccagga

SEQ ID NO: 2279493 - RNA, 22 nt, Human
cauccaaggagaaacagagaca

SEQ ID NO: 2279494 - RNA, 21 nt, Human
cauccaaggagaaacagagac

SEQ ID NO: 2279495 - RNA, 21 nt, Human
cauccaaggccagguucuccg

SEQ ID NO: 2279496 - RNA, 16 nt, Human
cauccaaccuucccaa

SEQ ID NO: 2279497 - RNA, 18 nt, Human
cauccaaauaagaaaccu

SEQ ID NO: 2279498 - RNA, 15 nt, Human
caucauuguauauau

SEQ ID NO: 2279499 - RNA, 13 nt, Human
caucauuguauau

SEQ ID NO: 2279500 - RNA, 14 nt, Human
caucauuguauaua

SEQ ID NO: 2279501 - RNA, 24 nt, Human
caucauucucugucucauccauca

SEQ ID NO: 2279502 - RNA, 14 nt, Human
caucauugcacucu

SEQ ID NO: 2279503 - RNA, 19 nt, Human
caucauuguauauaugugu

SEQ ID NO: 2279504 - RNA, 16 nt, Human
cauccaaagcagacag

SEQ ID NO: 2279505 - RNA, 15 nt, Human
cauccaaagcagaca

SEQ ID NO: 2279506 - RNA, 23 nt, Human
cauccaaaauaguuaagacauga

SEQ ID NO: 2279507 - RNA, 16 nt, Human
caucauuuugcauuca

SEQ ID NO: 2279508 - RNA, 18 nt, Human
caucauuuugcauucaaa

SEQ ID NO: 2279509 - RNA, 20 nt, Human
caucauuuugcauucaaauu

SEQ ID NO: 2279510 - RNA, 17 nt, Human
caucauuuuuguaucua

SEQ ID NO: 2279511 - RNA, 22 nt, Human
caucauuuugcauucaaauuaa

SEQ ID NO: 2279512 - RNA, 18 nt, Human
caucauuuuuccuucccu

SEQ ID NO: 2279513 - RNA, 22 nt, Human
caucacaggguugggcccagau

SEQ ID NO: 2279514 - RNA, 13 nt, Human
caucacaguuuug

SEQ ID NO: 2279515 - RNA, 22 nt, Human
caucacaguuuugguugcuuua

SEQ ID NO: 2279516 - RNA, 21 nt, Human
caucacaguuuugguugcuuu

SEQ ID NO: 2279517 - RNA, 15 nt, Human
caucaccaacgucug

SEQ ID NO: 2279518 - RNA, 13 nt, Human
caucauugaaauc

SEQ ID NO: 2279519 - RNA, 22 nt, Human
caucauucucugucucauccau

SEQ ID NO: 2279520 - RNA, 21 nt, Human
caucauucucugucucaucca

SEQ ID NO: 2279521 - RNA, 13 nt, Human
caucacauuuuug

SEQ ID NO: 2279522 - RNA, 14 nt, Human
caucauugaaaucu

SEQ ID NO: 2279523 - RNA, 15 nt, Human
caucauugaaaucuu

SEQ ID NO: 2279524 - RNA, 20 nt, Human
caucauugaaaucuuuuugc

SEQ ID NO: 2279525 - RNA, 21 nt, Human
caucauugaaaucuuuuugcu

SEQ ID NO: 2279526 - RNA, 15 nt, Human
cauccacucuacccu

SEQ ID NO: 2279527 - RNA, 14 nt, Human
cauccacucuaccc

SEQ ID NO: 2279528 - RNA, 21 nt, Human
cauccacuagugcaaaucaua

SEQ ID NO: 2279529 - RNA, 22 nt, Human
cauccacuagugcaaaucauag

SEQ ID NO: 2279530 - RNA, 12 nt, Human
cauccaccuccu

SEQ ID NO: 2279531 - RNA, 13 nt, Human
cauccaccuccuu

SEQ ID NO: 2279532 - RNA, 14 nt, Human
cauccaccuccuuc

SEQ ID NO: 2279533 - RNA, 15 nt, Human
cauccaccuccuucu

SEQ ID NO: 2279534 - RNA, 16 nt, Human
cauccaccuccuucuc

SEQ ID NO: 2279535 - RNA, 14 nt, Human
cauccacuagugca

SEQ ID NO: 2279536 - RNA, 20 nt, Human
cauccacuagugcaaaucau

SEQ ID NO: 2279537 - RNA, 11 nt, Human
cauccagggcc

SEQ ID NO: 2279538 - RNA, 12 nt, Human
cauccaggcagu

SEQ ID NO: 2279539 - RNA, 21 nt, Human
cauccagggcccccaucucau

SEQ ID NO: 2279540 - RNA, 23 nt, Human
cauccaaugcucaagaaacaacu

SEQ ID NO: 2279541 - RNA, 18 nt, Human
cauccacacacgcaggaa

SEQ ID NO: 2279542 - RNA, 17 nt, Human
cauccacaugggagccg

SEQ ID NO: 2279543 - RNA, 17 nt, Human
cauccacauuguuuuaa

SEQ ID NO: 2279544 - RNA, 18 nt, Human
cauccacauuguuuuaaa

SEQ ID NO: 2279545 - RNA, 14 nt, Human
cauccaccccaucc

SEQ ID NO: 2279546 - RNA, 12 nt, Human
cauccaccccau

SEQ ID NO: 2279547 - RNA, 21 nt, Human
cauccacauuguuuuaaaaag

SEQ ID NO: 2279548 - RNA, 21 nt, Human
cauccaauccucacugggugg

SEQ ID NO: 2279549 - RNA, 19 nt, Human
cauccaaucuaaccacauc

SEQ ID NO: 2279550 - RNA, 19 nt, Human
cauccaauccucacugggu

SEQ ID NO: 2279551 - RNA, 18 nt, Human
cauccaauccucacuggg

SEQ ID NO: 2279552 - RNA, 14 nt, Human
cauccaaugcucaa

SEQ ID NO: 2279553 - RNA, 20 nt, Human
cauccaaucuaaccacauca

SEQ ID NO: 2279554 - RNA, 17 nt, Human
cauccaauccucacugg

SEQ ID NO: 2279555 - RNA, 16 nt, Human
cauccaauccucacug

SEQ ID NO: 2279556 - RNA, 15 nt, Human
cauccaauccucacu

SEQ ID NO: 2279557 - RNA, 14 nt, Human
cauccaauccucac

SEQ ID NO: 2279558 - RNA, 13 nt, Human
cauccaauccuca

SEQ ID NO: 2279559 - RNA, 23 nt, Human
cauccaaggagaaacagagacag

SEQ ID NO: 2279560 - RNA, 22 nt, Human
caucccuacccccuaagagcca

SEQ ID NO: 2279561 - RNA, 19 nt, Human
cauccagggcucugaccag

SEQ ID NO: 2279562 - RNA, 15 nt, Human
cauccagguucagcu

SEQ ID NO: 2279563 - RNA, 13 nt, Human
caucccuccccag

SEQ ID NO: 2279564 - RNA, 11 nt, Human
caucccugaag

SEQ ID NO: 2279565 - RNA, 13 nt, Human
caucccugaaggc

SEQ ID NO: 2279566 - RNA, 19 nt, Human
caucccucuggggcuguuc

SEQ ID NO: 2279567 - RNA, 14 nt, Human
caucccuccccagu

SEQ ID NO: 2279568 - RNA, 22 nt, Human
caguguucuguuuaauacucau

SEQ ID NO: 2279569 - RNA, 17 nt, Human
caguguuucccauaauu

SEQ ID NO: 2279570 - RNA, 15 nt, Human
caguguuucccauaa

SEQ ID NO: 2279571 - RNA, 14 nt, Human
caguguuucccaua

SEQ ID NO: 2279572 - RNA, 21 nt, Human
caguguuucccauaauuuucu

SEQ ID NO: 2279573 - RNA, 14 nt, Human
caguguuuccuuuu

SEQ ID NO: 2279574 - RNA, 20 nt, Human
caguguuucccauaauuuuc

SEQ ID NO: 2279575 - RNA, 18 nt, Human
caguguuucccauaauuu

SEQ ID NO: 2279576 - RNA, 22 nt, Human
caguuaacuuucagaagagaug

SEQ ID NO: 2279577 - RNA, 20 nt, Human
caguuaacuuucagaagaga

SEQ ID NO: 2279578 - RNA, 16 nt, Human
caguuaacuuucagaa

SEQ ID NO: 2279579 - RNA, 19 nt, Human
caguuaacuuuaagacuga

SEQ ID NO: 2279580 - RNA, 19 nt, Human
caguuaaaaaaaauuuuaa

SEQ ID NO: 2279581 - RNA, 16 nt, Human
caguuaaaaaaaauuu

SEQ ID NO: 2279582 - RNA, 15 nt, Human
caguuaaaaaaaauu

SEQ ID NO: 2279583 - RNA, 20 nt, Human
caguguuuuuguaaagugug

SEQ ID NO: 2279584 - RNA, 21 nt, Human
caguguuuuuguaaagugugg

SEQ ID NO: 2279585 - RNA, 15 nt, Human
caguguuuucuggga

SEQ ID NO: 2279586 - RNA, 22 nt, Human
caguguuuucugggauaaguaa

SEQ ID NO: 2279587 - RNA, 14 nt, Human
caguguuuuuguaa

SEQ ID NO: 2279588 - RNA, 15 nt, Human
caguguuuuuguaaa

SEQ ID NO: 2279589 - RNA, 19 nt, Human
caguguuuuuguaaagugu

SEQ ID NO: 2279590 - RNA, 16 nt, Human
caguguuaaaugaaau

SEQ ID NO: 2279591 - RNA, 17 nt, Human
caguguuaaaugaaauu

SEQ ID NO: 2279592 - RNA, 18 nt, Human
caguguuaaaugaaauug

SEQ ID NO: 2279593 - RNA, 15 nt, Human
caguguuaaaugaaa

SEQ ID NO: 2279594 - RNA, 17 nt, Human
caguguguuugugauug

SEQ ID NO: 2279595 - RNA, 19 nt, Human
caguguuaaaugugaugaa

SEQ ID NO: 2279596 - RNA, 14 nt, Human
caguguuaaaugug

SEQ ID NO: 2279597 - RNA, 16 nt, Human
caguguuaggccuggc

SEQ ID NO: 2279598 - RNA, 14 nt, Human
caguguuauuuucu

SEQ ID NO: 2279599 - RNA, 14 nt, Human
caguguuccccauc

SEQ ID NO: 2279600 - RNA, 19 nt, Human
caguguuagggaagggccu

SEQ ID NO: 2279601 - RNA, 18 nt, Human
caguguuccgugguuaaa

SEQ ID NO: 2279602 - RNA, 17 nt, Human
caguguuaggccuggca

SEQ ID NO: 2279603 - RNA, 18 nt, Human
caguguuaggccuggcac

SEQ ID NO: 2279604 - RNA, 19 nt, Human
caguguuaggccuggcaca

SEQ ID NO: 2279605 - RNA, 20 nt, Human
caguguuaggccuggcacag

SEQ ID NO: 2279606 - RNA, 21 nt, Human
caguguuaggccuggcacagu

SEQ ID NO: 2279607 - RNA, 22 nt, Human
caguguuaggccuggcacagug

SEQ ID NO: 2279608 - RNA, 23 nt, Human
caguguuaggccuggcacagugu

SEQ ID NO: 2279609 - RNA, 22 nt, Human
caguguuguggauuuaacagaa

SEQ ID NO: 2279610 - RNA, 20 nt, Human
caguguuguggauuuaacag

SEQ ID NO: 2279611 - RNA, 19 nt, Human
caguguuguggauuuaaca

SEQ ID NO: 2279612 - RNA, 18 nt, Human
caguguugagccuuuucc

SEQ ID NO: 2279613 - RNA, 13 nt, Human
caguguucuguuu

SEQ ID NO: 2279614 - RNA, 16 nt, Human
caguguucuguuuaau

SEQ ID NO: 2279615 - RNA, 19 nt, Human
caguguuccccaucugggu

SEQ ID NO: 2279616 - RNA, 21 nt, Human
caguguuccccaucugggucc

SEQ ID NO: 2279617 - RNA, 13 nt, Human
caguuaauuacau

SEQ ID NO: 2279618 - RNA, 20 nt, Human
caguuaagccuuuggaaaca

SEQ ID NO: 2279619 - RNA, 13 nt, Human
caguuacagaaag

SEQ ID NO: 2279620 - RNA, 14 nt, Human
caguuacagaaagu

SEQ ID NO: 2279621 - RNA, 15 nt, Human
caguuacagaaagug

SEQ ID NO: 2279622 - RNA, 14 nt, Human
caguuaagccuuug

SEQ ID NO: 2279623 - RNA, 17 nt, Human
caguuaagccuuuggaa

SEQ ID NO: 2279624 - RNA, 15 nt, Human
caguuaagccuuugg

SEQ ID NO: 2279625 - RNA, 13 nt, Human
caguuaagagaaa

SEQ ID NO: 2279626 - RNA, 14 nt, Human
caguuaagagaaau

SEQ ID NO: 2279627 - RNA, 20 nt, Human
caguucccuuggccucagaa

SEQ ID NO: 2279628 - RNA, 17 nt, Human
caguuccgauuucccag

SEQ ID NO: 2279629 - RNA, 18 nt, Human
caguuccgauuucccagg

SEQ ID NO: 2279630 - RNA, 19 nt, Human
caguucccuuggccucaga

SEQ ID NO: 2279631 - RNA, 18 nt, Human
caguucccuuggccucag

SEQ ID NO: 2279632 - RNA, 17 nt, Human
caguucccuuggccuca

SEQ ID NO: 2279633 - RNA, 16 nt, Human
caguucccuuggccuc

SEQ ID NO: 2279634 - RNA, 15 nt, Human
caguucccuuggccu

SEQ ID NO: 2279635 - RNA, 14 nt, Human
caguucccuuggcc

SEQ ID NO: 2279636 - RNA, 18 nt, Human
caguuccucgcccugggu

SEQ ID NO: 2279637 - RNA, 15 nt, Human
caguuccucuuugca

SEQ ID NO: 2279638 - RNA, 17 nt, Human
caguuccucgcccuggg

SEQ ID NO: 2279639 - RNA, 14 nt, Human
caguuccucgcccu

SEQ ID NO: 2279640 - RNA, 13 nt, Human
caguuccucgccc

SEQ ID NO: 2279641 - RNA, 20 nt, Human
caguuccggauuggcuugug

SEQ ID NO: 2279642 - RNA, 22 nt, Human
caguuccggauuggcuugugug

SEQ ID NO: 2279643 - RNA, 17 nt, Human
caguuccucuuugcaug

SEQ ID NO: 2279644 - RNA, 18 nt, Human
caguuccucuuugcaugg

SEQ ID NO: 2279645 - RNA, 23 nt, Human
caguuccucuuugcauggaauuu

SEQ ID NO: 2279646 - RNA, 13 nt, Human
caguucccuuggc

SEQ ID NO: 2279647 - RNA, 22 nt, Human
caguuacuaagaagaaaauugc

SEQ ID NO: 2279648 - RNA, 17 nt, Human
caguucccccaaccuca

SEQ ID NO: 2279649 - RNA, 18 nt, Human
caguucccccaaccucag

SEQ ID NO: 2279650 - RNA, 19 nt, Human
caguucccccaaccucaga

SEQ ID NO: 2279651 - RNA, 14 nt, Human
caguuacucagaau

SEQ ID NO: 2279652 - RNA, 19 nt, Human
caguuacuaagaagaaaau

SEQ ID NO: 2279653 - RNA, 22 nt, Human
caguuacaugcauacuucaaaa

SEQ ID NO: 2279654 - RNA, 17 nt, Human
caguuacagaaaguggu

SEQ ID NO: 2279655 - RNA, 21 nt, Human
caguuaccucugccucagaaa

SEQ ID NO: 2279656 - RNA, 15 nt, Human
caguuccuuucaaug

SEQ ID NO: 2279657 - RNA, 22 nt, Human
caguucggugagcuacaaaugc

SEQ ID NO: 2279658 - RNA, 13 nt, Human
caguucucuccuu

SEQ ID NO: 2279659 - RNA, 17 nt, Human
caguucuagucucucug

SEQ ID NO: 2279660 - RNA, 17 nt, Human
caguucuaguuugcauu

SEQ ID NO: 2279661 - RNA, 18 nt, Human
caguucuaguuugcauuc

SEQ ID NO: 2279662 - RNA, 19 nt, Human
caguucuaguuugcauucc

SEQ ID NO: 2279663 - RNA, 14 nt, Human
caguucucuccuuc

SEQ ID NO: 2279664 - RNA, 15 nt, Human
caguucucuccuucu

SEQ ID NO: 2279665 - RNA, 22 nt, Human
caguucucuccuucuucccccc

SEQ ID NO: 2279666 - RNA, 12 nt, Human
caguucugaaga

SEQ ID NO: 2279667 - RNA, 13 nt, Human
caguucugaagaa

SEQ ID NO: 2279668 - RNA, 14 nt, Human
caguucugaagaag

SEQ ID NO: 2279669 - RNA, 16 nt, Human
caguucucuucacuca

SEQ ID NO: 2279670 - RNA, 14 nt, Human
caguucugaagaau

SEQ ID NO: 2279671 - RNA, 21 nt, Human
caguucugaauaugcugcuca

SEQ ID NO: 2279672 - RNA, 22 nt, Human
caguucugaagaagaugguacc

SEQ ID NO: 2279673 - RNA, 15 nt, Human
caguucugaagaaga

SEQ ID NO: 2279674 - RNA, 16 nt, Human
caguucugaagaagau

SEQ ID NO: 2279675 - RNA, 15 nt, Human
caguucuuguguggu

SEQ ID NO: 2279676 - RNA, 24 nt, Human
caguucuucgggaagagaggaguu

SEQ ID NO: 2279677 - RNA, 16 nt, Human
caguucuugugugguu

SEQ ID NO: 2279678 - RNA, 19 nt, Human
caguucuucgggaagagag

SEQ ID NO: 2279679 - RNA, 20 nt, Human
caguucuucgggaagagagg

SEQ ID NO: 2279680 - RNA, 22 nt, Human
caguucuucgggaagagaggag

SEQ ID NO: 2279681 - RNA, 23 nt, Human
caguucuucgggaagagaggagu

SEQ ID NO: 2279682 - RNA, 20 nt, Human
caguucugggugcucccuac

SEQ ID NO: 2279683 - RNA, 17 nt, Human
caguucuucgggaagag

SEQ ID NO: 2279684 - RNA, 13 nt, Human
caguucugcagcu

SEQ ID NO: 2279685 - RNA, 13 nt, Human
caguucugcuccu

SEQ ID NO: 2279686 - RNA, 14 nt, Human
caguucugcuccuc

SEQ ID NO: 2279687 - RNA, 15 nt, Human
caguucugcuccucu

SEQ ID NO: 2279688 - RNA, 16 nt, Human
caguucugcuccucuc

SEQ ID NO: 2279689 - RNA, 17 nt, Human
caguucugggugcuccc

SEQ ID NO: 2279690 - RNA, 21 nt, Human
caguucugcuccucuccaggc

SEQ ID NO: 2279691 - RNA, 22 nt, Human
caguucugcuccucuccaggca

SEQ ID NO: 2279692 - RNA, 17 nt, Human
caguucugcuccucucc

SEQ ID NO: 2279693 - RNA, 18 nt, Human
caguucugcuccucucca

SEQ ID NO: 2279694 - RNA, 19 nt, Human
caguucugcuccucuccag

SEQ ID NO: 2279695 - RNA, 20 nt, Human
caguucugcuccucuccagg

SEQ ID NO: 2279696 - RNA, 19 nt, Human
caguugaaaaacagcugag

SEQ ID NO: 2279697 - RNA, 18 nt, Human
caguugaaaaacagcuga

SEQ ID NO: 2279698 - RNA, 12 nt, Human
caguugaaaaac

SEQ ID NO: 2279699 - RNA, 19 nt, Human
caguucuuugggccagaca

SEQ ID NO: 2279700 - RNA, 18 nt, Human
caguucuuugggccagac

SEQ ID NO: 2279701 - RNA, 17 nt, Human
caguucuuugggccaga

SEQ ID NO: 2279702 - RNA, 16 nt, Human
caguucuuugggccag

SEQ ID NO: 2279703 - RNA, 14 nt, Human
caguggauuaauua

SEQ ID NO: 2279704 - RNA, 19 nt, Human
caguggcacucaacaugag

SEQ ID NO: 2279705 - RNA, 16 nt, Human
caguggauugcauuuc

SEQ ID NO: 2279706 - RNA, 19 nt, Human
caguggcauggcuccaguc

SEQ ID NO: 2279707 - RNA, 17 nt, Human
caguggcauggcuccag

SEQ ID NO: 2279708 - RNA, 16 nt, Human
caguggcauggcucca

SEQ ID NO: 2279709 - RNA, 18 nt, Human
caguggcagggcucagga

SEQ ID NO: 2279710 - RNA, 13 nt, Human
caguggccacuca

SEQ ID NO: 2279711 - RNA, 14 nt, Human
caguggccacucag

SEQ ID NO: 2279712 - RNA, 15 nt, Human
caguggcauggcucc

SEQ ID NO: 2279713 - RNA, 14 nt, Human
caguggcagggcuc

SEQ ID NO: 2279714 - RNA, 15 nt, Human
caguggcagggcuca

SEQ ID NO: 2279715 - RNA, 17 nt, Human
caguggcagggcucagg

SEQ ID NO: 2279716 - RNA, 23 nt, Human
caguggccucaacccucccucag

SEQ ID NO: 2279717 - RNA, 20 nt, Human
caguggcucacgccuaugau

SEQ ID NO: 2279718 - RNA, 13 nt, Human
caguggcugcugc

SEQ ID NO: 2279719 - RNA, 22 nt, Human
caguggccucaacccucccuca

SEQ ID NO: 2279720 - RNA, 21 nt, Human
caguggccucaacccucccuc

SEQ ID NO: 2279721 - RNA, 20 nt, Human
caguggccucaacccucccu

SEQ ID NO: 2279722 - RNA, 19 nt, Human
caguggccucaacccuccc

SEQ ID NO: 2279723 - RNA, 16 nt, Human
caguggccucaacccu

SEQ ID NO: 2279724 - RNA, 19 nt, Human
caguggcuucaucugucaa

SEQ ID NO: 2279725 - RNA, 20 nt, Human
caguggcugguccagggcua

SEQ ID NO: 2279726 - RNA, 18 nt, Human
caguggcugguccagggc

SEQ ID NO: 2279727 - RNA, 19 nt, Human
caguggcugguccagggcu

SEQ ID NO: 2279728 - RNA, 21 nt, Human
cagugggaacgugacugcccc

SEQ ID NO: 2279729 - RNA, 20 nt, Human
cagugggaacgugacugccc

SEQ ID NO: 2279730 - RNA, 19 nt, Human
cagugggaacgugacugcc

SEQ ID NO: 2279731 - RNA, 14 nt, Human
cagugggaaauauu

SEQ ID NO: 2279732 - RNA, 12 nt, Human
cagugggaaaua

SEQ ID NO: 2279733 - RNA, 21 nt, Human
caguggcuucaucugucaagu

SEQ ID NO: 2279734 - RNA, 20 nt, Human
caguggcuggaucugugagg

SEQ ID NO: 2279735 - RNA, 18 nt, Human
caguggcuggaucuguga

SEQ ID NO: 2279736 - RNA, 16 nt, Human
caguggcuggaucugu

SEQ ID NO: 2279737 - RNA, 14 nt, Human
caguggcugcugcc

SEQ ID NO: 2279738 - RNA, 15 nt, Human
caguggcugcugccc

SEQ ID NO: 2279739 - RNA, 17 nt, Human
caguggcugcugcccag

SEQ ID NO: 2279740 - RNA, 18 nt, Human
caguggcugcugcccagg

SEQ ID NO: 2279741 - RNA, 13 nt, Human
cagugguugcugu

SEQ ID NO: 2279742 - RNA, 14 nt, Human
cagugguugcuguu

SEQ ID NO: 2279743 - RNA, 18 nt, Human
cagugguuugagacacug

SEQ ID NO: 2279744 - RNA, 22 nt, Human
cagugguuugagacacugguuu

SEQ ID NO: 2279745 - RNA, 15 nt, Human
cagugguuuuauacu

SEQ ID NO: 2279746 - RNA, 21 nt, Human
cagugguuuuauacugaagga

SEQ ID NO: 2279747 - RNA, 22 nt, Human
cagugguuccuaauccucuagg

SEQ ID NO: 2279748 - RNA, 14 nt, Human
cagugguuauuuag

SEQ ID NO: 2279749 - RNA, 22 nt, Human
cagugggaacgugacugcccca

SEQ ID NO: 2279750 - RNA, 11 nt, Human
cagugguuaag

SEQ ID NO: 2279751 - RNA, 11 nt, Human
cagugggaacu

SEQ ID NO: 2279752 - RNA, 22 nt, Human
caguggacaccaggagucccug

SEQ ID NO: 2279753 - RNA, 13 nt, Human
caguggacaccag

SEQ ID NO: 2279754 - RNA, 23 nt, Human
caguggaauauaaggaaagcaau

SEQ ID NO: 2279755 - RNA, 12 nt, Human
caguggcagcug

SEQ ID NO: 2279756 - RNA, 15 nt, Human
caguggaggaagagg

SEQ ID NO: 2279757 - RNA, 20 nt, Human
caguggaggaagagggacag

SEQ ID NO: 2279758 - RNA, 20 nt, Human
caguggacuuuccacccccu

SEQ ID NO: 2279759 - RNA, 19 nt, Human
caguggacuuuccaccccc

SEQ ID NO: 2279760 - RNA, 18 nt, Human
caguggacuuuccacccc

SEQ ID NO: 2279761 - RNA, 17 nt, Human
caguggacuuuccaccc

SEQ ID NO: 2279762 - RNA, 13 nt, Human
caguggaagaagc

SEQ ID NO: 2279763 - RNA, 23 nt, Human
caguggacuuuccacccccuccc

SEQ ID NO: 2279764 - RNA, 13 nt, Human
caguggagaauua

SEQ ID NO: 2279765 - RNA, 22 nt, Human
caguggacuuuccacccccucc

SEQ ID NO: 2279766 - RNA, 21 nt, Human
caguggacuuuccacccccuc

SEQ ID NO: 2279767 - RNA, 14 nt, Human
caguggagaauuau

SEQ ID NO: 2279768 - RNA, 13 nt, Human
caguggcagcugc

SEQ ID NO: 2279769 - RNA, 14 nt, Human
caguggcagcugcu

SEQ ID NO: 2279770 - RNA, 15 nt, Human
caguggcagcugcuu

SEQ ID NO: 2279771 - RNA, 16 nt, Human
caguggcagcugcuuu

SEQ ID NO: 2279772 - RNA, 21 nt, Human
cagugugaaguuagaauuccu

SEQ ID NO: 2279773 - RNA, 16 nt, Human
cagugugaggccaggg

SEQ ID NO: 2279774 - RNA, 18 nt, Human
cagugugaggccagggca

SEQ ID NO: 2279775 - RNA, 17 nt, Human
cagugugaggccagggc

SEQ ID NO: 2279776 - RNA, 19 nt, Human
cagugugaucccaagugcc

SEQ ID NO: 2279777 - RNA, 18 nt, Human
cagugugaucccaagugc

SEQ ID NO: 2279778 - RNA, 19 nt, Human
cagugugaggccagggcag

SEQ ID NO: 2279779 - RNA, 22 nt, Human
cagugugaucccaagugccagu

SEQ ID NO: 2279780 - RNA, 23 nt, Human
cagugugcacuaaggggcccggc

SEQ ID NO: 2279781 - RNA, 13 nt, Human
cagugugcccccc

SEQ ID NO: 2279782 - RNA, 19 nt, Human
cagugugcacuaaggggcc

SEQ ID NO: 2279783 - RNA, 15 nt, Human
cagugugcacuaagg

SEQ ID NO: 2279784 - RNA, 14 nt, Human
cagugugcccccca

SEQ ID NO: 2279785 - RNA, 15 nt, Human
cagugugccccccau

SEQ ID NO: 2279786 - RNA, 17 nt, Human
cagugugccccccaucc

SEQ ID NO: 2279787 - RNA, 19 nt, Human
cagugugccccccauccug

SEQ ID NO: 2279788 - RNA, 23 nt, Human
cagugugucuaaauuugaauguu

SEQ ID NO: 2279789 - RNA, 23 nt, Human
cagugugggaaugcggcaagaag

SEQ ID NO: 2279790 - RNA, 21 nt, Human
cagugugggaaugcggcaaga

SEQ ID NO: 2279791 - RNA, 14 nt, Human
cagugugucuaaau

SEQ ID NO: 2279792 - RNA, 20 nt, Human
cagugugccccccauccugg

SEQ ID NO: 2279793 - RNA, 22 nt, Human
cagugugccccccauccuggcc

SEQ ID NO: 2279794 - RNA, 23 nt, Human
cagugugccccccauccuggccc

SEQ ID NO: 2279795 - RNA, 11 nt, Human
caguguggaac

SEQ ID NO: 2279796 - RNA, 23 nt, Human
cagugucuuccauaauguauaaa

SEQ ID NO: 2279797 - RNA, 22 nt, Human
cagugucuuccauaauguauaa

SEQ ID NO: 2279798 - RNA, 20 nt, Human
cagugucuuccauaauguau

SEQ ID NO: 2279799 - RNA, 18 nt, Human
cagugucuuccauaaugu

SEQ ID NO: 2279800 - RNA, 17 nt, Human
cagugucuuccauaaug

SEQ ID NO: 2279801 - RNA, 16 nt, Human
cagugucuuccauaau

SEQ ID NO: 2279802 - RNA, 15 nt, Human
cagugucuuccauaa

SEQ ID NO: 2279803 - RNA, 14 nt, Human
cagugucuuccaua

SEQ ID NO: 2279804 - RNA, 24 nt, Human
cagugucuguaucggagacaguga

SEQ ID NO: 2279805 - RNA, 23 nt, Human
cagugucuguaucggagacagug

SEQ ID NO: 2279806 - RNA, 13 nt, Human
cagugucuguccc

SEQ ID NO: 2279807 - RNA, 14 nt, Human
cagugucugucccg

SEQ ID NO: 2279808 - RNA, 13 nt, Human
cagugucuuccau

SEQ ID NO: 2279809 - RNA, 16 nt, Human
cagugucugucccggg

SEQ ID NO: 2279810 - RNA, 22 nt, Human
cagugucuguaucggagacagu

SEQ ID NO: 2279811 - RNA, 18 nt, Human
cagugucugggcugacug

SEQ ID NO: 2279812 - RNA, 14 nt, Human
cagugucugggcug

SEQ ID NO: 2279813 - RNA, 15 nt, Human
cagugucugggcuga

SEQ ID NO: 2279814 - RNA, 14 nt, Human
cagugucucggagg

SEQ ID NO: 2279815 - RNA, 20 nt, Human
cagugucucacagcccugcu

SEQ ID NO: 2279816 - RNA, 13 nt, Human
cagugucugggcu

SEQ ID NO: 2279817 - RNA, 19 nt, Human
cagugucuggcugcagagc

SEQ ID NO: 2279818 - RNA, 17 nt, Human
cagugucuggcugcaga

SEQ ID NO: 2279819 - RNA, 13 nt, Human
cagugucuuccug

SEQ ID NO: 2279820 - RNA, 15 nt, Human
cagugucuuccugug

SEQ ID NO: 2279821 - RNA, 16 nt, Human
cagugucuuccugugg

SEQ ID NO: 2279822 - RNA, 17 nt, Human
cagugucuuccuguggg

SEQ ID NO: 2279823 - RNA, 13 nt, Human
cagugugaaguua

SEQ ID NO: 2279824 - RNA, 14 nt, Human
cagugugaaguuag

SEQ ID NO: 2279825 - RNA, 15 nt, Human
cagugugaaguuaga

SEQ ID NO: 2279826 - RNA, 17 nt, Human
cagugugaaguuagaau

SEQ ID NO: 2279827 - RNA, 20 nt, Human
cagugugaaguuagaauucc

SEQ ID NO: 2279828 - RNA, 14 nt, Human
cagugugacaagga

SEQ ID NO: 2279829 - RNA, 12 nt, Human
cagugugacuga

SEQ ID NO: 2279830 - RNA, 17 nt, Human
caguguacagucuugua

SEQ ID NO: 2279831 - RNA, 18 nt, Human
caguguacagucuuguau

SEQ ID NO: 2279832 - RNA, 16 nt, Human
caguguacauggaaua

SEQ ID NO: 2279833 - RNA, 12 nt, Human
caguguacaguc

SEQ ID NO: 2279834 - RNA, 15 nt, Human
caguguacagucuug

SEQ ID NO: 2279835 - RNA, 19 nt, Human
caguguaaauaguuacucc

SEQ ID NO: 2279836 - RNA, 17 nt, Human
caguguaaauaguuacu

SEQ ID NO: 2279837 - RNA, 20 nt, Human
cagugguuuuauacugaagg

SEQ ID NO: 2279838 - RNA, 12 nt, Human
caguguaauuuc

SEQ ID NO: 2279839 - RNA, 14 nt, Human
caguguaauuucuu

SEQ ID NO: 2279840 - RNA, 15 nt, Human
caguguaauuucuuu

SEQ ID NO: 2279841 - RNA, 16 nt, Human
caguguaauuucuuug

SEQ ID NO: 2279842 - RNA, 23 nt, Human
caguguacauggaauaacaugua

SEQ ID NO: 2279843 - RNA, 20 nt, Human
caguguacauggaauaacau

SEQ ID NO: 2279844 - RNA, 14 nt, Human
caguguacccccgc

SEQ ID NO: 2279845 - RNA, 17 nt, Human
caguguaauuucuuugc

SEQ ID NO: 2279846 - RNA, 20 nt, Human
caguguaauuucuuugccug

SEQ ID NO: 2279847 - RNA, 16 nt, Human
caguguacccccgccc

SEQ ID NO: 2279848 - RNA, 17 nt, Human
caguguacccccgccca

SEQ ID NO: 2279849 - RNA, 18 nt, Human
caguguacccccgcccag

SEQ ID NO: 2279850 - RNA, 19 nt, Human
caguguacccccgcccagg

SEQ ID NO: 2279851 - RNA, 20 nt, Human
caguguacccccgcccaggc

SEQ ID NO: 2279852 - RNA, 21 nt, Human
caguguacccccgcccaggcu

SEQ ID NO: 2279853 - RNA, 23 nt, Human
caguguacccccgcccaggcugg

SEQ ID NO: 2279854 - RNA, 18 nt, Human
caguguccucuugcucaa

SEQ ID NO: 2279855 - RNA, 21 nt, Human
caguguccccuccacugucac

SEQ ID NO: 2279856 - RNA, 14 nt, Human
cagugucccgggcc

SEQ ID NO: 2279857 - RNA, 16 nt, Human
caguguccccuccacu

SEQ ID NO: 2279858 - RNA, 17 nt, Human
caguguccccuccacug

SEQ ID NO: 2279859 - RNA, 19 nt, Human
caguguccccuccacuguc

SEQ ID NO: 2279860 - RNA, 20 nt, Human
caguguccccuccacuguca

SEQ ID NO: 2279861 - RNA, 15 nt, Human
caguguccccuccac

SEQ ID NO: 2279862 - RNA, 22 nt, Human
caguguccaaagcagggucugg

SEQ ID NO: 2279863 - RNA, 16 nt, Human
caguguccaaagcagg

SEQ ID NO: 2279864 - RNA, 17 nt, Human
caguguccaaagcaggg

SEQ ID NO: 2279865 - RNA, 16 nt, Human
caguguccuuagaaca

SEQ ID NO: 2279866 - RNA, 19 nt, Human
caguguccucuugcucaaa

SEQ ID NO: 2279867 - RNA, 20 nt, Human
caguguccuuagaacauuuu

SEQ ID NO: 2279868 - RNA, 12 nt, Human
cagugucucaca

SEQ ID NO: 2279869 - RNA, 16 nt, Human
cagugucucacacugg

SEQ ID NO: 2279870 - RNA, 18 nt, Human
cagugucucacacuggcg

SEQ ID NO: 2279871 - RNA, 15 nt, Human
cagugucucacagcc

SEQ ID NO: 2279872 - RNA, 19 nt, Human
caguguagccuugcccgga

SEQ ID NO: 2279873 - RNA, 17 nt, Human
caguguauggaaauaaa

SEQ ID NO: 2279874 - RNA, 22 nt, Human
caguguacccccgcccaggcug

SEQ ID NO: 2279875 - RNA, 15 nt, Human
caguguauuuguauu

SEQ ID NO: 2279876 - RNA, 23 nt, Human
caguguauuuguauuuuuuugca

SEQ ID NO: 2279877 - RNA, 16 nt, Human
cagugucaaauaaaca

SEQ ID NO: 2279878 - RNA, 17 nt, Human
cagugucaaauaaacac

SEQ ID NO: 2279879 - RNA, 18 nt, Human
cagugucaaauaaacacu

SEQ ID NO: 2279880 - RNA, 19 nt, Human
cagugucaaauaaacacug

SEQ ID NO: 2279881 - RNA, 20 nt, Human
cagugucaaauaaacacugu

SEQ ID NO: 2279882 - RNA, 20 nt, Human
cagugucauuuaugaaaaga

SEQ ID NO: 2279883 - RNA, 21 nt, Human
cagugucaaauaaacacugug

SEQ ID NO: 2279884 - RNA, 18 nt, Human
cagugucaaguugugcuu

SEQ ID NO: 2279885 - RNA, 19 nt, Human
cagugucaaguugugcuug

SEQ ID NO: 2279886 - RNA, 20 nt, Human
cagugucaaguugugcuugu

SEQ ID NO: 2279887 - RNA, 14 nt, Human
cagugucaaugcag

SEQ ID NO: 2279888 - RNA, 14 nt, Human
caguuguagaaugu

SEQ ID NO: 2279889 - RNA, 15 nt, Human
caguuguagaaugua

SEQ ID NO: 2279890 - RNA, 17 nt, Human
caguuguagaauguauu

SEQ ID NO: 2279891 - RNA, 18 nt, Human
caguuguagaauguauug

SEQ ID NO: 2279892 - RNA, 19 nt, Human
caguuguagaauguauugu

SEQ ID NO: 2279893 - RNA, 17 nt, Human
caguugggugagaacaa

SEQ ID NO: 2279894 - RNA, 21 nt, Human
caguuguagaauguauuguac

SEQ ID NO: 2279895 - RNA, 17 nt, Human
caguuguuagugugucu

SEQ ID NO: 2279896 - RNA, 15 nt, Human
caguuuucugagaaa

SEQ ID NO: 2279897 - RNA, 14 nt, Human
caguuuucugagaa

SEQ ID NO: 2279898 - RNA, 15 nt, Human
caguuuuuauugcuu

SEQ ID NO: 2279899 - RNA, 22 nt, Human
caguuuuucagaguggaaugcu

SEQ ID NO: 2279900 - RNA, 18 nt, Human
caguuuuucuguauuuua

SEQ ID NO: 2279901 - RNA, 16 nt, Human
caguuuuucuguauuu

SEQ ID NO: 2279902 - RNA, 17 nt, Human
caguuuuucuguauuuu

SEQ ID NO: 2279903 - RNA, 10 nt, Human
caguuuuucu

SEQ ID NO: 2279904 - RNA, 16 nt, Human
caguuuuuuaugcuaa

SEQ ID NO: 2279905 - RNA, 22 nt, Human
caguuuuccuucucaucuguga

SEQ ID NO: 2279906 - RNA, 17 nt, Human
caguuuugguugcuuua

SEQ ID NO: 2279907 - RNA, 20 nt, Human
caguuuucuggcuggagccu

SEQ ID NO: 2279908 - RNA, 19 nt, Human
caguuuugguugcuuuaau

SEQ ID NO: 2279909 - RNA, 18 nt, Human
caguuuugguugcuuuaa

SEQ ID NO: 2279910 - RNA, 20 nt, Human
caguuuucugagaaagacua

SEQ ID NO: 2279911 - RNA, 19 nt, Human
caguuuucugagaaagacu

SEQ ID NO: 2279912 - RNA, 18 nt, Human
caguuggguggaugccug

SEQ ID NO: 2279913 - RNA, 19 nt, Human
caguuggguggaugccugg

SEQ ID NO: 2279914 - RNA, 18 nt, Human
caguuggucccccuucca

SEQ ID NO: 2279915 - RNA, 20 nt, Human
caguugggagcacuggagug

SEQ ID NO: 2279916 - RNA, 21 nt, Human
caguugggagcacuggagugc

SEQ ID NO: 2279917 - RNA, 19 nt, Human
caguuggucccccuuccau

SEQ ID NO: 2279918 - RNA, 20 nt, Human
caguuggucccccuuccaug

SEQ ID NO: 2279919 - RNA, 21 nt, Human
caguuggucccccuuccaugg

SEQ ID NO: 2279920 - RNA, 22 nt, Human
caguuggucccccuuccaugga

SEQ ID NO: 2279921 - RNA, 23 nt, Human
caguugccagucaccccggccac

SEQ ID NO: 2279922 - RNA, 14 nt, Human
caguugggagcacu

SEQ ID NO: 2279923 - RNA, 16 nt, Human
caguuggccuucagaa

SEQ ID NO: 2279924 - RNA, 17 nt, Human
caguuggccagagagcc

SEQ ID NO: 2279925 - RNA, 15 nt, Human
caguugggagcacug

SEQ ID NO: 2279926 - RNA, 16 nt, Human
caguugggagcacugg

SEQ ID NO: 2279927 - RNA, 17 nt, Human
caguugggagcacugga

SEQ ID NO: 2279928 - RNA, 18 nt, Human
caguugggagcacuggag

SEQ ID NO: 2279929 - RNA, 16 nt, Human
caguuggguggaugcc

SEQ ID NO: 2279930 - RNA, 16 nt, Human
caguuggccagagagc

SEQ ID NO: 2279931 - RNA, 18 nt, Human
caguuggaaauccaucca

SEQ ID NO: 2279932 - RNA, 22 nt, Human
caguucuuugggccagacaugc

SEQ ID NO: 2279933 - RNA, 21 nt, Human
caguucuuugggccagacaug

SEQ ID NO: 2279934 - RNA, 20 nt, Human
caguucuuugggccagacau

SEQ ID NO: 2279935 - RNA, 18 nt, Human
caguugaaaagacuccaa

SEQ ID NO: 2279936 - RNA, 14 nt, Human
caguugaaaagacu

SEQ ID NO: 2279937 - RNA, 14 nt, Human
caguugacagcagg

SEQ ID NO: 2279938 - RNA, 16 nt, Human
caguugacagcaggug

SEQ ID NO: 2279939 - RNA, 20 nt, Human
caguugaaugacaacagaag

SEQ ID NO: 2279940 - RNA, 21 nt, Human
caguugaaugacaacagaagc

SEQ ID NO: 2279941 - RNA, 21 nt, Human
caguugaauuuauggaaucua

SEQ ID NO: 2279942 - RNA, 23 nt, Human
caguugaaaagacuccaaagaaa

SEQ ID NO: 2279943 - RNA, 22 nt, Human
caguugaaaagacuccaaagaa

SEQ ID NO: 2279944 - RNA, 21 nt, Human
caguugaaaagacuccaaaga

SEQ ID NO: 2279945 - RNA, 20 nt, Human
caguugcacuuggccucugg

SEQ ID NO: 2279946 - RNA, 19 nt, Human
caguugcacuuggccucug

SEQ ID NO: 2279947 - RNA, 13 nt, Human
caguugcacuugg

SEQ ID NO: 2279948 - RNA, 16 nt, Human
caguugcacuuggccu

SEQ ID NO: 2279949 - RNA, 15 nt, Human
caguugcaauaauac

SEQ ID NO: 2279950 - RNA, 20 nt, Human
caguugagucgucaucacuu

SEQ ID NO: 2279951 - RNA, 17 nt, Human
caguugcaauaauacuu

SEQ ID NO: 2279952 - RNA, 16 nt, Human
cauaaccuagccuuag

SEQ ID NO: 2279953 - RNA, 12 nt, Human
cauaaccccacc

SEQ ID NO: 2279954 - RNA, 13 nt, Human
cauaaccccaccc

SEQ ID NO: 2279955 - RNA, 20 nt, Human
cauaaccccacccuugccca

SEQ ID NO: 2279956 - RNA, 17 nt, Human
cauaacggaucagaaau

SEQ ID NO: 2279957 - RNA, 21 nt, Human
cauaacggaucagaaauacag

SEQ ID NO: 2279958 - RNA, 18 nt, Human
cauaaccuuaccagauuu

SEQ ID NO: 2279959 - RNA, 17 nt, Human
cauaacaauuccucuac

SEQ ID NO: 2279960 - RNA, 16 nt, Human
cauaacaauuccucua

SEQ ID NO: 2279961 - RNA, 15 nt, Human
cauaacaauuccucu

SEQ ID NO: 2279962 - RNA, 14 nt, Human
cauaacaauuccuc

SEQ ID NO: 2279963 - RNA, 15 nt, Human
cauaacaacuucaua

SEQ ID NO: 2279964 - RNA, 21 nt, Human
cauaaagccuuggauguauau

SEQ ID NO: 2279965 - RNA, 15 nt, Human
cauaaagucagugcc

SEQ ID NO: 2279966 - RNA, 22 nt, Human
cauaaaggugguaugugugugu

SEQ ID NO: 2279967 - RNA, 20 nt, Human
cauaaaggugguaugugugu

SEQ ID NO: 2279968 - RNA, 12 nt, Human
cauaaauaugca

SEQ ID NO: 2279969 - RNA, 18 nt, Human
cauaaauaaaaugaccag

SEQ ID NO: 2279970 - RNA, 23 nt, Human
cauaaaggugguaugugugugua

SEQ ID NO: 2279971 - RNA, 14 nt, Human
cauaaauaaaauga

SEQ ID NO: 2279972 - RNA, 13 nt, Human
cauaaauaugcag

SEQ ID NO: 2279973 - RNA, 15 nt, Human
cauaaauaugcagug

SEQ ID NO: 2279974 - RNA, 20 nt, Human
cauaaauaugcagugauaug

SEQ ID NO: 2279975 - RNA, 14 nt, Human
cauaaaugaggaaa

SEQ ID NO: 2279976 - RNA, 18 nt, Human
cauaaauaugcagugaua

SEQ ID NO: 2279977 - RNA, 13 nt, Human
cauaaaugaauuu

SEQ ID NO: 2279978 - RNA, 13 nt, Human
cauaaaugaagca

SEQ ID NO: 2279979 - RNA, 14 nt, Human
cauaaaugaagcag

SEQ ID NO: 2279980 - RNA, 13 nt, Human
cauaaaaagcuga

SEQ ID NO: 2279981 - RNA, 12 nt, Human
cauaaaacaggu

SEQ ID NO: 2279982 - RNA, 11 nt, Human
cauaaaacauu

SEQ ID NO: 2279983 - RNA, 21 nt, Human
cauaaaaauuagccaagugug

SEQ ID NO: 2279984 - RNA, 19 nt, Human
cauaaaauaaaguauauau

SEQ ID NO: 2279985 - RNA, 23 nt, Human
cauaaaacauuaagaaaaucaua

SEQ ID NO: 2279986 - RNA, 16 nt, Human
cauaaaacauuaagaa

SEQ ID NO: 2279987 - RNA, 17 nt, Human
cauaaaacauuaagaaa

SEQ ID NO: 2279988 - RNA, 18 nt, Human
cauaaaacauuaagaaaa

SEQ ID NO: 2279989 - RNA, 19 nt, Human
cauaaaacauuaagaaaau

SEQ ID NO: 2279990 - RNA, 20 nt, Human
cauaaaauaaaguauauaua

SEQ ID NO: 2279991 - RNA, 22 nt, Human
cauaaaacauuaagaaaaucau

SEQ ID NO: 2279992 - RNA, 22 nt, Human
cauaaaauuuucuacucuuuuu

SEQ ID NO: 2279993 - RNA, 23 nt, Human
cauaaaaagcaaaacaaaaauua

SEQ ID NO: 2279994 - RNA, 23 nt, Human
cauaaaaagccugcaauuucaua

SEQ ID NO: 2279995 - RNA, 15 nt, Human
cauaaacugugugca

SEQ ID NO: 2279996 - RNA, 14 nt, Human
cauaaacugugugc

SEQ ID NO: 2279997 - RNA, 12 nt, Human
cauaaacuucau

SEQ ID NO: 2279998 - RNA, 16 nt, Human
cauaaacuucaugguc

SEQ ID NO: 2279999 - RNA, 20 nt, Human
cauaaaccuuaaguaagcaa

SEQ ID NO: 2280000 - RNA, 13 nt, Human
cauaaacugacuu

SEQ ID NO: 2280001 - RNA, 15 nt, Human
cauaaacugacuuua

SEQ ID NO: 2280002 - RNA, 17 nt, Human
cauaaacugacuuuauc

SEQ ID NO: 2280003 - RNA, 12 nt, Human
cauaaagaagca

SEQ ID NO: 2280004 - RNA, 21 nt, Human
cauaaagaagcaauaaagaag

SEQ ID NO: 2280005 - RNA, 18 nt, Human
cauaaagaagauguuuaa

SEQ ID NO: 2280006 - RNA, 19 nt, Human
cauaaagaagauguuuaac

SEQ ID NO: 2280007 - RNA, 21 nt, Human
cauaaagaagauguuuaacuu

SEQ ID NO: 2280008 - RNA, 11 nt, Human
cauaaagaagc

SEQ ID NO: 2280009 - RNA, 14 nt, Human
cauaaagcaggcag

SEQ ID NO: 2280010 - RNA, 16 nt, Human
cauaaagcaggcagaa

SEQ ID NO: 2280011 - RNA, 21 nt, Human
cauaaacaagaccacguuucu

SEQ ID NO: 2280012 - RNA, 20 nt, Human
cauaaacaagaccacguuuc

SEQ ID NO: 2280013 - RNA, 21 nt, Human
cauaaacccaguugccaucug

SEQ ID NO: 2280014 - RNA, 12 nt, Human
cauaaaccuuaa

SEQ ID NO: 2280015 - RNA, 14 nt, Human
cauaaaccuuaagu

SEQ ID NO: 2280016 - RNA, 22 nt, Human
cauaaacaagaccacguuucua

SEQ ID NO: 2280017 - RNA, 17 nt, Human
cauaauaagcuaaagag

SEQ ID NO: 2280018 - RNA, 18 nt, Human
cauaauaaauaucuguac

SEQ ID NO: 2280019 - RNA, 12 nt, Human
cauaaguuucug

SEQ ID NO: 2280020 - RNA, 19 nt, Human
cauaaguauuaugucucuu

SEQ ID NO: 2280021 - RNA, 15 nt, Human
cauaaguauuucaaa

SEQ ID NO: 2280022 - RNA, 18 nt, Human
cauaaguaauucaagaaa

SEQ ID NO: 2280023 - RNA, 22 nt, Human
cauaaguaauucaagaaaacaa

SEQ ID NO: 2280024 - RNA, 22 nt, Human
cauaagguuucguuucuguaua

SEQ ID NO: 2280025 - RNA, 15 nt, Human
cauaagguuucguuu

SEQ ID NO: 2280026 - RNA, 21 nt, Human
cauaagguuucguuucuguau

SEQ ID NO: 2280027 - RNA, 16 nt, Human
cauaaguaauucaaga

SEQ ID NO: 2280028 - RNA, 17 nt, Human
cauaaguaauucaagaa

SEQ ID NO: 2280029 - RNA, 22 nt, Human
cauaagcuauagacccgaggaa

SEQ ID NO: 2280030 - RNA, 14 nt, Human
cauaagcucagaau

SEQ ID NO: 2280031 - RNA, 16 nt, Human
cauaagcucagaaucc

SEQ ID NO: 2280032 - RNA, 22 nt, Human
cauaaggaauguagcugguuuc

SEQ ID NO: 2280033 - RNA, 17 nt, Human
cauaaggaaacuggguu

SEQ ID NO: 2280034 - RNA, 18 nt, Human
cauaagacuuugggauag

SEQ ID NO: 2280035 - RNA, 16 nt, Human
cauaagacccuaagcc

SEQ ID NO: 2280036 - RNA, 20 nt, Human
cauaagacccuaagccuccu

SEQ ID NO: 2280037 - RNA, 11 nt, Human
cauaagaccau

SEQ ID NO: 2280038 - RNA, 20 nt, Human
cauaagaccauaacagccaa

SEQ ID NO: 2280039 - RNA, 21 nt, Human
cauaagaccauaacagccaac

SEQ ID NO: 2280040 - RNA, 23 nt, Human
cauaagaccauaacagccaacag

SEQ ID NO: 2280041 - RNA, 14 nt, Human
cauaagauaaaugu

SEQ ID NO: 2280042 - RNA, 23 nt, Human
cauaagccuccauuuaguucuuu

SEQ ID NO: 2280043 - RNA, 21 nt, Human
cauaagccuccauuuaguucu

SEQ ID NO: 2280044 - RNA, 17 nt, Human
cauaagccaauuuuucu

SEQ ID NO: 2280045 - RNA, 20 nt, Human
cauaagccaauuuuucugca

SEQ ID NO: 2280046 - RNA, 19 nt, Human
cauaagcggcguaaguuua

SEQ ID NO: 2280047 - RNA, 15 nt, Human
cauaagccaauuuuu

SEQ ID NO: 2280048 - RNA, 17 nt, Human
cauaagauauuuuucau

SEQ ID NO: 2280049 - RNA, 20 nt, Human
cauaacguuuuuccuuuaaa

SEQ ID NO: 2280050 - RNA, 17 nt, Human
cauaacguuuuuccuuu

SEQ ID NO: 2280051 - RNA, 18 nt, Human
cauaacguuuuuccuuua

SEQ ID NO: 2280052 - RNA, 22 nt, Human
cauaacggaucagaaauacaga

SEQ ID NO: 2280053 - RNA, 15 nt, Human
cauaacguuuuuccu

SEQ ID NO: 2280054 - RNA, 16 nt, Human
cauaacguuuuuccuu

SEQ ID NO: 2280055 - RNA, 21 nt, Human
cauaacguuuuuccuuuaaaa

SEQ ID NO: 2280056 - RNA, 14 nt, Human
cauaacugaaaaug

SEQ ID NO: 2280057 - RNA, 11 nt, Human
cauaacugaaa

SEQ ID NO: 2280058 - RNA, 21 nt, Human
cauaagaaugaauaauaauua

SEQ ID NO: 2280059 - RNA, 12 nt, Human
cauaagaaugaa

SEQ ID NO: 2280060 - RNA, 19 nt, Human
cauaagaaaacuaagaaau

SEQ ID NO: 2280061 - RNA, 24 nt, Human
cauacauuuauaauguuugcuauu

SEQ ID NO: 2280062 - RNA, 23 nt, Human
cauacauuuauaauguuugcuau

SEQ ID NO: 2280063 - RNA, 22 nt, Human
cauacauuuauaauguuugcua

SEQ ID NO: 2280064 - RNA, 21 nt, Human
cauacauuuauaauguuugcu

SEQ ID NO: 2280065 - RNA, 17 nt, Human
cauacauuuauaauguu

SEQ ID NO: 2280066 - RNA, 17 nt, Human
cauaccaacacgagcag

SEQ ID NO: 2280067 - RNA, 22 nt, Human
cauaauagacuucccacucuag

SEQ ID NO: 2280068 - RNA, 23 nt, Human
cauaauagacuucccacucuagg

SEQ ID NO: 2280069 - RNA, 15 nt, Human
cauaauacuugcuuu

SEQ ID NO: 2280070 - RNA, 18 nt, Human
cauaaucacaacccuuca

SEQ ID NO: 2280071 - RNA, 20 nt, Human
cauaaucuaccaacgaaaga

SEQ ID NO: 2280072 - RNA, 14 nt, Human
cauaccaaugaaaa

SEQ ID NO: 2280073 - RNA, 19 nt, Human
cauaccacuuuuguucuug

SEQ ID NO: 2280074 - RNA, 11 nt, Human
cauacccaccc

SEQ ID NO: 2280075 - RNA, 12 nt, Human
cauacccacccc

SEQ ID NO: 2280076 - RNA, 18 nt, Human
cauaccacuuuuguucuu

SEQ ID NO: 2280077 - RNA, 15 nt, Human
cauaccacuuuuguu

SEQ ID NO: 2280078 - RNA, 14 nt, Human
cauaccacuuuugu

SEQ ID NO: 2280079 - RNA, 13 nt, Human
cauaccacuuuug

SEQ ID NO: 2280080 - RNA, 22 nt, Human
cauaccaggccgccccagccuc

SEQ ID NO: 2280081 - RNA, 13 nt, Human
cauacccuccccc

SEQ ID NO: 2280082 - RNA, 15 nt, Human
cauaccuacauguau

SEQ ID NO: 2280083 - RNA, 15 nt, Human
cauaccuggcccugu

SEQ ID NO: 2280084 - RNA, 22 nt, Human
cauacccuggccgcccccugcc

SEQ ID NO: 2280085 - RNA, 18 nt, Human
cauaccugcuggugcaga

SEQ ID NO: 2280086 - RNA, 13 nt, Human
cauaccuuccuuc

SEQ ID NO: 2280087 - RNA, 14 nt, Human
cauaccuuccuucc

SEQ ID NO: 2280088 - RNA, 15 nt, Human
cauaccuuccuuccc

SEQ ID NO: 2280089 - RNA, 16 nt, Human
cauaccuuccuucccu

SEQ ID NO: 2280090 - RNA, 18 nt, Human
cauaccuuccuucccugg

SEQ ID NO: 2280091 - RNA, 21 nt, Human
cauaccuuccuucccugggcu

SEQ ID NO: 2280092 - RNA, 23 nt, Human
cauaccuuccuucccugggcugu

SEQ ID NO: 2280093 - RNA, 14 nt, Human
cauacccaccccca

SEQ ID NO: 2280094 - RNA, 17 nt, Human
cauacccacccccaccc

SEQ ID NO: 2280095 - RNA, 18 nt, Human
cauacccacccccaccca

SEQ ID NO: 2280096 - RNA, 21 nt, Human
cauacccacccccacccaagg

SEQ ID NO: 2280097 - RNA, 18 nt, Human
cauacgcaccacaucucu

SEQ ID NO: 2280098 - RNA, 19 nt, Human
cauaccuuuauugugaucu

SEQ ID NO: 2280099 - RNA, 13 nt, Human
cauacguacacau

SEQ ID NO: 2280100 - RNA, 16 nt, Human
cauacguacacauuuu

SEQ ID NO: 2280101 - RNA, 15 nt, Human
cauacguacacauuu

SEQ ID NO: 2280102 - RNA, 21 nt, Human
cauacuaaccagcagaaaugc

SEQ ID NO: 2280103 - RNA, 14 nt, Human
cauacuaaccagca

SEQ ID NO: 2280104 - RNA, 18 nt, Human
cauacguacacauuuuau

SEQ ID NO: 2280105 - RNA, 17 nt, Human
cauacguacacauuuua

SEQ ID NO: 2280106 - RNA, 13 nt, Human
cauacguccacca

SEQ ID NO: 2280107 - RNA, 20 nt, Human
cauacuaauuauacccccug

SEQ ID NO: 2280108 - RNA, 19 nt, Human
cauacucaauguuacuauc

SEQ ID NO: 2280109 - RNA, 22 nt, Human
ggaagcccccaccgugggcagg

SEQ ID NO: 2280110 - RNA, 21 nt, Human
ggaagcccccaccgugggcag

SEQ ID NO: 2280111 - RNA, 13 nt, Human
ggaagcccccacc

SEQ ID NO: 2280112 - RNA, 23 nt, Human
ggaagcccuggauuucagaaaga

SEQ ID NO: 2280113 - RNA, 15 nt, Human
ggaagcccuggauuu

SEQ ID NO: 2280114 - RNA, 11 nt, Human
ggaagcccugg

SEQ ID NO: 2280115 - RNA, 12 nt, Human
ggaagcccugga

SEQ ID NO: 2280116 - RNA, 17 nt, Human
ggaagcccuccuuccac

SEQ ID NO: 2280117 - RNA, 16 nt, Human
ggaagcccuccuucca

SEQ ID NO: 2280118 - RNA, 15 nt, Human
ggaagcccuccuucc

SEQ ID NO: 2280119 - RNA, 12 nt, Human
ggaagcccuccu

SEQ ID NO: 2280120 - RNA, 11 nt, Human
ggaagcccucc

SEQ ID NO: 2280121 - RNA, 22 nt, Human
ggaagcgugaaggccgagaagc

SEQ ID NO: 2280122 - RNA, 21 nt, Human
ggaagcgugaaggccgagaag

SEQ ID NO: 2280123 - RNA, 16 nt, Human
ggaagcuaauuugcau

SEQ ID NO: 2280124 - RNA, 13 nt, Human
ggaagcuacaggu

SEQ ID NO: 2280125 - RNA, 15 nt, Human
ggaagcuacagguua

SEQ ID NO: 2280126 - RNA, 15 nt, Human
ggaagccgcuggggc

SEQ ID NO: 2280127 - RNA, 23 nt, Human
ggaagcuacagguuacaacagau

SEQ ID NO: 2280128 - RNA, 21 nt, Human
ggaagcuacagguuacaacag

SEQ ID NO: 2280129 - RNA, 22 nt, Human
ggaagcuacagguuacaacaga

SEQ ID NO: 2280130 - RNA, 16 nt, Human
ggaagcuagcuccccu

SEQ ID NO: 2280131 - RNA, 17 nt, Human
ggaagcuagcuccccuc

SEQ ID NO: 2280132 - RNA, 19 nt, Human
ggaagcuagcuccccuccu

SEQ ID NO: 2280133 - RNA, 20 nt, Human
ggaagcuagcuccccuccuc

SEQ ID NO: 2280134 - RNA, 21 nt, Human
ggaagcuagcuccccuccucu

SEQ ID NO: 2280135 - RNA, 22 nt, Human
ggaagcuagcuccccuccucuc

SEQ ID NO: 2280136 - RNA, 23 nt, Human
ggaagcuccacugucacccucca

SEQ ID NO: 2280137 - RNA, 14 nt, Human
ggaagcuccacugu

SEQ ID NO: 2280138 - RNA, 11 nt, Human
ggaagcuccgc

SEQ ID NO: 2280139 - RNA, 15 nt, Human
ggaagcucagggccu

SEQ ID NO: 2280140 - RNA, 23 nt, Human
ggaagcucagggccuggcucagg

SEQ ID NO: 2280141 - RNA, 20 nt, Human
ggaagcuuccaguccaaucu

SEQ ID NO: 2280142 - RNA, 19 nt, Human
ggaagcuucuuaaaugaga

SEQ ID NO: 2280143 - RNA, 23 nt, Human
ggaagcuguguccuugcaccugc

SEQ ID NO: 2280144 - RNA, 13 nt, Human
ggaagcuuccagu

SEQ ID NO: 2280145 - RNA, 21 nt, Human
ggaagcuguguccuugcaccu

SEQ ID NO: 2280146 - RNA, 16 nt, Human
ggaaggaaacccagcu

SEQ ID NO: 2280147 - RNA, 18 nt, Human
ggaagcucugaagucaca

SEQ ID NO: 2280148 - RNA, 17 nt, Human
ggaagcugcccugccca

SEQ ID NO: 2280149 - RNA, 13 nt, Human
ggaagcugaggcg

SEQ ID NO: 2280150 - RNA, 18 nt, Human
ggaagcuggccgaggguc

SEQ ID NO: 2280151 - RNA, 17 nt, Human
ggaagcuguguccuugc

SEQ ID NO: 2280152 - RNA, 15 nt, Human
ggaagcugcuccgug

SEQ ID NO: 2280153 - RNA, 13 nt, Human
ggaagcugcuccg

SEQ ID NO: 2280154 - RNA, 13 nt, Human
ggaaggagagccu

SEQ ID NO: 2280155 - RNA, 22 nt, Human
ggaaggagacucaccucugccu

SEQ ID NO: 2280156 - RNA, 21 nt, Human
ggaaggagacucaccucugcc

SEQ ID NO: 2280157 - RNA, 12 nt, Human
ggaagugugggu

SEQ ID NO: 2280158 - RNA, 22 nt, Human
ggaagugugggucugugugugu

SEQ ID NO: 2280159 - RNA, 21 nt, Human
ggaagugugggucugugugug

SEQ ID NO: 2280160 - RNA, 11 nt, Human
ggaaguuuuca

SEQ ID NO: 2280161 - RNA, 14 nt, Human
ggaaguuuucaaug

SEQ ID NO: 2280162 - RNA, 18 nt, Human
ggaaguuucauauauugu

SEQ ID NO: 2280163 - RNA, 12 nt, Human
ggaaggagagaa

SEQ ID NO: 2280164 - RNA, 13 nt, Human
ggaaguuuagaga

SEQ ID NO: 2280165 - RNA, 20 nt, Human
ggaaggagacucaccucugc

SEQ ID NO: 2280166 - RNA, 15 nt, Human
ggaaggagacucacc

SEQ ID NO: 2280167 - RNA, 23 nt, Human
ggaaggaacucuggcuuccaggu

SEQ ID NO: 2280168 - RNA, 13 nt, Human
ggaaggacccuga

SEQ ID NO: 2280169 - RNA, 19 nt, Human
ggaaggaaagaaagaagga

SEQ ID NO: 2280170 - RNA, 16 nt, Human
ggaaggaacucuggcu

SEQ ID NO: 2280171 - RNA, 17 nt, Human
ggaaggaacucuggcuu

SEQ ID NO: 2280172 - RNA, 18 nt, Human
ggaaggaacucuggcuuc

SEQ ID NO: 2280173 - RNA, 19 nt, Human
ggaaggaaacccagcucug

SEQ ID NO: 2280174 - RNA, 20 nt, Human
ggaaggaaacccagcucugg

SEQ ID NO: 2280175 - RNA, 21 nt, Human
ggaaguuuuguggaggagcuc

SEQ ID NO: 2280176 - RNA, 18 nt, Human
ggaaguuuugcauuuaug

SEQ ID NO: 2280177 - RNA, 12 nt, Human
ggaauaaaauac

SEQ ID NO: 2280178 - RNA, 14 nt, Human
ggaauaaaauacua

SEQ ID NO: 2280179 - RNA, 19 nt, Human
ggaauaaaauacuauuuuu

SEQ ID NO: 2280180 - RNA, 12 nt, Human
ggaauaaauaug

SEQ ID NO: 2280181 - RNA, 13 nt, Human
ggaauaaauaugc

SEQ ID NO: 2280182 - RNA, 22 nt, Human
ggaauaaauaugccucuccuuu

SEQ ID NO: 2280183 - RNA, 23 nt, Human
ggaauaaauaugccucuccuuug

SEQ ID NO: 2280184 - RNA, 20 nt, Human
ggaauaaggccuuaauaugu

SEQ ID NO: 2280185 - RNA, 13 nt, Human
ggaauaauaccua

SEQ ID NO: 2280186 - RNA, 18 nt, Human
ggaauaacauguaauuaa

SEQ ID NO: 2280187 - RNA, 16 nt, Human
ggaauccagacccggc

SEQ ID NO: 2280188 - RNA, 24 nt, Human
ggaaucauuucuauuucuccucca

SEQ ID NO: 2280189 - RNA, 14 nt, Human
ggaauccacuccca

SEQ ID NO: 2280190 - RNA, 16 nt, Human
ggaauccacucccagg

SEQ ID NO: 2280191 - RNA, 19 nt, Human
ggaauccacucccaggcag

SEQ ID NO: 2280192 - RNA, 21 nt, Human
ggaaucagacuucacacugca

SEQ ID NO: 2280193 - RNA, 20 nt, Human
ggaaucacucuuguggaugu

SEQ ID NO: 2280194 - RNA, 18 nt, Human
ggaaucacucuuguggau

SEQ ID NO: 2280195 - RNA, 23 nt, Human
ggaaucagacuucacacugcaag

SEQ ID NO: 2280196 - RNA, 16 nt, Human
ggaaucagcaagaaga

SEQ ID NO: 2280197 - RNA, 13 nt, Human
ggaaucagcuucu

SEQ ID NO: 2280198 - RNA, 19 nt, Human
ggaaucaugucaggccugu

SEQ ID NO: 2280199 - RNA, 21 nt, Human
ggaaucaugucaggccugugu

SEQ ID NO: 2280200 - RNA, 14 nt, Human
ggaaucagcuucua

SEQ ID NO: 2280201 - RNA, 15 nt, Human
ggaaucaugucaggc

SEQ ID NO: 2280202 - RNA, 18 nt, Human
ggaaucaugucaggccug

SEQ ID NO: 2280203 - RNA, 14 nt, Human
ggaauccuguccuc

SEQ ID NO: 2280204 - RNA, 19 nt, Human
ggaauccuguccucagcuu

SEQ ID NO: 2280205 - RNA, 20 nt, Human
ggaauccacucccaggcagc

SEQ ID NO: 2280206 - RNA, 21 nt, Human
ggaaucgaggaaccagagcca

SEQ ID NO: 2280207 - RNA, 20 nt, Human
ggaaucgaggaaccagagcc

SEQ ID NO: 2280208 - RNA, 19 nt, Human
ggaaucgaggaaccagagc

SEQ ID NO: 2280209 - RNA, 16 nt, Human
ggacaacgaggaagcc

SEQ ID NO: 2280210 - RNA, 13 nt, Human
ggaaucuggagag

SEQ ID NO: 2280211 - RNA, 19 nt, Human
ggaaucuggagagcuagaa

SEQ ID NO: 2280212 - RNA, 17 nt, Human
ggacaacgaggaagccc

SEQ ID NO: 2280213 - RNA, 15 nt, Human
ggacaacgaggaagc

SEQ ID NO: 2280214 - RNA, 13 nt, Human
ggacaagagcagg

SEQ ID NO: 2280215 - RNA, 13 nt, Human
ggacaagcagagg

SEQ ID NO: 2280216 - RNA, 20 nt, Human
ggacaagcagagguggccag

SEQ ID NO: 2280217 - RNA, 20 nt, Human
ggacaagccaacuuguaaau

SEQ ID NO: 2280218 - RNA, 21 nt, Human
ggacaagccaacuuguaaaua

SEQ ID NO: 2280219 - RNA, 23 nt, Human
ggacaagccaacuuguaaauaca

SEQ ID NO: 2280220 - RNA, 22 nt, Human
ggacaaggaugaucuaggaaga

SEQ ID NO: 2280221 - RNA, 23 nt, Human
ggacaaggaugaucuaggaagac

SEQ ID NO: 2280222 - RNA, 19 nt, Human
ggacaaucaugaaauaugc

SEQ ID NO: 2280223 - RNA, 21 nt, Human
ggacaaucaugaaauaugcau

SEQ ID NO: 2280224 - RNA, 17 nt, Human
ggacaaucaguccccuc

SEQ ID NO: 2280225 - RNA, 18 nt, Human
ggacaaucaguccccucc

SEQ ID NO: 2280226 - RNA, 20 nt, Human
ggacaaucaguccccuccca

SEQ ID NO: 2280227 - RNA, 22 nt, Human
ggacaaucaguccccucccauc

SEQ ID NO: 2280228 - RNA, 14 nt, Human
ggacacagcucuuc

SEQ ID NO: 2280229 - RNA, 22 nt, Human
ggacaaggcuagaucaugaaga

SEQ ID NO: 2280230 - RNA, 20 nt, Human
ggacaaggaggucugugcca

SEQ ID NO: 2280231 - RNA, 19 nt, Human
ggacaaggacuaggguccu

SEQ ID NO: 2280232 - RNA, 16 nt, Human
ggacaaucaguccccu

SEQ ID NO: 2280233 - RNA, 18 nt, Human
ggacaauacagaacccau

SEQ ID NO: 2280234 - RNA, 20 nt, Human
ggacaaguggacucagggca

SEQ ID NO: 2280235 - RNA, 16 nt, Human
ggacaccugcccugcc

SEQ ID NO: 2280236 - RNA, 21 nt, Human
ggacacagcucuucuccaggc

SEQ ID NO: 2280237 - RNA, 15 nt, Human
ggacacagcucuucu

SEQ ID NO: 2280238 - RNA, 18 nt, Human
ggacacagcucuucucca

SEQ ID NO: 2280239 - RNA, 20 nt, Human
ggacagcuccuucuguccua

SEQ ID NO: 2280240 - RNA, 11 nt, Human
ggacagcuguc

SEQ ID NO: 2280241 - RNA, 13 nt, Human
ggacagcuguccu

SEQ ID NO: 2280242 - RNA, 19 nt, Human
ggacagcuugagccgggcc

SEQ ID NO: 2280243 - RNA, 22 nt, Human
ggacacuaaccacgcuggaccu

SEQ ID NO: 2280244 - RNA, 19 nt, Human
ggacagcuccuucuguccu

SEQ ID NO: 2280245 - RNA, 22 nt, Human
ggacacggggcaguggcaaccu

SEQ ID NO: 2280246 - RNA, 17 nt, Human
ggacacuaaccacgcug

SEQ ID NO: 2280247 - RNA, 16 nt, Human
ggaacuguccagagag

SEQ ID NO: 2280248 - RNA, 17 nt, Human
ggaacuguccagagagc

SEQ ID NO: 2280249 - RNA, 18 nt, Human
ggaacuguccagagagca

SEQ ID NO: 2280250 - RNA, 15 nt, Human
ggaacuucuaauaua

SEQ ID NO: 2280251 - RNA, 22 nt, Human
ggaagacaaugugaaaagaaaa

SEQ ID NO: 2280252 - RNA, 13 nt, Human
ggaagacagcucu

SEQ ID NO: 2280253 - RNA, 14 nt, Human
ggaagacagcucuu

SEQ ID NO: 2280254 - RNA, 22 nt, Human
ggaagacauggggaggaaggac

SEQ ID NO: 2280255 - RNA, 12 nt, Human
ggaagacuuugg

SEQ ID NO: 2280256 - RNA, 22 nt, Human
ggaacuuggggaguuaagaccu

SEQ ID NO: 2280257 - RNA, 12 nt, Human
ggaagacagaga

SEQ ID NO: 2280258 - RNA, 23 nt, Human
ggaagacagagaccuccugccuc

SEQ ID NO: 2280259 - RNA, 13 nt, Human
ggaagacuuugga

SEQ ID NO: 2280260 - RNA, 17 nt, Human
ggaagacuuuggaaaga

SEQ ID NO: 2280261 - RNA, 21 nt, Human
ggaagagaggaguucaaugau

SEQ ID NO: 2280262 - RNA, 18 nt, Human
ggaagagaggaguucaau

SEQ ID NO: 2280263 - RNA, 19 nt, Human
ggaagagaggaguucaaug

SEQ ID NO: 2280264 - RNA, 20 nt, Human
ggaagagaggaguucaauga

SEQ ID NO: 2280265 - RNA, 17 nt, Human
ggaagagaggaguucaa

SEQ ID NO: 2280266 - RNA, 13 nt, Human
ggaagagaaaaaa

SEQ ID NO: 2280267 - RNA, 18 nt, Human
ggaagacuuuggaaagag

SEQ ID NO: 2280268 - RNA, 21 nt, Human
ggaagaccagcuuugcaguga

SEQ ID NO: 2280269 - RNA, 13 nt, Human
ggaagagaaacca

SEQ ID NO: 2280270 - RNA, 15 nt, Human
ggaagagaaaaaaua

SEQ ID NO: 2280271 - RNA, 12 nt, Human
ggaacacucuga

SEQ ID NO: 2280272 - RNA, 14 nt, Human
ggaacacucugaga

SEQ ID NO: 2280273 - RNA, 21 nt, Human
ggaacagacaacagaagucau

SEQ ID NO: 2280274 - RNA, 20 nt, Human
ggaacagacaacagaaguca

SEQ ID NO: 2280275 - RNA, 18 nt, Human
ggaacagacaacagaagu

SEQ ID NO: 2280276 - RNA, 12 nt, Human
ggaacagaaugu

SEQ ID NO: 2280277 - RNA, 16 nt, Human
ggaacagaauguuuua

SEQ ID NO: 2280278 - RNA, 16 nt, Human
ggaacagacaggagaa

SEQ ID NO: 2280279 - RNA, 15 nt, Human
ggaacagacaggaga

SEQ ID NO: 2280280 - RNA, 13 nt, Human
ggaacagacagga

SEQ ID NO: 2280281 - RNA, 19 nt, Human
ggaacagaauguuuuacug

SEQ ID NO: 2280282 - RNA, 17 nt, Human
ggaacagacaggagaaa

SEQ ID NO: 2280283 - RNA, 20 nt, Human
ggaacugcugggcuuggcag

SEQ ID NO: 2280284 - RNA, 14 nt, Human
ggaacuguccagag

SEQ ID NO: 2280285 - RNA, 15 nt, Human
ggaacuguccagaga

SEQ ID NO: 2280286 - RNA, 19 nt, Human
ggaacagaaggaugaauga

SEQ ID NO: 2280287 - RNA, 13 nt, Human
ggaacagaaggau

SEQ ID NO: 2280288 - RNA, 12 nt, Human
ggaacagaagga

SEQ ID NO: 2280289 - RNA, 11 nt, Human
ggaacagaagg

SEQ ID NO: 2280290 - RNA, 15 nt, Human
ggaacacucugagac

SEQ ID NO: 2280291 - RNA, 16 nt, Human
ggaacacucugagacu

SEQ ID NO: 2280292 - RNA, 20 nt, Human
ggacaggaugaccuggauaa

SEQ ID NO: 2280293 - RNA, 15 nt, Human
ggacggcugggcaca

SEQ ID NO: 2280294 - RNA, 13 nt, Human
ggacggggccggc

SEQ ID NO: 2280295 - RNA, 16 nt, Human
ggacggggccggccag

SEQ ID NO: 2280296 - RNA, 22 nt, Human
ggacggccugaugcucccuccc

SEQ ID NO: 2280297 - RNA, 21 nt, Human
ggacggccugaugcucccucc

SEQ ID NO: 2280298 - RNA, 18 nt, Human
ggacggcauuccugcuua

SEQ ID NO: 2280299 - RNA, 20 nt, Human
ggaccucaggccugggggcu

SEQ ID NO: 2280300 - RNA, 14 nt, Human
ggaccucaggccug

SEQ ID NO: 2280301 - RNA, 15 nt, Human
ggaccucaggccugg

SEQ ID NO: 2280302 - RNA, 22 nt, Human
ggacguccugccaccuggggca

SEQ ID NO: 2280303 - RNA, 18 nt, Human
ggacguggcucagccagc

SEQ ID NO: 2280304 - RNA, 18 nt, Human
ggacguccugccaccugg

SEQ ID NO: 2280305 - RNA, 20 nt, Human
ggacggugcuccaggcaggc

SEQ ID NO: 2280306 - RNA, 16 nt, Human
ggacgucccugcccau

SEQ ID NO: 2280307 - RNA, 20 nt, Human
ggacguguuaugacuccaga

SEQ ID NO: 2280308 - RNA, 23 nt, Human
ggacggggggccccagucagccu

SEQ ID NO: 2280309 - RNA, 19 nt, Human
ggacggggggccccaguca

SEQ ID NO: 2280310 - RNA, 21 nt, Human
ggacggggggccccagucagc

SEQ ID NO: 2280311 - RNA, 17 nt, Human
ggacggugcccaagcca

SEQ ID NO: 2280312 - RNA, 19 nt, Human
ggacggugcccaagccaga

SEQ ID NO: 2280313 - RNA, 21 nt, Human
ggacggugcccaagccagagg

SEQ ID NO: 2280314 - RNA, 14 nt, Human
ggacggugcuccag

SEQ ID NO: 2280315 - RNA, 15 nt, Human
ggacggugcuccagg

SEQ ID NO: 2280316 - RNA, 17 nt, Human
ggacggugcuccaggca

SEQ ID NO: 2280317 - RNA, 18 nt, Human
ggacggugcuccaggcag

SEQ ID NO: 2280318 - RNA, 23 nt, Human
ggacccuuuccuuccuucccugg

SEQ ID NO: 2280319 - RNA, 21 nt, Human
ggacccuuuccuuccuucccu

SEQ ID NO: 2280320 - RNA, 17 nt, Human
ggacccuuuccuuccuu

SEQ ID NO: 2280321 - RNA, 16 nt, Human
ggacccuuuccuuccu

SEQ ID NO: 2280322 - RNA, 12 nt, Human
ggacccuuuccu

SEQ ID NO: 2280323 - RNA, 23 nt, Human
ggacccuugagaguaucaggucu

SEQ ID NO: 2280324 - RNA, 21 nt, Human
ggacccuucccuugagcccuc

SEQ ID NO: 2280325 - RNA, 17 nt, Human
ggacccuguugcuaagc

SEQ ID NO: 2280326 - RNA, 13 nt, Human
ggacccuguugcu

SEQ ID NO: 2280327 - RNA, 22 nt, Human
ggacccugugacauggugccug

SEQ ID NO: 2280328 - RNA, 23 nt, Human
ggacccugugacauggugccuga

SEQ ID NO: 2280329 - RNA, 22 nt, Human
ggacccuuuccuuccuucccug

SEQ ID NO: 2280330 - RNA, 17 nt, Human
ggaccgccagauggggc

SEQ ID NO: 2280331 - RNA, 15 nt, Human
ggaccgccagauggg

SEQ ID NO: 2280332 - RNA, 22 nt, Human
ggaccgccagauggggccucug

SEQ ID NO: 2280333 - RNA, 13 nt, Human
ggaccucaggccu

SEQ ID NO: 2280334 - RNA, 12 nt, Human
ggacccugaggc

SEQ ID NO: 2280335 - RNA, 13 nt, Human
ggacccugaggcc

SEQ ID NO: 2280336 - RNA, 16 nt, Human
ggacccugugacaugg

SEQ ID NO: 2280337 - RNA, 13 nt, Human
ggacccugaaggg

SEQ ID NO: 2280338 - RNA, 23 nt, Human
ggacccccgcccccugcccuccc

SEQ ID NO: 2280339 - RNA, 15 nt, Human
ggaccccgagccugg

SEQ ID NO: 2280340 - RNA, 12 nt, Human
ggacccccugaa

SEQ ID NO: 2280341 - RNA, 12 nt, Human
ggacccccuucc

SEQ ID NO: 2280342 - RNA, 14 nt, Human
ggacccccuucccc

SEQ ID NO: 2280343 - RNA, 11 nt, Human
ggacccugagg

SEQ ID NO: 2280344 - RNA, 16 nt, Human
ggacccccgcccccug

SEQ ID NO: 2280345 - RNA, 19 nt, Human
ggacccccgcccccugccc

SEQ ID NO: 2280346 - RNA, 20 nt, Human
ggacccccgcccccugcccu

SEQ ID NO: 2280347 - RNA, 22 nt, Human
ggacccccgcccccugcccucc

SEQ ID NO: 2280348 - RNA, 14 nt, Human
ggacccccgccccc

SEQ ID NO: 2280349 - RNA, 15 nt, Human
ggacccccgcccccu

SEQ ID NO: 2280350 - RNA, 19 nt, Human
ggacguggcucagccagca

SEQ ID NO: 2280351 - RNA, 13 nt, Human
ggacguuccagcc

SEQ ID NO: 2280352 - RNA, 14 nt, Human
ggacguuccagccg

SEQ ID NO: 2280353 - RNA, 16 nt, Human
ggacguuccagccggc

SEQ ID NO: 2280354 - RNA, 12 nt, Human
ggacuaaaagau

SEQ ID NO: 2280355 - RNA, 14 nt, Human
ggacuaaaagauau

SEQ ID NO: 2280356 - RNA, 19 nt, Human
ggacuaaaagauauaagug

SEQ ID NO: 2280357 - RNA, 21 nt, Human
ggacguuccagccggcauggc

SEQ ID NO: 2280358 - RNA, 20 nt, Human
ggacuaacuugucuuuggac

SEQ ID NO: 2280359 - RNA, 14 nt, Human
ggacuauuauaauu

SEQ ID NO: 2280360 - RNA, 23 nt, Human
ggacuauauuugggccugcucca

SEQ ID NO: 2280361 - RNA, 16 nt, Human
ggacuaagccuaccug

SEQ ID NO: 2280362 - RNA, 19 nt, Human
ggacuaagccuaccugcuc

SEQ ID NO: 2280363 - RNA, 15 nt, Human
ggacucaaugcacug

SEQ ID NO: 2280364 - RNA, 14 nt, Human
ggacuacaggugug

SEQ ID NO: 2280365 - RNA, 24 nt, Human
ggacuaacuugucuuuggacccug

SEQ ID NO: 2280366 - RNA, 18 nt, Human
ggacuccagaaucuaaag

SEQ ID NO: 2280367 - RNA, 14 nt, Human
ggacuccagacucu

SEQ ID NO: 2280368 - RNA, 19 nt, Human
ggacuccagacucucugug

SEQ ID NO: 2280369 - RNA, 24 nt, Human
ggacucauuucauuccuaacacag

SEQ ID NO: 2280370 - RNA, 11 nt, Human
ggacuccaccc

SEQ ID NO: 2280371 - RNA, 20 nt, Human
ggacuccacccauccuauca

SEQ ID NO: 2280372 - RNA, 22 nt, Human
ggacucagggcagcgccaggcu

SEQ ID NO: 2280373 - RNA, 20 nt, Human
ggacucagggccaugccugc

SEQ ID NO: 2280374 - RNA, 22 nt, Human
ggacucauuuuaaaaaauggaa

SEQ ID NO: 2280375 - RNA, 20 nt, Human
ggacucaggaugcccagggc

SEQ ID NO: 2280376 - RNA, 19 nt, Human
ggacucaggaugcccaggg

SEQ ID NO: 2280377 - RNA, 18 nt, Human
ggacucaggaugcccagg

SEQ ID NO: 2280378 - RNA, 17 nt, Human
ggacucaggaugcccag

SEQ ID NO: 2280379 - RNA, 15 nt, Human
ggacucagggcagcg

SEQ ID NO: 2280380 - RNA, 13 nt, Human
ggacucagggcag

SEQ ID NO: 2280381 - RNA, 17 nt, Human
ggacucagccuucagac

SEQ ID NO: 2280382 - RNA, 21 nt, Human
ggacuaagccuaccugcucuc

SEQ ID NO: 2280383 - RNA, 21 nt, Human
ggacucagccuucagacagag

SEQ ID NO: 2280384 - RNA, 13 nt, Human
ggacucagcuccc

SEQ ID NO: 2280385 - RNA, 17 nt, Human
ggacucagcuccccaga

SEQ ID NO: 2280386 - RNA, 16 nt, Human
ggacucaaugcacuga

SEQ ID NO: 2280387 - RNA, 18 nt, Human
ggacucaaugcacugaca

SEQ ID NO: 2280388 - RNA, 16 nt, Human
ggacuccggcccuccu

SEQ ID NO: 2280389 - RNA, 22 nt, Human
ggacucccuccucaccucugga

SEQ ID NO: 2280390 - RNA, 20 nt, Human
ggacucccuccucaccucug

SEQ ID NO: 2280391 - RNA, 14 nt, Human
ggacuccccaggcc

SEQ ID NO: 2280392 - RNA, 16 nt, Human
ggacuccccaggccag

SEQ ID NO: 2280393 - RNA, 17 nt, Human
ggacuccccaggccagg

SEQ ID NO: 2280394 - RNA, 18 nt, Human
ggacuccccaggccaggc

SEQ ID NO: 2280395 - RNA, 23 nt, Human
ggacuugaaagcauccaugugug

SEQ ID NO: 2280396 - RNA, 17 nt, Human
ggacuucuuuucacauu

SEQ ID NO: 2280397 - RNA, 19 nt, Human
ggacuccccaggccaggcc

SEQ ID NO: 2280398 - RNA, 11 nt, Human
ggacuucuuuu

SEQ ID NO: 2280399 - RNA, 21 nt, Human
ggacuuucuuuucgccguggc

SEQ ID NO: 2280400 - RNA, 21 nt, Human
ggacuuuccacccccucccug

SEQ ID NO: 2280401 - RNA, 20 nt, Human
ggacuuuccacccccucccu

SEQ ID NO: 2280402 - RNA, 17 nt, Human
ggacuuuccacccccuc

SEQ ID NO: 2280403 - RNA, 16 nt, Human
ggacuuuccacccccu

SEQ ID NO: 2280404 - RNA, 19 nt, Human
ggacuugcaaaaaggguca

SEQ ID NO: 2280405 - RNA, 14 nt, Human
ggacuuggaagcuc

SEQ ID NO: 2280406 - RNA, 12 nt, Human
ggacuugaaguu

SEQ ID NO: 2280407 - RNA, 13 nt, Human
ggacuugaaguug

SEQ ID NO: 2280408 - RNA, 18 nt, Human
ggacuugaggauuuugag

SEQ ID NO: 2280409 - RNA, 23 nt, Human
ggacuuucuuuucgccguggcug

SEQ ID NO: 2280410 - RNA, 20 nt, Human
ggacuuuccuaaauguuuaa

SEQ ID NO: 2280411 - RNA, 16 nt, Human
ggacuuugcagccggc

SEQ ID NO: 2280412 - RNA, 17 nt, Human
ggacuuugcagccggca

SEQ ID NO: 2280413 - RNA, 15 nt, Human
ggagaaacagagaca

SEQ ID NO: 2280414 - RNA, 22 nt, Human
ggacuuugcagccggcacaggg

SEQ ID NO: 2280415 - RNA, 9 nt, Human
ggacuuugu

SEQ ID NO: 2280416 - RNA, 16 nt, Human
ggagaaaggaagggcu

SEQ ID NO: 2280417 - RNA, 13 nt, Human
ggagaaacuggaa

SEQ ID NO: 2280418 - RNA, 16 nt, Human
ggagacucuguggggc

SEQ ID NO: 2280419 - RNA, 13 nt, Human
ggagacucugugg

SEQ ID NO: 2280420 - RNA, 18 nt, Human
ggagacuccuaggcagga

SEQ ID NO: 2280421 - RNA, 21 nt, Human
ggagacuccuaggcaggacau

SEQ ID NO: 2280422 - RNA, 12 nt, Human
ggagacuccugc

SEQ ID NO: 2280423 - RNA, 17 nt, Human
ggagacuccugcccugu

SEQ ID NO: 2280424 - RNA, 21 nt, Human
ggagacuccaugagaagccgu

SEQ ID NO: 2280425 - RNA, 18 nt, Human
ggagacuccaugagaagc

SEQ ID NO: 2280426 - RNA, 13 nt, Human
ggagacuccuagg

SEQ ID NO: 2280427 - RNA, 16 nt, Human
ggagacuccuaggcag

SEQ ID NO: 2280428 - RNA, 21 nt, Human
ggagacucaccucugccucaa

SEQ ID NO: 2280429 - RNA, 19 nt, Human
ggagacucaccucugccuc

SEQ ID NO: 2280430 - RNA, 18 nt, Human
ggagacucaccucugccu

SEQ ID NO: 2280431 - RNA, 17 nt, Human
ggagacucaccucugcc

SEQ ID NO: 2280432 - RNA, 16 nt, Human
ggagacucaccucugc

SEQ ID NO: 2280433 - RNA, 13 nt, Human
ggagacucaccuc

SEQ ID NO: 2280434 - RNA, 9 nt, Human
ggagacuca

SEQ ID NO: 2280435 - RNA, 19 nt, Human
ggagaaacccuugaaaaga

SEQ ID NO: 2280436 - RNA, 16 nt, Human
ggagaaacagagacag

SEQ ID NO: 2280437 - RNA, 17 nt, Human
ggagaaagcacugaccu

SEQ ID NO: 2280438 - RNA, 20 nt, Human
gcuucagccugaggcugaga

SEQ ID NO: 2280439 - RNA, 15 nt, Human
gcuucagccugaggc

SEQ ID NO: 2280440 - RNA, 14 nt, Human
gcuucagccugagg

SEQ ID NO: 2280441 - RNA, 12 nt, Human
gcuucagccuga

SEQ ID NO: 2280442 - RNA, 23 nt, Human
gcuucagccugaggcugagacug

SEQ ID NO: 2280443 - RNA, 21 nt, Human
gcuucagccugaggcugagac

SEQ ID NO: 2280444 - RNA, 13 nt, Human
gcuucaggaggga

SEQ ID NO: 2280445 - RNA, 18 nt, Human
gcuucacggaagagccuu

SEQ ID NO: 2280446 - RNA, 15 nt, Human
gcuucagccaggagc

SEQ ID NO: 2280447 - RNA, 19 nt, Human
gcuucacggaagagccuug

SEQ ID NO: 2280448 - RNA, 12 nt, Human
gcuucagccucc

SEQ ID NO: 2280449 - RNA, 19 nt, Human
gcuucagccaggagcuggg

SEQ ID NO: 2280450 - RNA, 17 nt, Human
gcuucagccuccccacc

SEQ ID NO: 2280451 - RNA, 15 nt, Human
gcuucacggaagagc

SEQ ID NO: 2280452 - RNA, 17 nt, Human
gcuucacggaagagccu

SEQ ID NO: 2280453 - RNA, 20 nt, Human
gcuucaaggauccugagcca

SEQ ID NO: 2280454 - RNA, 21 nt, Human
gcuucaaggauccugagccag

SEQ ID NO: 2280455 - RNA, 11 nt, Human
gcuuauuuaau

SEQ ID NO: 2280456 - RNA, 22 nt, Human
gcuuauuguuccaagacauugu

SEQ ID NO: 2280457 - RNA, 21 nt, Human
gcuuauuguuccaagacauug

SEQ ID NO: 2280458 - RNA, 20 nt, Human
gcuuauuguuccaagacauu

SEQ ID NO: 2280459 - RNA, 17 nt, Human
gcuuauuguuccaagac

SEQ ID NO: 2280460 - RNA, 15 nt, Human
gcuuauuguuccaag

SEQ ID NO: 2280461 - RNA, 14 nt, Human
gcuuauuguuccaa

SEQ ID NO: 2280462 - RNA, 13 nt, Human
gcuuauuguucca

SEQ ID NO: 2280463 - RNA, 20 nt, Human
gcuuauucaucuguuuuucu

SEQ ID NO: 2280464 - RNA, 18 nt, Human
gcuuauuuaauuaaaaaa

SEQ ID NO: 2280465 - RNA, 18 nt, Human
gcuucaaggauccugagc

SEQ ID NO: 2280466 - RNA, 19 nt, Human
gcuucaaggauccugagcc

SEQ ID NO: 2280467 - RNA, 22 nt, Human
gcuuugacugagcagacuggug

SEQ ID NO: 2280468 - RNA, 15 nt, Human
gcuuugacugagcag

SEQ ID NO: 2280469 - RNA, 11 nt, Human
gcuuugaaugu

SEQ ID NO: 2280470 - RNA, 14 nt, Human
gcuuugacucaccu

SEQ ID NO: 2280471 - RNA, 20 nt, Human
gcuuugacucaccuguuacu

SEQ ID NO: 2280472 - RNA, 17 nt, Human
gcuuucuugcugguugu

SEQ ID NO: 2280473 - RNA, 20 nt, Human
gcuuucuuucguuuguuugu

SEQ ID NO: 2280474 - RNA, 21 nt, Human
gcuuucuuucguuuguuuguu

SEQ ID NO: 2280475 - RNA, 22 nt, Human
gcuuguccccuccucacucccu

SEQ ID NO: 2280476 - RNA, 19 nt, Human
gcuuguccccuccucacuc

SEQ ID NO: 2280477 - RNA, 16 nt, Human
gcuuguccccuccuca

SEQ ID NO: 2280478 - RNA, 16 nt, Human
gcuuguccagcgccua

SEQ ID NO: 2280479 - RNA, 15 nt, Human
gcuuguccagcgccu

SEQ ID NO: 2280480 - RNA, 18 nt, Human
gcuugucauuaccagacg

SEQ ID NO: 2280481 - RNA, 14 nt, Human
gcuuucuugcuggu

SEQ ID NO: 2280482 - RNA, 13 nt, Human
gcuuucuugcugg

SEQ ID NO: 2280483 - RNA, 12 nt, Human
gcuuucuugcug

SEQ ID NO: 2280484 - RNA, 22 nt, Human
gcuuucuguugucauugcuguu

SEQ ID NO: 2280485 - RNA, 16 nt, Human
gcuuucuguugucauu

SEQ ID NO: 2280486 - RNA, 23 nt, Human
gcuuucuguugucauugcuguug

SEQ ID NO: 2280487 - RNA, 16 nt, Human
gcuuguaacuccacca

SEQ ID NO: 2280488 - RNA, 15 nt, Human
gcuuguaacuccacc

SEQ ID NO: 2280489 - RNA, 12 nt, Human
gcuuguacauaa

SEQ ID NO: 2280490 - RNA, 18 nt, Human
gcuugucagagcugggag

SEQ ID NO: 2280491 - RNA, 17 nt, Human
gcuugucagagcuggga

SEQ ID NO: 2280492 - RNA, 16 nt, Human
gcuugucagagcuggg

SEQ ID NO: 2280493 - RNA, 15 nt, Human
gcuugucagagcugg

SEQ ID NO: 2280494 - RNA, 21 nt, Human
gcuuguccaacccgaggcccg

SEQ ID NO: 2280495 - RNA, 14 nt, Human
gcuugucagagcug

SEQ ID NO: 2280496 - RNA, 13 nt, Human
gcuugucagagcu

SEQ ID NO: 2280497 - RNA, 17 nt, Human
gcuuguaucaacacugu

SEQ ID NO: 2280498 - RNA, 14 nt, Human
gcuuguauagugua

SEQ ID NO: 2280499 - RNA, 15 nt, Human
gcuugagcccaggag

SEQ ID NO: 2280500 - RNA, 14 nt, Human
gcuugagcccagga

SEQ ID NO: 2280501 - RNA, 16 nt, Human
gcuugagcccaggagu

SEQ ID NO: 2280502 - RNA, 12 nt, Human
gcuugagccggg

SEQ ID NO: 2280503 - RNA, 12 nt, Human
gcuugagcccag

SEQ ID NO: 2280504 - RNA, 20 nt, Human
gcuugagaaauauggacacu

SEQ ID NO: 2280505 - RNA, 15 nt, Human
gcuugacuuuuguau

SEQ ID NO: 2280506 - RNA, 22 nt, Human
gcuugacuuuuguauagguaga

SEQ ID NO: 2280507 - RNA, 12 nt, Human
gcuucuugccuc

SEQ ID NO: 2280508 - RNA, 13 nt, Human
gcuucuugccucu

SEQ ID NO: 2280509 - RNA, 14 nt, Human
gcuucuugccucug

SEQ ID NO: 2280510 - RNA, 15 nt, Human
gcuucuugccucugu

SEQ ID NO: 2280511 - RNA, 16 nt, Human
gcuucuugccucugug

SEQ ID NO: 2280512 - RNA, 17 nt, Human
gcuucuugccucugugc

SEQ ID NO: 2280513 - RNA, 18 nt, Human
gcuucuugccucugugcu

SEQ ID NO: 2280514 - RNA, 14 nt, Human
gcuugagcucagga

SEQ ID NO: 2280515 - RNA, 20 nt, Human
gcuuguaaauagcucaggug

SEQ ID NO: 2280516 - RNA, 17 nt, Human
gcuugagccgggccccu

SEQ ID NO: 2280517 - RNA, 18 nt, Human
gcuugagccgggccccug

SEQ ID NO: 2280518 - RNA, 21 nt, Human
gcuugagccgggccccugggc

SEQ ID NO: 2280519 - RNA, 22 nt, Human
gcuugagccgggccccugggcu

SEQ ID NO: 2280520 - RNA, 22 nt, Human
gcuuguaacuccaccaacccau

SEQ ID NO: 2280521 - RNA, 23 nt, Human
gcuuccuagaaguuacugaaugc

SEQ ID NO: 2280522 - RNA, 22 nt, Human
gcuuccucauaguaugguggcu

SEQ ID NO: 2280523 - RNA, 18 nt, Human
gcuuccugacaaucaacu

SEQ ID NO: 2280524 - RNA, 17 nt, Human
gcuucguuuauuuucaa

SEQ ID NO: 2280525 - RNA, 16 nt, Human
gcuucguuuauuuuca

SEQ ID NO: 2280526 - RNA, 15 nt, Human
gcuucuaauauuuau

SEQ ID NO: 2280527 - RNA, 18 nt, Human
gcuucuaauauuuauugc

SEQ ID NO: 2280528 - RNA, 20 nt, Human
gcuucuaauauuuauugcuu

SEQ ID NO: 2280529 - RNA, 21 nt, Human
gcuucuaauauuuauugcuuu

SEQ ID NO: 2280530 - RNA, 14 nt, Human
gcuucguuuauuuu

SEQ ID NO: 2280531 - RNA, 22 nt, Human
gcuuccucuagaagccaaggga

SEQ ID NO: 2280532 - RNA, 23 nt, Human
gcuuccucuagaagccaagggaa

SEQ ID NO: 2280533 - RNA, 13 nt, Human
gcuuccuccugcg

SEQ ID NO: 2280534 - RNA, 15 nt, Human
gcuuccucuagaagc

SEQ ID NO: 2280535 - RNA, 17 nt, Human
gcuuccucuagaagcca

SEQ ID NO: 2280536 - RNA, 20 nt, Human
gcuuccucuagaagccaagg

SEQ ID NO: 2280537 - RNA, 14 nt, Human
gcuuccuccucccu

SEQ ID NO: 2280538 - RNA, 12 nt, Human
gcuuccuccugg

SEQ ID NO: 2280539 - RNA, 13 nt, Human
gcuuccuccugga

SEQ ID NO: 2280540 - RNA, 16 nt, Human
gcuuccuccuggaaau

SEQ ID NO: 2280541 - RNA, 17 nt, Human
gcuucuaccaugaacag

SEQ ID NO: 2280542 - RNA, 22 nt, Human
gcuucuaauauuuauugcuuua

SEQ ID NO: 2280543 - RNA, 19 nt, Human
gcuucuaccaugaacagaa

SEQ ID NO: 2280544 - RNA, 16 nt, Human
gcuucuucagaucagu

SEQ ID NO: 2280545 - RNA, 15 nt, Human
gcuucuuccaggugc

SEQ ID NO: 2280546 - RNA, 19 nt, Human
gcuucuuccaggugcccag

SEQ ID NO: 2280547 - RNA, 16 nt, Human
gcuucuuccaggugcc

SEQ ID NO: 2280548 - RNA, 19 nt, Human
gcuucuucagaucagugcu

SEQ ID NO: 2280549 - RNA, 14 nt, Human
gcuucuucucaggc

SEQ ID NO: 2280550 - RNA, 21 nt, Human
gcuucuuccuauuugccaugg

SEQ ID NO: 2280551 - RNA, 20 nt, Human
gcuucuucuccuauguguaa

SEQ ID NO: 2280552 - RNA, 18 nt, Human
gcuucuucuccuaugugu

SEQ ID NO: 2280553 - RNA, 19 nt, Human
gcuucuucuccuaugugua

SEQ ID NO: 2280554 - RNA, 23 nt, Human
gcugggugcgaccccaucugccc

SEQ ID NO: 2280555 - RNA, 21 nt, Human
gcugggugcgaccccaucugc

SEQ ID NO: 2280556 - RNA, 22 nt, Human
gcugggugcgaccccaucugcc

SEQ ID NO: 2280557 - RNA, 23 nt, Human
gcuggguggcaccagcagccugg

SEQ ID NO: 2280558 - RNA, 22 nt, Human
gcuggguggcaccagcagccug

SEQ ID NO: 2280559 - RNA, 21 nt, Human
gcuggguggcaccagcagccu

SEQ ID NO: 2280560 - RNA, 16 nt, Human
gcuggcugggcaugga

SEQ ID NO: 2280561 - RNA, 15 nt, Human
gcuggcugggcaugg

SEQ ID NO: 2280562 - RNA, 14 nt, Human
gcuggcuggggccu

SEQ ID NO: 2280563 - RNA, 15 nt, Human
gcuggcuguuggcug

SEQ ID NO: 2280564 - RNA, 16 nt, Human
gcuggcuguuggcugg

SEQ ID NO: 2280565 - RNA, 17 nt, Human
gcuggcuguuggcuggg

SEQ ID NO: 2280566 - RNA, 16 nt, Human
gcuggcggcuacucag

SEQ ID NO: 2280567 - RNA, 16 nt, Human
gcuggcgccucugcaa

SEQ ID NO: 2280568 - RNA, 12 nt, Human
gcuggcgccucu

SEQ ID NO: 2280569 - RNA, 13 nt, Human
gcuggcgccucug

SEQ ID NO: 2280570 - RNA, 14 nt, Human
gcuggcgccucugc

SEQ ID NO: 2280571 - RNA, 15 nt, Human
gcuggcgccucugca

SEQ ID NO: 2280572 - RNA, 22 nt, Human
gcuggcuccagaugcagggcag

SEQ ID NO: 2280573 - RNA, 21 nt, Human
gcuggcuccagaugcagggca

SEQ ID NO: 2280574 - RNA, 17 nt, Human
gcuggcuccagaugcag

SEQ ID NO: 2280575 - RNA, 14 nt, Human
gcuggcuccagaug

SEQ ID NO: 2280576 - RNA, 20 nt, Human
gcuggcggcuacucagcagc

SEQ ID NO: 2280577 - RNA, 23 nt, Human
gcuggcuccagaugcagggcagu

SEQ ID NO: 2280578 - RNA, 12 nt, Human
gcuggcucugag

SEQ ID NO: 2280579 - RNA, 23 nt, Human
gcugggccccugccucucugcag

SEQ ID NO: 2280580 - RNA, 21 nt, Human
gcugggccccugccucucugc

SEQ ID NO: 2280581 - RNA, 22 nt, Human
gcugggccccugccucucugca

SEQ ID NO: 2280582 - RNA, 12 nt, Human
gcugggucgccc

SEQ ID NO: 2280583 - RNA, 16 nt, Human
gcugggucaggcaggg

SEQ ID NO: 2280584 - RNA, 15 nt, Human
gcugggucaggcagg

SEQ ID NO: 2280585 - RNA, 14 nt, Human
gcugggucaggcag

SEQ ID NO: 2280586 - RNA, 13 nt, Human
gcugggucaggca

SEQ ID NO: 2280587 - RNA, 21 nt, Human
gcuggguaaacuguggaugau

SEQ ID NO: 2280588 - RNA, 11 nt, Human
gcugcuggcuu

SEQ ID NO: 2280589 - RNA, 15 nt, Human
gcugcuggcuugcag

SEQ ID NO: 2280590 - RNA, 16 nt, Human
gcugcuggcgccucug

SEQ ID NO: 2280591 - RNA, 17 nt, Human
gcugcuggcgccucugc

SEQ ID NO: 2280592 - RNA, 18 nt, Human
gcugcuggcgccucugca

SEQ ID NO: 2280593 - RNA, 19 nt, Human
gcugcuggcgccucugcaa

SEQ ID NO: 2280594 - RNA, 14 nt, Human
gcugcugcugcugc

SEQ ID NO: 2280595 - RNA, 21 nt, Human
gcugcuggacaguaucacugu

SEQ ID NO: 2280596 - RNA, 13 nt, Human
gcugcuggagacu

SEQ ID NO: 2280597 - RNA, 14 nt, Human
gcugcuggagacuc

SEQ ID NO: 2280598 - RNA, 18 nt, Human
gcugcugaaggcucgagc

SEQ ID NO: 2280599 - RNA, 15 nt, Human
gcugcugaaggcuca

SEQ ID NO: 2280600 - RNA, 13 nt, Human
gcugcugcugcug

SEQ ID NO: 2280601 - RNA, 22 nt, Human
gcugcuggaggaaaacugagac

SEQ ID NO: 2280602 - RNA, 18 nt, Human
gcugcuggaucacagcug

SEQ ID NO: 2280603 - RNA, 14 nt, Human
gcugcuggaggaaa

SEQ ID NO: 2280604 - RNA, 12 nt, Human
gcugcuggagga

SEQ ID NO: 2280605 - RNA, 12 nt, Human
gcugcuggcgcc

SEQ ID NO: 2280606 - RNA, 20 nt, Human
gcugcuggaucacagcugcu

SEQ ID NO: 2280607 - RNA, 14 nt, Human
gcugcuggcgccuc

SEQ ID NO: 2280608 - RNA, 13 nt, Human
gcugcuggcuggu

SEQ ID NO: 2280609 - RNA, 15 nt, Human
gcucugcccugcccu

SEQ ID NO: 2280610 - RNA, 13 nt, Human
gcucugcccugcc

SEQ ID NO: 2280611 - RNA, 13 nt, Human
gcucugcccuugg

SEQ ID NO: 2280612 - RNA, 23 nt, Human
gcucugggccauucuccacagca

SEQ ID NO: 2280613 - RNA, 20 nt, Human
gcucugggccauucuccaca

SEQ ID NO: 2280614 - RNA, 14 nt, Human
gcucugggccauuc

SEQ ID NO: 2280615 - RNA, 15 nt, Human
gcucugguccauaga

SEQ ID NO: 2280616 - RNA, 16 nt, Human
gcucugguccauagag

SEQ ID NO: 2280617 - RNA, 23 nt, Human
gcucugguccauagagagcaaga

SEQ ID NO: 2280618 - RNA, 13 nt, Human
gcugcugaaggcu

SEQ ID NO: 2280619 - RNA, 14 nt, Human
gcugcugaaggcuc

SEQ ID NO: 2280620 - RNA, 15 nt, Human
gcugcugaaggcucg

SEQ ID NO: 2280621 - RNA, 12 nt, Human
gcuggagugagg

SEQ ID NO: 2280622 - RNA, 14 nt, Human
gcuggccuggccgg

SEQ ID NO: 2280623 - RNA, 17 nt, Human
gcuggccuggccggcaa

SEQ ID NO: 2280624 - RNA, 15 nt, Human
gcuggagugcagugg

SEQ ID NO: 2280625 - RNA, 12 nt, Human
gcuggccuuccu

SEQ ID NO: 2280626 - RNA, 13 nt, Human
gcuggccuuccug

SEQ ID NO: 2280627 - RNA, 15 nt, Human
gcuggccuuccugcc

SEQ ID NO: 2280628 - RNA, 16 nt, Human
gcuggccuuccugccc

SEQ ID NO: 2280629 - RNA, 23 nt, Human
gcuggccuuccugcccuacagag

SEQ ID NO: 2280630 - RNA, 19 nt, Human
gcuggccuuccugcccuac

SEQ ID NO: 2280631 - RNA, 20 nt, Human
gcuggcgugcaguggugcga

SEQ ID NO: 2280632 - RNA, 13 nt, Human
gcuggcgcagcca

SEQ ID NO: 2280633 - RNA, 14 nt, Human
gcuggcgcagccaa

SEQ ID NO: 2280634 - RNA, 16 nt, Human
gcuggcgcagccaagg

SEQ ID NO: 2280635 - RNA, 17 nt, Human
gcuggcgcagccaaggc

SEQ ID NO: 2280636 - RNA, 20 nt, Human
gcuggcgcagccaaggccga

SEQ ID NO: 2280637 - RNA, 18 nt, Human
gcuggagugcagugagcc

SEQ ID NO: 2280638 - RNA, 17 nt, Human
gcuggagugcagugagc

SEQ ID NO: 2280639 - RNA, 22 nt, Human
gcuggagugcagugagccgaga

SEQ ID NO: 2280640 - RNA, 20 nt, Human
gcuggccuggccccucaggg

SEQ ID NO: 2280641 - RNA, 21 nt, Human
gcuggaggcagggccuugccc

SEQ ID NO: 2280642 - RNA, 16 nt, Human
gcuggaggcagggccu

SEQ ID NO: 2280643 - RNA, 12 nt, Human
gcuggaggcagg

SEQ ID NO: 2280644 - RNA, 15 nt, Human
gcuggaggcagggcc

SEQ ID NO: 2280645 - RNA, 14 nt, Human
gcuggaggcagggc

SEQ ID NO: 2280646 - RNA, 13 nt, Human
gcuggaggcaggg

SEQ ID NO: 2280647 - RNA, 16 nt, Human
gcuggagguaaggccu

SEQ ID NO: 2280648 - RNA, 14 nt, Human
gcuggaggugggag

SEQ ID NO: 2280649 - RNA, 15 nt, Human
gcuggaggugggagc

SEQ ID NO: 2280650 - RNA, 16 nt, Human
gcuggaggugggagca

SEQ ID NO: 2280651 - RNA, 17 nt, Human
gcuggaggugggagcag

SEQ ID NO: 2280652 - RNA, 19 nt, Human
gcuggaggugggagcagga

SEQ ID NO: 2280653 - RNA, 21 nt, Human
gcuggaggugggagcaggaga

SEQ ID NO: 2280654 - RNA, 16 nt, Human
gcuggagguggggccu

SEQ ID NO: 2280655 - RNA, 22 nt, Human
gcuggaggugggagcaggagau

SEQ ID NO: 2280656 - RNA, 20 nt, Human
gcccucaccccugcccuggg

SEQ ID NO: 2280657 - RNA, 17 nt, Human
gcccccaccgugggcag

SEQ ID NO: 2280658 - RNA, 22 nt, Human
gcccccaccgugggcagggagc

SEQ ID NO: 2280659 - RNA, 13 nt, Human
gcccccaccucca

SEQ ID NO: 2280660 - RNA, 14 nt, Human
gcccccaccuccac

SEQ ID NO: 2280661 - RNA, 20 nt, Human
gcccccaccgugggcaggga

SEQ ID NO: 2280662 - RNA, 18 nt, Human
gcccccaccgugggcagg

SEQ ID NO: 2280663 - RNA, 12 nt, Human
gcccccacuggu

SEQ ID NO: 2280664 - RNA, 17 nt, Human
gcccccacugaccagaa

SEQ ID NO: 2280665 - RNA, 12 nt, Human
gcccccacugac

SEQ ID NO: 2280666 - RNA, 18 nt, Human
gcccccaccuccacccuc

SEQ ID NO: 2280667 - RNA, 15 nt, Human
gcccccaccuccacc

SEQ ID NO: 2280668 - RNA, 16 nt, Human
gcccccaccuccaccc

SEQ ID NO: 2280669 - RNA, 15 nt, Human
gcccccccuuccacu

SEQ ID NO: 2280670 - RNA, 11 nt, Human
gccccccucaa

SEQ ID NO: 2280671 - RNA, 14 nt, Human
gccccccucaaacc

SEQ ID NO: 2280672 - RNA, 16 nt, Human
gccccccucaaaccuc

SEQ ID NO: 2280673 - RNA, 18 nt, Human
gccccugccaccucccug

SEQ ID NO: 2280674 - RNA, 16 nt, Human
gccccugccagacccc

SEQ ID NO: 2280675 - RNA, 11 nt, Human
gccccugccag

SEQ ID NO: 2280676 - RNA, 17 nt, Human
gccccugccacccuggg

SEQ ID NO: 2280677 - RNA, 16 nt, Human
gccccugccacccugg

SEQ ID NO: 2280678 - RNA, 13 nt, Human
gcccccccuucca

SEQ ID NO: 2280679 - RNA, 14 nt, Human
gcccccccuuccac

SEQ ID NO: 2280680 - RNA, 17 nt, Human
gcccccccccaccccug

SEQ ID NO: 2280681 - RNA, 16 nt, Human
gcccccccccaccccu

SEQ ID NO: 2280682 - RNA, 23 nt, Human
gcccccccaacacugugcccugg

SEQ ID NO: 2280683 - RNA, 16 nt, Human
gccccccauccuggcc

SEQ ID NO: 2280684 - RNA, 17 nt, Human
gccccccauccuggccc

SEQ ID NO: 2280685 - RNA, 18 nt, Human
gccccccauccuggccca

SEQ ID NO: 2280686 - RNA, 19 nt, Human
gccccccauccuggcccau

SEQ ID NO: 2280687 - RNA, 20 nt, Human
gccccccauccuggcccauc

SEQ ID NO: 2280688 - RNA, 17 nt, Human
gcccccccaacacugug

SEQ ID NO: 2280689 - RNA, 19 nt, Human
gcccccccaacacugugcc

SEQ ID NO: 2280690 - RNA, 22 nt, Human
gcccccccaacacugugcccug

SEQ ID NO: 2280691 - RNA, 14 nt, Human
gccccccaccccag

SEQ ID NO: 2280692 - RNA, 13 nt, Human
gccccccacccca

SEQ ID NO: 2280693 - RNA, 15 nt, Human
gccccccauccuggc

SEQ ID NO: 2280694 - RNA, 16 nt, Human
gccccccagccucugg

SEQ ID NO: 2280695 - RNA, 19 nt, Human
gcccccacugccuuugacc

SEQ ID NO: 2280696 - RNA, 18 nt, Human
gcccccaucucaugcccc

SEQ ID NO: 2280697 - RNA, 16 nt, Human
gcccucaaggccuccc

SEQ ID NO: 2280698 - RNA, 15 nt, Human
gcccucaaggccucc

SEQ ID NO: 2280699 - RNA, 19 nt, Human
gcccucaaaaugacagcca

SEQ ID NO: 2280700 - RNA, 15 nt, Human
gcccucaaucccagc

SEQ ID NO: 2280701 - RNA, 17 nt, Human
gcccucaaggccuccca

SEQ ID NO: 2280702 - RNA, 18 nt, Human
gcccucaaggccucccac

SEQ ID NO: 2280703 - RNA, 19 nt, Human
gcccucaaggccucccaca

SEQ ID NO: 2280704 - RNA, 20 nt, Human
gcccucaaggccucccacag

SEQ ID NO: 2280705 - RNA, 13 nt, Human
gcccucaccccug

SEQ ID NO: 2280706 - RNA, 21 nt, Human
gcccucaaggccucccacagu

SEQ ID NO: 2280707 - RNA, 22 nt, Human
gcccucaaggccucccacagug

SEQ ID NO: 2280708 - RNA, 19 nt, Human
gcccucaccccugcccugg

SEQ ID NO: 2280709 - RNA, 23 nt, Human
gcccucaaggccucccacaguga

SEQ ID NO: 2280710 - RNA, 18 nt, Human
gcccucaccccugguucu

SEQ ID NO: 2280711 - RNA, 15 nt, Human
gcccucacccugggg

SEQ ID NO: 2280712 - RNA, 21 nt, Human
gcccucaccccugguucucau

SEQ ID NO: 2280713 - RNA, 22 nt, Human
gcccucaccccugguucucauc

SEQ ID NO: 2280714 - RNA, 18 nt, Human
gcccgucauguuccucaa

SEQ ID NO: 2280715 - RNA, 21 nt, Human
gcccuaaccucugagucacca

SEQ ID NO: 2280716 - RNA, 17 nt, Human
gcccguaaacacgccug

SEQ ID NO: 2280717 - RNA, 13 nt, Human
gcccguccugccu

SEQ ID NO: 2280718 - RNA, 15 nt, Human
gcccuaaggaucucu

SEQ ID NO: 2280719 - RNA, 20 nt, Human
gcccuaaugcgcaggcuggc

SEQ ID NO: 2280720 - RNA, 19 nt, Human
gcccuaaugcgcaggcugg

SEQ ID NO: 2280721 - RNA, 17 nt, Human
gcccuaaugcgcaggcu

SEQ ID NO: 2280722 - RNA, 16 nt, Human
gcccuaaugcgcaggc

SEQ ID NO: 2280723 - RNA, 15 nt, Human
gccccugcugccucc

SEQ ID NO: 2280724 - RNA, 13 nt, Human
gccccugcugccu

SEQ ID NO: 2280725 - RNA, 15 nt, Human
gccccugccccagcc

SEQ ID NO: 2280726 - RNA, 20 nt, Human
gccccugccccagcccaagu

SEQ ID NO: 2280727 - RNA, 21 nt, Human
gccccugccccagcccaaguc

SEQ ID NO: 2280728 - RNA, 20 nt, Human
gccccugccucucugcaggu

SEQ ID NO: 2280729 - RNA, 23 nt, Human
gccccugccucucugcagguccc

SEQ ID NO: 2280730 - RNA, 20 nt, Human
gccccugcugccuccccaac

SEQ ID NO: 2280731 - RNA, 17 nt, Human
gccccugcugccucccc

SEQ ID NO: 2280732 - RNA, 16 nt, Human
gccccugcugccuccc

SEQ ID NO: 2280733 - RNA, 19 nt, Human
gccccugcugccuccccaa

SEQ ID NO: 2280734 - RNA, 12 nt, Human
gcccgggcugcc

SEQ ID NO: 2280735 - RNA, 23 nt, Human
gcccgggcucugccucccaucac

SEQ ID NO: 2280736 - RNA, 22 nt, Human
gcccggggcagcugccagagaa

SEQ ID NO: 2280737 - RNA, 17 nt, Human
gcccggggcagcugcca

SEQ ID NO: 2280738 - RNA, 14 nt, Human
gcccggggcagcug

SEQ ID NO: 2280739 - RNA, 18 nt, Human
gcccggggcagcugccag

SEQ ID NO: 2280740 - RNA, 13 nt, Human
gcccgggcugccu

SEQ ID NO: 2280741 - RNA, 14 nt, Human
gcccgggcugccug

SEQ ID NO: 2280742 - RNA, 15 nt, Human
gcccgggcugccugg

SEQ ID NO: 2280743 - RNA, 16 nt, Human
gcccgggcugccuggg

SEQ ID NO: 2280744 - RNA, 17 nt, Human
gcccgggcugccugggc

SEQ ID NO: 2280745 - RNA, 18 nt, Human
gcccgggcugccugggcu

SEQ ID NO: 2280746 - RNA, 23 nt, Human
gcccgggcugccugggcuguugg

SEQ ID NO: 2280747 - RNA, 21 nt, Human
gcccugcagaggggaaaccag

SEQ ID NO: 2280748 - RNA, 16 nt, Human
gcccugcagagggcac

SEQ ID NO: 2280749 - RNA, 18 nt, Human
gcccugcagagggcacag

SEQ ID NO: 2280750 - RNA, 18 nt, Human
gcccugcccuagcuccac

SEQ ID NO: 2280751 - RNA, 17 nt, Human
gcccugcccuagcucca

SEQ ID NO: 2280752 - RNA, 16 nt, Human
gcccugcccuagcucc

SEQ ID NO: 2280753 - RNA, 15 nt, Human
gcccugcccuagcuc

SEQ ID NO: 2280754 - RNA, 11 nt, Human
gcccugcccug

SEQ ID NO: 2280755 - RNA, 16 nt, Human
gcccugcccugguuuc

SEQ ID NO: 2280756 - RNA, 12 nt, Human
gcccugcccugg

SEQ ID NO: 2280757 - RNA, 11 nt, Human
gcccugccucc

SEQ ID NO: 2280758 - RNA, 17 nt, Human
gcccugcccaccuggcc

SEQ ID NO: 2280759 - RNA, 20 nt, Human
gcccugcccaccuggccucu

SEQ ID NO: 2280760 - RNA, 21 nt, Human
gcccugcccaccuggccucug

SEQ ID NO: 2280761 - RNA, 22 nt, Human
gcccugcccaccuggccucugc

SEQ ID NO: 2280762 - RNA, 13 nt, Human
gcccugucccucc

SEQ ID NO: 2280763 - RNA, 15 nt, Human
gcccugucccuccca

SEQ ID NO: 2280764 - RNA, 16 nt, Human
gcccugucccucccac

SEQ ID NO: 2280765 - RNA, 17 nt, Human
gcccugucccucccacc

SEQ ID NO: 2280766 - RNA, 18 nt, Human
gcccugucccucccaccu

SEQ ID NO: 2280767 - RNA, 18 nt, Human
gcccugcccugguuuccu

SEQ ID NO: 2280768 - RNA, 12 nt, Human
gcccugccuccu

SEQ ID NO: 2280769 - RNA, 13 nt, Human
gcccugccuccuu

SEQ ID NO: 2280770 - RNA, 19 nt, Human
gcccuuagcagggaaacag

SEQ ID NO: 2280771 - RNA, 21 nt, Human
gcccugugcaaccucuuggcc

SEQ ID NO: 2280772 - RNA, 17 nt, Human
gcccugucgagacacuu

SEQ ID NO: 2280773 - RNA, 11 nt, Human
gcccugucugu

SEQ ID NO: 2280774 - RNA, 20 nt, Human
gcccuuagcagggaaacagc

SEQ ID NO: 2280775 - RNA, 22 nt, Human
gcccuguccugccuaaggcuga

SEQ ID NO: 2280776 - RNA, 19 nt, Human
gcccugucccucccaccuc

SEQ ID NO: 2280777 - RNA, 20 nt, Human
gcccugucccucccaccucu

SEQ ID NO: 2280778 - RNA, 21 nt, Human
gcccugucccucccaccucug

SEQ ID NO: 2280779 - RNA, 22 nt, Human
gcccugucccucccaccucugu

SEQ ID NO: 2280780 - RNA, 23 nt, Human
gcccugucccucccaccucugug

SEQ ID NO: 2280781 - RNA, 16 nt, Human
gcccugucgagacacu

SEQ ID NO: 2280782 - RNA, 21 nt, Human
gcccugucgagacacuugccu

SEQ ID NO: 2280783 - RNA, 18 nt, Human
gccgcagccucccucuga

SEQ ID NO: 2280784 - RNA, 17 nt, Human
gccgcagccucccucug

SEQ ID NO: 2280785 - RNA, 19 nt, Human
gccgcagcccugcagaggg

SEQ ID NO: 2280786 - RNA, 20 nt, Human
gccgcagcccugcagagggc

SEQ ID NO: 2280787 - RNA, 22 nt, Human
gcccuuagcagggaaacagcua

SEQ ID NO: 2280788 - RNA, 16 nt, Human
gcccuuaucugugcuc

SEQ ID NO: 2280789 - RNA, 15 nt, Human
gcccuuaucugugcu

SEQ ID NO: 2280790 - RNA, 19 nt, Human
gccgccccagccucugagc

SEQ ID NO: 2280791 - RNA, 14 nt, Human
gccgccccacccag

SEQ ID NO: 2280792 - RNA, 17 nt, Human
gccgcccccugcccccc

SEQ ID NO: 2280793 - RNA, 15 nt, Human
gccgccccacccaga

SEQ ID NO: 2280794 - RNA, 13 nt, Human
gccgccgccucgc

SEQ ID NO: 2280795 - RNA, 18 nt, Human
gccgcccugcgggugaac

SEQ ID NO: 2280796 - RNA, 23 nt, Human
gccgcccccugccccccagccuc

SEQ ID NO: 2280797 - RNA, 15 nt, Human
gccgcauucccugag

SEQ ID NO: 2280798 - RNA, 14 nt, Human
gccgcauucccuga

SEQ ID NO: 2280799 - RNA, 20 nt, Human
gccgcaucuucuccaucugg

SEQ ID NO: 2280800 - RNA, 18 nt, Human
gccgcaucuucuccaucu

SEQ ID NO: 2280801 - RNA, 17 nt, Human
gccgcaucuucuccauc

SEQ ID NO: 2280802 - RNA, 15 nt, Human
gccgcaucuucucca

SEQ ID NO: 2280803 - RNA, 19 nt, Human
gccgcagcucuugcccuuc

SEQ ID NO: 2280804 - RNA, 20 nt, Human
gccgcagcucuugcccuucc

SEQ ID NO: 2280805 - RNA, 18 nt, Human
gcccuuaucugugcucag

SEQ ID NO: 2280806 - RNA, 13 nt, Human
gccgcagcucuug

SEQ ID NO: 2280807 - RNA, 14 nt, Human
gccgcagcucuugc

SEQ ID NO: 2280808 - RNA, 15 nt, Human
gccgcagcucuugcc

SEQ ID NO: 2280809 - RNA, 21 nt, Human
gccuaguucauccaauccuca

SEQ ID NO: 2280810 - RNA, 17 nt, Human
gccuaguucauccaauc

SEQ ID NO: 2280811 - RNA, 23 nt, Human
gccuaguggggucucccucuccu

SEQ ID NO: 2280812 - RNA, 22 nt, Human
gccuaguggggucucccucucc

SEQ ID NO: 2280813 - RNA, 19 nt, Human
gccuaguggggucucccuc

SEQ ID NO: 2280814 - RNA, 18 nt, Human
gccuaguggggucucccu

SEQ ID NO: 2280815 - RNA, 19 nt, Human
gccuagucccuuccacacc

SEQ ID NO: 2280816 - RNA, 22 nt, Human
gccuaggggucagggaccaagg

SEQ ID NO: 2280817 - RNA, 19 nt, Human
gccuagugaaggcuucucu

SEQ ID NO: 2280818 - RNA, 23 nt, Human
gccuagugaaggcuucucucugu

SEQ ID NO: 2280819 - RNA, 22 nt, Human
gccuagugaaggcuucucucug

SEQ ID NO: 2280820 - RNA, 14 nt, Human
gccuagucccuucc

SEQ ID NO: 2280821 - RNA, 17 nt, Human
gccuaggggucagggac

SEQ ID NO: 2280822 - RNA, 17 nt, Human
gccuagggccuggucca

SEQ ID NO: 2280823 - RNA, 20 nt, Human
gccuaggugacagagugaga

SEQ ID NO: 2280824 - RNA, 16 nt, Human
gccuaggccucagcca

SEQ ID NO: 2280825 - RNA, 13 nt, Human
gccuaggccucag

SEQ ID NO: 2280826 - RNA, 17 nt, Human
gccuaggaauucccagc

SEQ ID NO: 2280827 - RNA, 20 nt, Human
gccuaggagauaucugaggg

SEQ ID NO: 2280828 - RNA, 11 nt, Human
gccuaggagau

SEQ ID NO: 2280829 - RNA, 18 nt, Human
gccuaggagauaucugag

SEQ ID NO: 2280830 - RNA, 15 nt, Human
gccuagcugcuacaa

SEQ ID NO: 2280831 - RNA, 16 nt, Human
gccuagcugcuacaaa

SEQ ID NO: 2280832 - RNA, 17 nt, Human
gccuagcugcuacaaag

SEQ ID NO: 2280833 - RNA, 19 nt, Human
gccuagcugcuacaaagaa

SEQ ID NO: 2280834 - RNA, 22 nt, Human
gccuagcugcuacaaagaagac

SEQ ID NO: 2280835 - RNA, 23 nt, Human
gccuagcugcuacaaagaagaca

SEQ ID NO: 2280836 - RNA, 24 nt, Human
gccuagcugcuacaaagaagacau

SEQ ID NO: 2280837 - RNA, 13 nt, Human
gccuaggugacag

SEQ ID NO: 2280838 - RNA, 18 nt, Human
gccuaggccucagccaga

SEQ ID NO: 2280839 - RNA, 17 nt, Human
gccuaggccucagccag

SEQ ID NO: 2280840 - RNA, 20 nt, Human
gccuaggccucagccagaga

SEQ ID NO: 2280841 - RNA, 14 nt, Human
gccuaggugacaga

SEQ ID NO: 2280842 - RNA, 15 nt, Human
gccuaggugacagag

SEQ ID NO: 2280843 - RNA, 20 nt, Human
gccuagccgaccucagccuu

SEQ ID NO: 2280844 - RNA, 19 nt, Human
gccuagccgaccucagccu

SEQ ID NO: 2280845 - RNA, 14 nt, Human
gccgccucaccccc

SEQ ID NO: 2280846 - RNA, 14 nt, Human
gccuagcugcuaca

SEQ ID NO: 2280847 - RNA, 18 nt, Human
gccuagccgaccucagcc

SEQ ID NO: 2280848 - RNA, 17 nt, Human
gccuagccgaccucagc

SEQ ID NO: 2280849 - RNA, 16 nt, Human
gccuagccgaccucag

SEQ ID NO: 2280850 - RNA, 15 nt, Human
gccuagccgaccuca

SEQ ID NO: 2280851 - RNA, 13 nt, Human
gccgccucaaugu

SEQ ID NO: 2280852 - RNA, 16 nt, Human
gccgccucacccccuc

SEQ ID NO: 2280853 - RNA, 23 nt, Human
gccuagcauacguacacauuuua

SEQ ID NO: 2280854 - RNA, 24 nt, Human
gccgccgccucgcccaccgcaugc

SEQ ID NO: 2280855 - RNA, 13 nt, Human
gccgccgccucuu

SEQ ID NO: 2280856 - RNA, 14 nt, Human
gccgccgccucgcc

SEQ ID NO: 2280857 - RNA, 15 nt, Human
gccgccgccucgccc

SEQ ID NO: 2280858 - RNA, 16 nt, Human
gccgccgccucgccca

SEQ ID NO: 2280859 - RNA, 20 nt, Human
gccuagcauacguacacauu

SEQ ID NO: 2280860 - RNA, 22 nt, Human
gccuagcauacguacacauuuu

SEQ ID NO: 2280861 - RNA, 21 nt, Human
gccuagcauacguacacauuu

SEQ ID NO: 2280862 - RNA, 18 nt, Human
gccugccccucccagaac

SEQ ID NO: 2280863 - RNA, 16 nt, Human
gccugccccucccaga

SEQ ID NO: 2280864 - RNA, 15 nt, Human
gccugccccucccag

SEQ ID NO: 2280865 - RNA, 14 nt, Human
gccugccccuccca

SEQ ID NO: 2280866 - RNA, 21 nt, Human
gccugccccgcccccaguccc

SEQ ID NO: 2280867 - RNA, 20 nt, Human
gccugccccgcccccagucc

SEQ ID NO: 2280868 - RNA, 17 nt, Human
gccugccccaaacaaau

SEQ ID NO: 2280869 - RNA, 23 nt, Human
gccugccccaaacaaauaugcaa

SEQ ID NO: 2280870 - RNA, 18 nt, Human
gccucuuuucucugugcu

SEQ ID NO: 2280871 - RNA, 16 nt, Human
gccugccccccucauc

SEQ ID NO: 2280872 - RNA, 22 nt, Human
gccugcccaggccccugccacc

SEQ ID NO: 2280873 - RNA, 23 nt, Human
gccucuuugucuaaaacaauaaa

SEQ ID NO: 2280874 - RNA, 19 nt, Human
gccucuuugucuaaaacaa

SEQ ID NO: 2280875 - RNA, 16 nt, Human
gccugaaagaggcuga

SEQ ID NO: 2280876 - RNA, 15 nt, Human
gccugcccaggcccc

SEQ ID NO: 2280877 - RNA, 16 nt, Human
gccuccaggugugcac

SEQ ID NO: 2280878 - RNA, 16 nt, Human
gccuccauccaaggcc

SEQ ID NO: 2280879 - RNA, 11 nt, Human
gccuccaugcu

SEQ ID NO: 2280880 - RNA, 16 nt, Human
gccucccaaagugcug

SEQ ID NO: 2280881 - RNA, 16 nt, Human
gccuccauucugacca

SEQ ID NO: 2280882 - RNA, 17 nt, Human
gccucccaaagugcugg

SEQ ID NO: 2280883 - RNA, 17 nt, Human
gccuccauuuaguucuu

SEQ ID NO: 2280884 - RNA, 17 nt, Human
gccuccauucugaccau

SEQ ID NO: 2280885 - RNA, 16 nt, Human
gccuccuuccaccucc

SEQ ID NO: 2280886 - RNA, 17 nt, Human
gccuccuuccaccuccc

SEQ ID NO: 2280887 - RNA, 18 nt, Human
gccuccuuccaccucccu

SEQ ID NO: 2280888 - RNA, 17 nt, Human
gccucgaacuggcugca

SEQ ID NO: 2280889 - RNA, 19 nt, Human
gccuccugugugugcgccu

SEQ ID NO: 2280890 - RNA, 23 nt, Human
gccuccugugugugcgccuacag

SEQ ID NO: 2280891 - RNA, 15 nt, Human
gccuccauccaaggc

SEQ ID NO: 2280892 - RNA, 12 nt, Human
gccuccauccug

SEQ ID NO: 2280893 - RNA, 21 nt, Human
gccuccagggcuggacugagg

SEQ ID NO: 2280894 - RNA, 22 nt, Human
gccuccagggcuggacugaggc

SEQ ID NO: 2280895 - RNA, 23 nt, Human
gccuccagggcuggacugaggcc

SEQ ID NO: 2280896 - RNA, 24 nt, Human
gccuccagggcuggacugaggccu

SEQ ID NO: 2280897 - RNA, 12 nt, Human
gccuccaggugu

SEQ ID NO: 2280898 - RNA, 13 nt, Human
gccuccaggugug

SEQ ID NO: 2280899 - RNA, 14 nt, Human
gccuccaggugugc

SEQ ID NO: 2280900 - RNA, 14 nt, Human
gccucuuggguuca

SEQ ID NO: 2280901 - RNA, 21 nt, Human
gccucuuaugggcuggguucu

SEQ ID NO: 2280902 - RNA, 21 nt, Human
gccucuuccagucuuccugac

SEQ ID NO: 2280903 - RNA, 19 nt, Human
gccucuuagacuucugcuu

SEQ ID NO: 2280904 - RNA, 17 nt, Human
gccucuucaaauuagaa

SEQ ID NO: 2280905 - RNA, 14 nt, Human
gccucuucccccug

SEQ ID NO: 2280906 - RNA, 16 nt, Human
gccucuucccccugcu

SEQ ID NO: 2280907 - RNA, 18 nt, Human
gccucuucccccugcuuc

SEQ ID NO: 2280908 - RNA, 22 nt, Human
gccucuucccccugcuuccacc

SEQ ID NO: 2280909 - RNA, 13 nt, Human
gccugcccaggcc

SEQ ID NO: 2280910 - RNA, 14 nt, Human
gccugcccaggccc

SEQ ID NO: 2280911 - RNA, 16 nt, Human
gccucuuucauccacu

SEQ ID NO: 2280912 - RNA, 23 nt, Human
gccucuuucauccacuagugcaa

SEQ ID NO: 2280913 - RNA, 23 nt, Human
gccucuuucaagcagucgugccu

SEQ ID NO: 2280914 - RNA, 17 nt, Human
gccucuuucugucccuu

SEQ ID NO: 2280915 - RNA, 12 nt, Human
gccucuuuucuc

SEQ ID NO: 2280916 - RNA, 23 nt, Human
gccucuuaaagcugccuguaguu

SEQ ID NO: 2280917 - RNA, 22 nt, Human
gccucuuaaagcugccuguagu

SEQ ID NO: 2280918 - RNA, 18 nt, Human
gccucuuagacuucugcu

SEQ ID NO: 2280919 - RNA, 20 nt, Human
gccucuuaaagcugccugua

SEQ ID NO: 2280920 - RNA, 17 nt, Human
gccucgacacagagugg

SEQ ID NO: 2280921 - RNA, 19 nt, Human
gccuccuuccaccucccuc

SEQ ID NO: 2280922 - RNA, 20 nt, Human
gccuccuuccaccucccucc

SEQ ID NO: 2280923 - RNA, 20 nt, Human
gccucgaacuggcugcaaag

SEQ ID NO: 2280924 - RNA, 22 nt, Human
gccucgaacuggcugcaaaggg

SEQ ID NO: 2280925 - RNA, 17 nt, Human
gccucuuaugggcuggg

SEQ ID NO: 2280926 - RNA, 18 nt, Human
gccucuuaugggcugggu

SEQ ID NO: 2280927 - RNA, 16 nt, Human
gccucuuaugggcugg

SEQ ID NO: 2280928 - RNA, 15 nt, Human
gccucuuagaugcag

SEQ ID NO: 2280929 - RNA, 22 nt, Human
gcgcacugugacccccagcucc

SEQ ID NO: 2280930 - RNA, 20 nt, Human
gcgcagcauauucaggaagc

SEQ ID NO: 2280931 - RNA, 19 nt, Human
gcgcaccugcccccuggug

SEQ ID NO: 2280932 - RNA, 18 nt, Human
gcgcaccugcccccuggu

SEQ ID NO: 2280933 - RNA, 17 nt, Human
gcgcaccugcccccugg

SEQ ID NO: 2280934 - RNA, 12 nt, Human
gcgcaccugccc

SEQ ID NO: 2280935 - RNA, 18 nt, Human
gcgcacaaggcugaccaa

SEQ ID NO: 2280936 - RNA, 17 nt, Human
gcgcacaaggcugacca

SEQ ID NO: 2280937 - RNA, 20 nt, Human
gcgcacaauaguaaccuggg

SEQ ID NO: 2280938 - RNA, 13 nt, Human
gcgcacccucccc

SEQ ID NO: 2280939 - RNA, 15 nt, Human
gcgcacccuccccuc

SEQ ID NO: 2280940 - RNA, 16 nt, Human
gcgcacccuccccucc

SEQ ID NO: 2280941 - RNA, 17 nt, Human
gcgcacccuccccuccc

SEQ ID NO: 2280942 - RNA, 18 nt, Human
gcgcacccuccccucccg

SEQ ID NO: 2280943 - RNA, 21 nt, Human
gcgcacccuccccucccgucu

SEQ ID NO: 2280944 - RNA, 19 nt, Human
gcgaugaauuuggagacuc

SEQ ID NO: 2280945 - RNA, 22 nt, Human
gcgaucuggguucacugcaacc

SEQ ID NO: 2280946 - RNA, 15 nt, Human
gcgauggucucagaa

SEQ ID NO: 2280947 - RNA, 21 nt, Human
gcgcacuuuccuccuggcaga

SEQ ID NO: 2280948 - RNA, 19 nt, Human
gccuguuggacccgcucug

SEQ ID NO: 2280949 - RNA, 17 nt, Human
gccuguuccccucacug

SEQ ID NO: 2280950 - RNA, 22 nt, Human
gccuguuccccucacuggauga

SEQ ID NO: 2280951 - RNA, 20 nt, Human
gccuugaccauucuccaccu

SEQ ID NO: 2280952 - RNA, 17 nt, Human
gccuugaccauucucca

SEQ ID NO: 2280953 - RNA, 19 nt, Human
gccuugaccauucuccacc

SEQ ID NO: 2280954 - RNA, 21 nt, Human
gccuguugggccaggagccuc

SEQ ID NO: 2280955 - RNA, 20 nt, Human
gccuucggccuccauccuga

SEQ ID NO: 2280956 - RNA, 23 nt, Human
gccuucggccuccauccugaggc

SEQ ID NO: 2280957 - RNA, 21 nt, Human
gccuucggccuccauccugag

SEQ ID NO: 2280958 - RNA, 22 nt, Human
gccuugcccggauucugggagg

SEQ ID NO: 2280959 - RNA, 20 nt, Human
gccuugcccagagaugccuc

SEQ ID NO: 2280960 - RNA, 22 nt, Human
gccuugcgguauccgcccccaa

SEQ ID NO: 2280961 - RNA, 19 nt, Human
gccuugcgguauccgcccc

SEQ ID NO: 2280962 - RNA, 18 nt, Human
gccuugcgguauccgccc

SEQ ID NO: 2280963 - RNA, 22 nt, Human
gccuugcccagagaugccucca

SEQ ID NO: 2280964 - RNA, 16 nt, Human
gccuugcccagagaug

SEQ ID NO: 2280965 - RNA, 15 nt, Human
gccuugcccagagau

SEQ ID NO: 2280966 - RNA, 14 nt, Human
gccuugcccagaga

SEQ ID NO: 2280967 - RNA, 12 nt, Human
gccuugcccaga

SEQ ID NO: 2280968 - RNA, 17 nt, Human
gccuugccagagaucca

SEQ ID NO: 2280969 - RNA, 13 nt, Human
gccuugccagaga

SEQ ID NO: 2280970 - RNA, 21 nt, Human
gccuguuggacccgcucugga

SEQ ID NO: 2280971 - RNA, 14 nt, Human
gccuugccagagau

SEQ ID NO: 2280972 - RNA, 21 nt, Human
gcgagcuaugaucgcgccacu

SEQ ID NO: 2280973 - RNA, 19 nt, Human
gcgaggagaugcuccuugg

SEQ ID NO: 2280974 - RNA, 15 nt, Human
gcgaggaggcuccag

SEQ ID NO: 2280975 - RNA, 20 nt, Human
gcgaggagaugcuccuuggg

SEQ ID NO: 2280976 - RNA, 21 nt, Human
gcgauccaccugucucagccu

SEQ ID NO: 2280977 - RNA, 18 nt, Human
gcgaggaggcuccagagg

SEQ ID NO: 2280978 - RNA, 17 nt, Human
gcgauccaccugucuca

SEQ ID NO: 2280979 - RNA, 17 nt, Human
gcgaggaggcuccagag

SEQ ID NO: 2280980 - RNA, 16 nt, Human
gcgaggaggcuccaga

SEQ ID NO: 2280981 - RNA, 17 nt, Human
gcgagcccugguggcag

SEQ ID NO: 2280982 - RNA, 15 nt, Human
gcgagcccugguggc

SEQ ID NO: 2280983 - RNA, 13 nt, Human
gccuggccugagc

SEQ ID NO: 2280984 - RNA, 14 nt, Human
gccuggccugagcu

SEQ ID NO: 2280985 - RNA, 18 nt, Human
gccuggccugagcuggga

SEQ ID NO: 2280986 - RNA, 21 nt, Human
gccuggcgaaaccccaucucu

SEQ ID NO: 2280987 - RNA, 13 nt, Human
gccuggccuggca

SEQ ID NO: 2280988 - RNA, 16 nt, Human
gccuggccuggcacac

SEQ ID NO: 2280989 - RNA, 19 nt, Human
gccuggcgacagagcgaga

SEQ ID NO: 2280990 - RNA, 15 nt, Human
gccuggcgggauggg

SEQ ID NO: 2280991 - RNA, 20 nt, Human
gccuggcgggaugggccacc

SEQ ID NO: 2280992 - RNA, 23 nt, Human
gccuggcgggaugggccaccgcc

SEQ ID NO: 2280993 - RNA, 21 nt, Human
gccuggcgggaugggccaccg

SEQ ID NO: 2280994 - RNA, 22 nt, Human
gccuggcgggaugggccaccgc

SEQ ID NO: 2280995 - RNA, 14 nt, Human
gccuggccugaggu

SEQ ID NO: 2280996 - RNA, 20 nt, Human
gccuggccugagcugggaug

SEQ ID NO: 2280997 - RNA, 23 nt, Human
gccuguucccauucuugcauggc

SEQ ID NO: 2280998 - RNA, 19 nt, Human
gccuguguccaugcgcuca

SEQ ID NO: 2280999 - RNA, 14 nt, Human
gccuguucccccgc

SEQ ID NO: 2281000 - RNA, 20 nt, Human
gccuguucccccgccgcuuu

SEQ ID NO: 2281001 - RNA, 14 nt, Human
gccuguugggccag

SEQ ID NO: 2281002 - RNA, 19 nt, Human
gccuguucccauucuugca

SEQ ID NO: 2281003 - RNA, 12 nt, Human
gccuguguccau

SEQ ID NO: 2281004 - RNA, 14 nt, Human
gccuguguccaugc

SEQ ID NO: 2281005 - RNA, 18 nt, Human
gccuguguaacagcuccu

SEQ ID NO: 2281006 - RNA, 19 nt, Human
gccuguguaacagcuccuu

SEQ ID NO: 2281007 - RNA, 22 nt, Human
gccuguguaacagcuccuuggg

SEQ ID NO: 2281008 - RNA, 23 nt, Human
gccuguguaacagcuccuuggga

SEQ ID NO: 2281009 - RNA, 15 nt, Human
gccuguugggccagg

SEQ ID NO: 2281010 - RNA, 16 nt, Human
gccuguugggccagga

SEQ ID NO: 2281011 - RNA, 18 nt, Human
gccuguugggccaggagc

SEQ ID NO: 2281012 - RNA, 20 nt, Human
gccuguugggccaggagccu

SEQ ID NO: 2281013 - RNA, 19 nt, Human
gccuguggcggugccuggg

SEQ ID NO: 2281014 - RNA, 18 nt, Human
gccuguggcggugccugg

SEQ ID NO: 2281015 - RNA, 16 nt, Human
gccuguggcggugccu

SEQ ID NO: 2281016 - RNA, 21 nt, Human
gccuguggcgccgucuccagg

SEQ ID NO: 2281017 - RNA, 23 nt, Human
gccuguggcgccgucuccagggg

SEQ ID NO: 2281018 - RNA, 14 nt, Human
gccuguguaacagc

SEQ ID NO: 2281019 - RNA, 16 nt, Human
gccuguguaacagcuc

SEQ ID NO: 2281020 - RNA, 17 nt, Human
gccuguguaacagcucc

SEQ ID NO: 2281021 - RNA, 18 nt, Human
gccugugccucugggacu

SEQ ID NO: 2281022 - RNA, 19 nt, Human
gccugugccuccucacccc

SEQ ID NO: 2281023 - RNA, 19 nt, Human
gccuguggcgccgucucca

SEQ ID NO: 2281024 - RNA, 18 nt, Human
gccuguggccuguguccc

SEQ ID NO: 2281025 - RNA, 17 nt, Human
gccugugccucugggac

SEQ ID NO: 2281026 - RNA, 16 nt, Human
gccugugccucuggga

SEQ ID NO: 2281027 - RNA, 13 nt, Human
gccuggcucaggu

SEQ ID NO: 2281028 - RNA, 14 nt, Human
gccuggcucagagc

SEQ ID NO: 2281029 - RNA, 16 nt, Human
gccuggcucagagcca

SEQ ID NO: 2281030 - RNA, 17 nt, Human
gccuggcucagagccag

SEQ ID NO: 2281031 - RNA, 18 nt, Human
gccuggcucagagccagu

SEQ ID NO: 2281032 - RNA, 20 nt, Human
gcgggaggauguucugggac

SEQ ID NO: 2281033 - RNA, 14 nt, Human
gcgggaugggccac

SEQ ID NO: 2281034 - RNA, 20 nt, Human
gcgugcacacaccagagccc

SEQ ID NO: 2281035 - RNA, 21 nt, Human
gcgggaggauguucugggaca

SEQ ID NO: 2281036 - RNA, 22 nt, Human
gcgggaggauguucugggacac

SEQ ID NO: 2281037 - RNA, 15 nt, Human
gcgggaugggccacc

SEQ ID NO: 2281038 - RNA, 16 nt, Human
gcgggaugggccaccg

SEQ ID NO: 2281039 - RNA, 19 nt, Human
gcgugcacacaccagagcc

SEQ ID NO: 2281040 - RNA, 23 nt, Human
gcgugcacacaccagagcccacc

SEQ ID NO: 2281041 - RNA, 14 nt, Human
gcgugcccucgcug

SEQ ID NO: 2281042 - RNA, 15 nt, Human
gcgugguuccuuucu

SEQ ID NO: 2281043 - RNA, 18 nt, Human
gcgugugcgugcaugugc

SEQ ID NO: 2281044 - RNA, 19 nt, Human
gcgugucgugggugugugu

SEQ ID NO: 2281045 - RNA, 17 nt, Human
gcgugucaccugugcuu

SEQ ID NO: 2281046 - RNA, 23 nt, Human
gcguguguccaugugugugcaag

SEQ ID NO: 2281047 - RNA, 18 nt, Human
gcguguguccaugugugu

SEQ ID NO: 2281048 - RNA, 16 nt, Human
gcguguguggguggau

SEQ ID NO: 2281049 - RNA, 23 nt, Human
gcguguguggguggauauaaaua

SEQ ID NO: 2281050 - RNA, 17 nt, Human
gcguguguccaugugug

SEQ ID NO: 2281051 - RNA, 22 nt, Human
gcguguguagaguuaagaagcu

SEQ ID NO: 2281052 - RNA, 20 nt, Human
gcguguguagaguuaagaag

SEQ ID NO: 2281053 - RNA, 21 nt, Human
gcguguguagaguuaagaagc

SEQ ID NO: 2281054 - RNA, 21 nt, Human
gcguguggcucacguguguga

SEQ ID NO: 2281055 - RNA, 18 nt, Human
gcguguguacacgggacu

SEQ ID NO: 2281056 - RNA, 12 nt, Human
gcguguguagag

SEQ ID NO: 2281057 - RNA, 15 nt, Human
gcguguguagaguua

SEQ ID NO: 2281058 - RNA, 19 nt, Human
gcguguggcucacgugugu

SEQ ID NO: 2281059 - RNA, 14 nt, Human
gcguguggcucacg

SEQ ID NO: 2281060 - RNA, 13 nt, Human
gcguguggcucac

SEQ ID NO: 2281061 - RNA, 11 nt, Human
gcguguggcuc

SEQ ID NO: 2281062 - RNA, 11 nt, Human
gcuaaaaaugg

SEQ ID NO: 2281063 - RNA, 22 nt, Human
gcguuugaccuuuuauguagua

SEQ ID NO: 2281064 - RNA, 18 nt, Human
gcguuucuaugacacaug

SEQ ID NO: 2281065 - RNA, 19 nt, Human
gcuacucagaagccugagg

SEQ ID NO: 2281066 - RNA, 18 nt, Human
gcuacucagaagccugag

SEQ ID NO: 2281067 - RNA, 17 nt, Human
gcuacucagaagccuga

SEQ ID NO: 2281068 - RNA, 16 nt, Human
gcuacucagaagccug

SEQ ID NO: 2281069 - RNA, 15 nt, Human
gcuacucagaagccu

SEQ ID NO: 2281070 - RNA, 20 nt, Human
gcuaauucccagagugugaa

SEQ ID NO: 2281071 - RNA, 22 nt, Human
gcuaauucuuugaccuguuggg

SEQ ID NO: 2281072 - RNA, 23 nt, Human
gcuacucaggaggcugaggcaga

SEQ ID NO: 2281073 - RNA, 16 nt, Human
gcuacucaggaggcug

SEQ ID NO: 2281074 - RNA, 15 nt, Human
gcuacucaggaggcu

SEQ ID NO: 2281075 - RNA, 14 nt, Human
gcuacucaggaggc

SEQ ID NO: 2281076 - RNA, 24 nt, Human
gcuacucagcagcccuccucaccc

SEQ ID NO: 2281077 - RNA, 22 nt, Human
gcuacucagcagcccuccucac

SEQ ID NO: 2281078 - RNA, 21 nt, Human
gcuacucagcagcccuccuca

SEQ ID NO: 2281079 - RNA, 19 nt, Human
gcuacucagcagcccuccu

SEQ ID NO: 2281080 - RNA, 18 nt, Human
gcuacucagcagcccucc

SEQ ID NO: 2281081 - RNA, 17 nt, Human
gcuacucagcagcccuc

SEQ ID NO: 2281082 - RNA, 16 nt, Human
gcuacucagcagcccu

SEQ ID NO: 2281083 - RNA, 12 nt, Human
gcuacucagcag

SEQ ID NO: 2281084 - RNA, 21 nt, Human
gcuacucagaagccugaggcu

SEQ ID NO: 2281085 - RNA, 11 nt, Human
gcuacucagca

SEQ ID NO: 2281086 - RNA, 21 nt, Human
gcuaaugaagggaaaggauau

SEQ ID NO: 2281087 - RNA, 15 nt, Human
gcuaaugggacacua

SEQ ID NO: 2281088 - RNA, 13 nt, Human
gcuaaugggacac

SEQ ID NO: 2281089 - RNA, 22 nt, Human
gcuaaucuguagggcuggaccu

SEQ ID NO: 2281090 - RNA, 20 nt, Human
gcuaaucuguagggcuggac

SEQ ID NO: 2281091 - RNA, 21 nt, Human
gcuaaucuguagggcuggacc

SEQ ID NO: 2281092 - RNA, 19 nt, Human
gcuaaucagugucucacac

SEQ ID NO: 2281093 - RNA, 17 nt, Human
gcuaaucuguagggcug

SEQ ID NO: 2281094 - RNA, 18 nt, Human
gcuaaucuguagggcugg

SEQ ID NO: 2281095 - RNA, 19 nt, Human
gcuaaucuguagggcugga

SEQ ID NO: 2281096 - RNA, 23 nt, Human
gcuaagugauccucccaccucag

SEQ ID NO: 2281097 - RNA, 13 nt, Human
gcuaagugugaac

SEQ ID NO: 2281098 - RNA, 16 nt, Human
gcuaaaaccugagcua

SEQ ID NO: 2281099 - RNA, 14 nt, Human
gcuaaaaccugagc

SEQ ID NO: 2281100 - RNA, 14 nt, Human
gcuaaaaaugggac

SEQ ID NO: 2281101 - RNA, 20 nt, Human
gcuaaaaaugggacuucuuu

SEQ ID NO: 2281102 - RNA, 20 nt, Human
gcuaauaucaauagaaggau

SEQ ID NO: 2281103 - RNA, 14 nt, Human
gcuaaucagcauuc

SEQ ID NO: 2281104 - RNA, 16 nt, Human
gcuaaucagcauucuc

SEQ ID NO: 2281105 - RNA, 17 nt, Human
gcuaaucagcauucuca

SEQ ID NO: 2281106 - RNA, 22 nt, Human
gcuaaucagcauucucacuccu

SEQ ID NO: 2281107 - RNA, 15 nt, Human
gcuaaucagugucuc

SEQ ID NO: 2281108 - RNA, 16 nt, Human
gcuaaucagugucuca

SEQ ID NO: 2281109 - RNA, 17 nt, Human
gcuaaucagugucucac

SEQ ID NO: 2281110 - RNA, 18 nt, Human
gcuaaucagugucucaca

SEQ ID NO: 2281111 - RNA, 19 nt, Human
gcuacugcagcuuuacaug

SEQ ID NO: 2281112 - RNA, 18 nt, Human
gcuacugcagcuuuacau

SEQ ID NO: 2281113 - RNA, 18 nt, Human
gcuagaacucccuuucaa

SEQ ID NO: 2281114 - RNA, 16 nt, Human
gcuagaacucccuuuc

SEQ ID NO: 2281115 - RNA, 20 nt, Human
gcuacucuaguauuccagac

SEQ ID NO: 2281116 - RNA, 19 nt, Human
gcuacucuaguauuccaga

SEQ ID NO: 2281117 - RNA, 21 nt, Human
gcuacucuaguauuccagacc

SEQ ID NO: 2281118 - RNA, 17 nt, Human
gcuacucuguuccuuca

SEQ ID NO: 2281119 - RNA, 17 nt, Human
gcuacugauuuccuuug

SEQ ID NO: 2281120 - RNA, 20 nt, Human
gcuacugauuuccuuuggag

SEQ ID NO: 2281121 - RNA, 16 nt, Human
gcuacugauuuuugug

SEQ ID NO: 2281122 - RNA, 17 nt, Human
gcuacugauuuuuguga

SEQ ID NO: 2281123 - RNA, 18 nt, Human
gcuacucuguuccuucac

SEQ ID NO: 2281124 - RNA, 15 nt, Human
gcuagaacucccuuu

SEQ ID NO: 2281125 - RNA, 14 nt, Human
gcuagaacucccuu

SEQ ID NO: 2281126 - RNA, 13 nt, Human
gcuagaacucccu

SEQ ID NO: 2281127 - RNA, 12 nt, Human
gcuagaacuccc

SEQ ID NO: 2281128 - RNA, 22 nt, Human
gcuauugauauaaauaaaacau

SEQ ID NO: 2281129 - RNA, 13 nt, Human
gcuauuguaaaua

SEQ ID NO: 2281130 - RNA, 16 nt, Human
gcuauugacaagucau

SEQ ID NO: 2281131 - RNA, 20 nt, Human
gcuauucaguaauaacucua

SEQ ID NO: 2281132 - RNA, 17 nt, Human
gcuaugggagccccagg

SEQ ID NO: 2281133 - RNA, 22 nt, Human
gcuauuuuuauuuguuugugca

SEQ ID NO: 2281134 - RNA, 15 nt, Human
gcuauuuuuauggaa

SEQ ID NO: 2281135 - RNA, 15 nt, Human
gcucaaaaaaugagc

SEQ ID NO: 2281136 - RNA, 20 nt, Human
gcucaaaauuugaagaauga

SEQ ID NO: 2281137 - RNA, 12 nt, Human
gcuauuuuuccc

SEQ ID NO: 2281138 - RNA, 16 nt, Human
gcuauuuuucccccug

SEQ ID NO: 2281139 - RNA, 23 nt, Human
gcucaaaauuugaagaaugaaca

SEQ ID NO: 2281140 - RNA, 17 nt, Human
gcucacuaugaaucuau

SEQ ID NO: 2281141 - RNA, 18 nt, Human
gcucacuauggugccaau

SEQ ID NO: 2281142 - RNA, 16 nt, Human
gcucacuauggugcca

SEQ ID NO: 2281143 - RNA, 17 nt, Human
gcucacugcagccucaa

SEQ ID NO: 2281144 - RNA, 16 nt, Human
gcucacugcauccucc

SEQ ID NO: 2281145 - RNA, 16 nt, Human
gcucacucggcacccu

SEQ ID NO: 2281146 - RNA, 15 nt, Human
gcucacugcagccuc

SEQ ID NO: 2281147 - RNA, 16 nt, Human
gcucacugcagccuca

SEQ ID NO: 2281148 - RNA, 11 nt, Human
gcucacugcag

SEQ ID NO: 2281149 - RNA, 12 nt, Human
gcucacugcagc

SEQ ID NO: 2281150 - RNA, 13 nt, Human
gcucacugcagcc

SEQ ID NO: 2281151 - RNA, 14 nt, Human
gcucacugcagccu

SEQ ID NO: 2281152 - RNA, 17 nt, Human
gcucagggaaaagcagc

SEQ ID NO: 2281153 - RNA, 15 nt, Human
gcucagggaaaagca

SEQ ID NO: 2281154 - RNA, 24 nt, Human
gcucaggcgauccaccugucucag

SEQ ID NO: 2281155 - RNA, 17 nt, Human
gcucagggaaaggccag

SEQ ID NO: 2281156 - RNA, 16 nt, Human
gcucagggaccacagc

SEQ ID NO: 2281157 - RNA, 17 nt, Human
gcucagggaccacagca

SEQ ID NO: 2281158 - RNA, 19 nt, Human
gcucagggccaugcugagg

SEQ ID NO: 2281159 - RNA, 18 nt, Human
gcucagggaccacagcaa

SEQ ID NO: 2281160 - RNA, 20 nt, Human
gcucagggaccacagcaagg

SEQ ID NO: 2281161 - RNA, 22 nt, Human
gcucaggcgauccaccugucuc

SEQ ID NO: 2281162 - RNA, 19 nt, Human
gcucaggcgauccaccugu

SEQ ID NO: 2281163 - RNA, 20 nt, Human
gcucaggccuauaaccccag

SEQ ID NO: 2281164 - RNA, 18 nt, Human
gcucaggaucucuuagca

SEQ ID NO: 2281165 - RNA, 14 nt, Human
gcucaggaucucuu

SEQ ID NO: 2281166 - RNA, 16 nt, Human
gcucaggacucagaag

SEQ ID NO: 2281167 - RNA, 15 nt, Human
gcucaggaccaggca

SEQ ID NO: 2281168 - RNA, 16 nt, Human
gcucaggaccaggcaa

SEQ ID NO: 2281169 - RNA, 14 nt, Human
gcucaggugucccu

SEQ ID NO: 2281170 - RNA, 23 nt, Human
gcucagguggggucacucuggca

SEQ ID NO: 2281171 - RNA, 16 nt, Human
gcucaggugucccugc

SEQ ID NO: 2281172 - RNA, 17 nt, Human
gcucaggugucccugca

SEQ ID NO: 2281173 - RNA, 20 nt, Human
gcucagggccaugcugaggc

SEQ ID NO: 2281174 - RNA, 16 nt, Human
gcucagaccagcucuu

SEQ ID NO: 2281175 - RNA, 21 nt, Human
gcucagacauguuuuccguga

SEQ ID NO: 2281176 - RNA, 23 nt, Human
gcucagacccccacucucauucc

SEQ ID NO: 2281177 - RNA, 13 nt, Human
gcucagagagggc

SEQ ID NO: 2281178 - RNA, 19 nt, Human
gcucagacccccacucuca

SEQ ID NO: 2281179 - RNA, 15 nt, Human
gcucagacccccacu

SEQ ID NO: 2281180 - RNA, 13 nt, Human
gcucagagagggu

SEQ ID NO: 2281181 - RNA, 21 nt, Human
gcucacugccaggccagccuc

SEQ ID NO: 2281182 - RNA, 20 nt, Human
gcucacugccaggccagccu

SEQ ID NO: 2281183 - RNA, 16 nt, Human
gcucagacauguuuuc

SEQ ID NO: 2281184 - RNA, 14 nt, Human
gcucacugccaggc

SEQ ID NO: 2281185 - RNA, 15 nt, Human
gcucacugccaggcc

SEQ ID NO: 2281186 - RNA, 17 nt, Human
gcucacugccaggccag

SEQ ID NO: 2281187 - RNA, 19 nt, Human
gcucacugccaggccagcc

SEQ ID NO: 2281188 - RNA, 12 nt, Human
gcucacugccag

SEQ ID NO: 2281189 - RNA, 13 nt, Human
gcucacugccagg

SEQ ID NO: 2281190 - RNA, 20 nt, Human
gcucacugcauccuccgccu

SEQ ID NO: 2281191 - RNA, 14 nt, Human
gcucagagagggug

SEQ ID NO: 2281192 - RNA, 20 nt, Human
gcucaggacagaugccacac

SEQ ID NO: 2281193 - RNA, 19 nt, Human
gcucagagagggcaggcau

SEQ ID NO: 2281194 - RNA, 14 nt, Human
gcucaggaccaggc

SEQ ID NO: 2281195 - RNA, 17 nt, Human
gcucaggacagaugcca

SEQ ID NO: 2281196 - RNA, 16 nt, Human
gcucagagagggcagg

SEQ ID NO: 2281197 - RNA, 18 nt, Human
gcucagagagggcaggca

SEQ ID NO: 2281198 - RNA, 16 nt, Human
gcuaggccuggccaga

SEQ ID NO: 2281199 - RNA, 16 nt, Human
gcuaggcgagugccag

SEQ ID NO: 2281200 - RNA, 18 nt, Human
gcuaggcgagugccagga

SEQ ID NO: 2281201 - RNA, 18 nt, Human
gcuagucagagagagugu

SEQ ID NO: 2281202 - RNA, 14 nt, Human
gcuagucagagaga

SEQ ID NO: 2281203 - RNA, 16 nt, Human
gcuagucuuaagaacu

SEQ ID NO: 2281204 - RNA, 19 nt, Human
gcuaggcgagugccaggac

SEQ ID NO: 2281205 - RNA, 20 nt, Human
gcuaggcgagugccaggacu

SEQ ID NO: 2281206 - RNA, 17 nt, Human
gcuaggccuggccagau

SEQ ID NO: 2281207 - RNA, 23 nt, Human
gcuaggccuggccagaugcacca

SEQ ID NO: 2281208 - RNA, 19 nt, Human
gcuauucaguaauaacucu

SEQ ID NO: 2281209 - RNA, 14 nt, Human
gcuaugggagcccc

SEQ ID NO: 2281210 - RNA, 13 nt, Human
gcuaugggagccc

SEQ ID NO: 2281211 - RNA, 18 nt, Human
gcuauggauggcuucuaa

SEQ ID NO: 2281212 - RNA, 17 nt, Human
gcuaugaucgcgccacu

SEQ ID NO: 2281213 - RNA, 14 nt, Human
gcuagugacuugug

SEQ ID NO: 2281214 - RNA, 13 nt, Human
gcuaugcauuuga

SEQ ID NO: 2281215 - RNA, 12 nt, Human
gcuaugcauuug

SEQ ID NO: 2281216 - RNA, 14 nt, Human
gcuaugagggccuu

SEQ ID NO: 2281217 - RNA, 21 nt, Human
gcuagugacuugugucccaug

SEQ ID NO: 2281218 - RNA, 21 nt, Human
gcuagugugguguuuccuggc

SEQ ID NO: 2281219 - RNA, 22 nt, Human
gcuagugugguguuuccuggca

SEQ ID NO: 2281220 - RNA, 21 nt, Human
gcuccccucuauuuagcauga

SEQ ID NO: 2281221 - RNA, 19 nt, Human
gcuccccucuauuuagcau

SEQ ID NO: 2281222 - RNA, 12 nt, Human
gcucccgcccgu

SEQ ID NO: 2281223 - RNA, 18 nt, Human
gcucccccuccaccugcu

SEQ ID NO: 2281224 - RNA, 17 nt, Human
gcucccccuccaccugc

SEQ ID NO: 2281225 - RNA, 21 nt, Human
gcuccccucggagaagagcug

SEQ ID NO: 2281226 - RNA, 21 nt, Human
gcuccugaggggcaucugccc

SEQ ID NO: 2281227 - RNA, 18 nt, Human
gcuccugaggggcaucug

SEQ ID NO: 2281228 - RNA, 15 nt, Human
gcucccuaccaccuc

SEQ ID NO: 2281229 - RNA, 23 nt, Human
gcuccugaggggcaucugccccu

SEQ ID NO: 2281230 - RNA, 22 nt, Human
gcuccugaggggcaucugcccc

SEQ ID NO: 2281231 - RNA, 12 nt, Human
gcuccugcacuu

SEQ ID NO: 2281232 - RNA, 20 nt, Human
gcuccugcacuuacuugcuu

SEQ ID NO: 2281233 - RNA, 18 nt, Human
gcuccugccaccacgccc

SEQ ID NO: 2281234 - RNA, 12 nt, Human
gcuccugccacc

SEQ ID NO: 2281235 - RNA, 19 nt, Human
gcuccuggcccacugcauc

SEQ ID NO: 2281236 - RNA, 18 nt, Human
gcuccuggcccacugcau

SEQ ID NO: 2281237 - RNA, 18 nt, Human
gcuccuggagccuuugaa

SEQ ID NO: 2281238 - RNA, 19 nt, Human
gcuccuggagccuuugaau

SEQ ID NO: 2281239 - RNA, 20 nt, Human
gcuccuggcccacugcaucg

SEQ ID NO: 2281240 - RNA, 15 nt, Human
gcuccuggcccacug

SEQ ID NO: 2281241 - RNA, 14 nt, Human
gcuccuggcccacu

SEQ ID NO: 2281242 - RNA, 22 nt, Human
gcuccuggaaaggcucagucuc

SEQ ID NO: 2281243 - RNA, 21 nt, Human
gcuccuggaaaggcucagucu

SEQ ID NO: 2281244 - RNA, 23 nt, Human
gcuccuggaaaggcucagucuca

SEQ ID NO: 2281245 - RNA, 22 nt, Human
gcuccugcugcaccaacccagc

SEQ ID NO: 2281246 - RNA, 18 nt, Human
gcuccuggaaaggcucag

SEQ ID NO: 2281247 - RNA, 21 nt, Human
gcuccugccaccacgcccggc

SEQ ID NO: 2281248 - RNA, 18 nt, Human
gcuccugcugcaccaacc

SEQ ID NO: 2281249 - RNA, 20 nt, Human
gcuccagcucaccagcccca

SEQ ID NO: 2281250 - RNA, 21 nt, Human
gcuccagcucaccagccccag

SEQ ID NO: 2281251 - RNA, 16 nt, Human
gcucccacaggcccuu

SEQ ID NO: 2281252 - RNA, 17 nt, Human
gcucccacaggcccuuc

SEQ ID NO: 2281253 - RNA, 20 nt, Human
gcucccacaggcccuuccuc

SEQ ID NO: 2281254 - RNA, 21 nt, Human
gcucccacaggcccuuccucu

SEQ ID NO: 2281255 - RNA, 18 nt, Human
gcuccagcucaccagccc

SEQ ID NO: 2281256 - RNA, 23 nt, Human
gcuccacucugcuucucugacuu

SEQ ID NO: 2281257 - RNA, 12 nt, Human
gcuccacuguca

SEQ ID NO: 2281258 - RNA, 18 nt, Human
gcuccacugucacccucc

SEQ ID NO: 2281259 - RNA, 19 nt, Human
gcuccacuuggucugugag

SEQ ID NO: 2281260 - RNA, 18 nt, Human
gcuccacuuggucuguga

SEQ ID NO: 2281261 - RNA, 21 nt, Human
gcucccaccccacccccuuca

SEQ ID NO: 2281262 - RNA, 18 nt, Human
gcucccaccccacccccu

SEQ ID NO: 2281263 - RNA, 22 nt, Human
gcucccacaggcccuuccucuc

SEQ ID NO: 2281264 - RNA, 12 nt, Human
gcucccagcagc

SEQ ID NO: 2281265 - RNA, 12 nt, Human
gcucccaggaac

SEQ ID NO: 2281266 - RNA, 23 nt, Human
gcucccagcagcccuaaggaucu

SEQ ID NO: 2281267 - RNA, 19 nt, Human
gcucccagcagcccuaagg

SEQ ID NO: 2281268 - RNA, 15 nt, Human
gcucccccacccccu

SEQ ID NO: 2281269 - RNA, 14 nt, Human
gcucccccaccccc

SEQ ID NO: 2281270 - RNA, 14 nt, Human
gcuccccauguguc

SEQ ID NO: 2281271 - RNA, 22 nt, Human
gcuccccagcccuggcucugca

SEQ ID NO: 2281272 - RNA, 12 nt, Human
gcuccccaugug

SEQ ID NO: 2281273 - RNA, 21 nt, Human
gcuccccagcccuggcucugc

SEQ ID NO: 2281274 - RNA, 17 nt, Human
gcucccaggcauucccc

SEQ ID NO: 2281275 - RNA, 22 nt, Human
gcucccccacccccuccccagg

SEQ ID NO: 2281276 - RNA, 20 nt, Human
gcucccccacccccucccca

SEQ ID NO: 2281277 - RNA, 16 nt, Human
gcucccccauccuccc

SEQ ID NO: 2281278 - RNA, 14 nt, Human
gcucccccauccuc

SEQ ID NO: 2281279 - RNA, 18 nt, Human
gcucccccauccuccccu

SEQ ID NO: 2281280 - RNA, 17 nt, Human
gcucccccauccucccc

SEQ ID NO: 2281281 - RNA, 20 nt, Human
gcucccccauccuccccuuc

SEQ ID NO: 2281282 - RNA, 15 nt, Human
gcucccccgggaggg

SEQ ID NO: 2281283 - RNA, 17 nt, Human
gcucccccgggaggggc

SEQ ID NO: 2281284 - RNA, 21 nt, Human
gcucccccgggaggggcccgc

SEQ ID NO: 2281285 - RNA, 23 nt, Human
gcuccacacccucucccaggacc

SEQ ID NO: 2281286 - RNA, 22 nt, Human
gcuccacacccucucccaggac

SEQ ID NO: 2281287 - RNA, 21 nt, Human
gcuccacacccucucccagga

SEQ ID NO: 2281288 - RNA, 19 nt, Human
gcuccacccuuggccuguc

SEQ ID NO: 2281289 - RNA, 17 nt, Human
gcuccacccuuggccug

SEQ ID NO: 2281290 - RNA, 16 nt, Human
gcuccacccuuggccu

SEQ ID NO: 2281291 - RNA, 15 nt, Human
gcuccacccuuggcc

SEQ ID NO: 2281292 - RNA, 14 nt, Human
gcuccacccuuggc

SEQ ID NO: 2281293 - RNA, 13 nt, Human
gcuccacccuugg

SEQ ID NO: 2281294 - RNA, 11 nt, Human
gcuccacccuu

SEQ ID NO: 2281295 - RNA, 19 nt, Human
gcuccacccuggccgaguc

SEQ ID NO: 2281296 - RNA, 15 nt, Human
gcuccaccacauccu

SEQ ID NO: 2281297 - RNA, 12 nt, Human
gcuccaccacau

SEQ ID NO: 2281298 - RNA, 19 nt, Human
gcuccaccaagaaagcagg

SEQ ID NO: 2281299 - RNA, 16 nt, Human
gcuccacagccauccc

SEQ ID NO: 2281300 - RNA, 12 nt, Human
gcuccacagugu

SEQ ID NO: 2281301 - RNA, 16 nt, Human
gcuccacccuggccga

SEQ ID NO: 2281302 - RNA, 21 nt, Human
gcuccacucugacuggcacag

SEQ ID NO: 2281303 - RNA, 19 nt, Human
gcuccacgucugcgccgcc

SEQ ID NO: 2281304 - RNA, 13 nt, Human
gcuccacucugcu

SEQ ID NO: 2281305 - RNA, 15 nt, Human
gcuccacucugcuuc

SEQ ID NO: 2281306 - RNA, 16 nt, Human
gcuccacucugcuucu

SEQ ID NO: 2281307 - RNA, 23 nt, Human
gcuccacccuuggccugucucau

SEQ ID NO: 2281308 - RNA, 22 nt, Human
gcuccacccuuggccugucuca

SEQ ID NO: 2281309 - RNA, 15 nt, Human
gcuccacuuggucug

SEQ ID NO: 2281310 - RNA, 17 nt, Human
gcuccacucugcuucuc

SEQ ID NO: 2281311 - RNA, 19 nt, Human
gcuccacucugcuucucug

SEQ ID NO: 2281312 - RNA, 20 nt, Human
gcuccacucugcuucucuga

SEQ ID NO: 2281313 - RNA, 21 nt, Human
gcuccacucugcuucucugac

SEQ ID NO: 2281314 - RNA, 14 nt, Human
gcucugagcgccuc

SEQ ID NO: 2281315 - RNA, 17 nt, Human
gcucugagcgccuccau

SEQ ID NO: 2281316 - RNA, 18 nt, Human
gcucugagcgccuccauc

SEQ ID NO: 2281317 - RNA, 16 nt, Human
gcucugagccaguuca

SEQ ID NO: 2281318 - RNA, 16 nt, Human
gcucugaggcuuccag

SEQ ID NO: 2281319 - RNA, 18 nt, Human
gcucugaggcuuccagag

SEQ ID NO: 2281320 - RNA, 21 nt, Human
gcucugaggcuuccagagagu

SEQ ID NO: 2281321 - RNA, 19 nt, Human
gcucugaggcuuccagaga

SEQ ID NO: 2281322 - RNA, 20 nt, Human
gcucugaggcuuccagagag

SEQ ID NO: 2281323 - RNA, 16 nt, Human
gcucugauaggccaag

SEQ ID NO: 2281324 - RNA, 19 nt, Human
gcucugccccagcucuggc

SEQ ID NO: 2281325 - RNA, 18 nt, Human
gcucugccccagcucugg

SEQ ID NO: 2281326 - RNA, 20 nt, Human
gcucugccccagcucuggcu

SEQ ID NO: 2281327 - RNA, 21 nt, Human
gcucugccccagaggccucuc

SEQ ID NO: 2281328 - RNA, 11 nt, Human
gcucugcccuu

SEQ ID NO: 2281329 - RNA, 15 nt, Human
gcucugccccagcuc

SEQ ID NO: 2281330 - RNA, 13 nt, Human
gcucugccccagc

SEQ ID NO: 2281331 - RNA, 12 nt, Human
gcucugccccag

SEQ ID NO: 2281332 - RNA, 15 nt, Human
gcucugccccagagg

SEQ ID NO: 2281333 - RNA, 16 nt, Human
gcucugccccagaggc

SEQ ID NO: 2281334 - RNA, 20 nt, Human
gcucugccccagaggccucu

SEQ ID NO: 2281335 - RNA, 23 nt, Human
gcucugcaaugggcacugggaug

SEQ ID NO: 2281336 - RNA, 17 nt, Human
gcucugcaauuccccuc

SEQ ID NO: 2281337 - RNA, 21 nt, Human
gcucugauauuccaugaaugu

SEQ ID NO: 2281338 - RNA, 23 nt, Human
gcucugaucccucuacagagcuu

SEQ ID NO: 2281339 - RNA, 22 nt, Human
gcucugaucccucuacagagcu

SEQ ID NO: 2281340 - RNA, 13 nt, Human
gcucugaucccuc

SEQ ID NO: 2281341 - RNA, 23 nt, Human
gcucugcaagaauugaagcagga

SEQ ID NO: 2281342 - RNA, 23 nt, Human
gcucugaucauccacugugccau

SEQ ID NO: 2281343 - RNA, 17 nt, Human
gcucugaucauccacug

SEQ ID NO: 2281344 - RNA, 18 nt, Human
gcucgguggacccaggga

SEQ ID NO: 2281345 - RNA, 17 nt, Human
gcucgguggacccaggg

SEQ ID NO: 2281346 - RNA, 14 nt, Human
gcucgguggaccca

SEQ ID NO: 2281347 - RNA, 12 nt, Human
gcucgguggacc

SEQ ID NO: 2281348 - RNA, 21 nt, Human
gcucgucggggggacagcucc

SEQ ID NO: 2281349 - RNA, 15 nt, Human
gcucguguauccugg

SEQ ID NO: 2281350 - RNA, 16 nt, Human
gcucguguauccuggg

SEQ ID NO: 2281351 - RNA, 17 nt, Human
gcucguguauccugggg

SEQ ID NO: 2281352 - RNA, 18 nt, Human
gcucguguauccuggggc

SEQ ID NO: 2281353 - RNA, 19 nt, Human
gcucguguauccuggggcu

SEQ ID NO: 2281354 - RNA, 23 nt, Human
gcucguguauccuggggcucccu

SEQ ID NO: 2281355 - RNA, 22 nt, Human
ggcucauauuccugcagccugg

SEQ ID NO: 2281356 - RNA, 21 nt, Human
ggcucauauuccugcagccug

SEQ ID NO: 2281357 - RNA, 17 nt, Human
ggcuccaaacccucgag

SEQ ID NO: 2281358 - RNA, 14 nt, Human
ggcuccacuugguc

SEQ ID NO: 2281359 - RNA, 15 nt, Human
ggcucacugccaggc

SEQ ID NO: 2281360 - RNA, 13 nt, Human
ggcucagccuggu

SEQ ID NO: 2281361 - RNA, 18 nt, Human
ggcucagagaugugcacc

SEQ ID NO: 2281362 - RNA, 13 nt, Human
ggcucagaucuca

SEQ ID NO: 2281363 - RNA, 18 nt, Human
ggcucagcggggacagcu

SEQ ID NO: 2281364 - RNA, 14 nt, Human
ggcucagagugggg

SEQ ID NO: 2281365 - RNA, 16 nt, Human
ggcucacugccaggcc

SEQ ID NO: 2281366 - RNA, 18 nt, Human
ggcucacugccaggccag

SEQ ID NO: 2281367 - RNA, 19 nt, Human
ggcucacugccaggccagc

SEQ ID NO: 2281368 - RNA, 20 nt, Human
ggcucacugccaggccagcc

SEQ ID NO: 2281369 - RNA, 22 nt, Human
ggcucacugccaggccagccuc

SEQ ID NO: 2281370 - RNA, 21 nt, Human
ggcucacugccaggccagccu

SEQ ID NO: 2281371 - RNA, 13 nt, Human
ggcucagagaugu

SEQ ID NO: 2281372 - RNA, 20 nt, Human
ggcucauauuccugcagccu

SEQ ID NO: 2281373 - RNA, 17 nt, Human
ggcucauauuccugcag

SEQ ID NO: 2281374 - RNA, 20 nt, Human
ggcucauagggaagaccugc

SEQ ID NO: 2281375 - RNA, 17 nt, Human
ggcucagucucaggagc

SEQ ID NO: 2281376 - RNA, 15 nt, Human
ggcucagucucagga

SEQ ID NO: 2281377 - RNA, 14 nt, Human
ggcucagucucagg

SEQ ID NO: 2281378 - RNA, 22 nt, Human
ggcucagggagguuaagugacu

SEQ ID NO: 2281379 - RNA, 19 nt, Human
ggcucagguggggucacuc

SEQ ID NO: 2281380 - RNA, 20 nt, Human
ggcucagguggggucacucu

SEQ ID NO: 2281381 - RNA, 19 nt, Human
ggcucagcggggacagcuc

SEQ ID NO: 2281382 - RNA, 20 nt, Human
ggcucagcggggacagcucc

SEQ ID NO: 2281383 - RNA, 12 nt, Human
ggcucaggaaaa

SEQ ID NO: 2281384 - RNA, 22 nt, Human
ggcucaggauuucgugggucug

SEQ ID NO: 2281385 - RNA, 20 nt, Human
ggcucagccuggugggccuc

SEQ ID NO: 2281386 - RNA, 14 nt, Human
ggcucagggaccac

SEQ ID NO: 2281387 - RNA, 16 nt, Human
ggcucagggaccacag

SEQ ID NO: 2281388 - RNA, 17 nt, Human
ggcucagggaccacagc

SEQ ID NO: 2281389 - RNA, 18 nt, Human
ggcucagggaccacagca

SEQ ID NO: 2281390 - RNA, 13 nt, Human
ggcugcuccucca

SEQ ID NO: 2281391 - RNA, 12 nt, Human
ggcugcuccucc

SEQ ID NO: 2281392 - RNA, 23 nt, Human
ggcugcuccuccagggccacgug

SEQ ID NO: 2281393 - RNA, 19 nt, Human
ggcugcuccuccagggcca

SEQ ID NO: 2281394 - RNA, 18 nt, Human
ggcugcuccuccagggcc

SEQ ID NO: 2281395 - RNA, 15 nt, Human
ggcugcuccuccagg

SEQ ID NO: 2281396 - RNA, 13 nt, Human
ggcugcugaagcu

SEQ ID NO: 2281397 - RNA, 16 nt, Human
ggcugcuacccagaaa

SEQ ID NO: 2281398 - RNA, 15 nt, Human
ggcugcuacccagaa

SEQ ID NO: 2281399 - RNA, 15 nt, Human
ggcugcucagggcug

SEQ ID NO: 2281400 - RNA, 21 nt, Human
ggcugcgucuggaggggcccc

SEQ ID NO: 2281401 - RNA, 13 nt, Human
ggcugggagagcc

SEQ ID NO: 2281402 - RNA, 13 nt, Human
ggcugcugaaggc

SEQ ID NO: 2281403 - RNA, 14 nt, Human
ggcugggagagccu

SEQ ID NO: 2281404 - RNA, 15 nt, Human
ggcugggagagccuu

SEQ ID NO: 2281405 - RNA, 16 nt, Human
ggcugggagagccuuc

SEQ ID NO: 2281406 - RNA, 13 nt, Human
ggcuccuggaaag

SEQ ID NO: 2281407 - RNA, 21 nt, Human
ggcuccugcugcaccaaccca

SEQ ID NO: 2281408 - RNA, 22 nt, Human
ggcuccugcugcaccaacccag

SEQ ID NO: 2281409 - RNA, 23 nt, Human
ggcuccugcugcaccaacccagc

SEQ ID NO: 2281410 - RNA, 18 nt, Human
ggcuccugccuucugucc

SEQ ID NO: 2281411 - RNA, 19 nt, Human
ggcuccugccuucuguccu

SEQ ID NO: 2281412 - RNA, 11 nt, Human
ggcuccugcug

SEQ ID NO: 2281413 - RNA, 12 nt, Human
ggcuccugcugc

SEQ ID NO: 2281414 - RNA, 13 nt, Human
ggcuccugcugca

SEQ ID NO: 2281415 - RNA, 14 nt, Human
ggcuccugcugcac

SEQ ID NO: 2281416 - RNA, 15 nt, Human
ggcuccugcugcacc

SEQ ID NO: 2281417 - RNA, 16 nt, Human
ggcuccugcugcacca

SEQ ID NO: 2281418 - RNA, 20 nt, Human
ggcuccuucccaucgcuguc

SEQ ID NO: 2281419 - RNA, 23 nt, Human
ggcuccugugcuacuuugccuuu

SEQ ID NO: 2281420 - RNA, 13 nt, Human
ggcuccugugccc

SEQ ID NO: 2281421 - RNA, 14 nt, Human
ggcuccugugcccu

SEQ ID NO: 2281422 - RNA, 17 nt, Human
ggcuccugugcccuuau

SEQ ID NO: 2281423 - RNA, 12 nt, Human
ggcuccugugcu

SEQ ID NO: 2281424 - RNA, 13 nt, Human
ggcuccugugcua

SEQ ID NO: 2281425 - RNA, 20 nt, Human
ggcuccugugcuacuuugcc

SEQ ID NO: 2281426 - RNA, 11 nt, Human
ggcucucaggc

SEQ ID NO: 2281427 - RNA, 12 nt, Human
ggcucuucuccu

SEQ ID NO: 2281428 - RNA, 13 nt, Human
ggcucuucuccuu

SEQ ID NO: 2281429 - RNA, 17 nt, Human
ggcucuucuccccagag

SEQ ID NO: 2281430 - RNA, 21 nt, Human
ggcucuuagcagcuuccagau

SEQ ID NO: 2281431 - RNA, 12 nt, Human
ggcucuuccagg

SEQ ID NO: 2281432 - RNA, 18 nt, Human
ggcucuuagcagcuucca

SEQ ID NO: 2281433 - RNA, 15 nt, Human
ggcucugugggcugc

SEQ ID NO: 2281434 - RNA, 18 nt, Human
ggcucugugggcugcacu

SEQ ID NO: 2281435 - RNA, 19 nt, Human
ggcucuuagcagcuuccag

SEQ ID NO: 2281436 - RNA, 20 nt, Human
ggcucuuagcagcuuccaga

SEQ ID NO: 2281437 - RNA, 20 nt, Human
ggcucugugcugacccuccu

SEQ ID NO: 2281438 - RNA, 12 nt, Human
ggcucugugggc

SEQ ID NO: 2281439 - RNA, 14 nt, Human
ggcucugugggcug

SEQ ID NO: 2281440 - RNA, 12 nt, Human
ggcucugugcug

SEQ ID NO: 2281441 - RNA, 16 nt, Human
ggcucugugcugaccc

SEQ ID NO: 2281442 - RNA, 18 nt, Human
ggcucugugcugacccuc

SEQ ID NO: 2281443 - RNA, 19 nt, Human
ggcucugugcugacccucc

SEQ ID NO: 2281444 - RNA, 15 nt, Human
ggcucugugcaggga

SEQ ID NO: 2281445 - RNA, 19 nt, Human
ggcucucagcucagcgcca

SEQ ID NO: 2281446 - RNA, 12 nt, Human
ggcucucagcuc

SEQ ID NO: 2281447 - RNA, 14 nt, Human
ggcucucagcucag

SEQ ID NO: 2281448 - RNA, 14 nt, Human
ggcucucaggccag

SEQ ID NO: 2281449 - RNA, 13 nt, Human
ggcucucaggcca

SEQ ID NO: 2281450 - RNA, 15 nt, Human
ggcugccaaggccag

SEQ ID NO: 2281451 - RNA, 19 nt, Human
ggcugaccacagcacagcc

SEQ ID NO: 2281452 - RNA, 13 nt, Human
ggcugcccuggug

SEQ ID NO: 2281453 - RNA, 21 nt, Human
ggcugccaaugggagcucaug

SEQ ID NO: 2281454 - RNA, 14 nt, Human
ggcugcccuggugc

SEQ ID NO: 2281455 - RNA, 15 nt, Human
ggcugcccuggugcu

SEQ ID NO: 2281456 - RNA, 16 nt, Human
ggcugcccuggugcug

SEQ ID NO: 2281457 - RNA, 19 nt, Human
ggcugcccuggugcugcca

SEQ ID NO: 2281458 - RNA, 22 nt, Human
ggcugcggaaugaaccacaucu

SEQ ID NO: 2281459 - RNA, 16 nt, Human
ggcugccuuagaaccu

SEQ ID NO: 2281460 - RNA, 17 nt, Human
ggcugccugggcuguug

SEQ ID NO: 2281461 - RNA, 14 nt, Human
ggcugccugggcug

SEQ ID NO: 2281462 - RNA, 15 nt, Human
ggcugccugggcugu

SEQ ID NO: 2281463 - RNA, 16 nt, Human
ggcugccuggccccca

SEQ ID NO: 2281464 - RNA, 11 nt, Human
ggcugccuggg

SEQ ID NO: 2281465 - RNA, 17 nt, Human
ggcugccaaggccagag

SEQ ID NO: 2281466 - RNA, 20 nt, Human
ggcugccuccacucccacuu

SEQ ID NO: 2281467 - RNA, 22 nt, Human
ggcugcccuggugcugccacac

SEQ ID NO: 2281468 - RNA, 16 nt, Human
ggcucuucuccuuuca

SEQ ID NO: 2281469 - RNA, 16 nt, Human
ggcugaauagcagaag

SEQ ID NO: 2281470 - RNA, 13 nt, Human
ggcugaaggacug

SEQ ID NO: 2281471 - RNA, 14 nt, Human
ggcugaaggacugu

SEQ ID NO: 2281472 - RNA, 24 nt, Human
ggcugacacguccaccccagugca

SEQ ID NO: 2281473 - RNA, 18 nt, Human
ggcugaaggacugugaca

SEQ ID NO: 2281474 - RNA, 14 nt, Human
ggcugacaucugug

SEQ ID NO: 2281475 - RNA, 22 nt, Human
ggcugacagacagcccuccauc

SEQ ID NO: 2281476 - RNA, 14 nt, Human
ggcucuucuccuuu

SEQ ID NO: 2281477 - RNA, 15 nt, Human
ggcucuucuccuuuc

SEQ ID NO: 2281478 - RNA, 19 nt, Human
ggcugccaaugggagcuca

SEQ ID NO: 2281479 - RNA, 20 nt, Human
ggcugccaaugggagcucau

SEQ ID NO: 2281480 - RNA, 18 nt, Human
ggcugaccacagcacagc

SEQ ID NO: 2281481 - RNA, 17 nt, Human
ggcugaccacagcacag

SEQ ID NO: 2281482 - RNA, 16 nt, Human
ggcugaccacagcaca

SEQ ID NO: 2281483 - RNA, 15 nt, Human
ggcugaccacagcac

SEQ ID NO: 2281484 - RNA, 13 nt, Human
ggcugaccacagc

SEQ ID NO: 2281485 - RNA, 18 nt, Human
ggcugacaucuguguuuc

SEQ ID NO: 2281486 - RNA, 21 nt, Human
aaaaauaaauuugguucuaau

SEQ ID NO: 2281487 - RNA, 14 nt, Human
aaaaauaacaauga

SEQ ID NO: 2281488 - RNA, 15 nt, Human
ggcugggggccucag

SEQ ID NO: 2281489 - RNA, 16 nt, Human
ggcugggggccucagu

SEQ ID NO: 2281490 - RNA, 17 nt, Human
ggcugggggccucagug

SEQ ID NO: 2281491 - RNA, 19 nt, Human
ggcugggggccucagugcc

SEQ ID NO: 2281492 - RNA, 14 nt, Human
ggcugggugcgacc

SEQ ID NO: 2281493 - RNA, 19 nt, Human
ggcuggguggcaccagcag

SEQ ID NO: 2281494 - RNA, 19 nt, Human
ggcuggguucuacccaggu

SEQ ID NO: 2281495 - RNA, 21 nt, Human
ggcuggguucuacccaggugc

SEQ ID NO: 2281496 - RNA, 16 nt, Human
aaaaauaauaauaaug

SEQ ID NO: 2281497 - RNA, 14 nt, Human
ggcugggucgcccu

SEQ ID NO: 2281498 - RNA, 17 nt, Human
ggcugggucgcccugga

SEQ ID NO: 2281499 - RNA, 20 nt, Human
ggcugggucgcccuggacug

SEQ ID NO: 2281500 - RNA, 14 nt, Human
ggcuucccgcucag

SEQ ID NO: 2281501 - RNA, 12 nt, Human
ggcuucauacac

SEQ ID NO: 2281502 - RNA, 22 nt, Human
ggcuucauccuccucagaucuu

SEQ ID NO: 2281503 - RNA, 18 nt, Human
ggcuucauccuccucaga

SEQ ID NO: 2281504 - RNA, 11 nt, Human
ggcuucauaca

SEQ ID NO: 2281505 - RNA, 9 nt, Human
ggcuucaua

SEQ ID NO: 2281506 - RNA, 16 nt, Human
ggcuuccucauaguau

SEQ ID NO: 2281507 - RNA, 19 nt, Human
ggcuucccgcucagcccuc

SEQ ID NO: 2281508 - RNA, 21 nt, Human
ggcuucccgcucagcccuccc

SEQ ID NO: 2281509 - RNA, 15 nt, Human
ggcuucccgcucagc

SEQ ID NO: 2281510 - RNA, 16 nt, Human
ggcuucccgcucagcc

SEQ ID NO: 2281511 - RNA, 17 nt, Human
ggcuucccgcucagccc

SEQ ID NO: 2281512 - RNA, 18 nt, Human
ggcuucccgcucagcccu

SEQ ID NO: 2281513 - RNA, 18 nt, Human
ggcuucaguggcagcugc

SEQ ID NO: 2281514 - RNA, 17 nt, Human
ggcuucaguggcagcug

SEQ ID NO: 2281515 - RNA, 19 nt, Human
ggcuucaguggcagcugcu

SEQ ID NO: 2281516 - RNA, 20 nt, Human
ggcuucaguggcagcugcuu

SEQ ID NO: 2281517 - RNA, 18 nt, Human
ggcuguaucccaugagcc

SEQ ID NO: 2281518 - RNA, 16 nt, Human
ggcuguaaaaugcaug

SEQ ID NO: 2281519 - RNA, 13 nt, Human
ggcugguuuugua

SEQ ID NO: 2281520 - RNA, 21 nt, Human
ggcugguuuuguaagaugcug

SEQ ID NO: 2281521 - RNA, 22 nt, Human
ggcugguuuuguaagaugcugg

SEQ ID NO: 2281522 - RNA, 23 nt, Human
ggcugguuuuguaagaugcuggg

SEQ ID NO: 2281523 - RNA, 23 nt, Human
ggcugguucggauuuggggugga

SEQ ID NO: 2281524 - RNA, 10 nt, Human
ggcugggugc

SEQ ID NO: 2281525 - RNA, 18 nt, Human
ggcugguuuggaaugcuu

SEQ ID NO: 2281526 - RNA, 22 nt, Human
ggcugguucggauuuggggugg

SEQ ID NO: 2281527 - RNA, 14 nt, Human
ggcuucucucugug

SEQ ID NO: 2281528 - RNA, 13 nt, Human
ggcuucugcaccc

SEQ ID NO: 2281529 - RNA, 14 nt, Human
ggcuucugcacccu

SEQ ID NO: 2281530 - RNA, 15 nt, Human
ggcuucugcacccuc

SEQ ID NO: 2281531 - RNA, 16 nt, Human
ggcuucugcacccucc

SEQ ID NO: 2281532 - RNA, 18 nt, Human
ggcuucugcacccuccac

SEQ ID NO: 2281533 - RNA, 20 nt, Human
ggcuucugcacccuccaccc

SEQ ID NO: 2281534 - RNA, 21 nt, Human
ggcuucugcacccuccacccu

SEQ ID NO: 2281535 - RNA, 21 nt, Human
ggcuuccucaguuccugcccu

SEQ ID NO: 2281536 - RNA, 12 nt, Human
ggcuuccuccuc

SEQ ID NO: 2281537 - RNA, 15 nt, Human
ggcuguagaaggaga

SEQ ID NO: 2281538 - RNA, 21 nt, Human
ggcuguaggacucgcagucag

SEQ ID NO: 2281539 - RNA, 22 nt, Human
ggcuucccgcucagcccucccu

SEQ ID NO: 2281540 - RNA, 21 nt, Human
ggcuuccuccugguguggaag

SEQ ID NO: 2281541 - RNA, 16 nt, Human
ggcuucuggagcccuu

SEQ ID NO: 2281542 - RNA, 13 nt, Human
ggcuucuggagcc

SEQ ID NO: 2281543 - RNA, 22 nt, Human
ggcuucugcacccuccacccug

SEQ ID NO: 2281544 - RNA, 20 nt, Human
ggcuucuggagcccuugggu

SEQ ID NO: 2281545 - RNA, 18 nt, Human
ggcuucuggagcccuugg

SEQ ID NO: 2281546 - RNA, 20 nt, Human
gggaacaguguuucccauaa

SEQ ID NO: 2281547 - RNA, 18 nt, Human
gggaaccaugaagacagg

SEQ ID NO: 2281548 - RNA, 20 nt, Human
ggcuucuucagaucagugcu

SEQ ID NO: 2281549 - RNA, 12 nt, Human
gggaacaguguu

SEQ ID NO: 2281550 - RNA, 13 nt, Human
gggaacuccugga

SEQ ID NO: 2281551 - RNA, 16 nt, Human
gggaacucagauccag

SEQ ID NO: 2281552 - RNA, 22 nt, Human
gggaacucaccuggggcugcug

SEQ ID NO: 2281553 - RNA, 23 nt, Human
gggaacucaccuggggcugcugg

SEQ ID NO: 2281554 - RNA, 17 nt, Human
gggaacgugacugcccc

SEQ ID NO: 2281555 - RNA, 14 nt, Human
gggaacgugacugc

SEQ ID NO: 2281556 - RNA, 18 nt, Human
gggaacgugacugcccca

SEQ ID NO: 2281557 - RNA, 18 nt, Human
gggaagaagcucucuccu

SEQ ID NO: 2281558 - RNA, 15 nt, Human
gggaacugcagaccu

SEQ ID NO: 2281559 - RNA, 20 nt, Human
gggaacugcagaccuguccu

SEQ ID NO: 2281560 - RNA, 13 nt, Human
gggaaccugaccc

SEQ ID NO: 2281561 - RNA, 12 nt, Human
gggaaccucacu

SEQ ID NO: 2281562 - RNA, 13 nt, Human
gggaaccuggaac

SEQ ID NO: 2281563 - RNA, 13 nt, Human
gggaaccuguguc

SEQ ID NO: 2281564 - RNA, 14 nt, Human
gggaaccugugucc

SEQ ID NO: 2281565 - RNA, 15 nt, Human
gggaaccuguguccg

SEQ ID NO: 2281566 - RNA, 20 nt, Human
gggaacccaaguccaagcau

SEQ ID NO: 2281567 - RNA, 19 nt, Human
gggaaccaugaagacagga

SEQ ID NO: 2281568 - RNA, 12 nt, Human
gggaacccugcu

SEQ ID NO: 2281569 - RNA, 19 nt, Human
gggaaccucacucuugcca

SEQ ID NO: 2281570 - RNA, 15 nt, Human
gggacagcuccuucu

SEQ ID NO: 2281571 - RNA, 14 nt, Human
gggacagaggccug

SEQ ID NO: 2281572 - RNA, 13 nt, Human
gggacagggcugg

SEQ ID NO: 2281573 - RNA, 18 nt, Human
gggacaggggcaggagga

SEQ ID NO: 2281574 - RNA, 21 nt, Human
gggacagggcuggcccagccc

SEQ ID NO: 2281575 - RNA, 22 nt, Human
gggacagggcuggcccagcccu

SEQ ID NO: 2281576 - RNA, 17 nt, Human
gggacaggggcaggagg

SEQ ID NO: 2281577 - RNA, 17 nt, Human
gggacagggcuggccca

SEQ ID NO: 2281578 - RNA, 18 nt, Human
gggacagggcuggcccag

SEQ ID NO: 2281579 - RNA, 19 nt, Human
gggacagggcuggcccagc

SEQ ID NO: 2281580 - RNA, 20 nt, Human
gggacagggcuggcccagcc

SEQ ID NO: 2281581 - RNA, 15 nt, Human
gggacaucucuuuga

SEQ ID NO: 2281582 - RNA, 22 nt, Human
gggacagucaccucauggaauu

SEQ ID NO: 2281583 - RNA, 20 nt, Human
gggacagucaccucauggaa

SEQ ID NO: 2281584 - RNA, 21 nt, Human
gggacagucaccucauggaau

SEQ ID NO: 2281585 - RNA, 20 nt, Human
gggacagagacaccugcacc

SEQ ID NO: 2281586 - RNA, 18 nt, Human
gggacagagacaccugca

SEQ ID NO: 2281587 - RNA, 17 nt, Human
gggacagaggccccagc

SEQ ID NO: 2281588 - RNA, 13 nt, Human
gggacagagcaga

SEQ ID NO: 2281589 - RNA, 21 nt, Human
gggacagaggccccagccucc

SEQ ID NO: 2281590 - RNA, 20 nt, Human
gggacagaggccccagccuc

SEQ ID NO: 2281591 - RNA, 19 nt, Human
gggacagaggccccagccu

SEQ ID NO: 2281592 - RNA, 18 nt, Human
gggacagaggccccagcc

SEQ ID NO: 2281593 - RNA, 12 nt, Human
gggacagcuccu

SEQ ID NO: 2281594 - RNA, 13 nt, Human
gggacagcuccuu

SEQ ID NO: 2281595 - RNA, 14 nt, Human
gggacaccugcccu

SEQ ID NO: 2281596 - RNA, 17 nt, Human
gggacagagacaccugc

SEQ ID NO: 2281597 - RNA, 16 nt, Human
gggacaccugcccugc

SEQ ID NO: 2281598 - RNA, 17 nt, Human
gggacaccugcccugcc

SEQ ID NO: 2281599 - RNA, 17 nt, Human
gggaagacgccugagcu

SEQ ID NO: 2281600 - RNA, 15 nt, Human
gggaagacgaggccc

SEQ ID NO: 2281601 - RNA, 19 nt, Human
gggaagaaaagagcuuucu

SEQ ID NO: 2281602 - RNA, 16 nt, Human
gggaagaaagagaagg

SEQ ID NO: 2281603 - RNA, 13 nt, Human
gggaagagacuug

SEQ ID NO: 2281604 - RNA, 14 nt, Human
gggaggucauuuug

SEQ ID NO: 2281605 - RNA, 15 nt, Human
gggaggucacuggaa

SEQ ID NO: 2281606 - RNA, 15 nt, Human
gggaggucgaggcag

SEQ ID NO: 2281607 - RNA, 20 nt, Human
gggaugacuaaaauauuuau

SEQ ID NO: 2281608 - RNA, 19 nt, Human
gggaugacuaaaauauuua

SEQ ID NO: 2281609 - RNA, 22 nt, Human
gggagggguaaaauuccuuagc

SEQ ID NO: 2281610 - RNA, 19 nt, Human
gggagggguugccacaggc

SEQ ID NO: 2281611 - RNA, 23 nt, Human
gggagggguugccacaggccucc

SEQ ID NO: 2281612 - RNA, 17 nt, Human
gggaggggggcacaugc

SEQ ID NO: 2281613 - RNA, 18 nt, Human
gggaggucaaggcugcag

SEQ ID NO: 2281614 - RNA, 14 nt, Human
gggaggcugaggcg

SEQ ID NO: 2281615 - RNA, 17 nt, Human
gggaggcugagacagga

SEQ ID NO: 2281616 - RNA, 13 nt, Human
gggaggcuucccc

SEQ ID NO: 2281617 - RNA, 15 nt, Human
gggagggagggcucc

SEQ ID NO: 2281618 - RNA, 16 nt, Human
gggagggagggcucca

SEQ ID NO: 2281619 - RNA, 15 nt, Human
gggaggcugagacag

SEQ ID NO: 2281620 - RNA, 22 nt, Human
gggagggauucugguuccaggg

SEQ ID NO: 2281621 - RNA, 15 nt, Human
gggagggggauccga

SEQ ID NO: 2281622 - RNA, 24 nt, Human
gggagcaggcggugggcacccacc

SEQ ID NO: 2281623 - RNA, 15 nt, Human
gggagcagggagguc

SEQ ID NO: 2281624 - RNA, 22 nt, Human
gggagaggccaugauucgccca

SEQ ID NO: 2281625 - RNA, 17 nt, Human
gggagagggaggucacu

SEQ ID NO: 2281626 - RNA, 20 nt, Human
gggagcagugucuuccauaa

SEQ ID NO: 2281627 - RNA, 18 nt, Human
gggagcauagaaggcagg

SEQ ID NO: 2281628 - RNA, 19 nt, Human
gggagcagugucuuccaua

SEQ ID NO: 2281629 - RNA, 11 nt, Human
gggagcagugu

SEQ ID NO: 2281630 - RNA, 16 nt, Human
gggagcauggcuguga

SEQ ID NO: 2281631 - RNA, 12 nt, Human
gggagccagggc

SEQ ID NO: 2281632 - RNA, 19 nt, Human
gggagcauagaaggcaggu

SEQ ID NO: 2281633 - RNA, 10 nt, Human
gggaggcuga

SEQ ID NO: 2281634 - RNA, 19 nt, Human
gggagccaugcgcccccuc

SEQ ID NO: 2281635 - RNA, 16 nt, Human
gggagagccugcuggc

SEQ ID NO: 2281636 - RNA, 21 nt, Human
gggagaggauuuuuuucugag

SEQ ID NO: 2281637 - RNA, 12 nt, Human
gggagagccugc

SEQ ID NO: 2281638 - RNA, 13 nt, Human
gggagagccugcu

SEQ ID NO: 2281639 - RNA, 23 nt, Human
gggagcaggcucgggcuccccag

SEQ ID NO: 2281640 - RNA, 15 nt, Human
gggagagccuuccag

SEQ ID NO: 2281641 - RNA, 19 nt, Human
gggagagccuuccaggggu

SEQ ID NO: 2281642 - RNA, 15 nt, Human
aaaagcauguacagu

SEQ ID NO: 2281643 - RNA, 18 nt, Human
aaaagcauguacaguguu

SEQ ID NO: 2281644 - RNA, 19 nt, Human
aaaagcauguacaguguuc

SEQ ID NO: 2281645 - RNA, 22 nt, Human
aaaagcauguacaguguucugu

SEQ ID NO: 2281646 - RNA, 18 nt, Human
aaaagccaagaggcugca

SEQ ID NO: 2281647 - RNA, 13 nt, Human
aaaaggaagacua

SEQ ID NO: 2281648 - RNA, 18 nt, Human
aaaaggaagccaaagagu

SEQ ID NO: 2281649 - RNA, 14 nt, Human
aaaagcuuuuuauu

SEQ ID NO: 2281650 - RNA, 14 nt, Human
aaaaggaaaagcaa

SEQ ID NO: 2281651 - RNA, 21 nt, Human
aaaagccucaacuagucauuu

SEQ ID NO: 2281652 - RNA, 21 nt, Human
aaaagcuuugaacccugggac

SEQ ID NO: 2281653 - RNA, 14 nt, Human
aaaagccucugugu

SEQ ID NO: 2281654 - RNA, 10 nt, Human
aaaaggaaaa

SEQ ID NO: 2281655 - RNA, 15 nt, Human
gggagaaccucaggc

SEQ ID NO: 2281656 - RNA, 16 nt, Human
gggagaaccucaggcu

SEQ ID NO: 2281657 - RNA, 14 nt, Human
gggagaaccucagg

SEQ ID NO: 2281658 - RNA, 16 nt, Human
gggagaaauugacaga

SEQ ID NO: 2281659 - RNA, 10 nt, Human
gggagaaaac

SEQ ID NO: 2281660 - RNA, 15 nt, Human
gggagaaaauucaau

SEQ ID NO: 2281661 - RNA, 13 nt, Human
gggagaaaauuca

SEQ ID NO: 2281662 - RNA, 15 nt, Human
gggagaaaagacaug

SEQ ID NO: 2281663 - RNA, 15 nt, Human
aaaaggaagacuaga

SEQ ID NO: 2281664 - RNA, 14 nt, Human
aaaaggaagacuag

SEQ ID NO: 2281665 - RNA, 21 nt, Human
gggagaaccaaaaagaggcua

SEQ ID NO: 2281666 - RNA, 15 nt, Human
gggacuuggaagcuc

SEQ ID NO: 2281667 - RNA, 17 nt, Human
gggacuuggaagcuccg

SEQ ID NO: 2281668 - RNA, 18 nt, Human
gggacuuggaagcuccgc

SEQ ID NO: 2281669 - RNA, 23 nt, Human
gggacuuggaagcuccgcuuucu

SEQ ID NO: 2281670 - RNA, 11 nt, Human
aaaaccaggcc

SEQ ID NO: 2281671 - RNA, 17 nt, Human
aaaaccacuagaacucu

SEQ ID NO: 2281672 - RNA, 12 nt, Human
aaaacccaagug

SEQ ID NO: 2281673 - RNA, 16 nt, Human
aaaaccacuagaacuc

SEQ ID NO: 2281674 - RNA, 20 nt, Human
aaaaccacagcccugucagu

SEQ ID NO: 2281675 - RNA, 19 nt, Human
aaaaccacagcccugucag

SEQ ID NO: 2281676 - RNA, 11 nt, Human
aaaacaucugg

SEQ ID NO: 2281677 - RNA, 21 nt, Human
aaaacauccagauacacccaa

SEQ ID NO: 2281678 - RNA, 16 nt, Human
aaaacauccagauaca

SEQ ID NO: 2281679 - RNA, 21 nt, Human
aaaacaucuauucucuccaaa

SEQ ID NO: 2281680 - RNA, 16 nt, Human
aaaacaucuauucucu

SEQ ID NO: 2281681 - RNA, 13 nt, Human
aaaacaucuauuc

SEQ ID NO: 2281682 - RNA, 16 nt, Human
aaaaauguauaugcac

SEQ ID NO: 2281683 - RNA, 14 nt, Human
aaaacaugcuacac

SEQ ID NO: 2281684 - RNA, 13 nt, Human
aaaacaugcuaca

SEQ ID NO: 2281685 - RNA, 15 nt, Human
gggacauugggaagg

SEQ ID NO: 2281686 - RNA, 17 nt, Human
gggaccaaggaccccuc

SEQ ID NO: 2281687 - RNA, 12 nt, Human
gggaccaaggca

SEQ ID NO: 2281688 - RNA, 17 nt, Human
gggaccaaggcaaggca

SEQ ID NO: 2281689 - RNA, 19 nt, Human
gggaccaaggcaaggcagg

SEQ ID NO: 2281690 - RNA, 23 nt, Human
gggaccaaggcaaggcaggugcc

SEQ ID NO: 2281691 - RNA, 19 nt, Human
gggaccacagcaaggcacc

SEQ ID NO: 2281692 - RNA, 22 nt, Human
gggaccacagcaaggcaccugc

SEQ ID NO: 2281693 - RNA, 23 nt, Human
gggaccacagcaaggcaccugca

SEQ ID NO: 2281694 - RNA, 14 nt, Human
gggaccagagcugc

SEQ ID NO: 2281695 - RNA, 20 nt, Human
gggaccagagcugccaccug

SEQ ID NO: 2281696 - RNA, 15 nt, Human
aaaaauggugccuga

SEQ ID NO: 2281697 - RNA, 12 nt, Human
aaaaauguaaau

SEQ ID NO: 2281698 - RNA, 13 nt, Human
aaaaauguaaaua

SEQ ID NO: 2281699 - RNA, 17 nt, Human
aaaaaugguuuaaaugg

SEQ ID NO: 2281700 - RNA, 14 nt, Human
gggaccagccaaga

SEQ ID NO: 2281701 - RNA, 13 nt, Human
aaaaaugguaauu

SEQ ID NO: 2281702 - RNA, 17 nt, Human
aaaaaugggacuucuuu

SEQ ID NO: 2281703 - RNA, 18 nt, Human
aaaaaugggacuucuuuu

SEQ ID NO: 2281704 - RNA, 23 nt, Human
aaaaaugggacuucuuuucacau

SEQ ID NO: 2281705 - RNA, 23 nt, Human
aaaacugaaagugaaaguccaga

SEQ ID NO: 2281706 - RNA, 18 nt, Human
aaaacugaaaaucuaaua

SEQ ID NO: 2281707 - RNA, 19 nt, Human
aaaacugaaaaucuaauau

SEQ ID NO: 2281708 - RNA, 15 nt, Human
aaaacugaagucuga

SEQ ID NO: 2281709 - RNA, 17 nt, Human
aaaacugaagucugaaa

SEQ ID NO: 2281710 - RNA, 18 nt, Human
aaaacugaagucugaaau

SEQ ID NO: 2281711 - RNA, 19 nt, Human
aaaacugaagucugaaauu

SEQ ID NO: 2281712 - RNA, 18 nt, Human
aaaacgguuaaaacuguc

SEQ ID NO: 2281713 - RNA, 21 nt, Human
aaaacucuacuuaauccaaug

SEQ ID NO: 2281714 - RNA, 16 nt, Human
aaaacgguuaaaacug

SEQ ID NO: 2281715 - RNA, 17 nt, Human
aaaacgcauggagugug

SEQ ID NO: 2281716 - RNA, 16 nt, Human
aaaacggcccucuuga

SEQ ID NO: 2281717 - RNA, 18 nt, Human
aaaacucuccucugcugc

SEQ ID NO: 2281718 - RNA, 20 nt, Human
aaaaccuuucaaauuucaca

SEQ ID NO: 2281719 - RNA, 14 nt, Human
aaaaccuuuugaaa

SEQ ID NO: 2281720 - RNA, 18 nt, Human
aaaacgcauggagugugu

SEQ ID NO: 2281721 - RNA, 14 nt, Human
aaaacgcauggagu

SEQ ID NO: 2281722 - RNA, 13 nt, Human
aaaacgcauggag

SEQ ID NO: 2281723 - RNA, 17 nt, Human
aaaacgcaaagggcuga

SEQ ID NO: 2281724 - RNA, 13 nt, Human
aaaaccuuucaaa

SEQ ID NO: 2281725 - RNA, 14 nt, Human
aaaaccugucaaug

SEQ ID NO: 2281726 - RNA, 17 nt, Human
aaaaccugucaaugaua

SEQ ID NO: 2281727 - RNA, 12 nt, Human
aaaacccagaga

SEQ ID NO: 2281728 - RNA, 22 nt, Human
aaaacccaccuuguuggagccu

SEQ ID NO: 2281729 - RNA, 20 nt, Human
aaaaccaucaaaaauauucc

SEQ ID NO: 2281730 - RNA, 11 nt, Human
aaaagauucau

SEQ ID NO: 2281731 - RNA, 13 nt, Human
aaaagauucauuu

SEQ ID NO: 2281732 - RNA, 23 nt, Human
aaaagauguagauuuauuucauc

SEQ ID NO: 2281733 - RNA, 12 nt, Human
aaaacuucuuuu

SEQ ID NO: 2281734 - RNA, 18 nt, Human
aaaagauugcugaaauuu

SEQ ID NO: 2281735 - RNA, 16 nt, Human
aaaagauugcugaaau

SEQ ID NO: 2281736 - RNA, 14 nt, Human
aaaagauugcugaa

SEQ ID NO: 2281737 - RNA, 21 nt, Human
aaaagauugaaguauuuugcu

SEQ ID NO: 2281738 - RNA, 14 nt, Human
aaaagauuuuaauc

SEQ ID NO: 2281739 - RNA, 17 nt, Human
aaaagauuuguuuuguc

SEQ ID NO: 2281740 - RNA, 13 nt, Human
aaaagauuuguuu

SEQ ID NO: 2281741 - RNA, 21 nt, Human
aaaagauugcugaaauuuuau

SEQ ID NO: 2281742 - RNA, 15 nt, Human
aaaagauuuuaauca

SEQ ID NO: 2281743 - RNA, 12 nt, Human
aaaagcaaaauc

SEQ ID NO: 2281744 - RNA, 21 nt, Human
aaaagauuuucagaaaauauu

SEQ ID NO: 2281745 - RNA, 16 nt, Human
aaaacugacuccuuag

SEQ ID NO: 2281746 - RNA, 21 nt, Human
aaaacugaagucugaaauuug

SEQ ID NO: 2281747 - RNA, 17 nt, Human
aaaacugaauuauaaga

SEQ ID NO: 2281748 - RNA, 15 nt, Human
aaaacugacagagga

SEQ ID NO: 2281749 - RNA, 15 nt, Human
aaaacuuauuugagu

SEQ ID NO: 2281750 - RNA, 11 nt, Human
aaaacuuauuu

SEQ ID NO: 2281751 - RNA, 17 nt, Human
aaaacuuaacauauuua

SEQ ID NO: 2281752 - RNA, 19 nt, Human
aaaacuuaacauauuuacu

SEQ ID NO: 2281753 - RNA, 15 nt, Human
aaaacuucagacaua

SEQ ID NO: 2281754 - RNA, 22 nt, Human
aaaagauguagauuuauuucau

SEQ ID NO: 2281755 - RNA, 14 nt, Human
ggcaggggacagga

SEQ ID NO: 2281756 - RNA, 13 nt, Human
ggcagggcucuga

SEQ ID NO: 2281757 - RNA, 14 nt, Human
ggcagggcucugau

SEQ ID NO: 2281758 - RNA, 15 nt, Human
ggcagggcugacucu

SEQ ID NO: 2281759 - RNA, 15 nt, Human
ggcagggcugaggcc

SEQ ID NO: 2281760 - RNA, 15 nt, Human
ggcagcccuguaggg

SEQ ID NO: 2281761 - RNA, 11 nt, Human
ggcagcccuug

SEQ ID NO: 2281762 - RNA, 21 nt, Human
ggcagcccuugcuuguuggga

SEQ ID NO: 2281763 - RNA, 13 nt, Human
ggcagcccuguag

SEQ ID NO: 2281764 - RNA, 22 nt, Human
ggcagccccuguucuggcagag

SEQ ID NO: 2281765 - RNA, 21 nt, Human
ggcagggccuugcccagagau

SEQ ID NO: 2281766 - RNA, 20 nt, Human
ggcagggccuugcccagaga

SEQ ID NO: 2281767 - RNA, 19 nt, Human
ggcagggccuugcccagag

SEQ ID NO: 2281768 - RNA, 18 nt, Human
ggcagggccuugcccaga

SEQ ID NO: 2281769 - RNA, 16 nt, Human
ggcagggccuugccca

SEQ ID NO: 2281770 - RNA, 13 nt, Human
ggcagccgagcuc

SEQ ID NO: 2281771 - RNA, 15 nt, Human
ggcagggcucaggau

SEQ ID NO: 2281772 - RNA, 13 nt, Human
ggcagggcucagg

SEQ ID NO: 2281773 - RNA, 11 nt, Human
ggcagggcuca

SEQ ID NO: 2281774 - RNA, 14 nt, Human
ggcaguuggccaga

SEQ ID NO: 2281775 - RNA, 21 nt, Human
ggcaguucugggugcucccua

SEQ ID NO: 2281776 - RNA, 15 nt, Human
ggcaguucugggugc

SEQ ID NO: 2281777 - RNA, 11 nt, Human
ggcaguuacau

SEQ ID NO: 2281778 - RNA, 21 nt, Human
ggcaguggugguuuucuguuc

SEQ ID NO: 2281779 - RNA, 20 nt, Human
ggcaguggugguuuucuguu

SEQ ID NO: 2281780 - RNA, 15 nt, Human
ggagagaccucauca

SEQ ID NO: 2281781 - RNA, 21 nt, Human
ggagagaaggggaggagggcg

SEQ ID NO: 2281782 - RNA, 20 nt, Human
ggagagaaggggaggagggc

SEQ ID NO: 2281783 - RNA, 18 nt, Human
ggagagaaggggaggagg

SEQ ID NO: 2281784 - RNA, 18 nt, Human
ggagagaccgagugaacc

SEQ ID NO: 2281785 - RNA, 11 nt, Human
ggagagaccuc

SEQ ID NO: 2281786 - RNA, 13 nt, Human
ggagagaccucau

SEQ ID NO: 2281787 - RNA, 18 nt, Human
ggagagaaacaauaaaga

SEQ ID NO: 2281788 - RNA, 16 nt, Human
ggagagaaagugggug

SEQ ID NO: 2281789 - RNA, 18 nt, Human
ggagagaaagugggugag

SEQ ID NO: 2281790 - RNA, 12 nt, Human
ggagagaagaau

SEQ ID NO: 2281791 - RNA, 24 nt, Human
ggagagaaagugggugagaugcug

SEQ ID NO: 2281792 - RNA, 16 nt, Human
ggagagaagagaaugc

SEQ ID NO: 2281793 - RNA, 20 nt, Human
ggagacucuguggggccuug

SEQ ID NO: 2281794 - RNA, 15 nt, Human
ggagacugcccagcu

SEQ ID NO: 2281795 - RNA, 12 nt, Human
ggagagaaaaca

SEQ ID NO: 2281796 - RNA, 12 nt, Human
ggcacagggucu

SEQ ID NO: 2281797 - RNA, 23 nt, Human
ggcacagaaaauggaagacagcu

SEQ ID NO: 2281798 - RNA, 21 nt, Human
ggcacaguuuucugagaaaga

SEQ ID NO: 2281799 - RNA, 17 nt, Human
ggcacagggucugcucu

SEQ ID NO: 2281800 - RNA, 18 nt, Human
ggcacagggucugcucuu

SEQ ID NO: 2281801 - RNA, 19 nt, Human
ggcacagggucugcucuuu

SEQ ID NO: 2281802 - RNA, 17 nt, Human
ggcacaguaugucccau

SEQ ID NO: 2281803 - RNA, 17 nt, Human
ggcacugagauauuuau

SEQ ID NO: 2281804 - RNA, 12 nt, Human
ggcacugagccc

SEQ ID NO: 2281805 - RNA, 22 nt, Human
ggcacucuguuauuuagacuca

SEQ ID NO: 2281806 - RNA, 23 nt, Human
ggcacucagaagacacugauggg

SEQ ID NO: 2281807 - RNA, 17 nt, Human
ggcacaucagaaaggaa

SEQ ID NO: 2281808 - RNA, 19 nt, Human
ggcacagugucugggcuga

SEQ ID NO: 2281809 - RNA, 15 nt, Human
ggcacagugucuggg

SEQ ID NO: 2281810 - RNA, 18 nt, Human
ggcacagugucugggcug

SEQ ID NO: 2281811 - RNA, 13 nt, Human
ggcacaucagcac

SEQ ID NO: 2281812 - RNA, 19 nt, Human
ggcacagaaaauggaagac

SEQ ID NO: 2281813 - RNA, 20 nt, Human
ggcacagaaaauggaagaca

SEQ ID NO: 2281814 - RNA, 21 nt, Human
ggcacagaaaauggaagacag

SEQ ID NO: 2281815 - RNA, 23 nt, Human
ggcagccccauucugccugccca

SEQ ID NO: 2281816 - RNA, 11 nt, Human
ggcagccccug

SEQ ID NO: 2281817 - RNA, 20 nt, Human
ggcagcagugugaggccagg

SEQ ID NO: 2281818 - RNA, 19 nt, Human
ggcagcagugugaggccag

SEQ ID NO: 2281819 - RNA, 14 nt, Human
ggcagcagugugag

SEQ ID NO: 2281820 - RNA, 13 nt, Human
ggcagcaguguga

SEQ ID NO: 2281821 - RNA, 21 nt, Human
ggcagcagggcuacccugagc

SEQ ID NO: 2281822 - RNA, 15 nt, Human
ggcagcaggugcugc

SEQ ID NO: 2281823 - RNA, 16 nt, Human
ggcagcaggugcugcu

SEQ ID NO: 2281824 - RNA, 19 nt, Human
ggcagcaggugcugcuacc

SEQ ID NO: 2281825 - RNA, 21 nt, Human
ggcagcaggugcugcuacccu

SEQ ID NO: 2281826 - RNA, 18 nt, Human
ggcagcagggcuacccug

SEQ ID NO: 2281827 - RNA, 13 nt, Human
ggcagcagggcua

SEQ ID NO: 2281828 - RNA, 12 nt, Human
ggcagcagccau

SEQ ID NO: 2281829 - RNA, 13 nt, Human
ggcagcagccauc

SEQ ID NO: 2281830 - RNA, 20 nt, Human
ggcagacagcagcucaggca

SEQ ID NO: 2281831 - RNA, 21 nt, Human
ggcagacacggaucugagaau

SEQ ID NO: 2281832 - RNA, 16 nt, Human
ggcagacgccggggac

SEQ ID NO: 2281833 - RNA, 15 nt, Human
ggcacugguggcccg

SEQ ID NO: 2281834 - RNA, 12 nt, Human
ggcacugccuga

SEQ ID NO: 2281835 - RNA, 13 nt, Human
ggcacugagcccc

SEQ ID NO: 2281836 - RNA, 19 nt, Human
ggcacugagcccccccaac

SEQ ID NO: 2281837 - RNA, 23 nt, Human
ggcacugagcccccccaacacug

SEQ ID NO: 2281838 - RNA, 14 nt, Human
ggcacugcaggggc

SEQ ID NO: 2281839 - RNA, 15 nt, Human
ggcacuucacagagu

SEQ ID NO: 2281840 - RNA, 21 nt, Human
ggcacuucacagagugugcug

SEQ ID NO: 2281841 - RNA, 11 nt, Human
ggcacuucaca

SEQ ID NO: 2281842 - RNA, 13 nt, Human
ggcacuucacaga

SEQ ID NO: 2281843 - RNA, 14 nt, Human
ggcacuucacagag

SEQ ID NO: 2281844 - RNA, 19 nt, Human
ggcagacagcagcucaggc

SEQ ID NO: 2281845 - RNA, 18 nt, Human
ggcagacagcagcucagg

SEQ ID NO: 2281846 - RNA, 17 nt, Human
ggcagacagcagcucag

SEQ ID NO: 2281847 - RNA, 16 nt, Human
ggcagacagcagcuca

SEQ ID NO: 2281848 - RNA, 15 nt, Human
ggcagacagcagcuc

SEQ ID NO: 2281849 - RNA, 14 nt, Human
ggcagacagcagcu

SEQ ID NO: 2281850 - RNA, 13 nt, Human
ggcagacagcagc

SEQ ID NO: 2281851 - RNA, 17 nt, Human
ggcagacacggaucuga

SEQ ID NO: 2281852 - RNA, 19 nt, Human
ggcagacacggaucugaga

SEQ ID NO: 2281853 - RNA, 16 nt, Human
ggcacuugauuccuug

SEQ ID NO: 2281854 - RNA, 18 nt, Human
ggcagaaugcuagcucug

SEQ ID NO: 2281855 - RNA, 20 nt, Human
ggcagaaugcuagcucugag

SEQ ID NO: 2281856 - RNA, 21 nt, Human
ggcagaaugcuagcucugagc

SEQ ID NO: 2281857 - RNA, 23 nt, Human
ggcagaaugcuagcucugagcca

SEQ ID NO: 2281858 - RNA, 17 nt, Human
ggcagacacagggacuu

SEQ ID NO: 2281859 - RNA, 20 nt, Human
ggcagacacagggacuugaa

SEQ ID NO: 2281860 - RNA, 19 nt, Human
ggccagugugaucccaagu

SEQ ID NO: 2281861 - RNA, 17 nt, Human
ggccagucugggcugcc

SEQ ID NO: 2281862 - RNA, 15 nt, Human
ggccauacuggccuc

SEQ ID NO: 2281863 - RNA, 14 nt, Human
ggccaguugguccc

SEQ ID NO: 2281864 - RNA, 17 nt, Human
ggccaguuggucccccu

SEQ ID NO: 2281865 - RNA, 21 nt, Human
ggcauacgccuguaguccuag

SEQ ID NO: 2281866 - RNA, 16 nt, Human
ggcaguuuuucuguau

SEQ ID NO: 2281867 - RNA, 12 nt, Human
ggcaguuuuucu

SEQ ID NO: 2281868 - RNA, 15 nt, Human
ggcaguuuuucugua

SEQ ID NO: 2281869 - RNA, 19 nt, Human
ggcaguuuuucuguauuuu

SEQ ID NO: 2281870 - RNA, 16 nt, Human
ggccaguccugccugg

SEQ ID NO: 2281871 - RNA, 19 nt, Human
ggcauagaugcaggugagc

SEQ ID NO: 2281872 - RNA, 15 nt, Human
ggcauagcccagaca

SEQ ID NO: 2281873 - RNA, 23 nt, Human
ggccagucccugaggcagguccc

SEQ ID NO: 2281874 - RNA, 17 nt, Human
ggccagucccugaggca

SEQ ID NO: 2281875 - RNA, 16 nt, Human
ggcauagaggcuucuc

SEQ ID NO: 2281876 - RNA, 14 nt, Human
ggcauacuaauaaa

SEQ ID NO: 2281877 - RNA, 22 nt, Human
ggcauagaggcuucuccgccag

SEQ ID NO: 2281878 - RNA, 21 nt, Human
ggccaguccugccuggccagg

SEQ ID NO: 2281879 - RNA, 20 nt, Human
ggccaguccugccuggccag

SEQ ID NO: 2281880 - RNA, 19 nt, Human
ggccaguccugccuggcca

SEQ ID NO: 2281881 - RNA, 18 nt, Human
ggccaguccugccuggcc

SEQ ID NO: 2281882 - RNA, 22 nt, Human
ggccaguccugccuggccaggc

SEQ ID NO: 2281883 - RNA, 15 nt, Human
ggccagucugggcug

SEQ ID NO: 2281884 - RNA, 16 nt, Human
ggccagucugggcugc

SEQ ID NO: 2281885 - RNA, 13 nt, Human
ggccagucugugg

SEQ ID NO: 2281886 - RNA, 14 nt, Human
ggccagucugugga

SEQ ID NO: 2281887 - RNA, 20 nt, Human
ggccagugugacaaggauug

SEQ ID NO: 2281888 - RNA, 23 nt, Human
ggccagucuguggaucagagaug

SEQ ID NO: 2281889 - RNA, 15 nt, Human
ggccagucuguggau

SEQ ID NO: 2281890 - RNA, 18 nt, Human
ggccagucuguggaucag

SEQ ID NO: 2281891 - RNA, 20 nt, Human
ggcccuccuacccugcgccc

SEQ ID NO: 2281892 - RNA, 15 nt, Human
ggcccucgcugccag

SEQ ID NO: 2281893 - RNA, 19 nt, Human
ggcccucgcugccagcucu

SEQ ID NO: 2281894 - RNA, 16 nt, Human
ggcccucgcugccagc

SEQ ID NO: 2281895 - RNA, 17 nt, Human
ggcccuccuacccugcg

SEQ ID NO: 2281896 - RNA, 19 nt, Human
ggcccuccuacccugcgcc

SEQ ID NO: 2281897 - RNA, 21 nt, Human
ggcccuccuacccugcgccca

SEQ ID NO: 2281898 - RNA, 16 nt, Human
ggcccuccuacccugc

SEQ ID NO: 2281899 - RNA, 22 nt, Human
ggcccggggcuggcggcuacuc

SEQ ID NO: 2281900 - RNA, 19 nt, Human
ggcccggggcuggcggcua

SEQ ID NO: 2281901 - RNA, 13 nt, Human
ggcccggggcugg

SEQ ID NO: 2281902 - RNA, 23 nt, Human
ggcccggcgcgguggcucacgcc

SEQ ID NO: 2281903 - RNA, 20 nt, Human
ggcccggccagccaugucug

SEQ ID NO: 2281904 - RNA, 15 nt, Human
ggcccggcuccaggc

SEQ ID NO: 2281905 - RNA, 19 nt, Human
ggcccuucucuccagcccc

SEQ ID NO: 2281906 - RNA, 17 nt, Human
ggcccucgggcccagcc

SEQ ID NO: 2281907 - RNA, 18 nt, Human
ggcccucgggcccagccc

SEQ ID NO: 2281908 - RNA, 19 nt, Human
ggcccucgggcccagcccc

SEQ ID NO: 2281909 - RNA, 20 nt, Human
ggcccucgggcccagccccc

SEQ ID NO: 2281910 - RNA, 23 nt, Human
ggcccucgcugccagcucuguau

SEQ ID NO: 2281911 - RNA, 15 nt, Human
ggcccucgggcccag

SEQ ID NO: 2281912 - RNA, 16 nt, Human
ggcccucgggcccagc

SEQ ID NO: 2281913 - RNA, 22 nt, Human
ggcccucgcugccagcucugua

SEQ ID NO: 2281914 - RNA, 21 nt, Human
ggcccucgcugccagcucugu

SEQ ID NO: 2281915 - RNA, 20 nt, Human
ggcccuucucuccagccccu

SEQ ID NO: 2281916 - RNA, 21 nt, Human
ggcccuucucuccagccccug

SEQ ID NO: 2281917 - RNA, 13 nt, Human
ggccccugcuggu

SEQ ID NO: 2281918 - RNA, 14 nt, Human
ggccccugcugguu

SEQ ID NO: 2281919 - RNA, 13 nt, Human
ggcccggcuccag

SEQ ID NO: 2281920 - RNA, 12 nt, Human
ggcccggccagc

SEQ ID NO: 2281921 - RNA, 19 nt, Human
ggccccugcuucuccagcc

SEQ ID NO: 2281922 - RNA, 22 nt, Human
ggcccgcuugccucggcuccug

SEQ ID NO: 2281923 - RNA, 23 nt, Human
ggcccgcuugccucggcuccugc

SEQ ID NO: 2281924 - RNA, 23 nt, Human
ggccccugcugguucaggguugg

SEQ ID NO: 2281925 - RNA, 16 nt, Human
ggccccugcuucucca

SEQ ID NO: 2281926 - RNA, 16 nt, Human
ggccuccauccugagg

SEQ ID NO: 2281927 - RNA, 15 nt, Human
ggccuccauccugag

SEQ ID NO: 2281928 - RNA, 14 nt, Human
ggccuccauccuga

SEQ ID NO: 2281929 - RNA, 20 nt, Human
ggccucagccagagaagcua

SEQ ID NO: 2281930 - RNA, 17 nt, Human
ggccucagccagagaag

SEQ ID NO: 2281931 - RNA, 15 nt, Human
ggccucagccagaga

SEQ ID NO: 2281932 - RNA, 19 nt, Human
ggccucaccgagugggggc

SEQ ID NO: 2281933 - RNA, 17 nt, Human
ggccucagcaccccugu

SEQ ID NO: 2281934 - RNA, 21 nt, Human
ggccucagcaccccugucucu

SEQ ID NO: 2281935 - RNA, 23 nt, Human
ggccucaagugauucuccugccu

SEQ ID NO: 2281936 - RNA, 14 nt, Human
ggccgaagcucugg

SEQ ID NO: 2281937 - RNA, 15 nt, Human
ggccgaagcucuggc

SEQ ID NO: 2281938 - RNA, 16 nt, Human
ggccgaagcucuggcu

SEQ ID NO: 2281939 - RNA, 17 nt, Human
ggccgaagcucuggcug

SEQ ID NO: 2281940 - RNA, 18 nt, Human
ggccgaagcucuggcuga

SEQ ID NO: 2281941 - RNA, 16 nt, Human
ggccgaaggcagugca

SEQ ID NO: 2281942 - RNA, 19 nt, Human
ggccgaauccccucccugu

SEQ ID NO: 2281943 - RNA, 10 nt, Human
ggccucagaa

SEQ ID NO: 2281944 - RNA, 19 nt, Human
ggccucacuaggcuucugg

SEQ ID NO: 2281945 - RNA, 21 nt, Human
ggccgaauccccucccuguca

SEQ ID NO: 2281946 - RNA, 18 nt, Human
ggccucaccgaguggggg

SEQ ID NO: 2281947 - RNA, 21 nt, Human
ggcccuugcaguucagcacca

SEQ ID NO: 2281948 - RNA, 13 nt, Human
ggcccucuacccc

SEQ ID NO: 2281949 - RNA, 16 nt, Human
ggcccuuuccucaggc

SEQ ID NO: 2281950 - RNA, 18 nt, Human
ggcccuuuccucaggcaa

SEQ ID NO: 2281951 - RNA, 22 nt, Human
ggcccuucucuccagccccugg

SEQ ID NO: 2281952 - RNA, 23 nt, Human
ggcccuucucuccagccccugga

SEQ ID NO: 2281953 - RNA, 14 nt, Human
guaccacucaggcc

SEQ ID NO: 2281954 - RNA, 21 nt, Human
guaccaaucauuuuaauuauu

SEQ ID NO: 2281955 - RNA, 14 nt, Human
guaccaaucauuuu

SEQ ID NO: 2281956 - RNA, 15 nt, Human
guaccaaucauuuua

SEQ ID NO: 2281957 - RNA, 16 nt, Human
guaccaaaugcuuuaa

SEQ ID NO: 2281958 - RNA, 18 nt, Human
guaccaaaugcuuuaaaa

SEQ ID NO: 2281959 - RNA, 20 nt, Human
guaccaagacuacuagggaa

SEQ ID NO: 2281960 - RNA, 23 nt, Human
guaccaagacuacuagggaaaug

SEQ ID NO: 2281961 - RNA, 13 nt, Human
guacauuucugaa

SEQ ID NO: 2281962 - RNA, 17 nt, Human
guacauuucugaaauga

SEQ ID NO: 2281963 - RNA, 15 nt, Human
guacauuuuguaaca

SEQ ID NO: 2281964 - RNA, 14 nt, Human
guacauuuaugauu

SEQ ID NO: 2281965 - RNA, 16 nt, Human
guacauuuaugauuua

SEQ ID NO: 2281966 - RNA, 18 nt, Human
guacauuuaugauuuaau

SEQ ID NO: 2281967 - RNA, 19 nt, Human
guacauuuaugauuuaaua

SEQ ID NO: 2281968 - RNA, 20 nt, Human
guacauuuaugauuuaauaa

SEQ ID NO: 2281969 - RNA, 21 nt, Human
guacauuuaugauuuaauaaa

SEQ ID NO: 2281970 - RNA, 22 nt, Human
guacauuuaugauuuaauaaaa

SEQ ID NO: 2281971 - RNA, 18 nt, Human
guacauuucccugugcug

SEQ ID NO: 2281972 - RNA, 14 nt, Human
guacauuucccugu

SEQ ID NO: 2281973 - RNA, 16 nt, Human
guacauuucccugugc

SEQ ID NO: 2281974 - RNA, 15 nt, Human
guacauuuggagaca

SEQ ID NO: 2281975 - RNA, 20 nt, Human
guaccauaguaccauuuaua

SEQ ID NO: 2281976 - RNA, 20 nt, Human
guaccaugaaacaaagcugc

SEQ ID NO: 2281977 - RNA, 12 nt, Human
guacccacugcu

SEQ ID NO: 2281978 - RNA, 19 nt, Human
guaccauuuauacaaauua

SEQ ID NO: 2281979 - RNA, 21 nt, Human
guaccauuuauacaaauuaga

SEQ ID NO: 2281980 - RNA, 14 nt, Human
guaccauuugcaug

SEQ ID NO: 2281981 - RNA, 18 nt, Human
guacccaaaagcucagcc

SEQ ID NO: 2281982 - RNA, 16 nt, Human
guaccagcccagaugu

SEQ ID NO: 2281983 - RNA, 14 nt, Human
guaccagcugcgcu

SEQ ID NO: 2281984 - RNA, 16 nt, Human
guaccagcugcgcuug

SEQ ID NO: 2281985 - RNA, 16 nt, Human
guaccagauaaaauua

SEQ ID NO: 2281986 - RNA, 16 nt, Human
guaccagcaauaugua

SEQ ID NO: 2281987 - RNA, 19 nt, Human
guaccaggucuccuccacc

SEQ ID NO: 2281988 - RNA, 22 nt, Human
guaccaggucuccuccaccgcc

SEQ ID NO: 2281989 - RNA, 19 nt, Human
guaccagcugcgcuugcuu

SEQ ID NO: 2281990 - RNA, 17 nt, Human
guaccagcugcgcuugc

SEQ ID NO: 2281991 - RNA, 18 nt, Human
guaccaggucuccuccac

SEQ ID NO: 2281992 - RNA, 14 nt, Human
guacaucuggccuu

SEQ ID NO: 2281993 - RNA, 20 nt, Human
guacaucuauuuuggauugu

SEQ ID NO: 2281994 - RNA, 18 nt, Human
guacaucuauuuuggauu

SEQ ID NO: 2281995 - RNA, 14 nt, Human
guacaugaaaacac

SEQ ID NO: 2281996 - RNA, 16 nt, Human
guacaugaaaacacau

SEQ ID NO: 2281997 - RNA, 15 nt, Human
guacaugaaaacaca

SEQ ID NO: 2281998 - RNA, 14 nt, Human
aaauccagaaagaa

SEQ ID NO: 2281999 - RNA, 15 nt, Human
aaauccagaaagaaa

SEQ ID NO: 2282000 - RNA, 15 nt, Human
aaauccauacauuug

SEQ ID NO: 2282001 - RNA, 20 nt, Human
guacauauuuguggaauaau

SEQ ID NO: 2282002 - RNA, 17 nt, Human
guacaucccauguaaca

SEQ ID NO: 2282003 - RNA, 20 nt, Human
guacaucccauguaacagaa

SEQ ID NO: 2282004 - RNA, 21 nt, Human
guacaucccauguaacagaaa

SEQ ID NO: 2282005 - RNA, 22 nt, Human
guacaucccauguaacagaaag

SEQ ID NO: 2282006 - RNA, 23 nt, Human
guacaucccauguaacagaaagg

SEQ ID NO: 2282007 - RNA, 18 nt, Human
aaauccauacauuugugu

SEQ ID NO: 2282008 - RNA, 19 nt, Human
guacauggaauaacaugua

SEQ ID NO: 2282009 - RNA, 16 nt, Human
guacauggcagaguuu

SEQ ID NO: 2282010 - RNA, 10 nt, Human
guacauguau

SEQ ID NO: 2282011 - RNA, 11 nt, Human
guacaugagaa

SEQ ID NO: 2282012 - RNA, 18 nt, Human
guacauucaauguuuaug

SEQ ID NO: 2282013 - RNA, 17 nt, Human
guacauucaauguuuau

SEQ ID NO: 2282014 - RNA, 13 nt, Human
guacaugugaggc

SEQ ID NO: 2282015 - RNA, 19 nt, Human
guacauguguagccugugc

SEQ ID NO: 2282016 - RNA, 20 nt, Human
guacauguguagccugugca

SEQ ID NO: 2282017 - RNA, 20 nt, Human
guacaugaaaacacauuuuu

SEQ ID NO: 2282018 - RNA, 19 nt, Human
guacaugaaaacacauuuu

SEQ ID NO: 2282019 - RNA, 18 nt, Human
guacaugaaaacacauuu

SEQ ID NO: 2282020 - RNA, 17 nt, Human
guacaugaaaacacauu

SEQ ID NO: 2282021 - RNA, 23 nt, Human
aaauauuauuguggaaaugaaua

SEQ ID NO: 2282022 - RNA, 15 nt, Human
aaauauuauguguuu

SEQ ID NO: 2282023 - RNA, 20 nt, Human
aaauauuauuuuaugaaagg

SEQ ID NO: 2282024 - RNA, 16 nt, Human
aaauauucaugcuucu

SEQ ID NO: 2282025 - RNA, 23 nt, Human
aaauauuccauccauauacuuug

SEQ ID NO: 2282026 - RNA, 22 nt, Human
aaaucaccacaccaaaccucuc

SEQ ID NO: 2282027 - RNA, 15 nt, Human
aaauauuccugcauu

SEQ ID NO: 2282028 - RNA, 19 nt, Human
aaauauucccuagaaacuu

SEQ ID NO: 2282029 - RNA, 18 nt, Human
aaauauucccuagaaacu

SEQ ID NO: 2282030 - RNA, 14 nt, Human
aaaucagacuauga

SEQ ID NO: 2282031 - RNA, 21 nt, Human
aaaucagacuaugaaguuuuu

SEQ ID NO: 2282032 - RNA, 18 nt, Human
aaaucagccaauuauguu

SEQ ID NO: 2282033 - RNA, 20 nt, Human
aaaucagccaauuauguuaa

SEQ ID NO: 2282034 - RNA, 21 nt, Human
aaaucagccaauuauguuaaa

SEQ ID NO: 2282035 - RNA, 23 nt, Human
aaaucagccaauuauguuaaacu

SEQ ID NO: 2282036 - RNA, 17 nt, Human
aaaucagccaauuaugu

SEQ ID NO: 2282037 - RNA, 20 nt, Human
aaauauuauaacuuaaaaaa

SEQ ID NO: 2282038 - RNA, 18 nt, Human
aaauauuagaugugauuu

SEQ ID NO: 2282039 - RNA, 20 nt, Human
aaauauuagaugugauuuaa

SEQ ID NO: 2282040 - RNA, 21 nt, Human
aaauauuagaugugauuuaau

SEQ ID NO: 2282041 - RNA, 22 nt, Human
aaauauuagaugugauuuaaua

SEQ ID NO: 2282042 - RNA, 14 nt, Human
aaauauuagaaaca

SEQ ID NO: 2282043 - RNA, 17 nt, Human
aaauauuagaaacagcu

SEQ ID NO: 2282044 - RNA, 13 nt, Human
aaauauuagaugu

SEQ ID NO: 2282045 - RNA, 14 nt, Human
aaauauuagaugug

SEQ ID NO: 2282046 - RNA, 15 nt, Human
aaauauuagauguga

SEQ ID NO: 2282047 - RNA, 14 nt, Human
aaauauuauguguu

SEQ ID NO: 2282048 - RNA, 17 nt, Human
aaauauuauguuaaaac

SEQ ID NO: 2282049 - RNA, 12 nt, Human
aaauauacugua

SEQ ID NO: 2282050 - RNA, 16 nt, Human
aaauauacuguaaaga

SEQ ID NO: 2282051 - RNA, 15 nt, Human
aaauauacuguaaag

SEQ ID NO: 2282052 - RNA, 14 nt, Human
aaauauacuguaaa

SEQ ID NO: 2282053 - RNA, 13 nt, Human
aaauauacuguaa

SEQ ID NO: 2282054 - RNA, 14 nt, Human
aaauauacuuaaau

SEQ ID NO: 2282055 - RNA, 18 nt, Human
aaauauacuuaaauggaa

SEQ ID NO: 2282056 - RNA, 23 nt, Human
aaauauacuguaaagaaagagag

SEQ ID NO: 2282057 - RNA, 21 nt, Human
aaauauacuguaaagaaagag

SEQ ID NO: 2282058 - RNA, 19 nt, Human
aaauauacuguaaagaaag

SEQ ID NO: 2282059 - RNA, 17 nt, Human
aaauauacuguaaagaa

SEQ ID NO: 2282060 - RNA, 18 nt, Human
aaaucagccugcuccagc

SEQ ID NO: 2282061 - RNA, 16 nt, Human
aaaucagcugcuacua

SEQ ID NO: 2282062 - RNA, 12 nt, Human
aaaucagccugc

SEQ ID NO: 2282063 - RNA, 19 nt, Human
aaaucagccguguaaccau

SEQ ID NO: 2282064 - RNA, 16 nt, Human
aaaucauaaacugugu

SEQ ID NO: 2282065 - RNA, 14 nt, Human
aaaucauaaacugu

SEQ ID NO: 2282066 - RNA, 17 nt, Human
aaaucaguuacuaagaa

SEQ ID NO: 2282067 - RNA, 21 nt, Human
aaaucaguuacuaagaagaaa

SEQ ID NO: 2282068 - RNA, 23 nt, Human
aaaucauaaacugugugcagacu

SEQ ID NO: 2282069 - RNA, 22 nt, Human
aaaucauaagauauuuuucaug

SEQ ID NO: 2282070 - RNA, 12 nt, Human
aaaucauuucug

SEQ ID NO: 2282071 - RNA, 22 nt, Human
aaaucagucagugcaaauguca

SEQ ID NO: 2282072 - RNA, 16 nt, Human
aaaucaguuacuaaga

SEQ ID NO: 2282073 - RNA, 22 nt, Human
aaaucauaggaaaguauuuuuu

SEQ ID NO: 2282074 - RNA, 12 nt, Human
aaaucauuuggg

SEQ ID NO: 2282075 - RNA, 20 nt, Human
aaaucauuuuauaugucaaa

SEQ ID NO: 2282076 - RNA, 21 nt, Human
aaaucauuuuauaugucaaag

SEQ ID NO: 2282077 - RNA, 23 nt, Human
aaaucauuuggguuaauauggcu

SEQ ID NO: 2282078 - RNA, 16 nt, Human
aaaucauuuuauaugu

SEQ ID NO: 2282079 - RNA, 15 nt, Human
aaauccacuuuaucu

SEQ ID NO: 2282080 - RNA, 23 nt, Human
aaaucauuucugcaucagcugcu

SEQ ID NO: 2282081 - RNA, 22 nt, Human
aaaucauuucugcaucagcugc

SEQ ID NO: 2282082 - RNA, 21 nt, Human
aaaucauuucugcaucagcug

SEQ ID NO: 2282083 - RNA, 19 nt, Human
aaaucauuucugcaucagc

SEQ ID NO: 2282084 - RNA, 11 nt, Human
guagagacagg

SEQ ID NO: 2282085 - RNA, 12 nt, Human
guagagacaggg

SEQ ID NO: 2282086 - RNA, 20 nt, Human
guagaccuagggaggaccuu

SEQ ID NO: 2282087 - RNA, 17 nt, Human
guagaccuagggaggac

SEQ ID NO: 2282088 - RNA, 16 nt, Human
guagaccuagggagga

SEQ ID NO: 2282089 - RNA, 19 nt, Human
guagaccuuguuacuucug

SEQ ID NO: 2282090 - RNA, 20 nt, Human
guagaccuuguuacuucuga

SEQ ID NO: 2282091 - RNA, 21 nt, Human
guagaccuuguuacuucugag

SEQ ID NO: 2282092 - RNA, 22 nt, Human
guagaccuuguuacuucugagg

SEQ ID NO: 2282093 - RNA, 18 nt, Human
guagacacgcucuucuau

SEQ ID NO: 2282094 - RNA, 19 nt, Human
guagacacgcucuucuauu

SEQ ID NO: 2282095 - RNA, 22 nt, Human
guagacaagcaauuagacaaga

SEQ ID NO: 2282096 - RNA, 16 nt, Human
guagaccaaaauaaaa

SEQ ID NO: 2282097 - RNA, 15 nt, Human
guagaccaaaauaaa

SEQ ID NO: 2282098 - RNA, 14 nt, Human
guagaccaaaauaa

SEQ ID NO: 2282099 - RNA, 15 nt, Human
guagacauuucucuu

SEQ ID NO: 2282100 - RNA, 15 nt, Human
guagagccagggucu

SEQ ID NO: 2282101 - RNA, 18 nt, Human
guagagccagggucucac

SEQ ID NO: 2282102 - RNA, 16 nt, Human
guagcccgccugccag

SEQ ID NO: 2282103 - RNA, 20 nt, Human
guagcccgccugccaguccu

SEQ ID NO: 2282104 - RNA, 17 nt, Human
guagagauggaggagga

SEQ ID NO: 2282105 - RNA, 16 nt, Human
guagagauggaggagg

SEQ ID NO: 2282106 - RNA, 17 nt, Human
guagcccuggccagagg

SEQ ID NO: 2282107 - RNA, 14 nt, Human
guagcccuuucugu

SEQ ID NO: 2282108 - RNA, 15 nt, Human
guagcccuggccaga

SEQ ID NO: 2282109 - RNA, 17 nt, Human
guagcccgccugccagu

SEQ ID NO: 2282110 - RNA, 19 nt, Human
guagccgagagccugcucc

SEQ ID NO: 2282111 - RNA, 13 nt, Human
guagagacagggu

SEQ ID NO: 2282112 - RNA, 10 nt, Human
guagagccag

SEQ ID NO: 2282113 - RNA, 15 nt, Human
guagagauggaggag

SEQ ID NO: 2282114 - RNA, 18 nt, Human
guagagaccgagccucug

SEQ ID NO: 2282115 - RNA, 13 nt, Human
guagagaaacacu

SEQ ID NO: 2282116 - RNA, 15 nt, Human
guagagccagagguc

SEQ ID NO: 2282117 - RNA, 11 nt, Human
guagagccagg

SEQ ID NO: 2282118 - RNA, 22 nt, Human
guagaacacaaggucauuugcu

SEQ ID NO: 2282119 - RNA, 22 nt, Human
guagaaaggggcccaguccugg

SEQ ID NO: 2282120 - RNA, 20 nt, Human
guagaaaugguuguauuaga

SEQ ID NO: 2282121 - RNA, 22 nt, Human
guagaaaugguuguauuagaug

SEQ ID NO: 2282122 - RNA, 14 nt, Human
guagaaaugaugau

SEQ ID NO: 2282123 - RNA, 17 nt, Human
guagaaauaauaugcau

SEQ ID NO: 2282124 - RNA, 17 nt, Human
guagaaaugguuguauu

SEQ ID NO: 2282125 - RNA, 18 nt, Human
guagaaaugguuguauua

SEQ ID NO: 2282126 - RNA, 19 nt, Human
guagaacguaaccacggaa

SEQ ID NO: 2282127 - RNA, 18 nt, Human
guagaacguaaccacgga

SEQ ID NO: 2282128 - RNA, 23 nt, Human
guagaaauaucugaaaauguaug

SEQ ID NO: 2282129 - RNA, 21 nt, Human
guagaaauaucugaaaaugua

SEQ ID NO: 2282130 - RNA, 16 nt, Human
guagaaauaauaugca

SEQ ID NO: 2282131 - RNA, 21 nt, Human
guagaaaggccuuuaaaauuu

SEQ ID NO: 2282132 - RNA, 16 nt, Human
guacuuauuacugcua

SEQ ID NO: 2282133 - RNA, 18 nt, Human
guacuuauuacugcuaag

SEQ ID NO: 2282134 - RNA, 15 nt, Human
guacuucacugucag

SEQ ID NO: 2282135 - RNA, 18 nt, Human
guacuucaggggcacuuc

SEQ ID NO: 2282136 - RNA, 20 nt, Human
guagaaauaucugaaaaugu

SEQ ID NO: 2282137 - RNA, 15 nt, Human
guagaauugcauuga

SEQ ID NO: 2282138 - RNA, 14 nt, Human
guagaauugcauug

SEQ ID NO: 2282139 - RNA, 20 nt, Human
guagaauguauuguaccuuu

SEQ ID NO: 2282140 - RNA, 23 nt, Human
guagaauguauuguaccuuuuaa

SEQ ID NO: 2282141 - RNA, 17 nt, Human
guagaauguauuguacc

SEQ ID NO: 2282142 - RNA, 18 nt, Human
guagaauguauuguaccu

SEQ ID NO: 2282143 - RNA, 19 nt, Human
guagaauguauuguaccuu

SEQ ID NO: 2282144 - RNA, 19 nt, Human
guagaaggguuauauuuua

SEQ ID NO: 2282145 - RNA, 15 nt, Human
guagaaggucggagg

SEQ ID NO: 2282146 - RNA, 14 nt, Human
guagaaguuuuugu

SEQ ID NO: 2282147 - RNA, 15 nt, Human
guagaaguuuuugua

SEQ ID NO: 2282148 - RNA, 19 nt, Human
guagaaguuuuuguacugu

SEQ ID NO: 2282149 - RNA, 14 nt, Human
guagaauguauugu

SEQ ID NO: 2282150 - RNA, 12 nt, Human
guagaagauggc

SEQ ID NO: 2282151 - RNA, 13 nt, Human
guagaagagggau

SEQ ID NO: 2282152 - RNA, 20 nt, Human
guagaagauuugaugcugga

SEQ ID NO: 2282153 - RNA, 15 nt, Human
guagaagcauuccuu

SEQ ID NO: 2282154 - RNA, 18 nt, Human
guagaagcccuucuaccu

SEQ ID NO: 2282155 - RNA, 13 nt, Human
guagaaggagaca

SEQ ID NO: 2282156 - RNA, 22 nt, Human
guagaagcauuccuucuuugau

SEQ ID NO: 2282157 - RNA, 18 nt, Human
guagaagcauuccuucuu

SEQ ID NO: 2282158 - RNA, 21 nt, Human
guagaagcauuccuucuuuga

SEQ ID NO: 2282159 - RNA, 17 nt, Human
guagaaggguuauauuu

SEQ ID NO: 2282160 - RNA, 15 nt, Human
guagaaggagacaga

SEQ ID NO: 2282161 - RNA, 21 nt, Human
guagaagucuuagauguauau

SEQ ID NO: 2282162 - RNA, 19 nt, Human
guacuggcugauggaguaa

SEQ ID NO: 2282163 - RNA, 16 nt, Human
guacuggcaugguacg

SEQ ID NO: 2282164 - RNA, 14 nt, Human
guacuggcauggua

SEQ ID NO: 2282165 - RNA, 16 nt, Human
guacuggagaaaaugg

SEQ ID NO: 2282166 - RNA, 14 nt, Human
guacuguaguuuuu

SEQ ID NO: 2282167 - RNA, 16 nt, Human
guacuguaaagagacc

SEQ ID NO: 2282168 - RNA, 12 nt, Human
guacuggggguu

SEQ ID NO: 2282169 - RNA, 21 nt, Human
guacuggggguugcgggggga

SEQ ID NO: 2282170 - RNA, 16 nt, Human
guacugauuuuuguaa

SEQ ID NO: 2282171 - RNA, 22 nt, Human
guacucuuccgaaaaauccucu

SEQ ID NO: 2282172 - RNA, 23 nt, Human
guacucuuccgaaaaauccucuu

SEQ ID NO: 2282173 - RNA, 16 nt, Human
guacugagccuuguaa

SEQ ID NO: 2282174 - RNA, 12 nt, Human
guacugagauuu

SEQ ID NO: 2282175 - RNA, 19 nt, Human
guacuuagcagcuaucucu

SEQ ID NO: 2282176 - RNA, 16 nt, Human
guacuuagcagcuauc

SEQ ID NO: 2282177 - RNA, 13 nt, Human
guacuuauuacug

SEQ ID NO: 2282178 - RNA, 15 nt, Human
guacuuauuacugcu

SEQ ID NO: 2282179 - RNA, 21 nt, Human
guacuucacugucaggaagaa

SEQ ID NO: 2282180 - RNA, 15 nt, Human
guacuucaugcuguc

SEQ ID NO: 2282181 - RNA, 21 nt, Human
guacuucaaauccuugaagau

SEQ ID NO: 2282182 - RNA, 22 nt, Human
guacuucaaauccuugaagauu

SEQ ID NO: 2282183 - RNA, 17 nt, Human
guacuuaaaugaaagca

SEQ ID NO: 2282184 - RNA, 23 nt, Human
guacuguucucuucuugaacacu

SEQ ID NO: 2282185 - RNA, 17 nt, Human
guacuguucugugucuu

SEQ ID NO: 2282186 - RNA, 18 nt, Human
guacuguucugugucuuu

SEQ ID NO: 2282187 - RNA, 15 nt, Human
guacuuaauaaauuc

SEQ ID NO: 2282188 - RNA, 19 nt, Human
guacuuaaaugaaagcaug

SEQ ID NO: 2282189 - RNA, 14 nt, Human
guacuuaacuauuc

SEQ ID NO: 2282190 - RNA, 23 nt, Human
guacuguguacagaauucugcua

SEQ ID NO: 2282191 - RNA, 14 nt, Human
guacuguucugugu

SEQ ID NO: 2282192 - RNA, 15 nt, Human
guacuguucuguguc

SEQ ID NO: 2282193 - RNA, 22 nt, Human
guacuagggggaagugacaagg

SEQ ID NO: 2282194 - RNA, 22 nt, Human
guacuagagaucugguuuugcu

SEQ ID NO: 2282195 - RNA, 21 nt, Human
guacuacuagaugucuuuagg

SEQ ID NO: 2282196 - RNA, 20 nt, Human
guacuacuagaugucuuuag

SEQ ID NO: 2282197 - RNA, 15 nt, Human
guacuacuagauguc

SEQ ID NO: 2282198 - RNA, 17 nt, Human
guacuacaguccuccca

SEQ ID NO: 2282199 - RNA, 13 nt, Human
guacuauguauca

SEQ ID NO: 2282200 - RNA, 17 nt, Human
guacuaguuacacaucu

SEQ ID NO: 2282201 - RNA, 16 nt, Human
guacuaguuacacauc

SEQ ID NO: 2282202 - RNA, 13 nt, Human
guacccacugcuc

SEQ ID NO: 2282203 - RNA, 14 nt, Human
guacccacugcucu

SEQ ID NO: 2282204 - RNA, 18 nt, Human
guacuacaguccucccau

SEQ ID NO: 2282205 - RNA, 19 nt, Human
guacuacaguccucccauc

SEQ ID NO: 2282206 - RNA, 20 nt, Human
guacucaucaucaacccuaa

SEQ ID NO: 2282207 - RNA, 15 nt, Human
guacuccugcaaaau

SEQ ID NO: 2282208 - RNA, 14 nt, Human
guacuccucccagg

SEQ ID NO: 2282209 - RNA, 13 nt, Human
guacucuuccgaa

SEQ ID NO: 2282210 - RNA, 15 nt, Human
guacucuccuagaga

SEQ ID NO: 2282211 - RNA, 14 nt, Human
guacucuuccgaaa

SEQ ID NO: 2282212 - RNA, 16 nt, Human
guacucugcacauacg

SEQ ID NO: 2282213 - RNA, 21 nt, Human
guacuccugcaaaauuuuaua

SEQ ID NO: 2282214 - RNA, 16 nt, Human
guacuccugcaaaauu

SEQ ID NO: 2282215 - RNA, 17 nt, Human
guacucgcuugugcaga

SEQ ID NO: 2282216 - RNA, 11 nt, Human
guacucuccua

SEQ ID NO: 2282217 - RNA, 14 nt, Human
guacucuccuagag

SEQ ID NO: 2282218 - RNA, 23 nt, Human
guacucuccuagagacagaagca

SEQ ID NO: 2282219 - RNA, 14 nt, Human
guacucauuaaaaa

SEQ ID NO: 2282220 - RNA, 23 nt, Human
guacucaggaggcugaggggagg

SEQ ID NO: 2282221 - RNA, 17 nt, Human
guacucaggaggcugag

SEQ ID NO: 2282222 - RNA, 15 nt, Human
guacucaaauguagc

SEQ ID NO: 2282223 - RNA, 21 nt, Human
guacuauuuagauauaacacu

SEQ ID NO: 2282224 - RNA, 13 nt, Human
guacuauucugau

SEQ ID NO: 2282225 - RNA, 17 nt, Human
guacuauguaucaauga

SEQ ID NO: 2282226 - RNA, 15 nt, Human
guacuauguaucaau

SEQ ID NO: 2282227 - RNA, 18 nt, Human
aaauaacuucaagcaaac

SEQ ID NO: 2282228 - RNA, 15 nt, Human
aaauaacuucaagca

SEQ ID NO: 2282229 - RNA, 17 nt, Human
aaauaacuaguguugcu

SEQ ID NO: 2282230 - RNA, 19 nt, Human
aaauaaccaauccuggaca

SEQ ID NO: 2282231 - RNA, 19 nt, Human
aaauaacaauguuaaggaa

SEQ ID NO: 2282232 - RNA, 21 nt, Human
aaauaacacacauauaaacau

SEQ ID NO: 2282233 - RNA, 13 nt, Human
aaauaacacacau

SEQ ID NO: 2282234 - RNA, 18 nt, Human
aaauaacaauguuaagga

SEQ ID NO: 2282235 - RNA, 14 nt, Human
aaauaaaaauauug

SEQ ID NO: 2282236 - RNA, 14 nt, Human
aaauaaaaauaaau

SEQ ID NO: 2282237 - RNA, 16 nt, Human
aaauaaaaauaaauuc

SEQ ID NO: 2282238 - RNA, 19 nt, Human
aaauaaaaaguuaaaaagu

SEQ ID NO: 2282239 - RNA, 15 nt, Human
aaauaaaaaguuaaa

SEQ ID NO: 2282240 - RNA, 13 nt, Human
aaauaaaaagaaa

SEQ ID NO: 2282241 - RNA, 14 nt, Human
aaauaaaaacuaaa

SEQ ID NO: 2282242 - RNA, 14 nt, Human
aaauaaaaagugac

SEQ ID NO: 2282243 - RNA, 15 nt, Human
aaauaaaaagugaca

SEQ ID NO: 2282244 - RNA, 19 nt, Human
aaauaaaaagugacacagc

SEQ ID NO: 2282245 - RNA, 14 nt, Human
aaauaaaaaguuaa

SEQ ID NO: 2282246 - RNA, 13 nt, Human
aaauaaaaaguua

SEQ ID NO: 2282247 - RNA, 12 nt, Human
aaauaaaaaguu

SEQ ID NO: 2282248 - RNA, 20 nt, Human
aaauaaaaagugacacagca

SEQ ID NO: 2282249 - RNA, 21 nt, Human
aaauaaaaagugacacagcag

SEQ ID NO: 2282250 - RNA, 20 nt, Human
aaaguuuaaaacagaagccu

SEQ ID NO: 2282251 - RNA, 18 nt, Human
aaaguugugauuccagau

SEQ ID NO: 2282252 - RNA, 13 nt, Human
aaauaaaaacaaa

SEQ ID NO: 2282253 - RNA, 10 nt, Human
aaauaaaaag

SEQ ID NO: 2282254 - RNA, 23 nt, Human
aaauaaaaacuaaauuguaaacu

SEQ ID NO: 2282255 - RNA, 16 nt, Human
aaaguuggugacagau

SEQ ID NO: 2282256 - RNA, 17 nt, Human
aaaguugguaaaccuuu

SEQ ID NO: 2282257 - RNA, 16 nt, Human
aaaguugguaaaccuu

SEQ ID NO: 2282258 - RNA, 12 nt, Human
aaauaagagaga

SEQ ID NO: 2282259 - RNA, 23 nt, Human
aaauaagacggauuuauuuuucc

SEQ ID NO: 2282260 - RNA, 17 nt, Human
aaauaagaauagaaaua

SEQ ID NO: 2282261 - RNA, 14 nt, Human
aaauaagaauagaa

SEQ ID NO: 2282262 - RNA, 16 nt, Human
aaauaacuucaagcaa

SEQ ID NO: 2282263 - RNA, 12 nt, Human
aaauaagaaaag

SEQ ID NO: 2282264 - RNA, 22 nt, Human
aaauaagaaaagauguagauuu

SEQ ID NO: 2282265 - RNA, 13 nt, Human
aaauaagaaaaga

SEQ ID NO: 2282266 - RNA, 24 nt, Human
aaauaagaaacaacucuuugagaa

SEQ ID NO: 2282267 - RNA, 15 nt, Human
aaauaagaaaaauca

SEQ ID NO: 2282268 - RNA, 14 nt, Human
aaauaagaaaccua

SEQ ID NO: 2282269 - RNA, 15 nt, Human
aaauaaucggcccac

SEQ ID NO: 2282270 - RNA, 14 nt, Human
aaauaaucauucuu

SEQ ID NO: 2282271 - RNA, 13 nt, Human
aaauaaucuauuu

SEQ ID NO: 2282272 - RNA, 22 nt, Human
aaauaaucuauuucuaugagaa

SEQ ID NO: 2282273 - RNA, 23 nt, Human
aaauaaucuauuucuaugagaaa

SEQ ID NO: 2282274 - RNA, 12 nt, Human
aaauaauaaauc

SEQ ID NO: 2282275 - RNA, 14 nt, Human
aaauaauaugcauu

SEQ ID NO: 2282276 - RNA, 12 nt, Human
aaauaauaugca

SEQ ID NO: 2282277 - RNA, 13 nt, Human
aaauaauaugcau

SEQ ID NO: 2282278 - RNA, 19 nt, Human
aaauaauaaagaugcucuu

SEQ ID NO: 2282279 - RNA, 17 nt, Human
aaauaauaaagaugcuc

SEQ ID NO: 2282280 - RNA, 15 nt, Human
aaauaauaauaaugu

SEQ ID NO: 2282281 - RNA, 12 nt, Human
aaauaauuuuau

SEQ ID NO: 2282282 - RNA, 20 nt, Human
guaaacagauggcacuuuga

SEQ ID NO: 2282283 - RNA, 17 nt, Human
aaauaauugauuucaag

SEQ ID NO: 2282284 - RNA, 12 nt, Human
aaauaauuuuaa

SEQ ID NO: 2282285 - RNA, 20 nt, Human
aaauaauuuuaaacaaaggu

SEQ ID NO: 2282286 - RNA, 18 nt, Human
aaauaauuuuaaacaaag

SEQ ID NO: 2282287 - RNA, 14 nt, Human
aaauaauuuuaaac

SEQ ID NO: 2282288 - RNA, 20 nt, Human
guaaacagugccugcugaau

SEQ ID NO: 2282289 - RNA, 18 nt, Human
guaaacagugccugcuga

SEQ ID NO: 2282290 - RNA, 17 nt, Human
guaaacagugccugcug

SEQ ID NO: 2282291 - RNA, 15 nt, Human
guaaacagugccugc

SEQ ID NO: 2282292 - RNA, 14 nt, Human
guaaacagugccug

SEQ ID NO: 2282293 - RNA, 13 nt, Human
guaaacagugccu

SEQ ID NO: 2282294 - RNA, 23 nt, Human
guaaacauaauucuuguauauua

SEQ ID NO: 2282295 - RNA, 22 nt, Human
guaaacagugccugcugaauga

SEQ ID NO: 2282296 - RNA, 14 nt, Human
guaaacauguguuu

SEQ ID NO: 2282297 - RNA, 20 nt, Human
guaaacauguguuuuaauuc

SEQ ID NO: 2282298 - RNA, 22 nt, Human
guaaacauguguuuuaauucca

SEQ ID NO: 2282299 - RNA, 13 nt, Human
guaaaccaaagcc

SEQ ID NO: 2282300 - RNA, 24 nt, Human
guaaacugugcaccaagcaggaaa

SEQ ID NO: 2282301 - RNA, 22 nt, Human
guaaaccccuuuaguggcuuca

SEQ ID NO: 2282302 - RNA, 21 nt, Human
aaaguuauuaauauuuuaauu

SEQ ID NO: 2282303 - RNA, 23 nt, Human
aaaguuagucuacucuuaagcca

SEQ ID NO: 2282304 - RNA, 16 nt, Human
aaaguuauauagguuu

SEQ ID NO: 2282305 - RNA, 20 nt, Human
aaaguuacuuugucagaggc

SEQ ID NO: 2282306 - RNA, 14 nt, Human
aaaguuagcugagc

SEQ ID NO: 2282307 - RNA, 14 nt, Human
aaaguuagucuacu

SEQ ID NO: 2282308 - RNA, 12 nt, Human
aaaguuacuagg

SEQ ID NO: 2282309 - RNA, 19 nt, Human
aaaguuacuaccugucaag

SEQ ID NO: 2282310 - RNA, 21 nt, Human
aaaguuacuagguaacuucau

SEQ ID NO: 2282311 - RNA, 22 nt, Human
aaaguuacugauucacugcaug

SEQ ID NO: 2282312 - RNA, 20 nt, Human
aaaguuacuagguaacuuca

SEQ ID NO: 2282313 - RNA, 15 nt, Human
aaaguuacuagguaa

SEQ ID NO: 2282314 - RNA, 12 nt, Human
aaaguugaaauu

SEQ ID NO: 2282315 - RNA, 21 nt, Human
aaaguucuguacucaaaugua

SEQ ID NO: 2282316 - RNA, 23 nt, Human
aaaguucugcagauaaacaguag

SEQ ID NO: 2282317 - RNA, 14 nt, Human
aaaguucuguacuc

SEQ ID NO: 2282318 - RNA, 16 nt, Human
aaaguucuagugaccg

SEQ ID NO: 2282319 - RNA, 17 nt, Human
aaaguucuguaaaauau

SEQ ID NO: 2282320 - RNA, 17 nt, Human
aaaguauuauuuuccaa

SEQ ID NO: 2282321 - RNA, 16 nt, Human
aaaguauuauuuucca

SEQ ID NO: 2282322 - RNA, 15 nt, Human
aaaguauuauuuucc

SEQ ID NO: 2282323 - RNA, 16 nt, Human
aaaguaucaugcauuc

SEQ ID NO: 2282324 - RNA, 21 nt, Human
aaaguauuuaauuagugcuaa

SEQ ID NO: 2282325 - RNA, 23 nt, Human
aaaguauuuaauuagugcuaagu

SEQ ID NO: 2282326 - RNA, 17 nt, Human
aaaguauuuaauuagug

SEQ ID NO: 2282327 - RNA, 18 nt, Human
aaaguauuuaauuagugc

SEQ ID NO: 2282328 - RNA, 19 nt, Human
aaaguauuuaauuagugcu

SEQ ID NO: 2282329 - RNA, 20 nt, Human
aaaguauuuaauuagugcua

SEQ ID NO: 2282330 - RNA, 19 nt, Human
aaaguauucuguacucuua

SEQ ID NO: 2282331 - RNA, 12 nt, Human
aaaguauucuuc

SEQ ID NO: 2282332 - RNA, 22 nt, Human
aaaguauucuucucuuccuuuu

SEQ ID NO: 2282333 - RNA, 16 nt, Human
aaaguacauguuaaac

SEQ ID NO: 2282334 - RNA, 14 nt, Human
aaaggugaaggaau

SEQ ID NO: 2282335 - RNA, 19 nt, Human
aaaguacuucuccacccug

SEQ ID NO: 2282336 - RNA, 12 nt, Human
aaaguacauuua

SEQ ID NO: 2282337 - RNA, 13 nt, Human
aaaguacauuuaa

SEQ ID NO: 2282338 - RNA, 14 nt, Human
aaaguacauuuaau

SEQ ID NO: 2282339 - RNA, 15 nt, Human
aaaguacauuuaaua

SEQ ID NO: 2282340 - RNA, 16 nt, Human
aaagguauaauuuuau

SEQ ID NO: 2282341 - RNA, 14 nt, Human
aaaggguguacuua

SEQ ID NO: 2282342 - RNA, 16 nt, Human
aaaggguguuuuucug

SEQ ID NO: 2282343 - RNA, 16 nt, Human
aaaggguuuuaaugua

SEQ ID NO: 2282344 - RNA, 20 nt, Human
aaagguauuuuaaucaccaa

SEQ ID NO: 2282345 - RNA, 14 nt, Human
aaagguauaauuuu

SEQ ID NO: 2282346 - RNA, 20 nt, Human
aaaguacacuguuucaaacu

SEQ ID NO: 2282347 - RNA, 14 nt, Human
aaaguauauguuag

SEQ ID NO: 2282348 - RNA, 12 nt, Human
aaaguaucaugc

SEQ ID NO: 2282349 - RNA, 14 nt, Human
aaaguaucaugcau

SEQ ID NO: 2282350 - RNA, 15 nt, Human
aaaguaucaugcauu

SEQ ID NO: 2282351 - RNA, 23 nt, Human
aaaguauauauuuauuuaagcuu

SEQ ID NO: 2282352 - RNA, 15 nt, Human
aaaguauauauuuau

SEQ ID NO: 2282353 - RNA, 14 nt, Human
aaaguauauauuua

SEQ ID NO: 2282354 - RNA, 22 nt, Human
aaaguauauauauauauuauau

SEQ ID NO: 2282355 - RNA, 18 nt, Human
aaaguauauauagaaucu

SEQ ID NO: 2282356 - RNA, 17 nt, Human
aaaguauauauagaauc

SEQ ID NO: 2282357 - RNA, 13 nt, Human
aaaguauauauag

SEQ ID NO: 2282358 - RNA, 14 nt, Human
aaaguaguaaaaau

SEQ ID NO: 2282359 - RNA, 18 nt, Human
aaaguaucccuacuguaa

SEQ ID NO: 2282360 - RNA, 18 nt, Human
aaaguauguuagugcaaa

SEQ ID NO: 2282361 - RNA, 23 nt, Human
aaaguacuucuccacccugcucu

SEQ ID NO: 2282362 - RNA, 21 nt, Human
aaaguaguaaaaauuaaaaaa

SEQ ID NO: 2282363 - RNA, 16 nt, Human
aaaguaguccugugaa

SEQ ID NO: 2282364 - RNA, 20 nt, Human
aaaguacuucuccacccugc

SEQ ID NO: 2282365 - RNA, 21 nt, Human
aaaguacuucuccacccugcu

SEQ ID NO: 2282366 - RNA, 15 nt, Human
aaauauacacacagc

SEQ ID NO: 2282367 - RNA, 23 nt, Human
aaauacugccagaugcugauguu

SEQ ID NO: 2282368 - RNA, 15 nt, Human
aaauacuguacaaug

SEQ ID NO: 2282369 - RNA, 14 nt, Human
aaauacuguacaau

SEQ ID NO: 2282370 - RNA, 18 nt, Human
aaauacugccagaugcug

SEQ ID NO: 2282371 - RNA, 20 nt, Human
aaauacugccagaugcugau

SEQ ID NO: 2282372 - RNA, 17 nt, Human
aaauacucauguguaug

SEQ ID NO: 2282373 - RNA, 21 nt, Human
aaauacucauguguaugggca

SEQ ID NO: 2282374 - RNA, 17 nt, Human
aaauacugcaagaaaau

SEQ ID NO: 2282375 - RNA, 13 nt, Human
aaauacugccaga

SEQ ID NO: 2282376 - RNA, 17 nt, Human
aaauacugccagaugcu

SEQ ID NO: 2282377 - RNA, 16 nt, Human
aaauacuauuuuuacu

SEQ ID NO: 2282378 - RNA, 21 nt, Human
aaauacuauuuuuacugccac

SEQ ID NO: 2282379 - RNA, 22 nt, Human
aaauacuauuuuuacugccacu

SEQ ID NO: 2282380 - RNA, 14 nt, Human
aaauacucaugugu

SEQ ID NO: 2282381 - RNA, 15 nt, Human
aaauacucaugugua

SEQ ID NO: 2282382 - RNA, 16 nt, Human
aaauacucauguguau

SEQ ID NO: 2282383 - RNA, 21 nt, Human
aaauaccaaaauuauuucaga

SEQ ID NO: 2282384 - RNA, 23 nt, Human
aaauaccaaaauuauuucagaaa

SEQ ID NO: 2282385 - RNA, 14 nt, Human
aaauacuacuccug

SEQ ID NO: 2282386 - RNA, 15 nt, Human
aaauacuacuccugu

SEQ ID NO: 2282387 - RNA, 20 nt, Human
aaauacuauuuaaagccucc

SEQ ID NO: 2282388 - RNA, 18 nt, Human
aaauaccagccaguaaau

SEQ ID NO: 2282389 - RNA, 18 nt, Human
aaauacacauagcaugua

SEQ ID NO: 2282390 - RNA, 19 nt, Human
aaauacaacuuaaauaaua

SEQ ID NO: 2282391 - RNA, 19 nt, Human
aaauacacacucaaaucaa

SEQ ID NO: 2282392 - RNA, 17 nt, Human
aaauacagauagauaua

SEQ ID NO: 2282393 - RNA, 17 nt, Human
aaauacacaaguaaaca

SEQ ID NO: 2282394 - RNA, 21 nt, Human
aaauacaccaccucacuccug

SEQ ID NO: 2282395 - RNA, 22 nt, Human
aaauacaccaccucacuccugu

SEQ ID NO: 2282396 - RNA, 23 nt, Human
aaauacaccaccucacuccuguu

SEQ ID NO: 2282397 - RNA, 14 nt, Human
aaauacagacacua

SEQ ID NO: 2282398 - RNA, 16 nt, Human
aaauacagacacuaag

SEQ ID NO: 2282399 - RNA, 17 nt, Human
aaauacagacacuaagu

SEQ ID NO: 2282400 - RNA, 14 nt, Human
aaauacaugcaucu

SEQ ID NO: 2282401 - RNA, 13 nt, Human
aaauacaugacau

SEQ ID NO: 2282402 - RNA, 16 nt, Human
aaauacauauuuccaa

SEQ ID NO: 2282403 - RNA, 23 nt, Human
aaauacagucuuccauuugcaag

SEQ ID NO: 2282404 - RNA, 22 nt, Human
aaauacagucuuccauuugcaa

SEQ ID NO: 2282405 - RNA, 22 nt, Human
aaauacaguuugucacaugaaa

SEQ ID NO: 2282406 - RNA, 20 nt, Human
aaauacaguuugucacauga

SEQ ID NO: 2282407 - RNA, 15 nt, Human
aaauacagauuuuga

SEQ ID NO: 2282408 - RNA, 22 nt, Human
aaauacagacacuaaguuauag

SEQ ID NO: 2282409 - RNA, 17 nt, Human
aaauacagauuuugaua

SEQ ID NO: 2282410 - RNA, 23 nt, Human
aaauacagauuuugauagcaaag

SEQ ID NO: 2282411 - RNA, 17 nt, Human
aaauacagcuggauugg

SEQ ID NO: 2282412 - RNA, 15 nt, Human
aaauacaaaacuucc

SEQ ID NO: 2282413 - RNA, 22 nt, Human
aaauaauuuuuauauuugaaau

SEQ ID NO: 2282414 - RNA, 23 nt, Human
aaauaauuuuuauauuugaaaua

SEQ ID NO: 2282415 - RNA, 15 nt, Human
aaauacacacucaaa

SEQ ID NO: 2282416 - RNA, 15 nt, Human
guaauuuuauaugaa

SEQ ID NO: 2282417 - RNA, 18 nt, Human
guaauuuuauaugaagau

SEQ ID NO: 2282418 - RNA, 14 nt, Human
guaauuuugccaaa

SEQ ID NO: 2282419 - RNA, 20 nt, Human
guacacagcucuagacacug

SEQ ID NO: 2282420 - RNA, 21 nt, Human
guaauuuuuuuaauuuacaaa

SEQ ID NO: 2282421 - RNA, 21 nt, Human
guaauuuuguucuaguuuuca

SEQ ID NO: 2282422 - RNA, 14 nt, Human
guacacguguccug

SEQ ID NO: 2282423 - RNA, 15 nt, Human
guacacguguccugu

SEQ ID NO: 2282424 - RNA, 15 nt, Human
guacacugaauauuu

SEQ ID NO: 2282425 - RNA, 14 nt, Human
guacacugaauauu

SEQ ID NO: 2282426 - RNA, 17 nt, Human
guacacguguccuguag

SEQ ID NO: 2282427 - RNA, 23 nt, Human
guacacugccuucucaacuccaa

SEQ ID NO: 2282428 - RNA, 21 nt, Human
aaauaauuuuuauauuugaaa

SEQ ID NO: 2282429 - RNA, 15 nt, Human
guaauccaccugccu

SEQ ID NO: 2282430 - RNA, 12 nt, Human
guaaucccagca

SEQ ID NO: 2282431 - RNA, 17 nt, Human
guaauccaucacuagcc

SEQ ID NO: 2282432 - RNA, 14 nt, Human
guaaucccagcacu

SEQ ID NO: 2282433 - RNA, 16 nt, Human
guaaucccagcacuuu

SEQ ID NO: 2282434 - RNA, 15 nt, Human
guaaucccagcacuu

SEQ ID NO: 2282435 - RNA, 13 nt, Human
guaaucccagcag

SEQ ID NO: 2282436 - RNA, 18 nt, Human
guaaucccagcacuuugg

SEQ ID NO: 2282437 - RNA, 20 nt, Human
guaaucccagcacuuuggga

SEQ ID NO: 2282438 - RNA, 23 nt, Human
guaaucauuucuugggcccuccu

SEQ ID NO: 2282439 - RNA, 22 nt, Human
guaaucauuucuugggcccucc

SEQ ID NO: 2282440 - RNA, 15 nt, Human
guaauauauugcugc

SEQ ID NO: 2282441 - RNA, 16 nt, Human
guaauauauugcugcu

SEQ ID NO: 2282442 - RNA, 18 nt, Human
guaauauauugcugcugg

SEQ ID NO: 2282443 - RNA, 20 nt, Human
guaauauauugcugcuggua

SEQ ID NO: 2282444 - RNA, 21 nt, Human
guaauccaagcaaaugugaau

SEQ ID NO: 2282445 - RNA, 18 nt, Human
guaauaugcacacauuuu

SEQ ID NO: 2282446 - RNA, 17 nt, Human
guaauaugcacacauuu

SEQ ID NO: 2282447 - RNA, 16 nt, Human
guaauaugcacacauu

SEQ ID NO: 2282448 - RNA, 14 nt, Human
guaauaugcacaca

SEQ ID NO: 2282449 - RNA, 21 nt, Human
guaaucccagcuacucaggag

SEQ ID NO: 2282450 - RNA, 18 nt, Human
guaaucccagcuacucag

SEQ ID NO: 2282451 - RNA, 17 nt, Human
guaaucccagcuacuca

SEQ ID NO: 2282452 - RNA, 12 nt, Human
guaaucccagcu

SEQ ID NO: 2282453 - RNA, 21 nt, Human
guaauuguugcuaaucuucuu

SEQ ID NO: 2282454 - RNA, 23 nt, Human
guaauuguuguuuguauguauaa

SEQ ID NO: 2282455 - RNA, 21 nt, Human
guaauuguuguuuguauguau

SEQ ID NO: 2282456 - RNA, 19 nt, Human
guaauuguuguuuguaugu

SEQ ID NO: 2282457 - RNA, 17 nt, Human
guaauuguuguuuguau

SEQ ID NO: 2282458 - RNA, 20 nt, Human
guaauuuaaaauugugaugu

SEQ ID NO: 2282459 - RNA, 19 nt, Human
guaauuuaaaauugugaug

SEQ ID NO: 2282460 - RNA, 11 nt, Human
guaauuuauuu

SEQ ID NO: 2282461 - RNA, 13 nt, Human
guaauuucuuugc

SEQ ID NO: 2282462 - RNA, 14 nt, Human
guaauuucuuugcc

SEQ ID NO: 2282463 - RNA, 23 nt, Human
guaauuugagagaaauaugaaga

SEQ ID NO: 2282464 - RNA, 22 nt, Human
guaauuucuuugccuguucagu

SEQ ID NO: 2282465 - RNA, 22 nt, Human
guaauuugugauacaaugcugu

SEQ ID NO: 2282466 - RNA, 16 nt, Human
guaauuugaggacaac

SEQ ID NO: 2282467 - RNA, 23 nt, Human
guaauuuaaaauugugauguguc

SEQ ID NO: 2282468 - RNA, 14 nt, Human
guaauuuaaacagg

SEQ ID NO: 2282469 - RNA, 16 nt, Human
guaauuuaaacaggcc

SEQ ID NO: 2282470 - RNA, 19 nt, Human
guaauuuaaacaggcccag

SEQ ID NO: 2282471 - RNA, 17 nt, Human
guaauuuaguuauugau

SEQ ID NO: 2282472 - RNA, 20 nt, Human
guaauuuaaacaggcccagc

SEQ ID NO: 2282473 - RNA, 21 nt, Human
guaauuuaaacaggcccagca

SEQ ID NO: 2282474 - RNA, 11 nt, Human
guaauaaauau

SEQ ID NO: 2282475 - RNA, 12 nt, Human
guaauaaauaug

SEQ ID NO: 2282476 - RNA, 15 nt, Human
guaauaaacuuuaau

SEQ ID NO: 2282477 - RNA, 14 nt, Human
guaacuggcugugu

SEQ ID NO: 2282478 - RNA, 15 nt, Human
guaauaacugugaag

SEQ ID NO: 2282479 - RNA, 16 nt, Human
guaauaacugugaagu

SEQ ID NO: 2282480 - RNA, 22 nt, Human
guaauaacugugaaguuuacau

SEQ ID NO: 2282481 - RNA, 13 nt, Human
guaauaaauauga

SEQ ID NO: 2282482 - RNA, 14 nt, Human
guaauaaauaugag

SEQ ID NO: 2282483 - RNA, 16 nt, Human
guaauaaauaugagug

SEQ ID NO: 2282484 - RNA, 12 nt, Human
guaauauauugc

SEQ ID NO: 2282485 - RNA, 13 nt, Human
guaauauauugcu

SEQ ID NO: 2282486 - RNA, 23 nt, Human
guaauaagacauaacguuuuucc

SEQ ID NO: 2282487 - RNA, 13 nt, Human
guaauaagacaua

SEQ ID NO: 2282488 - RNA, 14 nt, Human
guaauaagacauaa

SEQ ID NO: 2282489 - RNA, 19 nt, Human
guaauaagacauaacguuu

SEQ ID NO: 2282490 - RNA, 17 nt, Human
guaauagauuauaguug

SEQ ID NO: 2282491 - RNA, 20 nt, Human
guaauaggcguaacuaauuu

SEQ ID NO: 2282492 - RNA, 13 nt, Human
guaacugacaacu

SEQ ID NO: 2282493 - RNA, 17 nt, Human
guaacuccaccaaccca

SEQ ID NO: 2282494 - RNA, 12 nt, Human
guaacuccacca

SEQ ID NO: 2282495 - RNA, 23 nt, Human
guaacucuaauucccauuuugca

SEQ ID NO: 2282496 - RNA, 21 nt, Human
guaaagaaauuuaaaagacac

SEQ ID NO: 2282497 - RNA, 23 nt, Human
guaaagaaagagagaaaauaaaa

SEQ ID NO: 2282498 - RNA, 22 nt, Human
guaaagaaauuuaaaagacacu

SEQ ID NO: 2282499 - RNA, 13 nt, Human
guaacucaucugu

SEQ ID NO: 2282500 - RNA, 15 nt, Human
guaacucaucuguca

SEQ ID NO: 2282501 - RNA, 19 nt, Human
guaacugcauugagaacug

SEQ ID NO: 2282502 - RNA, 18 nt, Human
guaacugcauugagaacu

SEQ ID NO: 2282503 - RNA, 22 nt, Human
guaacugcauugagaacugcau

SEQ ID NO: 2282504 - RNA, 19 nt, Human
guaacucuaauucccauuu

SEQ ID NO: 2282505 - RNA, 14 nt, Human
guaacugcugaaaa

SEQ ID NO: 2282506 - RNA, 15 nt, Human
guaacugcugaaaac

SEQ ID NO: 2282507 - RNA, 14 nt, Human
guaaagaaagagag

SEQ ID NO: 2282508 - RNA, 16 nt, Human
guaaacuuuuugugcu

SEQ ID NO: 2282509 - RNA, 20 nt, Human
guaaacuguguauuccaaga

SEQ ID NO: 2282510 - RNA, 16 nt, Human
guaaacuguggaugau

SEQ ID NO: 2282511 - RNA, 22 nt, Human
guaaagaaagagagaaaauaaa

SEQ ID NO: 2282512 - RNA, 21 nt, Human
guaaagaaagagagaaaauaa

SEQ ID NO: 2282513 - RNA, 20 nt, Human
guaaagaaagagagaaaaua

SEQ ID NO: 2282514 - RNA, 19 nt, Human
guaaagaaagagagaaaau

SEQ ID NO: 2282515 - RNA, 18 nt, Human
guaaagaaagagagaaaa

SEQ ID NO: 2282516 - RNA, 17 nt, Human
guaaagaaagagagaaa

SEQ ID NO: 2282517 - RNA, 16 nt, Human
guaaagaaagagagaa

SEQ ID NO: 2282518 - RNA, 15 nt, Human
guaaagaaagagaga

SEQ ID NO: 2282519 - RNA, 17 nt, Human
aaacaauauuguuucua

SEQ ID NO: 2282520 - RNA, 16 nt, Human
aaacaauauuguuucu

SEQ ID NO: 2282521 - RNA, 19 nt, Human
aaacacaaacgggcucagc

SEQ ID NO: 2282522 - RNA, 11 nt, Human
aaacacagcaa

SEQ ID NO: 2282523 - RNA, 15 nt, Human
aaacaauauuguuuc

SEQ ID NO: 2282524 - RNA, 14 nt, Human
aaacaauauuguuu

SEQ ID NO: 2282525 - RNA, 21 nt, Human
aaacaauacucauaaugugaa

SEQ ID NO: 2282526 - RNA, 22 nt, Human
aaacaauaguaauucucaggcc

SEQ ID NO: 2282527 - RNA, 21 nt, Human
aaacaaauucauauucugucu

SEQ ID NO: 2282528 - RNA, 16 nt, Human
aaacaacaauuucuac

SEQ ID NO: 2282529 - RNA, 16 nt, Human
aaacaauaaaugugca

SEQ ID NO: 2282530 - RNA, 22 nt, Human
aaacaacaauuucuacuuugaa

SEQ ID NO: 2282531 - RNA, 12 nt, Human
aaacaaauaugc

SEQ ID NO: 2282532 - RNA, 23 nt, Human
aaacaaagcuuagcaggagagga

SEQ ID NO: 2282533 - RNA, 17 nt, Human
aaacaaaguuacuaggu

SEQ ID NO: 2282534 - RNA, 13 nt, Human
aaacaaauaugca

SEQ ID NO: 2282535 - RNA, 14 nt, Human
aaacaaauaugcaa

SEQ ID NO: 2282536 - RNA, 17 nt, Human
aaacaaauaugcaaaag

SEQ ID NO: 2282537 - RNA, 19 nt, Human
aaacaaauucauauucugu

SEQ ID NO: 2282538 - RNA, 16 nt, Human
aaacacaucuucccua

SEQ ID NO: 2282539 - RNA, 14 nt, Human
aaacacaucuuccc

SEQ ID NO: 2282540 - RNA, 18 nt, Human
aaacacaucuuuccuguc

SEQ ID NO: 2282541 - RNA, 11 nt, Human
aaacacauuuu

SEQ ID NO: 2282542 - RNA, 16 nt, Human
aaacacaguguuuuug

SEQ ID NO: 2282543 - RNA, 19 nt, Human
aaacacaguguuuuuguaa

SEQ ID NO: 2282544 - RNA, 20 nt, Human
aaacacaguguuuuuguaaa

SEQ ID NO: 2282545 - RNA, 20 nt, Human
aaacacaaaaguuagcugag

SEQ ID NO: 2282546 - RNA, 18 nt, Human
aaacacaguuacacuugu

SEQ ID NO: 2282547 - RNA, 13 nt, Human
aaacacaguuaca

SEQ ID NO: 2282548 - RNA, 16 nt, Human
aaacacaguuacacuu

SEQ ID NO: 2282549 - RNA, 14 nt, Human
aaacacagcaaggg

SEQ ID NO: 2282550 - RNA, 12 nt, Human
aaacacagcaag

SEQ ID NO: 2282551 - RNA, 13 nt, Human
aaaauuuuauucc

SEQ ID NO: 2282552 - RNA, 20 nt, Human
aaaauuuugauguuuuaagg

SEQ ID NO: 2282553 - RNA, 13 nt, Human
aaacaaagccaga

SEQ ID NO: 2282554 - RNA, 14 nt, Human
aaaauuuuauagcu

SEQ ID NO: 2282555 - RNA, 15 nt, Human
aaacaaagcuuagca

SEQ ID NO: 2282556 - RNA, 17 nt, Human
aaacaaagcuuagcagg

SEQ ID NO: 2282557 - RNA, 22 nt, Human
aaacaaagcuuagcaggagagg

SEQ ID NO: 2282558 - RNA, 17 nt, Human
aaacaaagguugagaug

SEQ ID NO: 2282559 - RNA, 19 nt, Human
aaaauuuagaaauauaauu

SEQ ID NO: 2282560 - RNA, 18 nt, Human
aaaauuuaagugcgugug

SEQ ID NO: 2282561 - RNA, 23 nt, Human
aaaauuuaagugcguguguagag

SEQ ID NO: 2282562 - RNA, 15 nt, Human
aaaauuuaguuuuug

SEQ ID NO: 2282563 - RNA, 16 nt, Human
aaaauuuaguuuuugu

SEQ ID NO: 2282564 - RNA, 19 nt, Human
aaaauuuaguuuuuguucu

SEQ ID NO: 2282565 - RNA, 23 nt, Human
aaaauuuaguuuuuguucuuaau

SEQ ID NO: 2282566 - RNA, 16 nt, Human
aaaauuuguuuugacg

SEQ ID NO: 2282567 - RNA, 20 nt, Human
aaaauuucaacaaguagcua

SEQ ID NO: 2282568 - RNA, 21 nt, Human
aaaauuuuauaaaauuaagca

SEQ ID NO: 2282569 - RNA, 22 nt, Human
aaaauuuguuuugacggaugau

SEQ ID NO: 2282570 - RNA, 23 nt, Human
aaaauuuaagcauuguuugcuua

SEQ ID NO: 2282571 - RNA, 21 nt, Human
aaaauuuaagcauuguuugcu

SEQ ID NO: 2282572 - RNA, 19 nt, Human
aaaauuuaaguaucuuuuu

SEQ ID NO: 2282573 - RNA, 15 nt, Human
aaaauuuaagugcgu

SEQ ID NO: 2282574 - RNA, 16 nt, Human
aaaauuuaagcauugu

SEQ ID NO: 2282575 - RNA, 15 nt, Human
aaaauuuaagcauug

SEQ ID NO: 2282576 - RNA, 14 nt, Human
aaaauuuaagcauu

SEQ ID NO: 2282577 - RNA, 21 nt, Human
aaaauguuggucauuuuaugu

SEQ ID NO: 2282578 - RNA, 15 nt, Human
aaaauguuuuagcaa

SEQ ID NO: 2282579 - RNA, 18 nt, Human
aaaauguuuuagcaauuu

SEQ ID NO: 2282580 - RNA, 14 nt, Human
aaaauguugagaau

SEQ ID NO: 2282581 - RNA, 15 nt, Human
aaaauguuggauuua

SEQ ID NO: 2282582 - RNA, 19 nt, Human
aaaauguuggauuuauaaa

SEQ ID NO: 2282583 - RNA, 20 nt, Human
aaaauguuggauuuauaaau

SEQ ID NO: 2282584 - RNA, 22 nt, Human
aaaauguuggauuuauaaaugc

SEQ ID NO: 2282585 - RNA, 13 nt, Human
aaaauguugaaaa

SEQ ID NO: 2282586 - RNA, 19 nt, Human
aaaauguugaaaagucaaa

SEQ ID NO: 2282587 - RNA, 17 nt, Human
aaaauguugaaaaguca

SEQ ID NO: 2282588 - RNA, 17 nt, Human
gggaugccaucuguggg

SEQ ID NO: 2282589 - RNA, 21 nt, Human
gggaugagcauggagcuggcc

SEQ ID NO: 2282590 - RNA, 15 nt, Human
gggaugagccgcugu

SEQ ID NO: 2282591 - RNA, 20 nt, Human
gggaugagcucaagcaggaa

SEQ ID NO: 2282592 - RNA, 22 nt, Human
gggaugaugccacaccaagcug

SEQ ID NO: 2282593 - RNA, 16 nt, Human
aaaauguuauuuaaca

SEQ ID NO: 2282594 - RNA, 16 nt, Human
aaaauguucagaaggu

SEQ ID NO: 2282595 - RNA, 23 nt, Human
gggaugacuagaggcagggaggg

SEQ ID NO: 2282596 - RNA, 15 nt, Human
gggaugacugugauu

SEQ ID NO: 2282597 - RNA, 17 nt, Human
gggaugacuagaggcag

SEQ ID NO: 2282598 - RNA, 20 nt, Human
gggaugacaugcacucagcu

SEQ ID NO: 2282599 - RNA, 15 nt, Human
gggaugagaguuuug

SEQ ID NO: 2282600 - RNA, 16 nt, Human
gggaugagaagagggg

SEQ ID NO: 2282601 - RNA, 20 nt, Human
gggaugagcauggagcuggc

SEQ ID NO: 2282602 - RNA, 13 nt, Human
gggaugagaaagg

SEQ ID NO: 2282603 - RNA, 15 nt, Human
ggggaauucaucucu

SEQ ID NO: 2282604 - RNA, 16 nt, Human
ggggaaguccucuggg

SEQ ID NO: 2282605 - RNA, 19 nt, Human
ggggaauugaggacacuga

SEQ ID NO: 2282606 - RNA, 22 nt, Human
ggggacagaggccugcccgggc

SEQ ID NO: 2282607 - RNA, 15 nt, Human
ggggaccagagcugc

SEQ ID NO: 2282608 - RNA, 16 nt, Human
ggggaccagagcugcc

SEQ ID NO: 2282609 - RNA, 18 nt, Human
ggggaauguuugccucug

SEQ ID NO: 2282610 - RNA, 22 nt, Human
ggggaauguuugccucugccuc

SEQ ID NO: 2282611 - RNA, 14 nt, Human
ggggaagcccugga

SEQ ID NO: 2282612 - RNA, 14 nt, Human
ggggaagagcacag

SEQ ID NO: 2282613 - RNA, 18 nt, Human
ggggaagagcacagcccu

SEQ ID NO: 2282614 - RNA, 16 nt, Human
ggggaagaguguacug

SEQ ID NO: 2282615 - RNA, 13 nt, Human
ggggaagcccugg

SEQ ID NO: 2282616 - RNA, 13 nt, Human
ggggaagggccag

SEQ ID NO: 2282617 - RNA, 22 nt, Human
ggggaagggccagucugggcug

SEQ ID NO: 2282618 - RNA, 23 nt, Human
ggggaagggccagucugggcugc

SEQ ID NO: 2282619 - RNA, 13 nt, Human
ggggaaggcaggg

SEQ ID NO: 2282620 - RNA, 14 nt, Human
aaacauguguuuua

SEQ ID NO: 2282621 - RNA, 16 nt, Human
aaacauguuagaagca

SEQ ID NO: 2282622 - RNA, 18 nt, Human
aaacauguacaaaaucga

SEQ ID NO: 2282623 - RNA, 22 nt, Human
aaacaugucuccuauccugguu

SEQ ID NO: 2282624 - RNA, 17 nt, Human
aaacauguuagaagcaa

SEQ ID NO: 2282625 - RNA, 21 nt, Human
aaacaugguagaauuggagag

SEQ ID NO: 2282626 - RNA, 22 nt, Human
aaacaugggguuggcugggccc

SEQ ID NO: 2282627 - RNA, 15 nt, Human
aaacaugguuacaau

SEQ ID NO: 2282628 - RNA, 17 nt, Human
aaacaugguuacaauca

SEQ ID NO: 2282629 - RNA, 17 nt, Human
aaacauggccuuugcuu

SEQ ID NO: 2282630 - RNA, 17 nt, Human
aaacaggucaauacagu

SEQ ID NO: 2282631 - RNA, 14 nt, Human
aaacaguagugaua

SEQ ID NO: 2282632 - RNA, 16 nt, Human
aaacauggccuuugcu

SEQ ID NO: 2282633 - RNA, 15 nt, Human
aaacagucucaggaa

SEQ ID NO: 2282634 - RNA, 18 nt, Human
ggggacccccgcccccug

SEQ ID NO: 2282635 - RNA, 11 nt, Human
ggggacccugu

SEQ ID NO: 2282636 - RNA, 13 nt, Human
ggggacccccgcc

SEQ ID NO: 2282637 - RNA, 15 nt, Human
ggggacccccgcccc

SEQ ID NO: 2282638 - RNA, 21 nt, Human
ggggacccaauguaggagcug

SEQ ID NO: 2282639 - RNA, 13 nt, Human
ggggacucagccc

SEQ ID NO: 2282640 - RNA, 18 nt, Human
ggggacggggggccccag

SEQ ID NO: 2282641 - RNA, 23 nt, Human
ggggacggggggccccagucagc

SEQ ID NO: 2282642 - RNA, 23 nt, Human
ggggacgcugguagagauggagg

SEQ ID NO: 2282643 - RNA, 21 nt, Human
ggggacgcugguagagaugga

SEQ ID NO: 2282644 - RNA, 15 nt, Human
ggggacucagcccug

SEQ ID NO: 2282645 - RNA, 14 nt, Human
ggggacucagcccu

SEQ ID NO: 2282646 - RNA, 11 nt, Human
ggggagaaagu

SEQ ID NO: 2282647 - RNA, 14 nt, Human
ggggacugucuuuc

SEQ ID NO: 2282648 - RNA, 16 nt, Human
ggggacucagcccuga

SEQ ID NO: 2282649 - RNA, 21 nt, Human
ggggacuagccccuguggaga

SEQ ID NO: 2282650 - RNA, 22 nt, Human
ggggccgcugccacccaccucc

SEQ ID NO: 2282651 - RNA, 14 nt, Human
ggggccgcugccac

SEQ ID NO: 2282652 - RNA, 19 nt, Human
ggggacuuacaugauucau

SEQ ID NO: 2282653 - RNA, 14 nt, Human
gggggccaggugca

SEQ ID NO: 2282654 - RNA, 12 nt, Human
ggggccucaggu

SEQ ID NO: 2282655 - RNA, 23 nt, Human
ggggccuaggccucagccagaga

SEQ ID NO: 2282656 - RNA, 19 nt, Human
ggggccuaucagugugccc

SEQ ID NO: 2282657 - RNA, 23 nt, Human
ggggccuaucagugugcccccca

SEQ ID NO: 2282658 - RNA, 21 nt, Human
gggggccccagucagccucuc

SEQ ID NO: 2282659 - RNA, 19 nt, Human
gggggccccagucagccuc

SEQ ID NO: 2282660 - RNA, 20 nt, Human
gggggccccagucagccucu

SEQ ID NO: 2282661 - RNA, 21 nt, Human
gggggccaugaggccucagug

SEQ ID NO: 2282662 - RNA, 17 nt, Human
gggggccccagucagcc

SEQ ID NO: 2282663 - RNA, 15 nt, Human
gggggccaugagcuc

SEQ ID NO: 2282664 - RNA, 14 nt, Human
gggggccaugagcu

SEQ ID NO: 2282665 - RNA, 15 nt, Human
ggggccucagugcca

SEQ ID NO: 2282666 - RNA, 20 nt, Human
ggggccuaggccucagccag

SEQ ID NO: 2282667 - RNA, 23 nt, Human
ggggccuacagcuuugaucccug

SEQ ID NO: 2282668 - RNA, 12 nt, Human
gggggccucagu

SEQ ID NO: 2282669 - RNA, 15 nt, Human
gggggccucagugcc

SEQ ID NO: 2282670 - RNA, 17 nt, Human
gggggccucagugccac

SEQ ID NO: 2282671 - RNA, 18 nt, Human
gggggccucagugccacu

SEQ ID NO: 2282672 - RNA, 23 nt, Human
gggucggaacccaagcuuagaac

SEQ ID NO: 2282673 - RNA, 14 nt, Human
gggucggcugacca

SEQ ID NO: 2282674 - RNA, 15 nt, Human
gggucggcugaccau

SEQ ID NO: 2282675 - RNA, 12 nt, Human
aaacauuaagaa

SEQ ID NO: 2282676 - RNA, 20 nt, Human
gggucggcugaccaugcuca

SEQ ID NO: 2282677 - RNA, 13 nt, Human
aaacauuaagaaa

SEQ ID NO: 2282678 - RNA, 14 nt, Human
aaacauuaagaaaa

SEQ ID NO: 2282679 - RNA, 15 nt, Human
aaacauuaagaaaau

SEQ ID NO: 2282680 - RNA, 16 nt, Human
aaacauuaagaaaauc

SEQ ID NO: 2282681 - RNA, 13 nt, Human
gggucgcccugga

SEQ ID NO: 2282682 - RNA, 15 nt, Human
gggucgcccuggacu

SEQ ID NO: 2282683 - RNA, 16 nt, Human
gggucccagccacccc

SEQ ID NO: 2282684 - RNA, 17 nt, Human
gggucccacuuccccuc

SEQ ID NO: 2282685 - RNA, 14 nt, Human
gggucccaguggga

SEQ ID NO: 2282686 - RNA, 16 nt, Human
gggucccagugggagg

SEQ ID NO: 2282687 - RNA, 17 nt, Human
gggucccagugggaggg

SEQ ID NO: 2282688 - RNA, 22 nt, Human
gggucccagugggaggggcagg

SEQ ID NO: 2282689 - RNA, 23 nt, Human
gggucccagugggaggggcaggc

SEQ ID NO: 2282690 - RNA, 12 nt, Human
ggguccaugggc

SEQ ID NO: 2282691 - RNA, 13 nt, Human
gggucccaagcug

SEQ ID NO: 2282692 - RNA, 15 nt, Human
gggucccaagcuggg

SEQ ID NO: 2282693 - RNA, 17 nt, Human
gggucccaagcugggcc

SEQ ID NO: 2282694 - RNA, 20 nt, Human
gggucccaagcugggcccca

SEQ ID NO: 2282695 - RNA, 22 nt, Human
gggucccaagcugggccccagc

SEQ ID NO: 2282696 - RNA, 23 nt, Human
gggucccaagcugggccccagcc

SEQ ID NO: 2282697 - RNA, 22 nt, Human
ggguccccaucaucccagcugc

SEQ ID NO: 2282698 - RNA, 17 nt, Human
ggguccccaucauccca

SEQ ID NO: 2282699 - RNA, 16 nt, Human
gggucccugcuguguu

SEQ ID NO: 2282700 - RNA, 13 nt, Human
ggggguggccgcu

SEQ ID NO: 2282701 - RNA, 13 nt, Human
ggggguggaggcu

SEQ ID NO: 2282702 - RNA, 16 nt, Human
ggguccagggagcagg

SEQ ID NO: 2282703 - RNA, 17 nt, Human
ggguccagggagcaggc

SEQ ID NO: 2282704 - RNA, 19 nt, Human
ggguccaggggaugggagg

SEQ ID NO: 2282705 - RNA, 19 nt, Human
gggggugcugggccccugc

SEQ ID NO: 2282706 - RNA, 22 nt, Human
gggggcuauagcuacaggaagc

SEQ ID NO: 2282707 - RNA, 20 nt, Human
ggggguagagcugauccaga

SEQ ID NO: 2282708 - RNA, 16 nt, Human
ggggguccacccagca

SEQ ID NO: 2282709 - RNA, 18 nt, Human
gggggucccagugggagg

SEQ ID NO: 2282710 - RNA, 22 nt, Human
gggggucccagugggaggggca

SEQ ID NO: 2282711 - RNA, 23 nt, Human
ggggggcccgccuggcagaacug

SEQ ID NO: 2282712 - RNA, 14 nt, Human
ggggguagagcuga

SEQ ID NO: 2282713 - RNA, 15 nt, Human
ggggguagagcugau

SEQ ID NO: 2282714 - RNA, 22 nt, Human
aaaccucuccucauguucugcu

SEQ ID NO: 2282715 - RNA, 11 nt, Human
aaaccucuccu

SEQ ID NO: 2282716 - RNA, 19 nt, Human
aaaccucuaauuuauuuug

SEQ ID NO: 2282717 - RNA, 20 nt, Human
aaaccucuaauuuauuuugu

SEQ ID NO: 2282718 - RNA, 24 nt, Human
aaaccucuaauuuauuuugucgaa

SEQ ID NO: 2282719 - RNA, 16 nt, Human
aaaccucuacuaaaaa

SEQ ID NO: 2282720 - RNA, 21 nt, Human
aaaccucuguucaguguaaau

SEQ ID NO: 2282721 - RNA, 16 nt, Human
aaaccugaaaaaaagu

SEQ ID NO: 2282722 - RNA, 17 nt, Human
aaaccucuguucagugu

SEQ ID NO: 2282723 - RNA, 16 nt, Human
aaaccucuguucagug

SEQ ID NO: 2282724 - RNA, 14 nt, Human
aaaccucuguucag

SEQ ID NO: 2282725 - RNA, 11 nt, Human
aaaccucuguu

SEQ ID NO: 2282726 - RNA, 15 nt, Human
aaaccucugugagca

SEQ ID NO: 2282727 - RNA, 17 nt, Human
aaaccuuucaaauuuca

SEQ ID NO: 2282728 - RNA, 11 nt, Human
aaaccuuucaa

SEQ ID NO: 2282729 - RNA, 19 nt, Human
aaaccuuucaaauuucaca

SEQ ID NO: 2282730 - RNA, 18 nt, Human
aaaccugaccccugcuca

SEQ ID NO: 2282731 - RNA, 22 nt, Human
aaaccugaaaaaaaguuuacaa

SEQ ID NO: 2282732 - RNA, 15 nt, Human
aaacgggcucagcaa

SEQ ID NO: 2282733 - RNA, 20 nt, Human
aaaccuuuuggaaaaucugc

SEQ ID NO: 2282734 - RNA, 13 nt, Human
aaaccuuuugaaa

SEQ ID NO: 2282735 - RNA, 18 nt, Human
aaaccuuuguuugcaucu

SEQ ID NO: 2282736 - RNA, 18 nt, Human
aaaccuuuuauauuuagu

SEQ ID NO: 2282737 - RNA, 22 nt, Human
aaaccucacccgaggcugccca

SEQ ID NO: 2282738 - RNA, 21 nt, Human
aaaccacaaggcuguugcaug

SEQ ID NO: 2282739 - RNA, 21 nt, Human
aaaccuccaaaacuccugccc

SEQ ID NO: 2282740 - RNA, 19 nt, Human
aaaccucuaacccaggucu

SEQ ID NO: 2282741 - RNA, 18 nt, Human
aaaccucuaauuuauuuu

SEQ ID NO: 2282742 - RNA, 12 nt, Human
aaaccacagcag

SEQ ID NO: 2282743 - RNA, 23 nt, Human
aaaccaagucaagugaaaaagga

SEQ ID NO: 2282744 - RNA, 22 nt, Human
aaaccaagggggaugacaugug

SEQ ID NO: 2282745 - RNA, 20 nt, Human
aaaccacaaggcuguugcau

SEQ ID NO: 2282746 - RNA, 16 nt, Human
aaacauugaaguaaug

SEQ ID NO: 2282747 - RNA, 12 nt, Human
aaacauugaaga

SEQ ID NO: 2282748 - RNA, 16 nt, Human
aaaccaagccguggcu

SEQ ID NO: 2282749 - RNA, 12 nt, Human
aaacauucuauc

SEQ ID NO: 2282750 - RNA, 23 nt, Human
aaacauucugauuuggaaaaaga

SEQ ID NO: 2282751 - RNA, 15 nt, Human
aaacauuaugaugug

SEQ ID NO: 2282752 - RNA, 20 nt, Human
aaacauuaagauugaggccu

SEQ ID NO: 2282753 - RNA, 18 nt, Human
aaacauuaagaaaaucau

SEQ ID NO: 2282754 - RNA, 19 nt, Human
aaacauuaagaaaaucaua

SEQ ID NO: 2282755 - RNA, 20 nt, Human
aaacauuaagaaaaucauau

SEQ ID NO: 2282756 - RNA, 15 nt, Human
aaacauuaagauuga

SEQ ID NO: 2282757 - RNA, 18 nt, Human
aaacuagggccaagccca

SEQ ID NO: 2282758 - RNA, 17 nt, Human
aaacguaugcaugugaa

SEQ ID NO: 2282759 - RNA, 22 nt, Human
aaacuaggugcauauuuauaaa

SEQ ID NO: 2282760 - RNA, 11 nt, Human
aaacuaucagu

SEQ ID NO: 2282761 - RNA, 16 nt, Human
aaacuaucuuggugaa

SEQ ID NO: 2282762 - RNA, 16 nt, Human
aaacuaucaguuuguc

SEQ ID NO: 2282763 - RNA, 15 nt, Human
aaacgguuaaaacug

SEQ ID NO: 2282764 - RNA, 17 nt, Human
aaacgguuaaaacuguc

SEQ ID NO: 2282765 - RNA, 15 nt, Human
aaaccuuuuuuaaga

SEQ ID NO: 2282766 - RNA, 16 nt, Human
aaaccuuuuuuaagau

SEQ ID NO: 2282767 - RNA, 18 nt, Human
aaaccuuuuuuaagauuu

SEQ ID NO: 2282768 - RNA, 16 nt, Human
aaacguaugcauguga

SEQ ID NO: 2282769 - RNA, 17 nt, Human
aaacuaggaaauuuuuu

SEQ ID NO: 2282770 - RNA, 18 nt, Human
aaacuaggugcauauuua

SEQ ID NO: 2282771 - RNA, 22 nt, Human
aaacucauuuccuauguaacug

SEQ ID NO: 2282772 - RNA, 16 nt, Human
aaacucgaggacugua

SEQ ID NO: 2282773 - RNA, 15 nt, Human
aaacucauuuccuau

SEQ ID NO: 2282774 - RNA, 17 nt, Human
aaacucgaggacuguau

SEQ ID NO: 2282775 - RNA, 19 nt, Human
aaacucgaggacuguauuu

SEQ ID NO: 2282776 - RNA, 20 nt, Human
aaacucgaggacuguauuug

SEQ ID NO: 2282777 - RNA, 22 nt, Human
aaacucgaggacuguauuugug

SEQ ID NO: 2282778 - RNA, 15 nt, Human
aaacucguuaauuug

SEQ ID NO: 2282779 - RNA, 24 nt, Human
aaacucauuuauaaagcuaaaaua

SEQ ID NO: 2282780 - RNA, 15 nt, Human
aaacucauuuauaaa

SEQ ID NO: 2282781 - RNA, 18 nt, Human
aaacucagggacagagcc

SEQ ID NO: 2282782 - RNA, 19 nt, Human
aaacucagggacagagcca

SEQ ID NO: 2282783 - RNA, 20 nt, Human
aaacucacugcucaagaaga

SEQ ID NO: 2282784 - RNA, 16 nt, Human
aaacucacugcucaag

SEQ ID NO: 2282785 - RNA, 23 nt, Human
aaacucagccucaauaagccuug

SEQ ID NO: 2282786 - RNA, 23 nt, Human
aaacucaggauggucaucuugga

SEQ ID NO: 2282787 - RNA, 13 nt, Human
aaacucagggaca

SEQ ID NO: 2282788 - RNA, 17 nt, Human
aaacucagggacagagc

SEQ ID NO: 2282789 - RNA, 22 nt, Human
aaacuauuuaucuguguuuuug

SEQ ID NO: 2282790 - RNA, 13 nt, Human
aaacuauuuaucu

SEQ ID NO: 2282791 - RNA, 20 nt, Human
aaacuauuugucuuucagga

SEQ ID NO: 2282792 - RNA, 13 nt, Human
aaacucaaaacuu

SEQ ID NO: 2282793 - RNA, 11 nt, Human
aaacuauuuau

SEQ ID NO: 2282794 - RNA, 17 nt, Human
aaacuauuuaacuugag

SEQ ID NO: 2282795 - RNA, 13 nt, Human
aaacuauuuaacu

SEQ ID NO: 2282796 - RNA, 21 nt, Human
aaacucaaaauauuuguacau

SEQ ID NO: 2282797 - RNA, 22 nt, Human
aaacucaaaacuuaacauauuu

SEQ ID NO: 2282798 - RNA, 15 nt, Human
aaacucaaacuuuuc

SEQ ID NO: 2282799 - RNA, 13 nt, Human
aaacucaaaauau

SEQ ID NO: 2282800 - RNA, 18 nt, Human
aaacucaaaacuuaacau

SEQ ID NO: 2282801 - RNA, 19 nt, Human
aaacucaaaacuuaacaua

SEQ ID NO: 2282802 - RNA, 22 nt, Human
aaacucaccugcuggccccuca

SEQ ID NO: 2282803 - RNA, 15 nt, Human
aaacucacugcucaa

SEQ ID NO: 2282804 - RNA, 20 nt, Human
aaacucaccugcuggccccu

SEQ ID NO: 2282805 - RNA, 19 nt, Human
aaacucaccugcuggcccc

SEQ ID NO: 2282806 - RNA, 18 nt, Human
aaacucaccugcuggccc

SEQ ID NO: 2282807 - RNA, 16 nt, Human
aaacucaccugcuggc

SEQ ID NO: 2282808 - RNA, 18 nt, Human
aaacucaccauguaaaag

SEQ ID NO: 2282809 - RNA, 16 nt, Human
aaacucaccauguaaa

SEQ ID NO: 2282810 - RNA, 11 nt, Human
aaacucaaaug

SEQ ID NO: 2282811 - RNA, 12 nt, Human
aaacugucccuu

SEQ ID NO: 2282812 - RNA, 22 nt, Human
aaacugcuuguuuccuagcaca

SEQ ID NO: 2282813 - RNA, 12 nt, Human
aaacugugcacc

SEQ ID NO: 2282814 - RNA, 10 nt, Human
aaacugugua

SEQ ID NO: 2282815 - RNA, 18 nt, Human
aaacuguguauuccaaga

SEQ ID NO: 2282816 - RNA, 16 nt, Human
aaacuguguauuccaa

SEQ ID NO: 2282817 - RNA, 21 nt, Human
aaacuguguacauaacugaaa

SEQ ID NO: 2282818 - RNA, 20 nt, Human
aaacuguguacauaacugaa

SEQ ID NO: 2282819 - RNA, 17 nt, Human
aaacugcguuaaaggcu

SEQ ID NO: 2282820 - RNA, 21 nt, Human
aaacugcccccucugcccugc

SEQ ID NO: 2282821 - RNA, 19 nt, Human
aaacugcuuguuuccuagc

SEQ ID NO: 2282822 - RNA, 17 nt, Human
aaacugcuuguuuccua

SEQ ID NO: 2282823 - RNA, 14 nt, Human
aaacugcuuguuuc

SEQ ID NO: 2282824 - RNA, 13 nt, Human
aaacugcuuguuu

SEQ ID NO: 2282825 - RNA, 21 nt, Human
aaacucuaaacauuaaucaau

SEQ ID NO: 2282826 - RNA, 20 nt, Human
aaacucuaaacauuaaucaa

SEQ ID NO: 2282827 - RNA, 23 nt, Human
aaacucgaggacuguauuuguga

SEQ ID NO: 2282828 - RNA, 24 nt, Human
aaacucgaggacuguauuugugac

SEQ ID NO: 2282829 - RNA, 22 nt, Human
aaacugcccccucugcccugcg

SEQ ID NO: 2282830 - RNA, 13 nt, Human
aaacucuccucug

SEQ ID NO: 2282831 - RNA, 20 nt, Human
aaacuguguggacugugaug

SEQ ID NO: 2282832 - RNA, 19 nt, Human
aaacuguguggacugugau

SEQ ID NO: 2282833 - RNA, 14 nt, Human
ggguggcacugcca

SEQ ID NO: 2282834 - RNA, 19 nt, Human
aaacuguguauuccaagac

SEQ ID NO: 2282835 - RNA, 19 nt, Human
ggguggcaccagcagccug

SEQ ID NO: 2282836 - RNA, 11 nt, Human
ggguggcccau

SEQ ID NO: 2282837 - RNA, 22 nt, Human
ggguggccuaagaguugagcuc

SEQ ID NO: 2282838 - RNA, 19 nt, Human
ggguggcccauccccccuc

SEQ ID NO: 2282839 - RNA, 21 nt, Human
ggguggccgcugaguggcagg

SEQ ID NO: 2282840 - RNA, 17 nt, Human
ggguggccgcugagugg

SEQ ID NO: 2282841 - RNA, 13 nt, Human
ggguggcccaucc

SEQ ID NO: 2282842 - RNA, 18 nt, Human
ggguggcccauccccccu

SEQ ID NO: 2282843 - RNA, 14 nt, Human
aaacuuaaucuaaa

SEQ ID NO: 2282844 - RNA, 16 nt, Human
aaacuuaaucuaaaug

SEQ ID NO: 2282845 - RNA, 18 nt, Human
aaacuuaaucuaaaugga

SEQ ID NO: 2282846 - RNA, 17 nt, Human
aaacuuaaucuaaaugg

SEQ ID NO: 2282847 - RNA, 19 nt, Human
ggugcagagugcccagaac

SEQ ID NO: 2282848 - RNA, 17 nt, Human
ggugcagagugcccaga

SEQ ID NO: 2282849 - RNA, 16 nt, Human
ggugcagagugcccag

SEQ ID NO: 2282850 - RNA, 23 nt, Human
ggugcaacccaaggacugaggga

SEQ ID NO: 2282851 - RNA, 16 nt, Human
ggugcaacccuuaccc

SEQ ID NO: 2282852 - RNA, 20 nt, Human
ggugcaguugacagcaggug

SEQ ID NO: 2282853 - RNA, 16 nt, Human
ggugcagugugaaaag

SEQ ID NO: 2282854 - RNA, 18 nt, Human
ggugcaguugacagcagg

SEQ ID NO: 2282855 - RNA, 21 nt, Human
ggugcauuugaggucuguucu

SEQ ID NO: 2282856 - RNA, 21 nt, Human
ggugcauauuuauaaaaauaa

SEQ ID NO: 2282857 - RNA, 11 nt, Human
ggugcugggcc

SEQ ID NO: 2282858 - RNA, 13 nt, Human
ggugcugggcccc

SEQ ID NO: 2282859 - RNA, 15 nt, Human
ggugcugggccccug

SEQ ID NO: 2282860 - RNA, 16 nt, Human
ggugcugggccccugc

SEQ ID NO: 2282861 - RNA, 13 nt, Human
gguggauauaaau

SEQ ID NO: 2282862 - RNA, 20 nt, Human
gguggagguugcagugagcu

SEQ ID NO: 2282863 - RNA, 16 nt, Human
gguggaucaccugagg

SEQ ID NO: 2282864 - RNA, 15 nt, Human
gguggaucacagagg

SEQ ID NO: 2282865 - RNA, 15 nt, Human
gguggauauaaauau

SEQ ID NO: 2282866 - RNA, 13 nt, Human
gguggaugccugg

SEQ ID NO: 2282867 - RNA, 15 nt, Human
gguggaggcuuccug

SEQ ID NO: 2282868 - RNA, 13 nt, Human
gguggagggccac

SEQ ID NO: 2282869 - RNA, 23 nt, Human
gguggagggccacaugggaggcu

SEQ ID NO: 2282870 - RNA, 21 nt, Human
gguggagccaguaaacagagg

SEQ ID NO: 2282871 - RNA, 20 nt, Human
gguggaggguggggggcgcu

SEQ ID NO: 2282872 - RNA, 13 nt, Human
gguggagaagcca

SEQ ID NO: 2282873 - RNA, 14 nt, Human
gguggagaagccau

SEQ ID NO: 2282874 - RNA, 15 nt, Human
gguggagaagccauu

SEQ ID NO: 2282875 - RNA, 15 nt, Human
gguggaauuauuuua

SEQ ID NO: 2282876 - RNA, 20 nt, Human
gguggaagcccuccuuccac

SEQ ID NO: 2282877 - RNA, 19 nt, Human
gguggaagcccuccuucca

SEQ ID NO: 2282878 - RNA, 18 nt, Human
gguggaagcccuccuucc

SEQ ID NO: 2282879 - RNA, 13 nt, Human
gguggaagcccuc

SEQ ID NO: 2282880 - RNA, 15 nt, Human
gguggaaggaggcgc

SEQ ID NO: 2282881 - RNA, 16 nt, Human
gguggaaggcccgagg

SEQ ID NO: 2282882 - RNA, 19 nt, Human
gguggaaggcccgaggggc

SEQ ID NO: 2282883 - RNA, 21 nt, Human
ggugcuuuuauagaggcuagc

SEQ ID NO: 2282884 - RNA, 19 nt, Human
gguggaagaagggagaaga

SEQ ID NO: 2282885 - RNA, 16 nt, Human
gguggaagaggggaca

SEQ ID NO: 2282886 - RNA, 19 nt, Human
ggugcauuacagagaggag

SEQ ID NO: 2282887 - RNA, 17 nt, Human
ggugcaugaucuugagc

SEQ ID NO: 2282888 - RNA, 20 nt, Human
ggugcugggaggagggagag

SEQ ID NO: 2282889 - RNA, 21 nt, Human
ggugcuuguucccucucccug

SEQ ID NO: 2282890 - RNA, 19 nt, Human
ggugcuuuuauagaggcua

SEQ ID NO: 2282891 - RNA, 13 nt, Human
ggucgcccaggag

SEQ ID NO: 2282892 - RNA, 12 nt, Human
ggucgcccagga

SEQ ID NO: 2282893 - RNA, 14 nt, Human
ggucgcccuggacu

SEQ ID NO: 2282894 - RNA, 20 nt, Human
ggucgaccccaaagccccuu

SEQ ID NO: 2282895 - RNA, 15 nt, Human
gguccuuugggguga

SEQ ID NO: 2282896 - RNA, 13 nt, Human
ggucgaggcagga

SEQ ID NO: 2282897 - RNA, 14 nt, Human
ggucgcccaggaga

SEQ ID NO: 2282898 - RNA, 13 nt, Human
ggugaaagggagc

SEQ ID NO: 2282899 - RNA, 13 nt, Human
ggugaacagaaca

SEQ ID NO: 2282900 - RNA, 22 nt, Human
ggugcaacccaaggacugaggg

SEQ ID NO: 2282901 - RNA, 12 nt, Human
ggugcaaauccu

SEQ ID NO: 2282902 - RNA, 19 nt, Human
ggugaucaauuaaauguag

SEQ ID NO: 2282903 - RNA, 18 nt, Human
ggugcaaaguucccuacu

SEQ ID NO: 2282904 - RNA, 12 nt, Human
ggugcaaugacc

SEQ ID NO: 2282905 - RNA, 13 nt, Human
ggugcaaugaccu

SEQ ID NO: 2282906 - RNA, 16 nt, Human
ggugcaaugaccuuuc

SEQ ID NO: 2282907 - RNA, 14 nt, Human
ggugaaagggagcu

SEQ ID NO: 2282908 - RNA, 18 nt, Human
ggugaacaaagcagccac

SEQ ID NO: 2282909 - RNA, 19 nt, Human
ggugaacaaagcagccacg

SEQ ID NO: 2282910 - RNA, 23 nt, Human
ggugaaauuuauuaguuaauaua

SEQ ID NO: 2282911 - RNA, 20 nt, Human
ggugauauccauucuuucug

SEQ ID NO: 2282912 - RNA, 18 nt, Human
ggugauccacccaccuca

SEQ ID NO: 2282913 - RNA, 23 nt, Human
ggugauccacccaccucagccuc

SEQ ID NO: 2282914 - RNA, 24 nt, Human
ggugauccacccaccucagccucc

SEQ ID NO: 2282915 - RNA, 21 nt, Human
aaagcugcucagggaaaagca

SEQ ID NO: 2282916 - RNA, 13 nt, Human
aaagcugcugaca

SEQ ID NO: 2282917 - RNA, 23 nt, Human
aaagcugccuguaguuaggaaau

SEQ ID NO: 2282918 - RNA, 21 nt, Human
aaagcugccuguaguuaggaa

SEQ ID NO: 2282919 - RNA, 17 nt, Human
aaagcugccuguaguua

SEQ ID NO: 2282920 - RNA, 16 nt, Human
aaagcugccuguaguu

SEQ ID NO: 2282921 - RNA, 15 nt, Human
aaagcugccuguagu

SEQ ID NO: 2282922 - RNA, 12 nt, Human
aaagcugaaaac

SEQ ID NO: 2282923 - RNA, 21 nt, Human
aaagcuuugcuuaugguaaua

SEQ ID NO: 2282924 - RNA, 23 nt, Human
aaagcuuuccugccccaggccug

SEQ ID NO: 2282925 - RNA, 14 nt, Human
aaagcuuuccugcc

SEQ ID NO: 2282926 - RNA, 22 nt, Human
aaagcuuuccugccccaggccu

SEQ ID NO: 2282927 - RNA, 15 nt, Human
aaagcuuuuagaaau

SEQ ID NO: 2282928 - RNA, 15 nt, Human
aaagcuuguuaagau

SEQ ID NO: 2282929 - RNA, 12 nt, Human
aaagcuuuccug

SEQ ID NO: 2282930 - RNA, 13 nt, Human
aaagcuuuccugc

SEQ ID NO: 2282931 - RNA, 14 nt, Human
aaagcacugaccug

SEQ ID NO: 2282932 - RNA, 13 nt, Human
aaagcaccugccg

SEQ ID NO: 2282933 - RNA, 14 nt, Human
aaagcacuauacag

SEQ ID NO: 2282934 - RNA, 14 nt, Human
aaagcacggacucu

SEQ ID NO: 2282935 - RNA, 17 nt, Human
gguggaucacagaggcu

SEQ ID NO: 2282936 - RNA, 12 nt, Human
aaagcaccugcc

SEQ ID NO: 2282937 - RNA, 22 nt, Human
aaagcaccagcuucuccaggcu

SEQ ID NO: 2282938 - RNA, 19 nt, Human
aaagcacgaaauguuauuu

SEQ ID NO: 2282939 - RNA, 21 nt, Human
aaagcacugacuucuaaguaa

SEQ ID NO: 2282940 - RNA, 17 nt, Human
aaagcacugacuucuaa

SEQ ID NO: 2282941 - RNA, 15 nt, Human
aaagcugaaaacugc

SEQ ID NO: 2282942 - RNA, 13 nt, Human
aaagcuccugucc

SEQ ID NO: 2282943 - RNA, 16 nt, Human
aaagcuccuguccucc

SEQ ID NO: 2282944 - RNA, 13 nt, Human
aaagcucauauuu

SEQ ID NO: 2282945 - RNA, 17 nt, Human
aaagcuccuagcagaga

SEQ ID NO: 2282946 - RNA, 20 nt, Human
aaagcuccucgagggcaggg

SEQ ID NO: 2282947 - RNA, 15 nt, Human
aaagcucacuuuacu

SEQ ID NO: 2282948 - RNA, 19 nt, Human
aaagcacuuggacucuugc

SEQ ID NO: 2282949 - RNA, 22 nt, Human
aaagcacugaccugucaugccc

SEQ ID NO: 2282950 - RNA, 16 nt, Human
aaagcacuuggacucu

SEQ ID NO: 2282951 - RNA, 21 nt, Human
aaagcucauauuuuguauaua

SEQ ID NO: 2282952 - RNA, 23 nt, Human
aaaggagcccuuaucugugcuca

SEQ ID NO: 2282953 - RNA, 20 nt, Human
aaagggacugagaaauuuau

SEQ ID NO: 2282954 - RNA, 22 nt, Human
aaagggacuuggaagcuccgcu

SEQ ID NO: 2282955 - RNA, 18 nt, Human
aaagggagcuaucaggaa

SEQ ID NO: 2282956 - RNA, 20 nt, Human
aaagggagcagaacugaacc

SEQ ID NO: 2282957 - RNA, 23 nt, Human
aaagggagcacuggguugacuuu

SEQ ID NO: 2282958 - RNA, 17 nt, Human
aaagggagagagagagg

SEQ ID NO: 2282959 - RNA, 20 nt, Human
aaagggauggcaagaugugg

SEQ ID NO: 2282960 - RNA, 18 nt, Human
aaagggugcugcuucccu

SEQ ID NO: 2282961 - RNA, 21 nt, Human
aaagggugaagcuauuuaucu

SEQ ID NO: 2282962 - RNA, 19 nt, Human
aaagggugaagcuauuuau

SEQ ID NO: 2282963 - RNA, 14 nt, Human
aaagggugaagcua

SEQ ID NO: 2282964 - RNA, 10 nt, Human
aaagggugaa

SEQ ID NO: 2282965 - RNA, 17 nt, Human
aaagggucuugggaaau

SEQ ID NO: 2282966 - RNA, 15 nt, Human
aaaggggugcuuuua

SEQ ID NO: 2282967 - RNA, 14 nt, Human
aaagguaaaucaga

SEQ ID NO: 2282968 - RNA, 14 nt, Human
aaagguacuucaaa

SEQ ID NO: 2282969 - RNA, 12 nt, Human
aaaggaagacua

SEQ ID NO: 2282970 - RNA, 13 nt, Human
aaaggaagacuag

SEQ ID NO: 2282971 - RNA, 23 nt, Human
aaaggaaaucucaccccauccca

SEQ ID NO: 2282972 - RNA, 15 nt, Human
aaaggaaaugauuga

SEQ ID NO: 2282973 - RNA, 15 nt, Human
aaaggaagccaaaga

SEQ ID NO: 2282974 - RNA, 14 nt, Human
aaaggaagccaaag

SEQ ID NO: 2282975 - RNA, 12 nt, Human
aaaggaagccaa

SEQ ID NO: 2282976 - RNA, 17 nt, Human
aaaggaaaucucacccc

SEQ ID NO: 2282977 - RNA, 22 nt, Human
aaaggaaagagggagguaagga

SEQ ID NO: 2282978 - RNA, 17 nt, Human
aaaggagagcuagcagc

SEQ ID NO: 2282979 - RNA, 21 nt, Human
aaaggagagcuagcagcaggg

SEQ ID NO: 2282980 - RNA, 14 nt, Human
aaaggagauaaauc

SEQ ID NO: 2282981 - RNA, 15 nt, Human
aaaggagauaaaucu

SEQ ID NO: 2282982 - RNA, 19 nt, Human
aaaggagcccuuaucugug

SEQ ID NO: 2282983 - RNA, 17 nt, Human
aaaggagauuggaagga

SEQ ID NO: 2282984 - RNA, 18 nt, Human
aaacuuuccucgccugac

SEQ ID NO: 2282985 - RNA, 20 nt, Human
aaacuuguaauuuuuuuaau

SEQ ID NO: 2282986 - RNA, 14 nt, Human
aaacuuugcuaaau

SEQ ID NO: 2282987 - RNA, 22 nt, Human
aaacuuccagugcaacacugaa

SEQ ID NO: 2282988 - RNA, 21 nt, Human
aaacuuccagugcaacacuga

SEQ ID NO: 2282989 - RNA, 18 nt, Human
aaacuugcuuuaugccuu

SEQ ID NO: 2282990 - RNA, 24 nt, Human
aaacuuggcucgaaucucugugcc

SEQ ID NO: 2282991 - RNA, 12 nt, Human
aaacuuguaaau

SEQ ID NO: 2282992 - RNA, 11 nt, Human
aaacuuguaaa

SEQ ID NO: 2282993 - RNA, 16 nt, Human
aaacuuguaauuuuuu

SEQ ID NO: 2282994 - RNA, 19 nt, Human
aaacuuguaaauaaaggaa

SEQ ID NO: 2282995 - RNA, 16 nt, Human
aaacuuguauuaugug

SEQ ID NO: 2282996 - RNA, 19 nt, Human
aaacuuccagugcaacacu

SEQ ID NO: 2282997 - RNA, 14 nt, Human
ggguggggcugcuc

SEQ ID NO: 2282998 - RNA, 23 nt, Human
aaacuucagcgguuuauauaagc

SEQ ID NO: 2282999 - RNA, 19 nt, Human
aaacuucagacauagaauu

SEQ ID NO: 2283000 - RNA, 19 nt, Human
ggguggggggcuucauaca

SEQ ID NO: 2283001 - RNA, 12 nt, Human
ggguggggcugc

SEQ ID NO: 2283002 - RNA, 23 nt, Human
ggguggccuaagaguugagcucu

SEQ ID NO: 2283003 - RNA, 17 nt, Human
ggguggggggcuucaua

SEQ ID NO: 2283004 - RNA, 14 nt, Human
ggguggccucccaa

SEQ ID NO: 2283005 - RNA, 22 nt, Human
aaagacagggcugauaagcuaa

SEQ ID NO: 2283006 - RNA, 14 nt, Human
aaagacagagcugg

SEQ ID NO: 2283007 - RNA, 13 nt, Human
aaagacagaagcc

SEQ ID NO: 2283008 - RNA, 14 nt, Human
aaagacaucaagca

SEQ ID NO: 2283009 - RNA, 19 nt, Human
aaagacauccauaaagaag

SEQ ID NO: 2283010 - RNA, 15 nt, Human
aaagacaugaauaug

SEQ ID NO: 2283011 - RNA, 18 nt, Human
aaagacauccauaaagaa

SEQ ID NO: 2283012 - RNA, 19 nt, Human
aaagacauucugacaucuu

SEQ ID NO: 2283013 - RNA, 15 nt, Human
aaagaccauuuuucc

SEQ ID NO: 2283014 - RNA, 13 nt, Human
aaagaccagacua

SEQ ID NO: 2283015 - RNA, 17 nt, Human
aaagaccuuguguguau

SEQ ID NO: 2283016 - RNA, 19 nt, Human
aaagaccuuguguguaugu

SEQ ID NO: 2283017 - RNA, 9 nt, Human
aaagacaga

SEQ ID NO: 2283018 - RNA, 14 nt, Human
aaacuuuucucaga

SEQ ID NO: 2283019 - RNA, 12 nt, Human
aaacuuuucuca

SEQ ID NO: 2283020 - RNA, 13 nt, Human
aaagacagugaaa

SEQ ID NO: 2283021 - RNA, 19 nt, Human
aaagacugaccaauauugu

SEQ ID NO: 2283022 - RNA, 21 nt, Human
aaagacuccaaagaaauguaa

SEQ ID NO: 2283023 - RNA, 15 nt, Human
aaagacuccaaagaa

SEQ ID NO: 2283024 - RNA, 21 nt, Human
aaagacuauucaaacagucuc

SEQ ID NO: 2283025 - RNA, 23 nt, Human
aaagacgaccagcauuuaaccaa

SEQ ID NO: 2283026 - RNA, 20 nt, Human
aaagaccuuguguguaugug

SEQ ID NO: 2283027 - RNA, 23 nt, Human
aaagaccuuguguguauguguac

SEQ ID NO: 2283028 - RNA, 22 nt, Human
aaagaccuuuggagcaaagcug

SEQ ID NO: 2283029 - RNA, 17 nt, Human
aaagacuauucaaacag

SEQ ID NO: 2283030 - RNA, 19 nt, Human
aaagacuauucaaacaguc

SEQ ID NO: 2283031 - RNA, 18 nt, Human
aaagacuauucaaacagu

SEQ ID NO: 2283032 - RNA, 22 nt, Human
aaagagcuuucuucccgaaccc

SEQ ID NO: 2283033 - RNA, 22 nt, Human
aaagagcuuuaguccuagagga

SEQ ID NO: 2283034 - RNA, 20 nt, Human
aaagagcacuuaagagaaua

SEQ ID NO: 2283035 - RNA, 21 nt, Human
aaagagcacuuaagagaauau

SEQ ID NO: 2283036 - RNA, 22 nt, Human
aaagagcacuuaagagaauauu

SEQ ID NO: 2283037 - RNA, 15 nt, Human
aaagagcccuugccu

SEQ ID NO: 2283038 - RNA, 23 nt, Human
aaagagcaagucuggaucuggga

SEQ ID NO: 2283039 - RNA, 12 nt, Human
aaagagcacuua

SEQ ID NO: 2283040 - RNA, 18 nt, Human
aaagagcacuuaagagaa

SEQ ID NO: 2283041 - RNA, 15 nt, Human
aaagagcaagucugg

SEQ ID NO: 2283042 - RNA, 14 nt, Human
aaagagauuucaag

SEQ ID NO: 2283043 - RNA, 13 nt, Human
aaagagauuucaa

SEQ ID NO: 2283044 - RNA, 15 nt, Human
aaagaggaaugaagu

SEQ ID NO: 2283045 - RNA, 15 nt, Human
aaagaggcagcuuga

SEQ ID NO: 2283046 - RNA, 14 nt, Human
aaagaugcuucuca

SEQ ID NO: 2283047 - RNA, 17 nt, Human
aaagaugcuucucacug

SEQ ID NO: 2283048 - RNA, 19 nt, Human
aaagaugcuucucacugcc

SEQ ID NO: 2283049 - RNA, 14 nt, Human
aaagaggagugcuu

SEQ ID NO: 2283050 - RNA, 18 nt, Human
aaagagcccuugccuccc

SEQ ID NO: 2283051 - RNA, 12 nt, Human
aaagaggaaaga

SEQ ID NO: 2283052 - RNA, 14 nt, Human
aaagaggaaagaau

SEQ ID NO: 2283053 - RNA, 13 nt, Human
aaagacuguacaa

SEQ ID NO: 2283054 - RNA, 13 nt, Human
aaagacuggcuuu

SEQ ID NO: 2283055 - RNA, 21 nt, Human
aaagacuggcuuuuauuaaug

SEQ ID NO: 2283056 - RNA, 23 nt, Human
aaagacuggcuuuuauuaaugca

SEQ ID NO: 2283057 - RNA, 16 nt, Human
aaagacugagcucaag

SEQ ID NO: 2283058 - RNA, 12 nt, Human
aaagacuggcuu

SEQ ID NO: 2283059 - RNA, 23 nt, Human
aaagacugaguacguugugcauu

SEQ ID NO: 2283060 - RNA, 12 nt, Human
aaagagauauuu

SEQ ID NO: 2283061 - RNA, 13 nt, Human
aaagagauauuuu

SEQ ID NO: 2283062 - RNA, 16 nt, Human
aaagagauauuuuaaa

SEQ ID NO: 2283063 - RNA, 11 nt, Human
aaagagagguu

SEQ ID NO: 2283064 - RNA, 12 nt, Human
aaagagagguua

SEQ ID NO: 2283065 - RNA, 14 nt, Human
aaagacuguacaaa

SEQ ID NO: 2283066 - RNA, 18 nt, Human
aaagagauggccugagaa

SEQ ID NO: 2283067 - RNA, 20 nt, Human
aaagagauauuuuaaaauga

SEQ ID NO: 2283068 - RNA, 22 nt, Human
aaagagaugaugaaaauauuua

SEQ ID NO: 2283069 - RNA, 20 nt, Human
aaagagaugaugaaaauauu

SEQ ID NO: 2283070 - RNA, 19 nt, Human
aaagagaugaugaaaauau

SEQ ID NO: 2283071 - RNA, 19 nt, Human
gguccuucccucuccccaa

SEQ ID NO: 2283072 - RNA, 15 nt, Human
gguccuucccucucc

SEQ ID NO: 2283073 - RNA, 16 nt, Human
gguccuuccaggcccc

SEQ ID NO: 2283074 - RNA, 15 nt, Human
gguccuuccaggccc

SEQ ID NO: 2283075 - RNA, 21 nt, Human
gguccuguggcaggcagcgcc

SEQ ID NO: 2283076 - RNA, 22 nt, Human
gguccuguggcaggcagcgcca

SEQ ID NO: 2283077 - RNA, 21 nt, Human
gguccuuugggaaaggagaag

SEQ ID NO: 2283078 - RNA, 20 nt, Human
gguccuuggugugacccucu

SEQ ID NO: 2283079 - RNA, 22 nt, Human
gguccuuuacacucaggcuuuc

SEQ ID NO: 2283080 - RNA, 16 nt, Human
gguccuugcaccccuc

SEQ ID NO: 2283081 - RNA, 21 nt, Human
gguccuucaaguuagcucagg

SEQ ID NO: 2283082 - RNA, 14 nt, Human
gguccuguggcagg

SEQ ID NO: 2283083 - RNA, 16 nt, Human
gguccuguggcaggca

SEQ ID NO: 2283084 - RNA, 17 nt, Human
gguccuguggcaggcag

SEQ ID NO: 2283085 - RNA, 18 nt, Human
gguccuguggcaggcagc

SEQ ID NO: 2283086 - RNA, 12 nt, Human
gguccuguggca

SEQ ID NO: 2283087 - RNA, 13 nt, Human
gguccuguggcag

SEQ ID NO: 2283088 - RNA, 11 nt, Human
gguccugcugc

SEQ ID NO: 2283089 - RNA, 19 nt, Human
gguccugcagucuggcuga

SEQ ID NO: 2283090 - RNA, 17 nt, Human
gguccugagggucccca

SEQ ID NO: 2283091 - RNA, 12 nt, Human
gguccugcugca

SEQ ID NO: 2283092 - RNA, 14 nt, Human
gguccugcugcagu

SEQ ID NO: 2283093 - RNA, 20 nt, Human
gguccugcagucuggcugag

SEQ ID NO: 2283094 - RNA, 17 nt, Human
aaagcaauaaaugaaug

SEQ ID NO: 2283095 - RNA, 15 nt, Human
aaagcaauaaaugaa

SEQ ID NO: 2283096 - RNA, 14 nt, Human
aaagcaauaauggu

SEQ ID NO: 2283097 - RNA, 22 nt, Human
aaagcaauaauggucccaucca

SEQ ID NO: 2283098 - RNA, 23 nt, Human
aaagcaauaauggucccauccag

SEQ ID NO: 2283099 - RNA, 22 nt, Human
aaagcaagugauugggacagag

SEQ ID NO: 2283100 - RNA, 20 nt, Human
aaagcaaggaaacuauguaa

SEQ ID NO: 2283101 - RNA, 14 nt, Human
aaagcaaggaaacu

SEQ ID NO: 2283102 - RNA, 14 nt, Human
aaagcaauaugcau

SEQ ID NO: 2283103 - RNA, 12 nt, Human
aaagcaaugcau

SEQ ID NO: 2283104 - RNA, 13 nt, Human
aaagcaaugcauu

SEQ ID NO: 2283105 - RNA, 14 nt, Human
aaagcaaugcauuu

SEQ ID NO: 2283106 - RNA, 15 nt, Human
aaagcaauuccaacc

SEQ ID NO: 2283107 - RNA, 12 nt, Human
aaagcaauuuuc

SEQ ID NO: 2283108 - RNA, 13 nt, Human
aaagcaauuuucc

SEQ ID NO: 2283109 - RNA, 14 nt, Human
aaagcaauuuuccu

SEQ ID NO: 2283110 - RNA, 15 nt, Human
aaagcaauuuuccuu

SEQ ID NO: 2283111 - RNA, 16 nt, Human
aaagcaauuuuccuug

SEQ ID NO: 2283112 - RNA, 17 nt, Human
aaagcaauuuuccuuga

SEQ ID NO: 2283113 - RNA, 18 nt, Human
aaagcaauuuuccuugaa

SEQ ID NO: 2283114 - RNA, 19 nt, Human
aaagcaauuuuccuugaag

SEQ ID NO: 2283115 - RNA, 20 nt, Human
aaagcaauuuuccuugaagc

SEQ ID NO: 2283116 - RNA, 22 nt, Human
aaagauggggucuguaaaaucu

SEQ ID NO: 2283117 - RNA, 19 nt, Human
aaagauggggucuguaaaa

SEQ ID NO: 2283118 - RNA, 21 nt, Human
aaagauggggucuguaaaauc

SEQ ID NO: 2283119 - RNA, 23 nt, Human
aaagauggcugugccucugccug

SEQ ID NO: 2283120 - RNA, 17 nt, Human
aaagauggggucuguaa

SEQ ID NO: 2283121 - RNA, 18 nt, Human
aaagauggggucuguaaa

SEQ ID NO: 2283122 - RNA, 16 nt, Human
aaagauggaugugcuu

SEQ ID NO: 2283123 - RNA, 21 nt, Human
aaagauggcugugccucugcc

SEQ ID NO: 2283124 - RNA, 22 nt, Human
aaagauggcugugccucugccu

SEQ ID NO: 2283125 - RNA, 18 nt, Human
gagguggaauuauuuuaa

SEQ ID NO: 2283126 - RNA, 19 nt, Human
gagguggagguugcaguga

SEQ ID NO: 2283127 - RNA, 20 nt, Human
gagguggagguugcagugag

SEQ ID NO: 2283128 - RNA, 19 nt, Human
gagguggaggcugcaguga

SEQ ID NO: 2283129 - RNA, 21 nt, Human
gagguggagcaaagugagggc

SEQ ID NO: 2283130 - RNA, 18 nt, Human
gagguggcagcccuguag

SEQ ID NO: 2283131 - RNA, 16 nt, Human
gagguggcagcccugu

SEQ ID NO: 2283132 - RNA, 15 nt, Human
gagguggcagcccug

SEQ ID NO: 2283133 - RNA, 20 nt, Human
gagguggaucacagaggcuu

SEQ ID NO: 2283134 - RNA, 20 nt, Human
gagguggcugagccccuguc

SEQ ID NO: 2283135 - RNA, 23 nt, Human
gagguggccagagcugggaggca

SEQ ID NO: 2283136 - RNA, 17 nt, Human
gagguggccagagcugg

SEQ ID NO: 2283137 - RNA, 19 nt, Human
gagguggccagagcuggga

SEQ ID NO: 2283138 - RNA, 21 nt, Human
gagguggccagagcugggagg

SEQ ID NO: 2283139 - RNA, 22 nt, Human
gagguggccagagcugggaggc

SEQ ID NO: 2283140 - RNA, 13 nt, Human
gaggugggauccu

SEQ ID NO: 2283141 - RNA, 15 nt, Human
gaggugggauccucc

SEQ ID NO: 2283142 - RNA, 16 nt, Human
gaggugggauccucca

SEQ ID NO: 2283143 - RNA, 14 nt, Human
gaggugggagcagg

SEQ ID NO: 2283144 - RNA, 13 nt, Human
gaggugggagcag

SEQ ID NO: 2283145 - RNA, 14 nt, Human
gagguggcuggguu

SEQ ID NO: 2283146 - RNA, 12 nt, Human
gagucacugccu

SEQ ID NO: 2283147 - RNA, 17 nt, Human
gaggugggauccuccag

SEQ ID NO: 2283148 - RNA, 14 nt, Human
gagucacuggaaca

SEQ ID NO: 2283149 - RNA, 21 nt, Human
gagucacuggaacacuaauga

SEQ ID NO: 2283150 - RNA, 23 nt, Human
gagugccccauucuuuuguaauu

SEQ ID NO: 2283151 - RNA, 14 nt, Human
gagugccuggccaa

SEQ ID NO: 2283152 - RNA, 19 nt, Human
gaguugauacuacaguuug

SEQ ID NO: 2283153 - RNA, 22 nt, Human
gaguugauacuacaguuuguua

SEQ ID NO: 2283154 - RNA, 21 nt, Human
gaguugauagcacagacccug

SEQ ID NO: 2283155 - RNA, 13 nt, Human
gagugcagugagc

SEQ ID NO: 2283156 - RNA, 18 nt, Human
gagugcagugagccgaga

SEQ ID NO: 2283157 - RNA, 14 nt, Human
gagugcccagaacu

SEQ ID NO: 2283158 - RNA, 20 nt, Human
gagugccaggacuccccagg

SEQ ID NO: 2283159 - RNA, 22 nt, Human
gagugccaggacuccccaggcc

SEQ ID NO: 2283160 - RNA, 12 nt, Human
gagugccaggac

SEQ ID NO: 2283161 - RNA, 13 nt, Human
gagugccaggacu

SEQ ID NO: 2283162 - RNA, 14 nt, Human
gagugccaggacuc

SEQ ID NO: 2283163 - RNA, 19 nt, Human
gagugccaggacuccccag

SEQ ID NO: 2283164 - RNA, 13 nt, Human
gagugagacccug

SEQ ID NO: 2283165 - RNA, 20 nt, Human
gaguccaacguggggcagca

SEQ ID NO: 2283166 - RNA, 22 nt, Human
gaguccaacguggggcagcaca

SEQ ID NO: 2283167 - RNA, 12 nt, Human
gaguccaagcug

SEQ ID NO: 2283168 - RNA, 14 nt, Human
gaguccaagcuggg

SEQ ID NO: 2283169 - RNA, 23 nt, Human
gagugagacccagcccucauccc

SEQ ID NO: 2283170 - RNA, 22 nt, Human
gagugagacccagcccucaucc

SEQ ID NO: 2283171 - RNA, 14 nt, Human
gagugagacucugu

SEQ ID NO: 2283172 - RNA, 18 nt, Human
gagugagacucugucuca

SEQ ID NO: 2283173 - RNA, 18 nt, Human
gagucaugaucucccugc

SEQ ID NO: 2283174 - RNA, 13 nt, Human
gagucaucuccau

SEQ ID NO: 2283175 - RNA, 16 nt, Human
gagucaugaucucccu

SEQ ID NO: 2283176 - RNA, 18 nt, Human
gagucauucguucugugg

SEQ ID NO: 2283177 - RNA, 20 nt, Human
gagucaugaucucccugccg

SEQ ID NO: 2283178 - RNA, 19 nt, Human
gagucaugaucucccugcc

SEQ ID NO: 2283179 - RNA, 12 nt, Human
gagucaugccaa

SEQ ID NO: 2283180 - RNA, 23 nt, Human
gagucacugccucucccuggccc

SEQ ID NO: 2283181 - RNA, 15 nt, Human
gagucagugccaggu

SEQ ID NO: 2283182 - RNA, 21 nt, Human
gagucacugccucucccuggc

SEQ ID NO: 2283183 - RNA, 15 nt, Human
gagucacugccucuc

SEQ ID NO: 2283184 - RNA, 18 nt, Human
gagucagugccagguccu

SEQ ID NO: 2283185 - RNA, 16 nt, Human
gagucauaaaccuuaa

SEQ ID NO: 2283186 - RNA, 20 nt, Human
gagucauaaaccuuaaguaa

SEQ ID NO: 2283187 - RNA, 14 nt, Human
gagucauauuuuga

SEQ ID NO: 2283188 - RNA, 18 nt, Human
gagucagaaguuucugcc

SEQ ID NO: 2283189 - RNA, 19 nt, Human
gaggggaauaauagaagaa

SEQ ID NO: 2283190 - RNA, 18 nt, Human
gaggggaauaauagaaga

SEQ ID NO: 2283191 - RNA, 19 nt, Human
gaggggacaaaacccaccu

SEQ ID NO: 2283192 - RNA, 13 nt, Human
gaggggacagguc

SEQ ID NO: 2283193 - RNA, 21 nt, Human
gaggccagccccacccaggag

SEQ ID NO: 2283194 - RNA, 20 nt, Human
gaggccagccccacccagga

SEQ ID NO: 2283195 - RNA, 18 nt, Human
gaggccagccccacccag

SEQ ID NO: 2283196 - RNA, 16 nt, Human
gaggccagccccaccc

SEQ ID NO: 2283197 - RNA, 14 nt, Human
gaggccagccuggc

SEQ ID NO: 2283198 - RNA, 13 nt, Human
gaggccagccugg

SEQ ID NO: 2283199 - RNA, 22 nt, Human
gaggccagccccacccaggagg

SEQ ID NO: 2283200 - RNA, 12 nt, Human
gaggccagccug

SEQ ID NO: 2283201 - RNA, 14 nt, Human
gaggccagccccac

SEQ ID NO: 2283202 - RNA, 13 nt, Human
gaggccagcccca

SEQ ID NO: 2283203 - RNA, 21 nt, Human
gaggccagaggcccccagccc

SEQ ID NO: 2283204 - RNA, 20 nt, Human
gaggccagagacacaagccu

SEQ ID NO: 2283205 - RNA, 17 nt, Human
gaggcuccagagggcac

SEQ ID NO: 2283206 - RNA, 14 nt, Human
gaggcuccagaggg

SEQ ID NO: 2283207 - RNA, 12 nt, Human
gaggcucugccc

SEQ ID NO: 2283208 - RNA, 13 nt, Human
gaggcucugcccu

SEQ ID NO: 2283209 - RNA, 14 nt, Human
gaggcucugcccuu

SEQ ID NO: 2283210 - RNA, 14 nt, Human
gaggcucuggagcc

SEQ ID NO: 2283211 - RNA, 19 nt, Human
gaggcucuggagcccacug

SEQ ID NO: 2283212 - RNA, 15 nt, Human
gaggcucugcccuug

SEQ ID NO: 2283213 - RNA, 17 nt, Human
gaggcucugcccuuggu

SEQ ID NO: 2283214 - RNA, 12 nt, Human
gaggggaacaga

SEQ ID NO: 2283215 - RNA, 14 nt, Human
gaggggaagggcca

SEQ ID NO: 2283216 - RNA, 15 nt, Human
gaggggaagggccag

SEQ ID NO: 2283217 - RNA, 21 nt, Human
gagggcuuccucuagaagcca

SEQ ID NO: 2283218 - RNA, 19 nt, Human
gaggggaagaguguacugg

SEQ ID NO: 2283219 - RNA, 21 nt, Human
gagggcuagaaucuggagagc

SEQ ID NO: 2283220 - RNA, 19 nt, Human
gagggcuagaacuggagag

SEQ ID NO: 2283221 - RNA, 18 nt, Human
gagggcuagaaucuggag

SEQ ID NO: 2283222 - RNA, 19 nt, Human
gagggcuagaaucuggaga

SEQ ID NO: 2283223 - RNA, 20 nt, Human
gagggcuagaaucuggagag

SEQ ID NO: 2283224 - RNA, 19 nt, Human
gagggcuuccucuagaagc

SEQ ID NO: 2283225 - RNA, 22 nt, Human
gagggcuuccucuagaagccaa

SEQ ID NO: 2283226 - RNA, 12 nt, Human
gagggcuccaga

SEQ ID NO: 2283227 - RNA, 13 nt, Human
gagggcuccagac

SEQ ID NO: 2283228 - RNA, 14 nt, Human
gagggcuccagaca

SEQ ID NO: 2283229 - RNA, 15 nt, Human
gagggcuccagacac

SEQ ID NO: 2283230 - RNA, 20 nt, Human
gagggcgugacucacccaag

SEQ ID NO: 2283231 - RNA, 14 nt, Human
gagggcguggaggg

SEQ ID NO: 2283232 - RNA, 17 nt, Human
gagggcuagaaccuaga

SEQ ID NO: 2283233 - RNA, 19 nt, Human
gagggcggcaggggccugg

SEQ ID NO: 2283234 - RNA, 23 nt, Human
gagggcggcaggggccuggagau

SEQ ID NO: 2283235 - RNA, 14 nt, Human
gagggcgugggagc

SEQ ID NO: 2283236 - RNA, 16 nt, Human
gagggcuagaaccugg

SEQ ID NO: 2283237 - RNA, 20 nt, Human
gagggcuagaaccuggaagg

SEQ ID NO: 2283238 - RNA, 18 nt, Human
gagggcuagaaccuggag

SEQ ID NO: 2283239 - RNA, 19 nt, Human
gagggcuagaaccuggaga

SEQ ID NO: 2283240 - RNA, 21 nt, Human
gagggcuagaaccuggagagc

SEQ ID NO: 2283241 - RNA, 20 nt, Human
gagggcuagaaccuggcagg

SEQ ID NO: 2283242 - RNA, 18 nt, Human
gagggcuagaacuggaga

SEQ ID NO: 2283243 - RNA, 14 nt, Human
gaggcugccucucc

SEQ ID NO: 2283244 - RNA, 19 nt, Human
gagggccugugggagccug

SEQ ID NO: 2283245 - RNA, 23 nt, Human
gagggcgaccccgucacagccuc

SEQ ID NO: 2283246 - RNA, 13 nt, Human
gagggcggcaggg

SEQ ID NO: 2283247 - RNA, 14 nt, Human
gaggcugcagucag

SEQ ID NO: 2283248 - RNA, 16 nt, Human
gaggcugcagcgagcu

SEQ ID NO: 2283249 - RNA, 23 nt, Human
gaggcugccccaccccuccccau

SEQ ID NO: 2283250 - RNA, 9 nt, Human
gaggcugcc

SEQ ID NO: 2283251 - RNA, 12 nt, Human
gaggcugccccc

SEQ ID NO: 2283252 - RNA, 17 nt, Human
gaggcugcccccggccc

SEQ ID NO: 2283253 - RNA, 22 nt, Human
gaggcuccugugcuacuuugcc

SEQ ID NO: 2283254 - RNA, 19 nt, Human
gaggcugcccccggccccc

SEQ ID NO: 2283255 - RNA, 20 nt, Human
gaggcugcccccggcccccu

SEQ ID NO: 2283256 - RNA, 21 nt, Human
gaggcugcccccggcccccug

SEQ ID NO: 2283257 - RNA, 22 nt, Human
gaggcugcccccggcccccugg

SEQ ID NO: 2283258 - RNA, 23 nt, Human
gaggcugcccccggcccccuggu

SEQ ID NO: 2283259 - RNA, 17 nt, Human
gagcuguucacagccag

SEQ ID NO: 2283260 - RNA, 18 nt, Human
gagcugugcaggugggga

SEQ ID NO: 2283261 - RNA, 20 nt, Human
gagcuguggacuuuguucac

SEQ ID NO: 2283262 - RNA, 14 nt, Human
gagcuggugucuga

SEQ ID NO: 2283263 - RNA, 18 nt, Human
gagcuguauuaagccacu

SEQ ID NO: 2283264 - RNA, 18 nt, Human
gagcugguugggaagaca

SEQ ID NO: 2283265 - RNA, 20 nt, Human
gagcugugcaucagcuagaa

SEQ ID NO: 2283266 - RNA, 21 nt, Human
gagcuggugcccggagauugg

SEQ ID NO: 2283267 - RNA, 17 nt, Human
gagcuggugcccggaga

SEQ ID NO: 2283268 - RNA, 16 nt, Human
gagcuggugcccggag

SEQ ID NO: 2283269 - RNA, 15 nt, Human
gagcuggugcccgga

SEQ ID NO: 2283270 - RNA, 18 nt, Human
gagcuggugcauuacaga

SEQ ID NO: 2283271 - RNA, 17 nt, Human
gagcggaaagcagcuca

SEQ ID NO: 2283272 - RNA, 16 nt, Human
gagcggaaagcagcuc

SEQ ID NO: 2283273 - RNA, 15 nt, Human
gagcggaaagcagcu

SEQ ID NO: 2283274 - RNA, 14 nt, Human
gagcggaaagcagc

SEQ ID NO: 2283275 - RNA, 13 nt, Human
gagcggaaagcag

SEQ ID NO: 2283276 - RNA, 18 nt, Human
gagcgcuuucuggaaaag

SEQ ID NO: 2283277 - RNA, 17 nt, Human
gagcggagaaaggaagg

SEQ ID NO: 2283278 - RNA, 15 nt, Human
gagcugccuguucag

SEQ ID NO: 2283279 - RNA, 16 nt, Human
gagcugccuguucagc

SEQ ID NO: 2283280 - RNA, 19 nt, Human
gagcugccuguucagcucc

SEQ ID NO: 2283281 - RNA, 21 nt, Human
gagcgagacuugguuucaaaa

SEQ ID NO: 2283282 - RNA, 16 nt, Human
gagcgagcgcuaccca

SEQ ID NO: 2283283 - RNA, 18 nt, Human
gagcgaggagaugcuccu

SEQ ID NO: 2283284 - RNA, 15 nt, Human
gagcgccugccccuc

SEQ ID NO: 2283285 - RNA, 13 nt, Human
gagcgccugcccc

SEQ ID NO: 2283286 - RNA, 21 nt, Human
gagcgaggagaugcuccuugg

SEQ ID NO: 2283287 - RNA, 22 nt, Human
gagcgccugccccucccagaac

SEQ ID NO: 2283288 - RNA, 18 nt, Human
gagcgccugccccuccca

SEQ ID NO: 2283289 - RNA, 16 nt, Human
gagcgccugccccucc

SEQ ID NO: 2283290 - RNA, 15 nt, Human
gagcgcuacccacuu

SEQ ID NO: 2283291 - RNA, 20 nt, Human
gagcgccugccccucccaga

SEQ ID NO: 2283292 - RNA, 15 nt, Human
gagcgcuccugccgc

SEQ ID NO: 2283293 - RNA, 21 nt, Human
gagcgcuccugccgcagagcu

SEQ ID NO: 2283294 - RNA, 22 nt, Human
gagcgcuccugccgcagagcug

SEQ ID NO: 2283295 - RNA, 23 nt, Human
gagcgcuccugccgcagagcugg

SEQ ID NO: 2283296 - RNA, 12 nt, Human
gagccuuccagg

SEQ ID NO: 2283297 - RNA, 13 nt, Human
gagccuuccaggg

SEQ ID NO: 2283298 - RNA, 15 nt, Human
gagcgacagugagac

SEQ ID NO: 2283299 - RNA, 13 nt, Human
gagcgacagugag

SEQ ID NO: 2283300 - RNA, 17 nt, Human
gagcccggaugcuucuc

SEQ ID NO: 2283301 - RNA, 17 nt, Human
gagcccggcgccccugc

SEQ ID NO: 2283302 - RNA, 14 nt, Human
gagcccgggagcug

SEQ ID NO: 2283303 - RNA, 22 nt, Human
gagcccgggagcugcugcccug

SEQ ID NO: 2283304 - RNA, 14 nt, Human
gagcccgggcugcc

SEQ ID NO: 2283305 - RNA, 15 nt, Human
gagcccgggcugccu

SEQ ID NO: 2283306 - RNA, 17 nt, Human
gagcccgggcugccugg

SEQ ID NO: 2283307 - RNA, 23 nt, Human
gagcccgcacccccacccuuugg

SEQ ID NO: 2283308 - RNA, 20 nt, Human
gagcccgcacccccacccuu

SEQ ID NO: 2283309 - RNA, 19 nt, Human
gagcccgcacccccacccu

SEQ ID NO: 2283310 - RNA, 17 nt, Human
gagcccgcacccccacc

SEQ ID NO: 2283311 - RNA, 17 nt, Human
gagcaucaggccaggcc

SEQ ID NO: 2283312 - RNA, 14 nt, Human
gagcauccaccucc

SEQ ID NO: 2283313 - RNA, 22 nt, Human
gagccccuucugcucagcucug

SEQ ID NO: 2283314 - RNA, 15 nt, Human
gagcccucaaaguga

SEQ ID NO: 2283315 - RNA, 13 nt, Human
gagcccucagaac

SEQ ID NO: 2283316 - RNA, 18 nt, Human
gagcccgggcugccuggg

SEQ ID NO: 2283317 - RNA, 19 nt, Human
gagcccgggcugccugggc

SEQ ID NO: 2283318 - RNA, 22 nt, Human
gagcccgggcugccugggcugu

SEQ ID NO: 2283319 - RNA, 20 nt, Human
gagcccgggcugccugggcu

SEQ ID NO: 2283320 - RNA, 22 nt, Human
gagccuguguaacagcuccuug

SEQ ID NO: 2283321 - RNA, 18 nt, Human
gagccuguguaacagcuc

SEQ ID NO: 2283322 - RNA, 19 nt, Human
gagccuguguaacagcucc

SEQ ID NO: 2283323 - RNA, 20 nt, Human
gagccuguguaacagcuccu

SEQ ID NO: 2283324 - RNA, 21 nt, Human
gagccuguguaacagcuccuu

SEQ ID NO: 2283325 - RNA, 19 nt, Human
gagccugugccuccucacc

SEQ ID NO: 2283326 - RNA, 21 nt, Human
gagcccucaaagugaggggaa

SEQ ID NO: 2283327 - RNA, 13 nt, Human
gagccuguguaac

SEQ ID NO: 2283328 - RNA, 14 nt, Human
gagccuguguaaca

SEQ ID NO: 2283329 - RNA, 15 nt, Human
gagccuguguaacag

SEQ ID NO: 2283330 - RNA, 16 nt, Human
gagccuguguaacagc

SEQ ID NO: 2283331 - RNA, 17 nt, Human
gagccuguguaacagcu

SEQ ID NO: 2283332 - RNA, 22 nt, Human
gagaagcuccucuccccagccc

SEQ ID NO: 2283333 - RNA, 23 nt, Human
gagaagcugaugcuuugcuucaa

SEQ ID NO: 2283334 - RNA, 19 nt, Human
gagaagcuaaaaccugagc

SEQ ID NO: 2283335 - RNA, 19 nt, Human
gagaagcuccucuccccag

SEQ ID NO: 2283336 - RNA, 17 nt, Human
gagaagcucccaggaac

SEQ ID NO: 2283337 - RNA, 20 nt, Human
gagaagcuaaaaccugagcu

SEQ ID NO: 2283338 - RNA, 11 nt, Human
gagaagcugcu

SEQ ID NO: 2283339 - RNA, 21 nt, Human
gagcagugaaugauucagugu

SEQ ID NO: 2283340 - RNA, 14 nt, Human
gagcagugcaggca

SEQ ID NO: 2283341 - RNA, 15 nt, Human
gagcagugcaggcac

SEQ ID NO: 2283342 - RNA, 16 nt, Human
gagcagugcaggcaca

SEQ ID NO: 2283343 - RNA, 17 nt, Human
gagcagugcaggcacag

SEQ ID NO: 2283344 - RNA, 14 nt, Human
gagcaguggcuggu

SEQ ID NO: 2283345 - RNA, 23 nt, Human
gagcaguggcugguccagggcua

SEQ ID NO: 2283346 - RNA, 12 nt, Human
gagcagugucuu

SEQ ID NO: 2283347 - RNA, 11 nt, Human
gagcagugucu

SEQ ID NO: 2283348 - RNA, 18 nt, Human
gagcagugggccuggcca

SEQ ID NO: 2283349 - RNA, 17 nt, Human
gagcagugggccuggcc

SEQ ID NO: 2283350 - RNA, 15 nt, Human
gagcagugggccugg

SEQ ID NO: 2283351 - RNA, 20 nt, Human
gagcaucaggccaggcccuc

SEQ ID NO: 2283352 - RNA, 22 nt, Human
gagcaucaggccaggcccucug

SEQ ID NO: 2283353 - RNA, 22 nt, Human
gacaguaugagucaaugugcag

SEQ ID NO: 2283354 - RNA, 21 nt, Human
gacaguaugagucaaugugca

SEQ ID NO: 2283355 - RNA, 20 nt, Human
gacaguauggcagcuuuccu

SEQ ID NO: 2283356 - RNA, 17 nt, Human
gacaggguuucaccaug

SEQ ID NO: 2283357 - RNA, 21 nt, Human
gacaggguuuggcugugucua

SEQ ID NO: 2283358 - RNA, 20 nt, Human
gacaggguuuggcugugucu

SEQ ID NO: 2283359 - RNA, 19 nt, Human
gacagguuugggaccccug

SEQ ID NO: 2283360 - RNA, 15 nt, Human
gacaguauacagucc

SEQ ID NO: 2283361 - RNA, 21 nt, Human
gacaguaucacugucuuuccu

SEQ ID NO: 2283362 - RNA, 17 nt, Human
gacaguaucacugucuu

SEQ ID NO: 2283363 - RNA, 22 nt, Human
gacagguuugggaccccuggug

SEQ ID NO: 2283364 - RNA, 23 nt, Human
gaccaggacucccuccucaccuc

SEQ ID NO: 2283365 - RNA, 16 nt, Human
gaccaggagggcacug

SEQ ID NO: 2283366 - RNA, 23 nt, Human
gaccaggagggcacuggagcugu

SEQ ID NO: 2283367 - RNA, 21 nt, Human
gaccaggacucccuccucacc

SEQ ID NO: 2283368 - RNA, 19 nt, Human
gaccaggacucccuccuca

SEQ ID NO: 2283369 - RNA, 17 nt, Human
gaccaggacucccuccu

SEQ ID NO: 2283370 - RNA, 16 nt, Human
gaccaggacucccucc

SEQ ID NO: 2283371 - RNA, 14 nt, Human
gaccaggacucccu

SEQ ID NO: 2283372 - RNA, 14 nt, Human
gaccaggacuauag

SEQ ID NO: 2283373 - RNA, 22 nt, Human
gaccaggacuauagcccagguc

SEQ ID NO: 2283374 - RNA, 16 nt, Human
gaccaggacaggacca

SEQ ID NO: 2283375 - RNA, 22 nt, Human
gaccagcuuuucccaaaagccc

SEQ ID NO: 2283376 - RNA, 15 nt, Human
gaccaguugcacuug

SEQ ID NO: 2283377 - RNA, 14 nt, Human
gaccaguggucuca

SEQ ID NO: 2283378 - RNA, 14 nt, Human
gaccaguugggagc

SEQ ID NO: 2283379 - RNA, 15 nt, Human
gaccaguugggagca

SEQ ID NO: 2283380 - RNA, 17 nt, Human
gaccaguugggagcacu

SEQ ID NO: 2283381 - RNA, 20 nt, Human
gaccaguugggagcacugga

SEQ ID NO: 2283382 - RNA, 19 nt, Human
gaccaguuuaaccugaugc

SEQ ID NO: 2283383 - RNA, 16 nt, Human
gaccauaacagccaac

SEQ ID NO: 2283384 - RNA, 14 nt, Human
gaccaucccugaag

SEQ ID NO: 2283385 - RNA, 15 nt, Human
gaccaucccugaagg

SEQ ID NO: 2283386 - RNA, 23 nt, Human
gaccaggggugauuucagagagg

SEQ ID NO: 2283387 - RNA, 22 nt, Human
gaccaggucuuggagcugagcc

SEQ ID NO: 2283388 - RNA, 23 nt, Human
gaccaggucuuggagcugagccu

SEQ ID NO: 2283389 - RNA, 22 nt, Human
gaccaggggugauuucagagag

SEQ ID NO: 2283390 - RNA, 18 nt, Human
gaccagucaaccugggca

SEQ ID NO: 2283391 - RNA, 15 nt, Human
gaccagucugacccu

SEQ ID NO: 2283392 - RNA, 17 nt, Human
gaccagucaaccugggc

SEQ ID NO: 2283393 - RNA, 21 nt, Human
gaccagguuauuuuaaaaaga

SEQ ID NO: 2283394 - RNA, 15 nt, Human
gaccaguaauuguga

SEQ ID NO: 2283395 - RNA, 23 nt, Human
gaccaggcauccuccacaauagc

SEQ ID NO: 2283396 - RNA, 13 nt, Human
gaccaggccuggg

SEQ ID NO: 2283397 - RNA, 22 nt, Human
gacccguucaacuuuuccuuug

SEQ ID NO: 2283398 - RNA, 16 nt, Human
gacccuaaaucuugac

SEQ ID NO: 2283399 - RNA, 18 nt, Human
gacccuaagaccggcggc

SEQ ID NO: 2283400 - RNA, 21 nt, Human
gacccggagcuaacacuggcc

SEQ ID NO: 2283401 - RNA, 16 nt, Human
gacccgcucuggacca

SEQ ID NO: 2283402 - RNA, 14 nt, Human
gacccguccauuug

SEQ ID NO: 2283403 - RNA, 14 nt, Human
gacccuaccccacc

SEQ ID NO: 2283404 - RNA, 11 nt, Human
gacccuacccc

SEQ ID NO: 2283405 - RNA, 15 nt, Human
gacccuacaggagag

SEQ ID NO: 2283406 - RNA, 14 nt, Human
gacccuacaggaga

SEQ ID NO: 2283407 - RNA, 16 nt, Human
gacccuaccccaccac

SEQ ID NO: 2283408 - RNA, 16 nt, Human
gacccuauugcugcuu

SEQ ID NO: 2283409 - RNA, 12 nt, Human
gacccggcugcg

SEQ ID NO: 2283410 - RNA, 13 nt, Human
gacccggcugcgu

SEQ ID NO: 2283411 - RNA, 18 nt, Human
gaccccuuuucagcuucu

SEQ ID NO: 2283412 - RNA, 17 nt, Human
gaccccuuuucagcuuc

SEQ ID NO: 2283413 - RNA, 20 nt, Human
gaccccuuuucagcuucugc

SEQ ID NO: 2283414 - RNA, 13 nt, Human
gacccgcucugga

SEQ ID NO: 2283415 - RNA, 14 nt, Human
gacccgcucuggac

SEQ ID NO: 2283416 - RNA, 21 nt, Human
gaccccuggcuuuucacugcu

SEQ ID NO: 2283417 - RNA, 22 nt, Human
gaccccuggcuuuucacugcug

SEQ ID NO: 2283418 - RNA, 13 nt, Human
gaccccuggcuuu

SEQ ID NO: 2283419 - RNA, 13 nt, Human
gaccccuggccuc

SEQ ID NO: 2283420 - RNA, 14 nt, Human
gaccccuggccucc

SEQ ID NO: 2283421 - RNA, 15 nt, Human
gaccccuggccuccg

SEQ ID NO: 2283422 - RNA, 16 nt, Human
gaccccuggccuccgg

SEQ ID NO: 2283423 - RNA, 23 nt, Human
gaccccugcucaguaaagcacuu

SEQ ID NO: 2283424 - RNA, 16 nt, Human
gaccauucuccaccug

SEQ ID NO: 2283425 - RNA, 19 nt, Human
gaccauaacagccaacagg

SEQ ID NO: 2283426 - RNA, 21 nt, Human
gaccaugcucaucugcugguc

SEQ ID NO: 2283427 - RNA, 22 nt, Human
gaccaugcucaucugcuggucc

SEQ ID NO: 2283428 - RNA, 16 nt, Human
gaccaucccugaaggc

SEQ ID NO: 2283429 - RNA, 17 nt, Human
gaccaucccugaaggcc

SEQ ID NO: 2283430 - RNA, 13 nt, Human
gacacucagaccu

SEQ ID NO: 2283431 - RNA, 15 nt, Human
gacacucagaccuga

SEQ ID NO: 2283432 - RNA, 14 nt, Human
gacagggcuggccc

SEQ ID NO: 2283433 - RNA, 12 nt, Human
gacagggcuggc

SEQ ID NO: 2283434 - RNA, 15 nt, Human
gacagggcuggccca

SEQ ID NO: 2283435 - RNA, 17 nt, Human
gacagggcuggcccagc

SEQ ID NO: 2283436 - RNA, 18 nt, Human
gacagggcuggcccagcc

SEQ ID NO: 2283437 - RNA, 19 nt, Human
gacagggcuggcccagccc

SEQ ID NO: 2283438 - RNA, 20 nt, Human
gacaggggcaggaggaaggg

SEQ ID NO: 2283439 - RNA, 22 nt, Human
gacagggcuggcccagcccugc

SEQ ID NO: 2283440 - RNA, 20 nt, Human
gacagggcuggcccagcccu

SEQ ID NO: 2283441 - RNA, 21 nt, Human
gacagggcuggcccagcccug

SEQ ID NO: 2283442 - RNA, 18 nt, Human
gacaggggcaggaggaag

SEQ ID NO: 2283443 - RNA, 13 nt, Human
gacagcuccuucu

SEQ ID NO: 2283444 - RNA, 11 nt, Human
gacagccuggc

SEQ ID NO: 2283445 - RNA, 12 nt, Human
gacagccuggca

SEQ ID NO: 2283446 - RNA, 14 nt, Human
gacagcuccuucug

SEQ ID NO: 2283447 - RNA, 15 nt, Human
gacagcuccuucugu

SEQ ID NO: 2283448 - RNA, 11 nt, Human
gacagccuccc

SEQ ID NO: 2283449 - RNA, 12 nt, Human
gacagaaagcag

SEQ ID NO: 2283450 - RNA, 16 nt, Human
gacagccucccacccc

SEQ ID NO: 2283451 - RNA, 21 nt, Human
gacagcccuucuuuccacaga

SEQ ID NO: 2283452 - RNA, 13 nt, Human
gacagcccuccau

SEQ ID NO: 2283453 - RNA, 16 nt, Human
gacagaaaacauguuu

SEQ ID NO: 2283454 - RNA, 20 nt, Human
gacagaaagcagaacaguga

SEQ ID NO: 2283455 - RNA, 19 nt, Human
gacacuuuuuugaguggau

SEQ ID NO: 2283456 - RNA, 12 nt, Human
gacacucugcuc

SEQ ID NO: 2283457 - RNA, 21 nt, Human
gacacuuuucaugugugauuu

SEQ ID NO: 2283458 - RNA, 14 nt, Human
gacagaaagcagaa

SEQ ID NO: 2283459 - RNA, 21 nt, Human
gacacuccccgaagucuuuug

SEQ ID NO: 2283460 - RNA, 16 nt, Human
gacacuccccgaaguc

SEQ ID NO: 2283461 - RNA, 12 nt, Human
gacacuccagug

SEQ ID NO: 2283462 - RNA, 14 nt, Human
gacacuccagugcc

SEQ ID NO: 2283463 - RNA, 19 nt, Human
gacacuccagugccagcaa

SEQ ID NO: 2283464 - RNA, 21 nt, Human
gacacucccuugggcucccug

SEQ ID NO: 2283465 - RNA, 15 nt, Human
gacacucccuugggc

SEQ ID NO: 2283466 - RNA, 16 nt, Human
gacacuccagugccag

SEQ ID NO: 2283467 - RNA, 14 nt, Human
gacacuccuagaga

SEQ ID NO: 2283468 - RNA, 21 nt, Human
gacacuccuagagaacgcagc

SEQ ID NO: 2283469 - RNA, 22 nt, Human
gacacuccuagagaacgcagcc

SEQ ID NO: 2283470 - RNA, 16 nt, Human
gaagcauguaggagaa

SEQ ID NO: 2283471 - RNA, 16 nt, Human
gaagcaugaaaaagca

SEQ ID NO: 2283472 - RNA, 17 nt, Human
gaagcauguaggagaau

SEQ ID NO: 2283473 - RNA, 12 nt, Human
gaagcauguuuc

SEQ ID NO: 2283474 - RNA, 13 nt, Human
gaagcauguuuca

SEQ ID NO: 2283475 - RNA, 14 nt, Human
gaagcauguuucau

SEQ ID NO: 2283476 - RNA, 19 nt, Human
gaagcauguuucauguuuu

SEQ ID NO: 2283477 - RNA, 16 nt, Human
gaagcauguuucaugu

SEQ ID NO: 2283478 - RNA, 13 nt, Human
gaagcaugaaaaa

SEQ ID NO: 2283479 - RNA, 16 nt, Human
gaagcaguugugucag

SEQ ID NO: 2283480 - RNA, 22 nt, Human
gaagcaucuuccagaaguguga

SEQ ID NO: 2283481 - RNA, 13 nt, Human
gaagcaguugugu

SEQ ID NO: 2283482 - RNA, 14 nt, Human
gaagcaguuguguc

SEQ ID NO: 2283483 - RNA, 16 nt, Human
gaagcagugagccgca

SEQ ID NO: 2283484 - RNA, 19 nt, Human
gaagcagugccuuccauaa

SEQ ID NO: 2283485 - RNA, 18 nt, Human
gaagcagugccuuccaua

SEQ ID NO: 2283486 - RNA, 17 nt, Human
gaagcagugccuuccau

SEQ ID NO: 2283487 - RNA, 21 nt, Human
gacgcugguagagauggagga

SEQ ID NO: 2283488 - RNA, 20 nt, Human
gacgcugguagagauggagg

SEQ ID NO: 2283489 - RNA, 13 nt, Human
gacgcugugcugc

SEQ ID NO: 2283490 - RNA, 18 nt, Human
gacgcugguagagaugga

SEQ ID NO: 2283491 - RNA, 13 nt, Human
gacgcugaauaaa

SEQ ID NO: 2283492 - RNA, 16 nt, Human
gacgcugaauaaaugu

SEQ ID NO: 2283493 - RNA, 17 nt, Human
gacgcugaauaaauguc

SEQ ID NO: 2283494 - RNA, 12 nt, Human
gacgcugugcug

SEQ ID NO: 2283495 - RNA, 18 nt, Human
gacccucguggccuuccc

SEQ ID NO: 2283496 - RNA, 23 nt, Human
gacccuccuguugcacccagccc

SEQ ID NO: 2283497 - RNA, 21 nt, Human
gacccuccuguugcacccagc

SEQ ID NO: 2283498 - RNA, 22 nt, Human
gacccuccuguugcacccagcc

SEQ ID NO: 2283499 - RNA, 15 nt, Human
gacccucguggccuu

SEQ ID NO: 2283500 - RNA, 11 nt, Human
gacccucucaa

SEQ ID NO: 2283501 - RNA, 22 nt, Human
gacccuccuccucccccagagg

SEQ ID NO: 2283502 - RNA, 19 nt, Human
gacccuccuccucccccag

SEQ ID NO: 2283503 - RNA, 15 nt, Human
gacccuccuguugca

SEQ ID NO: 2283504 - RNA, 18 nt, Human
gacccuccuguugcaccc

SEQ ID NO: 2283505 - RNA, 20 nt, Human
gacccuccuguugcacccag

SEQ ID NO: 2283506 - RNA, 17 nt, Human
gacccuccccgcacccc

SEQ ID NO: 2283507 - RNA, 15 nt, Human
gacccuccccgcacc

SEQ ID NO: 2283508 - RNA, 18 nt, Human
gacuauauuguacacacc

SEQ ID NO: 2283509 - RNA, 20 nt, Human
gacuauauagagauguuuuu

SEQ ID NO: 2283510 - RNA, 23 nt, Human
gacuauauagagauguuuuuaaa

SEQ ID NO: 2283511 - RNA, 16 nt, Human
gacuauauagagaugu

SEQ ID NO: 2283512 - RNA, 19 nt, Human
gacuauauagagauguuuu

SEQ ID NO: 2283513 - RNA, 19 nt, Human
gacuaugcguuuuuauaaa

SEQ ID NO: 2283514 - RNA, 21 nt, Human
gacuauauuugggccugcucc

SEQ ID NO: 2283515 - RNA, 19 nt, Human
gacuauauuugggccugcu

SEQ ID NO: 2283516 - RNA, 16 nt, Human
gacuauucaaacaguc

SEQ ID NO: 2283517 - RNA, 15 nt, Human
gacuauucaaacagu

SEQ ID NO: 2283518 - RNA, 22 nt, Human
gacucaaaugcucagaccagcu

SEQ ID NO: 2283519 - RNA, 18 nt, Human
gacucaaaguuucagaga

SEQ ID NO: 2283520 - RNA, 19 nt, Human
gacucaaaucuccaguauu

SEQ ID NO: 2283521 - RNA, 14 nt, Human
gacucaaaccaaau

SEQ ID NO: 2283522 - RNA, 15 nt, Human
gacuauggagcugag

SEQ ID NO: 2283523 - RNA, 22 nt, Human
gacuauucaaacagucucagga

SEQ ID NO: 2283524 - RNA, 22 nt, Human
gacucaacauguuacugaccag

SEQ ID NO: 2283525 - RNA, 17 nt, Human
gacuauagcccaggucc

SEQ ID NO: 2283526 - RNA, 18 nt, Human
gacuagugaggaaagauu

SEQ ID NO: 2283527 - RNA, 17 nt, Human
gagaagcggcuggcagc

SEQ ID NO: 2283528 - RNA, 21 nt, Human
gacucacaagaagaccagacu

SEQ ID NO: 2283529 - RNA, 22 nt, Human
gacucacaagaagaccagacug

SEQ ID NO: 2283530 - RNA, 22 nt, Human
gacugguguuaucaccgugggc

SEQ ID NO: 2283531 - RNA, 22 nt, Human
gacuguacaaaguagaagucuu

SEQ ID NO: 2283532 - RNA, 16 nt, Human
gacuguacuccuccca

SEQ ID NO: 2283533 - RNA, 17 nt, Human
gacuguacuccucccag

SEQ ID NO: 2283534 - RNA, 18 nt, Human
gacucacaaccugaaccu

SEQ ID NO: 2283535 - RNA, 16 nt, Human
gacucaauuucucccc

SEQ ID NO: 2283536 - RNA, 17 nt, Human
gacucaauuucucccca

SEQ ID NO: 2283537 - RNA, 19 nt, Human
gacucacaaccugaaccua

SEQ ID NO: 2283538 - RNA, 15 nt, Human
gacucacaagaagac

SEQ ID NO: 2283539 - RNA, 17 nt, Human
gacucacaagaagacca

SEQ ID NO: 2283540 - RNA, 17 nt, Human
gacucaaugcacugaca

SEQ ID NO: 2283541 - RNA, 17 nt, Human
gacucaaguccuuaccu

SEQ ID NO: 2283542 - RNA, 17 nt, Human
gacucaauaaaaucaug

SEQ ID NO: 2283543 - RNA, 15 nt, Human
gacucaauaaaauca

SEQ ID NO: 2283544 - RNA, 16 nt, Human
gacucaagugucucag

SEQ ID NO: 2283545 - RNA, 14 nt, Human
gacucaaugcacug

SEQ ID NO: 2283546 - RNA, 22 nt, Human
gacuguguauucuaguuuuguc

SEQ ID NO: 2283547 - RNA, 18 nt, Human
gacugucuccauggcccu

SEQ ID NO: 2283548 - RNA, 22 nt, Human
gacuguauuugugacuaauugu

SEQ ID NO: 2283549 - RNA, 23 nt, Human
gacuguauuugugacuaauugua

SEQ ID NO: 2283550 - RNA, 22 nt, Human
gacugucucaagagggcacugg

SEQ ID NO: 2283551 - RNA, 23 nt, Human
gacugucucaagagggcacuggu

SEQ ID NO: 2283552 - RNA, 17 nt, Human
gacuguauuugugacua

SEQ ID NO: 2283553 - RNA, 19 nt, Human
gacuguauuugugacuaau

SEQ ID NO: 2283554 - RNA, 20 nt, Human
gacuguauuugugacuaauu

SEQ ID NO: 2283555 - RNA, 21 nt, Human
gacugucucaagagggcacug

SEQ ID NO: 2283556 - RNA, 15 nt, Human
gacugucauagaaau

SEQ ID NO: 2283557 - RNA, 14 nt, Human
gacugugugcucag

SEQ ID NO: 2283558 - RNA, 16 nt, Human
gacugugugcucagga

SEQ ID NO: 2283559 - RNA, 17 nt, Human
gacugugugcucaggag

SEQ ID NO: 2283560 - RNA, 20 nt, Human
gacugugugcucaggagccc

SEQ ID NO: 2283561 - RNA, 21 nt, Human
gacuuugcagccggcacaggg

SEQ ID NO: 2283562 - RNA, 18 nt, Human
gacuuucugccuggagug

SEQ ID NO: 2283563 - RNA, 11 nt, Human
gacuuucuguu

SEQ ID NO: 2283564 - RNA, 13 nt, Human
gacuuucuguugg

SEQ ID NO: 2283565 - RNA, 14 nt, Human
gacuuuggaaagac

SEQ ID NO: 2283566 - RNA, 14 nt, Human
gacuuuggaaagag

SEQ ID NO: 2283567 - RNA, 19 nt, Human
gacuguuuucucucggcuc

SEQ ID NO: 2283568 - RNA, 21 nt, Human
gacuguuuucucucggcuccc

SEQ ID NO: 2283569 - RNA, 13 nt, Human
gacuguuuuuacc

SEQ ID NO: 2283570 - RNA, 17 nt, Human
gacuguuuuuacccaua

SEQ ID NO: 2283571 - RNA, 20 nt, Human
gacuguuuuuuccugagcuu

SEQ ID NO: 2283572 - RNA, 19 nt, Human
gacuguuuuuuccugagcu

SEQ ID NO: 2283573 - RNA, 16 nt, Human
gacuuucugccuggag

SEQ ID NO: 2283574 - RNA, 14 nt, Human
gacuguuuuuuccu

SEQ ID NO: 2283575 - RNA, 18 nt, Human
gacuguuuuuacccauau

SEQ ID NO: 2283576 - RNA, 18 nt, Human
gacuguuuucucuugaga

SEQ ID NO: 2283577 - RNA, 16 nt, Human
gacuguuuucucuuga

SEQ ID NO: 2283578 - RNA, 21 nt, Human
gacuuuucuguccgagcuuug

SEQ ID NO: 2283579 - RNA, 22 nt, Human
gacuuuucgaccaauucaaccc

SEQ ID NO: 2283580 - RNA, 19 nt, Human
gacuuuucgaccaauucaa

SEQ ID NO: 2283581 - RNA, 18 nt, Human
gacuuuuccauguaucua

SEQ ID NO: 2283582 - RNA, 17 nt, Human
gacuuuuccauguaucu

SEQ ID NO: 2283583 - RNA, 14 nt, Human
gacuuuguaccccc

SEQ ID NO: 2283584 - RNA, 23 nt, Human
gacuuuucuguccgagcuuugaa

SEQ ID NO: 2283585 - RNA, 13 nt, Human
gacuuuucugcaa

SEQ ID NO: 2283586 - RNA, 14 nt, Human
gacuuuucugcaaa

SEQ ID NO: 2283587 - RNA, 22 nt, Human
gacuuuguuaguuucuccaagc

SEQ ID NO: 2283588 - RNA, 19 nt, Human
gacuuuggcugcaugcgag

SEQ ID NO: 2283589 - RNA, 22 nt, Human
gacuuuguaccccccaaccccu

SEQ ID NO: 2283590 - RNA, 13 nt, Human
gacuuugugaucc

SEQ ID NO: 2283591 - RNA, 15 nt, Human
gacuuugcuucccau

SEQ ID NO: 2283592 - RNA, 16 nt, Human
gacuuuggcugcaugc

SEQ ID NO: 2283593 - RNA, 18 nt, Human
gacuuugggauaggaaaa

SEQ ID NO: 2283594 - RNA, 17 nt, Human
gcauacauuuauaaugu

SEQ ID NO: 2283595 - RNA, 23 nt, Human
gcauacacacacacacacagcca

SEQ ID NO: 2283596 - RNA, 16 nt, Human
gcauaccacuuuuguu

SEQ ID NO: 2283597 - RNA, 15 nt, Human
gcauaccacuuuugu

SEQ ID NO: 2283598 - RNA, 21 nt, Human
gcagggaaggggaggcagccg

SEQ ID NO: 2283599 - RNA, 21 nt, Human
gcagggaaguguaagaaacac

SEQ ID NO: 2283600 - RNA, 20 nt, Human
gcagggaaggggaggcagcc

SEQ ID NO: 2283601 - RNA, 17 nt, Human
gcagguggggagggggu

SEQ ID NO: 2283602 - RNA, 15 nt, Human
gcaggugguccugag

SEQ ID NO: 2283603 - RNA, 22 nt, Human
gcaggugucauauauggggggc

SEQ ID NO: 2283604 - RNA, 23 nt, Human
gcaggugguggcacugagccccc

SEQ ID NO: 2283605 - RNA, 21 nt, Human
gcaggugguggcacugagccc

SEQ ID NO: 2283606 - RNA, 22 nt, Human
gcaggugguggcacugagcccc

SEQ ID NO: 2283607 - RNA, 16 nt, Human
gcaggugguccugaga

SEQ ID NO: 2283608 - RNA, 21 nt, Human
gcaggugguccugagaccuga

SEQ ID NO: 2283609 - RNA, 14 nt, Human
gcaggugguggcac

SEQ ID NO: 2283610 - RNA, 20 nt, Human
gcaggugguggcacugagcc

SEQ ID NO: 2283611 - RNA, 16 nt, Human
gcagguuagaaccuag

SEQ ID NO: 2283612 - RNA, 15 nt, Human
gcaguugacagcagg

SEQ ID NO: 2283613 - RNA, 22 nt, Human
gcagguucuucuuccugaagcu

SEQ ID NO: 2283614 - RNA, 22 nt, Human
gcaguugaaugacaacagaagc

SEQ ID NO: 2283615 - RNA, 17 nt, Human
gcaguugacagcaggug

SEQ ID NO: 2283616 - RNA, 22 nt, Human
gcaguugaaaagacuccaaaga

SEQ ID NO: 2283617 - RNA, 13 nt, Human
gcagguucccaag

SEQ ID NO: 2283618 - RNA, 16 nt, Human
gcagguucccaagcuc

SEQ ID NO: 2283619 - RNA, 15 nt, Human
gcagguucccaagcu

SEQ ID NO: 2283620 - RNA, 19 nt, Human
gcagguucccaagcucaga

SEQ ID NO: 2283621 - RNA, 18 nt, Human
gcagguucccaagcucag

SEQ ID NO: 2283622 - RNA, 20 nt, Human
gcagguucuucuuccugaag

SEQ ID NO: 2283623 - RNA, 15 nt, Human
gcauaaaaauuagcc

SEQ ID NO: 2283624 - RNA, 14 nt, Human
gcauaaaggccuuu

SEQ ID NO: 2283625 - RNA, 13 nt, Human
gcauaaauaugca

SEQ ID NO: 2283626 - RNA, 14 nt, Human
gcaguugccaguca

SEQ ID NO: 2283627 - RNA, 23 nt, Human
gcaguugccagucaccccggcca

SEQ ID NO: 2283628 - RNA, 13 nt, Human
gcauacaaucuga

SEQ ID NO: 2283629 - RNA, 11 nt, Human
gcauacacaca

SEQ ID NO: 2283630 - RNA, 18 nt, Human
gcauaacaagguccaaga

SEQ ID NO: 2283631 - RNA, 22 nt, Human
gcauacacacacacacacagcc

SEQ ID NO: 2283632 - RNA, 21 nt, Human
gcauacacacacacacacagc

SEQ ID NO: 2283633 - RNA, 14 nt, Human
gcauacacacacac

SEQ ID NO: 2283634 - RNA, 13 nt, Human
gcauacacacaca

SEQ ID NO: 2283635 - RNA, 17 nt, Human
gcauaacaauuccucua

SEQ ID NO: 2283636 - RNA, 16 nt, Human
gcauaacaauuccucu

SEQ ID NO: 2283637 - RNA, 14 nt, Human
gcauaaauaugcag

SEQ ID NO: 2283638 - RNA, 15 nt, Human
gcauaaauaugcagu

SEQ ID NO: 2283639 - RNA, 17 nt, Human
gcacugaagugcuuagu

SEQ ID NO: 2283640 - RNA, 20 nt, Human
gcacuuucuauccucuguaa

SEQ ID NO: 2283641 - RNA, 16 nt, Human
gcacucuuaagcuucc

SEQ ID NO: 2283642 - RNA, 14 nt, Human
gcacucuguuauuu

SEQ ID NO: 2283643 - RNA, 20 nt, Human
gcacucugugcccaugggca

SEQ ID NO: 2283644 - RNA, 21 nt, Human
gcacucugugcccaugggcac

SEQ ID NO: 2283645 - RNA, 19 nt, Human
gcacucuguuauuuagacu

SEQ ID NO: 2283646 - RNA, 11 nt, Human
gcacucugugc

SEQ ID NO: 2283647 - RNA, 12 nt, Human
gcacucugugcc

SEQ ID NO: 2283648 - RNA, 13 nt, Human
gcacucugugccc

SEQ ID NO: 2283649 - RNA, 14 nt, Human
gcacucugugccca

SEQ ID NO: 2283650 - RNA, 19 nt, Human
gcacucugugcccaugggc

SEQ ID NO: 2283651 - RNA, 16 nt, Human
gcacuuugggaggcug

SEQ ID NO: 2283652 - RNA, 16 nt, Human
gcacuuugggaggccu

SEQ ID NO: 2283653 - RNA, 21 nt, Human
gcacuuugggaggcugaggcg

SEQ ID NO: 2283654 - RNA, 20 nt, Human
gcacuuugggaggcugaggc

SEQ ID NO: 2283655 - RNA, 16 nt, Human
gcacuuuguucuggcu

SEQ ID NO: 2283656 - RNA, 17 nt, Human
gcagcuguuagagucca

SEQ ID NO: 2283657 - RNA, 16 nt, Human
gcagcuguugcaguga

SEQ ID NO: 2283658 - RNA, 16 nt, Human
gcagcuguuuaaaugu

SEQ ID NO: 2283659 - RNA, 21 nt, Human
gcagcuguuuuaguuaaauuu

SEQ ID NO: 2283660 - RNA, 14 nt, Human
gcagcuguuagagu

SEQ ID NO: 2283661 - RNA, 23 nt, Human
gcagcugggcccaacccugucug

SEQ ID NO: 2283662 - RNA, 16 nt, Human
gcagcugggcccaacc

SEQ ID NO: 2283663 - RNA, 19 nt, Human
gcagcugggcccaacccug

SEQ ID NO: 2283664 - RNA, 21 nt, Human
gcagcugggcccaacccuguc

SEQ ID NO: 2283665 - RNA, 22 nt, Human
gcagcugggcccaacccugucu

SEQ ID NO: 2283666 - RNA, 14 nt, Human
gcagcugggcccaa

SEQ ID NO: 2283667 - RNA, 15 nt, Human
gcagcugggcccaac

SEQ ID NO: 2283668 - RNA, 16 nt, Human
gcagcuggacuaccca

SEQ ID NO: 2283669 - RNA, 23 nt, Human
gcagcuggaaaagggucuuggga

SEQ ID NO: 2283670 - RNA, 15 nt, Human
gcagcuggacuaccc

SEQ ID NO: 2283671 - RNA, 16 nt, Human
gcagcuugaggguugg

SEQ ID NO: 2283672 - RNA, 20 nt, Human
gcagcuucugccacuuccca

SEQ ID NO: 2283673 - RNA, 17 nt, Human
gcagcuucugccacuuc

SEQ ID NO: 2283674 - RNA, 18 nt, Human
gcagcuucugccacuucc

SEQ ID NO: 2283675 - RNA, 14 nt, Human
gcagcuucuguccu

SEQ ID NO: 2283676 - RNA, 15 nt, Human
gcagcuuauucacaa

SEQ ID NO: 2283677 - RNA, 14 nt, Human
gcagcuucaccaga

SEQ ID NO: 2283678 - RNA, 13 nt, Human
gcagcuucaguug

SEQ ID NO: 2283679 - RNA, 12 nt, Human
gcagcuuccaga

SEQ ID NO: 2283680 - RNA, 14 nt, Human
gcagcuucugccac

SEQ ID NO: 2283681 - RNA, 15 nt, Human
gcagcuucugccacu

SEQ ID NO: 2283682 - RNA, 22 nt, Human
gcagcugcgguccacccaggag

SEQ ID NO: 2283683 - RNA, 23 nt, Human
gcagcugcgguccacccaggagc

SEQ ID NO: 2283684 - RNA, 13 nt, Human
gcagcugcuuuug

SEQ ID NO: 2283685 - RNA, 20 nt, Human
gcagcugcuuuugucuaugg

SEQ ID NO: 2283686 - RNA, 19 nt, Human
gcaggcuggcaccgccuuc

SEQ ID NO: 2283687 - RNA, 18 nt, Human
gcaggcuggcaccgccuu

SEQ ID NO: 2283688 - RNA, 17 nt, Human
gcaggcuggcagcucuc

SEQ ID NO: 2283689 - RNA, 18 nt, Human
gcaggcuggcagcucucc

SEQ ID NO: 2283690 - RNA, 16 nt, Human
gcaggcuggcaccgcc

SEQ ID NO: 2283691 - RNA, 13 nt, Human
gcagcuugccccg

SEQ ID NO: 2283692 - RNA, 20 nt, Human
gcaggcuggagguaaggccu

SEQ ID NO: 2283693 - RNA, 12 nt, Human
gcagcuugcccc

SEQ ID NO: 2283694 - RNA, 17 nt, Human
gcaggcucucaggccag

SEQ ID NO: 2283695 - RNA, 22 nt, Human
gcagggaaacagcuaaugggac

SEQ ID NO: 2283696 - RNA, 22 nt, Human
gcagggaaaggcucugaaagcc

SEQ ID NO: 2283697 - RNA, 22 nt, Human
gcaggcuggccaguccaggcug

SEQ ID NO: 2283698 - RNA, 13 nt, Human
gcaggcuggcccu

SEQ ID NO: 2283699 - RNA, 12 nt, Human
gcaggcuggcca

SEQ ID NO: 2283700 - RNA, 14 nt, Human
gcaggcuggccagu

SEQ ID NO: 2283701 - RNA, 22 nt, Human
gcaggcuggcagcucuccaguc

SEQ ID NO: 2283702 - RNA, 23 nt, Human
gcaggcuggcagcucuccaguca

SEQ ID NO: 2283703 - RNA, 19 nt, Human
gcagcuugaggguugggcu

SEQ ID NO: 2283704 - RNA, 21 nt, Human
gcagcuugaggguugggcugg

SEQ ID NO: 2283705 - RNA, 22 nt, Human
gcaggcucgggcuccccagccc

SEQ ID NO: 2283706 - RNA, 12 nt, Human
gcaggcucucag

SEQ ID NO: 2283707 - RNA, 13 nt, Human
gcaggcucucagg

SEQ ID NO: 2283708 - RNA, 14 nt, Human
gcaggcucucaggc

SEQ ID NO: 2283709 - RNA, 15 nt, Human
gcaggcucucaggcc

SEQ ID NO: 2283710 - RNA, 16 nt, Human
gcaggcucucaggcca

SEQ ID NO: 2283711 - RNA, 20 nt, Human
gccaaggagggugagugcaa

SEQ ID NO: 2283712 - RNA, 23 nt, Human
gccaaggagcugcuauagccugg

SEQ ID NO: 2283713 - RNA, 21 nt, Human
gccaaggagcugcuauagccu

SEQ ID NO: 2283714 - RNA, 21 nt, Human
gccaaggagggugagugcaag

SEQ ID NO: 2283715 - RNA, 23 nt, Human
gccaaggaggguggaucaccuga

SEQ ID NO: 2283716 - RNA, 11 nt, Human
gccaaggccaa

SEQ ID NO: 2283717 - RNA, 19 nt, Human
gccaaggccaaaggaagca

SEQ ID NO: 2283718 - RNA, 17 nt, Human
gccaaggccaaaggaag

SEQ ID NO: 2283719 - RNA, 19 nt, Human
gccaagcuccuugggaggc

SEQ ID NO: 2283720 - RNA, 17 nt, Human
gccaagcuccuugggag

SEQ ID NO: 2283721 - RNA, 16 nt, Human
gccaagcuccuuggga

SEQ ID NO: 2283722 - RNA, 23 nt, Human
gccaagcucaggaccaggcaaug

SEQ ID NO: 2283723 - RNA, 16 nt, Human
gccaagcuccaagccc

SEQ ID NO: 2283724 - RNA, 14 nt, Human
gccaagcagccaag

SEQ ID NO: 2283725 - RNA, 14 nt, Human
gccaagcagggagg

SEQ ID NO: 2283726 - RNA, 21 nt, Human
gccaagcccuccccaucccau

SEQ ID NO: 2283727 - RNA, 22 nt, Human
gccaagcauuuaauguagccau

SEQ ID NO: 2283728 - RNA, 22 nt, Human
gccaagcccuccccaucccaug

SEQ ID NO: 2283729 - RNA, 13 nt, Human
gccaagcuagaau

SEQ ID NO: 2283730 - RNA, 20 nt, Human
gccaagcucaggaccaggca

SEQ ID NO: 2283731 - RNA, 14 nt, Human
gccaaggacugccg

SEQ ID NO: 2283732 - RNA, 17 nt, Human
gccaaggacugccgacc

SEQ ID NO: 2283733 - RNA, 11 nt, Human
gccaaggagcu

SEQ ID NO: 2283734 - RNA, 13 nt, Human
gccaaggagcugc

SEQ ID NO: 2283735 - RNA, 12 nt, Human
gccaaggagcug

SEQ ID NO: 2283736 - RNA, 20 nt, Human
gccaaggagcugcuauagcc

SEQ ID NO: 2283737 - RNA, 16 nt, Human
gccaaggagcugcuau

SEQ ID NO: 2283738 - RNA, 15 nt, Human
gccaaggagcugcua

SEQ ID NO: 2283739 - RNA, 14 nt, Human
gccaaggagcugcu

SEQ ID NO: 2283740 - RNA, 20 nt, Human
gccaagcacagugccugcau

SEQ ID NO: 2283741 - RNA, 12 nt, Human
gccaagcacagu

SEQ ID NO: 2283742 - RNA, 16 nt, Human
gccaagcacaguggug

SEQ ID NO: 2283743 - RNA, 21 nt, Human
gccaagcacagugguggcagg

SEQ ID NO: 2283744 - RNA, 13 nt, Human
gccaagcaaccug

SEQ ID NO: 2283745 - RNA, 18 nt, Human
gccaagcaaccugggucc

SEQ ID NO: 2283746 - RNA, 19 nt, Human
gccaagcaaccugggucca

SEQ ID NO: 2283747 - RNA, 20 nt, Human
gccaagcaaccuggguccaa

SEQ ID NO: 2283748 - RNA, 12 nt, Human
gccaagcagcca

SEQ ID NO: 2283749 - RNA, 23 nt, Human
gccaagcacugugcucagggcua

SEQ ID NO: 2283750 - RNA, 15 nt, Human
gccaagcacugugcu

SEQ ID NO: 2283751 - RNA, 18 nt, Human
gccaagcacugugcucag

SEQ ID NO: 2283752 - RNA, 22 nt, Human
gccaagcaccuagccucgcucu

SEQ ID NO: 2283753 - RNA, 18 nt, Human
gccaagaucgcgccacug

SEQ ID NO: 2283754 - RNA, 23 nt, Human
gccaagacuuggcaacagaagca

SEQ ID NO: 2283755 - RNA, 17 nt, Human
gccaagaggcugcagcc

SEQ ID NO: 2283756 - RNA, 23 nt, Human
gccaacccuucuccucuuguaaa

SEQ ID NO: 2283757 - RNA, 13 nt, Human
gccaacccuucuc

SEQ ID NO: 2283758 - RNA, 22 nt, Human
gccaacccuucuccucuuguaa

SEQ ID NO: 2283759 - RNA, 14 nt, Human
gccaaccccugugg

SEQ ID NO: 2283760 - RNA, 13 nt, Human
gccaaccauaccu

SEQ ID NO: 2283761 - RNA, 23 nt, Human
gccaaccauaccuuccuucccug

SEQ ID NO: 2283762 - RNA, 20 nt, Human
gccaacaucgugaaacccug

SEQ ID NO: 2283763 - RNA, 22 nt, Human
gccaacaucgugaaacccuguc

SEQ ID NO: 2283764 - RNA, 23 nt, Human
gccaacaucgugaaacccugucu

SEQ ID NO: 2283765 - RNA, 14 nt, Human
gccaacauggugaa

SEQ ID NO: 2283766 - RNA, 20 nt, Human
gccaacagucaaaacagaga

SEQ ID NO: 2283767 - RNA, 23 nt, Human
gccaacagguggcaggaccagga

SEQ ID NO: 2283768 - RNA, 19 nt, Human
gccaacagguggcaggacc

SEQ ID NO: 2283769 - RNA, 22 nt, Human
gccaacagguggcaggaccagg

SEQ ID NO: 2283770 - RNA, 20 nt, Human
gccaacaguguuaggccugg

SEQ ID NO: 2283771 - RNA, 21 nt, Human
gccaacaguguuaggccuggc

SEQ ID NO: 2283772 - RNA, 22 nt, Human
gccaacaguguuaggccuggca

SEQ ID NO: 2283773 - RNA, 23 nt, Human
gccaacaguguuaggccuggcac

SEQ ID NO: 2283774 - RNA, 16 nt, Human
gccaacagguggcagg

SEQ ID NO: 2283775 - RNA, 13 nt, Human
gcauuugagaaau

SEQ ID NO: 2283776 - RNA, 15 nt, Human
gcauuugaaugcauu

SEQ ID NO: 2283777 - RNA, 16 nt, Human
gcauuugaaugcauuu

SEQ ID NO: 2283778 - RNA, 16 nt, Human
gcauuugaaaauuuug

SEQ ID NO: 2283779 - RNA, 10 nt, Human
gcauuugaau

SEQ ID NO: 2283780 - RNA, 20 nt, Human
gcauuucuugauguugcuua

SEQ ID NO: 2283781 - RNA, 21 nt, Human
gcauuucuugauguugcuuag

SEQ ID NO: 2283782 - RNA, 12 nt, Human
gcauuugaaugc

SEQ ID NO: 2283783 - RNA, 13 nt, Human
gcauuugaaugca

SEQ ID NO: 2283784 - RNA, 14 nt, Human
gcauuugaaaauuu

SEQ ID NO: 2283785 - RNA, 13 nt, Human
gcauuucucuggg

SEQ ID NO: 2283786 - RNA, 12 nt, Human
gcauuucugaag

SEQ ID NO: 2283787 - RNA, 13 nt, Human
gcauuucugaagu

SEQ ID NO: 2283788 - RNA, 15 nt, Human
gcauuguugaggugg

SEQ ID NO: 2283789 - RNA, 19 nt, Human
gcauuguggcugucagcag

SEQ ID NO: 2283790 - RNA, 16 nt, Human
gcauuguggcugucag

SEQ ID NO: 2283791 - RNA, 18 nt, Human
gcauugugaacugacagg

SEQ ID NO: 2283792 - RNA, 22 nt, Human
gcauuguuugcuuauuguucca

SEQ ID NO: 2283793 - RNA, 21 nt, Human
gcauuguuugcuuauuguucc

SEQ ID NO: 2283794 - RNA, 20 nt, Human
gcauuguuugcuuauuguuc

SEQ ID NO: 2283795 - RNA, 18 nt, Human
gcauuguuugcuuauugu

SEQ ID NO: 2283796 - RNA, 17 nt, Human
gcauuguuugcuuauug

SEQ ID NO: 2283797 - RNA, 16 nt, Human
gcauuguugagguggu

SEQ ID NO: 2283798 - RNA, 23 nt, Human
gcauuguugagguggucugaaug

SEQ ID NO: 2283799 - RNA, 15 nt, Human
gcauuuaaaagauac

SEQ ID NO: 2283800 - RNA, 12 nt, Human
gcauuuaaaaga

SEQ ID NO: 2283801 - RNA, 19 nt, Human
gcauuuauggucaacacuu

SEQ ID NO: 2283802 - RNA, 17 nt, Human
gcauuuauuugugauga

SEQ ID NO: 2283803 - RNA, 16 nt, Human
gcauuuauuugugaug

SEQ ID NO: 2283804 - RNA, 23 nt, Human
gcauuguuugcuuauuguuccaa

SEQ ID NO: 2283805 - RNA, 18 nt, Human
gcauuuaaaacagacacu

SEQ ID NO: 2283806 - RNA, 11 nt, Human
gcauuucauuc

SEQ ID NO: 2283807 - RNA, 13 nt, Human
gcauuucauucuu

SEQ ID NO: 2283808 - RNA, 20 nt, Human
gcauuucauucuucucuagc

SEQ ID NO: 2283809 - RNA, 22 nt, Human
gcauuucauucuucucuagcug

SEQ ID NO: 2283810 - RNA, 21 nt, Human
gcauuuccaacaccacagaca

SEQ ID NO: 2283811 - RNA, 22 nt, Human
gcauuuccaacaccacagacac

SEQ ID NO: 2283812 - RNA, 23 nt, Human
gcauuuccaacaccacagacaca

SEQ ID NO: 2283813 - RNA, 21 nt, Human
gcauuuccuaucaccuauuuc

SEQ ID NO: 2283814 - RNA, 15 nt, Human
gccaaccccugugga

SEQ ID NO: 2283815 - RNA, 16 nt, Human
gccaaccuguaauaaa

SEQ ID NO: 2283816 - RNA, 18 nt, Human
gccaaccuguaauaaaua

SEQ ID NO: 2283817 - RNA, 20 nt, Human
gccaaccuguaauaaauaug

SEQ ID NO: 2283818 - RNA, 14 nt, Human
gccaacgacaaagc

SEQ ID NO: 2283819 - RNA, 21 nt, Human
gccaaccuguaauaaauauga

SEQ ID NO: 2283820 - RNA, 22 nt, Human
gccaaccuguaauaaauaugag

SEQ ID NO: 2283821 - RNA, 23 nt, Human
gccaacgacaaagccaaacucug

SEQ ID NO: 2283822 - RNA, 14 nt, Human
gccaacuauggccu

SEQ ID NO: 2283823 - RNA, 15 nt, Human
gccaacuauggccug

SEQ ID NO: 2283824 - RNA, 12 nt, Human
gccaacugcugc

SEQ ID NO: 2283825 - RNA, 19 nt, Human
gccaacuauggccugugga

SEQ ID NO: 2283826 - RNA, 19 nt, Human
gccaacugcugcuuuuuga

SEQ ID NO: 2283827 - RNA, 12 nt, Human
gccaacuguugu

SEQ ID NO: 2283828 - RNA, 19 nt, Human
gccaacuucuucagagcug

SEQ ID NO: 2283829 - RNA, 20 nt, Human
gccaacuucuucagagcuga

SEQ ID NO: 2283830 - RNA, 15 nt, Human
gccaacuugagggcc

SEQ ID NO: 2283831 - RNA, 20 nt, Human
gccaacuugagggcccagag

SEQ ID NO: 2283832 - RNA, 21 nt, Human
gccaacuugagggcccagagc

SEQ ID NO: 2283833 - RNA, 22 nt, Human
gccaacuugagggcccagagca

SEQ ID NO: 2283834 - RNA, 23 nt, Human
gccaacuugagggcccagagcag

SEQ ID NO: 2283835 - RNA, 14 nt, Human
gccaacuuggcuuu

SEQ ID NO: 2283836 - RNA, 13 nt, Human
gccaacuuguaaa

SEQ ID NO: 2283837 - RNA, 14 nt, Human
gccaacuuguaaau

SEQ ID NO: 2283838 - RNA, 15 nt, Human
gccaacuuguaaaua

SEQ ID NO: 2283839 - RNA, 17 nt, Human
gccaacuuguaaauaca

SEQ ID NO: 2283840 - RNA, 18 nt, Human
gccaacuuguaaauacac

SEQ ID NO: 2283841 - RNA, 20 nt, Human
gccaacuuguaaauacacca

SEQ ID NO: 2283842 - RNA, 20 nt, Human
gccaagagcagaggcagcga

SEQ ID NO: 2283843 - RNA, 16 nt, Human
gccaagagcagaggca

SEQ ID NO: 2283844 - RNA, 12 nt, Human
gccaagaggcug

SEQ ID NO: 2283845 - RNA, 14 nt, Human
gccaagaggcugca

SEQ ID NO: 2283846 - RNA, 13 nt, Human
gccaagaggcugc

SEQ ID NO: 2283847 - RNA, 12 nt, Human
gccaagacuugg

SEQ ID NO: 2283848 - RNA, 18 nt, Human
gccaagacuuggcaacag

SEQ ID NO: 2283849 - RNA, 22 nt, Human
gccaagacuuggcaacagaagc

SEQ ID NO: 2283850 - RNA, 18 nt, Human
gccaagaaguuuaaggaa

SEQ ID NO: 2283851 - RNA, 15 nt, Human
gccaagaaacgucuu

SEQ ID NO: 2283852 - RNA, 22 nt, Human
gccaagaaacgucuucuaaacu

SEQ ID NO: 2283853 - RNA, 21 nt, Human
gccaagaaacgucuucuaaac

SEQ ID NO: 2283854 - RNA, 14 nt, Human
gccaagaauucuua

SEQ ID NO: 2283855 - RNA, 18 nt, Human
gccaagaauucuuaaaua

SEQ ID NO: 2283856 - RNA, 22 nt, Human
gcauguacccuaaggucauuac

SEQ ID NO: 2283857 - RNA, 23 nt, Human
gcauguacaguguucuguuuaau

SEQ ID NO: 2283858 - RNA, 18 nt, Human
gcauguaccauuugcaug

SEQ ID NO: 2283859 - RNA, 23 nt, Human
gcauggggauaaaggagaaggca

SEQ ID NO: 2283860 - RNA, 22 nt, Human
gcaugggccuggccaccucucu

SEQ ID NO: 2283861 - RNA, 22 nt, Human
gcauggggauaaaggagaaggc

SEQ ID NO: 2283862 - RNA, 15 nt, Human
gcauguaggagaauc

SEQ ID NO: 2283863 - RNA, 14 nt, Human
gcauguaggagaau

SEQ ID NO: 2283864 - RNA, 20 nt, Human
gcauguaccauuugcauggc

SEQ ID NO: 2283865 - RNA, 14 nt, Human
gcauguaugucuug

SEQ ID NO: 2283866 - RNA, 15 nt, Human
gcauguaugucuugg

SEQ ID NO: 2283867 - RNA, 15 nt, Human
gcauguauuggccug

SEQ ID NO: 2283868 - RNA, 16 nt, Human
gcauguauuggccugg

SEQ ID NO: 2283869 - RNA, 17 nt, Human
gcauguauuggccugga

SEQ ID NO: 2283870 - RNA, 18 nt, Human
gcauguauuggccuggag

SEQ ID NO: 2283871 - RNA, 19 nt, Human
gcauguauuggccuggagg

SEQ ID NO: 2283872 - RNA, 20 nt, Human
gcauguauuggccuggaggu

SEQ ID NO: 2283873 - RNA, 20 nt, Human
gcauguauugugucuuuugc

SEQ ID NO: 2283874 - RNA, 13 nt, Human
gcaugggccuggc

SEQ ID NO: 2283875 - RNA, 12 nt, Human
gcauggcccugg

SEQ ID NO: 2283876 - RNA, 13 nt, Human
gcauggcccuggg

SEQ ID NO: 2283877 - RNA, 15 nt, Human
gcaugggcacucccu

SEQ ID NO: 2283878 - RNA, 19 nt, Human
gcaugggaaugaaugucag

SEQ ID NO: 2283879 - RNA, 13 nt, Human
gcaugggaaugaa

SEQ ID NO: 2283880 - RNA, 16 nt, Human
gcaugggaaugaaugu

SEQ ID NO: 2283881 - RNA, 21 nt, Human
gcaugugaaaaucaaauacau

SEQ ID NO: 2283882 - RNA, 21 nt, Human
gcaugugacucugaagcugac

SEQ ID NO: 2283883 - RNA, 15 nt, Human
gcaugugacucugaa

SEQ ID NO: 2283884 - RNA, 12 nt, Human
gcaugugaagaa

SEQ ID NO: 2283885 - RNA, 17 nt, Human
gcaugugaugagaggaa

SEQ ID NO: 2283886 - RNA, 23 nt, Human
gcaugucccuaccgagucucuuc

SEQ ID NO: 2283887 - RNA, 23 nt, Human
gcaugucgugaccaacuagacau

SEQ ID NO: 2283888 - RNA, 19 nt, Human
gcauguccuguaaagguua

SEQ ID NO: 2283889 - RNA, 23 nt, Human
gcauguauugugucuuuugcaug

SEQ ID NO: 2283890 - RNA, 21 nt, Human
gcauguauugugucuuuugca

SEQ ID NO: 2283891 - RNA, 16 nt, Human
gcauugucccugugcc

SEQ ID NO: 2283892 - RNA, 17 nt, Human
gcauugugaacugacag

SEQ ID NO: 2283893 - RNA, 19 nt, Human
gcauuguaucgauguuaug

SEQ ID NO: 2283894 - RNA, 15 nt, Human
gcauuguaucgaugu

SEQ ID NO: 2283895 - RNA, 20 nt, Human
gcaugugacucugaagcuga

SEQ ID NO: 2283896 - RNA, 21 nt, Human
gcauuggcagcaggugcugcu

SEQ ID NO: 2283897 - RNA, 20 nt, Human
gcauuggcagcaggugcugc

SEQ ID NO: 2283898 - RNA, 16 nt, Human
gcauuguaaaugugcu

SEQ ID NO: 2283899 - RNA, 17 nt, Human
gcauccuggcacccggc

SEQ ID NO: 2283900 - RNA, 21 nt, Human
gcauccuggcacccggccccu

SEQ ID NO: 2283901 - RNA, 14 nt, Human
gcauccugugaagu

SEQ ID NO: 2283902 - RNA, 17 nt, Human
gcauccugugaaguccu

SEQ ID NO: 2283903 - RNA, 14 nt, Human
gcauccuggcaccc

SEQ ID NO: 2283904 - RNA, 20 nt, Human
gcauccuuuucugcagaggg

SEQ ID NO: 2283905 - RNA, 18 nt, Human
gcaucgcaccauucugac

SEQ ID NO: 2283906 - RNA, 13 nt, Human
gcaucgcaaugua

SEQ ID NO: 2283907 - RNA, 22 nt, Human
gcauccuggcacccggccccug

SEQ ID NO: 2283908 - RNA, 23 nt, Human
gcauccuggcacccggccccugc

SEQ ID NO: 2283909 - RNA, 14 nt, Human
gcauggccaggugg

SEQ ID NO: 2283910 - RNA, 17 nt, Human
gcauggccagguggcca

SEQ ID NO: 2283911 - RNA, 17 nt, Human
gcauggccagcagcuug

SEQ ID NO: 2283912 - RNA, 13 nt, Human
gcauggccaggug

SEQ ID NO: 2283913 - RNA, 13 nt, Human
gcauccuucugcc

SEQ ID NO: 2283914 - RNA, 20 nt, Human
gcaucgcaccauucugacuc

SEQ ID NO: 2283915 - RNA, 18 nt, Human
gcauggcaucaccuccac

SEQ ID NO: 2283916 - RNA, 15 nt, Human
gcaaaagaugcuucu

SEQ ID NO: 2283917 - RNA, 16 nt, Human
gcaaaagacuaauuua

SEQ ID NO: 2283918 - RNA, 12 nt, Human
gcaaaacugaau

SEQ ID NO: 2283919 - RNA, 20 nt, Human
gcaaaacgcauggagugugu

SEQ ID NO: 2283920 - RNA, 17 nt, Human
gcaaaacucuacuuaau

SEQ ID NO: 2283921 - RNA, 22 nt, Human
gcaaaacucuacuuaauccaau

SEQ ID NO: 2283922 - RNA, 23 nt, Human
gcaaaacucuacuuaauccaaug

SEQ ID NO: 2283923 - RNA, 21 nt, Human
gcaaaaccacuagaacucucc

SEQ ID NO: 2283924 - RNA, 22 nt, Human
gcaaaacagcguuuaagacugu

SEQ ID NO: 2283925 - RNA, 16 nt, Human
gcaaaagaugcuucuc

SEQ ID NO: 2283926 - RNA, 17 nt, Human
gcaacccccagccugcu

SEQ ID NO: 2283927 - RNA, 18 nt, Human
gcaacccccagccugcua

SEQ ID NO: 2283928 - RNA, 23 nt, Human
gcaacccuccuaucaccuccccu

SEQ ID NO: 2283929 - RNA, 12 nt, Human
gcaacccuccua

SEQ ID NO: 2283930 - RNA, 21 nt, Human
gcaacccuuaccccuuagccu

SEQ ID NO: 2283931 - RNA, 23 nt, Human
gcaaccgucuguuaugcugugac

SEQ ID NO: 2283932 - RNA, 22 nt, Human
gcaacccuggugaccagcacca

SEQ ID NO: 2283933 - RNA, 18 nt, Human
gcaaccuccgccucuugg

SEQ ID NO: 2283934 - RNA, 21 nt, Human
gcaaguucuagagaagaggcu

SEQ ID NO: 2283935 - RNA, 22 nt, Human
gcaaguuucuagcuagaaauau

SEQ ID NO: 2283936 - RNA, 11 nt, Human
gcaauaaagca

SEQ ID NO: 2283937 - RNA, 18 nt, Human
gcaauaauggucccaucc

SEQ ID NO: 2283938 - RNA, 13 nt, Human
gcaauaaagaaga

SEQ ID NO: 2283939 - RNA, 19 nt, Human
gcaauaauggucccaucca

SEQ ID NO: 2283940 - RNA, 23 nt, Human
gcaauaaggggagaguaacccug

SEQ ID NO: 2283941 - RNA, 18 nt, Human
gcaauagucaaauugugu

SEQ ID NO: 2283942 - RNA, 23 nt, Human
gcaauaccguguugguuuugacu

SEQ ID NO: 2283943 - RNA, 20 nt, Human
gcaauaauggucccauccag

SEQ ID NO: 2283944 - RNA, 21 nt, Human
gcaauaauggucccauccagg

SEQ ID NO: 2283945 - RNA, 22 nt, Human
gcaauaauggucccauccaggc

SEQ ID NO: 2283946 - RNA, 23 nt, Human
gcaauaauggucccauccaggca

SEQ ID NO: 2283947 - RNA, 12 nt, Human
gcacacaccaga

SEQ ID NO: 2283948 - RNA, 14 nt, Human
gcacacaccagagc

SEQ ID NO: 2283949 - RNA, 15 nt, Human
gcacacaccagagcc

SEQ ID NO: 2283950 - RNA, 16 nt, Human
gcacacaccagagccc

SEQ ID NO: 2283951 - RNA, 17 nt, Human
gcacacaccagagccca

SEQ ID NO: 2283952 - RNA, 18 nt, Human
gcacacaccagagcccac

SEQ ID NO: 2283953 - RNA, 19 nt, Human
gcacacaccagagcccacc

SEQ ID NO: 2283954 - RNA, 18 nt, Human
gcaccuacaguguacagu

SEQ ID NO: 2283955 - RNA, 23 nt, Human
gcaccuaauccaggcagauccag

SEQ ID NO: 2283956 - RNA, 22 nt, Human
gcaccuaauccaggcagaucca

SEQ ID NO: 2283957 - RNA, 19 nt, Human
gcaccuacaguguacaguc

SEQ ID NO: 2283958 - RNA, 21 nt, Human
gcaccuacaguguacagucuu

SEQ ID NO: 2283959 - RNA, 14 nt, Human
gcaccucccauccu

SEQ ID NO: 2283960 - RNA, 11 nt, Human
gcaccucccau

SEQ ID NO: 2283961 - RNA, 18 nt, Human
gcaccuccacauccucca

SEQ ID NO: 2283962 - RNA, 18 nt, Human
gcaccuaccaccacgccc

SEQ ID NO: 2283963 - RNA, 17 nt, Human
gcaccuaccaccacgcc

SEQ ID NO: 2283964 - RNA, 17 nt, Human
gcaccggcuggccuggc

SEQ ID NO: 2283965 - RNA, 18 nt, Human
gcaccuaauccaggcaga

SEQ ID NO: 2283966 - RNA, 17 nt, Human
gcaccuaauccaggcag

SEQ ID NO: 2283967 - RNA, 15 nt, Human
gcaccggcuggccug

SEQ ID NO: 2283968 - RNA, 16 nt, Human
gcaccggcuggccugg

SEQ ID NO: 2283969 - RNA, 19 nt, Human
gcacacagcugcagagaca

SEQ ID NO: 2283970 - RNA, 23 nt, Human
gcacacagcacgggggccaagga

SEQ ID NO: 2283971 - RNA, 11 nt, Human
gcacacagcac

SEQ ID NO: 2283972 - RNA, 19 nt, Human
gcacacacugugcuuucua

SEQ ID NO: 2283973 - RNA, 13 nt, Human
gcacacaccugua

SEQ ID NO: 2283974 - RNA, 11 nt, Human
gcacacacugu

SEQ ID NO: 2283975 - RNA, 12 nt, Human
gcacacacugug

SEQ ID NO: 2283976 - RNA, 17 nt, Human
gcacacacugugcuuuc

SEQ ID NO: 2283977 - RNA, 21 nt, Human
gcacacaccuguagucccagc

SEQ ID NO: 2283978 - RNA, 16 nt, Human
gcacacaccucagagg

SEQ ID NO: 2283979 - RNA, 20 nt, Human
gcacacaccagagcccaccu

SEQ ID NO: 2283980 - RNA, 13 nt, Human
gcacacagggcag

SEQ ID NO: 2283981 - RNA, 11 nt, Human
gcacacauuuu

SEQ ID NO: 2283982 - RNA, 12 nt, Human
gcacacauuuuu

SEQ ID NO: 2283983 - RNA, 18 nt, Human
gcaccuccccccacugca

SEQ ID NO: 2283984 - RNA, 17 nt, Human
gcaccuccccccacugc

SEQ ID NO: 2283985 - RNA, 13 nt, Human
gcaccucccccca

SEQ ID NO: 2283986 - RNA, 17 nt, Human
gcaccucccauccuaau

SEQ ID NO: 2283987 - RNA, 21 nt, Human
gcaccuccccccacugcaggc

SEQ ID NO: 2283988 - RNA, 19 nt, Human
gcaccuccccccacugcag

SEQ ID NO: 2283989 - RNA, 23 nt, Human
gcaccuccccccacugcaggccc

SEQ ID NO: 2283990 - RNA, 12 nt, Human
gcaccuccugcc

SEQ ID NO: 2283991 - RNA, 22 nt, Human
gcacuauagccuaggugacaga

SEQ ID NO: 2283992 - RNA, 17 nt, Human
gcacucuaaaagguuca

SEQ ID NO: 2283993 - RNA, 21 nt, Human
gcacucuaaaagguucaggga

SEQ ID NO: 2283994 - RNA, 17 nt, Human
gcacuccagccugggug

SEQ ID NO: 2283995 - RNA, 21 nt, Human
gcacuccaugcuuagucacug

SEQ ID NO: 2283996 - RNA, 23 nt, Human
gcacuccaugcuuagucacugcc

SEQ ID NO: 2283997 - RNA, 23 nt, Human
gcacucacacaggacccccuucc

SEQ ID NO: 2283998 - RNA, 16 nt, Human
gcacuccaugagcacc

SEQ ID NO: 2283999 - RNA, 15 nt, Human
gcacuccaugcuuag

SEQ ID NO: 2284000 - RNA, 21 nt, Human
gcacuccagccugggcgacag

SEQ ID NO: 2284001 - RNA, 17 nt, Human
gcacuccagccugggca

SEQ ID NO: 2284002 - RNA, 16 nt, Human
gcacuccagccugggc

SEQ ID NO: 2284003 - RNA, 16 nt, Human
gcacucacacaggacc

SEQ ID NO: 2284004 - RNA, 22 nt, Human
gcacucacacaggacccccuuc

SEQ ID NO: 2284005 - RNA, 13 nt, Human
gcacucaacauga

SEQ ID NO: 2284006 - RNA, 15 nt, Human
gcacuccagccuggg

SEQ ID NO: 2284007 - RNA, 22 nt, Human
gcacuaugaggaauaauuauuu

SEQ ID NO: 2284008 - RNA, 23 nt, Human
gaugugcauuuuugugaaaugaa

SEQ ID NO: 2284009 - RNA, 14 nt, Human
gaugugcacccaug

SEQ ID NO: 2284010 - RNA, 21 nt, Human
gaugugcauuuuugugaaaug

SEQ ID NO: 2284011 - RNA, 15 nt, Human
gaugugcaugggagc

SEQ ID NO: 2284012 - RNA, 18 nt, Human
gaugugauuuaauagugu

SEQ ID NO: 2284013 - RNA, 23 nt, Human
gaugugauuuaauaguguuaauc

SEQ ID NO: 2284014 - RNA, 24 nt, Human
gaugugauuuaauaguguuaauca

SEQ ID NO: 2284015 - RNA, 18 nt, Human
gaugugauuguggaaugg

SEQ ID NO: 2284016 - RNA, 16 nt, Human
gaugugauuguggaau

SEQ ID NO: 2284017 - RNA, 15 nt, Human
gaugugauuguggaa

SEQ ID NO: 2284018 - RNA, 11 nt, Human
gaugugauaua

SEQ ID NO: 2284019 - RNA, 18 nt, Human
gaugugauauauaagugu

SEQ ID NO: 2284020 - RNA, 14 nt, Human
gaugucuaauaguu

SEQ ID NO: 2284021 - RNA, 17 nt, Human
gauguccucaccacaug

SEQ ID NO: 2284022 - RNA, 14 nt, Human
gaugucugccaauu

SEQ ID NO: 2284023 - RNA, 22 nt, Human
gaugucugccaauuuuugccuu

SEQ ID NO: 2284024 - RNA, 21 nt, Human
gaugucugccaauuuuugccu

SEQ ID NO: 2284025 - RNA, 14 nt, Human
gaugucuucauacc

SEQ ID NO: 2284026 - RNA, 18 nt, Human
gaugucuucauaccuaca

SEQ ID NO: 2284027 - RNA, 22 nt, Human
gaugucuuccuuggagggggga

SEQ ID NO: 2284028 - RNA, 20 nt, Human
gaugucuucguacaguucuu

SEQ ID NO: 2284029 - RNA, 19 nt, Human
gaugugaguugcacagcua

SEQ ID NO: 2284030 - RNA, 20 nt, Human
gaugucuucugccuguuaua

SEQ ID NO: 2284031 - RNA, 16 nt, Human
gaugucuucugccugu

SEQ ID NO: 2284032 - RNA, 18 nt, Human
gaugucuucugccuguua

SEQ ID NO: 2284033 - RNA, 21 nt, Human
gaugucuucguacaguucuuc

SEQ ID NO: 2284034 - RNA, 13 nt, Human
gaugucuucugcc

SEQ ID NO: 2284035 - RNA, 14 nt, Human
gaugucuucugccu

SEQ ID NO: 2284036 - RNA, 15 nt, Human
gaugucuucugccug

SEQ ID NO: 2284037 - RNA, 19 nt, Human
gauucuccugccucagccu

SEQ ID NO: 2284038 - RNA, 22 nt, Human
gauucuguguguuuucauaaua

SEQ ID NO: 2284039 - RNA, 19 nt, Human
gauucuguguguuuucaua

SEQ ID NO: 2284040 - RNA, 15 nt, Human
gauucuguggaacaa

SEQ ID NO: 2284041 - RNA, 12 nt, Human
gauucuguacau

SEQ ID NO: 2284042 - RNA, 14 nt, Human
gauucuccugugcu

SEQ ID NO: 2284043 - RNA, 16 nt, Human
gauucuccugugcuag

SEQ ID NO: 2284044 - RNA, 20 nt, Human
gauucuccugccucagccuc

SEQ ID NO: 2284045 - RNA, 21 nt, Human
gauucuccugccucagccucc

SEQ ID NO: 2284046 - RNA, 19 nt, Human
gauucuuuccauuaugauu

SEQ ID NO: 2284047 - RNA, 23 nt, Human
gauucuuggcccgcacagagcug

SEQ ID NO: 2284048 - RNA, 23 nt, Human
gauuuaacagaaauguacagcaa

SEQ ID NO: 2284049 - RNA, 20 nt, Human
gauuuaacagaaauguacag

SEQ ID NO: 2284050 - RNA, 21 nt, Human
gauucuucugcuucagccucc

SEQ ID NO: 2284051 - RNA, 23 nt, Human
gauucuuauggacaaugacccag

SEQ ID NO: 2284052 - RNA, 22 nt, Human
gauuucaggauacucugucaga

SEQ ID NO: 2284053 - RNA, 20 nt, Human
gauuucaggauacucuguca

SEQ ID NO: 2284054 - RNA, 22 nt, Human
gauuuuuuuuuccuucagugcc

SEQ ID NO: 2284055 - RNA, 23 nt, Human
gauuuuuuuuuccuucagugccu

SEQ ID NO: 2284056 - RNA, 12 nt, Human
gauuucaucugc

SEQ ID NO: 2284057 - RNA, 15 nt, Human
gauuucaucugcucu

SEQ ID NO: 2284058 - RNA, 20 nt, Human
gcaaaaaacucgaggacugu

SEQ ID NO: 2284059 - RNA, 18 nt, Human
gcaaaaaaaaaaaaaagc

SEQ ID NO: 2284060 - RNA, 21 nt, Human
gauuucagaaagagcaagucu

SEQ ID NO: 2284061 - RNA, 15 nt, Human
gauuuaauaaaauaa

SEQ ID NO: 2284062 - RNA, 17 nt, Human
gauuuaauaaaauaauu

SEQ ID NO: 2284063 - RNA, 15 nt, Human
gauuucagcucacug

SEQ ID NO: 2284064 - RNA, 20 nt, Human
gauuucagcucacugcaacc

SEQ ID NO: 2284065 - RNA, 17 nt, Human
gauuucagcucacugca

SEQ ID NO: 2284066 - RNA, 17 nt, Human
gauuucacucuccuugg

SEQ ID NO: 2284067 - RNA, 18 nt, Human
gauuucacucuccuuggu

SEQ ID NO: 2284068 - RNA, 22 nt, Human
gauuuaagggauggaaaaggaa

SEQ ID NO: 2284069 - RNA, 14 nt, Human
gauuuaauaaaaua

SEQ ID NO: 2284070 - RNA, 13 nt, Human
gauuuaauaaaau

SEQ ID NO: 2284071 - RNA, 18 nt, Human
gauuuaagacacuuuuug

SEQ ID NO: 2284072 - RNA, 20 nt, Human
gauucuuucccaauucacau

SEQ ID NO: 2284073 - RNA, 17 nt, Human
gauuuaacagucauuua

SEQ ID NO: 2284074 - RNA, 18 nt, Human
gauuuaacagucauuuaa

SEQ ID NO: 2284075 - RNA, 19 nt, Human
gauuuaacagucauuuaaa

SEQ ID NO: 2284076 - RNA, 13 nt, Human
gauuucacucucc

SEQ ID NO: 2284077 - RNA, 16 nt, Human
gauuucacucuccuug

SEQ ID NO: 2284078 - RNA, 23 nt, Human
gaucugggacccuuuccuuccuu

SEQ ID NO: 2284079 - RNA, 18 nt, Human
gaucuggggcucugggau

SEQ ID NO: 2284080 - RNA, 22 nt, Human
gaucugggacccuuuccuuccu

SEQ ID NO: 2284081 - RNA, 17 nt, Human
gaucuggggcucuggga

SEQ ID NO: 2284082 - RNA, 20 nt, Human
gaucuggguucacugcaacc

SEQ ID NO: 2284083 - RNA, 17 nt, Human
gaucugggacccuuucc

SEQ ID NO: 2284084 - RNA, 23 nt, Human
gaucuggaaccucagccuggcca

SEQ ID NO: 2284085 - RNA, 22 nt, Human
gaguugauagcacagacccugc

SEQ ID NO: 2284086 - RNA, 18 nt, Human
gaucuggguucacugcaa

SEQ ID NO: 2284087 - RNA, 12 nt, Human
gaugcuguugcc

SEQ ID NO: 2284088 - RNA, 14 nt, Human
gaugcuguuugaca

SEQ ID NO: 2284089 - RNA, 21 nt, Human
gaugcuuuaagugcacaacau

SEQ ID NO: 2284090 - RNA, 16 nt, Human
gaugcuuuucugucuc

SEQ ID NO: 2284091 - RNA, 17 nt, Human
gaugcuuuucugucucu

SEQ ID NO: 2284092 - RNA, 20 nt, Human
gaugcuuuucugucucugcc

SEQ ID NO: 2284093 - RNA, 17 nt, Human
gaugcuuuuagcucaaa

SEQ ID NO: 2284094 - RNA, 13 nt, Human
gaugcuguuugac

SEQ ID NO: 2284095 - RNA, 23 nt, Human
gaugcuuuguuucuuucauauga

SEQ ID NO: 2284096 - RNA, 16 nt, Human
gaugcuuguacauaau

SEQ ID NO: 2284097 - RNA, 14 nt, Human
gaugcuuguacaua

SEQ ID NO: 2284098 - RNA, 19 nt, Human
gauggagguucucucggag

SEQ ID NO: 2284099 - RNA, 22 nt, Human
gauggaggggugguccugacuc

SEQ ID NO: 2284100 - RNA, 21 nt, Human
gauggaggggugguccugacu

SEQ ID NO: 2284101 - RNA, 11 nt, Human
gauggaggagg

SEQ ID NO: 2284102 - RNA, 12 nt, Human
gauggaggagga

SEQ ID NO: 2284103 - RNA, 14 nt, Human
gauggaggagaaga

SEQ ID NO: 2284104 - RNA, 13 nt, Human
gauggaggagaag

SEQ ID NO: 2284105 - RNA, 23 nt, Human
gauggaggaaaaccaagccgugg

SEQ ID NO: 2284106 - RNA, 21 nt, Human
gaugcuuuucugucucugccu

SEQ ID NO: 2284107 - RNA, 18 nt, Human
gauggauaaccuauauga

SEQ ID NO: 2284108 - RNA, 16 nt, Human
gauggaguucuugugc

SEQ ID NO: 2284109 - RNA, 16 nt, Human
gauggagguuucauac

SEQ ID NO: 2284110 - RNA, 18 nt, Human
gauggaguccagggaaga

SEQ ID NO: 2284111 - RNA, 18 nt, Human
gauggaguucuugugcca

SEQ ID NO: 2284112 - RNA, 19 nt, Human
gauggaguucuugugccau

SEQ ID NO: 2284113 - RNA, 21 nt, Human
gaugucccuuucuuggccagu

SEQ ID NO: 2284114 - RNA, 20 nt, Human
gaugucccuuucuuggccag

SEQ ID NO: 2284115 - RNA, 21 nt, Human
gauguccucaccacaugcgga

SEQ ID NO: 2284116 - RNA, 18 nt, Human
gaugucccaacuuguaaa

SEQ ID NO: 2284117 - RNA, 12 nt, Human
gauguccagaag

SEQ ID NO: 2284118 - RNA, 20 nt, Human
gauguccagaagaauauuca

SEQ ID NO: 2284119 - RNA, 20 nt, Human
gauguccacagaugccucca

SEQ ID NO: 2284120 - RNA, 17 nt, Human
gauguccacagaugccu

SEQ ID NO: 2284121 - RNA, 17 nt, Human
gaugucccaacuuguaa

SEQ ID NO: 2284122 - RNA, 22 nt, Human
gaugucagccgagccgggccug

SEQ ID NO: 2284123 - RNA, 19 nt, Human
gauggauauauguuuuuga

SEQ ID NO: 2284124 - RNA, 12 nt, Human
gauguaaaguga

SEQ ID NO: 2284125 - RNA, 22 nt, Human
gauguacauuuccaaauucaca

SEQ ID NO: 2284126 - RNA, 19 nt, Human
gauguaccaugaaacaaag

SEQ ID NO: 2284127 - RNA, 15 nt, Human
gauguacauuuccaa

SEQ ID NO: 2284128 - RNA, 18 nt, Human
gauguacagucugucaug

SEQ ID NO: 2284129 - RNA, 19 nt, Human
gauguacagucugucauga

SEQ ID NO: 2284130 - RNA, 16 nt, Human
gauguacagucuguca

SEQ ID NO: 2284131 - RNA, 17 nt, Human
gauguacagucugucau

SEQ ID NO: 2284132 - RNA, 20 nt, Human
gaugcugguaauggccaugg

SEQ ID NO: 2284133 - RNA, 16 nt, Human
gaugcugugcuaugaa

SEQ ID NO: 2284134 - RNA, 23 nt, Human
gaugcuucucacugccaugccag

SEQ ID NO: 2284135 - RNA, 22 nt, Human
gaugcugggcuggcucccucuu

SEQ ID NO: 2284136 - RNA, 14 nt, Human
gaugcugggcuggg

SEQ ID NO: 2284137 - RNA, 15 nt, Human
gaugcugggcugggu

SEQ ID NO: 2284138 - RNA, 15 nt, Human
gaugauucagaaauu

SEQ ID NO: 2284139 - RNA, 17 nt, Human
gaugcugggcugggugc

SEQ ID NO: 2284140 - RNA, 19 nt, Human
gaugcuggguuggugcaca

SEQ ID NO: 2284141 - RNA, 20 nt, Human
gaugcuggguuggugcacag

SEQ ID NO: 2284142 - RNA, 23 nt, Human
gaugcuggguuggugcacaguga

SEQ ID NO: 2284143 - RNA, 17 nt, Human
gaugcugguaauggcca

SEQ ID NO: 2284144 - RNA, 20 nt, Human
gaugcuggucauguguuuga

SEQ ID NO: 2284145 - RNA, 17 nt, Human
gaugaugggaauugugu

SEQ ID NO: 2284146 - RNA, 19 nt, Human
gaugaugggaauuguguga

SEQ ID NO: 2284147 - RNA, 14 nt, Human
gaugaugcugccag

SEQ ID NO: 2284148 - RNA, 19 nt, Human
gaugaugccaaccucugga

SEQ ID NO: 2284149 - RNA, 13 nt, Human
gaugaugccacac

SEQ ID NO: 2284150 - RNA, 15 nt, Human
gaugaugccacacca

SEQ ID NO: 2284151 - RNA, 21 nt, Human
gaugauggucuucagccucuu

SEQ ID NO: 2284152 - RNA, 15 nt, Human
gaugaugguguuuug

SEQ ID NO: 2284153 - RNA, 22 nt, Human
gaugaugguugcaaaagacuaa

SEQ ID NO: 2284154 - RNA, 14 nt, Human
gaugaugugccugg

SEQ ID NO: 2284155 - RNA, 15 nt, Human
gaugaugugccuggg

SEQ ID NO: 2284156 - RNA, 17 nt, Human
gaugaugugccugggug

SEQ ID NO: 2284157 - RNA, 14 nt, Human
gaugaugacuaugg

SEQ ID NO: 2284158 - RNA, 22 nt, Human
gaugaggccucuuggaccucug

SEQ ID NO: 2284159 - RNA, 23 nt, Human
gaugaggccucuuggaccucugc

SEQ ID NO: 2284160 - RNA, 16 nt, Human
gaugagcucuacccag

SEQ ID NO: 2284161 - RNA, 11 nt, Human
gaugagcucua

SEQ ID NO: 2284162 - RNA, 20 nt, Human
gaugagcuggaaggagugag

SEQ ID NO: 2284163 - RNA, 20 nt, Human
gaugagcucuacccagggcc

SEQ ID NO: 2284164 - RNA, 19 nt, Human
gaugagcucuacccagggc

SEQ ID NO: 2284165 - RNA, 13 nt, Human
gaugaggcagagg

SEQ ID NO: 2284166 - RNA, 19 nt, Human
gaugaggccgcuagaggcc

SEQ ID NO: 2284167 - RNA, 21 nt, Human
gaugaggccgcuagaggccug

SEQ ID NO: 2284168 - RNA, 22 nt, Human
gaugaggccgcuagaggccuga

SEQ ID NO: 2284169 - RNA, 14 nt, Human
gaugaggccucuug

SEQ ID NO: 2284170 - RNA, 22 nt, Human
cuuggccugucucauccccagg

SEQ ID NO: 2284171 - RNA, 17 nt, Human
cuuggccugucucaucc

SEQ ID NO: 2284172 - RNA, 23 nt, Human
cuuggccugucucauccccaggg

SEQ ID NO: 2284173 - RNA, 16 nt, Human
cuuggccuugggcuuc

SEQ ID NO: 2284174 - RNA, 15 nt, Human
cuugcguaugucugu

SEQ ID NO: 2284175 - RNA, 15 nt, Human
cuugcuaaucagugu

SEQ ID NO: 2284176 - RNA, 16 nt, Human
cuugcuaaucaguguc

SEQ ID NO: 2284177 - RNA, 17 nt, Human
cuugcuaaucagugucu

SEQ ID NO: 2284178 - RNA, 18 nt, Human
cuugcuaaucagugucuc

SEQ ID NO: 2284179 - RNA, 12 nt, Human
cuugcaaaguau

SEQ ID NO: 2284180 - RNA, 16 nt, Human
cuugcuaccucaaggg

SEQ ID NO: 2284181 - RNA, 14 nt, Human
cuugcuaccucagu

SEQ ID NO: 2284182 - RNA, 23 nt, Human
cuugcuaaucagugucucacacu

SEQ ID NO: 2284183 - RNA, 19 nt, Human
cuugcuaaucagugucuca

SEQ ID NO: 2284184 - RNA, 20 nt, Human
cuugcuaaucagugucucac

SEQ ID NO: 2284185 - RNA, 21 nt, Human
cuugcuaaucagugucucaca

SEQ ID NO: 2284186 - RNA, 22 nt, Human
cuugcuaaucagugucucacac

SEQ ID NO: 2284187 - RNA, 15 nt, Human
cuugcaaaaaggguc

SEQ ID NO: 2284188 - RNA, 12 nt, Human
cuugauuuuugc

SEQ ID NO: 2284189 - RNA, 14 nt, Human
cuugauuuugcaaa

SEQ ID NO: 2284190 - RNA, 16 nt, Human
cuugcaaaaaggguca

SEQ ID NO: 2284191 - RNA, 19 nt, Human
cuugauuuuagccuucucu

SEQ ID NO: 2284192 - RNA, 21 nt, Human
cuugauuuuagccuucucugu

SEQ ID NO: 2284193 - RNA, 20 nt, Human
cuugauuuuagccuucucug

SEQ ID NO: 2284194 - RNA, 12 nt, Human
cuugauucauaa

SEQ ID NO: 2284195 - RNA, 23 nt, Human
cuuggccucagaauucacaaaau

SEQ ID NO: 2284196 - RNA, 12 nt, Human
cuuggccucaga

SEQ ID NO: 2284197 - RNA, 17 nt, Human
cuuggccugaucagacc

SEQ ID NO: 2284198 - RNA, 12 nt, Human
cuuggccugcug

SEQ ID NO: 2284199 - RNA, 13 nt, Human
cuuggccugcugu

SEQ ID NO: 2284200 - RNA, 15 nt, Human
cuuggccugcuguga

SEQ ID NO: 2284201 - RNA, 16 nt, Human
cuuggccugcugugau

SEQ ID NO: 2284202 - RNA, 11 nt, Human
cuuggccucag

SEQ ID NO: 2284203 - RNA, 20 nt, Human
cuuggcaacagaagcaguug

SEQ ID NO: 2284204 - RNA, 13 nt, Human
cuuggcaacagaa

SEQ ID NO: 2284205 - RNA, 15 nt, Human
cuuggcaacagaagc

SEQ ID NO: 2284206 - RNA, 13 nt, Human
cuugcuaugauga

SEQ ID NO: 2284207 - RNA, 23 nt, Human
cuuggauuguccccgacccuugc

SEQ ID NO: 2284208 - RNA, 24 nt, Human
cuuggauuguccccgacccuugcc

SEQ ID NO: 2284209 - RNA, 23 nt, Human
cuugaaggaucuguuuuuaaaaa

SEQ ID NO: 2284210 - RNA, 13 nt, Human
cuugaagggccag

SEQ ID NO: 2284211 - RNA, 21 nt, Human
cuugaagggccagagccaggg

SEQ ID NO: 2284212 - RNA, 19 nt, Human
cuugaagggccagagccag

SEQ ID NO: 2284213 - RNA, 18 nt, Human
cuugaagggccagagcca

SEQ ID NO: 2284214 - RNA, 17 nt, Human
cuugaagggccagagcc

SEQ ID NO: 2284215 - RNA, 16 nt, Human
cuugaagggccagagc

SEQ ID NO: 2284216 - RNA, 15 nt, Human
cuugaagggccagag

SEQ ID NO: 2284217 - RNA, 14 nt, Human
cuugaagggccaga

SEQ ID NO: 2284218 - RNA, 16 nt, Human
cuugaaggguaaagaa

SEQ ID NO: 2284219 - RNA, 20 nt, Human
cuugaagggccagagccagg

SEQ ID NO: 2284220 - RNA, 22 nt, Human
cuugaaggugcugacggccagg

SEQ ID NO: 2284221 - RNA, 14 nt, Human
cuugaaggugcuga

SEQ ID NO: 2284222 - RNA, 20 nt, Human
cuugaauguggcuugagaaa

SEQ ID NO: 2284223 - RNA, 20 nt, Human
cuugaauuguaacuguucuu

SEQ ID NO: 2284224 - RNA, 17 nt, Human
cuugaauuguaacuguu

SEQ ID NO: 2284225 - RNA, 22 nt, Human
cuugaauguggcuugagaaaua

SEQ ID NO: 2284226 - RNA, 19 nt, Human
cuugaauguggcuugagaa

SEQ ID NO: 2284227 - RNA, 13 nt, Human
cuugaaugucuuu

SEQ ID NO: 2284228 - RNA, 11 nt, Human
cuugaccagca

SEQ ID NO: 2284229 - RNA, 23 nt, Human
cuugaccaagcaggaagcucaga

SEQ ID NO: 2284230 - RNA, 20 nt, Human
cuugaccaagcaggaagcuc

SEQ ID NO: 2284231 - RNA, 19 nt, Human
cuugaccaagcaggaagcu

SEQ ID NO: 2284232 - RNA, 18 nt, Human
cuugaccaagcaggaagc

SEQ ID NO: 2284233 - RNA, 17 nt, Human
cuugaccaagcaggaag

SEQ ID NO: 2284234 - RNA, 15 nt, Human
cuugaccaagcagga

SEQ ID NO: 2284235 - RNA, 12 nt, Human
cuugaccaagca

SEQ ID NO: 2284236 - RNA, 19 nt, Human
cuugacauaauuucacuga

SEQ ID NO: 2284237 - RNA, 14 nt, Human
cuugacauucaagg

SEQ ID NO: 2284238 - RNA, 22 nt, Human
cuugaauuguaacuguucuuga

SEQ ID NO: 2284239 - RNA, 21 nt, Human
cuugaauuguaacuguucuug

SEQ ID NO: 2284240 - RNA, 16 nt, Human
cuugacaucaacugca

SEQ ID NO: 2284241 - RNA, 20 nt, Human
cuugacagggcacaccgggc

SEQ ID NO: 2284242 - RNA, 18 nt, Human
cuugauucacaaugaaau

SEQ ID NO: 2284243 - RNA, 23 nt, Human
cuugauguugcuuagucacuuau

SEQ ID NO: 2284244 - RNA, 16 nt, Human
cuugauuauccauauu

SEQ ID NO: 2284245 - RNA, 20 nt, Human
cuugauuaagaucucagugg

SEQ ID NO: 2284246 - RNA, 14 nt, Human
cuugauguugcuua

SEQ ID NO: 2284247 - RNA, 18 nt, Human
cuugauguguuaucucuu

SEQ ID NO: 2284248 - RNA, 22 nt, Human
cuugaccagcagaucccagcuc

SEQ ID NO: 2284249 - RNA, 21 nt, Human
cuugaccagcagaucccagcu

SEQ ID NO: 2284250 - RNA, 20 nt, Human
cuugaccagcagaucccagc

SEQ ID NO: 2284251 - RNA, 19 nt, Human
cuugaccagcagaucccag

SEQ ID NO: 2284252 - RNA, 17 nt, Human
cuugaucaacaucuuuu

SEQ ID NO: 2284253 - RNA, 23 nt, Human
cuugaucaacaucuuuucuugcc

SEQ ID NO: 2284254 - RNA, 22 nt, Human
cuugauauccucuuugagugaa

SEQ ID NO: 2284255 - RNA, 17 nt, Human
cuugauauccucuuuga

SEQ ID NO: 2284256 - RNA, 20 nt, Human
cuucuuaauauaacugccuu

SEQ ID NO: 2284257 - RNA, 16 nt, Human
cuucuuaaucuuuuca

SEQ ID NO: 2284258 - RNA, 17 nt, Human
cuucuuaaucuuuucac

SEQ ID NO: 2284259 - RNA, 20 nt, Human
cuucuuaaucuuuucacaaa

SEQ ID NO: 2284260 - RNA, 23 nt, Human
cuucuuaaucuuuucacaaauaa

SEQ ID NO: 2284261 - RNA, 21 nt, Human
cuucuuaaucuuuucacaaau

SEQ ID NO: 2284262 - RNA, 22 nt, Human
cuucuuaaucuuuucacaaaua

SEQ ID NO: 2284263 - RNA, 18 nt, Human
cuucuuaauauaacugcc

SEQ ID NO: 2284264 - RNA, 21 nt, Human
cuucuuaaccccaguaagcca

SEQ ID NO: 2284265 - RNA, 21 nt, Human
cuucuuaaaugagaaggaauu

SEQ ID NO: 2284266 - RNA, 16 nt, Human
cuucuuaaaugagaag

SEQ ID NO: 2284267 - RNA, 21 nt, Human
cuucugaccacagcaucauuu

SEQ ID NO: 2284268 - RNA, 23 nt, Human
cuucugaccacacuuccugucca

SEQ ID NO: 2284269 - RNA, 18 nt, Human
cuucugaccacagcauca

SEQ ID NO: 2284270 - RNA, 19 nt, Human
cuucugaccacacuuccug

SEQ ID NO: 2284271 - RNA, 18 nt, Human
cuucugaccacacuuccu

SEQ ID NO: 2284272 - RNA, 17 nt, Human
cuucugaccacacuucc

SEQ ID NO: 2284273 - RNA, 15 nt, Human
cuucugaccacacuu

SEQ ID NO: 2284274 - RNA, 14 nt, Human
cuucugaccacacu

SEQ ID NO: 2284275 - RNA, 13 nt, Human
cuucucuuccugu

SEQ ID NO: 2284276 - RNA, 14 nt, Human
cuucucuuccugua

SEQ ID NO: 2284277 - RNA, 22 nt, Human
cuucucuuccuuuuaucaguag

SEQ ID NO: 2284278 - RNA, 15 nt, Human
cuucugaaugcugcu

SEQ ID NO: 2284279 - RNA, 16 nt, Human
cuucugaaugcugcua

SEQ ID NO: 2284280 - RNA, 19 nt, Human
cuucugaaugcugcuacuu

SEQ ID NO: 2284281 - RNA, 20 nt, Human
cuucuucagaagacacugca

SEQ ID NO: 2284282 - RNA, 16 nt, Human
cuucuucacccagcua

SEQ ID NO: 2284283 - RNA, 18 nt, Human
cuucuucacccagcuaau

SEQ ID NO: 2284284 - RNA, 22 nt, Human
cuucuucacccagcuaaucugu

SEQ ID NO: 2284285 - RNA, 23 nt, Human
cuucuucacccagcuaaucugua

SEQ ID NO: 2284286 - RNA, 13 nt, Human
cuucuuacaugca

SEQ ID NO: 2284287 - RNA, 21 nt, Human
cuucuuacaauaauucuauga

SEQ ID NO: 2284288 - RNA, 22 nt, Human
cuucuuauucucacuccaccac

SEQ ID NO: 2284289 - RNA, 20 nt, Human
cuucuuauucucacuccacc

SEQ ID NO: 2284290 - RNA, 14 nt, Human
cuucuuacaugcau

SEQ ID NO: 2284291 - RNA, 17 nt, Human
cuucuuauucucacucc

SEQ ID NO: 2284292 - RNA, 13 nt, Human
cuucuucaccauu

SEQ ID NO: 2284293 - RNA, 14 nt, Human
cuucuucacccagc

SEQ ID NO: 2284294 - RNA, 15 nt, Human
cuucuucacccagcu

SEQ ID NO: 2284295 - RNA, 13 nt, Human
cuucuucagagac

SEQ ID NO: 2284296 - RNA, 14 nt, Human
cuucuucagagacu

SEQ ID NO: 2284297 - RNA, 22 nt, Human
cuuccuccuuuucuuucucucu

SEQ ID NO: 2284298 - RNA, 16 nt, Human
cuuccucgcagagagg

SEQ ID NO: 2284299 - RNA, 18 nt, Human
cuuccucgcagagaggcc

SEQ ID NO: 2284300 - RNA, 19 nt, Human
cuuccucgcagagaggcca

SEQ ID NO: 2284301 - RNA, 18 nt, Human
cuuccucuagaagccaag

SEQ ID NO: 2284302 - RNA, 13 nt, Human
cuuccuccuggug

SEQ ID NO: 2284303 - RNA, 14 nt, Human
cuuccucuccaccc

SEQ ID NO: 2284304 - RNA, 15 nt, Human
cuuccucucuccaga

SEQ ID NO: 2284305 - RNA, 19 nt, Human
cuuccucuagaagccaagg

SEQ ID NO: 2284306 - RNA, 15 nt, Human
cuuccucugagccuu

SEQ ID NO: 2284307 - RNA, 14 nt, Human
cuuccucugagccu

SEQ ID NO: 2284308 - RNA, 13 nt, Human
cuuccucuccacu

SEQ ID NO: 2284309 - RNA, 14 nt, Human
cuuccucuccacug

SEQ ID NO: 2284310 - RNA, 15 nt, Human
cuuccucuccacugc

SEQ ID NO: 2284311 - RNA, 21 nt, Human
cuuccucuuuccaucuacccu

SEQ ID NO: 2284312 - RNA, 16 nt, Human
cuuccucugaggcuga

SEQ ID NO: 2284313 - RNA, 16 nt, Human
cuuccucucuccagau

SEQ ID NO: 2284314 - RNA, 12 nt, Human
cuuccucugagg

SEQ ID NO: 2284315 - RNA, 14 nt, Human
cuuccucugaggcu

SEQ ID NO: 2284316 - RNA, 22 nt, Human
cuuccucuuuccaucuacccuc

SEQ ID NO: 2284317 - RNA, 22 nt, Human
cuuccucugaggcugaaauuca

SEQ ID NO: 2284318 - RNA, 15 nt, Human
cuuccucugaggcug

SEQ ID NO: 2284319 - RNA, 19 nt, Human
cuuccucugaggcuggauc

SEQ ID NO: 2284320 - RNA, 16 nt, Human
cuucucuuaauuuaau

SEQ ID NO: 2284321 - RNA, 15 nt, Human
cuucucuuaauuuaa

SEQ ID NO: 2284322 - RNA, 14 nt, Human
cuucucuuaauuua

SEQ ID NO: 2284323 - RNA, 12 nt, Human
cuucucuuaauu

SEQ ID NO: 2284324 - RNA, 21 nt, Human
cuucucuguuccauugaaucu

SEQ ID NO: 2284325 - RNA, 17 nt, Human
cuucucuguucauuucc

SEQ ID NO: 2284326 - RNA, 14 nt, Human
cuucucuguucauu

SEQ ID NO: 2284327 - RNA, 22 nt, Human
cuucucugugaacgauuuagaa

SEQ ID NO: 2284328 - RNA, 13 nt, Human
cuucucuguucau

SEQ ID NO: 2284329 - RNA, 21 nt, Human
cuucucugugaacgauuuaga

SEQ ID NO: 2284330 - RNA, 15 nt, Human
cuucuaguuucccac

SEQ ID NO: 2284331 - RNA, 22 nt, Human
cuucuagguggcaaggcugugc

SEQ ID NO: 2284332 - RNA, 14 nt, Human
cuucuaguuuccca

SEQ ID NO: 2284333 - RNA, 16 nt, Human
cuucuaguuucccaca

SEQ ID NO: 2284334 - RNA, 20 nt, Human
cuucucacauuuauauuuuu

SEQ ID NO: 2284335 - RNA, 13 nt, Human
cuucucacauuua

SEQ ID NO: 2284336 - RNA, 15 nt, Human
cuucuaaaugcauau

SEQ ID NO: 2284337 - RNA, 20 nt, Human
cuucuagguggcaaggcugu

SEQ ID NO: 2284338 - RNA, 21 nt, Human
cuucuaggguuauugcauuug

SEQ ID NO: 2284339 - RNA, 13 nt, Human
cuucuaaaugcau

SEQ ID NO: 2284340 - RNA, 23 nt, Human
cuucuaaagguguugucccuucu

SEQ ID NO: 2284341 - RNA, 23 nt, Human
cuucuaaauggcaaaggaaggug

SEQ ID NO: 2284342 - RNA, 21 nt, Human
cuucuaaguaaaaccacagca

SEQ ID NO: 2284343 - RNA, 16 nt, Human
cuucuagguucuaaaa

SEQ ID NO: 2284344 - RNA, 13 nt, Human
cuuccugaagcug

SEQ ID NO: 2284345 - RNA, 18 nt, Human
cuuccugacacuuuaauu

SEQ ID NO: 2284346 - RNA, 15 nt, Human
cuuccugacacuuua

SEQ ID NO: 2284347 - RNA, 17 nt, Human
cuuccugacacuuuaau

SEQ ID NO: 2284348 - RNA, 16 nt, Human
cuuccugacacuuuaa

SEQ ID NO: 2284349 - RNA, 17 nt, Human
cuucuaaguaaaaccac

SEQ ID NO: 2284350 - RNA, 13 nt, Human
cuucuaaguaaaa

SEQ ID NO: 2284351 - RNA, 17 nt, Human
cuugggucccagggaag

SEQ ID NO: 2284352 - RNA, 20 nt, Human
cuugggguuuucaguaugaa

SEQ ID NO: 2284353 - RNA, 23 nt, Human
cuugggucccccacgugacagug

SEQ ID NO: 2284354 - RNA, 15 nt, Human
cuuggguggagaagc

SEQ ID NO: 2284355 - RNA, 17 nt, Human
cuuggguggagaagcca

SEQ ID NO: 2284356 - RNA, 18 nt, Human
cuuggguggagaagccau

SEQ ID NO: 2284357 - RNA, 15 nt, Human
cuuggguaggcggga

SEQ ID NO: 2284358 - RNA, 23 nt, Human
cuuggguucaagugauucuccug

SEQ ID NO: 2284359 - RNA, 17 nt, Human
cuuggguuuuuguuacc

SEQ ID NO: 2284360 - RNA, 14 nt, Human
cuuggguucugaua

SEQ ID NO: 2284361 - RNA, 21 nt, Human
cuuggguguaacaggucuccu

SEQ ID NO: 2284362 - RNA, 23 nt, Human
cuuggguggagaagccauugucu

SEQ ID NO: 2284363 - RNA, 19 nt, Human
cuuggguggagaagccauu

SEQ ID NO: 2284364 - RNA, 20 nt, Human
cuuggguggagaagccauug

SEQ ID NO: 2284365 - RNA, 22 nt, Human
cuuggguguaacaggucuccuc

SEQ ID NO: 2284366 - RNA, 23 nt, Human
cuugguacuacuagaugucuuua

SEQ ID NO: 2284367 - RNA, 15 nt, Human
cuugguaagaagccg

SEQ ID NO: 2284368 - RNA, 14 nt, Human
cuuggucacauaca

SEQ ID NO: 2284369 - RNA, 22 nt, Human
cuugguagaagcccuucuaccu

SEQ ID NO: 2284370 - RNA, 15 nt, Human
cuuggucuuauuuau

SEQ ID NO: 2284371 - RNA, 14 nt, Human
cuuggucaccagcu

SEQ ID NO: 2284372 - RNA, 16 nt, Human
cuuggucaccagcucc

SEQ ID NO: 2284373 - RNA, 16 nt, Human
cuugguccaggaaaug

SEQ ID NO: 2284374 - RNA, 19 nt, Human
cuuggucugugagaugcua

SEQ ID NO: 2284375 - RNA, 14 nt, Human
cuugguccugcugc

SEQ ID NO: 2284376 - RNA, 16 nt, Human
cuuggucugugagaug

SEQ ID NO: 2284377 - RNA, 14 nt, Human
cuugguguccuuuc

SEQ ID NO: 2284378 - RNA, 19 nt, Human
cuugguguccaccuggccc

SEQ ID NO: 2284379 - RNA, 17 nt, Human
cuugguguccaccuggc

SEQ ID NO: 2284380 - RNA, 16 nt, Human
cuugguguccaccugg

SEQ ID NO: 2284381 - RNA, 20 nt, Human
cuuggugucgggcaugacac

SEQ ID NO: 2284382 - RNA, 19 nt, Human
cuuggugucgggcaugaca

SEQ ID NO: 2284383 - RNA, 15 nt, Human
cuugguguccaccug

SEQ ID NO: 2284384 - RNA, 17 nt, Human
cuugguguaguugaacu

SEQ ID NO: 2284385 - RNA, 22 nt, Human
cuuggugaauuuuuuuuuccua

SEQ ID NO: 2284386 - RNA, 20 nt, Human
cuuggugaauuuuuuuuucc

SEQ ID NO: 2284387 - RNA, 15 nt, Human
cuuggucuucccagg

SEQ ID NO: 2284388 - RNA, 16 nt, Human
cuuggucuucccaggc

SEQ ID NO: 2284389 - RNA, 21 nt, Human
cuugguguccuuucccuccac

SEQ ID NO: 2284390 - RNA, 20 nt, Human
cuugguguccuuucccucca

SEQ ID NO: 2284391 - RNA, 17 nt, Human
cuugucuauuuuugucu

SEQ ID NO: 2284392 - RNA, 14 nt, Human
cuugucucaaugcu

SEQ ID NO: 2284393 - RNA, 16 nt, Human
cuugucucaaugcuca

SEQ ID NO: 2284394 - RNA, 17 nt, Human
cuugucucaaugcucau

SEQ ID NO: 2284395 - RNA, 18 nt, Human
cuugucucaaugcucaua

SEQ ID NO: 2284396 - RNA, 19 nt, Human
cuugucucaaugcucauaa

SEQ ID NO: 2284397 - RNA, 23 nt, Human
cuugucucaaugcucauaacgga

SEQ ID NO: 2284398 - RNA, 21 nt, Human
cuugugacauauuaugucuuc

SEQ ID NO: 2284399 - RNA, 12 nt, Human
cuugugacauau

SEQ ID NO: 2284400 - RNA, 19 nt, Human
cuugugacagauuauacag

SEQ ID NO: 2284401 - RNA, 20 nt, Human
cuugugacagauuauacaga

SEQ ID NO: 2284402 - RNA, 13 nt, Human
cuugugacccagc

SEQ ID NO: 2284403 - RNA, 17 nt, Human
cuugugacccagcacug

SEQ ID NO: 2284404 - RNA, 13 nt, Human
cuugucuuuggac

SEQ ID NO: 2284405 - RNA, 15 nt, Human
cuugucuuuggaccc

SEQ ID NO: 2284406 - RNA, 18 nt, Human
cuugucuuuggacccuga

SEQ ID NO: 2284407 - RNA, 19 nt, Human
cuugucuuuggacccugag

SEQ ID NO: 2284408 - RNA, 23 nt, Human
cuuucagaugucuucugccuguu

SEQ ID NO: 2284409 - RNA, 21 nt, Human
cuuucagaugucuucugccug

SEQ ID NO: 2284410 - RNA, 22 nt, Human
cuuucagaugucuucugccugu

SEQ ID NO: 2284411 - RNA, 16 nt, Human
cuuucagaugucuucu

SEQ ID NO: 2284412 - RNA, 17 nt, Human
cuuucagaugucuucug

SEQ ID NO: 2284413 - RNA, 19 nt, Human
cuuucagaugucuucugcc

SEQ ID NO: 2284414 - RNA, 20 nt, Human
cuuucagaugucuucugccu

SEQ ID NO: 2284415 - RNA, 15 nt, Human
cuuucacuauuuccu

SEQ ID NO: 2284416 - RNA, 12 nt, Human
cuuucagauguc

SEQ ID NO: 2284417 - RNA, 15 nt, Human
cuuucagaugucuuc

SEQ ID NO: 2284418 - RNA, 20 nt, Human
cuuuacaugggguuuucaau

SEQ ID NO: 2284419 - RNA, 17 nt, Human
cuuuacaugacacagcu

SEQ ID NO: 2284420 - RNA, 17 nt, Human
cuuuacaugcaauuuau

SEQ ID NO: 2284421 - RNA, 14 nt, Human
cuuuacaugcaauu

SEQ ID NO: 2284422 - RNA, 19 nt, Human
cuuuacaugcaauuuauua

SEQ ID NO: 2284423 - RNA, 23 nt, Human
cuuucaccccagggccugagccu

SEQ ID NO: 2284424 - RNA, 22 nt, Human
cuuucaccccagggccugagcc

SEQ ID NO: 2284425 - RNA, 14 nt, Human
cuuuaccaccccca

SEQ ID NO: 2284426 - RNA, 16 nt, Human
cuuuaccacccccaca

SEQ ID NO: 2284427 - RNA, 17 nt, Human
cuuuaccacccccacac

SEQ ID NO: 2284428 - RNA, 14 nt, Human
cuuucacccuuuuc

SEQ ID NO: 2284429 - RNA, 15 nt, Human
cuuucacccuuuucu

SEQ ID NO: 2284430 - RNA, 20 nt, Human
cuuucacccuuuucuguuug

SEQ ID NO: 2284431 - RNA, 20 nt, Human
cuugugcugaucgugcuaaa

SEQ ID NO: 2284432 - RNA, 16 nt, Human
cuugugccuggcucag

SEQ ID NO: 2284433 - RNA, 15 nt, Human
cuugugccuggcuca

SEQ ID NO: 2284434 - RNA, 21 nt, Human
cuugugcuggauggagcccag

SEQ ID NO: 2284435 - RNA, 22 nt, Human
cuugugcuggauggagcccagg

SEQ ID NO: 2284436 - RNA, 23 nt, Human
cuugugcuggauggagcccaggc

SEQ ID NO: 2284437 - RNA, 23 nt, Human
cuuuaaugucacaggcaggucca

SEQ ID NO: 2284438 - RNA, 15 nt, Human
cuugugcaguguuga

SEQ ID NO: 2284439 - RNA, 20 nt, Human
cuugugcagaaaacauuguu

SEQ ID NO: 2284440 - RNA, 21 nt, Human
cuugugcagaaaacauuguuc

SEQ ID NO: 2284441 - RNA, 17 nt, Human
cuugugcagaaaacauu

SEQ ID NO: 2284442 - RNA, 18 nt, Human
cuugugcagaaaacauug

SEQ ID NO: 2284443 - RNA, 19 nt, Human
cuugugcagaaaacauugu

SEQ ID NO: 2284444 - RNA, 19 nt, Human
cuugugccauagucacaug

SEQ ID NO: 2284445 - RNA, 14 nt, Human
cuugugccuggcuc

SEQ ID NO: 2284446 - RNA, 11 nt, Human
cuugugccaua

SEQ ID NO: 2284447 - RNA, 18 nt, Human
cuugugccaacacucaag

SEQ ID NO: 2284448 - RNA, 17 nt, Human
cuugugccacacccucc

SEQ ID NO: 2284449 - RNA, 23 nt, Human
cuuuaauuguuaagauaugaugu

SEQ ID NO: 2284450 - RNA, 19 nt, Human
cuuuaauucucuuucaaag

SEQ ID NO: 2284451 - RNA, 17 nt, Human
cuuuaauucucauguga

SEQ ID NO: 2284452 - RNA, 20 nt, Human
cuuuaauucucaugugaucc

SEQ ID NO: 2284453 - RNA, 21 nt, Human
cuuuacagguauuuauaauau

SEQ ID NO: 2284454 - RNA, 22 nt, Human
cuuuaauuuauuuuugcauggc

SEQ ID NO: 2284455 - RNA, 16 nt, Human
cuuuaauuuauuuuug

SEQ ID NO: 2284456 - RNA, 18 nt, Human
cuuuaauuuauuuuugca

SEQ ID NO: 2284457 - RNA, 19 nt, Human
cuuuaauuuauuuuugcau

SEQ ID NO: 2284458 - RNA, 21 nt, Human
cuuuaauuuauuuuugcaugg

SEQ ID NO: 2284459 - RNA, 18 nt, Human
cuuguggaauugggagcu

SEQ ID NO: 2284460 - RNA, 20 nt, Human
cuugugcuuuuccuauuugu

SEQ ID NO: 2284461 - RNA, 21 nt, Human
cuuguggaagcaaaaaucuga

SEQ ID NO: 2284462 - RNA, 19 nt, Human
cuuuaauuaccaaccuguu

SEQ ID NO: 2284463 - RNA, 18 nt, Human
cuuuaauuaccaaccugu

SEQ ID NO: 2284464 - RNA, 22 nt, Human
cuuuuauaacuaguccuuuacu

SEQ ID NO: 2284465 - RNA, 20 nt, Human
cuuuguaugucauuuccuuc

SEQ ID NO: 2284466 - RNA, 14 nt, Human
cuuuuauaauaaaa

SEQ ID NO: 2284467 - RNA, 21 nt, Human
cuuuuauaauaaaaggaaaag

SEQ ID NO: 2284468 - RNA, 19 nt, Human
cuuuuauaaacuuuaccuu

SEQ ID NO: 2284469 - RNA, 22 nt, Human
cuuuguauucucuccuguaccu

SEQ ID NO: 2284470 - RNA, 21 nt, Human
cuuuuauaaacuuuaccuuuu

SEQ ID NO: 2284471 - RNA, 20 nt, Human
cuuuuauaaacuuuaccuuu

SEQ ID NO: 2284472 - RNA, 14 nt, Human
cuuugguucagcua

SEQ ID NO: 2284473 - RNA, 20 nt, Human
cuuugauucuccuucagccc

SEQ ID NO: 2284474 - RNA, 16 nt, Human
cuuugcaaaggagcuc

SEQ ID NO: 2284475 - RNA, 15 nt, Human
cuuugcaaaggagcu

SEQ ID NO: 2284476 - RNA, 18 nt, Human
cuuugcacagcucuccgg

SEQ ID NO: 2284477 - RNA, 17 nt, Human
cuuugagacugggucuc

SEQ ID NO: 2284478 - RNA, 17 nt, Human
cuuugagacaguuucuu

SEQ ID NO: 2284479 - RNA, 18 nt, Human
cuuugagacaguuucuua

SEQ ID NO: 2284480 - RNA, 13 nt, Human
cuuugagacaguu

SEQ ID NO: 2284481 - RNA, 15 nt, Human
cuuugagacaguuuc

SEQ ID NO: 2284482 - RNA, 16 nt, Human
cuuugagacaguuucu

SEQ ID NO: 2284483 - RNA, 17 nt, Human
cuuugacuuuuugcauu

SEQ ID NO: 2284484 - RNA, 15 nt, Human
cuuugacuuuuugca

SEQ ID NO: 2284485 - RNA, 14 nt, Human
cuuugacuuuuugc

SEQ ID NO: 2284486 - RNA, 18 nt, Human
cuuugagauagaagaacu

SEQ ID NO: 2284487 - RNA, 15 nt, Human
cuuugauucuccuuc

SEQ ID NO: 2284488 - RNA, 19 nt, Human
cuuugagauagaagaacug

SEQ ID NO: 2284489 - RNA, 16 nt, Human
cuuugauucuccuuca

SEQ ID NO: 2284490 - RNA, 18 nt, Human
cuuugauucuccuucagc

SEQ ID NO: 2284491 - RNA, 19 nt, Human
cuuugauucuccuucagcc

SEQ ID NO: 2284492 - RNA, 22 nt, Human
cuuugauucuccuucagcccuc

SEQ ID NO: 2284493 - RNA, 11 nt, Human
cuuugguuuuu

SEQ ID NO: 2284494 - RNA, 17 nt, Human
cuuugguuuuuuucuuc

SEQ ID NO: 2284495 - RNA, 19 nt, Human
cuuugguuuuuuucuucug

SEQ ID NO: 2284496 - RNA, 21 nt, Human
cuuugguucuggccagaaugc

SEQ ID NO: 2284497 - RNA, 19 nt, Human
cuuugguucuggccagaau

SEQ ID NO: 2284498 - RNA, 14 nt, Human
cuuugguucuggcc

SEQ ID NO: 2284499 - RNA, 13 nt, Human
cuuugcacugagg

SEQ ID NO: 2284500 - RNA, 14 nt, Human
cuuuguaaugaaaa

SEQ ID NO: 2284501 - RNA, 15 nt, Human
cuuuguaaugaaaac

SEQ ID NO: 2284502 - RNA, 12 nt, Human
cuuuguaugcac

SEQ ID NO: 2284503 - RNA, 18 nt, Human
cuuuguauauuauuucua

SEQ ID NO: 2284504 - RNA, 17 nt, Human
cuuuguauucucuccug

SEQ ID NO: 2284505 - RNA, 17 nt, Human
cuuuguaaugucaccac

SEQ ID NO: 2284506 - RNA, 13 nt, Human
cuuuguaauggga

SEQ ID NO: 2284507 - RNA, 13 nt, Human
cuuuguaaugaaa

SEQ ID NO: 2284508 - RNA, 22 nt, Human
cuuuguaaugucaccaccuucc

SEQ ID NO: 2284509 - RNA, 21 nt, Human
cuuuguaaugucaccaccuuc

SEQ ID NO: 2284510 - RNA, 16 nt, Human
cuuuguaaugaaaacc

SEQ ID NO: 2284511 - RNA, 17 nt, Human
cuuucuaaugugugaau

SEQ ID NO: 2284512 - RNA, 17 nt, Human
cuuucuauuguacagaa

SEQ ID NO: 2284513 - RNA, 23 nt, Human
cuuucuacaguauuauguacucu

SEQ ID NO: 2284514 - RNA, 16 nt, Human
cuuucuauugaaaaau

SEQ ID NO: 2284515 - RNA, 15 nt, Human
cuuucuauuguacag

SEQ ID NO: 2284516 - RNA, 16 nt, Human
cuuucuauuguacaga

SEQ ID NO: 2284517 - RNA, 20 nt, Human
cuuucuacaaugugaacuuu

SEQ ID NO: 2284518 - RNA, 14 nt, Human
cuuucuacaggcca

SEQ ID NO: 2284519 - RNA, 18 nt, Human
cuuucuacaaugugaacu

SEQ ID NO: 2284520 - RNA, 15 nt, Human
cuuucuacaauguga

SEQ ID NO: 2284521 - RNA, 20 nt, Human
cuuucuacagggcugacauu

SEQ ID NO: 2284522 - RNA, 19 nt, Human
cuuucuacaguauuaugua

SEQ ID NO: 2284523 - RNA, 15 nt, Human
cuuucuacccagcga

SEQ ID NO: 2284524 - RNA, 16 nt, Human
cuuucuacccagcgag

SEQ ID NO: 2284525 - RNA, 21 nt, Human
cuuucucagccgcuucugacu

SEQ ID NO: 2284526 - RNA, 22 nt, Human
cuuucucagccgcuucugacug

SEQ ID NO: 2284527 - RNA, 15 nt, Human
cuuucucaguuuuca

SEQ ID NO: 2284528 - RNA, 20 nt, Human
cuuucucaguuuucauaagu

SEQ ID NO: 2284529 - RNA, 17 nt, Human
cuuucucaguuuucaua

SEQ ID NO: 2284530 - RNA, 16 nt, Human
cuuucucaguuuucau

SEQ ID NO: 2284531 - RNA, 20 nt, Human
cuuucucagccucugaauau

SEQ ID NO: 2284532 - RNA, 13 nt, Human
cuuucuccagcca

SEQ ID NO: 2284533 - RNA, 14 nt, Human
cuuucuccagccag

SEQ ID NO: 2284534 - RNA, 15 nt, Human
cuuucuccagccagc

SEQ ID NO: 2284535 - RNA, 16 nt, Human
cuuucuccagccagca

SEQ ID NO: 2284536 - RNA, 19 nt, Human
cuuucuccagccagcaaug

SEQ ID NO: 2284537 - RNA, 20 nt, Human
cuuucuccagccagcaauga

SEQ ID NO: 2284538 - RNA, 18 nt, Human
cuuucucccacugaguuu

SEQ ID NO: 2284539 - RNA, 20 nt, Human
cuuugaccugccucccuuca

SEQ ID NO: 2284540 - RNA, 14 nt, Human
cuuugaccuguugg

SEQ ID NO: 2284541 - RNA, 16 nt, Human
cuuugacugagcagac

SEQ ID NO: 2284542 - RNA, 21 nt, Human
cuuugacucuuuugccauuaa

SEQ ID NO: 2284543 - RNA, 19 nt, Human
cuuugacucaccuguuacu

SEQ ID NO: 2284544 - RNA, 23 nt, Human
cuuugaccugccucccuucaugc

SEQ ID NO: 2284545 - RNA, 16 nt, Human
cuuugacucaccuguu

SEQ ID NO: 2284546 - RNA, 16 nt, Human
cuuugacgccauccca

SEQ ID NO: 2284547 - RNA, 17 nt, Human
cuuugacgccaucccag

SEQ ID NO: 2284548 - RNA, 18 nt, Human
gaaccaccacacccagcc

SEQ ID NO: 2284549 - RNA, 20 nt, Human
gaaccaccacacccagccca

SEQ ID NO: 2284550 - RNA, 21 nt, Human
gaaccaccacacccagcccac

SEQ ID NO: 2284551 - RNA, 22 nt, Human
gaaccaccacacccagcccacu

SEQ ID NO: 2284552 - RNA, 23 nt, Human
gaaccaugucagcaaaaagcaaa

SEQ ID NO: 2284553 - RNA, 21 nt, Human
gaaccaugucagcaaaaagca

SEQ ID NO: 2284554 - RNA, 16 nt, Human
gaaccaugaagacagg

SEQ ID NO: 2284555 - RNA, 17 nt, Human
gaaccaugaagacagga

SEQ ID NO: 2284556 - RNA, 18 nt, Human
gaaccaugaagacaggau

SEQ ID NO: 2284557 - RNA, 22 nt, Human
gaaccauggucggaaaacaugc

SEQ ID NO: 2284558 - RNA, 18 nt, Human
gaaccagggagaccgagc

SEQ ID NO: 2284559 - RNA, 19 nt, Human
gaaccaguccccccacccu

SEQ ID NO: 2284560 - RNA, 19 nt, Human
gaaccaguuucagguguuu

SEQ ID NO: 2284561 - RNA, 20 nt, Human
gaaccaucauuauaaacgug

SEQ ID NO: 2284562 - RNA, 12 nt, Human
gaaccaucagaa

SEQ ID NO: 2284563 - RNA, 23 nt, Human
gaaccaccacacccagcccacuu

SEQ ID NO: 2284564 - RNA, 19 nt, Human
gaaccacuacaugcagccc

SEQ ID NO: 2284565 - RNA, 14 nt, Human
gaaccacuucccuc

SEQ ID NO: 2284566 - RNA, 23 nt, Human
gaaccagagccauggacucuaca

SEQ ID NO: 2284567 - RNA, 19 nt, Human
gaaccagagccauggacuc

SEQ ID NO: 2284568 - RNA, 12 nt, Human
gaaccagagcca

SEQ ID NO: 2284569 - RNA, 21 nt, Human
gaaccaggaaauggaacccca

SEQ ID NO: 2284570 - RNA, 23 nt, Human
gaaccagaugaguaaaggaguaa

SEQ ID NO: 2284571 - RNA, 13 nt, Human
gaaccaggagcug

SEQ ID NO: 2284572 - RNA, 14 nt, Human
gaacccaccugcug

SEQ ID NO: 2284573 - RNA, 13 nt, Human
gaacccaccugcu

SEQ ID NO: 2284574 - RNA, 12 nt, Human
gaacccaccugc

SEQ ID NO: 2284575 - RNA, 19 nt, Human
gaacccaccugcugagaga

SEQ ID NO: 2284576 - RNA, 15 nt, Human
gaacccaccugcuga

SEQ ID NO: 2284577 - RNA, 13 nt, Human
gaacccagacuca

SEQ ID NO: 2284578 - RNA, 19 nt, Human
gaacccagacucagacauu

SEQ ID NO: 2284579 - RNA, 17 nt, Human
gaacccagacucagaca

SEQ ID NO: 2284580 - RNA, 16 nt, Human
gaacccagacucagac

SEQ ID NO: 2284581 - RNA, 17 nt, Human
gaacccaaguccaagca

SEQ ID NO: 2284582 - RNA, 16 nt, Human
gaacccaaguccaagc

SEQ ID NO: 2284583 - RNA, 17 nt, Human
gaaccccaaggagggag

SEQ ID NO: 2284584 - RNA, 14 nt, Human
gaaccccccuccca

SEQ ID NO: 2284585 - RNA, 19 nt, Human
gaacccaggacgcuucuga

SEQ ID NO: 2284586 - RNA, 23 nt, Human
gaacccauuccauuuaucuuucu

SEQ ID NO: 2284587 - RNA, 16 nt, Human
gaacccaggaggugga

SEQ ID NO: 2284588 - RNA, 15 nt, Human
gaacccaggacgcuu

SEQ ID NO: 2284589 - RNA, 17 nt, Human
gaacccaggacgcuucu

SEQ ID NO: 2284590 - RNA, 22 nt, Human
gaaccccuggcuccaggccagg

SEQ ID NO: 2284591 - RNA, 17 nt, Human
gaaccccuucauccucu

SEQ ID NO: 2284592 - RNA, 21 nt, Human
gaaccccuacaugaaacagaa

SEQ ID NO: 2284593 - RNA, 18 nt, Human
gaaccccuggcuccaggc

SEQ ID NO: 2284594 - RNA, 20 nt, Human
gaaccccggggugcccacag

SEQ ID NO: 2284595 - RNA, 17 nt, Human
gaaccccccucccaccc

SEQ ID NO: 2284596 - RNA, 21 nt, Human
gaaccccccucccacccaccg

SEQ ID NO: 2284597 - RNA, 13 nt, Human
gaacugaaaucau

SEQ ID NO: 2284598 - RNA, 21 nt, Human
gaacugagcuccucugggcag

SEQ ID NO: 2284599 - RNA, 14 nt, Human
gaacugagcuugga

SEQ ID NO: 2284600 - RNA, 22 nt, Human
gaacugagcuuggaagcuucug

SEQ ID NO: 2284601 - RNA, 21 nt, Human
gaacugagcuuggaagcuucu

SEQ ID NO: 2284602 - RNA, 16 nt, Human
gaacugagcuuggaag

SEQ ID NO: 2284603 - RNA, 15 nt, Human
gaacugagcuuggaa

SEQ ID NO: 2284604 - RNA, 19 nt, Human
gaacugauaguuacuguug

SEQ ID NO: 2284605 - RNA, 13 nt, Human
gaacugauaguua

SEQ ID NO: 2284606 - RNA, 16 nt, Human
gaacugcagaccuguc

SEQ ID NO: 2284607 - RNA, 17 nt, Human
gaacugcagaccugucc

SEQ ID NO: 2284608 - RNA, 18 nt, Human
gaacugcagaccuguccu

SEQ ID NO: 2284609 - RNA, 19 nt, Human
gaacugcagaccuguccuc

SEQ ID NO: 2284610 - RNA, 12 nt, Human
gaacugcaggcc

SEQ ID NO: 2284611 - RNA, 14 nt, Human
gaacugcaggcccu

SEQ ID NO: 2284612 - RNA, 16 nt, Human
gaacugcaggcccugg

SEQ ID NO: 2284613 - RNA, 17 nt, Human
gaacugcaggcccuggc

SEQ ID NO: 2284614 - RNA, 18 nt, Human
gaacugcaggcccuggcc

SEQ ID NO: 2284615 - RNA, 19 nt, Human
gaacugcaggcccuggccu

SEQ ID NO: 2284616 - RNA, 21 nt, Human
gaacugcaggcccuggccucc

SEQ ID NO: 2284617 - RNA, 23 nt, Human
gaacugcaggcccuggccucccc

SEQ ID NO: 2284618 - RNA, 13 nt, Human
gaacuccuggccu

SEQ ID NO: 2284619 - RNA, 14 nt, Human
gaacuccugaccuc

SEQ ID NO: 2284620 - RNA, 15 nt, Human
gaacuccugaccuca

SEQ ID NO: 2284621 - RNA, 19 nt, Human
gaacccgggaggcagaggu

SEQ ID NO: 2284622 - RNA, 17 nt, Human
gaacccgggaggcagag

SEQ ID NO: 2284623 - RNA, 20 nt, Human
gaacuccuggaaauaucagu

SEQ ID NO: 2284624 - RNA, 19 nt, Human
gaaccccgucgaggggcuc

SEQ ID NO: 2284625 - RNA, 19 nt, Human
gaacucuggcuuccaggua

SEQ ID NO: 2284626 - RNA, 15 nt, Human
gaacuccuggccuca

SEQ ID NO: 2284627 - RNA, 17 nt, Human
gaacucuggcuuccagg

SEQ ID NO: 2284628 - RNA, 14 nt, Human
gaacuccuggccuc

SEQ ID NO: 2284629 - RNA, 18 nt, Human
gaacucugggcugccaug

SEQ ID NO: 2284630 - RNA, 20 nt, Human
gaacucuggcuuccagguau

SEQ ID NO: 2284631 - RNA, 13 nt, Human
gaacucuuaauca

SEQ ID NO: 2284632 - RNA, 20 nt, Human
gaacucuuaaucaaauagca

SEQ ID NO: 2284633 - RNA, 15 nt, Human
gaacucuuagaaaug

SEQ ID NO: 2284634 - RNA, 18 nt, Human
gaacucuuagaaaugaag

SEQ ID NO: 2284635 - RNA, 22 nt, Human
gaagacauggggaggaaggaca

SEQ ID NO: 2284636 - RNA, 12 nt, Human
gaagacauguuu

SEQ ID NO: 2284637 - RNA, 15 nt, Human
gaagacauggagacu

SEQ ID NO: 2284638 - RNA, 20 nt, Human
gaagacauggagacuccugc

SEQ ID NO: 2284639 - RNA, 21 nt, Human
gaagacauggagacuccugcc

SEQ ID NO: 2284640 - RNA, 15 nt, Human
gaagacaggacagug

SEQ ID NO: 2284641 - RNA, 21 nt, Human
gaagacagagaccuccugccu

SEQ ID NO: 2284642 - RNA, 18 nt, Human
gaagacaugaaccaagug

SEQ ID NO: 2284643 - RNA, 14 nt, Human
gaagacagcucuua

SEQ ID NO: 2284644 - RNA, 15 nt, Human
gaagacagcucuuau

SEQ ID NO: 2284645 - RNA, 14 nt, Human
gaagaccccaccca

SEQ ID NO: 2284646 - RNA, 14 nt, Human
gaagacccuccccg

SEQ ID NO: 2284647 - RNA, 15 nt, Human
gaagaccccacccaa

SEQ ID NO: 2284648 - RNA, 16 nt, Human
gaagaccccacccaag

SEQ ID NO: 2284649 - RNA, 18 nt, Human
gaagacauguuuuagaca

SEQ ID NO: 2284650 - RNA, 23 nt, Human
gaagaccaaucucuugaauccca

SEQ ID NO: 2284651 - RNA, 14 nt, Human
gaagaccacaucca

SEQ ID NO: 2284652 - RNA, 20 nt, Human
gaagaccacauccacacacg

SEQ ID NO: 2284653 - RNA, 21 nt, Human
gaagaccacauccacacacgc

SEQ ID NO: 2284654 - RNA, 22 nt, Human
gaagaccacauccacacacgca

SEQ ID NO: 2284655 - RNA, 18 nt, Human
gaagaccagacuguggag

SEQ ID NO: 2284656 - RNA, 20 nt, Human
gaagaccagcuuugcaguga

SEQ ID NO: 2284657 - RNA, 22 nt, Human
gaagaccugcugagggaccagc

SEQ ID NO: 2284658 - RNA, 20 nt, Human
gaagaccucaccuagaaauu

SEQ ID NO: 2284659 - RNA, 22 nt, Human
gaagaccuggcaaggacacaga

SEQ ID NO: 2284660 - RNA, 18 nt, Human
gaagaccccacccaagcu

SEQ ID NO: 2284661 - RNA, 19 nt, Human
gaagaccucaccuagaaau

SEQ ID NO: 2284662 - RNA, 21 nt, Human
gaagacacugaaauauacaca

SEQ ID NO: 2284663 - RNA, 19 nt, Human
gaacugcaugcugcuggac

SEQ ID NO: 2284664 - RNA, 18 nt, Human
gaagacagagaccuccug

SEQ ID NO: 2284665 - RNA, 21 nt, Human
gaagacacugaugggcaaccc

SEQ ID NO: 2284666 - RNA, 21 nt, Human
gaacugcauauguuucgcuga

SEQ ID NO: 2284667 - RNA, 15 nt, Human
gaacugcauauguuu

SEQ ID NO: 2284668 - RNA, 15 nt, Human
gaacugcaugcugcu

SEQ ID NO: 2284669 - RNA, 16 nt, Human
gaagacacugaugggc

SEQ ID NO: 2284670 - RNA, 13 nt, Human
gaagacagagcua

SEQ ID NO: 2284671 - RNA, 15 nt, Human
gaagacagagcuaca

SEQ ID NO: 2284672 - RNA, 12 nt, Human
gaagacagcucu

SEQ ID NO: 2284673 - RNA, 13 nt, Human
gaagacagcucuu

SEQ ID NO: 2284674 - RNA, 18 nt, Human
gaagcagguugaggggcu

SEQ ID NO: 2284675 - RNA, 19 nt, Human
gaagcagguucccaagcuc

SEQ ID NO: 2284676 - RNA, 12 nt, Human
gaagcagguucc

SEQ ID NO: 2284677 - RNA, 22 nt, Human
gaagcagguugaggggcuccug

SEQ ID NO: 2284678 - RNA, 19 nt, Human
gaagcagguugaggggcuc

SEQ ID NO: 2284679 - RNA, 23 nt, Human
gaagcagguugaggggcuccugg

SEQ ID NO: 2284680 - RNA, 15 nt, Human
gaagcagugagccgc

SEQ ID NO: 2284681 - RNA, 15 nt, Human
gaagcaggcuggagg

SEQ ID NO: 2284682 - RNA, 19 nt, Human
gaagcaggcuacacugaca

SEQ ID NO: 2284683 - RNA, 23 nt, Human
gaagcaggcuacacugacacugg

SEQ ID NO: 2284684 - RNA, 12 nt, Human
gaagcaggcugg

SEQ ID NO: 2284685 - RNA, 13 nt, Human
gaagcaggcugga

SEQ ID NO: 2284686 - RNA, 12 nt, Human
gaagcagcucuu

SEQ ID NO: 2284687 - RNA, 14 nt, Human
gaagcaggcuacac

SEQ ID NO: 2284688 - RNA, 18 nt, Human
gaagcaggcuacacugac

SEQ ID NO: 2284689 - RNA, 23 nt, Human
gaagcagaugcaaagaggcaaga

SEQ ID NO: 2284690 - RNA, 12 nt, Human
gaagcagccucu

SEQ ID NO: 2284691 - RNA, 22 nt, Human
gaagcagccucuccccaggucc

SEQ ID NO: 2284692 - RNA, 21 nt, Human
gaagcaccccaugccaaagcu

SEQ ID NO: 2284693 - RNA, 16 nt, Human
gaagcaccccaugcca

SEQ ID NO: 2284694 - RNA, 19 nt, Human
gaagcacuguuccagccug

SEQ ID NO: 2284695 - RNA, 16 nt, Human
gaagcaccauaacuuu

SEQ ID NO: 2284696 - RNA, 14 nt, Human
gaagcacauguuua

SEQ ID NO: 2284697 - RNA, 21 nt, Human
gaagcacaugccucucucagg

SEQ ID NO: 2284698 - RNA, 13 nt, Human
gaagcacagcuuc

SEQ ID NO: 2284699 - RNA, 14 nt, Human
gaagcacagcuuca

SEQ ID NO: 2284700 - RNA, 14 nt, Human
gaagcacaugccuc

SEQ ID NO: 2284701 - RNA, 22 nt, Human
gaagcacaugccucucucaggc

SEQ ID NO: 2284702 - RNA, 17 nt, Human
gaagacucauucuucug

SEQ ID NO: 2284703 - RNA, 18 nt, Human
gaagacucauucuucugu

SEQ ID NO: 2284704 - RNA, 16 nt, Human
gaagacucauucuucu

SEQ ID NO: 2284705 - RNA, 14 nt, Human
gaagacgaggcccu

SEQ ID NO: 2284706 - RNA, 22 nt, Human
gaagacgaggcccucgggccca

SEQ ID NO: 2284707 - RNA, 23 nt, Human
gaagacgaggcccucgggcccag

SEQ ID NO: 2284708 - RNA, 15 nt, Human
gaagacgccugagcu

SEQ ID NO: 2284709 - RNA, 16 nt, Human
gaagacgccugagcuc

SEQ ID NO: 2284710 - RNA, 21 nt, Human
gaaacaacagcuuuaaaagaa

SEQ ID NO: 2284711 - RNA, 15 nt, Human
gaaacaacagcuuua

SEQ ID NO: 2284712 - RNA, 15 nt, Human
gaaacaaagcuuagc

SEQ ID NO: 2284713 - RNA, 19 nt, Human
gaaacaaagcuuagcagga

SEQ ID NO: 2284714 - RNA, 22 nt, Human
gaaacaaagcuuagcaggagag

SEQ ID NO: 2284715 - RNA, 16 nt, Human
gaaaauuauuugcaua

SEQ ID NO: 2284716 - RNA, 17 nt, Human
gaaaauuauuuuaaaca

SEQ ID NO: 2284717 - RNA, 17 nt, Human
gaaaauucaaaaagugu

SEQ ID NO: 2284718 - RNA, 14 nt, Human
gaaacaaagaaggu

SEQ ID NO: 2284719 - RNA, 19 nt, Human
gaaaauucaaaaaguguuu

SEQ ID NO: 2284720 - RNA, 20 nt, Human
gaaaauucaaaaaguguuua

SEQ ID NO: 2284721 - RNA, 21 nt, Human
gaaaauucaaaaaguguuuau

SEQ ID NO: 2284722 - RNA, 22 nt, Human
gaaaauucaaaaaguguuuauu

SEQ ID NO: 2284723 - RNA, 14 nt, Human
gaaacaacuuggaa

SEQ ID NO: 2284724 - RNA, 20 nt, Human
gaaacaacucuuugagaaac

SEQ ID NO: 2284725 - RNA, 17 nt, Human
gaaacaacucuuugaga

SEQ ID NO: 2284726 - RNA, 16 nt, Human
gaaaaaaaugacuaaa

SEQ ID NO: 2284727 - RNA, 19 nt, Human
gaaaaaacaccuagcuuua

SEQ ID NO: 2284728 - RNA, 16 nt, Human
gaaaaaagagaaaaga

SEQ ID NO: 2284729 - RNA, 10 nt, Human
gaaaaaagag

SEQ ID NO: 2284730 - RNA, 18 nt, Human
gaaaaaagagaaaagaaa

SEQ ID NO: 2284731 - RNA, 17 nt, Human
gaaaaaagagaaaagaa

SEQ ID NO: 2284732 - RNA, 17 nt, Human
gaaaaaauaacacacau

SEQ ID NO: 2284733 - RNA, 23 nt, Human
gaaaaaaguuguaggcgaaucau

SEQ ID NO: 2284734 - RNA, 22 nt, Human
gaaaaaaguuguaggcgaauca

SEQ ID NO: 2284735 - RNA, 14 nt, Human
gaaaaaaguuguag

SEQ ID NO: 2284736 - RNA, 19 nt, Human
gaaaacuuguauuaugugu

SEQ ID NO: 2284737 - RNA, 22 nt, Human
gaaaacuuguauuauguguguu

SEQ ID NO: 2284738 - RNA, 21 nt, Human
gaaaaaauaauugauuucaag

SEQ ID NO: 2284739 - RNA, 18 nt, Human
gaaaacuuguauuaugug

SEQ ID NO: 2284740 - RNA, 21 nt, Human
gaaaacuuuaugcuaagugaa

SEQ ID NO: 2284741 - RNA, 23 nt, Human
gaaaagaaaaaugagccuggcaa

SEQ ID NO: 2284742 - RNA, 20 nt, Human
gaaaagauacgacuuuauuu

SEQ ID NO: 2284743 - RNA, 19 nt, Human
gaaaagauacgacuuuauu

SEQ ID NO: 2284744 - RNA, 16 nt, Human
gaaaagauacgacuuu

SEQ ID NO: 2284745 - RNA, 21 nt, Human
gaaaagaggaguuucgaggua

SEQ ID NO: 2284746 - RNA, 22 nt, Human
gaaaagauacgacuuuauuuuc

SEQ ID NO: 2284747 - RNA, 18 nt, Human
gaaaagacuccaaagaaa

SEQ ID NO: 2284748 - RNA, 14 nt, Human
gaaaagagauggcc

SEQ ID NO: 2284749 - RNA, 21 nt, Human
gaaaagagauggccugagaag

SEQ ID NO: 2284750 - RNA, 12 nt, Human
gaaaagaggagu

SEQ ID NO: 2284751 - RNA, 20 nt, Human
gaaaagaggaguuucgaggu

SEQ ID NO: 2284752 - RNA, 13 nt, Human
gaaaagauaaaga

SEQ ID NO: 2284753 - RNA, 17 nt, Human
gaaaagacuccaaagaa

SEQ ID NO: 2284754 - RNA, 16 nt, Human
gaaaagacuccaaaga

SEQ ID NO: 2284755 - RNA, 18 nt, Human
gaaaagaauacagaaaga

SEQ ID NO: 2284756 - RNA, 16 nt, Human
gaaaagaauacagaaa

SEQ ID NO: 2284757 - RNA, 22 nt, Human
gaaaagaaaucuaugauuccag

SEQ ID NO: 2284758 - RNA, 19 nt, Human
gaaaagaauacagaaagau

SEQ ID NO: 2284759 - RNA, 14 nt, Human
gaaaagacuccaaa

SEQ ID NO: 2284760 - RNA, 21 nt, Human
gaaaagauguagauuuauuuc

SEQ ID NO: 2284761 - RNA, 17 nt, Human
gaaaagauuuuaaucaa

SEQ ID NO: 2284762 - RNA, 13 nt, Human
gaaaagauuuuaa

SEQ ID NO: 2284763 - RNA, 23 nt, Human
gaaaagauuuuaaucaaguugaa

SEQ ID NO: 2284764 - RNA, 19 nt, Human
gaaaagauguagauuuauu

SEQ ID NO: 2284765 - RNA, 18 nt, Human
gaaaagauguagauuuau

SEQ ID NO: 2284766 - RNA, 17 nt, Human
gaaaagauguagauuua

SEQ ID NO: 2284767 - RNA, 14 nt, Human
gaaaagauguagau

SEQ ID NO: 2284768 - RNA, 14 nt, Human
gaaaagcaccugcc

SEQ ID NO: 2284769 - RNA, 23 nt, Human
gaaaaugucagaaaccaguuaug

SEQ ID NO: 2284770 - RNA, 14 nt, Human
gaaaaugucuugug

SEQ ID NO: 2284771 - RNA, 15 nt, Human
gaaaaugugugugug

SEQ ID NO: 2284772 - RNA, 12 nt, Human
gaaaaugugugu

SEQ ID NO: 2284773 - RNA, 16 nt, Human
gaaaauguuauuuaac

SEQ ID NO: 2284774 - RNA, 15 nt, Human
gaaaauguuauuuaa

SEQ ID NO: 2284775 - RNA, 23 nt, Human
gaaaaugucuauucaaaauauca

SEQ ID NO: 2284776 - RNA, 20 nt, Human
gaaaauguugagaaucccaa

SEQ ID NO: 2284777 - RNA, 17 nt, Human
gaaaauguugagaaucc

SEQ ID NO: 2284778 - RNA, 15 nt, Human
gaaaauguugagaau

SEQ ID NO: 2284779 - RNA, 15 nt, Human
gaaaauuauuugcau

SEQ ID NO: 2284780 - RNA, 18 nt, Human
gaaaucccuguuuaauau

SEQ ID NO: 2284781 - RNA, 21 nt, Human
gaaaggggagagccugcuggc

SEQ ID NO: 2284782 - RNA, 19 nt, Human
gaaaucccuguuuaauauu

SEQ ID NO: 2284783 - RNA, 21 nt, Human
gaaaucccuguuuaauauuua

SEQ ID NO: 2284784 - RNA, 22 nt, Human
gaaaucccuguuuaauauuuaa

SEQ ID NO: 2284785 - RNA, 23 nt, Human
gaaaucccuguuuaauauuuaaa

SEQ ID NO: 2284786 - RNA, 12 nt, Human
gaaaucucaccc

SEQ ID NO: 2284787 - RNA, 20 nt, Human
gaaaucuaugauuccaggug

SEQ ID NO: 2284788 - RNA, 15 nt, Human
gaaaucuaguauuuc

SEQ ID NO: 2284789 - RNA, 18 nt, Human
gaaaucuaugauuccagg

SEQ ID NO: 2284790 - RNA, 15 nt, Human
gaaagggcccagaga

SEQ ID NO: 2284791 - RNA, 16 nt, Human
gaaagggcccagagag

SEQ ID NO: 2284792 - RNA, 16 nt, Human
gaaaggggagcccacu

SEQ ID NO: 2284793 - RNA, 15 nt, Human
gaaaggggagcccac

SEQ ID NO: 2284794 - RNA, 13 nt, Human
gaaaggggagccc

SEQ ID NO: 2284795 - RNA, 18 nt, Human
gaaaggggagagccugcu

SEQ ID NO: 2284796 - RNA, 20 nt, Human
gaaaggggagagccugcugg

SEQ ID NO: 2284797 - RNA, 20 nt, Human
gaaagggcaacaauaaaaua

SEQ ID NO: 2284798 - RNA, 15 nt, Human
gaaaggggagagccu

SEQ ID NO: 2284799 - RNA, 13 nt, Human
gaaaugaaagaaa

SEQ ID NO: 2284800 - RNA, 16 nt, Human
gaaaugaaaacaugua

SEQ ID NO: 2284801 - RNA, 20 nt, Human
gaaaucugugccugagaaca

SEQ ID NO: 2284802 - RNA, 19 nt, Human
gaaaucuuacagcugggug

SEQ ID NO: 2284803 - RNA, 14 nt, Human
gaaaucuuuuaaaa

SEQ ID NO: 2284804 - RNA, 11 nt, Human
gaaaugaaaaa

SEQ ID NO: 2284805 - RNA, 19 nt, Human
gaaaucucacuuuucucca

SEQ ID NO: 2284806 - RNA, 22 nt, Human
gaaaucuguaucuguagugaga

SEQ ID NO: 2284807 - RNA, 19 nt, Human
gaaaugaaaacauguaaua

SEQ ID NO: 2284808 - RNA, 16 nt, Human
gaacaaaaaaaucugc

SEQ ID NO: 2284809 - RNA, 21 nt, Human
gaacaaaaaaaucugcagaag

SEQ ID NO: 2284810 - RNA, 19 nt, Human
gaacaaaaaaaucugcaga

SEQ ID NO: 2284811 - RNA, 14 nt, Human
gaacaaagcagcca

SEQ ID NO: 2284812 - RNA, 16 nt, Human
gaacaaagcagccacg

SEQ ID NO: 2284813 - RNA, 15 nt, Human
gaacaaagcagccac

SEQ ID NO: 2284814 - RNA, 19 nt, Human
gaacaaagcagccacgagg

SEQ ID NO: 2284815 - RNA, 22 nt, Human
gaacaaaggacagaguaugaac

SEQ ID NO: 2284816 - RNA, 15 nt, Human
gaacaaagugagaca

SEQ ID NO: 2284817 - RNA, 21 nt, Human
gaacaccagagaccucaaauu

SEQ ID NO: 2284818 - RNA, 20 nt, Human
gaacacauaauucaggaagc

SEQ ID NO: 2284819 - RNA, 17 nt, Human
gaacacauaauucagga

SEQ ID NO: 2284820 - RNA, 15 nt, Human
gaacacagaaagccu

SEQ ID NO: 2284821 - RNA, 17 nt, Human
gaacacaggcaaaaucc

SEQ ID NO: 2284822 - RNA, 14 nt, Human
gaacacacuccauc

SEQ ID NO: 2284823 - RNA, 14 nt, Human
gaacacacuguguc

SEQ ID NO: 2284824 - RNA, 16 nt, Human
gaacacacuguguccu

SEQ ID NO: 2284825 - RNA, 22 nt, Human
gaacacacuguguccuggugcu

SEQ ID NO: 2284826 - RNA, 19 nt, Human
gaacacaaacuguaaauaa

SEQ ID NO: 2284827 - RNA, 19 nt, Human
gaacaauauugacuuuguc

SEQ ID NO: 2284828 - RNA, 20 nt, Human
gaacaauauugacuuugucu

SEQ ID NO: 2284829 - RNA, 21 nt, Human
gaacaaugugcuaugugaaga

SEQ ID NO: 2284830 - RNA, 14 nt, Human
gaacaaucaaagca

SEQ ID NO: 2284831 - RNA, 17 nt, Human
gaacacaaacuguaaau

SEQ ID NO: 2284832 - RNA, 19 nt, Human
gaacaaguuguuucauuga

SEQ ID NO: 2284833 - RNA, 21 nt, Human
gaacaaguuguuucauugacu

SEQ ID NO: 2284834 - RNA, 14 nt, Human
gaacacccucgaag

SEQ ID NO: 2284835 - RNA, 16 nt, Human
gaacacccuauauuuu

SEQ ID NO: 2284836 - RNA, 21 nt, Human
gaacacccgacuccucaaaag

SEQ ID NO: 2284837 - RNA, 22 nt, Human
gaacacggccacaucaaagagg

SEQ ID NO: 2284838 - RNA, 14 nt, Human
gaacacggccacau

SEQ ID NO: 2284839 - RNA, 16 nt, Human
gaacacucaugcugaa

SEQ ID NO: 2284840 - RNA, 13 nt, Human
gaacacuagccag

SEQ ID NO: 2284841 - RNA, 22 nt, Human
gaacacguccagaauuuuucau

SEQ ID NO: 2284842 - RNA, 16 nt, Human
gaacacuaaccugacc

SEQ ID NO: 2284843 - RNA, 22 nt, Human
gaacacuaaccugaccgugggc

SEQ ID NO: 2284844 - RNA, 18 nt, Human
gaacacuccaauuaagga

SEQ ID NO: 2284845 - RNA, 17 nt, Human
gaacacucaugcugaaa

SEQ ID NO: 2284846 - RNA, 21 nt, Human
gaaacugcuuguuuccuagca

SEQ ID NO: 2284847 - RNA, 17 nt, Human
gaaacuggauuaaacuu

SEQ ID NO: 2284848 - RNA, 13 nt, Human
gaaacuggauuaa

SEQ ID NO: 2284849 - RNA, 15 nt, Human
gaaagaaagaaggaa

SEQ ID NO: 2284850 - RNA, 22 nt, Human
gaaagaaacccgacagagggaa

SEQ ID NO: 2284851 - RNA, 21 nt, Human
gaaagaaacccgacagaggga

SEQ ID NO: 2284852 - RNA, 17 nt, Human
gaaagaaaauaugcauc

SEQ ID NO: 2284853 - RNA, 16 nt, Human
gaaagaaaauaugcau

SEQ ID NO: 2284854 - RNA, 18 nt, Human
gaaacuguagucucagga

SEQ ID NO: 2284855 - RNA, 18 nt, Human
gaaagaaaaucaggcugg

SEQ ID NO: 2284856 - RNA, 17 nt, Human
gaaacuggcacugaauu

SEQ ID NO: 2284857 - RNA, 17 nt, Human
gaaacuggguuccugca

SEQ ID NO: 2284858 - RNA, 19 nt, Human
gaaagaacauggacuugua

SEQ ID NO: 2284859 - RNA, 20 nt, Human
gaaagaacauggacuuguau

SEQ ID NO: 2284860 - RNA, 23 nt, Human
gaaagaacauggacuuguauauu

SEQ ID NO: 2284861 - RNA, 22 nt, Human
gaaagaaaguugcacggcugcu

SEQ ID NO: 2284862 - RNA, 23 nt, Human
gaaagaaaguugcacggcugcug

SEQ ID NO: 2284863 - RNA, 13 nt, Human
gaaaggcuccagg

SEQ ID NO: 2284864 - RNA, 14 nt, Human
gaaaggcuccagga

SEQ ID NO: 2284865 - RNA, 15 nt, Human
gaaaggcuccaggag

SEQ ID NO: 2284866 - RNA, 13 nt, Human
gaaagggcccaga

SEQ ID NO: 2284867 - RNA, 16 nt, Human
gaaaggcuccaggagc

SEQ ID NO: 2284868 - RNA, 14 nt, Human
cuguuggcuggggg

SEQ ID NO: 2284869 - RNA, 14 nt, Human
cuguugguuccaag

SEQ ID NO: 2284870 - RNA, 20 nt, Human
cuguugguuccaagcccugg

SEQ ID NO: 2284871 - RNA, 16 nt, Human
cuguuguaacuaggcu

SEQ ID NO: 2284872 - RNA, 22 nt, Human
cuguugggguggguauaaaaga

SEQ ID NO: 2284873 - RNA, 23 nt, Human
cuguugggguggguauaaaagau

SEQ ID NO: 2284874 - RNA, 19 nt, Human
cuguuggcugggggccuca

SEQ ID NO: 2284875 - RNA, 22 nt, Human
cuguuggcugggggccucagug

SEQ ID NO: 2284876 - RNA, 22 nt, Human
cuguuguauaaauuuauuuacu

SEQ ID NO: 2284877 - RNA, 12 nt, Human
cuguugucauug

SEQ ID NO: 2284878 - RNA, 17 nt, Human
cuguuguuucuaaacaa

SEQ ID NO: 2284879 - RNA, 16 nt, Human
cuguuguuuuguuuua

SEQ ID NO: 2284880 - RNA, 20 nt, Human
cuguuguuuuguuuuaaaua

SEQ ID NO: 2284881 - RNA, 19 nt, Human
cuguuuaaauauuucaaga

SEQ ID NO: 2284882 - RNA, 22 nt, Human
cuguuuaaauauuucaagacau

SEQ ID NO: 2284883 - RNA, 22 nt, Human
cuguuguacauuuaugauuuaa

SEQ ID NO: 2284884 - RNA, 15 nt, Human
cuguuguacauuuau

SEQ ID NO: 2284885 - RNA, 17 nt, Human
cuguuguacauuuauga

SEQ ID NO: 2284886 - RNA, 18 nt, Human
cuguuguacauuuaugau

SEQ ID NO: 2284887 - RNA, 19 nt, Human
cuguuguacauuuaugauu

SEQ ID NO: 2284888 - RNA, 22 nt, Human
cuguuguaacuaggcucagaga

SEQ ID NO: 2284889 - RNA, 12 nt, Human
cuguuguacauu

SEQ ID NO: 2284890 - RNA, 13 nt, Human
cuguuguacauuu

SEQ ID NO: 2284891 - RNA, 14 nt, Human
cuguuguacauuua

SEQ ID NO: 2284892 - RNA, 20 nt, Human
cuguuuaaauguuuuucuau

SEQ ID NO: 2284893 - RNA, 23 nt, Human
cuguuuaaauguuuuucuaugua

SEQ ID NO: 2284894 - RNA, 12 nt, Human
cuguuuaagaga

SEQ ID NO: 2284895 - RNA, 14 nt, Human
cuguuuaagagaca

SEQ ID NO: 2284896 - RNA, 21 nt, Human
cuuaaaaaugguuuaaauggu

SEQ ID NO: 2284897 - RNA, 16 nt, Human
cuuacaagccagcugg

SEQ ID NO: 2284898 - RNA, 17 nt, Human
cuuacaagccagcugga

SEQ ID NO: 2284899 - RNA, 16 nt, Human
cuuacaauucccugcu

SEQ ID NO: 2284900 - RNA, 18 nt, Human
cuuacaagccuaagaauc

SEQ ID NO: 2284901 - RNA, 21 nt, Human
cuuacauuagcaguuugcuuu

SEQ ID NO: 2284902 - RNA, 22 nt, Human
cuuacauuagcaguuugcuuug

SEQ ID NO: 2284903 - RNA, 22 nt, Human
cuuacaauuuuuuuaauuuugu

SEQ ID NO: 2284904 - RNA, 23 nt, Human
cuuacaauuuuuuuaauuuugua

SEQ ID NO: 2284905 - RNA, 19 nt, Human
cuuacaauucccugcuguc

SEQ ID NO: 2284906 - RNA, 20 nt, Human
cuuacaauucccugcugucg

SEQ ID NO: 2284907 - RNA, 20 nt, Human
cuuacaauuuuuuuaauuuu

SEQ ID NO: 2284908 - RNA, 21 nt, Human
cuuacaauuuuuuuaauuuug

SEQ ID NO: 2284909 - RNA, 20 nt, Human
cuuacauuuuacuuuuuccu

SEQ ID NO: 2284910 - RNA, 14 nt, Human
cuuaccaacuuucu

SEQ ID NO: 2284911 - RNA, 14 nt, Human
cuuacauuuuuaca

SEQ ID NO: 2284912 - RNA, 17 nt, Human
cuuacauuuuuacaaua

SEQ ID NO: 2284913 - RNA, 15 nt, Human
cuuacauugugaaac

SEQ ID NO: 2284914 - RNA, 20 nt, Human
cuuacauuguucaauuagaa

SEQ ID NO: 2284915 - RNA, 12 nt, Human
cuuacauuuccu

SEQ ID NO: 2284916 - RNA, 13 nt, Human
cuuacauuuccug

SEQ ID NO: 2284917 - RNA, 15 nt, Human
cuuaccagcagagca

SEQ ID NO: 2284918 - RNA, 22 nt, Human
cuuacauuuuuacaauaaauaa

SEQ ID NO: 2284919 - RNA, 15 nt, Human
cuuaccaacuuucug

SEQ ID NO: 2284920 - RNA, 16 nt, Human
cuuaccaacuuucugu

SEQ ID NO: 2284921 - RNA, 17 nt, Human
cuuaccaacuuucugua

SEQ ID NO: 2284922 - RNA, 19 nt, Human
cuuaccaacuuucuguaaa

SEQ ID NO: 2284923 - RNA, 13 nt, Human
cuuaccagaagcu

SEQ ID NO: 2284924 - RNA, 21 nt, Human
cuuaccagauaaugcuacuuu

SEQ ID NO: 2284925 - RNA, 14 nt, Human
cuuaaaacaacacu

SEQ ID NO: 2284926 - RNA, 16 nt, Human
cuguuuaauauuuaaa

SEQ ID NO: 2284927 - RNA, 18 nt, Human
cuguuuaauauuuaaaca

SEQ ID NO: 2284928 - RNA, 20 nt, Human
cuguuuaauauuuaaacagc

SEQ ID NO: 2284929 - RNA, 15 nt, Human
cuuaaaaauguaaau

SEQ ID NO: 2284930 - RNA, 16 nt, Human
cuuaaaaauguaaaua

SEQ ID NO: 2284931 - RNA, 17 nt, Human
cuuaaaaauguaaauau

SEQ ID NO: 2284932 - RNA, 18 nt, Human
cuuaaaaauguaaauauu

SEQ ID NO: 2284933 - RNA, 21 nt, Human
cuuaauuuugguuguauucuu

SEQ ID NO: 2284934 - RNA, 23 nt, Human
cuuaauuuugguuguauucuuug

SEQ ID NO: 2284935 - RNA, 20 nt, Human
cuuaauuuugguuguauucu

SEQ ID NO: 2284936 - RNA, 22 nt, Human
cuuaaauaauaaagaucaugua

SEQ ID NO: 2284937 - RNA, 21 nt, Human
cuuaaauaauaaacaguggaa

SEQ ID NO: 2284938 - RNA, 13 nt, Human
cuuaaauaauaaa

SEQ ID NO: 2284939 - RNA, 13 nt, Human
cuuaaaaccaaag

SEQ ID NO: 2284940 - RNA, 12 nt, Human
cuguucacagcc

SEQ ID NO: 2284941 - RNA, 16 nt, Human
cuguuauuucuauuuu

SEQ ID NO: 2284942 - RNA, 12 nt, Human
cuguucaagagc

SEQ ID NO: 2284943 - RNA, 17 nt, Human
cuguucaauguuuaaug

SEQ ID NO: 2284944 - RNA, 21 nt, Human
cuguucaagagcacacuuggc

SEQ ID NO: 2284945 - RNA, 23 nt, Human
cuguucaagagcacacuuggccc

SEQ ID NO: 2284946 - RNA, 17 nt, Human
cuguuauuucuauuuuu

SEQ ID NO: 2284947 - RNA, 20 nt, Human
cuguuauuuauaaucacuuu

SEQ ID NO: 2284948 - RNA, 14 nt, Human
cuguuauuuauaau

SEQ ID NO: 2284949 - RNA, 14 nt, Human
cuguuauuuagacu

SEQ ID NO: 2284950 - RNA, 16 nt, Human
cuguuauuuagacuca

SEQ ID NO: 2284951 - RNA, 14 nt, Human
cuguuauaacucug

SEQ ID NO: 2284952 - RNA, 15 nt, Human
cuuaggaagaauuuu

SEQ ID NO: 2284953 - RNA, 17 nt, Human
cuuaggaagagaaacca

SEQ ID NO: 2284954 - RNA, 16 nt, Human
cuuagcuuuuuaauug

SEQ ID NO: 2284955 - RNA, 17 nt, Human
cuuagcuuuuuaauugu

SEQ ID NO: 2284956 - RNA, 22 nt, Human
cuuaggaagagaaaccagggag

SEQ ID NO: 2284957 - RNA, 11 nt, Human
cuuaggaagga

SEQ ID NO: 2284958 - RNA, 20 nt, Human
cuuaggacagggucccugcu

SEQ ID NO: 2284959 - RNA, 15 nt, Human
cuuaggagagaccga

SEQ ID NO: 2284960 - RNA, 15 nt, Human
cuuaggcagggaagu

SEQ ID NO: 2284961 - RNA, 19 nt, Human
cuuaggcaugacuguagaa

SEQ ID NO: 2284962 - RNA, 15 nt, Human
cuuaggccagcacca

SEQ ID NO: 2284963 - RNA, 14 nt, Human
cuuaggcagggaag

SEQ ID NO: 2284964 - RNA, 18 nt, Human
cuuaggaugugugcaugu

SEQ ID NO: 2284965 - RNA, 22 nt, Human
cuuaggaugugugcaugugugu

SEQ ID NO: 2284966 - RNA, 16 nt, Human
cuuaggagcagagcuc

SEQ ID NO: 2284967 - RNA, 18 nt, Human
cuuaggagcagagcucug

SEQ ID NO: 2284968 - RNA, 14 nt, Human
cuuaggaugugugc

SEQ ID NO: 2284969 - RNA, 16 nt, Human
cuuaggaugugugcau

SEQ ID NO: 2284970 - RNA, 19 nt, Human
cuuagggaaggauacaaaa

SEQ ID NO: 2284971 - RNA, 17 nt, Human
cuuaggccuuccucucu

SEQ ID NO: 2284972 - RNA, 15 nt, Human
cuuaggccuuccucu

SEQ ID NO: 2284973 - RNA, 13 nt, Human
cuuaggccuuccu

SEQ ID NO: 2284974 - RNA, 12 nt, Human
cuuaggccuucc

SEQ ID NO: 2284975 - RNA, 21 nt, Human
cuuagggaaggauacaaaagc

SEQ ID NO: 2284976 - RNA, 23 nt, Human
cuuaggccuuccucucuccagau

SEQ ID NO: 2284977 - RNA, 16 nt, Human
cuuaggggcugcugac

SEQ ID NO: 2284978 - RNA, 15 nt, Human
cuuagggcaccaggg

SEQ ID NO: 2284979 - RNA, 14 nt, Human
cuuagcugagugga

SEQ ID NO: 2284980 - RNA, 14 nt, Human
cuuagcugucugcu

SEQ ID NO: 2284981 - RNA, 13 nt, Human
cuuagcugggaga

SEQ ID NO: 2284982 - RNA, 17 nt, Human
cuuagcuccccuccaac

SEQ ID NO: 2284983 - RNA, 17 nt, Human
cuuagcucuuaauuguu

SEQ ID NO: 2284984 - RNA, 11 nt, Human
cuuagcugagu

SEQ ID NO: 2284985 - RNA, 23 nt, Human
cuuagcucauucuccuuguguua

SEQ ID NO: 2284986 - RNA, 14 nt, Human
cuuagcuccccucc

SEQ ID NO: 2284987 - RNA, 14 nt, Human
cuuagcuaucagaa

SEQ ID NO: 2284988 - RNA, 20 nt, Human
cuuagcuuagaccucagccu

SEQ ID NO: 2284989 - RNA, 19 nt, Human
cuuagcuuagaccucagcc

SEQ ID NO: 2284990 - RNA, 18 nt, Human
cuuagcuuagaccucagc

SEQ ID NO: 2284991 - RNA, 17 nt, Human
cuuagcuuagaccucag

SEQ ID NO: 2284992 - RNA, 16 nt, Human
cuuagcuuagaccuca

SEQ ID NO: 2284993 - RNA, 15 nt, Human
cuuagcuuagaccuc

SEQ ID NO: 2284994 - RNA, 14 nt, Human
cuuagcuuagaccu

SEQ ID NO: 2284995 - RNA, 17 nt, Human
cuuagcugucugcucag

SEQ ID NO: 2284996 - RNA, 22 nt, Human
cuuagcuuagaccucagccugu

SEQ ID NO: 2284997 - RNA, 21 nt, Human
cuuagcuuagaccucagccug

SEQ ID NO: 2284998 - RNA, 23 nt, Human
cuuagcuuagaccucagccugug

SEQ ID NO: 2284999 - RNA, 23 nt, Human
cuuagcuucuauuauagccacau

SEQ ID NO: 2285000 - RNA, 18 nt, Human
cuuagcuuugcucugcca

SEQ ID NO: 2285001 - RNA, 14 nt, Human
cuuagcuuuuuaau

SEQ ID NO: 2285002 - RNA, 18 nt, Human
cuuagcauguguugaaaa

SEQ ID NO: 2285003 - RNA, 14 nt, Human
cuuaccaugugccu

SEQ ID NO: 2285004 - RNA, 16 nt, Human
cuuagcauguuugcug

SEQ ID NO: 2285005 - RNA, 17 nt, Human
cuuagcauguuugcuga

SEQ ID NO: 2285006 - RNA, 18 nt, Human
cuuagcauguuugcugaa

SEQ ID NO: 2285007 - RNA, 23 nt, Human
cuuacccaucugcaccccccugg

SEQ ID NO: 2285008 - RNA, 13 nt, Human
cuuaccauuaaag

SEQ ID NO: 2285009 - RNA, 15 nt, Human
cuuaccauaugugcu

SEQ ID NO: 2285010 - RNA, 13 nt, Human
cuuaccaggaagc

SEQ ID NO: 2285011 - RNA, 16 nt, Human
cuuaccagcagagcac

SEQ ID NO: 2285012 - RNA, 15 nt, Human
cuuagccucccugaa

SEQ ID NO: 2285013 - RNA, 14 nt, Human
cuuagccucccuga

SEQ ID NO: 2285014 - RNA, 14 nt, Human
cuuagccuccugac

SEQ ID NO: 2285015 - RNA, 17 nt, Human
cuuagccuccugaccug

SEQ ID NO: 2285016 - RNA, 21 nt, Human
cuuagccuccugaccugaggc

SEQ ID NO: 2285017 - RNA, 22 nt, Human
cuuagccuccugaccugaggcu

SEQ ID NO: 2285018 - RNA, 11 nt, Human
cuuagccuccc

SEQ ID NO: 2285019 - RNA, 18 nt, Human
cuuagcccccacccacuu

SEQ ID NO: 2285020 - RNA, 20 nt, Human
cuuagcccccacccacuucc

SEQ ID NO: 2285021 - RNA, 13 nt, Human
cuuagcccccacc

SEQ ID NO: 2285022 - RNA, 17 nt, Human
cuuagcccccacccacu

SEQ ID NO: 2285023 - RNA, 22 nt, Human
cuuagcucauucuccuuguguu

SEQ ID NO: 2285024 - RNA, 15 nt, Human
cugucgcccagucug

SEQ ID NO: 2285025 - RNA, 17 nt, Human
cuguccuggugucacuu

SEQ ID NO: 2285026 - RNA, 14 nt, Human
cuguccuguacauu

SEQ ID NO: 2285027 - RNA, 17 nt, Human
cugucgccuuagcaugu

SEQ ID NO: 2285028 - RNA, 22 nt, Human
cuguccuguacauugugggaug

SEQ ID NO: 2285029 - RNA, 18 nt, Human
cugucgccuuagcauguu

SEQ ID NO: 2285030 - RNA, 19 nt, Human
cugucgccuuagcauguuu

SEQ ID NO: 2285031 - RNA, 16 nt, Human
cugucgcccagucugg

SEQ ID NO: 2285032 - RNA, 19 nt, Human
cugucauaagaaugaauaa

SEQ ID NO: 2285033 - RNA, 16 nt, Human
cugucauagaaauuac

SEQ ID NO: 2285034 - RNA, 14 nt, Human
cugucauagaaauu

SEQ ID NO: 2285035 - RNA, 13 nt, Human
cugucacaccagc

SEQ ID NO: 2285036 - RNA, 15 nt, Human
cugucacaccagcca

SEQ ID NO: 2285037 - RNA, 16 nt, Human
cugucacaccagccau

SEQ ID NO: 2285038 - RNA, 17 nt, Human
cugucagugccgccgcc

SEQ ID NO: 2285039 - RNA, 18 nt, Human
cugucagugccgccgccu

SEQ ID NO: 2285040 - RNA, 22 nt, Human
cugucagugccgccgccucgcc

SEQ ID NO: 2285041 - RNA, 15 nt, Human
cugucaucaauugaa

SEQ ID NO: 2285042 - RNA, 17 nt, Human
cugucaauuucccugac

SEQ ID NO: 2285043 - RNA, 18 nt, Human
cugucaauuucccugacu

SEQ ID NO: 2285044 - RNA, 19 nt, Human
cugucaauuucccugacuc

SEQ ID NO: 2285045 - RNA, 15 nt, Human
cuguagucccagcca

SEQ ID NO: 2285046 - RNA, 17 nt, Human
cuguagucccagccacu

SEQ ID NO: 2285047 - RNA, 18 nt, Human
cuguagucccagccacuc

SEQ ID NO: 2285048 - RNA, 23 nt, Human
cuguagucccagccacucgggag

SEQ ID NO: 2285049 - RNA, 23 nt, Human
cugucaauuacaggaaguacugg

SEQ ID NO: 2285050 - RNA, 19 nt, Human
cugucaauuacaggaagua

SEQ ID NO: 2285051 - RNA, 20 nt, Human
cugucaauuacaggaaguac

SEQ ID NO: 2285052 - RNA, 17 nt, Human
cuguccuccaagccagc

SEQ ID NO: 2285053 - RNA, 15 nt, Human
cuguccuccaagcca

SEQ ID NO: 2285054 - RNA, 16 nt, Human
cuguccucccaucccc

SEQ ID NO: 2285055 - RNA, 18 nt, Human
cuguccucccauccccug

SEQ ID NO: 2285056 - RNA, 19 nt, Human
cuguccucccauccccugg

SEQ ID NO: 2285057 - RNA, 19 nt, Human
cuguccuccuggugggucc

SEQ ID NO: 2285058 - RNA, 20 nt, Human
cuguccucucuggcugggga

SEQ ID NO: 2285059 - RNA, 21 nt, Human
cuguccuccugguggguccag

SEQ ID NO: 2285060 - RNA, 23 nt, Human
cuguccuccucggaucaccgaga

SEQ ID NO: 2285061 - RNA, 12 nt, Human
cuguccuccucg

SEQ ID NO: 2285062 - RNA, 14 nt, Human
cuguccuccuggug

SEQ ID NO: 2285063 - RNA, 16 nt, Human
cuguccuccugguggg

SEQ ID NO: 2285064 - RNA, 21 nt, Human
cuguccucccauccccuggac

SEQ ID NO: 2285065 - RNA, 21 nt, Human
cuguccugggagugagcuggu

SEQ ID NO: 2285066 - RNA, 15 nt, Human
cuguccucuucugca

SEQ ID NO: 2285067 - RNA, 18 nt, Human
cuguccugggccugcaga

SEQ ID NO: 2285068 - RNA, 11 nt, Human
cuguccugggc

SEQ ID NO: 2285069 - RNA, 12 nt, Human
cuguccugggcg

SEQ ID NO: 2285070 - RNA, 14 nt, Human
cuguccugggccug

SEQ ID NO: 2285071 - RNA, 13 nt, Human
cuguccugggccu

SEQ ID NO: 2285072 - RNA, 13 nt, Human
cuguccugggcgc

SEQ ID NO: 2285073 - RNA, 18 nt, Human
cuguccugggcgcccugg

SEQ ID NO: 2285074 - RNA, 19 nt, Human
cuguccugggcgcccugga

SEQ ID NO: 2285075 - RNA, 21 nt, Human
cuguccugggcgcccuggaag

SEQ ID NO: 2285076 - RNA, 22 nt, Human
cuguccugggcgcccuggaagc

SEQ ID NO: 2285077 - RNA, 23 nt, Human
cuguccugggcgcccuggaagcc

SEQ ID NO: 2285078 - RNA, 14 nt, Human
cuguccugggcugg

SEQ ID NO: 2285079 - RNA, 18 nt, Human
cuguccugggcugguggc

SEQ ID NO: 2285080 - RNA, 17 nt, Human
cuguacuguucuguguc

SEQ ID NO: 2285081 - RNA, 16 nt, Human
cuguacuuaauaaauu

SEQ ID NO: 2285082 - RNA, 13 nt, Human
cuguacuuaauaa

SEQ ID NO: 2285083 - RNA, 20 nt, Human
cuguacuguucugugucuuu

SEQ ID NO: 2285084 - RNA, 15 nt, Human
cuguacucuuagaug

SEQ ID NO: 2285085 - RNA, 20 nt, Human
cuguacugauuuuuguaaga

SEQ ID NO: 2285086 - RNA, 22 nt, Human
cuguacugauuuuuguaagaca

SEQ ID NO: 2285087 - RNA, 15 nt, Human
cuguaacucuaaaag

SEQ ID NO: 2285088 - RNA, 19 nt, Human
cuguaacucuaaaagaucc

SEQ ID NO: 2285089 - RNA, 16 nt, Human
cuguaacacuuuacaa

SEQ ID NO: 2285090 - RNA, 15 nt, Human
cuguaaccucuucag

SEQ ID NO: 2285091 - RNA, 19 nt, Human
cuguaacauacuggccugg

SEQ ID NO: 2285092 - RNA, 23 nt, Human
cuguaaccucuucagaggcccuc

SEQ ID NO: 2285093 - RNA, 22 nt, Human
cuguaaccucuucagaggcccu

SEQ ID NO: 2285094 - RNA, 20 nt, Human
cuguaaccucuucagaggcc

SEQ ID NO: 2285095 - RNA, 19 nt, Human
cuguaaccucuucagaggc

SEQ ID NO: 2285096 - RNA, 19 nt, Human
cuguagaaaagggaacuga

SEQ ID NO: 2285097 - RNA, 15 nt, Human
cuguacuucaaguua

SEQ ID NO: 2285098 - RNA, 13 nt, Human
cuguagaaauggu

SEQ ID NO: 2285099 - RNA, 17 nt, Human
cuguagaaaugguugua

SEQ ID NO: 2285100 - RNA, 19 nt, Human
cuguagaaaugguuguauu

SEQ ID NO: 2285101 - RNA, 15 nt, Human
cuguagaagagggau

SEQ ID NO: 2285102 - RNA, 21 nt, Human
cuguagagcuagaacauggag

SEQ ID NO: 2285103 - RNA, 16 nt, Human
cuguagagggcccugg

SEQ ID NO: 2285104 - RNA, 22 nt, Human
cuguagaccuagggaggaccuu

SEQ ID NO: 2285105 - RNA, 18 nt, Human
cuguacuuaauaaauuca

SEQ ID NO: 2285106 - RNA, 20 nt, Human
cuguagaaaugguuguauua

SEQ ID NO: 2285107 - RNA, 13 nt, Human
cuguagaguggga

SEQ ID NO: 2285108 - RNA, 18 nt, Human
cuguaguagcccuuucug

SEQ ID NO: 2285109 - RNA, 19 nt, Human
cuguaguagcccuuucugu

SEQ ID NO: 2285110 - RNA, 12 nt, Human
cuguagucccag

SEQ ID NO: 2285111 - RNA, 14 nt, Human
cuguagucccagcc

SEQ ID NO: 2285112 - RNA, 21 nt, Human
cuguaguagcccuuucugugu

SEQ ID NO: 2285113 - RNA, 20 nt, Human
cuguaguaaacuauuuaucu

SEQ ID NO: 2285114 - RNA, 19 nt, Human
cuguaguaaacuauuuauc

SEQ ID NO: 2285115 - RNA, 18 nt, Human
cuguaguaaacuauuuau

SEQ ID NO: 2285116 - RNA, 24 nt, Human
cuguaggguaauuaguaacaugug

SEQ ID NO: 2285117 - RNA, 17 nt, Human
cuguagagggcccuggu

SEQ ID NO: 2285118 - RNA, 14 nt, Human
cugguugucauuuu

SEQ ID NO: 2285119 - RNA, 13 nt, Human
cugguugucauuu

SEQ ID NO: 2285120 - RNA, 21 nt, Human
cugguugguguugcagaaggu

SEQ ID NO: 2285121 - RNA, 20 nt, Human
cugguugguguugcagaagg

SEQ ID NO: 2285122 - RNA, 16 nt, Human
cuggugacaccagccu

SEQ ID NO: 2285123 - RNA, 15 nt, Human
cuggugacaccagcc

SEQ ID NO: 2285124 - RNA, 17 nt, Human
cuggugacaccagccuu

SEQ ID NO: 2285125 - RNA, 14 nt, Human
cuggugacaccagc

SEQ ID NO: 2285126 - RNA, 15 nt, Human
cuggugaagcucacu

SEQ ID NO: 2285127 - RNA, 22 nt, Human
cuggugacaugucuuuucuugc

SEQ ID NO: 2285128 - RNA, 15 nt, Human
cuggucuugagaugu

SEQ ID NO: 2285129 - RNA, 14 nt, Human
cuggucuugagaug

SEQ ID NO: 2285130 - RNA, 18 nt, Human
cuggucuuguggaauugg

SEQ ID NO: 2285131 - RNA, 20 nt, Human
cuggucuuguggaauuggga

SEQ ID NO: 2285132 - RNA, 15 nt, Human
cuggucuuuccucug

SEQ ID NO: 2285133 - RNA, 20 nt, Human
cuggugaagcucacuucugg

SEQ ID NO: 2285134 - RNA, 20 nt, Human
cuguaaagagaccuaccuca

SEQ ID NO: 2285135 - RNA, 22 nt, Human
cuguaaagagaccuaccucagg

SEQ ID NO: 2285136 - RNA, 23 nt, Human
cuguaaagagaccuaccucaggu

SEQ ID NO: 2285137 - RNA, 23 nt, Human
cuguaaagaaagagagaaaauaa

SEQ ID NO: 2285138 - RNA, 22 nt, Human
cuguaaagaaagagagaaaaua

SEQ ID NO: 2285139 - RNA, 21 nt, Human
cuguaaagaaagagagaaaau

SEQ ID NO: 2285140 - RNA, 20 nt, Human
cuguaaagaaagagagaaaa

SEQ ID NO: 2285141 - RNA, 19 nt, Human
cuguaaagaaagagagaaa

SEQ ID NO: 2285142 - RNA, 18 nt, Human
cuguaaagaaagagagaa

SEQ ID NO: 2285143 - RNA, 20 nt, Human
cuguaaacuguguauuccaa

SEQ ID NO: 2285144 - RNA, 14 nt, Human
cuguaaacugugua

SEQ ID NO: 2285145 - RNA, 22 nt, Human
cuguaaacucaaaacuuaacau

SEQ ID NO: 2285146 - RNA, 13 nt, Human
cuguaaagaaaga

SEQ ID NO: 2285147 - RNA, 17 nt, Human
cuguaaagaaagagaga

SEQ ID NO: 2285148 - RNA, 16 nt, Human
cuguaaagaaagagag

SEQ ID NO: 2285149 - RNA, 15 nt, Human
cuguaaagaaagaga

SEQ ID NO: 2285150 - RNA, 14 nt, Human
cuguaaagaaagag

SEQ ID NO: 2285151 - RNA, 17 nt, Human
cugguuucacuggccca

SEQ ID NO: 2285152 - RNA, 13 nt, Human
cugguuucacugg

SEQ ID NO: 2285153 - RNA, 18 nt, Human
cugguuucacuggcccaa

SEQ ID NO: 2285154 - RNA, 23 nt, Human
cugguuucauuucuacugugacu

SEQ ID NO: 2285155 - RNA, 15 nt, Human
cugguugucauuuuu

SEQ ID NO: 2285156 - RNA, 15 nt, Human
cugguuuacacuuua

SEQ ID NO: 2285157 - RNA, 14 nt, Human
cugguuuccugccc

SEQ ID NO: 2285158 - RNA, 13 nt, Human
cugguuuccugcc

SEQ ID NO: 2285159 - RNA, 13 nt, Human
cuguaaacugugu

SEQ ID NO: 2285160 - RNA, 12 nt, Human
cuguaaacugug

SEQ ID NO: 2285161 - RNA, 15 nt, Human
cugugacccccagcu

SEQ ID NO: 2285162 - RNA, 13 nt, Human
cugugacccccag

SEQ ID NO: 2285163 - RNA, 14 nt, Human
cugugaccucaggc

SEQ ID NO: 2285164 - RNA, 17 nt, Human
cugugaccucaggcacu

SEQ ID NO: 2285165 - RNA, 17 nt, Human
cugugaccucuccccug

SEQ ID NO: 2285166 - RNA, 22 nt, Human
cugugaccucaggcacuagccu

SEQ ID NO: 2285167 - RNA, 23 nt, Human
cugugaccucaggcacuagccuu

SEQ ID NO: 2285168 - RNA, 21 nt, Human
cugugacccccagcuccggcc

SEQ ID NO: 2285169 - RNA, 18 nt, Human
cugugacccccagcuccg

SEQ ID NO: 2285170 - RNA, 17 nt, Human
cugugacccccagcucc

SEQ ID NO: 2285171 - RNA, 16 nt, Human
cugugacccccagcuc

SEQ ID NO: 2285172 - RNA, 22 nt, Human
cugugaccugccccgcccagcu

SEQ ID NO: 2285173 - RNA, 16 nt, Human
cugugaccugccccgc

SEQ ID NO: 2285174 - RNA, 19 nt, Human
cugugccuucuuuugauua

SEQ ID NO: 2285175 - RNA, 15 nt, Human
cugugccugaauauu

SEQ ID NO: 2285176 - RNA, 17 nt, Human
cugugccugaccuugag

SEQ ID NO: 2285177 - RNA, 19 nt, Human
cugugccugaccuugagga

SEQ ID NO: 2285178 - RNA, 16 nt, Human
cugugccuuuugccau

SEQ ID NO: 2285179 - RNA, 21 nt, Human
cugugccuuugaguuuccuca

SEQ ID NO: 2285180 - RNA, 18 nt, Human
cugugccugccugggagu

SEQ ID NO: 2285181 - RNA, 14 nt, Human
cugugcgcugacaa

SEQ ID NO: 2285182 - RNA, 12 nt, Human
cugugcugcccu

SEQ ID NO: 2285183 - RNA, 13 nt, Human
cugugcugcccug

SEQ ID NO: 2285184 - RNA, 14 nt, Human
cugugcugcccugc

SEQ ID NO: 2285185 - RNA, 21 nt, Human
cugugcugcccugcccaccug

SEQ ID NO: 2285186 - RNA, 14 nt, Human
cugugucacuacgu

SEQ ID NO: 2285187 - RNA, 14 nt, Human
cugugucacuggcu

SEQ ID NO: 2285188 - RNA, 15 nt, Human
cugugucacuggcug

SEQ ID NO: 2285189 - RNA, 16 nt, Human
cugugucacuggcugc

SEQ ID NO: 2285190 - RNA, 17 nt, Human
cugugucacuggcugcc

SEQ ID NO: 2285191 - RNA, 19 nt, Human
cugugucagcauagaagua

SEQ ID NO: 2285192 - RNA, 17 nt, Human
cugugucagcauagaag

SEQ ID NO: 2285193 - RNA, 15 nt, Human
cugugcugcccugcc

SEQ ID NO: 2285194 - RNA, 17 nt, Human
cugugcugcccugccca

SEQ ID NO: 2285195 - RNA, 18 nt, Human
cugugcugcccugcccac

SEQ ID NO: 2285196 - RNA, 19 nt, Human
cugugcugcccugcccacc

SEQ ID NO: 2285197 - RNA, 22 nt, Human
cuguguccuugcaccugcaucc

SEQ ID NO: 2285198 - RNA, 11 nt, Human
cugugucuaaa

SEQ ID NO: 2285199 - RNA, 12 nt, Human
cugugucuaaac

SEQ ID NO: 2285200 - RNA, 13 nt, Human
cugugucuaaacu

SEQ ID NO: 2285201 - RNA, 16 nt, Human
cugugucguagccaag

SEQ ID NO: 2285202 - RNA, 19 nt, Human
cuguguccuugcaccugca

SEQ ID NO: 2285203 - RNA, 18 nt, Human
cuguguccuugcaccugc

SEQ ID NO: 2285204 - RNA, 16 nt, Human
cuguguccuugcaccu

SEQ ID NO: 2285205 - RNA, 14 nt, Human
cuguguccuugcac

SEQ ID NO: 2285206 - RNA, 15 nt, Human
cuguguccuucccug

SEQ ID NO: 2285207 - RNA, 16 nt, Human
cuguguccuucccugc

SEQ ID NO: 2285208 - RNA, 23 nt, Human
cuguguccuggugcucucugcca

SEQ ID NO: 2285209 - RNA, 19 nt, Human
cuguguccuggugcucucu

SEQ ID NO: 2285210 - RNA, 20 nt, Human
cuguguccuggugcucucug

SEQ ID NO: 2285211 - RNA, 23 nt, Human
cugugucccaugacccaccccug

SEQ ID NO: 2285212 - RNA, 13 nt, Human
cuguguccuggug

SEQ ID NO: 2285213 - RNA, 14 nt, Human
cuguguccuggugc

SEQ ID NO: 2285214 - RNA, 15 nt, Human
cuguguccuggugcu

SEQ ID NO: 2285215 - RNA, 17 nt, Human
cuguguccuggugcucu

SEQ ID NO: 2285216 - RNA, 18 nt, Human
cugugucacuggcugccu

SEQ ID NO: 2285217 - RNA, 19 nt, Human
cugugucacuggcugccuc

SEQ ID NO: 2285218 - RNA, 20 nt, Human
cugugucacuggcugccucc

SEQ ID NO: 2285219 - RNA, 21 nt, Human
cugugucacuggcugccucca

SEQ ID NO: 2285220 - RNA, 22 nt, Human
cugugucacuggcugccuccac

SEQ ID NO: 2285221 - RNA, 20 nt, Human
cugugucccaugacccaccc

SEQ ID NO: 2285222 - RNA, 21 nt, Human
cugugucccaugacccacccc

SEQ ID NO: 2285223 - RNA, 22 nt, Human
cugugucccaugacccaccccu

SEQ ID NO: 2285224 - RNA, 18 nt, Human
cuguuagucauuugcuga

SEQ ID NO: 2285225 - RNA, 14 nt, Human
cuguuagucauuug

SEQ ID NO: 2285226 - RNA, 15 nt, Human
cuguuagucauuugc

SEQ ID NO: 2285227 - RNA, 13 nt, Human
cuguuagucauuu

SEQ ID NO: 2285228 - RNA, 16 nt, Human
cugugucuaaacugca

SEQ ID NO: 2285229 - RNA, 14 nt, Human
cugugucuaaacug

SEQ ID NO: 2285230 - RNA, 15 nt, Human
cugugucuaaacugc

SEQ ID NO: 2285231 - RNA, 13 nt, Human
cuguuauaaucuu

SEQ ID NO: 2285232 - RNA, 19 nt, Human
cuguuauaaucuuucacag

SEQ ID NO: 2285233 - RNA, 20 nt, Human
cugggcaccggggccucgga

SEQ ID NO: 2285234 - RNA, 17 nt, Human
cugggcauugcuuucca

SEQ ID NO: 2285235 - RNA, 16 nt, Human
cugggcauugcuuucc

SEQ ID NO: 2285236 - RNA, 14 nt, Human
cugggcauugcuuu

SEQ ID NO: 2285237 - RNA, 15 nt, Human
cugggcagaaggaag

SEQ ID NO: 2285238 - RNA, 19 nt, Human
cugggcaccuggggagugg

SEQ ID NO: 2285239 - RNA, 17 nt, Human
cugggcaccuggggagu

SEQ ID NO: 2285240 - RNA, 16 nt, Human
cugggcaccuggggag

SEQ ID NO: 2285241 - RNA, 20 nt, Human
cugggcaccuggggaguggg

SEQ ID NO: 2285242 - RNA, 12 nt, Human
cugggcagaagg

SEQ ID NO: 2285243 - RNA, 17 nt, Human
cuggggagugggacaga

SEQ ID NO: 2285244 - RNA, 20 nt, Human
cuggggagcccgucucagug

SEQ ID NO: 2285245 - RNA, 12 nt, Human
cuggggagcccg

SEQ ID NO: 2285246 - RNA, 15 nt, Human
cuggggagcccgucu

SEQ ID NO: 2285247 - RNA, 20 nt, Human
cuggggagugggacagaguc

SEQ ID NO: 2285248 - RNA, 21 nt, Human
cuggggcacuuggcagcgcgg

SEQ ID NO: 2285249 - RNA, 17 nt, Human
cuggggaugucucucau

SEQ ID NO: 2285250 - RNA, 16 nt, Human
cuggggaugucucuca

SEQ ID NO: 2285251 - RNA, 14 nt, Human
cuggggagaaagua

SEQ ID NO: 2285252 - RNA, 14 nt, Human
cugggccagaauuu

SEQ ID NO: 2285253 - RNA, 12 nt, Human
cugggcauuuuc

SEQ ID NO: 2285254 - RNA, 13 nt, Human
cugggccagagua

SEQ ID NO: 2285255 - RNA, 20 nt, Human
cugggccaaguuccucuagu

SEQ ID NO: 2285256 - RNA, 18 nt, Human
cugggccaaguuccucua

SEQ ID NO: 2285257 - RNA, 15 nt, Human
cugggccaaguuccu

SEQ ID NO: 2285258 - RNA, 19 nt, Human
cugggccaacucaccugag

SEQ ID NO: 2285259 - RNA, 21 nt, Human
cugggccaaguuccucuagug

SEQ ID NO: 2285260 - RNA, 18 nt, Human
cugggccacuucugggug

SEQ ID NO: 2285261 - RNA, 12 nt, Human
cugggccagaau

SEQ ID NO: 2285262 - RNA, 13 nt, Human
cuggggcugaagg

SEQ ID NO: 2285263 - RNA, 14 nt, Human
cuggggcugaccuu

SEQ ID NO: 2285264 - RNA, 19 nt, Human
cuggggcucugugcaggga

SEQ ID NO: 2285265 - RNA, 17 nt, Human
cuggggcucugugcagg

SEQ ID NO: 2285266 - RNA, 14 nt, Human
cuggggcucugugc

SEQ ID NO: 2285267 - RNA, 15 nt, Human
cuggggcucugggau

SEQ ID NO: 2285268 - RNA, 14 nt, Human
cuggggcucuggga

SEQ ID NO: 2285269 - RNA, 20 nt, Human
cuggggcuccuuucuccagc

SEQ ID NO: 2285270 - RNA, 23 nt, Human
cuggggcuccuuucuccagccag

SEQ ID NO: 2285271 - RNA, 12 nt, Human
cuggggcucccu

SEQ ID NO: 2285272 - RNA, 14 nt, Human
cuggggcucccuuc

SEQ ID NO: 2285273 - RNA, 22 nt, Human
cuggggcucccuucaucuccag

SEQ ID NO: 2285274 - RNA, 19 nt, Human
cuggggcuccuuucuccag

SEQ ID NO: 2285275 - RNA, 19 nt, Human
cuggggcuaggcuggagcc

SEQ ID NO: 2285276 - RNA, 18 nt, Human
cuggggccacacagaaac

SEQ ID NO: 2285277 - RNA, 18 nt, Human
cuggggcuagggggagcc

SEQ ID NO: 2285278 - RNA, 17 nt, Human
cuggggccacacagaaa

SEQ ID NO: 2285279 - RNA, 15 nt, Human
cuggggccaggcugg

SEQ ID NO: 2285280 - RNA, 15 nt, Human
cuggggccacacaga

SEQ ID NO: 2285281 - RNA, 15 nt, Human
cuggggcagucaccu

SEQ ID NO: 2285282 - RNA, 21 nt, Human
cuggguggggugaggaccacu

SEQ ID NO: 2285283 - RNA, 16 nt, Human
cuggguggggugagga

SEQ ID NO: 2285284 - RNA, 22 nt, Human
cuggguggggcugcuccuccag

SEQ ID NO: 2285285 - RNA, 21 nt, Human
cuggguggggcugcuccucca

SEQ ID NO: 2285286 - RNA, 20 nt, Human
cuggguggggcugcuccucc

SEQ ID NO: 2285287 - RNA, 18 nt, Human
cuggguggggcugcuccu

SEQ ID NO: 2285288 - RNA, 17 nt, Human
cuggguggggcugcucc

SEQ ID NO: 2285289 - RNA, 13 nt, Human
cuggguggggcug

SEQ ID NO: 2285290 - RNA, 15 nt, Human
cuggguucacugcaa

SEQ ID NO: 2285291 - RNA, 15 nt, Human
cuggguggggcagug

SEQ ID NO: 2285292 - RNA, 14 nt, Human
cugggugggcucug

SEQ ID NO: 2285293 - RNA, 15 nt, Human
cugggugggcucugu

SEQ ID NO: 2285294 - RNA, 13 nt, Human
cugggugggcucu

SEQ ID NO: 2285295 - RNA, 23 nt, Human
cuggguggccucgggacaccugc

SEQ ID NO: 2285296 - RNA, 18 nt, Human
cuggggcugaccuuccuc

SEQ ID NO: 2285297 - RNA, 19 nt, Human
cuggguggccucgggacac

SEQ ID NO: 2285298 - RNA, 23 nt, Human
cuggguucagaaaugcugccugc

SEQ ID NO: 2285299 - RNA, 21 nt, Human
cuggguucagaaaugcugccu

SEQ ID NO: 2285300 - RNA, 22 nt, Human
cuggguucagaaaugcugccug

SEQ ID NO: 2285301 - RNA, 12 nt, Human
cugggugggugg

SEQ ID NO: 2285302 - RNA, 15 nt, Human
cuggguggguggugg

SEQ ID NO: 2285303 - RNA, 17 nt, Human
cuggguggguggugggg

SEQ ID NO: 2285304 - RNA, 18 nt, Human
cuggguggguggugggga

SEQ ID NO: 2285305 - RNA, 19 nt, Human
cugggugggugguggggag

SEQ ID NO: 2285306 - RNA, 20 nt, Human
cugggugggugguggggagg

SEQ ID NO: 2285307 - RNA, 22 nt, Human
cugggugggugguggggagggg

SEQ ID NO: 2285308 - RNA, 18 nt, Human
cuggguucagaaaugcug

SEQ ID NO: 2285309 - RNA, 18 nt, Human
cuggguucacugcaaccu

SEQ ID NO: 2285310 - RNA, 20 nt, Human
cuggguucacugcaaccucc

SEQ ID NO: 2285311 - RNA, 19 nt, Human
cuggcagccgugccuucag

SEQ ID NO: 2285312 - RNA, 20 nt, Human
cuggcagccgugccuucagc

SEQ ID NO: 2285313 - RNA, 13 nt, Human
cuggcagccccug

SEQ ID NO: 2285314 - RNA, 12 nt, Human
cuggcagccucc

SEQ ID NO: 2285315 - RNA, 15 nt, Human
cuggcagccucccau

SEQ ID NO: 2285316 - RNA, 14 nt, Human
cuggcagccuccca

SEQ ID NO: 2285317 - RNA, 21 nt, Human
cuggcagccgugccuucagcu

SEQ ID NO: 2285318 - RNA, 22 nt, Human
cuggcagccgugccuucagcuc

SEQ ID NO: 2285319 - RNA, 11 nt, Human
cuggcagccca

SEQ ID NO: 2285320 - RNA, 12 nt, Human
cuggcagccccu

SEQ ID NO: 2285321 - RNA, 15 nt, Human
cuggcagcagagugu

SEQ ID NO: 2285322 - RNA, 14 nt, Human
cuggcagaggaggg

SEQ ID NO: 2285323 - RNA, 19 nt, Human
cuggcagaguugaagacag

SEQ ID NO: 2285324 - RNA, 23 nt, Human
cuggcagaaugcuagcucugagc

SEQ ID NO: 2285325 - RNA, 17 nt, Human
cuggcagaguugaagac

SEQ ID NO: 2285326 - RNA, 18 nt, Human
cuggcagaguugaagaca

SEQ ID NO: 2285327 - RNA, 21 nt, Human
cugggacuuccuugcucuccc

SEQ ID NO: 2285328 - RNA, 16 nt, Human
cugggacuuccuugcu

SEQ ID NO: 2285329 - RNA, 17 nt, Human
cugggacuuccuugcuc

SEQ ID NO: 2285330 - RNA, 18 nt, Human
cugggacuuccuugcucu

SEQ ID NO: 2285331 - RNA, 20 nt, Human
cugggacuuccuugcucucc

SEQ ID NO: 2285332 - RNA, 11 nt, Human
cugggacacag

SEQ ID NO: 2285333 - RNA, 22 nt, Human
cugggaauguauuauucugcag

SEQ ID NO: 2285334 - RNA, 19 nt, Human
cugggaauguauuauucug

SEQ ID NO: 2285335 - RNA, 18 nt, Human
cugggaauguauuauucu

SEQ ID NO: 2285336 - RNA, 13 nt, Human
cugggaauguauu

SEQ ID NO: 2285337 - RNA, 18 nt, Human
cuggcucugcaaugggca

SEQ ID NO: 2285338 - RNA, 18 nt, Human
cugggaauaagugccagg

SEQ ID NO: 2285339 - RNA, 24 nt, Human
cuggcucugagcgccuccauccaa

SEQ ID NO: 2285340 - RNA, 24 nt, Human
cuggcucugcaaugggcacuggga

SEQ ID NO: 2285341 - RNA, 23 nt, Human
cugggaauguauuauucugcagc

SEQ ID NO: 2285342 - RNA, 13 nt, Human
cugggacucagcc

SEQ ID NO: 2285343 - RNA, 14 nt, Human
cugggacucagccu

SEQ ID NO: 2285344 - RNA, 15 nt, Human
cugggacucagccuu

SEQ ID NO: 2285345 - RNA, 16 nt, Human
cugggacucagccuuc

SEQ ID NO: 2285346 - RNA, 17 nt, Human
cugggacucagccuuca

SEQ ID NO: 2285347 - RNA, 14 nt, Human
cugggacuggccag

SEQ ID NO: 2285348 - RNA, 13 nt, Human
cugggacuggcca

SEQ ID NO: 2285349 - RNA, 20 nt, Human
cugggacugagccaguccca

SEQ ID NO: 2285350 - RNA, 14 nt, Human
cugggacuuccuug

SEQ ID NO: 2285351 - RNA, 18 nt, Human
cugggacucagccuucag

SEQ ID NO: 2285352 - RNA, 21 nt, Human
cugggacucagccuucagaca

SEQ ID NO: 2285353 - RNA, 13 nt, Human
cugggacugagcc

SEQ ID NO: 2285354 - RNA, 14 nt, Human
cugggacugagcca

SEQ ID NO: 2285355 - RNA, 15 nt, Human
cugggacugagccag

SEQ ID NO: 2285356 - RNA, 16 nt, Human
cugggacugagccagu

SEQ ID NO: 2285357 - RNA, 18 nt, Human
cuggcccgucauguuccu

SEQ ID NO: 2285358 - RNA, 13 nt, Human
cuggccccugggu

SEQ ID NO: 2285359 - RNA, 21 nt, Human
cuggcccgucauguuccucaa

SEQ ID NO: 2285360 - RNA, 14 nt, Human
cuggccccuggguc

SEQ ID NO: 2285361 - RNA, 13 nt, Human
cuggcccugaggu

SEQ ID NO: 2285362 - RNA, 16 nt, Human
cuggcccucuguguug

SEQ ID NO: 2285363 - RNA, 14 nt, Human
cuggcccugaggug

SEQ ID NO: 2285364 - RNA, 13 nt, Human
cuggcccucugug

SEQ ID NO: 2285365 - RNA, 14 nt, Human
cuggcccucugugu

SEQ ID NO: 2285366 - RNA, 14 nt, Human
cuggcccugcccug

SEQ ID NO: 2285367 - RNA, 17 nt, Human
cuggcccugaggugugg

SEQ ID NO: 2285368 - RNA, 19 nt, Human
cuggcccugaggugugggg

SEQ ID NO: 2285369 - RNA, 20 nt, Human
cuggcccugagguguggggg

SEQ ID NO: 2285370 - RNA, 13 nt, Human
cuggcccugcccu

SEQ ID NO: 2285371 - RNA, 11 nt, Human
cuggcccugcc

SEQ ID NO: 2285372 - RNA, 22 nt, Human
cuggccccucagggucccuggu

SEQ ID NO: 2285373 - RNA, 22 nt, Human
cuggcagccucccauccagggc

SEQ ID NO: 2285374 - RNA, 20 nt, Human
cuggcagccucccauccagg

SEQ ID NO: 2285375 - RNA, 23 nt, Human
cuggccccugagaucucugcagg

SEQ ID NO: 2285376 - RNA, 12 nt, Human
cuggccccuggg

SEQ ID NO: 2285377 - RNA, 22 nt, Human
cuggccccugagaucucugcag

SEQ ID NO: 2285378 - RNA, 18 nt, Human
cuggccccugagaucucu

SEQ ID NO: 2285379 - RNA, 12 nt, Human
cuggcccugccu

SEQ ID NO: 2285380 - RNA, 17 nt, Human
cuggccggucugcaagu

SEQ ID NO: 2285381 - RNA, 20 nt, Human
cuggccggucugcaagucag

SEQ ID NO: 2285382 - RNA, 21 nt, Human
cuggccggucugcaagucaga

SEQ ID NO: 2285383 - RNA, 16 nt, Human
cuggccggucugcaag

SEQ ID NO: 2285384 - RNA, 22 nt, Human
cuggccgggaccccgagccugg

SEQ ID NO: 2285385 - RNA, 16 nt, Human
cuggccgggagccuga

SEQ ID NO: 2285386 - RNA, 15 nt, Human
cuggcccugcccugg

SEQ ID NO: 2285387 - RNA, 19 nt, Human
cuggccgucacuugugggg

SEQ ID NO: 2285388 - RNA, 22 nt, Human
cuggccggucugcaagucagag

SEQ ID NO: 2285389 - RNA, 23 nt, Human
cuggccggucugcaagucagagg

SEQ ID NO: 2285390 - RNA, 15 nt, Human
cuggccgugggccug

SEQ ID NO: 2285391 - RNA, 23 nt, Human
cuggccguugauguuggcuggga

SEQ ID NO: 2285392 - RNA, 14 nt, Human
cuggccuagcauac

SEQ ID NO: 2285393 - RNA, 20 nt, Human
cuggcucucccauuuccuga

SEQ ID NO: 2285394 - RNA, 20 nt, Human
cuggcucuccaagugccaga

SEQ ID NO: 2285395 - RNA, 22 nt, Human
cuggcucuccaagugccagagg

SEQ ID NO: 2285396 - RNA, 15 nt, Human
cuggcucuccaagug

SEQ ID NO: 2285397 - RNA, 16 nt, Human
cuggcucuccaagugc

SEQ ID NO: 2285398 - RNA, 17 nt, Human
cuggcucuccaagugcc

SEQ ID NO: 2285399 - RNA, 19 nt, Human
cuggcucuccaagugccag

SEQ ID NO: 2285400 - RNA, 22 nt, Human
cuggccguugauguuggcuggg

SEQ ID NO: 2285401 - RNA, 17 nt, Human
cuggcucucaugggguc

SEQ ID NO: 2285402 - RNA, 12 nt, Human
cuggcucuccaa

SEQ ID NO: 2285403 - RNA, 13 nt, Human
cuggcucuccaag

SEQ ID NO: 2285404 - RNA, 14 nt, Human
cuggcucuccaagu

SEQ ID NO: 2285405 - RNA, 23 nt, Human
cuggcucuccaagugccagaggu

SEQ ID NO: 2285406 - RNA, 13 nt, Human
cuggcucucucca

SEQ ID NO: 2285407 - RNA, 14 nt, Human
cuggcucucuccag

SEQ ID NO: 2285408 - RNA, 15 nt, Human
cuggcucucuccagg

SEQ ID NO: 2285409 - RNA, 16 nt, Human
cuggcucucuccagga

SEQ ID NO: 2285410 - RNA, 12 nt, Human
cuggcucugagc

SEQ ID NO: 2285411 - RNA, 13 nt, Human
cuggcucugagcg

SEQ ID NO: 2285412 - RNA, 20 nt, Human
cuggcucugagcgccuccau

SEQ ID NO: 2285413 - RNA, 21 nt, Human
cuggcucugagcgccuccauc

SEQ ID NO: 2285414 - RNA, 22 nt, Human
cugcucagggaaaagcagcucu

SEQ ID NO: 2285415 - RNA, 16 nt, Human
cugcucagcuucuccu

SEQ ID NO: 2285416 - RNA, 23 nt, Human
cugcuauauuuucaugacuuuuc

SEQ ID NO: 2285417 - RNA, 23 nt, Human
cugcucagggaaaagcagcucuc

SEQ ID NO: 2285418 - RNA, 18 nt, Human
cugcucaguaaagcacuu

SEQ ID NO: 2285419 - RNA, 12 nt, Human
cugcucaucauu

SEQ ID NO: 2285420 - RNA, 19 nt, Human
cugcucauauugugauucu

SEQ ID NO: 2285421 - RNA, 15 nt, Human
cugcucauauuguga

SEQ ID NO: 2285422 - RNA, 19 nt, Human
cugcucaguaaagcacuug

SEQ ID NO: 2285423 - RNA, 18 nt, Human
cugcugaccuccacagcu

SEQ ID NO: 2285424 - RNA, 16 nt, Human
cugcugaccuccacag

SEQ ID NO: 2285425 - RNA, 18 nt, Human
cugcucagcuucuccugu

SEQ ID NO: 2285426 - RNA, 22 nt, Human
cugcugacccagccuguuuuaa

SEQ ID NO: 2285427 - RNA, 22 nt, Human
cugcucaucauucucugucuca

SEQ ID NO: 2285428 - RNA, 18 nt, Human
cugcucaucauucucugu

SEQ ID NO: 2285429 - RNA, 17 nt, Human
cugcucaucauucucug

SEQ ID NO: 2285430 - RNA, 16 nt, Human
cugcucaucauucucu

SEQ ID NO: 2285431 - RNA, 21 nt, Human
cugcugacuguuuucucuuga

SEQ ID NO: 2285432 - RNA, 18 nt, Human
cugcugacuguuuucucu

SEQ ID NO: 2285433 - RNA, 19 nt, Human
cugcugaccuccacagcuu

SEQ ID NO: 2285434 - RNA, 22 nt, Human
cugcuaggugggccagccccuc

SEQ ID NO: 2285435 - RNA, 21 nt, Human
cugcuaggugggccagccccu

SEQ ID NO: 2285436 - RNA, 20 nt, Human
cugcuaggugggccagcccc

SEQ ID NO: 2285437 - RNA, 16 nt, Human
cugcuaggugggccag

SEQ ID NO: 2285438 - RNA, 15 nt, Human
cugcuaggugggcca

SEQ ID NO: 2285439 - RNA, 23 nt, Human
cugcuaggcgagugccaggacuc

SEQ ID NO: 2285440 - RNA, 20 nt, Human
cugcuaggcgagugccagga

SEQ ID NO: 2285441 - RNA, 22 nt, Human
cugcuaggcgagugccaggacu

SEQ ID NO: 2285442 - RNA, 15 nt, Human
cugcuaggcgagugc

SEQ ID NO: 2285443 - RNA, 18 nt, Human
cugcuaggcgagugccag

SEQ ID NO: 2285444 - RNA, 19 nt, Human
cugcuaggcgagugccagg

SEQ ID NO: 2285445 - RNA, 23 nt, Human
cugcuaggugggccagccccucc

SEQ ID NO: 2285446 - RNA, 14 nt, Human
cugcuauagccugg

SEQ ID NO: 2285447 - RNA, 15 nt, Human
cugcuauagccuggg

SEQ ID NO: 2285448 - RNA, 17 nt, Human
cugcuauauuuucauga

SEQ ID NO: 2285449 - RNA, 19 nt, Human
cugcuauauuuucaugacu

SEQ ID NO: 2285450 - RNA, 15 nt, Human
cugcucagcuucucc

SEQ ID NO: 2285451 - RNA, 16 nt, Human
cugccuguaguuagga

SEQ ID NO: 2285452 - RNA, 15 nt, Human
cugccuguaguuagg

SEQ ID NO: 2285453 - RNA, 23 nt, Human
cugccuguugggccaggagccuc

SEQ ID NO: 2285454 - RNA, 21 nt, Human
cugccuguugggccaggagcc

SEQ ID NO: 2285455 - RNA, 22 nt, Human
cugccuguugggccaggagccu

SEQ ID NO: 2285456 - RNA, 23 nt, Human
cugccuccgcgugaucaaagcca

SEQ ID NO: 2285457 - RNA, 23 nt, Human
cugccucccuucaugcauggaaa

SEQ ID NO: 2285458 - RNA, 21 nt, Human
cugccucccuucaugcaugga

SEQ ID NO: 2285459 - RNA, 19 nt, Human
cugccucccuucaugcaug

SEQ ID NO: 2285460 - RNA, 18 nt, Human
cugccucccuucaugcau

SEQ ID NO: 2285461 - RNA, 17 nt, Human
cugccucccuucaugca

SEQ ID NO: 2285462 - RNA, 15 nt, Human
cugccucccuucaug

SEQ ID NO: 2285463 - RNA, 13 nt, Human
cugccuccucuuc

SEQ ID NO: 2285464 - RNA, 14 nt, Human
cugccuccucuuca

SEQ ID NO: 2285465 - RNA, 15 nt, Human
cugccuccucuucaa

SEQ ID NO: 2285466 - RNA, 24 nt, Human
cugccuccucuucaacugaccagc

SEQ ID NO: 2285467 - RNA, 22 nt, Human
cugccucucccaucacuucccu

SEQ ID NO: 2285468 - RNA, 15 nt, Human
cugccucucccauca

SEQ ID NO: 2285469 - RNA, 23 nt, Human
cugccucucccaucacuucccua

SEQ ID NO: 2285470 - RNA, 19 nt, Human
cugccuguaacuugagagu

SEQ ID NO: 2285471 - RNA, 16 nt, Human
cugccuguagcaguga

SEQ ID NO: 2285472 - RNA, 19 nt, Human
cugccuguagcccacucug

SEQ ID NO: 2285473 - RNA, 15 nt, Human
cugccuguagcccac

SEQ ID NO: 2285474 - RNA, 13 nt, Human
cugccuguaguua

SEQ ID NO: 2285475 - RNA, 23 nt, Human
cugccuguagcccacucugcucg

SEQ ID NO: 2285476 - RNA, 22 nt, Human
cugccuguagcccacucugcuc

SEQ ID NO: 2285477 - RNA, 20 nt, Human
cugccuguagcccacucugc

SEQ ID NO: 2285478 - RNA, 16 nt, Human
cugccugguccucaca

SEQ ID NO: 2285479 - RNA, 23 nt, Human
cugccugguccucacacucaccc

SEQ ID NO: 2285480 - RNA, 19 nt, Human
cugccugguccucacacuc

SEQ ID NO: 2285481 - RNA, 17 nt, Human
cugccugguccucacac

SEQ ID NO: 2285482 - RNA, 17 nt, Human
cugccuguucagcucca

SEQ ID NO: 2285483 - RNA, 18 nt, Human
cugccuguucagcuccag

SEQ ID NO: 2285484 - RNA, 19 nt, Human
cugccuguucagcuccagc

SEQ ID NO: 2285485 - RNA, 20 nt, Human
cugccuguugggccaggagc

SEQ ID NO: 2285486 - RNA, 21 nt, Human
cugaugaacucuuaaucaaau

SEQ ID NO: 2285487 - RNA, 20 nt, Human
cugaugaacuuauucuguag

SEQ ID NO: 2285488 - RNA, 23 nt, Human
cugaucugugcuuuccagcucac

SEQ ID NO: 2285489 - RNA, 13 nt, Human
cugaucugguuug

SEQ ID NO: 2285490 - RNA, 13 nt, Human
cugaucugugcuu

SEQ ID NO: 2285491 - RNA, 17 nt, Human
cugaucugugcuuucca

SEQ ID NO: 2285492 - RNA, 18 nt, Human
cugaucugugcuuuccag

SEQ ID NO: 2285493 - RNA, 20 nt, Human
cugaucugugcuuuccagcu

SEQ ID NO: 2285494 - RNA, 21 nt, Human
cugaucugugcuuuccagcuc

SEQ ID NO: 2285495 - RNA, 22 nt, Human
cugaucugugcuuuccagcuca

SEQ ID NO: 2285496 - RNA, 20 nt, Human
cugaucugaugcaagcaaga

SEQ ID NO: 2285497 - RNA, 18 nt, Human
cugaucugacauccccac

SEQ ID NO: 2285498 - RNA, 19 nt, Human
cugaucugacauccccacu

SEQ ID NO: 2285499 - RNA, 20 nt, Human
cugccuccccucuccuuccu

SEQ ID NO: 2285500 - RNA, 13 nt, Human
cugccuccccugu

SEQ ID NO: 2285501 - RNA, 14 nt, Human
cugccucccucacc

SEQ ID NO: 2285502 - RNA, 16 nt, Human
cugccuccccugugca

SEQ ID NO: 2285503 - RNA, 17 nt, Human
cugccuccccugugcag

SEQ ID NO: 2285504 - RNA, 14 nt, Human
cugccucccuucau

SEQ ID NO: 2285505 - RNA, 21 nt, Human
cugccucccucacccugagcc

SEQ ID NO: 2285506 - RNA, 22 nt, Human
cugccucccucacccugagccc

SEQ ID NO: 2285507 - RNA, 22 nt, Human
cugccuccccugugcaguccug

SEQ ID NO: 2285508 - RNA, 18 nt, Human
cugccucccucacccuga

SEQ ID NO: 2285509 - RNA, 19 nt, Human
cugccucccucacccugag

SEQ ID NO: 2285510 - RNA, 20 nt, Human
cugccucccucacccugagc

SEQ ID NO: 2285511 - RNA, 14 nt, Human
cugcuucaaauauu

SEQ ID NO: 2285512 - RNA, 20 nt, Human
cugcuuuugucuaugggacu

SEQ ID NO: 2285513 - RNA, 22 nt, Human
cugcuucaaggauccugagcca

SEQ ID NO: 2285514 - RNA, 23 nt, Human
cugcuucaaggauccugagccag

SEQ ID NO: 2285515 - RNA, 19 nt, Human
cugcuucaaauauuucccu

SEQ ID NO: 2285516 - RNA, 12 nt, Human
cugcuucaagga

SEQ ID NO: 2285517 - RNA, 13 nt, Human
cugcuucaaggau

SEQ ID NO: 2285518 - RNA, 21 nt, Human
cugcuucaaggauccugagcc

SEQ ID NO: 2285519 - RNA, 22 nt, Human
cuggauauuuucaaauuguauc

SEQ ID NO: 2285520 - RNA, 21 nt, Human
cuggauauuuucaaauuguau

SEQ ID NO: 2285521 - RNA, 23 nt, Human
cuggaucaaaguaggcaggacca

SEQ ID NO: 2285522 - RNA, 14 nt, Human
cuggaucacagcug

SEQ ID NO: 2285523 - RNA, 16 nt, Human
cuggaucacagcugcu

SEQ ID NO: 2285524 - RNA, 22 nt, Human
cuggaucacagcugcuuucugu

SEQ ID NO: 2285525 - RNA, 16 nt, Human
cuggauauuuucaaau

SEQ ID NO: 2285526 - RNA, 15 nt, Human
cuggauauuuucaaa

SEQ ID NO: 2285527 - RNA, 13 nt, Human
cuggauauuuuca

SEQ ID NO: 2285528 - RNA, 20 nt, Human
cuggauaggagccugcuggu

SEQ ID NO: 2285529 - RNA, 18 nt, Human
cuggauaggagccugcug

SEQ ID NO: 2285530 - RNA, 19 nt, Human
cuggauaggagccugcugg

SEQ ID NO: 2285531 - RNA, 15 nt, Human
cuggauaacuuaggu

SEQ ID NO: 2285532 - RNA, 13 nt, Human
cuggauaggagcc

SEQ ID NO: 2285533 - RNA, 15 nt, Human
cuggauaggagccug

SEQ ID NO: 2285534 - RNA, 13 nt, Human
cuggauaaaauga

SEQ ID NO: 2285535 - RNA, 16 nt, Human
cuggauaaagccacug

SEQ ID NO: 2285536 - RNA, 17 nt, Human
cuggauaaagccacuga

SEQ ID NO: 2285537 - RNA, 14 nt, Human
cuggauaacuuagg

SEQ ID NO: 2285538 - RNA, 18 nt, Human
cuggaguuucauguacaa

SEQ ID NO: 2285539 - RNA, 22 nt, Human
cuggaguuuuuguuuggagagc

SEQ ID NO: 2285540 - RNA, 23 nt, Human
cuggaguuuuuguuuggagagca

SEQ ID NO: 2285541 - RNA, 18 nt, Human
cuggaguugaucuggaac

SEQ ID NO: 2285542 - RNA, 13 nt, Human
cuggaguuucaug

SEQ ID NO: 2285543 - RNA, 22 nt, Human
cuggaguuucauguacaagaug

SEQ ID NO: 2285544 - RNA, 12 nt, Human
cuggacugaggc

SEQ ID NO: 2285545 - RNA, 19 nt, Human
cuggacugaagccugcagg

SEQ ID NO: 2285546 - RNA, 16 nt, Human
cuggacugaagccugc

SEQ ID NO: 2285547 - RNA, 13 nt, Human
cuggacugaggcc

SEQ ID NO: 2285548 - RNA, 15 nt, Human
cuggacugaggccug

SEQ ID NO: 2285549 - RNA, 16 nt, Human
cuggacugaggccuga

SEQ ID NO: 2285550 - RNA, 18 nt, Human
cuggacugaggccugagc

SEQ ID NO: 2285551 - RNA, 18 nt, Human
cuggacuugagcuuggca

SEQ ID NO: 2285552 - RNA, 20 nt, Human
cuggacugccuugaauaucc

SEQ ID NO: 2285553 - RNA, 22 nt, Human
cuggacugaagccugcaggagu

SEQ ID NO: 2285554 - RNA, 20 nt, Human
cuggacuugagcuuggcagc

SEQ ID NO: 2285555 - RNA, 22 nt, Human
cuggacugccuugaauaucccc

SEQ ID NO: 2285556 - RNA, 13 nt, Human
cuggacuuggagg

SEQ ID NO: 2285557 - RNA, 14 nt, Human
cuggagaaaaugga

SEQ ID NO: 2285558 - RNA, 22 nt, Human
cuggaguugaucuggaacccag

SEQ ID NO: 2285559 - RNA, 20 nt, Human
cuggaguugaucuggaaccc

SEQ ID NO: 2285560 - RNA, 13 nt, Human
cuggacuuuccug

SEQ ID NO: 2285561 - RNA, 14 nt, Human
cuggacuuuccugc

SEQ ID NO: 2285562 - RNA, 15 nt, Human
cuggacuuuccugca

SEQ ID NO: 2285563 - RNA, 16 nt, Human
cuggacuuuccugcaa

SEQ ID NO: 2285564 - RNA, 18 nt, Human
cuggacuuuccugcaacu

SEQ ID NO: 2285565 - RNA, 14 nt, Human
cuggaagcacagcu

SEQ ID NO: 2285566 - RNA, 23 nt, Human
cuggacugaagccugcaggaguu

SEQ ID NO: 2285567 - RNA, 13 nt, Human
cuggaagagagga

SEQ ID NO: 2285568 - RNA, 21 nt, Human
cuggaagacagagaccuccug

SEQ ID NO: 2285569 - RNA, 14 nt, Human
cuggaagauccugc

SEQ ID NO: 2285570 - RNA, 18 nt, Human
cuggaagauccugcgggu

SEQ ID NO: 2285571 - RNA, 12 nt, Human
cuggaagagagg

SEQ ID NO: 2285572 - RNA, 13 nt, Human
cuggaagacagag

SEQ ID NO: 2285573 - RNA, 21 nt, Human
cugcuucaauacccaaauccu

SEQ ID NO: 2285574 - RNA, 14 nt, Human
cuggaacuugggga

SEQ ID NO: 2285575 - RNA, 19 nt, Human
cugcuuuugucuaugggac

SEQ ID NO: 2285576 - RNA, 19 nt, Human
cugcuuuuuaaagaaugcu

SEQ ID NO: 2285577 - RNA, 21 nt, Human
cugcuuuugucuaugggacuc

SEQ ID NO: 2285578 - RNA, 14 nt, Human
cugacaccuuucau

SEQ ID NO: 2285579 - RNA, 17 nt, Human
cugacacguccacccca

SEQ ID NO: 2285580 - RNA, 14 nt, Human
cugacacguccacc

SEQ ID NO: 2285581 - RNA, 19 nt, Human
cugacaccuuugcaggcau

SEQ ID NO: 2285582 - RNA, 17 nt, Human
cugacacucccuugggc

SEQ ID NO: 2285583 - RNA, 13 nt, Human
cugacacugcggg

SEQ ID NO: 2285584 - RNA, 21 nt, Human
cugacacugcggggcuuggcu

SEQ ID NO: 2285585 - RNA, 14 nt, Human
cugacagaaagcag

SEQ ID NO: 2285586 - RNA, 19 nt, Human
cugacacuuuaauuaccaa

SEQ ID NO: 2285587 - RNA, 22 nt, Human
cugacacugguauuccugccuc

SEQ ID NO: 2285588 - RNA, 23 nt, Human
cugacacugcggggcuuggcuga

SEQ ID NO: 2285589 - RNA, 21 nt, Human
cugacacccauguuucucugg

SEQ ID NO: 2285590 - RNA, 13 nt, Human
cugacacccaugu

SEQ ID NO: 2285591 - RNA, 14 nt, Human
cugacacccauguu

SEQ ID NO: 2285592 - RNA, 18 nt, Human
cugacacaggaugaaggc

SEQ ID NO: 2285593 - RNA, 20 nt, Human
cugacacaaaccugccuggg

SEQ ID NO: 2285594 - RNA, 14 nt, Human
cugacacaaaccug

SEQ ID NO: 2285595 - RNA, 16 nt, Human
cugacacaaaccugcc

SEQ ID NO: 2285596 - RNA, 18 nt, Human
cugacacaaaccugccug

SEQ ID NO: 2285597 - RNA, 19 nt, Human
cugacacaaaccugccugg

SEQ ID NO: 2285598 - RNA, 22 nt, Human
cugaagcagaugcaaagaggca

SEQ ID NO: 2285599 - RNA, 13 nt, Human
cugaagcauguuu

SEQ ID NO: 2285600 - RNA, 21 nt, Human
cugaagcagguucccaagcuc

SEQ ID NO: 2285601 - RNA, 20 nt, Human
cugaagcagguucccaagcu

SEQ ID NO: 2285602 - RNA, 19 nt, Human
cugaagcagguucccaagc

SEQ ID NO: 2285603 - RNA, 14 nt, Human
cugaagcagccucu

SEQ ID NO: 2285604 - RNA, 15 nt, Human
cugaagcagccucuc

SEQ ID NO: 2285605 - RNA, 16 nt, Human
cugaagcagccucucc

SEQ ID NO: 2285606 - RNA, 20 nt, Human
cugaagcagccucuccccag

SEQ ID NO: 2285607 - RNA, 14 nt, Human
cugaaagaggccaa

SEQ ID NO: 2285608 - RNA, 14 nt, Human
cugaaagaggcuga

SEQ ID NO: 2285609 - RNA, 14 nt, Human
cugaaaauguaugu

SEQ ID NO: 2285610 - RNA, 14 nt, Human
cugaagcagaugca

SEQ ID NO: 2285611 - RNA, 12 nt, Human
cugaaagccacg

SEQ ID NO: 2285612 - RNA, 11 nt, Human
cugaaagccac

SEQ ID NO: 2285613 - RNA, 22 nt, Human
cugaaagaggcugaggccugga

SEQ ID NO: 2285614 - RNA, 18 nt, Human
cugacacaaaaaguagau

SEQ ID NO: 2285615 - RNA, 21 nt, Human
cugacaaucaacucuaauagu

SEQ ID NO: 2285616 - RNA, 13 nt, Human
cugacaaucaacu

SEQ ID NO: 2285617 - RNA, 14 nt, Human
cugaagccauuguc

SEQ ID NO: 2285618 - RNA, 15 nt, Human
cugaagcauguuuca

SEQ ID NO: 2285619 - RNA, 18 nt, Human
cugaagcauguuucaugu

SEQ ID NO: 2285620 - RNA, 20 nt, Human
cugaagcauguuucauguuu

SEQ ID NO: 2285621 - RNA, 23 nt, Human
cugaagcauguuucauguuuugu

SEQ ID NO: 2285622 - RNA, 16 nt, Human
cugaagccaaagccaa

SEQ ID NO: 2285623 - RNA, 13 nt, Human
cugaagccagccu

SEQ ID NO: 2285624 - RNA, 14 nt, Human
cugaagccagccuu

SEQ ID NO: 2285625 - RNA, 17 nt, Human
cugaagccagccuucuu

SEQ ID NO: 2285626 - RNA, 13 nt, Human
cugacacacagcu

SEQ ID NO: 2285627 - RNA, 15 nt, Human
cugacacacagcucu

SEQ ID NO: 2285628 - RNA, 16 nt, Human
cugacacacagcucug

SEQ ID NO: 2285629 - RNA, 17 nt, Human
cugacacacagcucugu

SEQ ID NO: 2285630 - RNA, 18 nt, Human
cugacacacagcucuguc

SEQ ID NO: 2285631 - RNA, 19 nt, Human
cugacacacagcucugucc

SEQ ID NO: 2285632 - RNA, 20 nt, Human
cugacacacagcucuguccu

SEQ ID NO: 2285633 - RNA, 21 nt, Human
cugacacacagcucuguccug

SEQ ID NO: 2285634 - RNA, 22 nt, Human
cugacacacagcucuguccugg

SEQ ID NO: 2285635 - RNA, 23 nt, Human
cugacacacagcucuguccuggg

SEQ ID NO: 2285636 - RNA, 17 nt, Human
cugaccccucauagccc

SEQ ID NO: 2285637 - RNA, 21 nt, Human
cugaccccucauagcccucac

SEQ ID NO: 2285638 - RNA, 20 nt, Human
cugaccccucauagcccuca

SEQ ID NO: 2285639 - RNA, 12 nt, Human
cugaccccuccu

SEQ ID NO: 2285640 - RNA, 14 nt, Human
cugaccccuccuca

SEQ ID NO: 2285641 - RNA, 15 nt, Human
cugaccccuccucac

SEQ ID NO: 2285642 - RNA, 16 nt, Human
cugaccccuccucacu

SEQ ID NO: 2285643 - RNA, 17 nt, Human
cugaccccuccucacug

SEQ ID NO: 2285644 - RNA, 20 nt, Human
cugaccccuccucacuggcc

SEQ ID NO: 2285645 - RNA, 14 nt, Human
cucuugagccuggg

SEQ ID NO: 2285646 - RNA, 13 nt, Human
cucuugagccugg

SEQ ID NO: 2285647 - RNA, 15 nt, Human
cucuugagggagcuu

SEQ ID NO: 2285648 - RNA, 14 nt, Human
cucuugagggagcu

SEQ ID NO: 2285649 - RNA, 17 nt, Human
cucuugaggccaggagu

SEQ ID NO: 2285650 - RNA, 16 nt, Human
cucuugaggccaggag

SEQ ID NO: 2285651 - RNA, 14 nt, Human
cucuugaggccagg

SEQ ID NO: 2285652 - RNA, 23 nt, Human
cucuugaguuugucgcucaugug

SEQ ID NO: 2285653 - RNA, 21 nt, Human
cucuugauaccccccucuguc

SEQ ID NO: 2285654 - RNA, 18 nt, Human
cucuugauaccccccucu

SEQ ID NO: 2285655 - RNA, 19 nt, Human
cucuugauaccccccucug

SEQ ID NO: 2285656 - RNA, 22 nt, Human
cucuugauucauaaugacuuaa

SEQ ID NO: 2285657 - RNA, 16 nt, Human
cucuugagccugggag

SEQ ID NO: 2285658 - RNA, 15 nt, Human
cucuugagccuggga

SEQ ID NO: 2285659 - RNA, 22 nt, Human
cucuugccccccaccccagccu

SEQ ID NO: 2285660 - RNA, 14 nt, Human
cucuugcccuuccc

SEQ ID NO: 2285661 - RNA, 20 nt, Human
cucuugccccccaccccagc

SEQ ID NO: 2285662 - RNA, 19 nt, Human
cucuugccccccaccccag

SEQ ID NO: 2285663 - RNA, 15 nt, Human
cucuugcccuucccu

SEQ ID NO: 2285664 - RNA, 16 nt, Human
cucuugcccuucccug

SEQ ID NO: 2285665 - RNA, 17 nt, Human
cucuugcccuucccugu

SEQ ID NO: 2285666 - RNA, 19 nt, Human
cucuugcccuucccugucc

SEQ ID NO: 2285667 - RNA, 16 nt, Human
cucuugccccccaccc

SEQ ID NO: 2285668 - RNA, 13 nt, Human
cucuugcccccca

SEQ ID NO: 2285669 - RNA, 12 nt, Human
cucuugcccccc

SEQ ID NO: 2285670 - RNA, 23 nt, Human
cucuugccccaacccccagcacc

SEQ ID NO: 2285671 - RNA, 14 nt, Human
cucuugccccaacc

SEQ ID NO: 2285672 - RNA, 19 nt, Human
cucuugccccaacccccag

SEQ ID NO: 2285673 - RNA, 20 nt, Human
cucuugccccaacccccagc

SEQ ID NO: 2285674 - RNA, 22 nt, Human
cucuugccccaacccccagcac

SEQ ID NO: 2285675 - RNA, 14 nt, Human
cucuuuuuguuuuu

SEQ ID NO: 2285676 - RNA, 20 nt, Human
cucuugcccuucccuguccc

SEQ ID NO: 2285677 - RNA, 21 nt, Human
cucuugcccuucccugucccu

SEQ ID NO: 2285678 - RNA, 22 nt, Human
cucuugcccuucccugucccuc

SEQ ID NO: 2285679 - RNA, 14 nt, Human
cucuugcaggucuc

SEQ ID NO: 2285680 - RNA, 20 nt, Human
cucuugcacccgccucuccc

SEQ ID NO: 2285681 - RNA, 21 nt, Human
cucuugcacccgccucucccg

SEQ ID NO: 2285682 - RNA, 13 nt, Human
cucuugcacccgc

SEQ ID NO: 2285683 - RNA, 14 nt, Human
cucuugcacccgcc

SEQ ID NO: 2285684 - RNA, 15 nt, Human
cucuugcacccgccu

SEQ ID NO: 2285685 - RNA, 19 nt, Human
cucuugcacccgccucucc

SEQ ID NO: 2285686 - RNA, 22 nt, Human
cucuugccacugccucuuccuc

SEQ ID NO: 2285687 - RNA, 18 nt, Human
cucuugcaggucucaacc

SEQ ID NO: 2285688 - RNA, 12 nt, Human
cucuugccccaa

SEQ ID NO: 2285689 - RNA, 24 nt, Human
cucuugauucauaaugacuuaagc

SEQ ID NO: 2285690 - RNA, 13 nt, Human
cucuugauuuuca

SEQ ID NO: 2285691 - RNA, 20 nt, Human
cucuugcaauccacaaucug

SEQ ID NO: 2285692 - RNA, 23 nt, Human
cucuugcaauccacaaucugaca

SEQ ID NO: 2285693 - RNA, 12 nt, Human
cucuugcacccg

SEQ ID NO: 2285694 - RNA, 14 nt, Human
cugaaaaaaaguuu

SEQ ID NO: 2285695 - RNA, 15 nt, Human
cugaaaaaaaguuua

SEQ ID NO: 2285696 - RNA, 18 nt, Human
cugaaaaaaaguuuacaa

SEQ ID NO: 2285697 - RNA, 22 nt, Human
cugaaaaaacaccuagcuuuau

SEQ ID NO: 2285698 - RNA, 20 nt, Human
cugaaaaaaaguuuacaagu

SEQ ID NO: 2285699 - RNA, 21 nt, Human
cugaaaaaacaccuagcuuua

SEQ ID NO: 2285700 - RNA, 12 nt, Human
cugaaaaaucac

SEQ ID NO: 2285701 - RNA, 17 nt, Human
cugaaaaaucacauccu

SEQ ID NO: 2285702 - RNA, 13 nt, Human
cugaaaauauaac

SEQ ID NO: 2285703 - RNA, 15 nt, Human
cugaaaauauaacca

SEQ ID NO: 2285704 - RNA, 21 nt, Human
cugaaaaaugguaauuguugc

SEQ ID NO: 2285705 - RNA, 22 nt, Human
cugaaaaaucuaagugauauaa

SEQ ID NO: 2285706 - RNA, 19 nt, Human
cugaaaaaucuaagugaua

SEQ ID NO: 2285707 - RNA, 21 nt, Human
cugaaaaaucacauccuggcc

SEQ ID NO: 2285708 - RNA, 23 nt, Human
cugaaaaaucacauccuggccug

SEQ ID NO: 2285709 - RNA, 17 nt, Human
cugaaagaggaaugaag

SEQ ID NO: 2285710 - RNA, 13 nt, Human
cugaaagaggaau

SEQ ID NO: 2285711 - RNA, 20 nt, Human
cugaaaaucgaguuuuuccu

SEQ ID NO: 2285712 - RNA, 15 nt, Human
cugaaaaucuaauau

SEQ ID NO: 2285713 - RNA, 16 nt, Human
cugaaaaucuaauauu

SEQ ID NO: 2285714 - RNA, 17 nt, Human
cugaaaaucuaauauua

SEQ ID NO: 2285715 - RNA, 20 nt, Human
cugaaaaucuaauauuaaaa

SEQ ID NO: 2285716 - RNA, 18 nt, Human
cugaaaaugguauuuucc

SEQ ID NO: 2285717 - RNA, 22 nt, Human
cugaaaauauaaccagccauug

SEQ ID NO: 2285718 - RNA, 18 nt, Human
cucugcacaagcugcacc

SEQ ID NO: 2285719 - RNA, 17 nt, Human
cucugcacaagcugcac

SEQ ID NO: 2285720 - RNA, 19 nt, Human
cucugcacaagcugcaccc

SEQ ID NO: 2285721 - RNA, 23 nt, Human
cugaggaagaugggggcaagaag

SEQ ID NO: 2285722 - RNA, 20 nt, Human
cugaggaagcacagcagcau

SEQ ID NO: 2285723 - RNA, 18 nt, Human
cugagcuuggccagaagg

SEQ ID NO: 2285724 - RNA, 18 nt, Human
cugaggaagaugggggca

SEQ ID NO: 2285725 - RNA, 23 nt, Human
cugaggaagaacggggcucuucu

SEQ ID NO: 2285726 - RNA, 23 nt, Human
cugaggaagagggacuguucuuu

SEQ ID NO: 2285727 - RNA, 18 nt, Human
cugaggaagagggacugu

SEQ ID NO: 2285728 - RNA, 15 nt, Human
cugaggaagaacggg

SEQ ID NO: 2285729 - RNA, 18 nt, Human
cugaggaagaacggggcu

SEQ ID NO: 2285730 - RNA, 22 nt, Human
cugaggaacccuuacaguagga

SEQ ID NO: 2285731 - RNA, 17 nt, Human
cugagcuuggccagaag

SEQ ID NO: 2285732 - RNA, 16 nt, Human
cugagcuuggccagaa

SEQ ID NO: 2285733 - RNA, 15 nt, Human
cugagcuuggccaga

SEQ ID NO: 2285734 - RNA, 12 nt, Human
cugagcuuggcc

SEQ ID NO: 2285735 - RNA, 21 nt, Human
cugagcuuggaagcuucuggu

SEQ ID NO: 2285736 - RNA, 20 nt, Human
cugagcuuggaagcuucugg

SEQ ID NO: 2285737 - RNA, 14 nt, Human
cugagcuuggaagc

SEQ ID NO: 2285738 - RNA, 15 nt, Human
cugagcuucucugug

SEQ ID NO: 2285739 - RNA, 16 nt, Human
cugagcuucucuguga

SEQ ID NO: 2285740 - RNA, 15 nt, Human
cugagcugugcaggu

SEQ ID NO: 2285741 - RNA, 22 nt, Human
cugagcuucccccccaccacag

SEQ ID NO: 2285742 - RNA, 22 nt, Human
cugagcuugcagagaugaggcc

SEQ ID NO: 2285743 - RNA, 12 nt, Human
cugagcuuggaa

SEQ ID NO: 2285744 - RNA, 18 nt, Human
cugacccucuccacccca

SEQ ID NO: 2285745 - RNA, 22 nt, Human
cugacccuccuguugcacccag

SEQ ID NO: 2285746 - RNA, 23 nt, Human
cugacccuccuguugcacccagc

SEQ ID NO: 2285747 - RNA, 13 nt, Human
cugacccuccugu

SEQ ID NO: 2285748 - RNA, 14 nt, Human
cugacccuccuguu

SEQ ID NO: 2285749 - RNA, 17 nt, Human
cugacccuccuguugca

SEQ ID NO: 2285750 - RNA, 19 nt, Human
cugacccugcuucaaauau

SEQ ID NO: 2285751 - RNA, 16 nt, Human
cugaccccugcucagu

SEQ ID NO: 2285752 - RNA, 14 nt, Human
cugaccccugcuca

SEQ ID NO: 2285753 - RNA, 13 nt, Human
cugaccccugcuc

SEQ ID NO: 2285754 - RNA, 15 nt, Human
cugagcugccaucca

SEQ ID NO: 2285755 - RNA, 13 nt, Human
cugagcugcucug

SEQ ID NO: 2285756 - RNA, 18 nt, Human
cugagcugaggcagcagu

SEQ ID NO: 2285757 - RNA, 15 nt, Human
cugagcugaggcagc

SEQ ID NO: 2285758 - RNA, 12 nt, Human
cugagcugggau

SEQ ID NO: 2285759 - RNA, 16 nt, Human
cugagcugccauccag

SEQ ID NO: 2285760 - RNA, 16 nt, Human
cugagcugcucugaau

SEQ ID NO: 2285761 - RNA, 13 nt, Human
cugagcugugcag

SEQ ID NO: 2285762 - RNA, 22 nt, Human
cugagcugggaugauuggaggg

SEQ ID NO: 2285763 - RNA, 14 nt, Human
cugaggugggccca

SEQ ID NO: 2285764 - RNA, 15 nt, Human
cugaggugggcccag

SEQ ID NO: 2285765 - RNA, 21 nt, Human
cugaggugggagauguggaaa

SEQ ID NO: 2285766 - RNA, 22 nt, Human
cugaggugggaggaucucuuga

SEQ ID NO: 2285767 - RNA, 13 nt, Human
cugaggugggagg

SEQ ID NO: 2285768 - RNA, 16 nt, Human
cugaggggggccgugc

SEQ ID NO: 2285769 - RNA, 20 nt, Human
cugaggggggccgugcccag

SEQ ID NO: 2285770 - RNA, 21 nt, Human
cugaggggggccgugcccagg

SEQ ID NO: 2285771 - RNA, 23 nt, Human
cugaggggggccgugcccagggg

SEQ ID NO: 2285772 - RNA, 22 nt, Human
cugaggggggccgugcccaggg

SEQ ID NO: 2285773 - RNA, 15 nt, Human
cugaggguccccacc

SEQ ID NO: 2285774 - RNA, 18 nt, Human
cugaggguccccaccugg

SEQ ID NO: 2285775 - RNA, 19 nt, Human
cugaggguccccaccuggg

SEQ ID NO: 2285776 - RNA, 20 nt, Human
cugaggguccccaccuggga

SEQ ID NO: 2285777 - RNA, 21 nt, Human
cugaggguccccaccugggac

SEQ ID NO: 2285778 - RNA, 15 nt, Human
cugaggguggagacu

SEQ ID NO: 2285779 - RNA, 19 nt, Human
cugaggguggagacuaagc

SEQ ID NO: 2285780 - RNA, 20 nt, Human
cugaggguggagacuaagcc

SEQ ID NO: 2285781 - RNA, 19 nt, Human
cugaggggcaucugccccu

SEQ ID NO: 2285782 - RNA, 18 nt, Human
cugaggggcaucugcccc

SEQ ID NO: 2285783 - RNA, 20 nt, Human
cugaggggcaucugccccuc

SEQ ID NO: 2285784 - RNA, 14 nt, Human
cugaggggccucuu

SEQ ID NO: 2285785 - RNA, 23 nt, Human
cugaggggaggaucacuggagcc

SEQ ID NO: 2285786 - RNA, 22 nt, Human
cugaggggaggaucacuggagc

SEQ ID NO: 2285787 - RNA, 17 nt, Human
cugaggggcaucugccc

SEQ ID NO: 2285788 - RNA, 16 nt, Human
cugaggggcaucugcc

SEQ ID NO: 2285789 - RNA, 23 nt, Human
cugaggaauccagacccggcugc

SEQ ID NO: 2285790 - RNA, 21 nt, Human
cugaggggaggaucacuggag

SEQ ID NO: 2285791 - RNA, 16 nt, Human
cugaggaauuucaccu

SEQ ID NO: 2285792 - RNA, 22 nt, Human
cugaguaaucgcuuaaagaugu

SEQ ID NO: 2285793 - RNA, 20 nt, Human
cugaguaagaaaugcugccc

SEQ ID NO: 2285794 - RNA, 21 nt, Human
cugagguuccucugccugccc

SEQ ID NO: 2285795 - RNA, 23 nt, Human
cugagguuccucugccugccccg

SEQ ID NO: 2285796 - RNA, 21 nt, Human
cugaguaaaaaagcugugugc

SEQ ID NO: 2285797 - RNA, 14 nt, Human
cugagguuccucug

SEQ ID NO: 2285798 - RNA, 15 nt, Human
cugagguuccucugc

SEQ ID NO: 2285799 - RNA, 16 nt, Human
cugagguuccucugcc

SEQ ID NO: 2285800 - RNA, 17 nt, Human
cugagguuccucugccu

SEQ ID NO: 2285801 - RNA, 18 nt, Human
cugagguuccucugccug

SEQ ID NO: 2285802 - RNA, 19 nt, Human
cugagguuccucugccugc

SEQ ID NO: 2285803 - RNA, 20 nt, Human
cugagguuccucugccugcc

SEQ ID NO: 2285804 - RNA, 21 nt, Human
cugaggugugggggcugcagc

SEQ ID NO: 2285805 - RNA, 22 nt, Human
cugaggugugggggcugcagca

SEQ ID NO: 2285806 - RNA, 17 nt, Human
cugaggugugggggcug

SEQ ID NO: 2285807 - RNA, 18 nt, Human
cugaggugugggggcugc

SEQ ID NO: 2285808 - RNA, 19 nt, Human
cugaggugugggggcugca

SEQ ID NO: 2285809 - RNA, 20 nt, Human
cugaggugugggggcugcag

SEQ ID NO: 2285810 - RNA, 16 nt, Human
cugaggugggcccagg

SEQ ID NO: 2285811 - RNA, 17 nt, Human
cugaggugggcccagga

SEQ ID NO: 2285812 - RNA, 20 nt, Human
cugaggugggcccaggacca

SEQ ID NO: 2285813 - RNA, 22 nt, Human
cugaggugggcccaggaccagc

SEQ ID NO: 2285814 - RNA, 23 nt, Human
cugaggugggcccaggaccagcu

SEQ ID NO: 2285815 - RNA, 13 nt, Human
cugaggugugggg

SEQ ID NO: 2285816 - RNA, 14 nt, Human
cugagguguggggg

SEQ ID NO: 2285817 - RNA, 16 nt, Human
cugaggugugggggcu

SEQ ID NO: 2285818 - RNA, 14 nt, Human
cugaucucucguga

SEQ ID NO: 2285819 - RNA, 17 nt, Human
cugaucucucgugauug

SEQ ID NO: 2285820 - RNA, 18 nt, Human
cugaucucucgugauuga

SEQ ID NO: 2285821 - RNA, 15 nt, Human
cuccccaucccaugu

SEQ ID NO: 2285822 - RNA, 15 nt, Human
cucccuccccugcca

SEQ ID NO: 2285823 - RNA, 14 nt, Human
cucccuccccugcc

SEQ ID NO: 2285824 - RNA, 11 nt, Human
cucccuccccu

SEQ ID NO: 2285825 - RNA, 21 nt, Human
cucccuccccugcccuggucc

SEQ ID NO: 2285826 - RNA, 18 nt, Human
cucccuccccugcccugg

SEQ ID NO: 2285827 - RNA, 16 nt, Human
cucccuccccugcccu

SEQ ID NO: 2285828 - RNA, 18 nt, Human
cucccuccccugccauuu

SEQ ID NO: 2285829 - RNA, 16 nt, Human
cucccucccucuuucc

SEQ ID NO: 2285830 - RNA, 21 nt, Human
cuccccaggggagagggucug

SEQ ID NO: 2285831 - RNA, 11 nt, Human
cuccccagggg

SEQ ID NO: 2285832 - RNA, 16 nt, Human
cuccccagguccagcu

SEQ ID NO: 2285833 - RNA, 17 nt, Human
cuccccagguccagcuc

SEQ ID NO: 2285834 - RNA, 23 nt, Human
cucccagcucuagacaacccugc

SEQ ID NO: 2285835 - RNA, 20 nt, Human
cucccagcucuagacaaccc

SEQ ID NO: 2285836 - RNA, 18 nt, Human
cucccagcucuagacaac

SEQ ID NO: 2285837 - RNA, 15 nt, Human
cucccagcucuagac

SEQ ID NO: 2285838 - RNA, 11 nt, Human
cucccagccug

SEQ ID NO: 2285839 - RNA, 18 nt, Human
cuccccagguccagcucu

SEQ ID NO: 2285840 - RNA, 19 nt, Human
cuccccagguccagcucug

SEQ ID NO: 2285841 - RNA, 20 nt, Human
cuccccagguccagcucugg

SEQ ID NO: 2285842 - RNA, 21 nt, Human
cuccccagguccagcucugga

SEQ ID NO: 2285843 - RNA, 23 nt, Human
cuccccagguccagcucuggagg

SEQ ID NO: 2285844 - RNA, 11 nt, Human
cuccccaguuc

SEQ ID NO: 2285845 - RNA, 21 nt, Human
cuccccaggguucaguccuca

SEQ ID NO: 2285846 - RNA, 14 nt, Human
cuccccaucccaug

SEQ ID NO: 2285847 - RNA, 18 nt, Human
cucccucugaccugcagg

SEQ ID NO: 2285848 - RNA, 17 nt, Human
cucccucugaccugcag

SEQ ID NO: 2285849 - RNA, 14 nt, Human
cucccucugaccug

SEQ ID NO: 2285850 - RNA, 13 nt, Human
cucccucugaccu

SEQ ID NO: 2285851 - RNA, 22 nt, Human
cucccucucucuucugcuccac

SEQ ID NO: 2285852 - RNA, 21 nt, Human
cucccucucucuucugcucca

SEQ ID NO: 2285853 - RNA, 20 nt, Human
cucccucucucuucugcucc

SEQ ID NO: 2285854 - RNA, 17 nt, Human
cucccucucucuucugc

SEQ ID NO: 2285855 - RNA, 16 nt, Human
cucccucucucuucug

SEQ ID NO: 2285856 - RNA, 15 nt, Human
cucccucucucuucu

SEQ ID NO: 2285857 - RNA, 15 nt, Human
cucccucuccugccu

SEQ ID NO: 2285858 - RNA, 14 nt, Human
cucccucuccugcc

SEQ ID NO: 2285859 - RNA, 13 nt, Human
cucccucuccugc

SEQ ID NO: 2285860 - RNA, 21 nt, Human
cucccuccgauccuuccuccc

SEQ ID NO: 2285861 - RNA, 23 nt, Human
cucccuccccugcccugguccag

SEQ ID NO: 2285862 - RNA, 18 nt, Human
cucccuccgauccuuccu

SEQ ID NO: 2285863 - RNA, 17 nt, Human
cucccucuggcccugcc

SEQ ID NO: 2285864 - RNA, 15 nt, Human
cucccucuggcccug

SEQ ID NO: 2285865 - RNA, 14 nt, Human
cucccucuggcccu

SEQ ID NO: 2285866 - RNA, 16 nt, Human
cucccucuggaucaaa

SEQ ID NO: 2285867 - RNA, 11 nt, Human
cucccucugga

SEQ ID NO: 2285868 - RNA, 13 nt, Human
cucccucuggauc

SEQ ID NO: 2285869 - RNA, 14 nt, Human
cucccucuggauca

SEQ ID NO: 2285870 - RNA, 22 nt, Human
cucccucugccugaaccuucca

SEQ ID NO: 2285871 - RNA, 17 nt, Human
cucccucugaggcugua

SEQ ID NO: 2285872 - RNA, 20 nt, Human
cucccucugaggcuguagga

SEQ ID NO: 2285873 - RNA, 17 nt, Human
cucccucuccugccuac

SEQ ID NO: 2285874 - RNA, 16 nt, Human
cucccucugaggcugu

SEQ ID NO: 2285875 - RNA, 21 nt, Human
cucccucugaccugcaggcca

SEQ ID NO: 2285876 - RNA, 20 nt, Human
cucccucuggcccugccuuc

SEQ ID NO: 2285877 - RNA, 19 nt, Human
cucccucuggcccugccuu

SEQ ID NO: 2285878 - RNA, 18 nt, Human
cucccucuggcccugccu

SEQ ID NO: 2285879 - RNA, 14 nt, Human
cucccucuucucaa

SEQ ID NO: 2285880 - RNA, 15 nt, Human
cucccucuucucaag

SEQ ID NO: 2285881 - RNA, 20 nt, Human
cucccucuucucaagugccu

SEQ ID NO: 2285882 - RNA, 15 nt, Human
cucccucuuucccuc

SEQ ID NO: 2285883 - RNA, 19 nt, Human
cucccucuuucccucccuu

SEQ ID NO: 2285884 - RNA, 15 nt, Human
cuccgggaccuggug

SEQ ID NO: 2285885 - RNA, 14 nt, Human
cuccgggagagggg

SEQ ID NO: 2285886 - RNA, 18 nt, Human
cuccggggagcgcccgcg

SEQ ID NO: 2285887 - RNA, 20 nt, Human
cuccgguaaaacaccggaga

SEQ ID NO: 2285888 - RNA, 21 nt, Human
cuccggggagcgcccgcgccc

SEQ ID NO: 2285889 - RNA, 22 nt, Human
cuccgcuuucuacccagcgagc

SEQ ID NO: 2285890 - RNA, 15 nt, Human
cuccguccagccgcc

SEQ ID NO: 2285891 - RNA, 21 nt, Human
cuccuagacugacccugauca

SEQ ID NO: 2285892 - RNA, 15 nt, Human
cuccuagagaacgca

SEQ ID NO: 2285893 - RNA, 18 nt, Human
cuccuagagaacgcagcc

SEQ ID NO: 2285894 - RNA, 20 nt, Human
cuccuagagaacgcagcccu

SEQ ID NO: 2285895 - RNA, 19 nt, Human
cuccuagagggaggggccu

SEQ ID NO: 2285896 - RNA, 18 nt, Human
cuccuagagggaggggcc

SEQ ID NO: 2285897 - RNA, 15 nt, Human
cuccuagagggaggg

SEQ ID NO: 2285898 - RNA, 13 nt, Human
cuccuagagggag

SEQ ID NO: 2285899 - RNA, 21 nt, Human
cuccuagagaacgcagcccua

SEQ ID NO: 2285900 - RNA, 17 nt, Human
cuccuagagacagaagc

SEQ ID NO: 2285901 - RNA, 18 nt, Human
cuccuagagacagaagca

SEQ ID NO: 2285902 - RNA, 23 nt, Human
cuccuagagacagaagcaggcug

SEQ ID NO: 2285903 - RNA, 23 nt, Human
cuccggugugccugcagccccgc

SEQ ID NO: 2285904 - RNA, 19 nt, Human
cuccggugugccugcagcc

SEQ ID NO: 2285905 - RNA, 18 nt, Human
cuccggugugccugcagc

SEQ ID NO: 2285906 - RNA, 13 nt, Human
cuccggugugccu

SEQ ID NO: 2285907 - RNA, 14 nt, Human
cuccguauuucaga

SEQ ID NO: 2285908 - RNA, 13 nt, Human
cuccguauuucag

SEQ ID NO: 2285909 - RNA, 15 nt, Human
cuccguauuucagac

SEQ ID NO: 2285910 - RNA, 21 nt, Human
cuccgcuuucuacccagcgag

SEQ ID NO: 2285911 - RNA, 20 nt, Human
cuccgcuuucuacccagcga

SEQ ID NO: 2285912 - RNA, 19 nt, Human
cucagacauguuuuccgug

SEQ ID NO: 2285913 - RNA, 20 nt, Human
cucagacauguuuuccguga

SEQ ID NO: 2285914 - RNA, 13 nt, Human
cucagacauuggc

SEQ ID NO: 2285915 - RNA, 21 nt, Human
cuccagaauuucccaaagcag

SEQ ID NO: 2285916 - RNA, 17 nt, Human
cucagaaucucaaauaa

SEQ ID NO: 2285917 - RNA, 16 nt, Human
cucagaaucucaaaua

SEQ ID NO: 2285918 - RNA, 20 nt, Human
cuccagacaaaccagaagca

SEQ ID NO: 2285919 - RNA, 22 nt, Human
cucagacaggaaagggaaggcc

SEQ ID NO: 2285920 - RNA, 16 nt, Human
cuccagacacaugucc

SEQ ID NO: 2285921 - RNA, 17 nt, Human
cucagacauuggcaccu

SEQ ID NO: 2285922 - RNA, 22 nt, Human
cuccagaauuucccaaagcagu

SEQ ID NO: 2285923 - RNA, 11 nt, Human
cuccagacaca

SEQ ID NO: 2285924 - RNA, 17 nt, Human
cuccaggcugucuuuca

SEQ ID NO: 2285925 - RNA, 23 nt, Human
cuccaggcuguaucccaugagcc

SEQ ID NO: 2285926 - RNA, 22 nt, Human
cuccaggcuguaucccaugagc

SEQ ID NO: 2285927 - RNA, 17 nt, Human
cuccaguuuucaguuga

SEQ ID NO: 2285928 - RNA, 16 nt, Human
cuccagugguugcugu

SEQ ID NO: 2285929 - RNA, 19 nt, Human
cuccagugguugcuguuga

SEQ ID NO: 2285930 - RNA, 21 nt, Human
cuccagggaguccccuccccg

SEQ ID NO: 2285931 - RNA, 18 nt, Human
cuccagugccagcaauga

SEQ ID NO: 2285932 - RNA, 20 nt, Human
cuccaguggggcaagauuuu

SEQ ID NO: 2285933 - RNA, 14 nt, Human
cuccagugccaaca

SEQ ID NO: 2285934 - RNA, 23 nt, Human
cuccaguggggcaagauuuuccu

SEQ ID NO: 2285935 - RNA, 15 nt, Human
cuccagugguugcug

SEQ ID NO: 2285936 - RNA, 22 nt, Human
cuccaggugcacaagcuccaag

SEQ ID NO: 2285937 - RNA, 18 nt, Human
cuccaggugcacaagcuc

SEQ ID NO: 2285938 - RNA, 14 nt, Human
cuccagggaguccc

SEQ ID NO: 2285939 - RNA, 17 nt, Human
cuccagggaguccccuc

SEQ ID NO: 2285940 - RNA, 18 nt, Human
cuccagggaguccccucc

SEQ ID NO: 2285941 - RNA, 20 nt, Human
cuccagggaguccccucccc

SEQ ID NO: 2285942 - RNA, 19 nt, Human
cuccaggugcacaagcucc

SEQ ID NO: 2285943 - RNA, 20 nt, Human
cuccaggugcacaagcucca

SEQ ID NO: 2285944 - RNA, 14 nt, Human
cucccaccucagcc

SEQ ID NO: 2285945 - RNA, 14 nt, Human
cuccauacucagga

SEQ ID NO: 2285946 - RNA, 22 nt, Human
cuccauaaccccacccuugccc

SEQ ID NO: 2285947 - RNA, 14 nt, Human
cuccauaaccccac

SEQ ID NO: 2285948 - RNA, 15 nt, Human
cuccauaaccccacc

SEQ ID NO: 2285949 - RNA, 16 nt, Human
cucccaccucagccuc

SEQ ID NO: 2285950 - RNA, 17 nt, Human
cucccaccucagccucc

SEQ ID NO: 2285951 - RNA, 16 nt, Human
cucccagcccuaugga

SEQ ID NO: 2285952 - RNA, 21 nt, Human
cucccagcccuauggaugugg

SEQ ID NO: 2285953 - RNA, 18 nt, Human
cucccagcccuauggaug

SEQ ID NO: 2285954 - RNA, 19 nt, Human
cucccagcccuauggaugu

SEQ ID NO: 2285955 - RNA, 21 nt, Human
cucccagcaacacaagcugga

SEQ ID NO: 2285956 - RNA, 19 nt, Human
cucccagcagcccuaagga

SEQ ID NO: 2285957 - RNA, 15 nt, Human
cucgugguaggacug

SEQ ID NO: 2285958 - RNA, 16 nt, Human
cucgugguaggacugu

SEQ ID NO: 2285959 - RNA, 12 nt, Human
cucucccuguug

SEQ ID NO: 2285960 - RNA, 13 nt, Human
cucucccuggccc

SEQ ID NO: 2285961 - RNA, 12 nt, Human
cucucccuggcc

SEQ ID NO: 2285962 - RNA, 13 nt, Human
cucucccuuggau

SEQ ID NO: 2285963 - RNA, 19 nt, Human
cucuccuccugcccaccug

SEQ ID NO: 2285964 - RNA, 15 nt, Human
cucuccuccugccca

SEQ ID NO: 2285965 - RNA, 20 nt, Human
cucuccuccccaaggagaca

SEQ ID NO: 2285966 - RNA, 16 nt, Human
cucuccgaccagacac

SEQ ID NO: 2285967 - RNA, 13 nt, Human
cucuccuccuuuu

SEQ ID NO: 2285968 - RNA, 20 nt, Human
cucuccuccuuuucacaguu

SEQ ID NO: 2285969 - RNA, 15 nt, Human
cucucuuugggaaug

SEQ ID NO: 2285970 - RNA, 17 nt, Human
cucucuuugggaauguu

SEQ ID NO: 2285971 - RNA, 18 nt, Human
cucucuuugggaauguuu

SEQ ID NO: 2285972 - RNA, 14 nt, Human
cucucuuuguucuc

SEQ ID NO: 2285973 - RNA, 15 nt, Human
cucucuuuguucuca

SEQ ID NO: 2285974 - RNA, 18 nt, Human
cucucuuuguucucagcu

SEQ ID NO: 2285975 - RNA, 15 nt, Human
cucucuuuccuucuu

SEQ ID NO: 2285976 - RNA, 17 nt, Human
cucucuuuccuucuugc

SEQ ID NO: 2285977 - RNA, 20 nt, Human
cucucuuuccuucuugccuu

SEQ ID NO: 2285978 - RNA, 18 nt, Human
cucucuucugcuccaccc

SEQ ID NO: 2285979 - RNA, 15 nt, Human
cucuccucugccuca

SEQ ID NO: 2285980 - RNA, 13 nt, Human
cucucuugcaccc

SEQ ID NO: 2285981 - RNA, 15 nt, Human
cucucuugguuuccu

SEQ ID NO: 2285982 - RNA, 14 nt, Human
cucucuugcacccg

SEQ ID NO: 2285983 - RNA, 16 nt, Human
cucucuugcacccgcc

SEQ ID NO: 2285984 - RNA, 17 nt, Human
cucucuucugcuccacc

SEQ ID NO: 2285985 - RNA, 20 nt, Human
cucuccuccugcccaccugu

SEQ ID NO: 2285986 - RNA, 20 nt, Human
cucuccucggcccccuccau

SEQ ID NO: 2285987 - RNA, 20 nt, Human
cucucuugauuaagaucuca

SEQ ID NO: 2285988 - RNA, 10 nt, Human
cucuccucug

SEQ ID NO: 2285989 - RNA, 17 nt, Human
cucucuggccuucggcc

SEQ ID NO: 2285990 - RNA, 22 nt, Human
cucucuggccuucggccuccau

SEQ ID NO: 2285991 - RNA, 19 nt, Human
cucucuggccuucggccuc

SEQ ID NO: 2285992 - RNA, 16 nt, Human
cucugaaaucugaaga

SEQ ID NO: 2285993 - RNA, 12 nt, Human
cucugaaaccag

SEQ ID NO: 2285994 - RNA, 19 nt, Human
cucucuuuuuggaggugcu

SEQ ID NO: 2285995 - RNA, 20 nt, Human
cucucuuuuuggaggugcuu

SEQ ID NO: 2285996 - RNA, 22 nt, Human
cucucuuuguucucagcucccc

SEQ ID NO: 2285997 - RNA, 19 nt, Human
cucucuuuguucucagcuc

SEQ ID NO: 2285998 - RNA, 20 nt, Human
cucucuuuguucucagcucc

SEQ ID NO: 2285999 - RNA, 21 nt, Human
cucucuuuguucucagcuccc

SEQ ID NO: 2286000 - RNA, 18 nt, Human
cucucuuuuuggaggugc

SEQ ID NO: 2286001 - RNA, 15 nt, Human
cucugaaacccugga

SEQ ID NO: 2286002 - RNA, 17 nt, Human
cucugaaaccaguguua

SEQ ID NO: 2286003 - RNA, 17 nt, Human
cucugaaaacggcccuc

SEQ ID NO: 2286004 - RNA, 22 nt, Human
cucugaaaucugaagaccucga

SEQ ID NO: 2286005 - RNA, 16 nt, Human
cucugcacaagcugca

SEQ ID NO: 2286006 - RNA, 22 nt, Human
cucgggcgagucacugccucuc

SEQ ID NO: 2286007 - RNA, 14 nt, Human
cucgggcuccugug

SEQ ID NO: 2286008 - RNA, 21 nt, Human
cucgggcgagucacugccucu

SEQ ID NO: 2286009 - RNA, 19 nt, Human
cucgggcgagucacugccu

SEQ ID NO: 2286010 - RNA, 15 nt, Human
cucgggcuccugugc

SEQ ID NO: 2286011 - RNA, 17 nt, Human
cucgggcuccugugccc

SEQ ID NO: 2286012 - RNA, 23 nt, Human
cucgggcugagaacccugcgugg

SEQ ID NO: 2286013 - RNA, 21 nt, Human
cucggguggcuagucagagag

SEQ ID NO: 2286014 - RNA, 24 nt, Human
cucgggcccaggccaucuuccagg

SEQ ID NO: 2286015 - RNA, 18 nt, Human
cucgguggacccagggau

SEQ ID NO: 2286016 - RNA, 11 nt, Human
cucggugccuu

SEQ ID NO: 2286017 - RNA, 14 nt, Human
cucgguggacccag

SEQ ID NO: 2286018 - RNA, 13 nt, Human
cucgguuucucca

SEQ ID NO: 2286019 - RNA, 18 nt, Human
cucguauaugucucaggu

SEQ ID NO: 2286020 - RNA, 14 nt, Human
cucguagccaucuc

SEQ ID NO: 2286021 - RNA, 14 nt, Human
cucguaacugguuu

SEQ ID NO: 2286022 - RNA, 20 nt, Human
cucguggccuuccccagccu

SEQ ID NO: 2286023 - RNA, 15 nt, Human
cucgugggagagcca

SEQ ID NO: 2286024 - RNA, 21 nt, Human
cucguggccuuccccagccuc

SEQ ID NO: 2286025 - RNA, 18 nt, Human
cucguggccuuccccagc

SEQ ID NO: 2286026 - RNA, 14 nt, Human
cucguggccuuccc

SEQ ID NO: 2286027 - RNA, 18 nt, Human
cucguggccagcccggcu

SEQ ID NO: 2286028 - RNA, 19 nt, Human
cucguggccagcccggcug

SEQ ID NO: 2286029 - RNA, 12 nt, Human
cucguggccagc

SEQ ID NO: 2286030 - RNA, 13 nt, Human
cucguggccagcc

SEQ ID NO: 2286031 - RNA, 14 nt, Human
cucguggccagccc

SEQ ID NO: 2286032 - RNA, 16 nt, Human
cucguggccagcccgg

SEQ ID NO: 2286033 - RNA, 17 nt, Human
cucguggccagcccggc

SEQ ID NO: 2286034 - RNA, 15 nt, Human
cucguccucccccug

SEQ ID NO: 2286035 - RNA, 14 nt, Human
cucguccucccccu

SEQ ID NO: 2286036 - RNA, 12 nt, Human
cucguccucccc

SEQ ID NO: 2286037 - RNA, 20 nt, Human
cucguauaugucucaggucc

SEQ ID NO: 2286038 - RNA, 22 nt, Human
cucgucaucauuuuuccuuccc

SEQ ID NO: 2286039 - RNA, 17 nt, Human
cucgaacuccugaccuu

SEQ ID NO: 2286040 - RNA, 16 nt, Human
cucgaacuccugaccu

SEQ ID NO: 2286041 - RNA, 23 nt, Human
cucgaacauggaacucauuccug

SEQ ID NO: 2286042 - RNA, 22 nt, Human
cucgaacauggaacucauuccu

SEQ ID NO: 2286043 - RNA, 20 nt, Human
cucgaaacacagaaaccuuu

SEQ ID NO: 2286044 - RNA, 13 nt, Human
cucgaacuccuga

SEQ ID NO: 2286045 - RNA, 19 nt, Human
cucgaaacacagaaaccuu

SEQ ID NO: 2286046 - RNA, 15 nt, Human
cucgaaacacagaaa

SEQ ID NO: 2286047 - RNA, 14 nt, Human
cucgaaacacagaa

SEQ ID NO: 2286048 - RNA, 19 nt, Human
cuccuuuuucucccucugg

SEQ ID NO: 2286049 - RNA, 21 nt, Human
cuccuuuuucucccucuggau

SEQ ID NO: 2286050 - RNA, 18 nt, Human
cuccuuuuuauguugcca

SEQ ID NO: 2286051 - RNA, 14 nt, Human
cuccuuuuucuccc

SEQ ID NO: 2286052 - RNA, 15 nt, Human
cuccuuuuucucccu

SEQ ID NO: 2286053 - RNA, 18 nt, Human
cuccuuuuucucccucug

SEQ ID NO: 2286054 - RNA, 14 nt, Human
cuccuuucuuucua

SEQ ID NO: 2286055 - RNA, 13 nt, Human
cuccuuucuuuuu

SEQ ID NO: 2286056 - RNA, 19 nt, Human
cuccuuucuuuuucuucuu

SEQ ID NO: 2286057 - RNA, 20 nt, Human
cuccuuucuuuuucuucuuc

SEQ ID NO: 2286058 - RNA, 21 nt, Human
cuccuuucuuuuucuucuucc

SEQ ID NO: 2286059 - RNA, 14 nt, Human
cuccuuugcacuga

SEQ ID NO: 2286060 - RNA, 15 nt, Human
cuccuuugcacugag

SEQ ID NO: 2286061 - RNA, 23 nt, Human
cuccuuugugaggaagccgcugg

SEQ ID NO: 2286062 - RNA, 16 nt, Human
cuccuuugcacugagg

SEQ ID NO: 2286063 - RNA, 18 nt, Human
cuccuuugcacugagggc

SEQ ID NO: 2286064 - RNA, 20 nt, Human
cuccuuugcacugagggcca

SEQ ID NO: 2286065 - RNA, 21 nt, Human
cuccuuugcacugagggccac

SEQ ID NO: 2286066 - RNA, 16 nt, Human
cuccuuugcaggcuca

SEQ ID NO: 2286067 - RNA, 22 nt, Human
cuccuuugcacugagggccaca

SEQ ID NO: 2286068 - RNA, 23 nt, Human
cuccuuugcugaggccuccagcu

SEQ ID NO: 2286069 - RNA, 24 nt, Human
cuccuuuucacaguucucuccuuc

SEQ ID NO: 2286070 - RNA, 22 nt, Human
cuccuagccugugccucuggga

SEQ ID NO: 2286071 - RNA, 16 nt, Human
cuccuagccacccacc

SEQ ID NO: 2286072 - RNA, 23 nt, Human
cuccuagagggaggggccuaggc

SEQ ID NO: 2286073 - RNA, 15 nt, Human
cuccuagcagagaga

SEQ ID NO: 2286074 - RNA, 16 nt, Human
cuccuuuagcgcccag

SEQ ID NO: 2286075 - RNA, 17 nt, Human
cuccuuuagcgcccagu

SEQ ID NO: 2286076 - RNA, 14 nt, Human
cuccuuucuccagc

SEQ ID NO: 2286077 - RNA, 17 nt, Human
cuccuuucuccagccag

SEQ ID NO: 2286078 - RNA, 18 nt, Human
cuccuuucuccagccagc

SEQ ID NO: 2286079 - RNA, 19 nt, Human
cuccuuucuccagccagca

SEQ ID NO: 2286080 - RNA, 21 nt, Human
cuccuuucuccagccagcaau

SEQ ID NO: 2286081 - RNA, 16 nt, Human
cuccuuucucuucucu

SEQ ID NO: 2286082 - RNA, 22 nt, Human
cuccuuuagcgcccaguugggu

SEQ ID NO: 2286083 - RNA, 14 nt, Human
cuccuuuagcaggu

SEQ ID NO: 2286084 - RNA, 15 nt, Human
cuccuaggaaaauac

SEQ ID NO: 2286085 - RNA, 20 nt, Human
cuccuuuagcaggugguccu

SEQ ID NO: 2286086 - RNA, 12 nt, Human
cguguuuguguu

SEQ ID NO: 2286087 - RNA, 13 nt, Human
cguuaaaauacca

SEQ ID NO: 2286088 - RNA, 20 nt, Human
cguuaagggaaggaacucug

SEQ ID NO: 2286089 - RNA, 14 nt, Human
cguuaccaggcagg

SEQ ID NO: 2286090 - RNA, 15 nt, Human
cgugucgugggugug

SEQ ID NO: 2286091 - RNA, 17 nt, Human
cguguccgacucuucug

SEQ ID NO: 2286092 - RNA, 15 nt, Human
cgugucccucucgga

SEQ ID NO: 2286093 - RNA, 11 nt, Human
cguguuugcac

SEQ ID NO: 2286094 - RNA, 20 nt, Human
cguguuucugacucugagcu

SEQ ID NO: 2286095 - RNA, 22 nt, Human
cguguccccuauccuacuuccc

SEQ ID NO: 2286096 - RNA, 16 nt, Human
cgugucaccugugcuu

SEQ ID NO: 2286097 - RNA, 16 nt, Human
cguguccccggccuca

SEQ ID NO: 2286098 - RNA, 17 nt, Human
cguguccccggccucag

SEQ ID NO: 2286099 - RNA, 14 nt, Human
cguguauccugggg

SEQ ID NO: 2286100 - RNA, 15 nt, Human
cguguauccuggggc

SEQ ID NO: 2286101 - RNA, 16 nt, Human
cguguauccuggggcu

SEQ ID NO: 2286102 - RNA, 13 nt, Human
cuaaaggccucuu

SEQ ID NO: 2286103 - RNA, 22 nt, Human
cuaaaguguauuuuuuuacuaa

SEQ ID NO: 2286104 - RNA, 19 nt, Human
cuaaaggcuaccuuuguau

SEQ ID NO: 2286105 - RNA, 17 nt, Human
cuaaaggcuaccuuugu

SEQ ID NO: 2286106 - RNA, 13 nt, Human
cuaaaguuuacag

SEQ ID NO: 2286107 - RNA, 14 nt, Human
cuaaaguuuacagu

SEQ ID NO: 2286108 - RNA, 18 nt, Human
cuaaaguuuacaguaaau

SEQ ID NO: 2286109 - RNA, 19 nt, Human
cuaaaguuuacaguaaaua

SEQ ID NO: 2286110 - RNA, 21 nt, Human
cuaaaguuuacaguaaauaaa

SEQ ID NO: 2286111 - RNA, 20 nt, Human
cuaacuagagcagcccugga

SEQ ID NO: 2286112 - RNA, 19 nt, Human
cuaaaguguguuguugcuu

SEQ ID NO: 2286113 - RNA, 16 nt, Human
cuaaagagagaaugua

SEQ ID NO: 2286114 - RNA, 21 nt, Human
cuaaagaaagauuacuuagag

SEQ ID NO: 2286115 - RNA, 14 nt, Human
cuaaagcugccagc

SEQ ID NO: 2286116 - RNA, 21 nt, Human
cuaaagaagguuucagaaaga

SEQ ID NO: 2286117 - RNA, 18 nt, Human
cuaaagaaaaagucaucc

SEQ ID NO: 2286118 - RNA, 19 nt, Human
cuaaagaaaaagucaucca

SEQ ID NO: 2286119 - RNA, 21 nt, Human
cguguuuuauuccuguauguu

SEQ ID NO: 2286120 - RNA, 19 nt, Human
cuaaagagagaauguagau

SEQ ID NO: 2286121 - RNA, 18 nt, Human
cuaaagagagaauguaga

SEQ ID NO: 2286122 - RNA, 15 nt, Human
cuaaagcugccagcc

SEQ ID NO: 2286123 - RNA, 16 nt, Human
cuaaaggcuaccuuug

SEQ ID NO: 2286124 - RNA, 15 nt, Human
cuaaaggcuaccuuu

SEQ ID NO: 2286125 - RNA, 13 nt, Human
cuaacuggaagca

SEQ ID NO: 2286126 - RNA, 20 nt, Human
cuaacucauacugugcugga

SEQ ID NO: 2286127 - RNA, 14 nt, Human
cuaacuggacuggu

SEQ ID NO: 2286128 - RNA, 19 nt, Human
cuaacucagaaacaucagu

SEQ ID NO: 2286129 - RNA, 17 nt, Human
cuaacucauacugugcu

SEQ ID NO: 2286130 - RNA, 21 nt, Human
cuaacuagagcagcccuggag

SEQ ID NO: 2286131 - RNA, 15 nt, Human
cuaacucaccuaacu

SEQ ID NO: 2286132 - RNA, 14 nt, Human
cuaacuccagugaa

SEQ ID NO: 2286133 - RNA, 20 nt, Human
cuaacugcuacaaauacucu

SEQ ID NO: 2286134 - RNA, 20 nt, Human
cgguuccacgucccccuggg

SEQ ID NO: 2286135 - RNA, 18 nt, Human
cgguuccacgucccccug

SEQ ID NO: 2286136 - RNA, 19 nt, Human
cgguuccacgucccccugg

SEQ ID NO: 2286137 - RNA, 15 nt, Human
cgguuuauauaagcu

SEQ ID NO: 2286138 - RNA, 16 nt, Human
cgguucaccagccucu

SEQ ID NO: 2286139 - RNA, 15 nt, Human
cgguucaccagccuc

SEQ ID NO: 2286140 - RNA, 14 nt, Human
cgguucaccagccu

SEQ ID NO: 2286141 - RNA, 13 nt, Human
cgguucaccagcc

SEQ ID NO: 2286142 - RNA, 20 nt, Human
cgguuaugaaauucaccccc

SEQ ID NO: 2286143 - RNA, 12 nt, Human
cgguucuuccag

SEQ ID NO: 2286144 - RNA, 14 nt, Human
cguaauaauuauua

SEQ ID NO: 2286145 - RNA, 21 nt, Human
cguaaugcuuagagaauguuc

SEQ ID NO: 2286146 - RNA, 16 nt, Human
cguaauuaaaagaauu

SEQ ID NO: 2286147 - RNA, 13 nt, Human
cguaaugcuuaga

SEQ ID NO: 2286148 - RNA, 17 nt, Human
cguaauaauuauuauua

SEQ ID NO: 2286149 - RNA, 16 nt, Human
cguacacauuuuauuu

SEQ ID NO: 2286150 - RNA, 13 nt, Human
cguacacauuuua

SEQ ID NO: 2286151 - RNA, 19 nt, Human
cggugggcauuugugaggc

SEQ ID NO: 2286152 - RNA, 15 nt, Human
cggagacagugaucu

SEQ ID NO: 2286153 - RNA, 12 nt, Human
cggagacagggu

SEQ ID NO: 2286154 - RNA, 18 nt, Human
cggagaaccuugugccug

SEQ ID NO: 2286155 - RNA, 15 nt, Human
cggagacggaguccc

SEQ ID NO: 2286156 - RNA, 24 nt, Human
cggagaagagcuguucacagccag

SEQ ID NO: 2286157 - RNA, 23 nt, Human
cggagaagagcuguucacagcca

SEQ ID NO: 2286158 - RNA, 20 nt, Human
cggugugccugcagccccgc

SEQ ID NO: 2286159 - RNA, 17 nt, Human
cggugugccugcagccc

SEQ ID NO: 2286160 - RNA, 15 nt, Human
cggugugccugcagc

SEQ ID NO: 2286161 - RNA, 16 nt, Human
cggugugcaccagggu

SEQ ID NO: 2286162 - RNA, 15 nt, Human
cggugugcaccaggg

SEQ ID NO: 2286163 - RNA, 21 nt, Human
cggugguaccaggucuccucc

SEQ ID NO: 2286164 - RNA, 17 nt, Human
cggugguaccaggucuc

SEQ ID NO: 2286165 - RNA, 19 nt, Human
cggugggccuugcugggga

SEQ ID NO: 2286166 - RNA, 19 nt, Human
cggugggccuuguccccug

SEQ ID NO: 2286167 - RNA, 13 nt, Human
cggugggccuugc

SEQ ID NO: 2286168 - RNA, 18 nt, Human
cggugggccuugcugggg

SEQ ID NO: 2286169 - RNA, 16 nt, Human
cguaauuuugccaaau

SEQ ID NO: 2286170 - RNA, 15 nt, Human
cgcauccuagucucu

SEQ ID NO: 2286171 - RNA, 16 nt, Human
cgcauccuagucucua

SEQ ID NO: 2286172 - RNA, 19 nt, Human
cgcauccuagucucuauca

SEQ ID NO: 2286173 - RNA, 14 nt, Human
cgcaucuucuccau

SEQ ID NO: 2286174 - RNA, 13 nt, Human
cgcaucuucucca

SEQ ID NO: 2286175 - RNA, 17 nt, Human
cgccuguaguccuagcc

SEQ ID NO: 2286176 - RNA, 20 nt, Human
cgccuguagucccagcuacu

SEQ ID NO: 2286177 - RNA, 21 nt, Human
cgcaucuucuccaucuggcag

SEQ ID NO: 2286178 - RNA, 16 nt, Human
cgcaucuucuccaucu

SEQ ID NO: 2286179 - RNA, 15 nt, Human
cgcaucuucuccauc

SEQ ID NO: 2286180 - RNA, 13 nt, Human
cgccuguuccccc

SEQ ID NO: 2286181 - RNA, 15 nt, Human
cgccuguucccccgc

SEQ ID NO: 2286182 - RNA, 19 nt, Human
cgccuguucccccgccgcu

SEQ ID NO: 2286183 - RNA, 20 nt, Human
cgccuguaguccuagccacu

SEQ ID NO: 2286184 - RNA, 16 nt, Human
cgccuuaaggauguuc

SEQ ID NO: 2286185 - RNA, 12 nt, Human
cgcaucauaugc

SEQ ID NO: 2286186 - RNA, 13 nt, Human
cgcaucagacaga

SEQ ID NO: 2286187 - RNA, 19 nt, Human
cgcaucaaaagacaauucu

SEQ ID NO: 2286188 - RNA, 22 nt, Human
cgcaucaaaagacaauucuuua

SEQ ID NO: 2286189 - RNA, 14 nt, Human
cgcaucaaaagaca

SEQ ID NO: 2286190 - RNA, 15 nt, Human
cgcaucaaaagacaa

SEQ ID NO: 2286191 - RNA, 18 nt, Human
cgcaucaaaagacaauuc

SEQ ID NO: 2286192 - RNA, 23 nt, Human
cgauacugcgacuuucugccugg

SEQ ID NO: 2286193 - RNA, 15 nt, Human
cgcauaggaccuuuc

SEQ ID NO: 2286194 - RNA, 19 nt, Human
cgauacugcgacuuucugc

SEQ ID NO: 2286195 - RNA, 16 nt, Human
cgaguuuggucccugg

SEQ ID NO: 2286196 - RNA, 15 nt, Human
cgauaaucagagaaa

SEQ ID NO: 2286197 - RNA, 20 nt, Human
cgauacugcgacuuucugcc

SEQ ID NO: 2286198 - RNA, 22 nt, Human
cgauacugcgacuuucugccug

SEQ ID NO: 2286199 - RNA, 18 nt, Human
cgcugcugcgcccugggc

SEQ ID NO: 2286200 - RNA, 18 nt, Human
cgcugccccuggcagccc

SEQ ID NO: 2286201 - RNA, 19 nt, Human
cgcuggaccuugaacuggg

SEQ ID NO: 2286202 - RNA, 23 nt, Human
cgcuggaccuugaacuggguacu

SEQ ID NO: 2286203 - RNA, 22 nt, Human
cgccuucacuccggugugccug

SEQ ID NO: 2286204 - RNA, 23 nt, Human
cgccuuagguacuuauuccagau

SEQ ID NO: 2286205 - RNA, 22 nt, Human
cgccuuagcacuaccacuccug

SEQ ID NO: 2286206 - RNA, 21 nt, Human
cgccuguucccccgccgcuuu

SEQ ID NO: 2286207 - RNA, 21 nt, Human
cgccuuagcauguuugcugaa

SEQ ID NO: 2286208 - RNA, 13 nt, Human
cgcugccccuggc

SEQ ID NO: 2286209 - RNA, 16 nt, Human
cgcugccccuggcagc

SEQ ID NO: 2286210 - RNA, 17 nt, Human
cgcugccccuggcagcc

SEQ ID NO: 2286211 - RNA, 17 nt, Human
cgcuggggccaguuggu

SEQ ID NO: 2286212 - RNA, 23 nt, Human
cgcuggccgggaccccgagccug

SEQ ID NO: 2286213 - RNA, 18 nt, Human
cgcuggccgggaccccga

SEQ ID NO: 2286214 - RNA, 20 nt, Human
cgcuggacucucagucucug

SEQ ID NO: 2286215 - RNA, 19 nt, Human
cgcugcugcgcccugggcu

SEQ ID NO: 2286216 - RNA, 20 nt, Human
cgcugcugcgcccugggcuc

SEQ ID NO: 2286217 - RNA, 15 nt, Human
cgcugcugcugcugc

SEQ ID NO: 2286218 - RNA, 20 nt, Human
cgcugcugcugcugcgcccu

SEQ ID NO: 2286219 - RNA, 20 nt, Human
cgcuggggccaguugguccc

SEQ ID NO: 2286220 - RNA, 17 nt, Human
cgcugggcugagccccu

SEQ ID NO: 2286221 - RNA, 14 nt, Human
cgcugggcugagcc

SEQ ID NO: 2286222 - RNA, 15 nt, Human
cgcugggcugagccc

SEQ ID NO: 2286223 - RNA, 20 nt, Human
cgagguggaucacagaggcu

SEQ ID NO: 2286224 - RNA, 21 nt, Human
cgaggucaacagagaaggcag

SEQ ID NO: 2286225 - RNA, 23 nt, Human
cgaggucaacagagaaggcagga

SEQ ID NO: 2286226 - RNA, 17 nt, Human
cgaggucaacagagaag

SEQ ID NO: 2286227 - RNA, 16 nt, Human
cgaggucaacagagaa

SEQ ID NO: 2286228 - RNA, 15 nt, Human
cgaggucaacagaga

SEQ ID NO: 2286229 - RNA, 16 nt, Human
cgagguaugaggucua

SEQ ID NO: 2286230 - RNA, 20 nt, Human
cgagguagaguuugaaggag

SEQ ID NO: 2286231 - RNA, 23 nt, Human
cgagguggaucacagaggcuucu

SEQ ID NO: 2286232 - RNA, 22 nt, Human
cgagguggaucacagaggcuuc

SEQ ID NO: 2286233 - RNA, 19 nt, Human
cgaguagcugagauuauag

SEQ ID NO: 2286234 - RNA, 22 nt, Human
cgaguuguggaaagccucugcu

SEQ ID NO: 2286235 - RNA, 14 nt, Human
cgaguuuccccaga

SEQ ID NO: 2286236 - RNA, 17 nt, Human
cgaguuuggucccuggg

SEQ ID NO: 2286237 - RNA, 18 nt, Human
cgauacaccgggccugga

SEQ ID NO: 2286238 - RNA, 20 nt, Human
cgauacaccgggccuggaga

SEQ ID NO: 2286239 - RNA, 21 nt, Human
cgauacaccgggccuggagaa

SEQ ID NO: 2286240 - RNA, 19 nt, Human
cuaggccucagccagagaa

SEQ ID NO: 2286241 - RNA, 15 nt, Human
cuaggcgagugccag

SEQ ID NO: 2286242 - RNA, 18 nt, Human
cuaggcuacaauuuucuc

SEQ ID NO: 2286243 - RNA, 19 nt, Human
cuaggcgagugccaggacu

SEQ ID NO: 2286244 - RNA, 20 nt, Human
cuaggcgagugccaggacuc

SEQ ID NO: 2286245 - RNA, 16 nt, Human
cuaggcgagugccagg

SEQ ID NO: 2286246 - RNA, 17 nt, Human
cuaggcgagugccagga

SEQ ID NO: 2286247 - RNA, 18 nt, Human
cuaggcgagugccaggac

SEQ ID NO: 2286248 - RNA, 13 nt, Human
cuaggccugggga

SEQ ID NO: 2286249 - RNA, 12 nt, Human
cuaggccugggg

SEQ ID NO: 2286250 - RNA, 14 nt, Human
cuaggccuggccag

SEQ ID NO: 2286251 - RNA, 15 nt, Human
cuaggccuggccaga

SEQ ID NO: 2286252 - RNA, 18 nt, Human
cuaggccuggccagaugc

SEQ ID NO: 2286253 - RNA, 19 nt, Human
cuaggccuggccagaugca

SEQ ID NO: 2286254 - RNA, 18 nt, Human
cuaggccucagccagaga

SEQ ID NO: 2286255 - RNA, 17 nt, Human
cuaggccucagccagag

SEQ ID NO: 2286256 - RNA, 16 nt, Human
cuaggccucagccaga

SEQ ID NO: 2286257 - RNA, 15 nt, Human
cuaggccucagccag

SEQ ID NO: 2286258 - RNA, 13 nt, Human
cuaggccuggcca

SEQ ID NO: 2286259 - RNA, 12 nt, Human
cuaggccgggcg

SEQ ID NO: 2286260 - RNA, 23 nt, Human
cuaggcccccacuugccucuucc

SEQ ID NO: 2286261 - RNA, 13 nt, Human
cuaggccucagcc

SEQ ID NO: 2286262 - RNA, 19 nt, Human
cuaggcccccacuugccuc

SEQ ID NO: 2286263 - RNA, 14 nt, Human
cuagcccaggagag

SEQ ID NO: 2286264 - RNA, 17 nt, Human
cuaggcccccacuugcc

SEQ ID NO: 2286265 - RNA, 20 nt, Human
cuaggcccccacuugccucu

SEQ ID NO: 2286266 - RNA, 22 nt, Human
cuaggcccccacuugccucuuc

SEQ ID NO: 2286267 - RNA, 19 nt, Human
cuagccagaggagagagga

SEQ ID NO: 2286268 - RNA, 17 nt, Human
cuagccagaggagagag

SEQ ID NO: 2286269 - RNA, 18 nt, Human
cuagcccaaugaaaugaa

SEQ ID NO: 2286270 - RNA, 17 nt, Human
cuagccauuccugguac

SEQ ID NO: 2286271 - RNA, 20 nt, Human
cuagccauuccugguaccca

SEQ ID NO: 2286272 - RNA, 21 nt, Human
cuagccauuccugguacccag

SEQ ID NO: 2286273 - RNA, 13 nt, Human
cuagcccaggaga

SEQ ID NO: 2286274 - RNA, 14 nt, Human
cuagccauuccugg

SEQ ID NO: 2286275 - RNA, 20 nt, Human
cuagccagcacuuguauaua

SEQ ID NO: 2286276 - RNA, 15 nt, Human
cuagccauuccuggu

SEQ ID NO: 2286277 - RNA, 22 nt, Human
cuagaaucagccuaggggucag

SEQ ID NO: 2286278 - RNA, 21 nt, Human
cuagaauauccuacuucucca

SEQ ID NO: 2286279 - RNA, 19 nt, Human
cuagaauauccuacuucuc

SEQ ID NO: 2286280 - RNA, 20 nt, Human
cuagaauauccuacuucucc

SEQ ID NO: 2286281 - RNA, 20 nt, Human
cuagaaucuggagagcuaga

SEQ ID NO: 2286282 - RNA, 16 nt, Human
cuagaaguuacugaau

SEQ ID NO: 2286283 - RNA, 17 nt, Human
cuagaaguuacugaaug

SEQ ID NO: 2286284 - RNA, 18 nt, Human
cuagaaguuacugaaugc

SEQ ID NO: 2286285 - RNA, 19 nt, Human
cuagaaguuacugaaugca

SEQ ID NO: 2286286 - RNA, 20 nt, Human
cuagaaguuacugaaugcac

SEQ ID NO: 2286287 - RNA, 21 nt, Human
cuagaauuuaucacacuucug

SEQ ID NO: 2286288 - RNA, 12 nt, Human
cuagaauuuauu

SEQ ID NO: 2286289 - RNA, 13 nt, Human
cuagaauuuauuc

SEQ ID NO: 2286290 - RNA, 16 nt, Human
cuagaauucccucucu

SEQ ID NO: 2286291 - RNA, 20 nt, Human
cuagaauucccucucucuga

SEQ ID NO: 2286292 - RNA, 22 nt, Human
cuagaauucccucucucugacu

SEQ ID NO: 2286293 - RNA, 15 nt, Human
cuagaauucuagugc

SEQ ID NO: 2286294 - RNA, 16 nt, Human
cuagaauucuagugcu

SEQ ID NO: 2286295 - RNA, 18 nt, Human
cuagaauucuagugcugc

SEQ ID NO: 2286296 - RNA, 19 nt, Human
cuagaauucuagugcugcu

SEQ ID NO: 2286297 - RNA, 20 nt, Human
cuagaauucuagugcugcug

SEQ ID NO: 2286298 - RNA, 20 nt, Human
cuagcauacguacacauuuu

SEQ ID NO: 2286299 - RNA, 19 nt, Human
cuagcauacguacacauuu

SEQ ID NO: 2286300 - RNA, 18 nt, Human
cuagcauacguacacauu

SEQ ID NO: 2286301 - RNA, 16 nt, Human
cuagcauacguacaca

SEQ ID NO: 2286302 - RNA, 13 nt, Human
cuagacacugcca

SEQ ID NO: 2286303 - RNA, 14 nt, Human
cuagacauucuguc

SEQ ID NO: 2286304 - RNA, 15 nt, Human
cuagacauucugucg

SEQ ID NO: 2286305 - RNA, 16 nt, Human
cuagacauucugucgc

SEQ ID NO: 2286306 - RNA, 14 nt, Human
cuagggagagaccc

SEQ ID NO: 2286307 - RNA, 17 nt, Human
cuagggaccccuccucc

SEQ ID NO: 2286308 - RNA, 20 nt, Human
cuagggaccccuccucccuu

SEQ ID NO: 2286309 - RNA, 20 nt, Human
cuagggaaaugaucaguuuu

SEQ ID NO: 2286310 - RNA, 15 nt, Human
cuagggaccccuccu

SEQ ID NO: 2286311 - RNA, 16 nt, Human
cuagggaccccuccuc

SEQ ID NO: 2286312 - RNA, 14 nt, Human
cuagggaagggugg

SEQ ID NO: 2286313 - RNA, 15 nt, Human
cuaggcuggagccca

SEQ ID NO: 2286314 - RNA, 16 nt, Human
cuagggaaacuucccg

SEQ ID NO: 2286315 - RNA, 17 nt, Human
cuagggaaacuucccgu

SEQ ID NO: 2286316 - RNA, 23 nt, Human
cuagggaggaccuuaucugugcg

SEQ ID NO: 2286317 - RNA, 21 nt, Human
cuagggaggaccuuaucugug

SEQ ID NO: 2286318 - RNA, 14 nt, Human
cuagggaggaccuu

SEQ ID NO: 2286319 - RNA, 15 nt, Human
cuagggagagacccu

SEQ ID NO: 2286320 - RNA, 21 nt, Human
cuaggggucagggaccaagga

SEQ ID NO: 2286321 - RNA, 23 nt, Human
cuaggggucuuguuaagugcagu

SEQ ID NO: 2286322 - RNA, 16 nt, Human
cuaggggucaggcucc

SEQ ID NO: 2286323 - RNA, 18 nt, Human
cuaggggucaggcuccau

SEQ ID NO: 2286324 - RNA, 23 nt, Human
cuagggggagccccuucugcuca

SEQ ID NO: 2286325 - RNA, 14 nt, Human
cuagggggaaguga

SEQ ID NO: 2286326 - RNA, 14 nt, Human
cuagggaagauaau

SEQ ID NO: 2286327 - RNA, 20 nt, Human
cuaggcucagagaugugcac

SEQ ID NO: 2286328 - RNA, 13 nt, Human
cuaggcuccaccc

SEQ ID NO: 2286329 - RNA, 22 nt, Human
cuaggcucagagaugugcaccc

SEQ ID NO: 2286330 - RNA, 20 nt, Human
cuaggcuacaauuuucuccc

SEQ ID NO: 2286331 - RNA, 12 nt, Human
cuaggcucagag

SEQ ID NO: 2286332 - RNA, 13 nt, Human
cuaggcucagaga

SEQ ID NO: 2286333 - RNA, 15 nt, Human
cuaggcucagagaug

SEQ ID NO: 2286334 - RNA, 17 nt, Human
cuaggguggcccuugca

SEQ ID NO: 2286335 - RNA, 13 nt, Human
cuaggguggcccu

SEQ ID NO: 2286336 - RNA, 15 nt, Human
cuaggguccugggga

SEQ ID NO: 2286337 - RNA, 14 nt, Human
cuaggguccugggg

SEQ ID NO: 2286338 - RNA, 13 nt, Human
cuaggguccuggg

SEQ ID NO: 2286339 - RNA, 19 nt, Human
cuaguuugauuaaauucuu

SEQ ID NO: 2286340 - RNA, 17 nt, Human
cuaguuugauuaaauuc

SEQ ID NO: 2286341 - RNA, 14 nt, Human
cuaguucuguagaa

SEQ ID NO: 2286342 - RNA, 13 nt, Human
cuauaaaacaggu

SEQ ID NO: 2286343 - RNA, 16 nt, Human
cuauaaacaauuacau

SEQ ID NO: 2286344 - RNA, 20 nt, Human
cuaguuuucuccucccagga

SEQ ID NO: 2286345 - RNA, 20 nt, Human
cuaguuugauuaaauucuug

SEQ ID NO: 2286346 - RNA, 15 nt, Human
cuaguucuguagaaa

SEQ ID NO: 2286347 - RNA, 15 nt, Human
cuaguuugauuaaau

SEQ ID NO: 2286348 - RNA, 23 nt, Human
cuauaaagaagaacuugcaugga

SEQ ID NO: 2286349 - RNA, 17 nt, Human
cuauaaacaauuacaug

SEQ ID NO: 2286350 - RNA, 16 nt, Human
cuauaaaguaaagcua

SEQ ID NO: 2286351 - RNA, 23 nt, Human
cuacuaacaaucagcuccuuccu

SEQ ID NO: 2286352 - RNA, 15 nt, Human
cuacuaaaaaugcaa

SEQ ID NO: 2286353 - RNA, 14 nt, Human
cuacuaaaaaugca

SEQ ID NO: 2286354 - RNA, 19 nt, Human
cuaccuugugacccagcac

SEQ ID NO: 2286355 - RNA, 14 nt, Human
cuacuaaugauguu

SEQ ID NO: 2286356 - RNA, 13 nt, Human
cuacuaaugaugu

SEQ ID NO: 2286357 - RNA, 15 nt, Human
cuacuaauuccacac

SEQ ID NO: 2286358 - RNA, 12 nt, Human
cuacuaauucca

SEQ ID NO: 2286359 - RNA, 18 nt, Human
cuacuacaucgcccucca

SEQ ID NO: 2286360 - RNA, 16 nt, Human
cuacuacaucgcccuc

SEQ ID NO: 2286361 - RNA, 17 nt, Human
cuacuaauuccacaccu

SEQ ID NO: 2286362 - RNA, 22 nt, Human
cuacuagagucugaacagcugu

SEQ ID NO: 2286363 - RNA, 22 nt, Human
cuaccuugaggucuuuugacau

SEQ ID NO: 2286364 - RNA, 14 nt, Human
cuaccuugugaccc

SEQ ID NO: 2286365 - RNA, 21 nt, Human
cuaccuugguucccccacuga

SEQ ID NO: 2286366 - RNA, 23 nt, Human
cuaccuugaggucuuuugacaug

SEQ ID NO: 2286367 - RNA, 16 nt, Human
cuaccuugggggaacc

SEQ ID NO: 2286368 - RNA, 19 nt, Human
cuaccuugaaaauaagaau

SEQ ID NO: 2286369 - RNA, 14 nt, Human
cuaccuugaaaaua

SEQ ID NO: 2286370 - RNA, 13 nt, Human
cuaccuucuguag

SEQ ID NO: 2286371 - RNA, 14 nt, Human
cuaccuucuguagu

SEQ ID NO: 2286372 - RNA, 15 nt, Human
cuaccuucuguaguu

SEQ ID NO: 2286373 - RNA, 18 nt, Human
cuaccuucauuucaggag

SEQ ID NO: 2286374 - RNA, 19 nt, Human
cuaccuuccagucaggaug

SEQ ID NO: 2286375 - RNA, 20 nt, Human
cuaccugauuggugcaaccc

SEQ ID NO: 2286376 - RNA, 18 nt, Human
cuaccuuccaguuccuca

SEQ ID NO: 2286377 - RNA, 12 nt, Human
cuaccuucugua

SEQ ID NO: 2286378 - RNA, 16 nt, Human
cuaccugaggggccuc

SEQ ID NO: 2286379 - RNA, 19 nt, Human
cuaccugaggggccucuua

SEQ ID NO: 2286380 - RNA, 23 nt, Human
cuaccugaggggccucuuauggg

SEQ ID NO: 2286381 - RNA, 15 nt, Human
cuacucacagucucu

SEQ ID NO: 2286382 - RNA, 20 nt, Human
cuacucaagaggcugaggca

SEQ ID NO: 2286383 - RNA, 16 nt, Human
cuacucaagaggcuga

SEQ ID NO: 2286384 - RNA, 18 nt, Human
cuacuaugccagaugccu

SEQ ID NO: 2286385 - RNA, 21 nt, Human
cuacuacaucgcccuccacau

SEQ ID NO: 2286386 - RNA, 15 nt, Human
cuacuagaugucuuu

SEQ ID NO: 2286387 - RNA, 14 nt, Human
cuacuauauaugug

SEQ ID NO: 2286388 - RNA, 20 nt, Human
cuacuagggaaaugccuuug

SEQ ID NO: 2286389 - RNA, 18 nt, Human
cuacucacagucucuuua

SEQ ID NO: 2286390 - RNA, 17 nt, Human
cuacucacagucucuuu

SEQ ID NO: 2286391 - RNA, 13 nt, Human
cucagaagggagg

SEQ ID NO: 2286392 - RNA, 20 nt, Human
cucagaaggcaaaugacuuu

SEQ ID NO: 2286393 - RNA, 14 nt, Human
cucagaaggcucuu

SEQ ID NO: 2286394 - RNA, 15 nt, Human
cucagaaggcucuuc

SEQ ID NO: 2286395 - RNA, 13 nt, Human
cucagaagguauu

SEQ ID NO: 2286396 - RNA, 20 nt, Human
cucagaagggaggcuggggu

SEQ ID NO: 2286397 - RNA, 20 nt, Human
cucagaaggcucuucugacu

SEQ ID NO: 2286398 - RNA, 14 nt, Human
cucagaagggaggc

SEQ ID NO: 2286399 - RNA, 19 nt, Human
cucagaagguauuccuuuu

SEQ ID NO: 2286400 - RNA, 16 nt, Human
cucagaagguauuccu

SEQ ID NO: 2286401 - RNA, 12 nt, Human
cucagaauauug

SEQ ID NO: 2286402 - RNA, 23 nt, Human
cucagaauccaagugaacacuag

SEQ ID NO: 2286403 - RNA, 11 nt, Human
cucagaaucua

SEQ ID NO: 2286404 - RNA, 20 nt, Human
cucagaaucuacccaaagga

SEQ ID NO: 2286405 - RNA, 19 nt, Human
cucagaaguuucuucuuua

SEQ ID NO: 2286406 - RNA, 16 nt, Human
cucagaaguuucuucu

SEQ ID NO: 2286407 - RNA, 15 nt, Human
cucacuuuucuccau

SEQ ID NO: 2286408 - RNA, 18 nt, Human
cucagaaacacuggggcu

SEQ ID NO: 2286409 - RNA, 19 nt, Human
cucagaaacacuggggcug

SEQ ID NO: 2286410 - RNA, 21 nt, Human
cucagaaacacuggggcuggc

SEQ ID NO: 2286411 - RNA, 19 nt, Human
cucagaaggcaaaugacuu

SEQ ID NO: 2286412 - RNA, 19 nt, Human
cucagaaaacaaggaugaa

SEQ ID NO: 2286413 - RNA, 23 nt, Human
cucagaaaacaaggaugaauuaa

SEQ ID NO: 2286414 - RNA, 21 nt, Human
cucaccuggggugugggaggc

SEQ ID NO: 2286415 - RNA, 14 nt, Human
cucaccuguacucu

SEQ ID NO: 2286416 - RNA, 13 nt, Human
cucaccuguugcu

SEQ ID NO: 2286417 - RNA, 15 nt, Human
cucaccuguugcuua

SEQ ID NO: 2286418 - RNA, 12 nt, Human
cucaccuggggu

SEQ ID NO: 2286419 - RNA, 21 nt, Human
cucaccuggggcugcuggccu

SEQ ID NO: 2286420 - RNA, 17 nt, Human
cucaccuggggcugcug

SEQ ID NO: 2286421 - RNA, 20 nt, Human
cucaccuggggcugcuggcc

SEQ ID NO: 2286422 - RNA, 11 nt, Human
cucaccugggg

SEQ ID NO: 2286423 - RNA, 21 nt, Human
cucaccugggcaccuggggag

SEQ ID NO: 2286424 - RNA, 20 nt, Human
cucaccugggcaccugggga

SEQ ID NO: 2286425 - RNA, 21 nt, Human
cucaccugcuggccccucacc

SEQ ID NO: 2286426 - RNA, 19 nt, Human
cucaccugggcaccugggg

SEQ ID NO: 2286427 - RNA, 18 nt, Human
cucaccuugcaacacaca

SEQ ID NO: 2286428 - RNA, 17 nt, Human
cucaccuguugcuuaca

SEQ ID NO: 2286429 - RNA, 20 nt, Human
cucaccuguugcuuacaauu

SEQ ID NO: 2286430 - RNA, 21 nt, Human
cucaccuguugcuuacaauuu

SEQ ID NO: 2286431 - RNA, 22 nt, Human
cucaccuguugcuuacaauuuu

SEQ ID NO: 2286432 - RNA, 21 nt, Human
cucaccuugcaacacacagac

SEQ ID NO: 2286433 - RNA, 20 nt, Human
cucaccuugcaacacacaga

SEQ ID NO: 2286434 - RNA, 19 nt, Human
cucaccuugcaacacacag

SEQ ID NO: 2286435 - RNA, 17 nt, Human
cucaccuuggcaccaga

SEQ ID NO: 2286436 - RNA, 16 nt, Human
cucaccuuggcaccag

SEQ ID NO: 2286437 - RNA, 14 nt, Human
cucacuuuucucca

SEQ ID NO: 2286438 - RNA, 20 nt, Human
cucacuuuccuccugaggcu

SEQ ID NO: 2286439 - RNA, 14 nt, Human
cucacuucacccug

SEQ ID NO: 2286440 - RNA, 21 nt, Human
cucacuuaucccaagagaaug

SEQ ID NO: 2286441 - RNA, 22 nt, Human
cucaccuugcaacacacagaca

SEQ ID NO: 2286442 - RNA, 19 nt, Human
cucaccuuggcaccagaca

SEQ ID NO: 2286443 - RNA, 20 nt, Human
cucacuucugggcuucaucu

SEQ ID NO: 2286444 - RNA, 18 nt, Human
cucacuuccauacagcuc

SEQ ID NO: 2286445 - RNA, 15 nt, Human
cucacuugcccacac

SEQ ID NO: 2286446 - RNA, 20 nt, Human
cucacuuccauacagcucua

SEQ ID NO: 2286447 - RNA, 21 nt, Human
cucacuuggugauauguccua

SEQ ID NO: 2286448 - RNA, 16 nt, Human
cucaccucuaaaacag

SEQ ID NO: 2286449 - RNA, 12 nt, Human
cucaccucugcc

SEQ ID NO: 2286450 - RNA, 23 nt, Human
cucaccucaugcccacccccugc

SEQ ID NO: 2286451 - RNA, 14 nt, Human
cucaccucuggacu

SEQ ID NO: 2286452 - RNA, 19 nt, Human
cucaccucugccucaaugu

SEQ ID NO: 2286453 - RNA, 18 nt, Human
cucaccucugccucaaug

SEQ ID NO: 2286454 - RNA, 16 nt, Human
cucaccucugccucaa

SEQ ID NO: 2286455 - RNA, 15 nt, Human
cucaccucugccuca

SEQ ID NO: 2286456 - RNA, 14 nt, Human
cucaccucugccuc

SEQ ID NO: 2286457 - RNA, 13 nt, Human
cucaccucugccu

SEQ ID NO: 2286458 - RNA, 21 nt, Human
cucaccucuggacuggcuaga

SEQ ID NO: 2286459 - RNA, 15 nt, Human
cucaccucuggacug

SEQ ID NO: 2286460 - RNA, 22 nt, Human
cucaccucuggacuggcuagag

SEQ ID NO: 2286461 - RNA, 19 nt, Human
cucaccugagucacccuac

SEQ ID NO: 2286462 - RNA, 13 nt, Human
cucaccugccccu

SEQ ID NO: 2286463 - RNA, 19 nt, Human
cucaccugcuggccccuca

SEQ ID NO: 2286464 - RNA, 18 nt, Human
cucaccugcuggccccuc

SEQ ID NO: 2286465 - RNA, 16 nt, Human
cucaccugcuggcccc

SEQ ID NO: 2286466 - RNA, 15 nt, Human
cucaccugcuggccc

SEQ ID NO: 2286467 - RNA, 18 nt, Human
cucaccugccccucaacu

SEQ ID NO: 2286468 - RNA, 14 nt, Human
cucaccugccccuc

SEQ ID NO: 2286469 - RNA, 16 nt, Human
cucaccugccccucaa

SEQ ID NO: 2286470 - RNA, 14 nt, Human
cucaccucaugccc

SEQ ID NO: 2286471 - RNA, 17 nt, Human
cucaccuaacucauacu

SEQ ID NO: 2286472 - RNA, 23 nt, Human
cucaccuaauguuuaugagccag

SEQ ID NO: 2286473 - RNA, 21 nt, Human
cucaccguggcuaagaguguc

SEQ ID NO: 2286474 - RNA, 15 nt, Human
cucaccgcagucguc

SEQ ID NO: 2286475 - RNA, 21 nt, Human
cucaccgcagucgucgcacag

SEQ ID NO: 2286476 - RNA, 16 nt, Human
cucaccucccccaucu

SEQ ID NO: 2286477 - RNA, 15 nt, Human
cucaccucaugccca

SEQ ID NO: 2286478 - RNA, 17 nt, Human
cucaccucaugcccacc

SEQ ID NO: 2286479 - RNA, 13 nt, Human
cucaccucucccu

SEQ ID NO: 2286480 - RNA, 14 nt, Human
cucaccucucccuu

SEQ ID NO: 2286481 - RNA, 15 nt, Human
cucaccucucccuug

SEQ ID NO: 2286482 - RNA, 16 nt, Human
cucaccucucccuugg

SEQ ID NO: 2286483 - RNA, 17 nt, Human
cucaccucucccuugga

SEQ ID NO: 2286484 - RNA, 14 nt, Human
cucacccgaggcug

SEQ ID NO: 2286485 - RNA, 14 nt, Human
cucacccugagccc

SEQ ID NO: 2286486 - RNA, 14 nt, Human
cucacccuggggcu

SEQ ID NO: 2286487 - RNA, 21 nt, Human
cucacccugccuuaucuugca

SEQ ID NO: 2286488 - RNA, 15 nt, Human
cucacccugcuacac

SEQ ID NO: 2286489 - RNA, 13 nt, Human
cucacccugccuu

SEQ ID NO: 2286490 - RNA, 19 nt, Human
cucacccugagccccuucc

SEQ ID NO: 2286491 - RNA, 20 nt, Human
cucacccugagccccuuccu

SEQ ID NO: 2286492 - RNA, 14 nt, Human
cucacccugccuua

SEQ ID NO: 2286493 - RNA, 15 nt, Human
cucacccugccuuau

SEQ ID NO: 2286494 - RNA, 20 nt, Human
cucacaaccugaaccuagga

SEQ ID NO: 2286495 - RNA, 15 nt, Human
cucacaagaagacca

SEQ ID NO: 2286496 - RNA, 17 nt, Human
cucacaagaagaccaga

SEQ ID NO: 2286497 - RNA, 19 nt, Human
cucacaagaagaccagacu

SEQ ID NO: 2286498 - RNA, 12 nt, Human
cucacacagcca

SEQ ID NO: 2286499 - RNA, 21 nt, Human
cucacaauaaaaauggcucag

SEQ ID NO: 2286500 - RNA, 22 nt, Human
cucacaauaaaaauggcucaga

SEQ ID NO: 2286501 - RNA, 14 nt, Human
cucacacagccagg

SEQ ID NO: 2286502 - RNA, 15 nt, Human
cucacacagccaggu

SEQ ID NO: 2286503 - RNA, 16 nt, Human
cucacacagccaggug

SEQ ID NO: 2286504 - RNA, 19 nt, Human
cucacacagccaggugccu

SEQ ID NO: 2286505 - RNA, 20 nt, Human
cucacacagccaggugccuu

SEQ ID NO: 2286506 - RNA, 22 nt, Human
cucacacagccaggugccuugg

SEQ ID NO: 2286507 - RNA, 13 nt, Human
cucacacaggacc

SEQ ID NO: 2286508 - RNA, 16 nt, Human
cucacaaccugaaccu

SEQ ID NO: 2286509 - RNA, 17 nt, Human
cucacaaccugaaccua

SEQ ID NO: 2286510 - RNA, 19 nt, Human
cucacaacauggugucugg

SEQ ID NO: 2286511 - RNA, 14 nt, Human
cucacaaaggaugc

SEQ ID NO: 2286512 - RNA, 12 nt, Human
cucaaauaacua

SEQ ID NO: 2286513 - RNA, 13 nt, Human
cucaaauaaaaua

SEQ ID NO: 2286514 - RNA, 21 nt, Human
cucaaaguuuugaaaagcuau

SEQ ID NO: 2286515 - RNA, 23 nt, Human
cucaaaguuuugaaaagcuauua

SEQ ID NO: 2286516 - RNA, 14 nt, Human
cucaaauaaaauaa

SEQ ID NO: 2286517 - RNA, 14 nt, Human
cucacacaugagca

SEQ ID NO: 2286518 - RNA, 21 nt, Human
cucacacaugagcaucaggcc

SEQ ID NO: 2286519 - RNA, 21 nt, Human
cucacacaggacccccuuccc

SEQ ID NO: 2286520 - RNA, 22 nt, Human
cucacacaggacccccuucccc

SEQ ID NO: 2286521 - RNA, 22 nt, Human
cuaugugauuuuaacucugucu

SEQ ID NO: 2286522 - RNA, 21 nt, Human
cuaugugauuuuaacucuguc

SEQ ID NO: 2286523 - RNA, 20 nt, Human
cuaugugauuuuaacucugu

SEQ ID NO: 2286524 - RNA, 22 nt, Human
cuauguguagggcgggaggaug

SEQ ID NO: 2286525 - RNA, 15 nt, Human
cuauguugcccaggc

SEQ ID NO: 2286526 - RNA, 17 nt, Human
cuauguggcuguaucuu

SEQ ID NO: 2286527 - RNA, 14 nt, Human
cuauguugcccagg

SEQ ID NO: 2286528 - RNA, 22 nt, Human
cuauguauggaauacaguguua

SEQ ID NO: 2286529 - RNA, 13 nt, Human
cuauguauuugca

SEQ ID NO: 2286530 - RNA, 14 nt, Human
cuauguauggaaua

SEQ ID NO: 2286531 - RNA, 16 nt, Human
cuauguaucaaugagu

SEQ ID NO: 2286532 - RNA, 22 nt, Human
cuauguauuugcaguucaccug

SEQ ID NO: 2286533 - RNA, 18 nt, Human
cuaugucauuucauuucc

SEQ ID NO: 2286534 - RNA, 16 nt, Human
cuaugucauuucauuu

SEQ ID NO: 2286535 - RNA, 23 nt, Human
cuaugucauuugcuggagcucug

SEQ ID NO: 2286536 - RNA, 19 nt, Human
cuaugugauuuuaacucug

SEQ ID NO: 2286537 - RNA, 18 nt, Human
cuaugugauuuuaacucu

SEQ ID NO: 2286538 - RNA, 16 nt, Human
cuaugugauuuuaacu

SEQ ID NO: 2286539 - RNA, 11 nt, Human
cuaugugauuu

SEQ ID NO: 2286540 - RNA, 19 nt, Human
cuauguaucaaugaguaac

SEQ ID NO: 2286541 - RNA, 18 nt, Human
cuaucugcuuaugcaguu

SEQ ID NO: 2286542 - RNA, 21 nt, Human
cuaucucugugugcacaaaua

SEQ ID NO: 2286543 - RNA, 21 nt, Human
cuaucugaaccauuaaagucg

SEQ ID NO: 2286544 - RNA, 17 nt, Human
cuaucucgugggagagc

SEQ ID NO: 2286545 - RNA, 17 nt, Human
cuaucucugugugcaca

SEQ ID NO: 2286546 - RNA, 20 nt, Human
cuaucucccccagccccauc

SEQ ID NO: 2286547 - RNA, 11 nt, Human
cucaaaggcac

SEQ ID NO: 2286548 - RNA, 18 nt, Human
cucaaagagggagugcau

SEQ ID NO: 2286549 - RNA, 15 nt, Human
cucaaagucugcaac

SEQ ID NO: 2286550 - RNA, 12 nt, Human
cucaaaguuuug

SEQ ID NO: 2286551 - RNA, 14 nt, Human
cucaaaguuuugaa

SEQ ID NO: 2286552 - RNA, 15 nt, Human
cucaaaguuuugaaa

SEQ ID NO: 2286553 - RNA, 17 nt, Human
cucaaaguuuugaaaag

SEQ ID NO: 2286554 - RNA, 18 nt, Human
cucaaaguuuugaaaagc

SEQ ID NO: 2286555 - RNA, 19 nt, Human
cucaaaguuuugaaaagcu

SEQ ID NO: 2286556 - RNA, 23 nt, Human
cucaaagugacuauucaguuuuc

SEQ ID NO: 2286557 - RNA, 14 nt, Human
cucaaagucugcaa

SEQ ID NO: 2286558 - RNA, 13 nt, Human
cucaaagucugca

SEQ ID NO: 2286559 - RNA, 22 nt, Human
cucaaagacaauguuauuuucc

SEQ ID NO: 2286560 - RNA, 17 nt, Human
cucaaacugccuuggcu

SEQ ID NO: 2286561 - RNA, 22 nt, Human
cucaaacugaggaauuucaccu

SEQ ID NO: 2286562 - RNA, 22 nt, Human
cucaaaacccaucugggcuccu

SEQ ID NO: 2286563 - RNA, 20 nt, Human
cucaaacuuuuccccugucc

SEQ ID NO: 2286564 - RNA, 19 nt, Human
cucaaaacccaucugggcu

SEQ ID NO: 2286565 - RNA, 17 nt, Human
cucaaaacugcacuguc

SEQ ID NO: 2286566 - RNA, 19 nt, Human
cucaaacugaggaauuuca

SEQ ID NO: 2286567 - RNA, 13 nt, Human
cucaaaacugcac

SEQ ID NO: 2286568 - RNA, 14 nt, Human
cuauuuuucagaau

SEQ ID NO: 2286569 - RNA, 15 nt, Human
cuauuuuuauuuaua

SEQ ID NO: 2286570 - RNA, 16 nt, Human
cuauuuuuacugccac

SEQ ID NO: 2286571 - RNA, 17 nt, Human
cuauuuuuacugccacu

SEQ ID NO: 2286572 - RNA, 13 nt, Human
cuauguguaaggu

SEQ ID NO: 2286573 - RNA, 19 nt, Human
cuauuuuguaaacucaaaa

SEQ ID NO: 2286574 - RNA, 18 nt, Human
cuauuuuuacuagaacac

SEQ ID NO: 2286575 - RNA, 21 nt, Human
cuauuuuuacuagaacacaga

SEQ ID NO: 2286576 - RNA, 12 nt, Human
cuauuuuuacug

SEQ ID NO: 2286577 - RNA, 16 nt, Human
cuauguugcccaggca

SEQ ID NO: 2286578 - RNA, 17 nt, Human
cuauguugcccaggcag

SEQ ID NO: 2286579 - RNA, 16 nt, Human
cuauuuuuauuuauau

SEQ ID NO: 2286580 - RNA, 19 nt, Human
cuauuuuuacugccacucu

SEQ ID NO: 2286581 - RNA, 18 nt, Human
cuauuuuuauuuauauuu

SEQ ID NO: 2286582 - RNA, 14 nt, Human
cuauuuuucccccu

SEQ ID NO: 2286583 - RNA, 22 nt, Human
cuauuuuuggcagucugaauuu

SEQ ID NO: 2286584 - RNA, 18 nt, Human
cucaaaaaaagaaaaaga

SEQ ID NO: 2286585 - RNA, 21 nt, Human
cuauuuuuggcagucugaauu

SEQ ID NO: 2286586 - RNA, 18 nt, Human
cuauuuuuggcagucuga

SEQ ID NO: 2286587 - RNA, 22 nt, Human
ccugagggcagaaagguucugc

SEQ ID NO: 2286588 - RNA, 22 nt, Human
ccugaggcuuuggauuugacau

SEQ ID NO: 2286589 - RNA, 20 nt, Human
ccugaggcuuuggauuugac

SEQ ID NO: 2286590 - RNA, 23 nt, Human
ccugagggcagaaagguucugcc

SEQ ID NO: 2286591 - RNA, 13 nt, Human
ccugagggccccu

SEQ ID NO: 2286592 - RNA, 14 nt, Human
ccugagggccccuc

SEQ ID NO: 2286593 - RNA, 16 nt, Human
ccugagggccccucug

SEQ ID NO: 2286594 - RNA, 18 nt, Human
ccugagggccccucugcc

SEQ ID NO: 2286595 - RNA, 19 nt, Human
ccugagggccccucugccc

SEQ ID NO: 2286596 - RNA, 20 nt, Human
ccugagggccccucugccca

SEQ ID NO: 2286597 - RNA, 19 nt, Human
ccugaggguccccaccugg

SEQ ID NO: 2286598 - RNA, 21 nt, Human
ccugagggccccucugcccag

SEQ ID NO: 2286599 - RNA, 22 nt, Human
ccugagggccccucugcccagc

SEQ ID NO: 2286600 - RNA, 23 nt, Human
ccugagggccccucugcccagcu

SEQ ID NO: 2286601 - RNA, 13 nt, Human
ccugagggucccc

SEQ ID NO: 2286602 - RNA, 20 nt, Human
ccugaggugaaagggagcua

SEQ ID NO: 2286603 - RNA, 21 nt, Human
ccugaggucuggcugcuugcc

SEQ ID NO: 2286604 - RNA, 12 nt, Human
ccugaggucugg

SEQ ID NO: 2286605 - RNA, 15 nt, Human
ccugaggucuggcug

SEQ ID NO: 2286606 - RNA, 17 nt, Human
ccugaggucuggcugcu

SEQ ID NO: 2286607 - RNA, 19 nt, Human
ccugaggucuggcugcuug

SEQ ID NO: 2286608 - RNA, 13 nt, Human
ccugaggguggag

SEQ ID NO: 2286609 - RNA, 15 nt, Human
ccugaggguggagac

SEQ ID NO: 2286610 - RNA, 16 nt, Human
ccugaggguggagacu

SEQ ID NO: 2286611 - RNA, 22 nt, Human
ccugaggucaggaguucaagac

SEQ ID NO: 2286612 - RNA, 16 nt, Human
ccugaggucucgcuga

SEQ ID NO: 2286613 - RNA, 19 nt, Human
ccugaguuccuagccaccg

SEQ ID NO: 2286614 - RNA, 15 nt, Human
ccugagguguggggg

SEQ ID NO: 2286615 - RNA, 17 nt, Human
ccugaggugugggggcu

SEQ ID NO: 2286616 - RNA, 19 nt, Human
ccugaggugugggggcugc

SEQ ID NO: 2286617 - RNA, 20 nt, Human
ccugaggugugggggcugca

SEQ ID NO: 2286618 - RNA, 15 nt, Human
ccugaggugggccca

SEQ ID NO: 2286619 - RNA, 16 nt, Human
ccugaggugggcccag

SEQ ID NO: 2286620 - RNA, 17 nt, Human
ccugaggugggcccagg

SEQ ID NO: 2286621 - RNA, 18 nt, Human
ccugaggugggcccagga

SEQ ID NO: 2286622 - RNA, 19 nt, Human
ccugaggugggcccaggac

SEQ ID NO: 2286623 - RNA, 21 nt, Human
ccugaggugggcccaggacca

SEQ ID NO: 2286624 - RNA, 23 nt, Human
ccugaggugggcccaggaccagc

SEQ ID NO: 2286625 - RNA, 23 nt, Human
ccugagcaacagagugagacccu

SEQ ID NO: 2286626 - RNA, 15 nt, Human
ccugaggcugugguc

SEQ ID NO: 2286627 - RNA, 16 nt, Human
ccugaggcugugguca

SEQ ID NO: 2286628 - RNA, 17 nt, Human
ccugaggcuguggucac

SEQ ID NO: 2286629 - RNA, 21 nt, Human
ccugagcaacagagugagacc

SEQ ID NO: 2286630 - RNA, 23 nt, Human
ccugagauuucaucugcucuccu

SEQ ID NO: 2286631 - RNA, 18 nt, Human
ccugagauuucaucugcu

SEQ ID NO: 2286632 - RNA, 22 nt, Human
ccugagauuucaucugcucucc

SEQ ID NO: 2286633 - RNA, 11 nt, Human
ccugagauuuc

SEQ ID NO: 2286634 - RNA, 15 nt, Human
ccugagauuucaucu

SEQ ID NO: 2286635 - RNA, 16 nt, Human
ccugagauuucaucug

SEQ ID NO: 2286636 - RNA, 17 nt, Human
ccugagauuucaucugc

SEQ ID NO: 2286637 - RNA, 14 nt, Human
ccugagauuuacac

SEQ ID NO: 2286638 - RNA, 22 nt, Human
ccugacccgucuaauauauaaa

SEQ ID NO: 2286639 - RNA, 18 nt, Human
ccugagaucucugcagga

SEQ ID NO: 2286640 - RNA, 17 nt, Human
ccugagaucucugcagg

SEQ ID NO: 2286641 - RNA, 18 nt, Human
ccugaccccucauagccc

SEQ ID NO: 2286642 - RNA, 15 nt, Human
ccugaccccugcuca

SEQ ID NO: 2286643 - RNA, 14 nt, Human
ccugaccccugcuc

SEQ ID NO: 2286644 - RNA, 12 nt, Human
ccugacccgucu

SEQ ID NO: 2286645 - RNA, 16 nt, Human
ccugaccccugcucag

SEQ ID NO: 2286646 - RNA, 17 nt, Human
ccugauaauaauugauc

SEQ ID NO: 2286647 - RNA, 17 nt, Human
ccugauaacaaccugga

SEQ ID NO: 2286648 - RNA, 18 nt, Human
ccugauaacaaccuggag

SEQ ID NO: 2286649 - RNA, 19 nt, Human
ccugauaaagaacaucugu

SEQ ID NO: 2286650 - RNA, 14 nt, Human
ccugauaugauuua

SEQ ID NO: 2286651 - RNA, 19 nt, Human
ccugauaacaaccuggaga

SEQ ID NO: 2286652 - RNA, 15 nt, Human
ccugauauaaaugca

SEQ ID NO: 2286653 - RNA, 21 nt, Human
ccugauauuucccuccccugg

SEQ ID NO: 2286654 - RNA, 19 nt, Human
ccugauaugauuuaaaaca

SEQ ID NO: 2286655 - RNA, 20 nt, Human
ccugauaugauuuaaaacau

SEQ ID NO: 2286656 - RNA, 21 nt, Human
ccugaggugugggggcugcag

SEQ ID NO: 2286657 - RNA, 21 nt, Human
ccugaguuccuagccaccgcc

SEQ ID NO: 2286658 - RNA, 20 nt, Human
ccugaguuccuagccaccgc

SEQ ID NO: 2286659 - RNA, 14 nt, Human
ccugcaggcagcca

SEQ ID NO: 2286660 - RNA, 20 nt, Human
ccugcaggaccugccuguag

SEQ ID NO: 2286661 - RNA, 19 nt, Human
ccugcaggaccugccugua

SEQ ID NO: 2286662 - RNA, 12 nt, Human
ccugcaggcagc

SEQ ID NO: 2286663 - RNA, 13 nt, Human
ccugcaggcagcc

SEQ ID NO: 2286664 - RNA, 23 nt, Human
ccucggagccucauccgaggcag

SEQ ID NO: 2286665 - RNA, 16 nt, Human
ccucggagccucaucc

SEQ ID NO: 2286666 - RNA, 14 nt, Human
ccucggagccucau

SEQ ID NO: 2286667 - RNA, 13 nt, Human
ccucggagccuca

SEQ ID NO: 2286668 - RNA, 17 nt, Human
ccucggaucaccgagag

SEQ ID NO: 2286669 - RNA, 15 nt, Human
ccucggaucaccgag

SEQ ID NO: 2286670 - RNA, 22 nt, Human
ccucggccucccaaagugcugg

SEQ ID NO: 2286671 - RNA, 16 nt, Human
ccucggccuggcuccu

SEQ ID NO: 2286672 - RNA, 12 nt, Human
ccucggcuccug

SEQ ID NO: 2286673 - RNA, 13 nt, Human
ccucggcuccugc

SEQ ID NO: 2286674 - RNA, 14 nt, Human
ccucggcuccugcu

SEQ ID NO: 2286675 - RNA, 19 nt, Human
ccucuuucccucccuuccu

SEQ ID NO: 2286676 - RNA, 18 nt, Human
ccucuugcggucccuucu

SEQ ID NO: 2286677 - RNA, 23 nt, Human
ccucuuuccucucuuuguucuca

SEQ ID NO: 2286678 - RNA, 15 nt, Human
ccucuuugagugaag

SEQ ID NO: 2286679 - RNA, 15 nt, Human
ccucuuuccucucuu

SEQ ID NO: 2286680 - RNA, 21 nt, Human
ccugacccaggccgcagcucu

SEQ ID NO: 2286681 - RNA, 15 nt, Human
ccugacccagucccc

SEQ ID NO: 2286682 - RNA, 16 nt, Human
ccucuuucccucccuu

SEQ ID NO: 2286683 - RNA, 17 nt, Human
ccucuugcggucccuuc

SEQ ID NO: 2286684 - RNA, 16 nt, Human
ccucuugccuccugga

SEQ ID NO: 2286685 - RNA, 12 nt, Human
ccucuugcucaa

SEQ ID NO: 2286686 - RNA, 23 nt, Human
ccucuugccccccaccccagccu

SEQ ID NO: 2286687 - RNA, 21 nt, Human
ccucuugccccccaccccagc

SEQ ID NO: 2286688 - RNA, 16 nt, Human
ccucuugccccccacc

SEQ ID NO: 2286689 - RNA, 12 nt, Human
ccucuugccccc

SEQ ID NO: 2286690 - RNA, 16 nt, Human
ccucuugccccaaccc

SEQ ID NO: 2286691 - RNA, 21 nt, Human
ccucuugccccaacccccagc

SEQ ID NO: 2286692 - RNA, 22 nt, Human
ccucuugccccaacccccagca

SEQ ID NO: 2286693 - RNA, 23 nt, Human
ccucuugccccaacccccagcac

SEQ ID NO: 2286694 - RNA, 23 nt, Human
ccucuugccacugccucuuccuc

SEQ ID NO: 2286695 - RNA, 12 nt, Human
ccucuugcccca

SEQ ID NO: 2286696 - RNA, 15 nt, Human
ccucuugccccaacc

SEQ ID NO: 2286697 - RNA, 22 nt, Human
ccucuugccacugccucuuccu

SEQ ID NO: 2286698 - RNA, 14 nt, Human
ccucuugccacugc

SEQ ID NO: 2286699 - RNA, 13 nt, Human
ccugccuccaccc

SEQ ID NO: 2286700 - RNA, 14 nt, Human
ccugccuccacccu

SEQ ID NO: 2286701 - RNA, 20 nt, Human
ccugccucucaucaacugaa

SEQ ID NO: 2286702 - RNA, 23 nt, Human
ccugccucucaucaacugaauga

SEQ ID NO: 2286703 - RNA, 17 nt, Human
ccugccucagccucccg

SEQ ID NO: 2286704 - RNA, 12 nt, Human
ccugccucagga

SEQ ID NO: 2286705 - RNA, 22 nt, Human
ccugcccacacagguucacgug

SEQ ID NO: 2286706 - RNA, 13 nt, Human
ccugccucucugc

SEQ ID NO: 2286707 - RNA, 20 nt, Human
ccugcugagucccaggcuga

SEQ ID NO: 2286708 - RNA, 19 nt, Human
ccugcugagucccaggcug

SEQ ID NO: 2286709 - RNA, 18 nt, Human
ccugcugagucccaggcu

SEQ ID NO: 2286710 - RNA, 14 nt, Human
ccugccucucugca

SEQ ID NO: 2286711 - RNA, 15 nt, Human
ccugccucucugcag

SEQ ID NO: 2286712 - RNA, 16 nt, Human
ccugccucagccuccc

SEQ ID NO: 2286713 - RNA, 15 nt, Human
ccugccucagccucc

SEQ ID NO: 2286714 - RNA, 21 nt, Human
ccugcccaggccccugccacc

SEQ ID NO: 2286715 - RNA, 22 nt, Human
ccugcccaggccccugccaccc

SEQ ID NO: 2286716 - RNA, 18 nt, Human
ccugcccaggccccugcc

SEQ ID NO: 2286717 - RNA, 14 nt, Human
ccugcccacacagg

SEQ ID NO: 2286718 - RNA, 19 nt, Human
ccugcccaggccccugcca

SEQ ID NO: 2286719 - RNA, 18 nt, Human
ccugcccaccuggccucu

SEQ ID NO: 2286720 - RNA, 19 nt, Human
ccugcccaccuggccucug

SEQ ID NO: 2286721 - RNA, 23 nt, Human
ccugccauuugcacccuccgccu

SEQ ID NO: 2286722 - RNA, 17 nt, Human
ccugccauuugcacccu

SEQ ID NO: 2286723 - RNA, 18 nt, Human
ccugccaucuucccagca

SEQ ID NO: 2286724 - RNA, 16 nt, Human
ccugccaucuucccag

SEQ ID NO: 2286725 - RNA, 17 nt, Human
ccugccaucuucccagc

SEQ ID NO: 2286726 - RNA, 23 nt, Human
ccugccagugccuuaccuccugc

SEQ ID NO: 2286727 - RNA, 14 nt, Human
ccugccaucuuccc

SEQ ID NO: 2286728 - RNA, 15 nt, Human
ccugccaucuuccca

SEQ ID NO: 2286729 - RNA, 15 nt, Human
ccugcccaccuggcc

SEQ ID NO: 2286730 - RNA, 17 nt, Human
ccugcccaccuggccuc

SEQ ID NO: 2286731 - RNA, 20 nt, Human
ccugccaucauguuuacaga

SEQ ID NO: 2286732 - RNA, 18 nt, Human
ccugccaucauguuuaca

SEQ ID NO: 2286733 - RNA, 13 nt, Human
ccugucuccuuuc

SEQ ID NO: 2286734 - RNA, 23 nt, Human
ccugucuccuuucaccccagggc

SEQ ID NO: 2286735 - RNA, 22 nt, Human
ccuguaacacaagccacagaag

SEQ ID NO: 2286736 - RNA, 17 nt, Human
ccugucucuacuaaaaa

SEQ ID NO: 2286737 - RNA, 20 nt, Human
ccugucucauccccaggggu

SEQ ID NO: 2286738 - RNA, 18 nt, Human
ccuguaacuugagaguag

SEQ ID NO: 2286739 - RNA, 18 nt, Human
ccugucucauccccaggg

SEQ ID NO: 2286740 - RNA, 21 nt, Human
ccuguaaccucuucagaggcc

SEQ ID NO: 2286741 - RNA, 16 nt, Human
ccuguaaccucuucag

SEQ ID NO: 2286742 - RNA, 19 nt, Human
ccuguaacauacuggccug

SEQ ID NO: 2286743 - RNA, 23 nt, Human
ccuguaacauacuggccuggacu

SEQ ID NO: 2286744 - RNA, 19 nt, Human
ccuguaaaugguguacaua

SEQ ID NO: 2286745 - RNA, 13 nt, Human
ccuguaaaccuga

SEQ ID NO: 2286746 - RNA, 19 nt, Human
ccuguaaaaaaaaaaaagu

SEQ ID NO: 2286747 - RNA, 18 nt, Human
ccuguaacacaagccaca

SEQ ID NO: 2286748 - RNA, 19 nt, Human
ccuguaacacaagccacag

SEQ ID NO: 2286749 - RNA, 20 nt, Human
ccuguaacacaagccacaga

SEQ ID NO: 2286750 - RNA, 21 nt, Human
ccuguaacacaagccacagaa

SEQ ID NO: 2286751 - RNA, 23 nt, Human
ccuguaacacaagccacagaagc

SEQ ID NO: 2286752 - RNA, 12 nt, Human
ccuguaaaccug

SEQ ID NO: 2286753 - RNA, 19 nt, Human
ccugguuuuuguagccuuc

SEQ ID NO: 2286754 - RNA, 22 nt, Human
ccugguuuuuguagccuuccuc

SEQ ID NO: 2286755 - RNA, 22 nt, Human
ccugguuuccugcccugggagg

SEQ ID NO: 2286756 - RNA, 18 nt, Human
ccugguuuuuguagccuu

SEQ ID NO: 2286757 - RNA, 22 nt, Human
ccugguuuuuaaauagaguuug

SEQ ID NO: 2286758 - RNA, 21 nt, Human
ccugucuccuuugcaggcuca

SEQ ID NO: 2286759 - RNA, 21 nt, Human
ccugucucuagccacuuuggu

SEQ ID NO: 2286760 - RNA, 14 nt, Human
ccuggauucauuuc

SEQ ID NO: 2286761 - RNA, 15 nt, Human
ccuggauucauuucc

SEQ ID NO: 2286762 - RNA, 17 nt, Human
ccuggauucauuuccug

SEQ ID NO: 2286763 - RNA, 18 nt, Human
ccuggauucauuuccugc

SEQ ID NO: 2286764 - RNA, 19 nt, Human
ccuggauucauuuccugcc

SEQ ID NO: 2286765 - RNA, 20 nt, Human
ccuggauucauuuccugccc

SEQ ID NO: 2286766 - RNA, 21 nt, Human
ccuggauucauuuccugcccu

SEQ ID NO: 2286767 - RNA, 23 nt, Human
ccuggauucauuuccugcccuuc

SEQ ID NO: 2286768 - RNA, 17 nt, Human
ccuggauggggcugcac

SEQ ID NO: 2286769 - RNA, 18 nt, Human
ccuggauggggcugcacc

SEQ ID NO: 2286770 - RNA, 12 nt, Human
ccugcugcacca

SEQ ID NO: 2286771 - RNA, 16 nt, Human
ccugcugcaccaaccc

SEQ ID NO: 2286772 - RNA, 17 nt, Human
ccugcugcaccaaccca

SEQ ID NO: 2286773 - RNA, 18 nt, Human
ccugcugcaccaacccag

SEQ ID NO: 2286774 - RNA, 19 nt, Human
ccugcugcaccaacccagc

SEQ ID NO: 2286775 - RNA, 20 nt, Human
ccugcugcaccaacccagcc

SEQ ID NO: 2286776 - RNA, 21 nt, Human
ccugcugcaccaacccagccg

SEQ ID NO: 2286777 - RNA, 23 nt, Human
ccugcugcaccaacccagccgcu

SEQ ID NO: 2286778 - RNA, 14 nt, Human
ccugcugcagaggg

SEQ ID NO: 2286779 - RNA, 16 nt, Human
ccugcugcagaggggc

SEQ ID NO: 2286780 - RNA, 18 nt, Human
ccugcugcagaggggcag

SEQ ID NO: 2286781 - RNA, 22 nt, Human
ccugcugcagaggggcaggccc

SEQ ID NO: 2286782 - RNA, 23 nt, Human
ccugcugcagaggggcaggcccu

SEQ ID NO: 2286783 - RNA, 12 nt, Human
ccugcugcaggg

SEQ ID NO: 2286784 - RNA, 13 nt, Human
ccugcugcagggg

SEQ ID NO: 2286785 - RNA, 15 nt, Human
ccuggauggggcugc

SEQ ID NO: 2286786 - RNA, 14 nt, Human
ccugcugcaggggc

SEQ ID NO: 2286787 - RNA, 12 nt, Human
ccuggcaauagu

SEQ ID NO: 2286788 - RNA, 23 nt, Human
ccuggcaagcuagaaccuggagg

SEQ ID NO: 2286789 - RNA, 21 nt, Human
ccuggcaagcuagaaccugga

SEQ ID NO: 2286790 - RNA, 22 nt, Human
ccuggcaagcuagaaccuggag

SEQ ID NO: 2286791 - RNA, 23 nt, Human
ccuggcaaagggagcagaacuga

SEQ ID NO: 2286792 - RNA, 19 nt, Human
ccuggcaaagggagcagaa

SEQ ID NO: 2286793 - RNA, 21 nt, Human
ccuggcaauaguguguucuga

SEQ ID NO: 2286794 - RNA, 19 nt, Human
ccuggcaauaguguguucu

SEQ ID NO: 2286795 - RNA, 12 nt, Human
ccuggcacacau

SEQ ID NO: 2286796 - RNA, 13 nt, Human
ccuggcacacauc

SEQ ID NO: 2286797 - RNA, 15 nt, Human
ccuggcacacaucag

SEQ ID NO: 2286798 - RNA, 16 nt, Human
ccugccuccacccucu

SEQ ID NO: 2286799 - RNA, 12 nt, Human
ccuggccugcug

SEQ ID NO: 2286800 - RNA, 16 nt, Human
ccuggccugaggucuc

SEQ ID NO: 2286801 - RNA, 12 nt, Human
ccuggccuggca

SEQ ID NO: 2286802 - RNA, 13 nt, Human
ccuggccuggcac

SEQ ID NO: 2286803 - RNA, 24 nt, Human
ccuggccuccggcgucagccucca

SEQ ID NO: 2286804 - RNA, 22 nt, Human
ccuggccuccggcgucagccuc

SEQ ID NO: 2286805 - RNA, 23 nt, Human
ccuggccuccggcgucagccucc

SEQ ID NO: 2286806 - RNA, 15 nt, Human
ccuggccuccccugc

SEQ ID NO: 2286807 - RNA, 17 nt, Human
ccuggccuccccugcca

SEQ ID NO: 2286808 - RNA, 18 nt, Human
ccuggccuccccugccac

SEQ ID NO: 2286809 - RNA, 19 nt, Human
ccuggccuccccugccacc

SEQ ID NO: 2286810 - RNA, 20 nt, Human
ccuggccuccccugccacca

SEQ ID NO: 2286811 - RNA, 13 nt, Human
ccuggccuccggc

SEQ ID NO: 2286812 - RNA, 21 nt, Human
ccuggccuccggcgucagccu

SEQ ID NO: 2286813 - RNA, 22 nt, Human
ccuggccucaagugauucuccu

SEQ ID NO: 2286814 - RNA, 20 nt, Human
ccuggccccucagggucccu

SEQ ID NO: 2286815 - RNA, 21 nt, Human
ccuggccccucagggucccug

SEQ ID NO: 2286816 - RNA, 18 nt, Human
ccuggccccucagggucc

SEQ ID NO: 2286817 - RNA, 21 nt, Human
ccugguuccggaauccugucc

SEQ ID NO: 2286818 - RNA, 16 nt, Human
ccugguuuccugcccu

SEQ ID NO: 2286819 - RNA, 20 nt, Human
ccugguuccggaauccuguc

SEQ ID NO: 2286820 - RNA, 22 nt, Human
ccugguucccguuucuccaccu

SEQ ID NO: 2286821 - RNA, 23 nt, Human
ccugguguuucuagcacuggccu

SEQ ID NO: 2286822 - RNA, 13 nt, Human
ccugguucccguu

SEQ ID NO: 2286823 - RNA, 21 nt, Human
ccugguguuucuagcacuggc

SEQ ID NO: 2286824 - RNA, 22 nt, Human
ccugguguuucuagcacuggcc

SEQ ID NO: 2286825 - RNA, 21 nt, Human
ccugguuuccugcccugggag

SEQ ID NO: 2286826 - RNA, 20 nt, Human
ccugguuuccugcccuggga

SEQ ID NO: 2286827 - RNA, 19 nt, Human
ccugguuuccugcccuggg

SEQ ID NO: 2286828 - RNA, 18 nt, Human
ccugguuuccugcccugg

SEQ ID NO: 2286829 - RNA, 13 nt, Human
ccugguguggaag

SEQ ID NO: 2286830 - RNA, 21 nt, Human
ccuggugguugcuguuuuccu

SEQ ID NO: 2286831 - RNA, 20 nt, Human
ccuggugugaagguccugcu

SEQ ID NO: 2286832 - RNA, 19 nt, Human
ccugguguuucuagcacug

SEQ ID NO: 2286833 - RNA, 12 nt, Human
ccuggugguuca

SEQ ID NO: 2286834 - RNA, 22 nt, Human
ccuggugguucacucuuggagc

SEQ ID NO: 2286835 - RNA, 13 nt, Human
ccuggugguucac

SEQ ID NO: 2286836 - RNA, 20 nt, Human
ccugguggcagugggagcug

SEQ ID NO: 2286837 - RNA, 19 nt, Human
ccuggggcuggccucccaa

SEQ ID NO: 2286838 - RNA, 17 nt, Human
ccuggggcugcuggccu

SEQ ID NO: 2286839 - RNA, 18 nt, Human
ccugguggguccaggggc

SEQ ID NO: 2286840 - RNA, 19 nt, Human
ccugguggguccaggggcc

SEQ ID NO: 2286841 - RNA, 22 nt, Human
ccugguggguccaggggccccu

SEQ ID NO: 2286842 - RNA, 23 nt, Human
ccugguggguccaggggccccuc

SEQ ID NO: 2286843 - RNA, 14 nt, Human
ccuggggcugcugg

SEQ ID NO: 2286844 - RNA, 18 nt, Human
ccuggggcucugugcagg

SEQ ID NO: 2286845 - RNA, 15 nt, Human
ccuggggcucugugc

SEQ ID NO: 2286846 - RNA, 17 nt, Human
ccuggggcuggccuccc

SEQ ID NO: 2286847 - RNA, 16 nt, Human
ccuggggcuggccucc

SEQ ID NO: 2286848 - RNA, 15 nt, Human
ccuggggcuggccuc

SEQ ID NO: 2286849 - RNA, 15 nt, Human
ccuggggcugcuggc

SEQ ID NO: 2286850 - RNA, 18 nt, Human
ccugguggcagugggagc

SEQ ID NO: 2286851 - RNA, 19 nt, Human
ccugguggcagugggagcu

SEQ ID NO: 2286852 - RNA, 22 nt, Human
ccuggggcuaggcuggagccca

SEQ ID NO: 2286853 - RNA, 20 nt, Human
ccuggggcuaggcuggagcc

SEQ ID NO: 2286854 - RNA, 17 nt, Human
ccuggggcgggccccuc

SEQ ID NO: 2286855 - RNA, 19 nt, Human
ccuggggcgggccccucau

SEQ ID NO: 2286856 - RNA, 19 nt, Human
ccuggggcagucaccugcc

SEQ ID NO: 2286857 - RNA, 24 nt, Human
ccuggggagugggacagagucugg

SEQ ID NO: 2286858 - RNA, 22 nt, Human
ccuggggcuccuuucuccagcc

SEQ ID NO: 2286859 - RNA, 20 nt, Human
ccuggggcuccuuucuccag

SEQ ID NO: 2286860 - RNA, 21 nt, Human
ccuggggcuccuuucuccagc

SEQ ID NO: 2286861 - RNA, 13 nt, Human
ccuggggcucccu

SEQ ID NO: 2286862 - RNA, 14 nt, Human
ccuggggcucccuu

SEQ ID NO: 2286863 - RNA, 15 nt, Human
ccuggggcuccuuuc

SEQ ID NO: 2286864 - RNA, 16 nt, Human
ccuggggcuccuuucu

SEQ ID NO: 2286865 - RNA, 15 nt, Human
ccuggggagaaagua

SEQ ID NO: 2286866 - RNA, 23 nt, Human
ccuggggagugggacagagucug

SEQ ID NO: 2286867 - RNA, 22 nt, Human
ccuggggagugggacagagucu

SEQ ID NO: 2286868 - RNA, 19 nt, Human
ccuggggagugggacagag

SEQ ID NO: 2286869 - RNA, 18 nt, Human
ccuggggagugggacaga

SEQ ID NO: 2286870 - RNA, 14 nt, Human
ccuggggagccagg

SEQ ID NO: 2286871 - RNA, 22 nt, Human
ccugggcugagagaaccucacg

SEQ ID NO: 2286872 - RNA, 22 nt, Human
ccugggcucugugggcugcacu

SEQ ID NO: 2286873 - RNA, 15 nt, Human
ccugggcucuguggg

SEQ ID NO: 2286874 - RNA, 19 nt, Human
ccugggcucugugggcugc

SEQ ID NO: 2286875 - RNA, 14 nt, Human
ccugggcuggaauc

SEQ ID NO: 2286876 - RNA, 20 nt, Human
ccugggcuggaaucaggaau

SEQ ID NO: 2286877 - RNA, 13 nt, Human
ccugggcugugcu

SEQ ID NO: 2286878 - RNA, 14 nt, Human
ccugggcugugcua

SEQ ID NO: 2286879 - RNA, 14 nt, Human
ccugggcuguuggc

SEQ ID NO: 2286880 - RNA, 16 nt, Human
ccugggcuguuggcac

SEQ ID NO: 2286881 - RNA, 18 nt, Human
ccugggcuguuggcacuc

SEQ ID NO: 2286882 - RNA, 20 nt, Human
ccugggcuguuggcacucac

SEQ ID NO: 2286883 - RNA, 18 nt, Human
ccuggggaaccugacccc

SEQ ID NO: 2286884 - RNA, 18 nt, Human
ccugggcuuggccugcug

SEQ ID NO: 2286885 - RNA, 19 nt, Human
ccugggcuuggccugcugu

SEQ ID NO: 2286886 - RNA, 20 nt, Human
ccugggcuuggccugcugug

SEQ ID NO: 2286887 - RNA, 21 nt, Human
ccugggcuuggccugcuguga

SEQ ID NO: 2286888 - RNA, 21 nt, Human
ccugggcuguuggcacucaca

SEQ ID NO: 2286889 - RNA, 22 nt, Human
ccugggcuguuggcacucacag

SEQ ID NO: 2286890 - RNA, 23 nt, Human
ccugggcuguuggcacucacaga

SEQ ID NO: 2286891 - RNA, 13 nt, Human
ccugggcuuggcc

SEQ ID NO: 2286892 - RNA, 14 nt, Human
ccugggcuuggccu

SEQ ID NO: 2286893 - RNA, 15 nt, Human
ccugggcuuggccug

SEQ ID NO: 2286894 - RNA, 16 nt, Human
ccugggcuuggccugc

SEQ ID NO: 2286895 - RNA, 17 nt, Human
ccugggcuuggccugcu

SEQ ID NO: 2286896 - RNA, 24 nt, Human
ccugggcucugccccagcucuggc

SEQ ID NO: 2286897 - RNA, 22 nt, Human
ccugggcucugccccagcucug

SEQ ID NO: 2286898 - RNA, 20 nt, Human
ccugggcucugccccagcuc

SEQ ID NO: 2286899 - RNA, 14 nt, Human
ccugggcucugccc

SEQ ID NO: 2286900 - RNA, 13 nt, Human
ccugggcucuggg

SEQ ID NO: 2286901 - RNA, 16 nt, Human
ccugggcucugggagc

SEQ ID NO: 2286902 - RNA, 17 nt, Human
ccugggcucugggagca

SEQ ID NO: 2286903 - RNA, 18 nt, Human
ccugggcucugggagcag

SEQ ID NO: 2286904 - RNA, 19 nt, Human
ccugggcucugggagcagc

SEQ ID NO: 2286905 - RNA, 12 nt, Human
ccugggcucugu

SEQ ID NO: 2286906 - RNA, 13 nt, Human
ccugggcucugug

SEQ ID NO: 2286907 - RNA, 14 nt, Human
ccugggcucugugg

SEQ ID NO: 2286908 - RNA, 12 nt, Human
ccugggcucugc

SEQ ID NO: 2286909 - RNA, 22 nt, Human
ccugggcucggaggcugccccc

SEQ ID NO: 2286910 - RNA, 16 nt, Human
ccugggcucggaggcu

SEQ ID NO: 2286911 - RNA, 18 nt, Human
ccugggcucggaggcugc

SEQ ID NO: 2286912 - RNA, 19 nt, Human
ccugggcucggaggcugcc

SEQ ID NO: 2286913 - RNA, 21 nt, Human
ccugggcucggaggcugcccc

SEQ ID NO: 2286914 - RNA, 15 nt, Human
ccugggcuacaagga

SEQ ID NO: 2286915 - RNA, 14 nt, Human
ccugggcucggagg

SEQ ID NO: 2286916 - RNA, 15 nt, Human
ccugggcucggaggc

SEQ ID NO: 2286917 - RNA, 13 nt, Human
ccuggccugcugg

SEQ ID NO: 2286918 - RNA, 15 nt, Human
ccuggccuggcuucu

SEQ ID NO: 2286919 - RNA, 11 nt, Human
ccuggccuguu

SEQ ID NO: 2286920 - RNA, 14 nt, Human
ccuggccugugccu

SEQ ID NO: 2286921 - RNA, 15 nt, Human
ccuggccuggcacac

SEQ ID NO: 2286922 - RNA, 16 nt, Human
ccuggccuggcacaca

SEQ ID NO: 2286923 - RNA, 19 nt, Human
ccuggccuggcacacauca

SEQ ID NO: 2286924 - RNA, 19 nt, Human
ccuggccuguucuguuuug

SEQ ID NO: 2286925 - RNA, 13 nt, Human
ccuggccuguucu

SEQ ID NO: 2286926 - RNA, 12 nt, Human
ccugggcgcccu

SEQ ID NO: 2286927 - RNA, 13 nt, Human
ccugggcgcccug

SEQ ID NO: 2286928 - RNA, 15 nt, Human
ccugggcgcccugga

SEQ ID NO: 2286929 - RNA, 16 nt, Human
ccugggcgcccuggaa

SEQ ID NO: 2286930 - RNA, 19 nt, Human
ccugggcgcccuggaagcc

SEQ ID NO: 2286931 - RNA, 17 nt, Human
ccugggcgcccuggaag

SEQ ID NO: 2286932 - RNA, 18 nt, Human
ccugggcgcccuggaagc

SEQ ID NO: 2286933 - RNA, 18 nt, Human
cccuucuccucuuguaaa

SEQ ID NO: 2286934 - RNA, 20 nt, Human
cccuucuccucuuguaaaua

SEQ ID NO: 2286935 - RNA, 15 nt, Human
cccuucucucaucuc

SEQ ID NO: 2286936 - RNA, 23 nt, Human
cccuuuuuuggcugcugaaggcu

SEQ ID NO: 2286937 - RNA, 21 nt, Human
cccuuuuuuggcugcugaagg

SEQ ID NO: 2286938 - RNA, 22 nt, Human
cccuuuuuuggcugcugaaggc

SEQ ID NO: 2286939 - RNA, 17 nt, Human
cccuucuccucuuguaa

SEQ ID NO: 2286940 - RNA, 15 nt, Human
cccuucucccacacu

SEQ ID NO: 2286941 - RNA, 14 nt, Human
cccuucucccacac

SEQ ID NO: 2286942 - RNA, 22 nt, Human
cccuucuccaucucucuggccc

SEQ ID NO: 2286943 - RNA, 23 nt, Human
cccuucuccaucucucuggcccu

SEQ ID NO: 2286944 - RNA, 19 nt, Human
cccuucucccaccccugcc

SEQ ID NO: 2286945 - RNA, 14 nt, Human
cccuucucccauga

SEQ ID NO: 2286946 - RNA, 14 nt, Human
cccuucucuccagc

SEQ ID NO: 2286947 - RNA, 19 nt, Human
cccuucucuccagccccug

SEQ ID NO: 2286948 - RNA, 20 nt, Human
ccgaagaaggguccuucccu

SEQ ID NO: 2286949 - RNA, 19 nt, Human
ccgaagaaggguccuuccc

SEQ ID NO: 2286950 - RNA, 16 nt, Human
ccgaagcucuggcuga

SEQ ID NO: 2286951 - RNA, 18 nt, Human
ccgaagccgccuguggac

SEQ ID NO: 2286952 - RNA, 18 nt, Human
ccgaagaaggguccuucc

SEQ ID NO: 2286953 - RNA, 17 nt, Human
ccgaacuguuguauaaa

SEQ ID NO: 2286954 - RNA, 16 nt, Human
ccgaaccuccucugug

SEQ ID NO: 2286955 - RNA, 15 nt, Human
ccgaaccuccucugu

SEQ ID NO: 2286956 - RNA, 13 nt, Human
ccgaaccuccucu

SEQ ID NO: 2286957 - RNA, 23 nt, Human
ccgaacaucaccgacgcgucucc

SEQ ID NO: 2286958 - RNA, 15 nt, Human
ccgaacacccucgaa

SEQ ID NO: 2286959 - RNA, 22 nt, Human
ccgaaaaauccucuuccucuga

SEQ ID NO: 2286960 - RNA, 15 nt, Human
ccgaaaaauccucuu

SEQ ID NO: 2286961 - RNA, 17 nt, Human
ccgaaaaauccucuucc

SEQ ID NO: 2286962 - RNA, 15 nt, Human
ccgacagccuggcac

SEQ ID NO: 2286963 - RNA, 22 nt, Human
ccgacagccuggcacagggcag

SEQ ID NO: 2286964 - RNA, 21 nt, Human
ccgaagcucuggcugaacccu

SEQ ID NO: 2286965 - RNA, 18 nt, Human
ccgacagcccccucugcc

SEQ ID NO: 2286966 - RNA, 13 nt, Human
ccgacagccuggc

SEQ ID NO: 2286967 - RNA, 14 nt, Human
ccgacagccuggca

SEQ ID NO: 2286968 - RNA, 12 nt, Human
ccgacagccugg

SEQ ID NO: 2286969 - RNA, 13 nt, Human
ccgacagagggaa

SEQ ID NO: 2286970 - RNA, 17 nt, Human
ccgaagcucuggcugaa

SEQ ID NO: 2286971 - RNA, 19 nt, Human
ccgaagcucuggcugaacc

SEQ ID NO: 2286972 - RNA, 13 nt, Human
cccuucucccaca

SEQ ID NO: 2286973 - RNA, 13 nt, Human
cccuucuccaucu

SEQ ID NO: 2286974 - RNA, 17 nt, Human
cccuucuccaucucucu

SEQ ID NO: 2286975 - RNA, 18 nt, Human
cccuucuccaucucucug

SEQ ID NO: 2286976 - RNA, 21 nt, Human
cccuucuccaucucucuggcc

SEQ ID NO: 2286977 - RNA, 23 nt, Human
cccuucuccauccacaugggagc

SEQ ID NO: 2286978 - RNA, 23 nt, Human
cccuucucauuccaacagugagu

SEQ ID NO: 2286979 - RNA, 10 nt, Human
cccuucucca

SEQ ID NO: 2286980 - RNA, 15 nt, Human
cccuucucagaaucu

SEQ ID NO: 2286981 - RNA, 16 nt, Human
cccuucucagaaucua

SEQ ID NO: 2286982 - RNA, 15 nt, Human
cccuucucaucacuc

SEQ ID NO: 2286983 - RNA, 19 nt, Human
cccuucucaucacuccccu

SEQ ID NO: 2286984 - RNA, 17 nt, Human
cccuguggagcccgcac

SEQ ID NO: 2286985 - RNA, 23 nt, Human
cccuucuaggguuauugcauuug

SEQ ID NO: 2286986 - RNA, 21 nt, Human
cccuguggaagggacuaggag

SEQ ID NO: 2286987 - RNA, 16 nt, Human
cccuguggagacuggg

SEQ ID NO: 2286988 - RNA, 18 nt, Human
cccuguggaagggacuag

SEQ ID NO: 2286989 - RNA, 14 nt, Human
cccuguggaaggga

SEQ ID NO: 2286990 - RNA, 21 nt, Human
cccuguggaugagcccucaga

SEQ ID NO: 2286991 - RNA, 20 nt, Human
cccuguggaugagcccucag

SEQ ID NO: 2286992 - RNA, 15 nt, Human
cccugugggccccca

SEQ ID NO: 2286993 - RNA, 23 nt, Human
cccuguggaugagcccucagaac

SEQ ID NO: 2286994 - RNA, 22 nt, Human
cccuguggaugagcccucagaa

SEQ ID NO: 2286995 - RNA, 20 nt, Human
cccugugcuccgugccucca

SEQ ID NO: 2286996 - RNA, 22 nt, Human
cccugugcuccgugccuccacc

SEQ ID NO: 2286997 - RNA, 12 nt, Human
cccugugcuggu

SEQ ID NO: 2286998 - RNA, 22 nt, Human
cccugugacauggugccugaga

SEQ ID NO: 2286999 - RNA, 24 nt, Human
cccugugacauggugccugagagg

SEQ ID NO: 2287000 - RNA, 23 nt, Human
cccugugagauuuugcuuuucca

SEQ ID NO: 2287001 - RNA, 23 nt, Human
cccugugaguuuguacagucuug

SEQ ID NO: 2287002 - RNA, 13 nt, Human
cccugugcuggug

SEQ ID NO: 2287003 - RNA, 14 nt, Human
cccugugcuggugu

SEQ ID NO: 2287004 - RNA, 15 nt, Human
cccugugcugguguc

SEQ ID NO: 2287005 - RNA, 16 nt, Human
cccugugcuggugucc

SEQ ID NO: 2287006 - RNA, 20 nt, Human
cccugugcugguguccugac

SEQ ID NO: 2287007 - RNA, 21 nt, Human
cccugugcugguguccugacc

SEQ ID NO: 2287008 - RNA, 22 nt, Human
cccugugcugguguccugacca

SEQ ID NO: 2287009 - RNA, 23 nt, Human
cccugugcugguguccugaccac

SEQ ID NO: 2287010 - RNA, 12 nt, Human
cccuccuugucu

SEQ ID NO: 2287011 - RNA, 16 nt, Human
cccuccuugggcacuu

SEQ ID NO: 2287012 - RNA, 18 nt, Human
cccuccuuguccacccac

SEQ ID NO: 2287013 - RNA, 19 nt, Human
cccuccuugcucugcaggc

SEQ ID NO: 2287014 - RNA, 20 nt, Human
cccuccuugcucugcaggca

SEQ ID NO: 2287015 - RNA, 23 nt, Human
cccuccuugcucugcaggcaccu

SEQ ID NO: 2287016 - RNA, 14 nt, Human
cccuccuugggcac

SEQ ID NO: 2287017 - RNA, 21 nt, Human
cccugugaguacuacaguccu

SEQ ID NO: 2287018 - RNA, 23 nt, Human
cccugugaguacuacaguccucc

SEQ ID NO: 2287019 - RNA, 15 nt, Human
cccugugauggggcc

SEQ ID NO: 2287020 - RNA, 11 nt, Human
cccuccuucca

SEQ ID NO: 2287021 - RNA, 22 nt, Human
cccuccuguugcacccagcccu

SEQ ID NO: 2287022 - RNA, 18 nt, Human
cccuccuguugcacccag

SEQ ID NO: 2287023 - RNA, 19 nt, Human
cccuccuguugcacccagc

SEQ ID NO: 2287024 - RNA, 12 nt, Human
cccuccuucaga

SEQ ID NO: 2287025 - RNA, 13 nt, Human
cccuccuguugca

SEQ ID NO: 2287026 - RNA, 18 nt, Human
cccuccuugccuccugug

SEQ ID NO: 2287027 - RNA, 17 nt, Human
cccuccuugccuccugu

SEQ ID NO: 2287028 - RNA, 18 nt, Human
cccuccuuccuugaccag

SEQ ID NO: 2287029 - RNA, 16 nt, Human
cccuccuuccuugacc

SEQ ID NO: 2287030 - RNA, 14 nt, Human
cccuccuuucacca

SEQ ID NO: 2287031 - RNA, 14 nt, Human
ccgcagcccugcag

SEQ ID NO: 2287032 - RNA, 15 nt, Human
ccgcagagcuggccg

SEQ ID NO: 2287033 - RNA, 14 nt, Human
ccgcagcagcuccc

SEQ ID NO: 2287034 - RNA, 13 nt, Human
ccgcagagcuggc

SEQ ID NO: 2287035 - RNA, 18 nt, Human
ccgcagcccugcagaggg

SEQ ID NO: 2287036 - RNA, 23 nt, Human
ccgcagcccugcagagggcacag

SEQ ID NO: 2287037 - RNA, 16 nt, Human
ccgguucuuccagugg

SEQ ID NO: 2287038 - RNA, 20 nt, Human
ccgguuucgaaguugaugca

SEQ ID NO: 2287039 - RNA, 20 nt, Human
ccgguucuuccagugguuug

SEQ ID NO: 2287040 - RNA, 21 nt, Human
ccgguuucgaaguugaugcaa

SEQ ID NO: 2287041 - RNA, 15 nt, Human
ccguaacccaacucu

SEQ ID NO: 2287042 - RNA, 17 nt, Human
ccguaauaauuauuauu

SEQ ID NO: 2287043 - RNA, 21 nt, Human
ccguaaacacgccugcaaacg

SEQ ID NO: 2287044 - RNA, 18 nt, Human
ccguacauucaauguuua

SEQ ID NO: 2287045 - RNA, 12 nt, Human
ccguaccccacc

SEQ ID NO: 2287046 - RNA, 13 nt, Human
ccguaccccaccc

SEQ ID NO: 2287047 - RNA, 18 nt, Human
ccguacaacguguccuca

SEQ ID NO: 2287048 - RNA, 18 nt, Human
ccguaccccacccucagc

SEQ ID NO: 2287049 - RNA, 20 nt, Human
ccguaccccacccucagcac

SEQ ID NO: 2287050 - RNA, 14 nt, Human
ccguaccccacccu

SEQ ID NO: 2287051 - RNA, 15 nt, Human
ccguaccccacccuc

SEQ ID NO: 2287052 - RNA, 16 nt, Human
ccguaccccacccuca

SEQ ID NO: 2287053 - RNA, 17 nt, Human
ccguaccccacccucag

SEQ ID NO: 2287054 - RNA, 13 nt, Human
ccguccgcccugc

SEQ ID NO: 2287055 - RNA, 14 nt, Human
ccguccgcccugcu

SEQ ID NO: 2287056 - RNA, 14 nt, Human
ccgucccccucugg

SEQ ID NO: 2287057 - RNA, 18 nt, Human
ccgucccauauccugccu

SEQ ID NO: 2287058 - RNA, 13 nt, Human
ccguccugccugu

SEQ ID NO: 2287059 - RNA, 16 nt, Human
ccguccucccgggccc

SEQ ID NO: 2287060 - RNA, 19 nt, Human
ccguccucccgggcccucc

SEQ ID NO: 2287061 - RNA, 15 nt, Human
ccguccugccugugg

SEQ ID NO: 2287062 - RNA, 11 nt, Human
ccguccucacc

SEQ ID NO: 2287063 - RNA, 14 nt, Human
ccguccucaccccu

SEQ ID NO: 2287064 - RNA, 16 nt, Human
ccguccucaccccugu

SEQ ID NO: 2287065 - RNA, 19 nt, Human
ccguccucaccccuguccu

SEQ ID NO: 2287066 - RNA, 20 nt, Human
ccguccucaccccuguccuc

SEQ ID NO: 2287067 - RNA, 23 nt, Human
ccguccucaccccuguccucacu

SEQ ID NO: 2287068 - RNA, 24 nt, Human
ccguccucaccccuguccucacug

SEQ ID NO: 2287069 - RNA, 14 nt, Human
ccguccucccgggc

SEQ ID NO: 2287070 - RNA, 13 nt, Human
ccggccaggccac

SEQ ID NO: 2287071 - RNA, 11 nt, Human
ccggccagccc

SEQ ID NO: 2287072 - RNA, 15 nt, Human
ccggccaggugggcg

SEQ ID NO: 2287073 - RNA, 13 nt, Human
ccggccagguggg

SEQ ID NO: 2287074 - RNA, 12 nt, Human
ccggccccagcc

SEQ ID NO: 2287075 - RNA, 13 nt, Human
ccggccccagcca

SEQ ID NO: 2287076 - RNA, 16 nt, Human
ccggccccagccagag

SEQ ID NO: 2287077 - RNA, 14 nt, Human
ccggccccagccag

SEQ ID NO: 2287078 - RNA, 15 nt, Human
ccggccccagccaga

SEQ ID NO: 2287079 - RNA, 18 nt, Human
ccggccaccugcggugcu

SEQ ID NO: 2287080 - RNA, 15 nt, Human
ccggccagccauguc

SEQ ID NO: 2287081 - RNA, 13 nt, Human
ccggcagaaggga

SEQ ID NO: 2287082 - RNA, 15 nt, Human
ccggcacuccaugcu

SEQ ID NO: 2287083 - RNA, 17 nt, Human
ccggccaccugcggugc

SEQ ID NO: 2287084 - RNA, 19 nt, Human
ccggcacagggucugcucu

SEQ ID NO: 2287085 - RNA, 20 nt, Human
ccggcacagggucugcucuu

SEQ ID NO: 2287086 - RNA, 14 nt, Human
ccuaauuagagcag

SEQ ID NO: 2287087 - RNA, 18 nt, Human
ccuaauguuuaugagcca

SEQ ID NO: 2287088 - RNA, 19 nt, Human
ccuaauguuuaugagccag

SEQ ID NO: 2287089 - RNA, 21 nt, Human
ccuagcauacguacacauuuu

SEQ ID NO: 2287090 - RNA, 16 nt, Human
ccuaaugcuccuuguu

SEQ ID NO: 2287091 - RNA, 19 nt, Human
ccuaaugcuccuuguuccu

SEQ ID NO: 2287092 - RNA, 12 nt, Human
ccuaaugcugca

SEQ ID NO: 2287093 - RNA, 22 nt, Human
ccuaauaaacauccuucaagaa

SEQ ID NO: 2287094 - RNA, 20 nt, Human
ccuaaugcgcaggcuggccc

SEQ ID NO: 2287095 - RNA, 21 nt, Human
ccuaaugcgcaggcuggcccu

SEQ ID NO: 2287096 - RNA, 23 nt, Human
ccuaauuagagcagaugaccccu

SEQ ID NO: 2287097 - RNA, 12 nt, Human
ccuagccaccca

SEQ ID NO: 2287098 - RNA, 16 nt, Human
ccuagccacccaccac

SEQ ID NO: 2287099 - RNA, 14 nt, Human
ccuagccauuccug

SEQ ID NO: 2287100 - RNA, 15 nt, Human
ccuagccauuccugg

SEQ ID NO: 2287101 - RNA, 21 nt, Human
ccuagccccuuagcccccacc

SEQ ID NO: 2287102 - RNA, 22 nt, Human
ccuagccccuuagcccccaccc

SEQ ID NO: 2287103 - RNA, 17 nt, Human
ccuagcccaggagagag

SEQ ID NO: 2287104 - RNA, 18 nt, Human
ccuagcccaggagagaga

SEQ ID NO: 2287105 - RNA, 19 nt, Human
ccuagcccaggagagagaa

SEQ ID NO: 2287106 - RNA, 20 nt, Human
ccuagcccaggagagagaaa

SEQ ID NO: 2287107 - RNA, 21 nt, Human
ccuagccauuccugguaccca

SEQ ID NO: 2287108 - RNA, 16 nt, Human
ccuagccauuccuggu

SEQ ID NO: 2287109 - RNA, 11 nt, Human
ccuagcccagg

SEQ ID NO: 2287110 - RNA, 13 nt, Human
ccuagcccaggag

SEQ ID NO: 2287111 - RNA, 15 nt, Human
ccuagcccaggagag

SEQ ID NO: 2287112 - RNA, 15 nt, Human
ccgucuucagccuag

SEQ ID NO: 2287113 - RNA, 14 nt, Human
ccgucuucagccua

SEQ ID NO: 2287114 - RNA, 13 nt, Human
ccgucugugaauu

SEQ ID NO: 2287115 - RNA, 14 nt, Human
ccguccugccugug

SEQ ID NO: 2287116 - RNA, 22 nt, Human
ccgucuuagaaguggaccagga

SEQ ID NO: 2287117 - RNA, 17 nt, Human
ccgugaaaacggagcug

SEQ ID NO: 2287118 - RNA, 18 nt, Human
ccgugaaaacggagcuga

SEQ ID NO: 2287119 - RNA, 18 nt, Human
ccgugacagacuccugag

SEQ ID NO: 2287120 - RNA, 20 nt, Human
ccgugacagacuccugagga

SEQ ID NO: 2287121 - RNA, 22 nt, Human
ccgugacagacuccugaggaca

SEQ ID NO: 2287122 - RNA, 18 nt, Human
ccuaauaaacauccuuca

SEQ ID NO: 2287123 - RNA, 13 nt, Human
ccuaauaaagcug

SEQ ID NO: 2287124 - RNA, 12 nt, Human
ccuaauaaagcu

SEQ ID NO: 2287125 - RNA, 22 nt, Human
ccuagccuuagaagucacacag

SEQ ID NO: 2287126 - RNA, 19 nt, Human
ccuagccuuauccucugau

SEQ ID NO: 2287127 - RNA, 18 nt, Human
ccuagccuuauccucuga

SEQ ID NO: 2287128 - RNA, 23 nt, Human
ccuagccugugccucugggacug

SEQ ID NO: 2287129 - RNA, 19 nt, Human
ccuagccuuagaagucaca

SEQ ID NO: 2287130 - RNA, 15 nt, Human
ccucccaggcucuca

SEQ ID NO: 2287131 - RNA, 20 nt, Human
ccucauuugggguagcuaga

SEQ ID NO: 2287132 - RNA, 17 nt, Human
ccuccaagaaucuaucu

SEQ ID NO: 2287133 - RNA, 14 nt, Human
ccucccagggccag

SEQ ID NO: 2287134 - RNA, 17 nt, Human
ccucauuugggguagcu

SEQ ID NO: 2287135 - RNA, 19 nt, Human
ccucauugacaagaacuga

SEQ ID NO: 2287136 - RNA, 20 nt, Human
ccuccaagaccuucuccuuc

SEQ ID NO: 2287137 - RNA, 21 nt, Human
ccucccagggccagggcccug

SEQ ID NO: 2287138 - RNA, 17 nt, Human
ccucccaguaccuccug

SEQ ID NO: 2287139 - RNA, 12 nt, Human
ccucccaucacc

SEQ ID NO: 2287140 - RNA, 20 nt, Human
ccucauuuaucccucaaccc

SEQ ID NO: 2287141 - RNA, 22 nt, Human
ccucauuucaggagcagccuca

SEQ ID NO: 2287142 - RNA, 19 nt, Human
ccucauuuaucccucaacc

SEQ ID NO: 2287143 - RNA, 16 nt, Human
ccucauuuaucccuca

SEQ ID NO: 2287144 - RNA, 16 nt, Human
ccuccaagaccuucuc

SEQ ID NO: 2287145 - RNA, 17 nt, Human
ccuccaagaccuucucc

SEQ ID NO: 2287146 - RNA, 19 nt, Human
ccuccaagaccuucuccuu

SEQ ID NO: 2287147 - RNA, 17 nt, Human
ccucccaucacccgcua

SEQ ID NO: 2287148 - RNA, 15 nt, Human
ccucccauccagggc

SEQ ID NO: 2287149 - RNA, 16 nt, Human
ccucccagucaccuug

SEQ ID NO: 2287150 - RNA, 18 nt, Human
ccucagcugccucacuuc

SEQ ID NO: 2287151 - RNA, 17 nt, Human
ccucagcugccucacuu

SEQ ID NO: 2287152 - RNA, 16 nt, Human
ccucagcugccucacu

SEQ ID NO: 2287153 - RNA, 15 nt, Human
ccucagcugccucac

SEQ ID NO: 2287154 - RNA, 14 nt, Human
ccucagcugccuca

SEQ ID NO: 2287155 - RNA, 13 nt, Human
ccucagcugccuc

SEQ ID NO: 2287156 - RNA, 15 nt, Human
ccucagcucugggag

SEQ ID NO: 2287157 - RNA, 16 nt, Human
ccucagcucugggaga

SEQ ID NO: 2287158 - RNA, 17 nt, Human
ccucagcucugggagag

SEQ ID NO: 2287159 - RNA, 18 nt, Human
ccucagcucugggagagg

SEQ ID NO: 2287160 - RNA, 18 nt, Human
ccucaggcaggugggaug

SEQ ID NO: 2287161 - RNA, 12 nt, Human
ccucaggcaggu

SEQ ID NO: 2287162 - RNA, 22 nt, Human
ccucaggcauaggccugggugc

SEQ ID NO: 2287163 - RNA, 18 nt, Human
ccucaggcauaggccugg

SEQ ID NO: 2287164 - RNA, 19 nt, Human
ccucaggcaggaagggcag

SEQ ID NO: 2287165 - RNA, 15 nt, Human
ccucaggcaggaagg

SEQ ID NO: 2287166 - RNA, 20 nt, Human
ccucagcucugggagaggau

SEQ ID NO: 2287167 - RNA, 10 nt, Human
ccucaggccu

SEQ ID NO: 2287168 - RNA, 22 nt, Human
ccucauucaggaaaacugacag

SEQ ID NO: 2287169 - RNA, 17 nt, Human
ccucauucaggaaaacu

SEQ ID NO: 2287170 - RNA, 16 nt, Human
ccucauucaggaaaac

SEQ ID NO: 2287171 - RNA, 15 nt, Human
ccucauucaggaaaa

SEQ ID NO: 2287172 - RNA, 21 nt, Human
ccucaggccaggugcaguggc

SEQ ID NO: 2287173 - RNA, 13 nt, Human
ccucauucaggaa

SEQ ID NO: 2287174 - RNA, 21 nt, Human
ccucauuccaccuucccaugc

SEQ ID NO: 2287175 - RNA, 13 nt, Human
ccucauuccugaa

SEQ ID NO: 2287176 - RNA, 23 nt, Human
ccucagccuuggauaaugcuguu

SEQ ID NO: 2287177 - RNA, 22 nt, Human
ccucagccuugccagagaucca

SEQ ID NO: 2287178 - RNA, 23 nt, Human
ccucaagugauucuccugccuca

SEQ ID NO: 2287179 - RNA, 11 nt, Human
ccucagcucca

SEQ ID NO: 2287180 - RNA, 12 nt, Human
ccucagcucugg

SEQ ID NO: 2287181 - RNA, 13 nt, Human
ccucagcucuggg

SEQ ID NO: 2287182 - RNA, 14 nt, Human
ccucagcucuggga

SEQ ID NO: 2287183 - RNA, 11 nt, Human
ccucagcucug

SEQ ID NO: 2287184 - RNA, 19 nt, Human
ccucaagggggacugucuu

SEQ ID NO: 2287185 - RNA, 20 nt, Human
ccucaaggggccauccuguc

SEQ ID NO: 2287186 - RNA, 20 nt, Human
ccucaagucacucccaagcc

SEQ ID NO: 2287187 - RNA, 20 nt, Human
ccucaagugauucuccugcc

SEQ ID NO: 2287188 - RNA, 21 nt, Human
ccucaaggccucccacaguga

SEQ ID NO: 2287189 - RNA, 15 nt, Human
ccucaacugccuacu

SEQ ID NO: 2287190 - RNA, 14 nt, Human
ccucaacugccuac

SEQ ID NO: 2287191 - RNA, 19 nt, Human
ccucaaaugacccaaagac

SEQ ID NO: 2287192 - RNA, 16 nt, Human
ccucaaaugacccaaa

SEQ ID NO: 2287193 - RNA, 15 nt, Human
ccucaaaucguccag

SEQ ID NO: 2287194 - RNA, 22 nt, Human
ccucaacaagggagagaccuca

SEQ ID NO: 2287195 - RNA, 18 nt, Human
ccucaacaagggagagac

SEQ ID NO: 2287196 - RNA, 21 nt, Human
ccucaacaagggagagaccuc

SEQ ID NO: 2287197 - RNA, 16 nt, Human
ccucaacccucccuca

SEQ ID NO: 2287198 - RNA, 18 nt, Human
ccucaacccucccucagc

SEQ ID NO: 2287199 - RNA, 23 nt, Human
ccucaacccucccucagccccuc

SEQ ID NO: 2287200 - RNA, 22 nt, Human
ccucaacccucccucagccccu

SEQ ID NO: 2287201 - RNA, 21 nt, Human
ccucaacccucccucagcccc

SEQ ID NO: 2287202 - RNA, 19 nt, Human
ccucaacccucccucagcc

SEQ ID NO: 2287203 - RNA, 16 nt, Human
ccucaacaccucugca

SEQ ID NO: 2287204 - RNA, 15 nt, Human
ccucaacaagggaga

SEQ ID NO: 2287205 - RNA, 16 nt, Human
ccucaacaagggagag

SEQ ID NO: 2287206 - RNA, 17 nt, Human
ccucaacaagggagaga

SEQ ID NO: 2287207 - RNA, 17 nt, Human
ccucaaauuacuuugug

SEQ ID NO: 2287208 - RNA, 15 nt, Human
ccucaaccuccuggg

SEQ ID NO: 2287209 - RNA, 19 nt, Human
ccucaacucuccuccagag

SEQ ID NO: 2287210 - RNA, 21 nt, Human
ccucaacucuccuccagaguc

SEQ ID NO: 2287211 - RNA, 23 nt, Human
ccucaacucuccuccagagucag

SEQ ID NO: 2287212 - RNA, 20 nt, Human
ccuccgcgugaucaaagcca

SEQ ID NO: 2287213 - RNA, 19 nt, Human
ccuccgccuucacuccggu

SEQ ID NO: 2287214 - RNA, 14 nt, Human
ccuccgccucuugg

SEQ ID NO: 2287215 - RNA, 18 nt, Human
ccuccuaucaccuccccu

SEQ ID NO: 2287216 - RNA, 19 nt, Human
ccuccuaccgaaaccuugc

SEQ ID NO: 2287217 - RNA, 22 nt, Human
ccuccuaccgaaaccuugccuu

SEQ ID NO: 2287218 - RNA, 15 nt, Human
ccuccuagccaccca

SEQ ID NO: 2287219 - RNA, 12 nt, Human
ccuccggccucc

SEQ ID NO: 2287220 - RNA, 15 nt, Human
ccuccggccuccccu

SEQ ID NO: 2287221 - RNA, 16 nt, Human
ccuccggccuccccuc

SEQ ID NO: 2287222 - RNA, 17 nt, Human
ccuccggcgucagccuc

SEQ ID NO: 2287223 - RNA, 18 nt, Human
ccuccggcgucagccucc

SEQ ID NO: 2287224 - RNA, 19 nt, Human
ccuccggcgucagccucca

SEQ ID NO: 2287225 - RNA, 20 nt, Human
ccuccggcgucagccuccag

SEQ ID NO: 2287226 - RNA, 22 nt, Human
ccuccggcgucagccuccagcc

SEQ ID NO: 2287227 - RNA, 13 nt, Human
ccuccgccucuug

SEQ ID NO: 2287228 - RNA, 15 nt, Human
ccuccgauccuuccu

SEQ ID NO: 2287229 - RNA, 14 nt, Human
ccuccgaggccagu

SEQ ID NO: 2287230 - RNA, 16 nt, Human
ccuccgauccuuccuc

SEQ ID NO: 2287231 - RNA, 14 nt, Human
ccuccgagagggag

SEQ ID NO: 2287232 - RNA, 16 nt, Human
ccuccgagagggagag

SEQ ID NO: 2287233 - RNA, 19 nt, Human
ccuccgagagggagagaga

SEQ ID NO: 2287234 - RNA, 21 nt, Human
ccuccgagccggggaguuucu

SEQ ID NO: 2287235 - RNA, 20 nt, Human
ccuccgacagcccccucugc

SEQ ID NO: 2287236 - RNA, 22 nt, Human
ccuccgacagcccccucugccg

SEQ ID NO: 2287237 - RNA, 16 nt, Human
ccucccuuuuuccuug

SEQ ID NO: 2287238 - RNA, 17 nt, Human
ccucccuuuuuccuugu

SEQ ID NO: 2287239 - RNA, 18 nt, Human
ccucccuuuuuccuuguc

SEQ ID NO: 2287240 - RNA, 19 nt, Human
ccucccuuuuuccuugucc

SEQ ID NO: 2287241 - RNA, 12 nt, Human
ccucccuuucuc

SEQ ID NO: 2287242 - RNA, 13 nt, Human
ccucccuuucucc

SEQ ID NO: 2287243 - RNA, 14 nt, Human
ccucccuuucuccc

SEQ ID NO: 2287244 - RNA, 15 nt, Human
ccucccuuucucccc

SEQ ID NO: 2287245 - RNA, 13 nt, Human
ccucccuuccuuu

SEQ ID NO: 2287246 - RNA, 15 nt, Human
ccucccuuccuuuuc

SEQ ID NO: 2287247 - RNA, 16 nt, Human
ccucccuuccuuuucc

SEQ ID NO: 2287248 - RNA, 17 nt, Human
ccucccuuccuuuuccc

SEQ ID NO: 2287249 - RNA, 16 nt, Human
ccucccuucucuucac

SEQ ID NO: 2287250 - RNA, 20 nt, Human
ccucccuuggggccuaugca

SEQ ID NO: 2287251 - RNA, 21 nt, Human
ccucccuuggaaaccugcccu

SEQ ID NO: 2287252 - RNA, 22 nt, Human
ccucccuuggaaaccugcccug

SEQ ID NO: 2287253 - RNA, 23 nt, Human
ccucccuuggaaaccugcccugc

SEQ ID NO: 2287254 - RNA, 19 nt, Human
ccucccuuggguucugaua

SEQ ID NO: 2287255 - RNA, 13 nt, Human
ccucccuucugcu

SEQ ID NO: 2287256 - RNA, 10 nt, Human
ccucccuucu

SEQ ID NO: 2287257 - RNA, 21 nt, Human
ccucccuuccuuuucccugcu

SEQ ID NO: 2287258 - RNA, 22 nt, Human
ccucccuuccuuuucccugcuu

SEQ ID NO: 2287259 - RNA, 16 nt, Human
ccucccuucugcuacu

SEQ ID NO: 2287260 - RNA, 15 nt, Human
ccucccuucugcuac

SEQ ID NO: 2287261 - RNA, 17 nt, Human
ccucccuucugcuacug

SEQ ID NO: 2287262 - RNA, 19 nt, Human
ccucccuuggaaaccugcc

SEQ ID NO: 2287263 - RNA, 12 nt, Human
ccucgcuuggac

SEQ ID NO: 2287264 - RNA, 18 nt, Human
ccucgcuggacucucagu

SEQ ID NO: 2287265 - RNA, 20 nt, Human
ccucggacuuagcugggaga

SEQ ID NO: 2287266 - RNA, 19 nt, Human
ccucggacuuagcugggag

SEQ ID NO: 2287267 - RNA, 14 nt, Human
ccucggagaagagc

SEQ ID NO: 2287268 - RNA, 12 nt, Human
ccucggagaaga

SEQ ID NO: 2287269 - RNA, 21 nt, Human
ccucgcuggggcagugcccuc

SEQ ID NO: 2287270 - RNA, 13 nt, Human
ccucgcugcuucu

SEQ ID NO: 2287271 - RNA, 17 nt, Human
ccucgcuggacucucag

SEQ ID NO: 2287272 - RNA, 13 nt, Human
ccucgcccugggu

SEQ ID NO: 2287273 - RNA, 12 nt, Human
ccucgcccuggg

SEQ ID NO: 2287274 - RNA, 12 nt, Human
ccucgcccaccg

SEQ ID NO: 2287275 - RNA, 21 nt, Human
ccucgcccaccgcaugccccc

SEQ ID NO: 2287276 - RNA, 13 nt, Human
ccucgcccaccgc

SEQ ID NO: 2287277 - RNA, 19 nt, Human
ccucgcccaccgcaugccc

SEQ ID NO: 2287278 - RNA, 14 nt, Human
ccucgcagagaggc

SEQ ID NO: 2287279 - RNA, 14 nt, Human
ccucgcaagcuggg

SEQ ID NO: 2287280 - RNA, 18 nt, Human
ccuccuuuucacaguucu

SEQ ID NO: 2287281 - RNA, 20 nt, Human
ccucgaaacacagaaaccuu

SEQ ID NO: 2287282 - RNA, 16 nt, Human
ccucgaaacacagaaa

SEQ ID NO: 2287283 - RNA, 18 nt, Human
ccuccuuuugcuugaaac

SEQ ID NO: 2287284 - RNA, 18 nt, Human
ccuccuuuuuauguugcc

SEQ ID NO: 2287285 - RNA, 12 nt, Human
ccuccucaccuc

SEQ ID NO: 2287286 - RNA, 13 nt, Human
ccuccucaccuca

SEQ ID NO: 2287287 - RNA, 14 nt, Human
ccuccucaccucau

SEQ ID NO: 2287288 - RNA, 15 nt, Human
ccuccucaccucaug

SEQ ID NO: 2287289 - RNA, 23 nt, Human
ccuccuuugugaggaagccgcug

SEQ ID NO: 2287290 - RNA, 15 nt, Human
ccuccucaccccguc

SEQ ID NO: 2287291 - RNA, 13 nt, Human
ccuccucaccccg

SEQ ID NO: 2287292 - RNA, 16 nt, Human
ccuccucacccccagc

SEQ ID NO: 2287293 - RNA, 14 nt, Human
ccuccucaccccca

SEQ ID NO: 2287294 - RNA, 13 nt, Human
ccuccucaccccc

SEQ ID NO: 2287295 - RNA, 19 nt, Human
ccuccuaucaccuccccuc

SEQ ID NO: 2287296 - RNA, 20 nt, Human
ccuccuagggaaaaguucau

SEQ ID NO: 2287297 - RNA, 22 nt, Human
ccuccuauucaguucccagaau

SEQ ID NO: 2287298 - RNA, 19 nt, Human
ccuccuaucagaaguuucu

SEQ ID NO: 2287299 - RNA, 21 nt, Human
cccaagacagaugccccagag

SEQ ID NO: 2287300 - RNA, 20 nt, Human
cccaagacagaugccccaga

SEQ ID NO: 2287301 - RNA, 19 nt, Human
cccaagacagaugccccag

SEQ ID NO: 2287302 - RNA, 22 nt, Human
cccaagacuugguguccuuucc

SEQ ID NO: 2287303 - RNA, 15 nt, Human
cccaagagaugaaga

SEQ ID NO: 2287304 - RNA, 17 nt, Human
cccaagagaugaagagu

SEQ ID NO: 2287305 - RNA, 23 nt, Human
cccaacuccuggaagcugugucc

SEQ ID NO: 2287306 - RNA, 17 nt, Human
cccaacuccuggaagcu

SEQ ID NO: 2287307 - RNA, 15 nt, Human
cccaacuccuggaag

SEQ ID NO: 2287308 - RNA, 13 nt, Human
cccaacuccugga

SEQ ID NO: 2287309 - RNA, 18 nt, Human
cccaagacagaugcccca

SEQ ID NO: 2287310 - RNA, 15 nt, Human
cccaagaaugggagg

SEQ ID NO: 2287311 - RNA, 21 nt, Human
cccaacucuagcugggggugg

SEQ ID NO: 2287312 - RNA, 16 nt, Human
cccaacucuagcuggg

SEQ ID NO: 2287313 - RNA, 15 nt, Human
cccaacucuagcugg

SEQ ID NO: 2287314 - RNA, 12 nt, Human
cccaacuccugg

SEQ ID NO: 2287315 - RNA, 18 nt, Human
ccauuucccaucugcacc

SEQ ID NO: 2287316 - RNA, 20 nt, Human
cccaacuaauuuuuguauuu

SEQ ID NO: 2287317 - RNA, 13 nt, Human
cccaacuccagaa

SEQ ID NO: 2287318 - RNA, 17 nt, Human
cccaacucaccccagcc

SEQ ID NO: 2287319 - RNA, 20 nt, Human
cccaacucaccccagcccca

SEQ ID NO: 2287320 - RNA, 13 nt, Human
cccaagcucugcu

SEQ ID NO: 2287321 - RNA, 14 nt, Human
cccaagcucugcuc

SEQ ID NO: 2287322 - RNA, 12 nt, Human
cccaagcucugc

SEQ ID NO: 2287323 - RNA, 23 nt, Human
cccaagaggucaaggcugcagug

SEQ ID NO: 2287324 - RNA, 20 nt, Human
cccaagauucacaccugacu

SEQ ID NO: 2287325 - RNA, 15 nt, Human
cccaagcucugcucc

SEQ ID NO: 2287326 - RNA, 15 nt, Human
cccacccacauguga

SEQ ID NO: 2287327 - RNA, 14 nt, Human
cccacccacaugug

SEQ ID NO: 2287328 - RNA, 23 nt, Human
cccaagauucacaccugacucug

SEQ ID NO: 2287329 - RNA, 19 nt, Human
cccaagcaaaaucauggaa

SEQ ID NO: 2287330 - RNA, 12 nt, Human
cccaccccacac

SEQ ID NO: 2287331 - RNA, 12 nt, Human
cccacccaggag

SEQ ID NO: 2287332 - RNA, 21 nt, Human
cccacccagcacccagcaacu

SEQ ID NO: 2287333 - RNA, 13 nt, Human
cccacccaggagg

SEQ ID NO: 2287334 - RNA, 22 nt, Human
cccaccccuuccccacugccug

SEQ ID NO: 2287335 - RNA, 17 nt, Human
cccaccccuuccccacu

SEQ ID NO: 2287336 - RNA, 15 nt, Human
cccaccccuucccca

SEQ ID NO: 2287337 - RNA, 13 nt, Human
cccaccccuuccc

SEQ ID NO: 2287338 - RNA, 14 nt, Human
cccaccccuugcuc

SEQ ID NO: 2287339 - RNA, 14 nt, Human
cccacccgaugcug

SEQ ID NO: 2287340 - RNA, 15 nt, Human
cccacccgaugcugc

SEQ ID NO: 2287341 - RNA, 16 nt, Human
cccacccgaugcugcu

SEQ ID NO: 2287342 - RNA, 12 nt, Human
cccacccucagc

SEQ ID NO: 2287343 - RNA, 13 nt, Human
cccacccucagca

SEQ ID NO: 2287344 - RNA, 14 nt, Human
cccacccucagcac

SEQ ID NO: 2287345 - RNA, 16 nt, Human
cccacccucagcaccc

SEQ ID NO: 2287346 - RNA, 17 nt, Human
cccacccucagcacccc

SEQ ID NO: 2287347 - RNA, 18 nt, Human
cccacccucagcaccccu

SEQ ID NO: 2287348 - RNA, 21 nt, Human
cccacccucagcaccccuucc

SEQ ID NO: 2287349 - RNA, 22 nt, Human
cccacucccuggcucucagaag

SEQ ID NO: 2287350 - RNA, 14 nt, Human
cccacccucccugg

SEQ ID NO: 2287351 - RNA, 12 nt, Human
cccacucccugc

SEQ ID NO: 2287352 - RNA, 13 nt, Human
cccacucccugca

SEQ ID NO: 2287353 - RNA, 12 nt, Human
cccaccccuucc

SEQ ID NO: 2287354 - RNA, 21 nt, Human
cccaccccugugcuccgugcc

SEQ ID NO: 2287355 - RNA, 15 nt, Human
cccaccccugugcuc

SEQ ID NO: 2287356 - RNA, 16 nt, Human
cccaccccugugcucc

SEQ ID NO: 2287357 - RNA, 22 nt, Human
cccaccccugggggcucucaug

SEQ ID NO: 2287358 - RNA, 16 nt, Human
cccaccccugccccca

SEQ ID NO: 2287359 - RNA, 12 nt, Human
cccaccccugug

SEQ ID NO: 2287360 - RNA, 13 nt, Human
cccaccccugugc

SEQ ID NO: 2287361 - RNA, 12 nt, Human
cccaccccuggg

SEQ ID NO: 2287362 - RNA, 12 nt, Human
cccaccccugcc

SEQ ID NO: 2287363 - RNA, 14 nt, Human
cccaccccagccua

SEQ ID NO: 2287364 - RNA, 17 nt, Human
cccaccccacccccacc

SEQ ID NO: 2287365 - RNA, 15 nt, Human
cccaccccacccccu

SEQ ID NO: 2287366 - RNA, 14 nt, Human
cccaccccacacuu

SEQ ID NO: 2287367 - RNA, 13 nt, Human
cccaccccacacu

SEQ ID NO: 2287368 - RNA, 21 nt, Human
cccacucugcuuugacugagc

SEQ ID NO: 2287369 - RNA, 12 nt, Human
cccacucugugc

SEQ ID NO: 2287370 - RNA, 16 nt, Human
cccacugacagccucc

SEQ ID NO: 2287371 - RNA, 14 nt, Human
cccacugaccagaa

SEQ ID NO: 2287372 - RNA, 15 nt, Human
cccacugcaauccug

SEQ ID NO: 2287373 - RNA, 18 nt, Human
cccacugcaauccugucu

SEQ ID NO: 2287374 - RNA, 23 nt, Human
cccacugcuuuuggucuguguga

SEQ ID NO: 2287375 - RNA, 16 nt, Human
cccacugcacacaccu

SEQ ID NO: 2287376 - RNA, 12 nt, Human
cccacugcaccc

SEQ ID NO: 2287377 - RNA, 14 nt, Human
cccacugcaccccc

SEQ ID NO: 2287378 - RNA, 15 nt, Human
cccacugcacccccu

SEQ ID NO: 2287379 - RNA, 22 nt, Human
cccacugcuuuuggucugugug

SEQ ID NO: 2287380 - RNA, 15 nt, Human
cccacucuccccaca

SEQ ID NO: 2287381 - RNA, 14 nt, Human
cccacucuccccac

SEQ ID NO: 2287382 - RNA, 11 nt, Human
cccacucuccc

SEQ ID NO: 2287383 - RNA, 19 nt, Human
cccacucucauuccccagg

SEQ ID NO: 2287384 - RNA, 14 nt, Human
cccacucucauucc

SEQ ID NO: 2287385 - RNA, 17 nt, Human
cccacucuccccacacu

SEQ ID NO: 2287386 - RNA, 21 nt, Human
cccacucucauuccccaggug

SEQ ID NO: 2287387 - RNA, 20 nt, Human
cccacucccuggcucucaga

SEQ ID NO: 2287388 - RNA, 13 nt, Human
cccacucucauuc

SEQ ID NO: 2287389 - RNA, 21 nt, Human
cccacucuaggggucaggcuc

SEQ ID NO: 2287390 - RNA, 21 nt, Human
ccauuucaucuauuucugaga

SEQ ID NO: 2287391 - RNA, 13 nt, Human
ccauuucccaucu

SEQ ID NO: 2287392 - RNA, 14 nt, Human
ccauuucccaucug

SEQ ID NO: 2287393 - RNA, 15 nt, Human
ccauuucccaucugc

SEQ ID NO: 2287394 - RNA, 16 nt, Human
ccauuucccaucugca

SEQ ID NO: 2287395 - RNA, 17 nt, Human
ccauuucccaucugcac

SEQ ID NO: 2287396 - RNA, 22 nt, Human
ccauuucauuugugccagaaug

SEQ ID NO: 2287397 - RNA, 21 nt, Human
ccauuucauuugugccagaau

SEQ ID NO: 2287398 - RNA, 15 nt, Human
cccaacucaccccag

SEQ ID NO: 2287399 - RNA, 16 nt, Human
cccaacucaccccagc

SEQ ID NO: 2287400 - RNA, 23 nt, Human
ccauugccuccuccuucccaaag

SEQ ID NO: 2287401 - RNA, 15 nt, Human
ccauuggaucucauu

SEQ ID NO: 2287402 - RNA, 19 nt, Human
ccauuggcuauuuaaaacu

SEQ ID NO: 2287403 - RNA, 20 nt, Human
ccauuggcuauuuaaaacuu

SEQ ID NO: 2287404 - RNA, 13 nt, Human
ccauuucagagag

SEQ ID NO: 2287405 - RNA, 17 nt, Human
ccauuucaucuauuucu

SEQ ID NO: 2287406 - RNA, 16 nt, Human
ccauuucaucuauuuc

SEQ ID NO: 2287407 - RNA, 17 nt, Human
ccauuucaauucucaaa

SEQ ID NO: 2287408 - RNA, 21 nt, Human
ccauuggcuauuuaaaacuug

SEQ ID NO: 2287409 - RNA, 14 nt, Human
ccauugcccugguu

SEQ ID NO: 2287410 - RNA, 13 nt, Human
ccauugccuccuc

SEQ ID NO: 2287411 - RNA, 15 nt, Human
ccauugccuccuccu

SEQ ID NO: 2287412 - RNA, 21 nt, Human
ccauugccaccaggagaacca

SEQ ID NO: 2287413 - RNA, 17 nt, Human
ccauugccaccaggaga

SEQ ID NO: 2287414 - RNA, 16 nt, Human
ccauugccaccaggag

SEQ ID NO: 2287415 - RNA, 15 nt, Human
ccauugccaccagga

SEQ ID NO: 2287416 - RNA, 18 nt, Human
ccauugcacuccagccug

SEQ ID NO: 2287417 - RNA, 20 nt, Human
ccauucuuccuaguuuucuc

SEQ ID NO: 2287418 - RNA, 22 nt, Human
ccauucuggauuuugucaagca

SEQ ID NO: 2287419 - RNA, 19 nt, Human
ccauucuuccuaguuuucu

SEQ ID NO: 2287420 - RNA, 14 nt, Human
ccauucuuccuagu

SEQ ID NO: 2287421 - RNA, 19 nt, Human
ccauucuggaagugacuuu

SEQ ID NO: 2287422 - RNA, 17 nt, Human
ccaugaucccuguguug

SEQ ID NO: 2287423 - RNA, 22 nt, Human
ccaugaucccuguguugucucu

SEQ ID NO: 2287424 - RNA, 16 nt, Human
ccauguacaugaagaa

SEQ ID NO: 2287425 - RNA, 12 nt, Human
ccaugaugcugg

SEQ ID NO: 2287426 - RNA, 22 nt, Human
ccauguacuguaguuuuucuuc

SEQ ID NO: 2287427 - RNA, 15 nt, Human
ccauguacuguaguu

SEQ ID NO: 2287428 - RNA, 14 nt, Human
ccauguacuguagu

SEQ ID NO: 2287429 - RNA, 13 nt, Human
ccauguacuguag

SEQ ID NO: 2287430 - RNA, 16 nt, Human
ccauguagaaaauuug

SEQ ID NO: 2287431 - RNA, 15 nt, Human
ccauguagaaaauuu

SEQ ID NO: 2287432 - RNA, 20 nt, Human
ccauguagcccccuggccuc

SEQ ID NO: 2287433 - RNA, 14 nt, Human
ccauguagcccccu

SEQ ID NO: 2287434 - RNA, 14 nt, Human
ccauguagaagcug

SEQ ID NO: 2287435 - RNA, 15 nt, Human
ccauguagaagcugc

SEQ ID NO: 2287436 - RNA, 18 nt, Human
ccauguagaagcugcauc

SEQ ID NO: 2287437 - RNA, 19 nt, Human
ccauguagaagcugcaucu

SEQ ID NO: 2287438 - RNA, 16 nt, Human
ccauguagcaggacug

SEQ ID NO: 2287439 - RNA, 15 nt, Human
ccauguaucuaccuc

SEQ ID NO: 2287440 - RNA, 23 nt, Human
ccauguagcccccuggccucugu

SEQ ID NO: 2287441 - RNA, 22 nt, Human
ccauguagcccccuggccucug

SEQ ID NO: 2287442 - RNA, 12 nt, Human
ccaugucgccuc

SEQ ID NO: 2287443 - RNA, 15 nt, Human
ccaugucgccucugc

SEQ ID NO: 2287444 - RNA, 16 nt, Human
ccaugucgccucugca

SEQ ID NO: 2287445 - RNA, 17 nt, Human
ccaugucgccucugcau

SEQ ID NO: 2287446 - RNA, 15 nt, Human
ccaugaggccucagu

SEQ ID NO: 2287447 - RNA, 20 nt, Human
ccaugaggaguugcuguuug

SEQ ID NO: 2287448 - RNA, 18 nt, Human
ccaugaggaguugcuguu

SEQ ID NO: 2287449 - RNA, 22 nt, Human
ccaucccucgugguccccaaca

SEQ ID NO: 2287450 - RNA, 23 nt, Human
ccaugaggaacaaggcaaggcug

SEQ ID NO: 2287451 - RNA, 20 nt, Human
ccaugaggaacaaggcaagg

SEQ ID NO: 2287452 - RNA, 18 nt, Human
ccaugaguuugcccuggu

SEQ ID NO: 2287453 - RNA, 17 nt, Human
ccaugaguuugcccugg

SEQ ID NO: 2287454 - RNA, 14 nt, Human
ccaugaucccugug

SEQ ID NO: 2287455 - RNA, 16 nt, Human
ccaugaucccuguguu

SEQ ID NO: 2287456 - RNA, 23 nt, Human
ccaugaguuggggucuggcagcc

SEQ ID NO: 2287457 - RNA, 22 nt, Human
ccaugaguuggggucuggcagc

SEQ ID NO: 2287458 - RNA, 21 nt, Human
ccaugaguuggggucuggcag

SEQ ID NO: 2287459 - RNA, 20 nt, Human
ccaugaguggcauggccacc

SEQ ID NO: 2287460 - RNA, 21 nt, Human
ccaugaguggcauggccacca

SEQ ID NO: 2287461 - RNA, 18 nt, Human
ccaugaguccccuguuug

SEQ ID NO: 2287462 - RNA, 17 nt, Human
ccaugaguccuugaaaa

SEQ ID NO: 2287463 - RNA, 15 nt, Human
ccauguccuuagcac

SEQ ID NO: 2287464 - RNA, 23 nt, Human
ccaguuccuuucaaugguuugca

SEQ ID NO: 2287465 - RNA, 13 nt, Human
ccaguucugcucc

SEQ ID NO: 2287466 - RNA, 14 nt, Human
ccaguucugcuccu

SEQ ID NO: 2287467 - RNA, 15 nt, Human
ccaguucugcuccuc

SEQ ID NO: 2287468 - RNA, 16 nt, Human
ccaguucugcuccucu

SEQ ID NO: 2287469 - RNA, 17 nt, Human
ccaguucugcuccucuc

SEQ ID NO: 2287470 - RNA, 19 nt, Human
ccaguucugcuccucucca

SEQ ID NO: 2287471 - RNA, 20 nt, Human
ccaguucugcuccucuccag

SEQ ID NO: 2287472 - RNA, 21 nt, Human
ccaguucugcuccucuccagg

SEQ ID NO: 2287473 - RNA, 22 nt, Human
ccaguucugcuccucuccaggc

SEQ ID NO: 2287474 - RNA, 20 nt, Human
ccaguugcacuuggccucug

SEQ ID NO: 2287475 - RNA, 14 nt, Human
ccaguugcacuugg

SEQ ID NO: 2287476 - RNA, 21 nt, Human
ccaguugcacuuggccucugg

SEQ ID NO: 2287477 - RNA, 18 nt, Human
ccaguugaucaaugaaua

SEQ ID NO: 2287478 - RNA, 22 nt, Human
ccaguuggagcagaugccuccc

SEQ ID NO: 2287479 - RNA, 15 nt, Human
ccaguugccaucugc

SEQ ID NO: 2287480 - RNA, 23 nt, Human
ccaguuggguggaugccuggugg

SEQ ID NO: 2287481 - RNA, 13 nt, Human
ccaguuggucccc

SEQ ID NO: 2287482 - RNA, 22 nt, Human
ccaucccgacauggacccggag

SEQ ID NO: 2287483 - RNA, 17 nt, Human
ccaucccgacauggacc

SEQ ID NO: 2287484 - RNA, 19 nt, Human
ccaucccgaaaaucucucg

SEQ ID NO: 2287485 - RNA, 19 nt, Human
ccaucccaugaacacacug

SEQ ID NO: 2287486 - RNA, 16 nt, Human
ccaucccgaaaaucuc

SEQ ID NO: 2287487 - RNA, 14 nt, Human
ccaucccguuuaga

SEQ ID NO: 2287488 - RNA, 16 nt, Human
ccaucccuccccaguu

SEQ ID NO: 2287489 - RNA, 11 nt, Human
ccaucccauga

SEQ ID NO: 2287490 - RNA, 17 nt, Human
ccauccccauccuccag

SEQ ID NO: 2287491 - RNA, 21 nt, Human
ccaucccauaugccugggcag

SEQ ID NO: 2287492 - RNA, 20 nt, Human
ccaucccaaacccuucagug

SEQ ID NO: 2287493 - RNA, 19 nt, Human
ccauccagugucucacagc

SEQ ID NO: 2287494 - RNA, 19 nt, Human
ccaucccauaugccugggc

SEQ ID NO: 2287495 - RNA, 20 nt, Human
ccaucccauaugccugggca

SEQ ID NO: 2287496 - RNA, 21 nt, Human
ccauaagccuccauuuaguuc

SEQ ID NO: 2287497 - RNA, 20 nt, Human
ccaguugggagcacuggagu

SEQ ID NO: 2287498 - RNA, 19 nt, Human
ccaguugggagcacuggag

SEQ ID NO: 2287499 - RNA, 18 nt, Human
ccaguugggagcacugga

SEQ ID NO: 2287500 - RNA, 17 nt, Human
ccaguugggagcacugg

SEQ ID NO: 2287501 - RNA, 17 nt, Human
ccauaagccuccauuua

SEQ ID NO: 2287502 - RNA, 15 nt, Human
ccauaaggaauguag

SEQ ID NO: 2287503 - RNA, 20 nt, Human
ccauaagguuucguuucugu

SEQ ID NO: 2287504 - RNA, 22 nt, Human
ccauaagguuucguuucuguau

SEQ ID NO: 2287505 - RNA, 18 nt, Human
ccaguuggucccccuucc

SEQ ID NO: 2287506 - RNA, 20 nt, Human
ccaguuggucccccuuccau

SEQ ID NO: 2287507 - RNA, 18 nt, Human
ccauccagguucagcuug

SEQ ID NO: 2287508 - RNA, 19 nt, Human
ccauccagguucagcuugu

SEQ ID NO: 2287509 - RNA, 14 nt, Human
ccauaaucuggacu

SEQ ID NO: 2287510 - RNA, 21 nt, Human
ccauaaucuggacuccucugu

SEQ ID NO: 2287511 - RNA, 23 nt, Human
ccauaauuuucuucaugcaauga

SEQ ID NO: 2287512 - RNA, 21 nt, Human
ccauaauuuucuucaugcaau

SEQ ID NO: 2287513 - RNA, 17 nt, Human
ccauaauuuucuucaug

SEQ ID NO: 2287514 - RNA, 20 nt, Human
ccauaauuaugacaguuaua

SEQ ID NO: 2287515 - RNA, 19 nt, Human
ccauaauguauaaagaaca

SEQ ID NO: 2287516 - RNA, 21 nt, Human
ccauaaugcuacugucucacu

SEQ ID NO: 2287517 - RNA, 22 nt, Human
ccagcuauugauauaaauaaaa

SEQ ID NO: 2287518 - RNA, 17 nt, Human
ccagcuauuuuuacuag

SEQ ID NO: 2287519 - RNA, 19 nt, Human
ccagcuauaccugugccuc

SEQ ID NO: 2287520 - RNA, 22 nt, Human
ccagcuauguuauauugaaaaa

SEQ ID NO: 2287521 - RNA, 18 nt, Human
ccagcuauaccugugccu

SEQ ID NO: 2287522 - RNA, 16 nt, Human
ccagcuauaccugugc

SEQ ID NO: 2287523 - RNA, 15 nt, Human
ccagcuauaccugug

SEQ ID NO: 2287524 - RNA, 14 nt, Human
ccagcuauaccugu

SEQ ID NO: 2287525 - RNA, 22 nt, Human
ccagcuccaaggggaaucagaa

SEQ ID NO: 2287526 - RNA, 20 nt, Human
ccagcuccaaccugcaaaga

SEQ ID NO: 2287527 - RNA, 19 nt, Human
ccagcuccaagaccuguug

SEQ ID NO: 2287528 - RNA, 21 nt, Human
ccagcuccaagaccuguuggu

SEQ ID NO: 2287529 - RNA, 15 nt, Human
ccagcuccaaccugc

SEQ ID NO: 2287530 - RNA, 14 nt, Human
ccagcuccaaccug

SEQ ID NO: 2287531 - RNA, 17 nt, Human
ccagcucaauggacugg

SEQ ID NO: 2287532 - RNA, 19 nt, Human
ccagcuauuuuuacuagaa

SEQ ID NO: 2287533 - RNA, 21 nt, Human
ccagcuauuuuuacuagaaca

SEQ ID NO: 2287534 - RNA, 14 nt, Human
ccagcucccuagga

SEQ ID NO: 2287535 - RNA, 17 nt, Human
ccagcucccccgggagg

SEQ ID NO: 2287536 - RNA, 21 nt, Human
ccagcucccccgggaggggcc

SEQ ID NO: 2287537 - RNA, 14 nt, Human
ccagcucccucuau

SEQ ID NO: 2287538 - RNA, 18 nt, Human
ccagcuuucccugccucu

SEQ ID NO: 2287539 - RNA, 14 nt, Human
ccagcuuucccugc

SEQ ID NO: 2287540 - RNA, 12 nt, Human
ccagcuuucccu

SEQ ID NO: 2287541 - RNA, 15 nt, Human
ccagcucccccggga

SEQ ID NO: 2287542 - RNA, 23 nt, Human
ccagcuccccaagaaagccucag

SEQ ID NO: 2287543 - RNA, 14 nt, Human
ccagcuccccaaga

SEQ ID NO: 2287544 - RNA, 20 nt, Human
ccagccccucccaccacagc

SEQ ID NO: 2287545 - RNA, 14 nt, Human
ccagccccuugaga

SEQ ID NO: 2287546 - RNA, 13 nt, Human
ccagccccucugg

SEQ ID NO: 2287547 - RNA, 13 nt, Human
ccagcccggccug

SEQ ID NO: 2287548 - RNA, 14 nt, Human
ccagcccggccugc

SEQ ID NO: 2287549 - RNA, 15 nt, Human
ccagcccggccugcu

SEQ ID NO: 2287550 - RNA, 17 nt, Human
ccagcccggccugcucc

SEQ ID NO: 2287551 - RNA, 17 nt, Human
ccagcccggcugguuuu

SEQ ID NO: 2287552 - RNA, 15 nt, Human
ccagcuacuuccucc

SEQ ID NO: 2287553 - RNA, 17 nt, Human
ccagcuacuuccuccuc

SEQ ID NO: 2287554 - RNA, 19 nt, Human
ccagcccggccugcuccca

SEQ ID NO: 2287555 - RNA, 20 nt, Human
ccagcccggccugcucccag

SEQ ID NO: 2287556 - RNA, 22 nt, Human
ccagcccggccugcucccagca

SEQ ID NO: 2287557 - RNA, 14 nt, Human
ccagcuacuuggga

SEQ ID NO: 2287558 - RNA, 16 nt, Human
ccagcuacuugggaag

SEQ ID NO: 2287559 - RNA, 17 nt, Human
ccagcuacuugggaagc

SEQ ID NO: 2287560 - RNA, 21 nt, Human
ccagccccucccaccacagca

SEQ ID NO: 2287561 - RNA, 16 nt, Human
ccagccccucccacca

SEQ ID NO: 2287562 - RNA, 15 nt, Human
ccagccccucccacc

SEQ ID NO: 2287563 - RNA, 14 nt, Human
ccagccccucccac

SEQ ID NO: 2287564 - RNA, 13 nt, Human
ccagccccuccca

SEQ ID NO: 2287565 - RNA, 12 nt, Human
ccagccccuccc

SEQ ID NO: 2287566 - RNA, 11 nt, Human
ccagccccucc

SEQ ID NO: 2287567 - RNA, 14 nt, Human
ccagccccuagccc

SEQ ID NO: 2287568 - RNA, 15 nt, Human
ccagccccuagccca

SEQ ID NO: 2287569 - RNA, 16 nt, Human
ccagccccuagcccag

SEQ ID NO: 2287570 - RNA, 17 nt, Human
ccagccccuagcccagg

SEQ ID NO: 2287571 - RNA, 18 nt, Human
ccagccccuagcccagga

SEQ ID NO: 2287572 - RNA, 19 nt, Human
ccagccccuagcccaggag

SEQ ID NO: 2287573 - RNA, 22 nt, Human
ccagccccuagcccaggagaga

SEQ ID NO: 2287574 - RNA, 23 nt, Human
ccagccccuagcccaggagagag

SEQ ID NO: 2287575 - RNA, 23 nt, Human
ccagccccuucugacccaugcug

SEQ ID NO: 2287576 - RNA, 24 nt, Human
ccagccccuucugacccaugcugc

SEQ ID NO: 2287577 - RNA, 17 nt, Human
ccagcacuuugggaggc

SEQ ID NO: 2287578 - RNA, 11 nt, Human
ccagcacuuug

SEQ ID NO: 2287579 - RNA, 19 nt, Human
ccagcacuuugggaggcca

SEQ ID NO: 2287580 - RNA, 16 nt, Human
ccagcacuuugggagg

SEQ ID NO: 2287581 - RNA, 15 nt, Human
ccagcacuuugggag

SEQ ID NO: 2287582 - RNA, 14 nt, Human
ccagcacuuuggga

SEQ ID NO: 2287583 - RNA, 20 nt, Human
ccagcacuuguccagcugag

SEQ ID NO: 2287584 - RNA, 19 nt, Human
ccagcacuuguccagcuga

SEQ ID NO: 2287585 - RNA, 16 nt, Human
ccagcacuuguccagc

SEQ ID NO: 2287586 - RNA, 21 nt, Human
ccagcacuuugggaggcugag

SEQ ID NO: 2287587 - RNA, 12 nt, Human
ccagcagacauu

SEQ ID NO: 2287588 - RNA, 21 nt, Human
ccagcacuuugggaggccaag

SEQ ID NO: 2287589 - RNA, 19 nt, Human
ccagcacuuugggaggccu

SEQ ID NO: 2287590 - RNA, 23 nt, Human
ccagcacuuugggaggccaagga

SEQ ID NO: 2287591 - RNA, 12 nt, Human
ccagcagaaaug

SEQ ID NO: 2287592 - RNA, 16 nt, Human
ccacucgcuuccccca

SEQ ID NO: 2287593 - RNA, 13 nt, Human
ccacucgcuuccc

SEQ ID NO: 2287594 - RNA, 22 nt, Human
ccacuccuuccugccaccugcu

SEQ ID NO: 2287595 - RNA, 13 nt, Human
ccacuccuuccug

SEQ ID NO: 2287596 - RNA, 12 nt, Human
ccacuccuuccu

SEQ ID NO: 2287597 - RNA, 15 nt, Human
ccacuccuguacacu

SEQ ID NO: 2287598 - RNA, 14 nt, Human
ccacuccuguacac

SEQ ID NO: 2287599 - RNA, 15 nt, Human
ccacuccucuuauuu

SEQ ID NO: 2287600 - RNA, 21 nt, Human
ccacucgcuucccccauagcc

SEQ ID NO: 2287601 - RNA, 18 nt, Human
ccacucgcuucccccaua

SEQ ID NO: 2287602 - RNA, 20 nt, Human
ccacucgggaggcugagaca

SEQ ID NO: 2287603 - RNA, 16 nt, Human
ccacucuacccuccca

SEQ ID NO: 2287604 - RNA, 23 nt, Human
ccacucgggaggcugagacagga

SEQ ID NO: 2287605 - RNA, 15 nt, Human
ccagcacuuggagag

SEQ ID NO: 2287606 - RNA, 21 nt, Human
ccagcacuuggagaggcugag

SEQ ID NO: 2287607 - RNA, 15 nt, Human
ccagcacuuguauau

SEQ ID NO: 2287608 - RNA, 17 nt, Human
ccagccccagugcccac

SEQ ID NO: 2287609 - RNA, 14 nt, Human
ccagcagagcaccu

SEQ ID NO: 2287610 - RNA, 12 nt, Human
ccagcagagcac

SEQ ID NO: 2287611 - RNA, 13 nt, Human
ccagcagagcacc

SEQ ID NO: 2287612 - RNA, 18 nt, Human
ccagccccauccucugua

SEQ ID NO: 2287613 - RNA, 13 nt, Human
ccagcagacauug

SEQ ID NO: 2287614 - RNA, 14 nt, Human
ccagcagacauugu

SEQ ID NO: 2287615 - RNA, 15 nt, Human
ccagcagacauuguc

SEQ ID NO: 2287616 - RNA, 17 nt, Human
ccagcagacauugucag

SEQ ID NO: 2287617 - RNA, 16 nt, Human
ccagccccaucaggac

SEQ ID NO: 2287618 - RNA, 17 nt, Human
ccagccccggggugagu

SEQ ID NO: 2287619 - RNA, 13 nt, Human
ccagccccuagcc

SEQ ID NO: 2287620 - RNA, 15 nt, Human
ccagccccauccucu

SEQ ID NO: 2287621 - RNA, 17 nt, Human
ccagccccauccucugu

SEQ ID NO: 2287622 - RNA, 19 nt, Human
ccaggaaacuccacaucug

SEQ ID NO: 2287623 - RNA, 20 nt, Human
ccaggaaacuccacaucugc

SEQ ID NO: 2287624 - RNA, 21 nt, Human
ccaggaaacuccacaucugcc

SEQ ID NO: 2287625 - RNA, 22 nt, Human
ccaggaaacuccacaucugccu

SEQ ID NO: 2287626 - RNA, 23 nt, Human
ccaggaaacuccacaucugccuu

SEQ ID NO: 2287627 - RNA, 13 nt, Human
ccagcuuuuccca

SEQ ID NO: 2287628 - RNA, 23 nt, Human
ccagcuuuucccaaaagcccauu

SEQ ID NO: 2287629 - RNA, 16 nt, Human
ccagcuuuuccucccu

SEQ ID NO: 2287630 - RNA, 18 nt, Human
ccagcuuuuccucccuug

SEQ ID NO: 2287631 - RNA, 20 nt, Human
ccagcuuugcuaccaaagca

SEQ ID NO: 2287632 - RNA, 15 nt, Human
ccagcuuugcccaac

SEQ ID NO: 2287633 - RNA, 18 nt, Human
ccagcuuugcccaacacc

SEQ ID NO: 2287634 - RNA, 19 nt, Human
ccagcuuugcccaacacca

SEQ ID NO: 2287635 - RNA, 22 nt, Human
ccagcuuugcccaacaccagcc

SEQ ID NO: 2287636 - RNA, 18 nt, Human
ccaggggaugaguggagg

SEQ ID NO: 2287637 - RNA, 21 nt, Human
ccaggggaggccugaggcuuc

SEQ ID NO: 2287638 - RNA, 23 nt, Human
ccagggggccagucccugaggca

SEQ ID NO: 2287639 - RNA, 17 nt, Human
ccaggggggugaggagc

SEQ ID NO: 2287640 - RNA, 20 nt, Human
ccaggggggugaggagcugg

SEQ ID NO: 2287641 - RNA, 19 nt, Human
ccaggggggugaggagcug

SEQ ID NO: 2287642 - RNA, 18 nt, Human
ccaggggucccagccacc

SEQ ID NO: 2287643 - RNA, 16 nt, Human
ccaggggucucccugg

SEQ ID NO: 2287644 - RNA, 17 nt, Human
ccaggggucccagccac

SEQ ID NO: 2287645 - RNA, 14 nt, Human
ccaggggucccagc

SEQ ID NO: 2287646 - RNA, 19 nt, Human
ccaggggugauuucagaga

SEQ ID NO: 2287647 - RNA, 20 nt, Human
ccaggggugauuucagagag

SEQ ID NO: 2287648 - RNA, 21 nt, Human
ccaggggugauuucagagagg

SEQ ID NO: 2287649 - RNA, 17 nt, Human
ccaggggucucccugga

SEQ ID NO: 2287650 - RNA, 18 nt, Human
ccaggggucucccuggag

SEQ ID NO: 2287651 - RNA, 19 nt, Human
ccaggggucucccuggagu

SEQ ID NO: 2287652 - RNA, 21 nt, Human
ccaguccaaauguccuccaga

SEQ ID NO: 2287653 - RNA, 14 nt, Human
ccaguccaaggaaa

SEQ ID NO: 2287654 - RNA, 21 nt, Human
ccaguccaaucucauggagaa

SEQ ID NO: 2287655 - RNA, 13 nt, Human
ccaguccaggcug

SEQ ID NO: 2287656 - RNA, 22 nt, Human
ccaguccaaucucauggagaag

SEQ ID NO: 2287657 - RNA, 14 nt, Human
ccaguccaggcugc

SEQ ID NO: 2287658 - RNA, 15 nt, Human
ccaguccaggcugcc

SEQ ID NO: 2287659 - RNA, 16 nt, Human
ccaguccaggcugccg

SEQ ID NO: 2287660 - RNA, 19 nt, Human
ccaguccaggcugccgugg

SEQ ID NO: 2287661 - RNA, 18 nt, Human
ccaggggugcccccuccu

SEQ ID NO: 2287662 - RNA, 18 nt, Human
ccaguccaaauguccucc

SEQ ID NO: 2287663 - RNA, 19 nt, Human
ccagucagguaguugcaau

SEQ ID NO: 2287664 - RNA, 13 nt, Human
ccaggggugcccc

SEQ ID NO: 2287665 - RNA, 15 nt, Human
ccaggggugcccccu

SEQ ID NO: 2287666 - RNA, 16 nt, Human
ccaggggugcccccuc

SEQ ID NO: 2287667 - RNA, 17 nt, Human
ccaggggugcccccucc

SEQ ID NO: 2287668 - RNA, 18 nt, Human
ccagucccccugccccag

SEQ ID NO: 2287669 - RNA, 22 nt, Human
ccaguccccgugccccgccucc

SEQ ID NO: 2287670 - RNA, 15 nt, Human
ccaguccccgugccc

SEQ ID NO: 2287671 - RNA, 17 nt, Human
ccaguccccgugccccg

SEQ ID NO: 2287672 - RNA, 15 nt, Human
ccagucccugaggca

SEQ ID NO: 2287673 - RNA, 23 nt, Human
ccagucccugggggaagcccugg

SEQ ID NO: 2287674 - RNA, 22 nt, Human
ccagucccugggggaagcccug

SEQ ID NO: 2287675 - RNA, 19 nt, Human
ccagucccugggggaagcc

SEQ ID NO: 2287676 - RNA, 15 nt, Human
ccagucccuggggga

SEQ ID NO: 2287677 - RNA, 13 nt, Human
ccagucccugggg

SEQ ID NO: 2287678 - RNA, 12 nt, Human
ccagucccuggg

SEQ ID NO: 2287679 - RNA, 14 nt, Human
ccaguccccuuugu

SEQ ID NO: 2287680 - RNA, 18 nt, Human
ccaguccuagcugcacag

SEQ ID NO: 2287681 - RNA, 14 nt, Human
ccaggauggagggg

SEQ ID NO: 2287682 - RNA, 17 nt, Human
ccaggaucccaggggcc

SEQ ID NO: 2287683 - RNA, 20 nt, Human
ccaggauggcccuucccacu

SEQ ID NO: 2287684 - RNA, 22 nt, Human
ccaggauggaggggugguccug

SEQ ID NO: 2287685 - RNA, 17 nt, Human
ccaggcaggugccugga

SEQ ID NO: 2287686 - RNA, 19 nt, Human
ccaggcaggugccuggaca

SEQ ID NO: 2287687 - RNA, 23 nt, Human
ccaggcaggucuugaacuccugg

SEQ ID NO: 2287688 - RNA, 12 nt, Human
ccaggcaggucu

SEQ ID NO: 2287689 - RNA, 14 nt, Human
ccaggcaggucuug

SEQ ID NO: 2287690 - RNA, 13 nt, Human
ccaggcugcucag

SEQ ID NO: 2287691 - RNA, 15 nt, Human
ccaggcugccguggg

SEQ ID NO: 2287692 - RNA, 18 nt, Human
ccaggcugccguggggcc

SEQ ID NO: 2287693 - RNA, 20 nt, Human
ccaggcugccaaggccagag

SEQ ID NO: 2287694 - RNA, 19 nt, Human
ccaggcugccaaggccaga

SEQ ID NO: 2287695 - RNA, 14 nt, Human
ccaggcugccgugg

SEQ ID NO: 2287696 - RNA, 17 nt, Human
ccaggcugcucagggcu

SEQ ID NO: 2287697 - RNA, 19 nt, Human
ccaggcugcucagggcugg

SEQ ID NO: 2287698 - RNA, 21 nt, Human
ccaggcugcucuugaacuccu

SEQ ID NO: 2287699 - RNA, 14 nt, Human
ccaggcugcuggac

SEQ ID NO: 2287700 - RNA, 12 nt, Human
ccaggcuggcca

SEQ ID NO: 2287701 - RNA, 20 nt, Human
ccaggggagagggucuggag

SEQ ID NO: 2287702 - RNA, 18 nt, Human
ccaggggagagggucugg

SEQ ID NO: 2287703 - RNA, 21 nt, Human
ccaggggagagggucuggaga

SEQ ID NO: 2287704 - RNA, 13 nt, Human
ccaggggaccaca

SEQ ID NO: 2287705 - RNA, 18 nt, Human
ccaggggaccacaccucc

SEQ ID NO: 2287706 - RNA, 18 nt, Human
ccaggggaguugugucug

SEQ ID NO: 2287707 - RNA, 16 nt, Human
ccaggggaguuguguc

SEQ ID NO: 2287708 - RNA, 13 nt, Human
ccaggggagcccu

SEQ ID NO: 2287709 - RNA, 14 nt, Human
ccaggggagcccuc

SEQ ID NO: 2287710 - RNA, 21 nt, Human
ccaggggaaaaucagccugcu

SEQ ID NO: 2287711 - RNA, 23 nt, Human
ccaggcuggcgcagccaaggccg

SEQ ID NO: 2287712 - RNA, 19 nt, Human
ccaggggaaagaugagcuu

SEQ ID NO: 2287713 - RNA, 12 nt, Human
ccaggcuggcgu

SEQ ID NO: 2287714 - RNA, 18 nt, Human
ccaggcuggcgcagccaa

SEQ ID NO: 2287715 - RNA, 19 nt, Human
ccaggcuggcgcagccaag

SEQ ID NO: 2287716 - RNA, 21 nt, Human
ccaggcuggcgcagccaaggc

SEQ ID NO: 2287717 - RNA, 22 nt, Human
ccaggcuggcgcagccaaggcc

SEQ ID NO: 2287718 - RNA, 13 nt, Human
ccaggcuggccag

SEQ ID NO: 2287719 - RNA, 14 nt, Human
ccaggcuggccagc

SEQ ID NO: 2287720 - RNA, 15 nt, Human
ccaggcuggccagcc

SEQ ID NO: 2287721 - RNA, 16 nt, Human
ccaggcuggccagccc

SEQ ID NO: 2287722 - RNA, 17 nt, Human
ccaggcuggccagcccc

SEQ ID NO: 2287723 - RNA, 18 nt, Human
ccaggcuggccagcccca

SEQ ID NO: 2287724 - RNA, 20 nt, Human
ccaggcuggccagccccaca

SEQ ID NO: 2287725 - RNA, 21 nt, Human
ccaggcuggccagccccacag

SEQ ID NO: 2287726 - RNA, 22 nt, Human
ccaggcuggccagccccacagc

SEQ ID NO: 2287727 - RNA, 23 nt, Human
ccaggcuggccagccccacagcc

SEQ ID NO: 2287728 - RNA, 13 nt, Human
ccaggcuggcgca

SEQ ID NO: 2287729 - RNA, 14 nt, Human
ccaggcuggcgcag

SEQ ID NO: 2287730 - RNA, 15 nt, Human
ccaggcuggcgcagc

SEQ ID NO: 2287731 - RNA, 16 nt, Human
ccaggcuggcgcagcc

SEQ ID NO: 2287732 - RNA, 17 nt, Human
ccaggcuggcgcagcca

SEQ ID NO: 2287733 - RNA, 18 nt, Human
ccaggaucagauugcaug

SEQ ID NO: 2287734 - RNA, 14 nt, Human
ccaggaucagauug

SEQ ID NO: 2287735 - RNA, 23 nt, Human
ccaggauagugggcaccccacug

SEQ ID NO: 2287736 - RNA, 21 nt, Human
ccaggauggaacacggccaca

SEQ ID NO: 2287737 - RNA, 20 nt, Human
ccaggaugagcaucccagga

SEQ ID NO: 2287738 - RNA, 17 nt, Human
ccaggauccagaagggg

SEQ ID NO: 2287739 - RNA, 19 nt, Human
ccaggaucagauugcaugu

SEQ ID NO: 2287740 - RNA, 14 nt, Human
ccaggaucauggug

SEQ ID NO: 2287741 - RNA, 21 nt, Human
ccaggaucagauugcauguga

SEQ ID NO: 2287742 - RNA, 15 nt, Human
ccaggaucauggugu

SEQ ID NO: 2287743 - RNA, 17 nt, Human
ccaggaucaugguguaa

SEQ ID NO: 2287744 - RNA, 20 nt, Human
ccaggaucaugguguaauaa

SEQ ID NO: 2287745 - RNA, 23 nt, Human
ccaggaucaugguguaauaagac

SEQ ID NO: 2287746 - RNA, 17 nt, Human
cccucagcaccccuucc

SEQ ID NO: 2287747 - RNA, 18 nt, Human
cccucagcaccccuucca

SEQ ID NO: 2287748 - RNA, 19 nt, Human
cccucagcaccccuuccau

SEQ ID NO: 2287749 - RNA, 21 nt, Human
cccucagcaccccuuccaugu

SEQ ID NO: 2287750 - RNA, 19 nt, Human
cccucagccccaccccagg

SEQ ID NO: 2287751 - RNA, 14 nt, Human
cccucagccccucu

SEQ ID NO: 2287752 - RNA, 13 nt, Human
cccucagccccuc

SEQ ID NO: 2287753 - RNA, 12 nt, Human
cccucagccccu

SEQ ID NO: 2287754 - RNA, 20 nt, Human
cccucagccccaccccaggu

SEQ ID NO: 2287755 - RNA, 21 nt, Human
cccucagccccucuugccccc

SEQ ID NO: 2287756 - RNA, 17 nt, Human
cccucagccccucuugc

SEQ ID NO: 2287757 - RNA, 23 nt, Human
cccucagccccucuugcccccca

SEQ ID NO: 2287758 - RNA, 23 nt, Human
cccucaccugggcaccuggggag

SEQ ID NO: 2287759 - RNA, 17 nt, Human
cccucaccugggcaccu

SEQ ID NO: 2287760 - RNA, 21 nt, Human
cccucaccuguagcagccagu

SEQ ID NO: 2287761 - RNA, 18 nt, Human
cccucaccuugcaacaca

SEQ ID NO: 2287762 - RNA, 20 nt, Human
cccucaccuuggcaccagac

SEQ ID NO: 2287763 - RNA, 21 nt, Human
cccucaccuugcaacacacag

SEQ ID NO: 2287764 - RNA, 23 nt, Human
cccucaccuuggcaccagacacc

SEQ ID NO: 2287765 - RNA, 21 nt, Human
cccucaccuuggcaccagaca

SEQ ID NO: 2287766 - RNA, 23 nt, Human
cccucaggcauaggccugggugc

SEQ ID NO: 2287767 - RNA, 12 nt, Human
cccucagggauc

SEQ ID NO: 2287768 - RNA, 22 nt, Human
cccucaggcauaggccugggug

SEQ ID NO: 2287769 - RNA, 21 nt, Human
cccucaggcauaggccugggu

SEQ ID NO: 2287770 - RNA, 20 nt, Human
cccucaggcauaggccuggg

SEQ ID NO: 2287771 - RNA, 19 nt, Human
cccucaggcauaggccugg

SEQ ID NO: 2287772 - RNA, 18 nt, Human
cccucaggcauaggccug

SEQ ID NO: 2287773 - RNA, 17 nt, Human
cccucaggacugcaaca

SEQ ID NO: 2287774 - RNA, 13 nt, Human
cccucaggacugc

SEQ ID NO: 2287775 - RNA, 12 nt, Human
cccucagcucca

SEQ ID NO: 2287776 - RNA, 16 nt, Human
cccucaacaccucugc

SEQ ID NO: 2287777 - RNA, 17 nt, Human
cccggcuaauuuuugua

SEQ ID NO: 2287778 - RNA, 18 nt, Human
cccucaaaugacccaaag

SEQ ID NO: 2287779 - RNA, 19 nt, Human
cccucaaaugacccaaaga

SEQ ID NO: 2287780 - RNA, 18 nt, Human
cccgggaagggggcuggg

SEQ ID NO: 2287781 - RNA, 21 nt, Human
cccgggaagggggcugggaca

SEQ ID NO: 2287782 - RNA, 15 nt, Human
cccucaccugggcac

SEQ ID NO: 2287783 - RNA, 14 nt, Human
cccucaccugggca

SEQ ID NO: 2287784 - RNA, 14 nt, Human
cccucaccuccucu

SEQ ID NO: 2287785 - RNA, 15 nt, Human
cccucacccuggggc

SEQ ID NO: 2287786 - RNA, 21 nt, Human
cccucaacaagggagagaccu

SEQ ID NO: 2287787 - RNA, 16 nt, Human
cccucacccuggggcu

SEQ ID NO: 2287788 - RNA, 16 nt, Human
cccucaacucuccucc

SEQ ID NO: 2287789 - RNA, 16 nt, Human
cccucaaccucuucug

SEQ ID NO: 2287790 - RNA, 20 nt, Human
cccucaaaugacccaaagac

SEQ ID NO: 2287791 - RNA, 17 nt, Human
cccucaacaagggagag

SEQ ID NO: 2287792 - RNA, 18 nt, Human
cccucaacaagggagaga

SEQ ID NO: 2287793 - RNA, 19 nt, Human
cccucaacaagggagagac

SEQ ID NO: 2287794 - RNA, 22 nt, Human
ccccuucucugcuccaccacau

SEQ ID NO: 2287795 - RNA, 16 nt, Human
ccccuucucugcucca

SEQ ID NO: 2287796 - RNA, 16 nt, Human
ccccuucugacccaug

SEQ ID NO: 2287797 - RNA, 14 nt, Human
ccccuucugaccca

SEQ ID NO: 2287798 - RNA, 14 nt, Human
ccccuucucugcuc

SEQ ID NO: 2287799 - RNA, 13 nt, Human
ccccuucucugcu

SEQ ID NO: 2287800 - RNA, 12 nt, Human
ccccuucucugc

SEQ ID NO: 2287801 - RNA, 19 nt, Human
ccccuucucuccuccccaa

SEQ ID NO: 2287802 - RNA, 13 nt, Human
ccccuucugaccc

SEQ ID NO: 2287803 - RNA, 16 nt, Human
cccgaauagcugggac

SEQ ID NO: 2287804 - RNA, 17 nt, Human
cccgaauagcugggacu

SEQ ID NO: 2287805 - RNA, 18 nt, Human
cccgaauagcugggacua

SEQ ID NO: 2287806 - RNA, 22 nt, Human
cccggcgcgguggcucacgccu

SEQ ID NO: 2287807 - RNA, 19 nt, Human
cccggcgcgguggcucacg

SEQ ID NO: 2287808 - RNA, 14 nt, Human
cccggcgcgguggc

SEQ ID NO: 2287809 - RNA, 19 nt, Human
cccggcgcccucuguccug

SEQ ID NO: 2287810 - RNA, 16 nt, Human
cccggcgcccucuguc

SEQ ID NO: 2287811 - RNA, 18 nt, Human
cccggcgcccucuguccu

SEQ ID NO: 2287812 - RNA, 20 nt, Human
cccggcgcccucuguccuga

SEQ ID NO: 2287813 - RNA, 18 nt, Human
cccggccucagcaccccu

SEQ ID NO: 2287814 - RNA, 17 nt, Human
cccggccugcucccagc

SEQ ID NO: 2287815 - RNA, 18 nt, Human
cccggccugcucccagca

SEQ ID NO: 2287816 - RNA, 20 nt, Human
cccggccugcucccagcagc

SEQ ID NO: 2287817 - RNA, 21 nt, Human
cccggccugcucccagcagcc

SEQ ID NO: 2287818 - RNA, 14 nt, Human
cccggcgcccucug

SEQ ID NO: 2287819 - RNA, 15 nt, Human
cccggcgcccucugu

SEQ ID NO: 2287820 - RNA, 20 nt, Human
cccggcuaauuuuuguauuu

SEQ ID NO: 2287821 - RNA, 15 nt, Human
cccgggaagggggcu

SEQ ID NO: 2287822 - RNA, 15 nt, Human
cccggccccugcugg

SEQ ID NO: 2287823 - RNA, 11 nt, Human
cccggccagcc

SEQ ID NO: 2287824 - RNA, 19 nt, Human
cccggccauguccuuagca

SEQ ID NO: 2287825 - RNA, 13 nt, Human
cccggccccagcc

SEQ ID NO: 2287826 - RNA, 14 nt, Human
cccggccccagcca

SEQ ID NO: 2287827 - RNA, 15 nt, Human
cccggccccagccag

SEQ ID NO: 2287828 - RNA, 16 nt, Human
cccggccccagccaga

SEQ ID NO: 2287829 - RNA, 12 nt, Human
cccggcccccug

SEQ ID NO: 2287830 - RNA, 16 nt, Human
cccggccccugcuggu

SEQ ID NO: 2287831 - RNA, 22 nt, Human
cccggcccugggcucggaggcu

SEQ ID NO: 2287832 - RNA, 18 nt, Human
cccggccgccgcccugcu

SEQ ID NO: 2287833 - RNA, 13 nt, Human
cccggcccccugg

SEQ ID NO: 2287834 - RNA, 21 nt, Human
cccggcccccuggucucuggu

SEQ ID NO: 2287835 - RNA, 18 nt, Human
cccggccccggccccagc

SEQ ID NO: 2287836 - RNA, 22 nt, Human
cccggcccuaccagcgcccgcu

SEQ ID NO: 2287837 - RNA, 17 nt, Human
ccccugccagugccuua

SEQ ID NO: 2287838 - RNA, 16 nt, Human
ccccugccagugccuu

SEQ ID NO: 2287839 - RNA, 15 nt, Human
ccccugccagugccu

SEQ ID NO: 2287840 - RNA, 14 nt, Human
ccccugccagugcc

SEQ ID NO: 2287841 - RNA, 14 nt, Human
ccccugcccaucug

SEQ ID NO: 2287842 - RNA, 18 nt, Human
ccccugcccaucugggaa

SEQ ID NO: 2287843 - RNA, 13 nt, Human
ccccugccccagc

SEQ ID NO: 2287844 - RNA, 23 nt, Human
ccccugccagggcagggccccag

SEQ ID NO: 2287845 - RNA, 19 nt, Human
ccccugccagggcagggcc

SEQ ID NO: 2287846 - RNA, 15 nt, Human
ccccugccagggcag

SEQ ID NO: 2287847 - RNA, 14 nt, Human
ccccugccagggca

SEQ ID NO: 2287848 - RNA, 16 nt, Human
ccccugcccccaggac

SEQ ID NO: 2287849 - RNA, 17 nt, Human
ccccugcccccaggacu

SEQ ID NO: 2287850 - RNA, 12 nt, Human
ccccugccccca

SEQ ID NO: 2287851 - RNA, 14 nt, Human
ccccugccccagcc

SEQ ID NO: 2287852 - RNA, 16 nt, Human
ccccugccccagccca

SEQ ID NO: 2287853 - RNA, 23 nt, Human
ccccugcccccaggacugggcca

SEQ ID NO: 2287854 - RNA, 17 nt, Human
ccccugccccccagccu

SEQ ID NO: 2287855 - RNA, 18 nt, Human
ccccugcccccaggacug

SEQ ID NO: 2287856 - RNA, 19 nt, Human
ccccugcccccaggacugg

SEQ ID NO: 2287857 - RNA, 14 nt, Human
ccccugccacccug

SEQ ID NO: 2287858 - RNA, 16 nt, Human
ccccugccacccuggg

SEQ ID NO: 2287859 - RNA, 10 nt, Human
ccccugccag

SEQ ID NO: 2287860 - RNA, 12 nt, Human
ccccugccacca

SEQ ID NO: 2287861 - RNA, 20 nt, Human
ccccugccaccaggccaccu

SEQ ID NO: 2287862 - RNA, 18 nt, Human
ccccugccaccucccuga

SEQ ID NO: 2287863 - RNA, 21 nt, Human
ccccugccaccucccugaccc

SEQ ID NO: 2287864 - RNA, 16 nt, Human
ccccucuggccaggau

SEQ ID NO: 2287865 - RNA, 22 nt, Human
ccccucuugccccaacccccag

SEQ ID NO: 2287866 - RNA, 13 nt, Human
ccccucuggccag

SEQ ID NO: 2287867 - RNA, 18 nt, Human
ccccucuggcuccagcug

SEQ ID NO: 2287868 - RNA, 16 nt, Human
ccccucuggcuccagc

SEQ ID NO: 2287869 - RNA, 15 nt, Human
ccccugacaacacuc

SEQ ID NO: 2287870 - RNA, 13 nt, Human
ccccugaaacuua

SEQ ID NO: 2287871 - RNA, 16 nt, Human
ccccugaaacuuauuu

SEQ ID NO: 2287872 - RNA, 17 nt, Human
ccccugaaacuuauuuu

SEQ ID NO: 2287873 - RNA, 20 nt, Human
ccccugcaaagcccagcuug

SEQ ID NO: 2287874 - RNA, 18 nt, Human
ccccugcaaagcccagcu

SEQ ID NO: 2287875 - RNA, 21 nt, Human
ccccugcaaagcccagcuuga

SEQ ID NO: 2287876 - RNA, 13 nt, Human
ccccugcacucca

SEQ ID NO: 2287877 - RNA, 16 nt, Human
ccccucugcugcuguc

SEQ ID NO: 2287878 - RNA, 23 nt, Human
ccccucugcccugcgggucacag

SEQ ID NO: 2287879 - RNA, 20 nt, Human
ccccucugcccugcggguca

SEQ ID NO: 2287880 - RNA, 15 nt, Human
ccccucugcccugcg

SEQ ID NO: 2287881 - RNA, 14 nt, Human
ccccucugcccugc

SEQ ID NO: 2287882 - RNA, 13 nt, Human
cccuccucaccuc

SEQ ID NO: 2287883 - RNA, 12 nt, Human
cccuccucaccu

SEQ ID NO: 2287884 - RNA, 13 nt, Human
cccuccucacccc

SEQ ID NO: 2287885 - RNA, 21 nt, Human
cccuccuaucaccuccccucc

SEQ ID NO: 2287886 - RNA, 23 nt, Human
cccuccucaccucuggacuggcu

SEQ ID NO: 2287887 - RNA, 18 nt, Human
cccuccucaccucuggac

SEQ ID NO: 2287888 - RNA, 17 nt, Human
cccuccucaccucugga

SEQ ID NO: 2287889 - RNA, 16 nt, Human
cccuccucaccucugg

SEQ ID NO: 2287890 - RNA, 14 nt, Human
cccuccucaccccg

SEQ ID NO: 2287891 - RNA, 14 nt, Human
cccuccucacuggc

SEQ ID NO: 2287892 - RNA, 12 nt, Human
cccuccucacug

SEQ ID NO: 2287893 - RNA, 15 nt, Human
cccuccucacuggcc

SEQ ID NO: 2287894 - RNA, 16 nt, Human
cccuccucacuggcca

SEQ ID NO: 2287895 - RNA, 19 nt, Human
cccuccucacuggccaucc

SEQ ID NO: 2287896 - RNA, 21 nt, Human
cccuccucacuggccaucccu

SEQ ID NO: 2287897 - RNA, 18 nt, Human
cccuccugaaacuuacac

SEQ ID NO: 2287898 - RNA, 16 nt, Human
cccuccucugccaccu

SEQ ID NO: 2287899 - RNA, 13 nt, Human
cccuccucugcca

SEQ ID NO: 2287900 - RNA, 18 nt, Human
cccuccugccgacuccug

SEQ ID NO: 2287901 - RNA, 13 nt, Human
cccuccuggcucu

SEQ ID NO: 2287902 - RNA, 13 nt, Human
cccuccugcugca

SEQ ID NO: 2287903 - RNA, 19 nt, Human
cccuccugccgacuccugg

SEQ ID NO: 2287904 - RNA, 20 nt, Human
cccuccugccgacuccuggg

SEQ ID NO: 2287905 - RNA, 11 nt, Human
cccuccugcug

SEQ ID NO: 2287906 - RNA, 12 nt, Human
cccuccugcugc

SEQ ID NO: 2287907 - RNA, 11 nt, Human
cccuccuggga

SEQ ID NO: 2287908 - RNA, 17 nt, Human
cccuccugggaucugcu

SEQ ID NO: 2287909 - RNA, 19 nt, Human
cccuccugggaucugcucg

SEQ ID NO: 2287910 - RNA, 16 nt, Human
cccuccugucuuccca

SEQ ID NO: 2287911 - RNA, 18 nt, Human
cccuccugucuucccagg

SEQ ID NO: 2287912 - RNA, 13 nt, Human
cccuccuguaaau

SEQ ID NO: 2287913 - RNA, 12 nt, Human
cccuccugucuu

SEQ ID NO: 2287914 - RNA, 14 nt, Human
cccuccugucuucc

SEQ ID NO: 2287915 - RNA, 15 nt, Human
cccuccugucuuccc

SEQ ID NO: 2287916 - RNA, 12 nt, Human
cccuccucugcc

SEQ ID NO: 2287917 - RNA, 11 nt, Human
cccuccucugc

SEQ ID NO: 2287918 - RNA, 20 nt, Human
cccuccucccuuuuuccuug

SEQ ID NO: 2287919 - RNA, 15 nt, Human
cccuccucucugccc

SEQ ID NO: 2287920 - RNA, 16 nt, Human
cccuccucucugcccu

SEQ ID NO: 2287921 - RNA, 12 nt, Human
cccuccuccacu

SEQ ID NO: 2287922 - RNA, 13 nt, Human
cccuccuccacuc

SEQ ID NO: 2287923 - RNA, 14 nt, Human
cccuccuccacucu

SEQ ID NO: 2287924 - RNA, 13 nt, Human
cccauccuggccc

SEQ ID NO: 2287925 - RNA, 12 nt, Human
cccauccuaccc

SEQ ID NO: 2287926 - RNA, 13 nt, Human
cccauccuacccu

SEQ ID NO: 2287927 - RNA, 14 nt, Human
cccauccuacccuc

SEQ ID NO: 2287928 - RNA, 18 nt, Human
cccauccuggcccaucag

SEQ ID NO: 2287929 - RNA, 14 nt, Human
cccauccuggccca

SEQ ID NO: 2287930 - RNA, 15 nt, Human
cccauccuggcccau

SEQ ID NO: 2287931 - RNA, 16 nt, Human
cccauccuggcccauc

SEQ ID NO: 2287932 - RNA, 17 nt, Human
cccauccuggcccauca

SEQ ID NO: 2287933 - RNA, 12 nt, Human
cccaucccugcc

SEQ ID NO: 2287934 - RNA, 13 nt, Human
cccaucccugccu

SEQ ID NO: 2287935 - RNA, 14 nt, Human
cccaucccugccug

SEQ ID NO: 2287936 - RNA, 15 nt, Human
cccaucccuccccag

SEQ ID NO: 2287937 - RNA, 16 nt, Human
cccaucccuccccagu

SEQ ID NO: 2287938 - RNA, 15 nt, Human
cccaucccugccugg

SEQ ID NO: 2287939 - RNA, 17 nt, Human
cccaucccugccugguc

SEQ ID NO: 2287940 - RNA, 18 nt, Human
cccaucccugccugguca

SEQ ID NO: 2287941 - RNA, 17 nt, Human
cccauccuaccaaugca

SEQ ID NO: 2287942 - RNA, 19 nt, Human
cccauccuaccaaugcaug

SEQ ID NO: 2287943 - RNA, 20 nt, Human
cccauccuaccaaugcaugc

SEQ ID NO: 2287944 - RNA, 21 nt, Human
cccauccuaccaaugcaugca

SEQ ID NO: 2287945 - RNA, 21 nt, Human
cccauccucuguacagagccc

SEQ ID NO: 2287946 - RNA, 22 nt, Human
cccauccucuguacagagccca

SEQ ID NO: 2287947 - RNA, 21 nt, Human
cccacugggguccagggagca

SEQ ID NO: 2287948 - RNA, 21 nt, Human
cccacuggggaaauaacagcu

SEQ ID NO: 2287949 - RNA, 15 nt, Human
cccacuggcagcauc

SEQ ID NO: 2287950 - RNA, 16 nt, Human
cccacuggacucaccu

SEQ ID NO: 2287951 - RNA, 16 nt, Human
cccacugcacccccuc

SEQ ID NO: 2287952 - RNA, 17 nt, Human
cccacugcacccccucc

SEQ ID NO: 2287953 - RNA, 18 nt, Human
cccagcacagcuugaccu

SEQ ID NO: 2287954 - RNA, 19 nt, Human
cccagcacagcuugaccug

SEQ ID NO: 2287955 - RNA, 21 nt, Human
cccagccaggccccaggcagg

SEQ ID NO: 2287956 - RNA, 17 nt, Human
cccagcacuaaagcagu

SEQ ID NO: 2287957 - RNA, 13 nt, Human
cccagcacugagg

SEQ ID NO: 2287958 - RNA, 14 nt, Human
cccagcacugagga

SEQ ID NO: 2287959 - RNA, 16 nt, Human
cccagcacuaaagcag

SEQ ID NO: 2287960 - RNA, 22 nt, Human
cccagcacccgggcucagggac

SEQ ID NO: 2287961 - RNA, 21 nt, Human
cccagcacccgggcucaggga

SEQ ID NO: 2287962 - RNA, 15 nt, Human
cccagcacccagcaa

SEQ ID NO: 2287963 - RNA, 18 nt, Human
cccagcacaugaaaccuu

SEQ ID NO: 2287964 - RNA, 12 nt, Human
cccagcacccgg

SEQ ID NO: 2287965 - RNA, 19 nt, Human
cccagcacccgggcucagg

SEQ ID NO: 2287966 - RNA, 13 nt, Human
cccagcacccagc

SEQ ID NO: 2287967 - RNA, 15 nt, Human
cccagcugcuugugu

SEQ ID NO: 2287968 - RNA, 21 nt, Human
cccagcugcuccccucccucc

SEQ ID NO: 2287969 - RNA, 15 nt, Human
cccagcugcuccccu

SEQ ID NO: 2287970 - RNA, 18 nt, Human
cccagccauuaccaugga

SEQ ID NO: 2287971 - RNA, 22 nt, Human
cccagccaucugcccaggggug

SEQ ID NO: 2287972 - RNA, 14 nt, Human
cccagcugcucccc

SEQ ID NO: 2287973 - RNA, 10 nt, Human
cccagccauu

SEQ ID NO: 2287974 - RNA, 23 nt, Human
cccagccaucugcccaggggugc

SEQ ID NO: 2287975 - RNA, 13 nt, Human
cccagccaucugc

SEQ ID NO: 2287976 - RNA, 15 nt, Human
cccagccaucugccc

SEQ ID NO: 2287977 - RNA, 16 nt, Human
cccagccaucugccca

SEQ ID NO: 2287978 - RNA, 17 nt, Human
cccagccaucugcccag

SEQ ID NO: 2287979 - RNA, 18 nt, Human
cccagccaucugcccagg

SEQ ID NO: 2287980 - RNA, 20 nt, Human
cccagccaucugcccagggg

SEQ ID NO: 2287981 - RNA, 21 nt, Human
cccagccaucugcccaggggu

SEQ ID NO: 2287982 - RNA, 15 nt, Human
cccaggaaaggcucc

SEQ ID NO: 2287983 - RNA, 16 nt, Human
cccaggaaaggcucca

SEQ ID NO: 2287984 - RNA, 11 nt, Human
cccagcuggcc

SEQ ID NO: 2287985 - RNA, 20 nt, Human
cccagcuggcccgugacaga

SEQ ID NO: 2287986 - RNA, 11 nt, Human
cccagcuggga

SEQ ID NO: 2287987 - RNA, 12 nt, Human
cccagcugggag

SEQ ID NO: 2287988 - RNA, 13 nt, Human
cccagcugggagg

SEQ ID NO: 2287989 - RNA, 14 nt, Human
cccagcugggaggc

SEQ ID NO: 2287990 - RNA, 15 nt, Human
cccagcugggaggca

SEQ ID NO: 2287991 - RNA, 17 nt, Human
cccagcugggaggcaag

SEQ ID NO: 2287992 - RNA, 18 nt, Human
cccagcugggaggcaaga

SEQ ID NO: 2287993 - RNA, 20 nt, Human
cccagcugggaggcaagagg

SEQ ID NO: 2287994 - RNA, 21 nt, Human
cccagcugggaggcaagaggg

SEQ ID NO: 2287995 - RNA, 22 nt, Human
cccagcugggaggcaagagggg

SEQ ID NO: 2287996 - RNA, 12 nt, Human
cccagcugggcu

SEQ ID NO: 2287997 - RNA, 13 nt, Human
cccagcugggcuc

SEQ ID NO: 2287998 - RNA, 14 nt, Human
cccagcugggcucu

SEQ ID NO: 2287999 - RNA, 17 nt, Human
cccagcugggcucugcc

SEQ ID NO: 2288000 - RNA, 15 nt, Human
cccagggaaguuuug

SEQ ID NO: 2288001 - RNA, 13 nt, Human
cccagggaagugc

SEQ ID NO: 2288002 - RNA, 14 nt, Human
cccagggacaccag

SEQ ID NO: 2288003 - RNA, 15 nt, Human
cccagggacaccagc

SEQ ID NO: 2288004 - RNA, 17 nt, Human
cccagggacaccagcca

SEQ ID NO: 2288005 - RNA, 18 nt, Human
cccagggacaccagccag

SEQ ID NO: 2288006 - RNA, 18 nt, Human
cccagggagaggccauga

SEQ ID NO: 2288007 - RNA, 14 nt, Human
cccagggagaggcc

SEQ ID NO: 2288008 - RNA, 17 nt, Human
cccagggaccgaaaagu

SEQ ID NO: 2288009 - RNA, 21 nt, Human
cccagggacaccagccaggcu

SEQ ID NO: 2288010 - RNA, 19 nt, Human
cccagggacaccagccagg

SEQ ID NO: 2288011 - RNA, 20 nt, Human
cccagggacaccagccaggc

SEQ ID NO: 2288012 - RNA, 22 nt, Human
cccaucacaggguugggcccag

SEQ ID NO: 2288013 - RNA, 21 nt, Human
cccaucacaggguugggccca

SEQ ID NO: 2288014 - RNA, 16 nt, Human
cccaucacgccugugc

SEQ ID NO: 2288015 - RNA, 15 nt, Human
cccagggagcggaaa

SEQ ID NO: 2288016 - RNA, 14 nt, Human
cccaucagaaggag

SEQ ID NO: 2288017 - RNA, 20 nt, Human
cccaucacuggagcaccagg

SEQ ID NO: 2288018 - RNA, 15 nt, Human
cccaucacuggagca

SEQ ID NO: 2288019 - RNA, 13 nt, Human
cccaucacuggag

SEQ ID NO: 2288020 - RNA, 18 nt, Human
cccaucagcuccagcugc

SEQ ID NO: 2288021 - RNA, 23 nt, Human
cccaucagugcucccucacaugu

SEQ ID NO: 2288022 - RNA, 13 nt, Human
cccaucaguguac

SEQ ID NO: 2288023 - RNA, 22 nt, Human
cccaucagugcucccucacaug

SEQ ID NO: 2288024 - RNA, 17 nt, Human
cccaucaggacucuugu

SEQ ID NO: 2288025 - RNA, 19 nt, Human
cccaucaggacucuuguga

SEQ ID NO: 2288026 - RNA, 16 nt, Human
cccauccccgcagugu

SEQ ID NO: 2288027 - RNA, 21 nt, Human
cccauccccuggacugggagg

SEQ ID NO: 2288028 - RNA, 16 nt, Human
cccaucccccugcccu

SEQ ID NO: 2288029 - RNA, 17 nt, Human
cccaucccccugcccuc

SEQ ID NO: 2288030 - RNA, 22 nt, Human
cccauccccccucaccaggggc

SEQ ID NO: 2288031 - RNA, 12 nt, Human
cccaucccccug

SEQ ID NO: 2288032 - RNA, 14 nt, Human
cccaucccccugcc

SEQ ID NO: 2288033 - RNA, 15 nt, Human
cccaucccccugccc

SEQ ID NO: 2288034 - RNA, 20 nt, Human
cccaucaguguacccccgcc

SEQ ID NO: 2288035 - RNA, 21 nt, Human
cccaucaguguacccccgccc

SEQ ID NO: 2288036 - RNA, 23 nt, Human
cccaucaguguacccccgcccag

SEQ ID NO: 2288037 - RNA, 17 nt, Human
cccaucauacacuuccu

SEQ ID NO: 2288038 - RNA, 12 nt, Human
cccauccccccu

SEQ ID NO: 2288039 - RNA, 14 nt, Human
cccauccccccuca

SEQ ID NO: 2288040 - RNA, 15 nt, Human
cccauccccccucac

SEQ ID NO: 2288041 - RNA, 16 nt, Human
cccauccccccucacc

SEQ ID NO: 2288042 - RNA, 20 nt, Human
cccauccccccucaccaggg

SEQ ID NO: 2288043 - RNA, 20 nt, Human
cccaggcuggagugcaauga

SEQ ID NO: 2288044 - RNA, 22 nt, Human
cccaggcuuagucacugagaca

SEQ ID NO: 2288045 - RNA, 13 nt, Human
cccaggcuggagu

SEQ ID NO: 2288046 - RNA, 18 nt, Human
cccaggcugagccucagu

SEQ ID NO: 2288047 - RNA, 24 nt, Human
cccagcugggcucugccacccuac

SEQ ID NO: 2288048 - RNA, 17 nt, Human
cccaggcugagccucag

SEQ ID NO: 2288049 - RNA, 16 nt, Human
cccaggcugagccuca

SEQ ID NO: 2288050 - RNA, 15 nt, Human
cccaggcugagccuc

SEQ ID NO: 2288051 - RNA, 18 nt, Human
cccagcugggcucugcca

SEQ ID NO: 2288052 - RNA, 19 nt, Human
cccagcugggcucugccac

SEQ ID NO: 2288053 - RNA, 20 nt, Human
cccagcugggcucugccacc

SEQ ID NO: 2288054 - RNA, 22 nt, Human
cccagcugggcucugccacccu

SEQ ID NO: 2288055 - RNA, 17 nt, Human
cccaggaaaggcuccag

SEQ ID NO: 2288056 - RNA, 18 nt, Human
cccaggaaaggcuccagg

SEQ ID NO: 2288057 - RNA, 12 nt, Human
ccccgcagaccu

SEQ ID NO: 2288058 - RNA, 13 nt, Human
ccccgcagaccuc

SEQ ID NO: 2288059 - RNA, 14 nt, Human
ccccgcagaccucc

SEQ ID NO: 2288060 - RNA, 17 nt, Human
ccccgcagaccucccca

SEQ ID NO: 2288061 - RNA, 19 nt, Human
ccccgcagaccuccccagc

SEQ ID NO: 2288062 - RNA, 14 nt, Human
ccccgcagacaccu

SEQ ID NO: 2288063 - RNA, 21 nt, Human
ccccgaguuuccccagacacc

SEQ ID NO: 2288064 - RNA, 14 nt, Human
ccccgcacugggcu

SEQ ID NO: 2288065 - RNA, 21 nt, Human
ccccgagggaugaugccacac

SEQ ID NO: 2288066 - RNA, 22 nt, Human
ccccgagggaugaugccacacc

SEQ ID NO: 2288067 - RNA, 18 nt, Human
cccccuuugugcuguggg

SEQ ID NO: 2288068 - RNA, 18 nt, Human
ccccgagggaugaugcca

SEQ ID NO: 2288069 - RNA, 19 nt, Human
ccccgagggaugaugccac

SEQ ID NO: 2288070 - RNA, 20 nt, Human
ccccgagggaugaugccaca

SEQ ID NO: 2288071 - RNA, 18 nt, Human
cccccuugccagacaugu

SEQ ID NO: 2288072 - RNA, 14 nt, Human
cccccuugaguggg

SEQ ID NO: 2288073 - RNA, 15 nt, Human
cccccuugccacccc

SEQ ID NO: 2288074 - RNA, 17 nt, Human
cccccuuucagaugucu

SEQ ID NO: 2288075 - RNA, 18 nt, Human
cccccuuucagaugucuu

SEQ ID NO: 2288076 - RNA, 12 nt, Human
cccccuuuccug

SEQ ID NO: 2288077 - RNA, 22 nt, Human
cccccuuucagaugucuucugc

SEQ ID NO: 2288078 - RNA, 20 nt, Human
cccccuuuccuggacacuca

SEQ ID NO: 2288079 - RNA, 16 nt, Human
cccccuuugggcccag

SEQ ID NO: 2288080 - RNA, 17 nt, Human
cccccuuugggcccagg

SEQ ID NO: 2288081 - RNA, 18 nt, Human
cccccuuugggcccaggg

SEQ ID NO: 2288082 - RNA, 19 nt, Human
cccccuuugggcccaggga

SEQ ID NO: 2288083 - RNA, 20 nt, Human
cccccuuugggcccagggac

SEQ ID NO: 2288084 - RNA, 14 nt, Human
cccccuuugugcug

SEQ ID NO: 2288085 - RNA, 16 nt, Human
cccccuuugugcugug

SEQ ID NO: 2288086 - RNA, 17 nt, Human
cccccuuugugcugugg

SEQ ID NO: 2288087 - RNA, 17 nt, Human
ccccaugccuguccagc

SEQ ID NO: 2288088 - RNA, 15 nt, Human
ccccaugccugucca

SEQ ID NO: 2288089 - RNA, 13 nt, Human
ccccaugccuguc

SEQ ID NO: 2288090 - RNA, 21 nt, Human
ccccagcccaggguuccccca

SEQ ID NO: 2288091 - RNA, 12 nt, Human
ccccaugccugu

SEQ ID NO: 2288092 - RNA, 20 nt, Human
ccccagcccagggcuccugc

SEQ ID NO: 2288093 - RNA, 21 nt, Human
ccccagcccagggcuccugca

SEQ ID NO: 2288094 - RNA, 13 nt, Human
ccccagcccaggg

SEQ ID NO: 2288095 - RNA, 12 nt, Human
ccccagcccagg

SEQ ID NO: 2288096 - RNA, 14 nt, Human
ccccagcccagggc

SEQ ID NO: 2288097 - RNA, 15 nt, Human
ccccagcccagggcu

SEQ ID NO: 2288098 - RNA, 16 nt, Human
ccccagcccagagaca

SEQ ID NO: 2288099 - RNA, 15 nt, Human
ccccagcccagagac

SEQ ID NO: 2288100 - RNA, 13 nt, Human
ccccagcccagag

SEQ ID NO: 2288101 - RNA, 12 nt, Human
ccccagcccaga

SEQ ID NO: 2288102 - RNA, 15 nt, Human
ccccagauugcaaca

SEQ ID NO: 2288103 - RNA, 22 nt, Human
ccccagagugugggaagggaga

SEQ ID NO: 2288104 - RNA, 15 nt, Human
ccccagauaccagcc

SEQ ID NO: 2288105 - RNA, 18 nt, Human
ccccagaucaccagcccg

SEQ ID NO: 2288106 - RNA, 17 nt, Human
ccccagaggcuggguga

SEQ ID NO: 2288107 - RNA, 11 nt, Human
ccccagcccag

SEQ ID NO: 2288108 - RNA, 20 nt, Human
ccccagcccacccuccuguc

SEQ ID NO: 2288109 - RNA, 22 nt, Human
ccccagcccacccuccugucuu

SEQ ID NO: 2288110 - RNA, 16 nt, Human
ccccagcccacccucc

SEQ ID NO: 2288111 - RNA, 18 nt, Human
ccccagauaccagccccu

SEQ ID NO: 2288112 - RNA, 19 nt, Human
ccccagcccacccuccugu

SEQ ID NO: 2288113 - RNA, 20 nt, Human
ccccagauugcaacaggcug

SEQ ID NO: 2288114 - RNA, 24 nt, Human
ccccaugccuguccagccugggca

SEQ ID NO: 2288115 - RNA, 15 nt, Human
ccccagcccagggug

SEQ ID NO: 2288116 - RNA, 12 nt, Human
ccccaugcugga

SEQ ID NO: 2288117 - RNA, 23 nt, Human
ccccaugccuguccagccugggc

SEQ ID NO: 2288118 - RNA, 22 nt, Human
ccccaugccuguccagccuggg

SEQ ID NO: 2288119 - RNA, 21 nt, Human
ccccaugccuguccagccugg

SEQ ID NO: 2288120 - RNA, 20 nt, Human
ccccaugccuguccagccug

SEQ ID NO: 2288121 - RNA, 19 nt, Human
ccccaugccuguccagccu

SEQ ID NO: 2288122 - RNA, 18 nt, Human
ccccaugccuguccagcc

SEQ ID NO: 2288123 - RNA, 14 nt, Human
ccccaugcuguuga

SEQ ID NO: 2288124 - RNA, 22 nt, Human
ccccaugcuggagccuguguaa

SEQ ID NO: 2288125 - RNA, 23 nt, Human
ccccaugcuggagccuguguaac

SEQ ID NO: 2288126 - RNA, 15 nt, Human
ccccaugcuggaggu

SEQ ID NO: 2288127 - RNA, 14 nt, Human
ccccaugcuggagc

SEQ ID NO: 2288128 - RNA, 15 nt, Human
ccccaugcuggagcc

SEQ ID NO: 2288129 - RNA, 16 nt, Human
ccccaugcuggagccu

SEQ ID NO: 2288130 - RNA, 17 nt, Human
ccccaugcuggagccug

SEQ ID NO: 2288131 - RNA, 18 nt, Human
ccccaugcuggagccugu

SEQ ID NO: 2288132 - RNA, 19 nt, Human
ccccaugcuggagccugug

SEQ ID NO: 2288133 - RNA, 20 nt, Human
ccccaugcuggagccugugu

SEQ ID NO: 2288134 - RNA, 21 nt, Human
ccccaugcuggagccugugua

SEQ ID NO: 2288135 - RNA, 17 nt, Human
ccccauuagagucagcc

SEQ ID NO: 2288136 - RNA, 18 nt, Human
ccccauguguccugguuc

SEQ ID NO: 2288137 - RNA, 23 nt, Human
ccccauguguccugguucccguu

SEQ ID NO: 2288138 - RNA, 17 nt, Human
ccccauuagcuuucaau

SEQ ID NO: 2288139 - RNA, 23 nt, Human
ccccauuagcuuucaauuccgua

SEQ ID NO: 2288140 - RNA, 12 nt, Human
cccccuucuggg

SEQ ID NO: 2288141 - RNA, 14 nt, Human
cccccuucugggca

SEQ ID NO: 2288142 - RNA, 22 nt, Human
cccccuucugggcaucuguucu

SEQ ID NO: 2288143 - RNA, 23 nt, Human
cccccuucugggcaucuguucug

SEQ ID NO: 2288144 - RNA, 17 nt, Human
ccccaugucucucagaa

SEQ ID NO: 2288145 - RNA, 15 nt, Human
ccccaugucucucag

SEQ ID NO: 2288146 - RNA, 14 nt, Human
ccccauguguccug

SEQ ID NO: 2288147 - RNA, 16 nt, Human
ccccauguguccuggu

SEQ ID NO: 2288148 - RNA, 22 nt, Human
ccccaugggaagacgaggcccu

SEQ ID NO: 2288149 - RNA, 19 nt, Human
ccccauggucagcccuagg

SEQ ID NO: 2288150 - RNA, 12 nt, Human
cccauuuugcaa

SEQ ID NO: 2288151 - RNA, 18 nt, Human
cccauuuugagugacucg

SEQ ID NO: 2288152 - RNA, 17 nt, Human
cccauuuugagugacuc

SEQ ID NO: 2288153 - RNA, 14 nt, Human
cccauuuuagucac

SEQ ID NO: 2288154 - RNA, 18 nt, Human
cccauuuuagucacuuuu

SEQ ID NO: 2288155 - RNA, 20 nt, Human
cccauuuuagucacuuuuuu

SEQ ID NO: 2288156 - RNA, 14 nt, Human
cccauuuucugugg

SEQ ID NO: 2288157 - RNA, 20 nt, Human
cccauuuuuauaucgaucuc

SEQ ID NO: 2288158 - RNA, 22 nt, Human
cccauuuugcaaaauuuccagu

SEQ ID NO: 2288159 - RNA, 19 nt, Human
cccauuuugcaaaauuucc

SEQ ID NO: 2288160 - RNA, 22 nt, Human
cccauuuuggaaguuuucagga

SEQ ID NO: 2288161 - RNA, 13 nt, Human
ccccagaggcugg

SEQ ID NO: 2288162 - RNA, 15 nt, Human
cccauuugcuccuuu

SEQ ID NO: 2288163 - RNA, 19 nt, Human
cccauucugccugcccagg

SEQ ID NO: 2288164 - RNA, 20 nt, Human
cccauuucuauuuauuuacu

SEQ ID NO: 2288165 - RNA, 15 nt, Human
cccauuucucacuga

SEQ ID NO: 2288166 - RNA, 14 nt, Human
cccauucugccugc

SEQ ID NO: 2288167 - RNA, 15 nt, Human
cccauucugccugcc

SEQ ID NO: 2288168 - RNA, 22 nt, Human
cacagggacugaaaaccucucc

SEQ ID NO: 2288169 - RNA, 14 nt, Human
cacagggacuugaa

SEQ ID NO: 2288170 - RNA, 16 nt, Human
cacagggacuugaagu

SEQ ID NO: 2288171 - RNA, 17 nt, Human
cacagggacuugaaguu

SEQ ID NO: 2288172 - RNA, 21 nt, Human
cacagggacuugaaguuguua

SEQ ID NO: 2288173 - RNA, 19 nt, Human
cacagaaaccucuacuaaa

SEQ ID NO: 2288174 - RNA, 20 nt, Human
cacagaaaauauacuguaaa

SEQ ID NO: 2288175 - RNA, 15 nt, Human
cacagaaagacugag

SEQ ID NO: 2288176 - RNA, 12 nt, Human
cacagaaaccuu

SEQ ID NO: 2288177 - RNA, 19 nt, Human
cacagaaaauauacuguaa

SEQ ID NO: 2288178 - RNA, 18 nt, Human
cacagaaaauauacugua

SEQ ID NO: 2288179 - RNA, 17 nt, Human
cacagaaaauauacugu

SEQ ID NO: 2288180 - RNA, 16 nt, Human
cacagaaaauauacug

SEQ ID NO: 2288181 - RNA, 12 nt, Human
cacagaaagccu

SEQ ID NO: 2288182 - RNA, 22 nt, Human
cacagaaagacugagcucaagg

SEQ ID NO: 2288183 - RNA, 18 nt, Human
cacagaaagacugagcuc

SEQ ID NO: 2288184 - RNA, 23 nt, Human
cacagaaagccuaucaaagaccu

SEQ ID NO: 2288185 - RNA, 13 nt, Human
cacagaacccuug

SEQ ID NO: 2288186 - RNA, 17 nt, Human
cacacuuuuuaagaaau

SEQ ID NO: 2288187 - RNA, 15 nt, Human
cacagaaaauauacu

SEQ ID NO: 2288188 - RNA, 14 nt, Human
cacagaaaauauac

SEQ ID NO: 2288189 - RNA, 13 nt, Human
cacagaaaauaua

SEQ ID NO: 2288190 - RNA, 12 nt, Human
cacagaaaauau

SEQ ID NO: 2288191 - RNA, 20 nt, Human
cacacuuguuccagcucuuu

SEQ ID NO: 2288192 - RNA, 19 nt, Human
cacacuuguuccagcucuu

SEQ ID NO: 2288193 - RNA, 18 nt, Human
cacacuuguuccagcucu

SEQ ID NO: 2288194 - RNA, 18 nt, Human
cacacauuuguguaaaca

SEQ ID NO: 2288195 - RNA, 18 nt, Human
cacaccaagcagcaacag

SEQ ID NO: 2288196 - RNA, 16 nt, Human
cacaccaagcugugcc

SEQ ID NO: 2288197 - RNA, 17 nt, Human
cacaccaagcugugcca

SEQ ID NO: 2288198 - RNA, 18 nt, Human
cacaccaagcugugccac

SEQ ID NO: 2288199 - RNA, 20 nt, Human
cacaccaagcugugccaccc

SEQ ID NO: 2288200 - RNA, 22 nt, Human
cacaccaagcugugccacccug

SEQ ID NO: 2288201 - RNA, 23 nt, Human
cacaccaagcugugccacccugg

SEQ ID NO: 2288202 - RNA, 18 nt, Human
cacacauggcuaauuuuu

SEQ ID NO: 2288203 - RNA, 11 nt, Human
cacacauuuuu

SEQ ID NO: 2288204 - RNA, 10 nt, Human
cacacauuuu

SEQ ID NO: 2288205 - RNA, 20 nt, Human
cacacauuuuuuaaaugcac

SEQ ID NO: 2288206 - RNA, 19 nt, Human
cacacauuuuuuaaaugca

SEQ ID NO: 2288207 - RNA, 16 nt, Human
cacacauuuuuuaaau

SEQ ID NO: 2288208 - RNA, 12 nt, Human
cacacauuuuuu

SEQ ID NO: 2288209 - RNA, 17 nt, Human
cacagcucuucuccagg

SEQ ID NO: 2288210 - RNA, 21 nt, Human
cacagcucuccggucucucuc

SEQ ID NO: 2288211 - RNA, 20 nt, Human
cacagcucuccggucucucu

SEQ ID NO: 2288212 - RNA, 14 nt, Human
cacagcucuucucc

SEQ ID NO: 2288213 - RNA, 15 nt, Human
cacagcucuucucca

SEQ ID NO: 2288214 - RNA, 15 nt, Human
cacagcucuguccug

SEQ ID NO: 2288215 - RNA, 16 nt, Human
cacagcucuguccugg

SEQ ID NO: 2288216 - RNA, 18 nt, Human
cacagcucuguccuggga

SEQ ID NO: 2288217 - RNA, 19 nt, Human
cacagcucuguccugggag

SEQ ID NO: 2288218 - RNA, 11 nt, Human
cacagcucugu

SEQ ID NO: 2288219 - RNA, 14 nt, Human
cacagcucuguccu

SEQ ID NO: 2288220 - RNA, 22 nt, Human
cacagaaaugagaucaggcucu

SEQ ID NO: 2288221 - RNA, 10 nt, Human
cacagcuccu

SEQ ID NO: 2288222 - RNA, 15 nt, Human
cacagcuccucccac

SEQ ID NO: 2288223 - RNA, 18 nt, Human
cacagacccugcccugug

SEQ ID NO: 2288224 - RNA, 19 nt, Human
cacagaagaggcugguucu

SEQ ID NO: 2288225 - RNA, 18 nt, Human
cacagaaagccuaucaaa

SEQ ID NO: 2288226 - RNA, 17 nt, Human
cacagaaaugagaucag

SEQ ID NO: 2288227 - RNA, 14 nt, Human
cacagacccugccc

SEQ ID NO: 2288228 - RNA, 16 nt, Human
cacagacccugcccug

SEQ ID NO: 2288229 - RNA, 17 nt, Human
cacagacccugcccugu

SEQ ID NO: 2288230 - RNA, 20 nt, Human
caccaggcuugccugcaggc

SEQ ID NO: 2288231 - RNA, 13 nt, Human
caccagggaaggg

SEQ ID NO: 2288232 - RNA, 21 nt, Human
caccagggaaggggacaagga

SEQ ID NO: 2288233 - RNA, 18 nt, Human
caccagggaaggggacaa

SEQ ID NO: 2288234 - RNA, 18 nt, Human
caccaggcugugggccuc

SEQ ID NO: 2288235 - RNA, 16 nt, Human
caccagggaugguacu

SEQ ID NO: 2288236 - RNA, 17 nt, Human
cacccaccucagccucc

SEQ ID NO: 2288237 - RNA, 13 nt, Human
caccagccccagu

SEQ ID NO: 2288238 - RNA, 20 nt, Human
caccagccaggcucugugcu

SEQ ID NO: 2288239 - RNA, 21 nt, Human
caccagccaggcucugugcug

SEQ ID NO: 2288240 - RNA, 17 nt, Human
caccaggcugugggccu

SEQ ID NO: 2288241 - RNA, 16 nt, Human
caccaggcugugggcc

SEQ ID NO: 2288242 - RNA, 15 nt, Human
caccaggcugugggc

SEQ ID NO: 2288243 - RNA, 16 nt, Human
caccagccccagugcc

SEQ ID NO: 2288244 - RNA, 23 nt, Human
cacccagcccauucucucuccug

SEQ ID NO: 2288245 - RNA, 23 nt, Human
cacccaccucccugccuccagga

SEQ ID NO: 2288246 - RNA, 15 nt, Human
cacccacucagcucc

SEQ ID NO: 2288247 - RNA, 22 nt, Human
cacccagcccauucucucuccu

SEQ ID NO: 2288248 - RNA, 14 nt, Human
cacccacucagcuc

SEQ ID NO: 2288249 - RNA, 13 nt, Human
cacccacucagcu

SEQ ID NO: 2288250 - RNA, 12 nt, Human
cacccagcccug

SEQ ID NO: 2288251 - RNA, 13 nt, Human
cacccagcccugg

SEQ ID NO: 2288252 - RNA, 14 nt, Human
cacccagcccuggu

SEQ ID NO: 2288253 - RNA, 16 nt, Human
cacccagcccuggucu

SEQ ID NO: 2288254 - RNA, 18 nt, Human
cacccagcccuggucuca

SEQ ID NO: 2288255 - RNA, 19 nt, Human
cacccagcccuggucucag

SEQ ID NO: 2288256 - RNA, 22 nt, Human
cacccagcccuggucucagcag

SEQ ID NO: 2288257 - RNA, 18 nt, Human
cacccaccucagccuccc

SEQ ID NO: 2288258 - RNA, 21 nt, Human
cacccaccucccugccuccag

SEQ ID NO: 2288259 - RNA, 18 nt, Human
cacccaccucccugccuc

SEQ ID NO: 2288260 - RNA, 16 nt, Human
cacccaccucccugcc

SEQ ID NO: 2288261 - RNA, 15 nt, Human
cacccaccucccugc

SEQ ID NO: 2288262 - RNA, 14 nt, Human
cacccaccucccug

SEQ ID NO: 2288263 - RNA, 13 nt, Human
cacccaccucccu

SEQ ID NO: 2288264 - RNA, 16 nt, Human
cacccaggagccccga

SEQ ID NO: 2288265 - RNA, 22 nt, Human
cacccagccucaguccuccccu

SEQ ID NO: 2288266 - RNA, 15 nt, Human
cacccagccucaguc

SEQ ID NO: 2288267 - RNA, 19 nt, Human
cacccagccucaguccucc

SEQ ID NO: 2288268 - RNA, 11 nt, Human
cacccagccuc

SEQ ID NO: 2288269 - RNA, 12 nt, Human
cacccagccuca

SEQ ID NO: 2288270 - RNA, 13 nt, Human
cacccagccucag

SEQ ID NO: 2288271 - RNA, 14 nt, Human
cacccagccucagu

SEQ ID NO: 2288272 - RNA, 22 nt, Human
cacccaugaagacaggacagug

SEQ ID NO: 2288273 - RNA, 14 nt, Human
cacccagcucagca

SEQ ID NO: 2288274 - RNA, 19 nt, Human
cacccaugaaucaaagaca

SEQ ID NO: 2288275 - RNA, 15 nt, Human
cacccaugaaucaaa

SEQ ID NO: 2288276 - RNA, 13 nt, Human
cacccaugggcuc

SEQ ID NO: 2288277 - RNA, 18 nt, Human
cacccaugggcucugaca

SEQ ID NO: 2288278 - RNA, 19 nt, Human
cacccaugggcucugacag

SEQ ID NO: 2288279 - RNA, 20 nt, Human
cacccaugggcucugacaga

SEQ ID NO: 2288280 - RNA, 12 nt, Human
caccccacacuu

SEQ ID NO: 2288281 - RNA, 11 nt, Human
caccccacacu

SEQ ID NO: 2288282 - RNA, 13 nt, Human
caccccacccccu

SEQ ID NO: 2288283 - RNA, 18 nt, Human
caccccaaagcuuuccug

SEQ ID NO: 2288284 - RNA, 13 nt, Human
cacccaugugcca

SEQ ID NO: 2288285 - RNA, 17 nt, Human
cacccauguuucucugg

SEQ ID NO: 2288286 - RNA, 18 nt, Human
cacccauguuucucuggc

SEQ ID NO: 2288287 - RNA, 15 nt, Human
cacccauuuucacau

SEQ ID NO: 2288288 - RNA, 19 nt, Human
caccccaaagcuuuccugc

SEQ ID NO: 2288289 - RNA, 23 nt, Human
caccaacaucccauugcccuggu

SEQ ID NO: 2288290 - RNA, 13 nt, Human
caccaacccagcc

SEQ ID NO: 2288291 - RNA, 14 nt, Human
caccaacccagccg

SEQ ID NO: 2288292 - RNA, 17 nt, Human
caccaacccagccgcug

SEQ ID NO: 2288293 - RNA, 13 nt, Human
caccaacccucag

SEQ ID NO: 2288294 - RNA, 14 nt, Human
caccaacgucugug

SEQ ID NO: 2288295 - RNA, 14 nt, Human
caccagccaggcuc

SEQ ID NO: 2288296 - RNA, 15 nt, Human
caccagccaggcucu

SEQ ID NO: 2288297 - RNA, 16 nt, Human
caccagccaggcucug

SEQ ID NO: 2288298 - RNA, 18 nt, Human
caccagccaggcucugug

SEQ ID NO: 2288299 - RNA, 19 nt, Human
caccagccaggcucugugc

SEQ ID NO: 2288300 - RNA, 19 nt, Human
caccaacccaucagaagga

SEQ ID NO: 2288301 - RNA, 20 nt, Human
caccaacccagccgcugccc

SEQ ID NO: 2288302 - RNA, 21 nt, Human
caccaacccagccgcugcccg

SEQ ID NO: 2288303 - RNA, 16 nt, Human
caccaacgucugugcc

SEQ ID NO: 2288304 - RNA, 22 nt, Human
caccaacaucccauugcccugg

SEQ ID NO: 2288305 - RNA, 17 nt, Human
caccaacaucccauugc

SEQ ID NO: 2288306 - RNA, 15 nt, Human
caccaacaccacggu

SEQ ID NO: 2288307 - RNA, 19 nt, Human
caccaaaauaagaaaagau

SEQ ID NO: 2288308 - RNA, 18 nt, Human
caccaaaauaagaaaaga

SEQ ID NO: 2288309 - RNA, 13 nt, Human
cacaucugccuua

SEQ ID NO: 2288310 - RNA, 16 nt, Human
caccaaacauacuaga

SEQ ID NO: 2288311 - RNA, 13 nt, Human
caccaaaggccag

SEQ ID NO: 2288312 - RNA, 15 nt, Human
caccaaaguauuuuu

SEQ ID NO: 2288313 - RNA, 12 nt, Human
cacaucuucccu

SEQ ID NO: 2288314 - RNA, 17 nt, Human
caccaaaauaagaaaag

SEQ ID NO: 2288315 - RNA, 12 nt, Human
caccaaaauaag

SEQ ID NO: 2288316 - RNA, 21 nt, Human
cacauuuuauuuuauuaugca

SEQ ID NO: 2288317 - RNA, 20 nt, Human
cacauuuuauuuuauuaugc

SEQ ID NO: 2288318 - RNA, 19 nt, Human
cacauuuuauuuuauuaug

SEQ ID NO: 2288319 - RNA, 22 nt, Human
cacaucuccuccauacucagga

SEQ ID NO: 2288320 - RNA, 13 nt, Human
cacaucucuaucu

SEQ ID NO: 2288321 - RNA, 21 nt, Human
cacaucugcauuuucacccca

SEQ ID NO: 2288322 - RNA, 13 nt, Human
cacaucugcauuu

SEQ ID NO: 2288323 - RNA, 11 nt, Human
cacaucucugc

SEQ ID NO: 2288324 - RNA, 12 nt, Human
cacaucugccuu

SEQ ID NO: 2288325 - RNA, 12 nt, Human
cacaucuguguc

SEQ ID NO: 2288326 - RNA, 17 nt, Human
cacauuuuauuuuauua

SEQ ID NO: 2288327 - RNA, 23 nt, Human
cacaucugugucuuguuuggaau

SEQ ID NO: 2288328 - RNA, 18 nt, Human
cacaucugugucuuguuu

SEQ ID NO: 2288329 - RNA, 17 nt, Human
cacaucugugucuuguu

SEQ ID NO: 2288330 - RNA, 16 nt, Human
cacaucugugucuugu

SEQ ID NO: 2288331 - RNA, 22 nt, Human
cacaucuaagccugaaggggcg

SEQ ID NO: 2288332 - RNA, 15 nt, Human
caaucaucuguguga

SEQ ID NO: 2288333 - RNA, 22 nt, Human
caaucaguccccucccaucugg

SEQ ID NO: 2288334 - RNA, 17 nt, Human
caaucaugaaauaugca

SEQ ID NO: 2288335 - RNA, 17 nt, Human
caaucaucugugugaaa

SEQ ID NO: 2288336 - RNA, 19 nt, Human
caaucaucugugugaaaau

SEQ ID NO: 2288337 - RNA, 20 nt, Human
caaucaucugugugaaaaug

SEQ ID NO: 2288338 - RNA, 15 nt, Human
caaucauugcugaaa

SEQ ID NO: 2288339 - RNA, 16 nt, Human
caaucauugcugaaaa

SEQ ID NO: 2288340 - RNA, 18 nt, Human
caaucauugcugaaaaug

SEQ ID NO: 2288341 - RNA, 21 nt, Human
caaucauugcugaaaauggua

SEQ ID NO: 2288342 - RNA, 13 nt, Human
caaucauuguaca

SEQ ID NO: 2288343 - RNA, 14 nt, Human
caaucauuguacag

SEQ ID NO: 2288344 - RNA, 15 nt, Human
caaucauuguacagu

SEQ ID NO: 2288345 - RNA, 15 nt, Human
caaucaguauaauuc

SEQ ID NO: 2288346 - RNA, 16 nt, Human
caaucaguauaauucu

SEQ ID NO: 2288347 - RNA, 19 nt, Human
caaucaguauaauucugua

SEQ ID NO: 2288348 - RNA, 14 nt, Human
caaucaguccccuc

SEQ ID NO: 2288349 - RNA, 15 nt, Human
caaucaguccccucc

SEQ ID NO: 2288350 - RNA, 16 nt, Human
caaucaguccccuccc

SEQ ID NO: 2288351 - RNA, 17 nt, Human
caaucaguccccuccca

SEQ ID NO: 2288352 - RNA, 20 nt, Human
caaucaguccccucccaucu

SEQ ID NO: 2288353 - RNA, 21 nt, Human
caaucaguccccucccaucug

SEQ ID NO: 2288354 - RNA, 15 nt, Human
caauccaagagucug

SEQ ID NO: 2288355 - RNA, 15 nt, Human
caauccauguaaggu

SEQ ID NO: 2288356 - RNA, 22 nt, Human
caaucauuguacaguuuguuua

SEQ ID NO: 2288357 - RNA, 17 nt, Human
caaucauuuuaauuauu

SEQ ID NO: 2288358 - RNA, 20 nt, Human
caaucauuguacaguuuguu

SEQ ID NO: 2288359 - RNA, 21 nt, Human
caaucauuguacaguuuguuu

SEQ ID NO: 2288360 - RNA, 23 nt, Human
caaucauuguacaguuuguuuac

SEQ ID NO: 2288361 - RNA, 23 nt, Human
caauccauguuaguuuuuacuuu

SEQ ID NO: 2288362 - RNA, 21 nt, Human
caauccauguuaguuuuuacu

SEQ ID NO: 2288363 - RNA, 17 nt, Human
caauccauguaagguau

SEQ ID NO: 2288364 - RNA, 16 nt, Human
caaucccaccaacccu

SEQ ID NO: 2288365 - RNA, 17 nt, Human
caaucccaccaacccuc

SEQ ID NO: 2288366 - RNA, 22 nt, Human
caaucccaccaacccucagagc

SEQ ID NO: 2288367 - RNA, 17 nt, Human
caaucccagcuaccuca

SEQ ID NO: 2288368 - RNA, 12 nt, Human
caaucccagcua

SEQ ID NO: 2288369 - RNA, 23 nt, Human
caaucccaccaacccucagagcc

SEQ ID NO: 2288370 - RNA, 22 nt, Human
caauccccucauucaggaaaac

SEQ ID NO: 2288371 - RNA, 21 nt, Human
caauccccucauucaggaaaa

SEQ ID NO: 2288372 - RNA, 15 nt, Human
caauccccucauuca

SEQ ID NO: 2288373 - RNA, 22 nt, Human
caauccauguuaguuuuuacuu

SEQ ID NO: 2288374 - RNA, 12 nt, Human
caauccccuccu

SEQ ID NO: 2288375 - RNA, 14 nt, Human
caauccccuccuug

SEQ ID NO: 2288376 - RNA, 16 nt, Human
caauccccuccuuggg

SEQ ID NO: 2288377 - RNA, 20 nt, Human
caauccccuccuugggcacu

SEQ ID NO: 2288378 - RNA, 22 nt, Human
caauccuaacacauuaucggga

SEQ ID NO: 2288379 - RNA, 17 nt, Human
caauccuaacacauuau

SEQ ID NO: 2288380 - RNA, 20 nt, Human
caaucccuuuauuacccccu

SEQ ID NO: 2288381 - RNA, 13 nt, Human
caaugcuggcugu

SEQ ID NO: 2288382 - RNA, 20 nt, Human
caaugcuggcuguuggcugg

SEQ ID NO: 2288383 - RNA, 21 nt, Human
caaugcuggcuguuggcuggg

SEQ ID NO: 2288384 - RNA, 16 nt, Human
caauggcgcagugccu

SEQ ID NO: 2288385 - RNA, 18 nt, Human
caauggcgcagugccucu

SEQ ID NO: 2288386 - RNA, 19 nt, Human
caauccuaauuucuccucc

SEQ ID NO: 2288387 - RNA, 19 nt, Human
caauggcgcagugccucug

SEQ ID NO: 2288388 - RNA, 20 nt, Human
caauggcgcagugccucugg

SEQ ID NO: 2288389 - RNA, 21 nt, Human
caauggcgcagugccucuggu

SEQ ID NO: 2288390 - RNA, 16 nt, Human
caauggcuaauuccca

SEQ ID NO: 2288391 - RNA, 16 nt, Human
caauggcagccuuggc

SEQ ID NO: 2288392 - RNA, 20 nt, Human
caauccuaauuucuccuccc

SEQ ID NO: 2288393 - RNA, 22 nt, Human
caauggcuauauggcaagaaag

SEQ ID NO: 2288394 - RNA, 14 nt, Human
caauggcugcugaa

SEQ ID NO: 2288395 - RNA, 22 nt, Human
caauggcugcugaagcugccug

SEQ ID NO: 2288396 - RNA, 17 nt, Human
caauggcuaauucccag

SEQ ID NO: 2288397 - RNA, 18 nt, Human
caauggcuaauucccaga

SEQ ID NO: 2288398 - RNA, 19 nt, Human
caauggcuaauucccagag

SEQ ID NO: 2288399 - RNA, 23 nt, Human
caauggcuaauucccagagugug

SEQ ID NO: 2288400 - RNA, 15 nt, Human
caaugggagcucaug

SEQ ID NO: 2288401 - RNA, 18 nt, Human
caauggcuuacuccagga

SEQ ID NO: 2288402 - RNA, 15 nt, Human
caauggcuuuuuaaa

SEQ ID NO: 2288403 - RNA, 21 nt, Human
caaugggaaauacuacuccug

SEQ ID NO: 2288404 - RNA, 21 nt, Human
caauugaacuuaaauaaaugu

SEQ ID NO: 2288405 - RNA, 21 nt, Human
caauugaauuaaauuaggaau

SEQ ID NO: 2288406 - RNA, 15 nt, Human
caauugaauggucag

SEQ ID NO: 2288407 - RNA, 17 nt, Human
caauuuccaagagcuga

SEQ ID NO: 2288408 - RNA, 16 nt, Human
caauuuccuuuauauu

SEQ ID NO: 2288409 - RNA, 15 nt, Human
caauuuccuuuauau

SEQ ID NO: 2288410 - RNA, 21 nt, Human
caauuuccuuuauauuuagug

SEQ ID NO: 2288411 - RNA, 19 nt, Human
caauuuccuuuauauuuag

SEQ ID NO: 2288412 - RNA, 20 nt, Human
caauuuccuuuauauuuagu

SEQ ID NO: 2288413 - RNA, 17 nt, Human
caauugcaucucccaga

SEQ ID NO: 2288414 - RNA, 15 nt, Human
caauugcaucuccca

SEQ ID NO: 2288415 - RNA, 14 nt, Human
caauugcaucuccc

SEQ ID NO: 2288416 - RNA, 19 nt, Human
caauugauuuuaaaccaua

SEQ ID NO: 2288417 - RNA, 19 nt, Human
caauugacugucacuguuc

SEQ ID NO: 2288418 - RNA, 18 nt, Human
cacaagagcccaggccuc

SEQ ID NO: 2288419 - RNA, 19 nt, Human
cacaagagcccaggccucc

SEQ ID NO: 2288420 - RNA, 21 nt, Human
caauuucuacuuugaagucau

SEQ ID NO: 2288421 - RNA, 20 nt, Human
caauuucuacuuugaaguca

SEQ ID NO: 2288422 - RNA, 16 nt, Human
caauuucuacuuugaa

SEQ ID NO: 2288423 - RNA, 20 nt, Human
caauuucuacaaaauccuga

SEQ ID NO: 2288424 - RNA, 22 nt, Human
caauuucuguccuucagaugga

SEQ ID NO: 2288425 - RNA, 15 nt, Human
caauuucuguguugc

SEQ ID NO: 2288426 - RNA, 12 nt, Human
caauuucucccc

SEQ ID NO: 2288427 - RNA, 13 nt, Human
caauuucucccca

SEQ ID NO: 2288428 - RNA, 14 nt, Human
caauuucuccccag

SEQ ID NO: 2288429 - RNA, 20 nt, Human
cacaagagcccaggccuccu

SEQ ID NO: 2288430 - RNA, 22 nt, Human
caauuucuguguugccaagcuc

SEQ ID NO: 2288431 - RNA, 20 nt, Human
caauuucuguguugccaagc

SEQ ID NO: 2288432 - RNA, 15 nt, Human
caauuucuccccagg

SEQ ID NO: 2288433 - RNA, 18 nt, Human
cacaagcuccaagcuccc

SEQ ID NO: 2288434 - RNA, 19 nt, Human
cacaagcuccaagcuccca

SEQ ID NO: 2288435 - RNA, 14 nt, Human
cacaagauucccag

SEQ ID NO: 2288436 - RNA, 20 nt, Human
cacaagcuccaagcucccag

SEQ ID NO: 2288437 - RNA, 21 nt, Human
cacaagcuccaagcucccagg

SEQ ID NO: 2288438 - RNA, 12 nt, Human
caagauuucaga

SEQ ID NO: 2288439 - RNA, 18 nt, Human
caagauugcuuaaaauag

SEQ ID NO: 2288440 - RNA, 16 nt, Human
caagauugcuuaaaau

SEQ ID NO: 2288441 - RNA, 21 nt, Human
caagauugcuuaaaauagcaa

SEQ ID NO: 2288442 - RNA, 13 nt, Human
caagauugcuuaa

SEQ ID NO: 2288443 - RNA, 17 nt, Human
caagauucugaaacauu

SEQ ID NO: 2288444 - RNA, 21 nt, Human
caagauguccuccuuguucua

SEQ ID NO: 2288445 - RNA, 19 nt, Human
caagauguccuccuuguuc

SEQ ID NO: 2288446 - RNA, 13 nt, Human
caaggcaccugca

SEQ ID NO: 2288447 - RNA, 17 nt, Human
caagauuuuccacaaga

SEQ ID NO: 2288448 - RNA, 15 nt, Human
caaggcaccugcagg

SEQ ID NO: 2288449 - RNA, 19 nt, Human
caaggcaccugcagguugg

SEQ ID NO: 2288450 - RNA, 18 nt, Human
caaggcaaggcugucaau

SEQ ID NO: 2288451 - RNA, 17 nt, Human
caaggcaaggcugucaa

SEQ ID NO: 2288452 - RNA, 16 nt, Human
caaggcaaggcuguca

SEQ ID NO: 2288453 - RNA, 18 nt, Human
caagauuuuaaagacaug

SEQ ID NO: 2288454 - RNA, 22 nt, Human
caaggccgcuguucacccacag

SEQ ID NO: 2288455 - RNA, 20 nt, Human
caaggccgcuguucacccac

SEQ ID NO: 2288456 - RNA, 13 nt, Human
caaggccucccac

SEQ ID NO: 2288457 - RNA, 14 nt, Human
caaggccucccaca

SEQ ID NO: 2288458 - RNA, 15 nt, Human
caaggccucccacag

SEQ ID NO: 2288459 - RNA, 16 nt, Human
caaggccucccacagu

SEQ ID NO: 2288460 - RNA, 17 nt, Human
caaggccucccacagug

SEQ ID NO: 2288461 - RNA, 18 nt, Human
caaggccucccacaguga

SEQ ID NO: 2288462 - RNA, 19 nt, Human
caaggccgcuguucaccca

SEQ ID NO: 2288463 - RNA, 23 nt, Human
caaggccgaagcucuggcugaac

SEQ ID NO: 2288464 - RNA, 20 nt, Human
caaggccgaagcucuggcug

SEQ ID NO: 2288465 - RNA, 21 nt, Human
caaggccgaagcucuggcuga

SEQ ID NO: 2288466 - RNA, 16 nt, Human
caaggccgaagcucug

SEQ ID NO: 2288467 - RNA, 17 nt, Human
caaggccgaagcucugg

SEQ ID NO: 2288468 - RNA, 19 nt, Human
caaggccgaagcucuggcu

SEQ ID NO: 2288469 - RNA, 14 nt, Human
caaggccagagugg

SEQ ID NO: 2288470 - RNA, 21 nt, Human
caaggccaaaggaagcacaug

SEQ ID NO: 2288471 - RNA, 19 nt, Human
caaggccaaaggaagcaca

SEQ ID NO: 2288472 - RNA, 20 nt, Human
caaggccaaaggaagcacau

SEQ ID NO: 2288473 - RNA, 19 nt, Human
caaggcugaccaagagaga

SEQ ID NO: 2288474 - RNA, 14 nt, Human
caagucacucccaa

SEQ ID NO: 2288475 - RNA, 18 nt, Human
caaggcugaccaagagag

SEQ ID NO: 2288476 - RNA, 16 nt, Human
caaggcgugaggaugg

SEQ ID NO: 2288477 - RNA, 14 nt, Human
caagucagaggaug

SEQ ID NO: 2288478 - RNA, 15 nt, Human
caagucagaggaugg

SEQ ID NO: 2288479 - RNA, 19 nt, Human
caagucagaggauggccag

SEQ ID NO: 2288480 - RNA, 21 nt, Human
caagucagaggauggccagug

SEQ ID NO: 2288481 - RNA, 19 nt, Human
caagucagcuuugccuucc

SEQ ID NO: 2288482 - RNA, 22 nt, Human
caagucagaggauggccagugu

SEQ ID NO: 2288483 - RNA, 23 nt, Human
caagucagaggauggccaguguc

SEQ ID NO: 2288484 - RNA, 20 nt, Human
caagucagcuuugccuucca

SEQ ID NO: 2288485 - RNA, 19 nt, Human
caagucaggcccuuauuuu

SEQ ID NO: 2288486 - RNA, 13 nt, Human
caagucaugugca

SEQ ID NO: 2288487 - RNA, 16 nt, Human
caagucaugugcauuu

SEQ ID NO: 2288488 - RNA, 12 nt, Human
caagucauggcu

SEQ ID NO: 2288489 - RNA, 14 nt, Human
caagucauggcugu

SEQ ID NO: 2288490 - RNA, 23 nt, Human
caagucaguccaggaugcuaaca

SEQ ID NO: 2288491 - RNA, 20 nt, Human
caagucauagguuaauauuu

SEQ ID NO: 2288492 - RNA, 19 nt, Human
caaggcgggagcaucucuu

SEQ ID NO: 2288493 - RNA, 14 nt, Human
caaggcggccccuc

SEQ ID NO: 2288494 - RNA, 15 nt, Human
caaggcggccccucc

SEQ ID NO: 2288495 - RNA, 16 nt, Human
caaggcggccccuccc

SEQ ID NO: 2288496 - RNA, 19 nt, Human
caaggcuagaucaugaaga

SEQ ID NO: 2288497 - RNA, 19 nt, Human
caaggcguccgcgcgccag

SEQ ID NO: 2288498 - RNA, 22 nt, Human
caaggcguccgcgcgccagcac

SEQ ID NO: 2288499 - RNA, 15 nt, Human
caaggcucugagcaa

SEQ ID NO: 2288500 - RNA, 13 nt, Human
caaggcggccccu

SEQ ID NO: 2288501 - RNA, 15 nt, Human
caaggccuuucugug

SEQ ID NO: 2288502 - RNA, 18 nt, Human
caaggccuuucugugugu

SEQ ID NO: 2288503 - RNA, 14 nt, Human
caaggccuucuccu

SEQ ID NO: 2288504 - RNA, 16 nt, Human
caaguuguuucauuga

SEQ ID NO: 2288505 - RNA, 13 nt, Human
caaguuguuugag

SEQ ID NO: 2288506 - RNA, 21 nt, Human
caaguuguuugagaaauuaag

SEQ ID NO: 2288507 - RNA, 17 nt, Human
caaguuguuugagaaau

SEQ ID NO: 2288508 - RNA, 13 nt, Human
caagucauggcug

SEQ ID NO: 2288509 - RNA, 23 nt, Human
caaguuguuugagaaauuaagua

SEQ ID NO: 2288510 - RNA, 20 nt, Human
caaguuuacucaacccucuc

SEQ ID NO: 2288511 - RNA, 22 nt, Human
caaguuucuagcuagaaauaug

SEQ ID NO: 2288512 - RNA, 23 nt, Human
caaguuucuagcuagaaauauga

SEQ ID NO: 2288513 - RNA, 22 nt, Human
caaguuuuaggacaaacagcuc

SEQ ID NO: 2288514 - RNA, 17 nt, Human
caaguuuguaucaggug

SEQ ID NO: 2288515 - RNA, 22 nt, Human
caauaaaagcaauuccaaccuu

SEQ ID NO: 2288516 - RNA, 17 nt, Human
caauaaaaauguuuaac

SEQ ID NO: 2288517 - RNA, 20 nt, Human
caauaaaagcaauuccaacc

SEQ ID NO: 2288518 - RNA, 15 nt, Human
caauaaaacauuaau

SEQ ID NO: 2288519 - RNA, 20 nt, Human
caauaaaaauguuuaacggu

SEQ ID NO: 2288520 - RNA, 14 nt, Human
caauaaaacauuaa

SEQ ID NO: 2288521 - RNA, 20 nt, Human
caauaaaauccauacauuug

SEQ ID NO: 2288522 - RNA, 23 nt, Human
caauaaaauccauacauuugugu

SEQ ID NO: 2288523 - RNA, 22 nt, Human
caauaaaaugugauuuuucuga

SEQ ID NO: 2288524 - RNA, 21 nt, Human
caauaaaaugugauuuuucug

SEQ ID NO: 2288525 - RNA, 20 nt, Human
caauaaaaugugauuuuucu

SEQ ID NO: 2288526 - RNA, 16 nt, Human
caauaaaaugugauuu

SEQ ID NO: 2288527 - RNA, 15 nt, Human
caauaaaaugugauu

SEQ ID NO: 2288528 - RNA, 20 nt, Human
caauaaaaucauguacauuu

SEQ ID NO: 2288529 - RNA, 15 nt, Human
caauaaaaucaugua

SEQ ID NO: 2288530 - RNA, 14 nt, Human
caauaaaaucaugu

SEQ ID NO: 2288531 - RNA, 20 nt, Human
caauaaaaucuugaaaaugc

SEQ ID NO: 2288532 - RNA, 13 nt, Human
caauaaaaucaug

SEQ ID NO: 2288533 - RNA, 13 nt, Human
caauaaaauagca

SEQ ID NO: 2288534 - RNA, 23 nt, Human
caccuuugugggguuuuuggaga

SEQ ID NO: 2288535 - RNA, 16 nt, Human
caccuuucuccuuugu

SEQ ID NO: 2288536 - RNA, 22 nt, Human
caccuuucauaaucuuugcuuu

SEQ ID NO: 2288537 - RNA, 19 nt, Human
caccuugggaugaugccuc

SEQ ID NO: 2288538 - RNA, 20 nt, Human
caccuugggaugaugccuca

SEQ ID NO: 2288539 - RNA, 21 nt, Human
caccuuucagauaacuguuau

SEQ ID NO: 2288540 - RNA, 22 nt, Human
caccuuucagauaacuguuauu

SEQ ID NO: 2288541 - RNA, 14 nt, Human
caccuuucccaucu

SEQ ID NO: 2288542 - RNA, 18 nt, Human
caccuuuuaacucaccuc

SEQ ID NO: 2288543 - RNA, 20 nt, Human
caccuuuugggaauguuuua

SEQ ID NO: 2288544 - RNA, 20 nt, Human
caccuuuucagcgauguaug

SEQ ID NO: 2288545 - RNA, 19 nt, Human
caccuuuuucauacaaggc

SEQ ID NO: 2288546 - RNA, 21 nt, Human
caccuuuuucauacaaggccc

SEQ ID NO: 2288547 - RNA, 13 nt, Human
cacgaaauguuau

SEQ ID NO: 2288548 - RNA, 17 nt, Human
caccuuuuuuaaggaaa

SEQ ID NO: 2288549 - RNA, 15 nt, Human
cacgaaauguuauuu

SEQ ID NO: 2288550 - RNA, 16 nt, Human
cacgaaauguuauuuu

SEQ ID NO: 2288551 - RNA, 22 nt, Human
caccugcccaucacaggguugg

SEQ ID NO: 2288552 - RNA, 18 nt, Human
caccugcccaucacaggg

SEQ ID NO: 2288553 - RNA, 13 nt, Human
caccugcccagau

SEQ ID NO: 2288554 - RNA, 11 nt, Human
caccucagccu

SEQ ID NO: 2288555 - RNA, 15 nt, Human
caccugcccccuggu

SEQ ID NO: 2288556 - RNA, 14 nt, Human
caccugcccccugg

SEQ ID NO: 2288557 - RNA, 16 nt, Human
caccugccccaacucu

SEQ ID NO: 2288558 - RNA, 15 nt, Human
caccugccccaacuc

SEQ ID NO: 2288559 - RNA, 18 nt, Human
caccugcccaaccugcuc

SEQ ID NO: 2288560 - RNA, 19 nt, Human
caccugcccaaccugcucu

SEQ ID NO: 2288561 - RNA, 13 nt, Human
caccugcccaacc

SEQ ID NO: 2288562 - RNA, 18 nt, Human
caccuuggcugcagggag

SEQ ID NO: 2288563 - RNA, 13 nt, Human
caccugcccccuu

SEQ ID NO: 2288564 - RNA, 21 nt, Human
caccugcccccugguggacag

SEQ ID NO: 2288565 - RNA, 23 nt, Human
caccuuuauucuggcagaggagg

SEQ ID NO: 2288566 - RNA, 15 nt, Human
caccuuggcugcagg

SEQ ID NO: 2288567 - RNA, 16 nt, Human
caccuuggcugcaggg

SEQ ID NO: 2288568 - RNA, 19 nt, Human
caccuaggccacuccucca

SEQ ID NO: 2288569 - RNA, 18 nt, Human
caccuaggccacuccucc

SEQ ID NO: 2288570 - RNA, 17 nt, Human
caccuaggccacuccuc

SEQ ID NO: 2288571 - RNA, 16 nt, Human
caccuaggccacuccu

SEQ ID NO: 2288572 - RNA, 16 nt, Human
caccuagcuuuauucu

SEQ ID NO: 2288573 - RNA, 16 nt, Human
caccuagaauuggcug

SEQ ID NO: 2288574 - RNA, 14 nt, Human
caccuagcagcacc

SEQ ID NO: 2288575 - RNA, 22 nt, Human
caccuacuuuucuuuccucaga

SEQ ID NO: 2288576 - RNA, 19 nt, Human
caccucagaggcuguucuu

SEQ ID NO: 2288577 - RNA, 20 nt, Human
caccucagagacauacaccu

SEQ ID NO: 2288578 - RNA, 19 nt, Human
caccucagaguauggagcu

SEQ ID NO: 2288579 - RNA, 22 nt, Human
caccucagaguauggagcucag

SEQ ID NO: 2288580 - RNA, 12 nt, Human
caccucagccuc

SEQ ID NO: 2288581 - RNA, 13 nt, Human
caccucacuccug

SEQ ID NO: 2288582 - RNA, 14 nt, Human
caccucacuccugu

SEQ ID NO: 2288583 - RNA, 15 nt, Human
caccucacuccuguu

SEQ ID NO: 2288584 - RNA, 21 nt, Human
caccucacugaaaacaucugg

SEQ ID NO: 2288585 - RNA, 14 nt, Human
caccucaccccacu

SEQ ID NO: 2288586 - RNA, 16 nt, Human
caccucaccccacuua

SEQ ID NO: 2288587 - RNA, 12 nt, Human
caccuacugagu

SEQ ID NO: 2288588 - RNA, 17 nt, Human
cacucuguuauuuagac

SEQ ID NO: 2288589 - RNA, 13 nt, Human
cacucuguuauuu

SEQ ID NO: 2288590 - RNA, 18 nt, Human
cacucugugcccaugggc

SEQ ID NO: 2288591 - RNA, 21 nt, Human
cacucugugcccaugggcacu

SEQ ID NO: 2288592 - RNA, 16 nt, Human
cacuccagccugggcg

SEQ ID NO: 2288593 - RNA, 15 nt, Human
cacuccagccugggc

SEQ ID NO: 2288594 - RNA, 21 nt, Human
cacuccagccugggcgacaga

SEQ ID NO: 2288595 - RNA, 15 nt, Human
cacuaccuccucagg

SEQ ID NO: 2288596 - RNA, 20 nt, Human
cacucugucgcccagucugg

SEQ ID NO: 2288597 - RNA, 12 nt, Human
cacucugugccc

SEQ ID NO: 2288598 - RNA, 13 nt, Human
cacucugugccca

SEQ ID NO: 2288599 - RNA, 14 nt, Human
cacucugugcccau

SEQ ID NO: 2288600 - RNA, 16 nt, Human
cacucugugcccaugg

SEQ ID NO: 2288601 - RNA, 21 nt, Human
cacuccagccugagcaacaga

SEQ ID NO: 2288602 - RNA, 15 nt, Human
cacuccagccugagc

SEQ ID NO: 2288603 - RNA, 14 nt, Human
cacuccagccugag

SEQ ID NO: 2288604 - RNA, 23 nt, Human
cacuccagccugagcgacaguga

SEQ ID NO: 2288605 - RNA, 14 nt, Human
cacuccagccuggg

SEQ ID NO: 2288606 - RNA, 13 nt, Human
cacuccagccugg

SEQ ID NO: 2288607 - RNA, 13 nt, Human
cacuccagccuga

SEQ ID NO: 2288608 - RNA, 12 nt, Human
cacuccagccug

SEQ ID NO: 2288609 - RNA, 21 nt, Human
cacuaccacgccaagcuaauu

SEQ ID NO: 2288610 - RNA, 20 nt, Human
cacuacaugugguuuauaga

SEQ ID NO: 2288611 - RNA, 19 nt, Human
cacuacauaaacugacuuu

SEQ ID NO: 2288612 - RNA, 19 nt, Human
cacuacaugugguuuauag

SEQ ID NO: 2288613 - RNA, 21 nt, Human
cacuacauucuguuaaucauu

SEQ ID NO: 2288614 - RNA, 15 nt, Human
cacuacaugcagccc

SEQ ID NO: 2288615 - RNA, 14 nt, Human
cacuacauaaacug

SEQ ID NO: 2288616 - RNA, 17 nt, Human
cacuacauaaacugacu

SEQ ID NO: 2288617 - RNA, 21 nt, Human
cacuacacuccagccugagca

SEQ ID NO: 2288618 - RNA, 20 nt, Human
cacuacacuccagccugagc

SEQ ID NO: 2288619 - RNA, 23 nt, Human
cacuacaugcagcccaugcccac

SEQ ID NO: 2288620 - RNA, 21 nt, Human
cacuacaugcagcccaugccc

SEQ ID NO: 2288621 - RNA, 17 nt, Human
cacuacauucuguuaau

SEQ ID NO: 2288622 - RNA, 16 nt, Human
cacuacauucuguuaa

SEQ ID NO: 2288623 - RNA, 23 nt, Human
cacggcaggacaacgaggaagcc

SEQ ID NO: 2288624 - RNA, 22 nt, Human
cacggcaggacaacgaggaagc

SEQ ID NO: 2288625 - RNA, 15 nt, Human
cacggccaacaaagc

SEQ ID NO: 2288626 - RNA, 17 nt, Human
cacggccaacaaagcug

SEQ ID NO: 2288627 - RNA, 21 nt, Human
cacggcaggacaacgaggaag

SEQ ID NO: 2288628 - RNA, 19 nt, Human
cacggccacaucaaagagg

SEQ ID NO: 2288629 - RNA, 13 nt, Human
cacggccacauca

SEQ ID NO: 2288630 - RNA, 19 nt, Human
cacuacacuccagccugag

SEQ ID NO: 2288631 - RNA, 18 nt, Human
cacuacacuccagccuga

SEQ ID NO: 2288632 - RNA, 17 nt, Human
cacuacacuccagccug

SEQ ID NO: 2288633 - RNA, 16 nt, Human
cacuacacuccagccu

SEQ ID NO: 2288634 - RNA, 23 nt, Human
cacuacaccuggcugagguuccu

SEQ ID NO: 2288635 - RNA, 15 nt, Human
cacuacaccuggcug

SEQ ID NO: 2288636 - RNA, 15 nt, Human
cacggcucacugcag

SEQ ID NO: 2288637 - RNA, 14 nt, Human
cacggcucacugca

SEQ ID NO: 2288638 - RNA, 14 nt, Human
cacggccgcuccag

SEQ ID NO: 2288639 - RNA, 14 nt, Human
cacggccacuggcc

SEQ ID NO: 2288640 - RNA, 15 nt, Human
cacggccgcuccagg

SEQ ID NO: 2288641 - RNA, 16 nt, Human
cacggccgcuccaggg

SEQ ID NO: 2288642 - RNA, 17 nt, Human
cacggccgcuccagggg

SEQ ID NO: 2288643 - RNA, 19 nt, Human
cacggccgcuccaggggug

SEQ ID NO: 2288644 - RNA, 17 nt, Human
cacggccaggccagagg

SEQ ID NO: 2288645 - RNA, 12 nt, Human
cacggccaggcc

SEQ ID NO: 2288646 - RNA, 13 nt, Human
cacggccaggcca

SEQ ID NO: 2288647 - RNA, 16 nt, Human
cacucuuaagcuuccg

SEQ ID NO: 2288648 - RNA, 20 nt, Human
cacucuuauugcccacgcug

SEQ ID NO: 2288649 - RNA, 21 nt, Human
cacucuuauugcccacgcugg

SEQ ID NO: 2288650 - RNA, 22 nt, Human
cacucuuauugcccacgcugga

SEQ ID NO: 2288651 - RNA, 20 nt, Human
cacucuguuauuuagacuca

SEQ ID NO: 2288652 - RNA, 20 nt, Human
cacugggagaggugccagca

SEQ ID NO: 2288653 - RNA, 23 nt, Human
cacugggagaggugccagcaacu

SEQ ID NO: 2288654 - RNA, 22 nt, Human
cacugccaucuuaguuuggauu

SEQ ID NO: 2288655 - RNA, 17 nt, Human
cacugccaugcagggcc

SEQ ID NO: 2288656 - RNA, 19 nt, Human
cacugccaugcagggccuc

SEQ ID NO: 2288657 - RNA, 16 nt, Human
cacugggagaggugcc

SEQ ID NO: 2288658 - RNA, 19 nt, Human
cacugggagaaaugaaaaa

SEQ ID NO: 2288659 - RNA, 20 nt, Human
cacugggaugagccgcugug

SEQ ID NO: 2288660 - RNA, 23 nt, Human
cacugggaugagccgcugugagc

SEQ ID NO: 2288661 - RNA, 13 nt, Human
cacugggcuucua

SEQ ID NO: 2288662 - RNA, 15 nt, Human
cacuggguugacuuu

SEQ ID NO: 2288663 - RNA, 20 nt, Human
cacugguagaccaaaauaaa

SEQ ID NO: 2288664 - RNA, 16 nt, Human
cacugguauuccugcc

SEQ ID NO: 2288665 - RNA, 17 nt, Human
cacugguauuccugccu

SEQ ID NO: 2288666 - RNA, 23 nt, Human
cacuggguggggugaggaccacu

SEQ ID NO: 2288667 - RNA, 21 nt, Human
cacuggguggggugaggacca

SEQ ID NO: 2288668 - RNA, 19 nt, Human
cacuggguggggugaggac

SEQ ID NO: 2288669 - RNA, 18 nt, Human
cacuggguggggugagga

SEQ ID NO: 2288670 - RNA, 15 nt, Human
cacugggugggguga

SEQ ID NO: 2288671 - RNA, 22 nt, Human
cacugggugcccaagcucagaa

SEQ ID NO: 2288672 - RNA, 20 nt, Human
cacuggggugccgccugccc

SEQ ID NO: 2288673 - RNA, 21 nt, Human
cacuggggugccgccugcccg

SEQ ID NO: 2288674 - RNA, 20 nt, Human
cacugggguccuggggccuc

SEQ ID NO: 2288675 - RNA, 22 nt, Human
cacugggaugagccgcugugag

SEQ ID NO: 2288676 - RNA, 13 nt, Human
cacuggggugccg

SEQ ID NO: 2288677 - RNA, 15 nt, Human
cacuggggugccgcc

SEQ ID NO: 2288678 - RNA, 18 nt, Human
cacuggggugccgccugc

SEQ ID NO: 2288679 - RNA, 16 nt, Human
cacuuaaaaaaugucc

SEQ ID NO: 2288680 - RNA, 14 nt, Human
cacuuaaaaaaugu

SEQ ID NO: 2288681 - RNA, 15 nt, Human
cacuuaaaaaugguu

SEQ ID NO: 2288682 - RNA, 19 nt, Human
cacugguauuccugccucc

SEQ ID NO: 2288683 - RNA, 18 nt, Human
cacuguugcccaggcugg

SEQ ID NO: 2288684 - RNA, 19 nt, Human
cacuguugcccaggcuggc

SEQ ID NO: 2288685 - RNA, 23 nt, Human
cacuguugcccaggcuggcgugc

SEQ ID NO: 2288686 - RNA, 20 nt, Human
cacugguauuccugccucca

SEQ ID NO: 2288687 - RNA, 19 nt, Human
cacugcagccucaaccucc

SEQ ID NO: 2288688 - RNA, 14 nt, Human
cacugcagccucaa

SEQ ID NO: 2288689 - RNA, 20 nt, Human
cacugcagccucaaccuccu

SEQ ID NO: 2288690 - RNA, 21 nt, Human
cacugcagccucaaccuccug

SEQ ID NO: 2288691 - RNA, 22 nt, Human
cacugcagccucaaccuccugg

SEQ ID NO: 2288692 - RNA, 23 nt, Human
cacugcagccucaaccuccuggg

SEQ ID NO: 2288693 - RNA, 17 nt, Human
cacugccaugccagcuu

SEQ ID NO: 2288694 - RNA, 14 nt, Human
cacugccauauacu

SEQ ID NO: 2288695 - RNA, 17 nt, Human
cacugccauaaaacauu

SEQ ID NO: 2288696 - RNA, 21 nt, Human
cacugccauaaaacauuaaga

SEQ ID NO: 2288697 - RNA, 16 nt, Human
cacugccaucuuaguu

SEQ ID NO: 2288698 - RNA, 20 nt, Human
cacugccaucuuaguuugga

SEQ ID NO: 2288699 - RNA, 12 nt, Human
cacugcaggcac

SEQ ID NO: 2288700 - RNA, 20 nt, Human
cacugcaggcaucacagcua

SEQ ID NO: 2288701 - RNA, 13 nt, Human
cacugccaggcca

SEQ ID NO: 2288702 - RNA, 14 nt, Human
cacugccaggccag

SEQ ID NO: 2288703 - RNA, 16 nt, Human
cacugccaggccagcc

SEQ ID NO: 2288704 - RNA, 17 nt, Human
cacugccaggccagccu

SEQ ID NO: 2288705 - RNA, 18 nt, Human
cacugccaggccagccuc

SEQ ID NO: 2288706 - RNA, 19 nt, Human
cacugccaggccagccucc

SEQ ID NO: 2288707 - RNA, 20 nt, Human
cacugccaggccagccuccg

SEQ ID NO: 2288708 - RNA, 21 nt, Human
cacugccaggccagccuccga

SEQ ID NO: 2288709 - RNA, 16 nt, Human
cacugccauaaaacau

SEQ ID NO: 2288710 - RNA, 18 nt, Human
cacuuguguuaugaagca

SEQ ID NO: 2288711 - RNA, 17 nt, Human
cacuuguguuuugcaag

SEQ ID NO: 2288712 - RNA, 19 nt, Human
cacuugugugugggcugug

SEQ ID NO: 2288713 - RNA, 17 nt, Human
cacuugugugugggcug

SEQ ID NO: 2288714 - RNA, 15 nt, Human
cacuugugugugggc

SEQ ID NO: 2288715 - RNA, 14 nt, Human
cacuuguguguggg

SEQ ID NO: 2288716 - RNA, 19 nt, Human
cacuuguugauuaauggaa

SEQ ID NO: 2288717 - RNA, 22 nt, Human
cacuugugugugggcugugagu

SEQ ID NO: 2288718 - RNA, 21 nt, Human
cacuugugugugggcugugag

SEQ ID NO: 2288719 - RNA, 14 nt, Human
cacuuguuguuuua

SEQ ID NO: 2288720 - RNA, 23 nt, Human
cacuugugugugggcugugagug

SEQ ID NO: 2288721 - RNA, 21 nt, Human
cacuuaagacuguguauucua

SEQ ID NO: 2288722 - RNA, 13 nt, Human
cacuuaagagaau

SEQ ID NO: 2288723 - RNA, 15 nt, Human
cacuuaagagaauau

SEQ ID NO: 2288724 - RNA, 17 nt, Human
cacuuaagagaauauuu

SEQ ID NO: 2288725 - RNA, 20 nt, Human
cacuuaagagaauauuuuaa

SEQ ID NO: 2288726 - RNA, 22 nt, Human
cacuuaagagaauauuuuaagu

SEQ ID NO: 2288727 - RNA, 17 nt, Human
cacuuaaggcacucugu

SEQ ID NO: 2288728 - RNA, 22 nt, Human
cacuuaacaagcucccaggccg

SEQ ID NO: 2288729 - RNA, 13 nt, Human
cacuuaacagaug

SEQ ID NO: 2288730 - RNA, 13 nt, Human
cacuuaagacugu

SEQ ID NO: 2288731 - RNA, 13 nt, Human
cacuugugugugg

SEQ ID NO: 2288732 - RNA, 22 nt, Human
cacuuguggguuuuuguuuugu

SEQ ID NO: 2288733 - RNA, 16 nt, Human
cacuuucuagccagag

SEQ ID NO: 2288734 - RNA, 17 nt, Human
cacuuucuagccagagg

SEQ ID NO: 2288735 - RNA, 13 nt, Human
cacuuucuagcca

SEQ ID NO: 2288736 - RNA, 23 nt, Human
cacuuucuacaaugugaacuuua

SEQ ID NO: 2288737 - RNA, 19 nt, Human
cacuuucuacaaugugaac

SEQ ID NO: 2288738 - RNA, 23 nt, Human
cacuuuagggcuguaaaaugcau

SEQ ID NO: 2288739 - RNA, 18 nt, Human
cacuuuagggcuguaaaa

SEQ ID NO: 2288740 - RNA, 17 nt, Human
cacuuuagggcuguaaa

SEQ ID NO: 2288741 - RNA, 15 nt, Human
cacuuuagggcugua

SEQ ID NO: 2288742 - RNA, 21 nt, Human
cacuuuagaugcugaugauuu

SEQ ID NO: 2288743 - RNA, 14 nt, Human
cacuuuagaugcug

SEQ ID NO: 2288744 - RNA, 15 nt, Human
cacuuuagaugcuga

SEQ ID NO: 2288745 - RNA, 16 nt, Human
cacuuuagaugcugau

SEQ ID NO: 2288746 - RNA, 21 nt, Human
cacuuuacaauguucauccca

SEQ ID NO: 2288747 - RNA, 22 nt, Human
cacuuuacaauguucaucccau

SEQ ID NO: 2288748 - RNA, 20 nt, Human
cacuuuaauuaccaaccugu

SEQ ID NO: 2288749 - RNA, 20 nt, Human
cacuuuaauucucaugugau

SEQ ID NO: 2288750 - RNA, 22 nt, Human
cacuuuaauucucaugugaucc

SEQ ID NO: 2288751 - RNA, 20 nt, Human
cagaaagguuuucuucuuuu

SEQ ID NO: 2288752 - RNA, 22 nt, Human
cagaaagggcaacaauaaaaua

SEQ ID NO: 2288753 - RNA, 15 nt, Human
cagaaagguucugcc

SEQ ID NO: 2288754 - RNA, 16 nt, Human
cagaaagguucugccc

SEQ ID NO: 2288755 - RNA, 17 nt, Human
cagaaagguucugcccg

SEQ ID NO: 2288756 - RNA, 21 nt, Human
cagaaagguucugcccgggaa

SEQ ID NO: 2288757 - RNA, 23 nt, Human
cagaaaguggccaugccacccug

SEQ ID NO: 2288758 - RNA, 17 nt, Human
cagaaaguggugcucag

SEQ ID NO: 2288759 - RNA, 22 nt, Human
cagaaaguggccaugccacccu

SEQ ID NO: 2288760 - RNA, 18 nt, Human
cagaaaguggugcucagu

SEQ ID NO: 2288761 - RNA, 19 nt, Human
cagaaaguggugcucaguu

SEQ ID NO: 2288762 - RNA, 21 nt, Human
cagaaaguggugcucaguugu

SEQ ID NO: 2288763 - RNA, 22 nt, Human
cagaaaguggugcucaguugua

SEQ ID NO: 2288764 - RNA, 20 nt, Human
cagaaauaaaguuggugaca

SEQ ID NO: 2288765 - RNA, 23 nt, Human
cagaaagugugcuuuaugcugaa

SEQ ID NO: 2288766 - RNA, 22 nt, Human
cagaaagugugcuuuaugcuga

SEQ ID NO: 2288767 - RNA, 17 nt, Human
cagaaagugugcuuuau

SEQ ID NO: 2288768 - RNA, 16 nt, Human
cagaaagugugcuuua

SEQ ID NO: 2288769 - RNA, 23 nt, Human
cagaaaguggugcucaguuguag

SEQ ID NO: 2288770 - RNA, 15 nt, Human
cagaaauacagauuu

SEQ ID NO: 2288771 - RNA, 20 nt, Human
cagaaauacagauuuugaua

SEQ ID NO: 2288772 - RNA, 13 nt, Human
cagaaauacauau

SEQ ID NO: 2288773 - RNA, 16 nt, Human
cagaaauacauauuuc

SEQ ID NO: 2288774 - RNA, 23 nt, Human
cagaaauacagauuuugauagca

SEQ ID NO: 2288775 - RNA, 12 nt, Human
cagaaaggagac

SEQ ID NO: 2288776 - RNA, 17 nt, Human
cagaaagggcaacaaua

SEQ ID NO: 2288777 - RNA, 23 nt, Human
cagaaauguacaacuuuuuaccu

SEQ ID NO: 2288778 - RNA, 23 nt, Human
cagaaaugcugccugccugucug

SEQ ID NO: 2288779 - RNA, 11 nt, Human
cagaaaugucu

SEQ ID NO: 2288780 - RNA, 14 nt, Human
cagaaaugucuaaa

SEQ ID NO: 2288781 - RNA, 16 nt, Human
cagaaauguacagcaa

SEQ ID NO: 2288782 - RNA, 20 nt, Human
cagaacagccgcuccugucu

SEQ ID NO: 2288783 - RNA, 17 nt, Human
cagaacagccgcuccug

SEQ ID NO: 2288784 - RNA, 12 nt, Human
cagaacagccgc

SEQ ID NO: 2288785 - RNA, 21 nt, Human
cagaaaugucuaaaugcugaa

SEQ ID NO: 2288786 - RNA, 12 nt, Human
cagaacagcuuc

SEQ ID NO: 2288787 - RNA, 13 nt, Human
cagaacagcuuca

SEQ ID NO: 2288788 - RNA, 15 nt, Human
cagaacagcuucagg

SEQ ID NO: 2288789 - RNA, 16 nt, Human
cagaacagcuucaggu

SEQ ID NO: 2288790 - RNA, 15 nt, Human
cagaaauaugugguu

SEQ ID NO: 2288791 - RNA, 23 nt, Human
cagaaauaccaaaauuauuucag

SEQ ID NO: 2288792 - RNA, 22 nt, Human
cagaaauaccaaaauuauuuca

SEQ ID NO: 2288793 - RNA, 19 nt, Human
cagaaauacauauuuccaa

SEQ ID NO: 2288794 - RNA, 19 nt, Human
cagaaaucuagaagacugu

SEQ ID NO: 2288795 - RNA, 14 nt, Human
cagaaauccaucua

SEQ ID NO: 2288796 - RNA, 20 nt, Human
cagaaaucaguaauauuuau

SEQ ID NO: 2288797 - RNA, 17 nt, Human
cagaaaugcugccugcc

SEQ ID NO: 2288798 - RNA, 19 nt, Human
cagaaaugcugccugccug

SEQ ID NO: 2288799 - RNA, 20 nt, Human
cagaaaugcugccugccugu

SEQ ID NO: 2288800 - RNA, 21 nt, Human
cagaaaugcugccugccuguc

SEQ ID NO: 2288801 - RNA, 20 nt, Human
cagaaaugagaucaggcucu

SEQ ID NO: 2288802 - RNA, 23 nt, Human
cagaaaugagaucaggcucugcc

SEQ ID NO: 2288803 - RNA, 14 nt, Human
cagaaaugcugccu

SEQ ID NO: 2288804 - RNA, 16 nt, Human
cagaaaugcugccugc

SEQ ID NO: 2288805 - RNA, 15 nt, Human
cagaaguuucucagc

SEQ ID NO: 2288806 - RNA, 19 nt, Human
cagaaguuucucagcuccc

SEQ ID NO: 2288807 - RNA, 18 nt, Human
cagaacagugauuaccag

SEQ ID NO: 2288808 - RNA, 14 nt, Human
cagaaguuucugcc

SEQ ID NO: 2288809 - RNA, 16 nt, Human
cagaaguuucugccgc

SEQ ID NO: 2288810 - RNA, 17 nt, Human
cagaacagcuucagguu

SEQ ID NO: 2288811 - RNA, 18 nt, Human
cagaacagcuucagguua

SEQ ID NO: 2288812 - RNA, 19 nt, Human
cagaacagcuucagguuau

SEQ ID NO: 2288813 - RNA, 24 nt, Human
cagaacagcuucagguuaucgaaa

SEQ ID NO: 2288814 - RNA, 11 nt, Human
cagaacaguga

SEQ ID NO: 2288815 - RNA, 17 nt, Human
cagaacagugauuacca

SEQ ID NO: 2288816 - RNA, 12 nt, Human
cagaacagugau

SEQ ID NO: 2288817 - RNA, 20 nt, Human
caaacaugugguuaaugcca

SEQ ID NO: 2288818 - RNA, 17 nt, Human
caaacauauauaacaau

SEQ ID NO: 2288819 - RNA, 17 nt, Human
caaacagucucaggaaa

SEQ ID NO: 2288820 - RNA, 16 nt, Human
caaacagucucaggaa

SEQ ID NO: 2288821 - RNA, 13 nt, Human
caaaaggaagucu

SEQ ID NO: 2288822 - RNA, 13 nt, Human
caaaagcuuuuua

SEQ ID NO: 2288823 - RNA, 15 nt, Human
caaacagucucagga

SEQ ID NO: 2288824 - RNA, 21 nt, Human
caaaaggauaaugaauacuuu

SEQ ID NO: 2288825 - RNA, 13 nt, Human
caaacccaugagg

SEQ ID NO: 2288826 - RNA, 18 nt, Human
caaaccccgaccaccugc

SEQ ID NO: 2288827 - RNA, 16 nt, Human
caaacccccuuugugc

SEQ ID NO: 2288828 - RNA, 17 nt, Human
caaaccccacccuaguu

SEQ ID NO: 2288829 - RNA, 21 nt, Human
caaaccccgaccaccugccca

SEQ ID NO: 2288830 - RNA, 17 nt, Human
caaacccccuuugugcu

SEQ ID NO: 2288831 - RNA, 18 nt, Human
caaacccccuuugugcug

SEQ ID NO: 2288832 - RNA, 15 nt, Human
caaaccaaauaaaaa

SEQ ID NO: 2288833 - RNA, 14 nt, Human
caaaccaaauaaaa

SEQ ID NO: 2288834 - RNA, 15 nt, Human
caaaagaaucagaaa

SEQ ID NO: 2288835 - RNA, 19 nt, Human
caaaagaaucagaaacagg

SEQ ID NO: 2288836 - RNA, 19 nt, Human
caaaagaagcccccagcua

SEQ ID NO: 2288837 - RNA, 18 nt, Human
caaaagaagcccccagcu

SEQ ID NO: 2288838 - RNA, 19 nt, Human
caaaagcugggcagguugg

SEQ ID NO: 2288839 - RNA, 23 nt, Human
caaaagacaauucuuuauacaac

SEQ ID NO: 2288840 - RNA, 21 nt, Human
caaaagacaauucuuuauaca

SEQ ID NO: 2288841 - RNA, 22 nt, Human
caaaagacaauucuuuauacaa

SEQ ID NO: 2288842 - RNA, 12 nt, Human
caaaagacaauu

SEQ ID NO: 2288843 - RNA, 13 nt, Human
caaaagacaauuc

SEQ ID NO: 2288844 - RNA, 15 nt, Human
caaaagacaauucuu

SEQ ID NO: 2288845 - RNA, 20 nt, Human
auuuuuuuuuccuucagugc

SEQ ID NO: 2288846 - RNA, 22 nt, Human
auuuuuuuuuccuucagugccu

SEQ ID NO: 2288847 - RNA, 13 nt, Human
caaaagaagcccc

SEQ ID NO: 2288848 - RNA, 17 nt, Human
caaaagaagcccccagc

SEQ ID NO: 2288849 - RNA, 16 nt, Human
caaaagaagcccccag

SEQ ID NO: 2288850 - RNA, 16 nt, Human
auuuuuuugagacaga

SEQ ID NO: 2288851 - RNA, 21 nt, Human
auuuuuuucugauuguaacgu

SEQ ID NO: 2288852 - RNA, 14 nt, Human
auuuuuuugcaagu

SEQ ID NO: 2288853 - RNA, 17 nt, Human
auuuuuuugcaagugaa

SEQ ID NO: 2288854 - RNA, 20 nt, Human
auuuuuuugcaagugaaggu

SEQ ID NO: 2288855 - RNA, 23 nt, Human
auuuuuuuguagaugaaaaagca

SEQ ID NO: 2288856 - RNA, 18 nt, Human
auuuuuuuuuccuucagu

SEQ ID NO: 2288857 - RNA, 22 nt, Human
auuuuuauaucuauauguacuu

SEQ ID NO: 2288858 - RNA, 15 nt, Human
auuuuuauauuuagu

SEQ ID NO: 2288859 - RNA, 16 nt, Human
auuuuuauauuugaaa

SEQ ID NO: 2288860 - RNA, 16 nt, Human
auuuuuuucugauugu

SEQ ID NO: 2288861 - RNA, 15 nt, Human
auuuuuauauuugaa

SEQ ID NO: 2288862 - RNA, 18 nt, Human
auuuuuauaucagccuga

SEQ ID NO: 2288863 - RNA, 20 nt, Human
auuuuuauaucagccugagu

SEQ ID NO: 2288864 - RNA, 16 nt, Human
caaagauaaucucuca

SEQ ID NO: 2288865 - RNA, 20 nt, Human
caaagauaaucucucagcuu

SEQ ID NO: 2288866 - RNA, 17 nt, Human
caaagauaucucaucuc

SEQ ID NO: 2288867 - RNA, 18 nt, Human
auuuucuucaugcaauga

SEQ ID NO: 2288868 - RNA, 14 nt, Human
auuuucuucaugca

SEQ ID NO: 2288869 - RNA, 11 nt, Human
auuuucuguug

SEQ ID NO: 2288870 - RNA, 19 nt, Human
auuuucuuaucuucugcaa

SEQ ID NO: 2288871 - RNA, 21 nt, Human
auuuucugugccugaauauuu

SEQ ID NO: 2288872 - RNA, 11 nt, Human
auuuucugugg

SEQ ID NO: 2288873 - RNA, 23 nt, Human
auuuucuguguuuugcuguacca

SEQ ID NO: 2288874 - RNA, 19 nt, Human
auuuucugugggcaggccu

SEQ ID NO: 2288875 - RNA, 20 nt, Human
auuuugaauaaauaaaugua

SEQ ID NO: 2288876 - RNA, 11 nt, Human
auuuugaauca

SEQ ID NO: 2288877 - RNA, 12 nt, Human
auuuugaaucaa

SEQ ID NO: 2288878 - RNA, 13 nt, Human
auuuugaaucaau

SEQ ID NO: 2288879 - RNA, 14 nt, Human
auuuugaaucaaua

SEQ ID NO: 2288880 - RNA, 15 nt, Human
auuuugaaucaauaa

SEQ ID NO: 2288881 - RNA, 17 nt, Human
auuuugaaucaauaaua

SEQ ID NO: 2288882 - RNA, 18 nt, Human
auuuugaaucaauaauau

SEQ ID NO: 2288883 - RNA, 16 nt, Human
auuuuaggaaaugaau

SEQ ID NO: 2288884 - RNA, 17 nt, Human
auuuuaggcagggauuu

SEQ ID NO: 2288885 - RNA, 21 nt, Human
auuuuaggcagggauuugagg

SEQ ID NO: 2288886 - RNA, 15 nt, Human
auuuuagguguugau

SEQ ID NO: 2288887 - RNA, 16 nt, Human
auuuuagguguugauu

SEQ ID NO: 2288888 - RNA, 21 nt, Human
auuuuagguguugauuuucug

SEQ ID NO: 2288889 - RNA, 21 nt, Human
auuuuauaucaauuuaaaaaa

SEQ ID NO: 2288890 - RNA, 16 nt, Human
auuuuagcugcagaac

SEQ ID NO: 2288891 - RNA, 15 nt, Human
auuuuagcugcagaa

SEQ ID NO: 2288892 - RNA, 21 nt, Human
auuuuaggaaaugaaugugug

SEQ ID NO: 2288893 - RNA, 18 nt, Human
auuuuagcuacuauauau

SEQ ID NO: 2288894 - RNA, 22 nt, Human
auuuuauguuaagggaagaauu

SEQ ID NO: 2288895 - RNA, 19 nt, Human
auuuuaugcuuuaaacauu

SEQ ID NO: 2288896 - RNA, 19 nt, Human
auuuuauggcucacuauga

SEQ ID NO: 2288897 - RNA, 18 nt, Human
auuuuaugcuuuaaacau

SEQ ID NO: 2288898 - RNA, 18 nt, Human
auuuuauaugcuuacuga

SEQ ID NO: 2288899 - RNA, 16 nt, Human
auuuuauaugcuuacu

SEQ ID NO: 2288900 - RNA, 15 nt, Human
auuuuauaugcuuac

SEQ ID NO: 2288901 - RNA, 20 nt, Human
auuuucugugccugaauauu

SEQ ID NO: 2288902 - RNA, 18 nt, Human
auuuucugugccugaaua

SEQ ID NO: 2288903 - RNA, 16 nt, Human
auuuucugugccugaa

SEQ ID NO: 2288904 - RNA, 21 nt, Human
auuuucugguagauagaaaua

SEQ ID NO: 2288905 - RNA, 21 nt, Human
auuuuuagauaguuagaaccu

SEQ ID NO: 2288906 - RNA, 15 nt, Human
auuuuuaaucaugaa

SEQ ID NO: 2288907 - RNA, 14 nt, Human
auuuuuacugccac

SEQ ID NO: 2288908 - RNA, 16 nt, Human
auuuuuaguaaagaca

SEQ ID NO: 2288909 - RNA, 14 nt, Human
auuuuuaaucauga

SEQ ID NO: 2288910 - RNA, 19 nt, Human
auuuuuaauauauacuaug

SEQ ID NO: 2288911 - RNA, 15 nt, Human
auuuuuacugccacu

SEQ ID NO: 2288912 - RNA, 14 nt, Human
auuuuuagacagag

SEQ ID NO: 2288913 - RNA, 18 nt, Human
auuuuuaauauauacuau

SEQ ID NO: 2288914 - RNA, 19 nt, Human
auuuuuaagugcugcauuu

SEQ ID NO: 2288915 - RNA, 18 nt, Human
auuuuuaagugcugcauu

SEQ ID NO: 2288916 - RNA, 16 nt, Human
auuuuuaagugcugca

SEQ ID NO: 2288917 - RNA, 17 nt, Human
caaccagcuaagaaaag

SEQ ID NO: 2288918 - RNA, 18 nt, Human
caaccaugagaccacugu

SEQ ID NO: 2288919 - RNA, 13 nt, Human
caaccaucgcuuu

SEQ ID NO: 2288920 - RNA, 23 nt, Human
caaccaugagaccacuguuauca

SEQ ID NO: 2288921 - RNA, 23 nt, Human
caaccaugaguggcauggccacc

SEQ ID NO: 2288922 - RNA, 22 nt, Human
caaccagcaucccuugaccagg

SEQ ID NO: 2288923 - RNA, 22 nt, Human
caaccagcuaagaaaagauuuu

SEQ ID NO: 2288924 - RNA, 15 nt, Human
caaccagcuaagaaa

SEQ ID NO: 2288925 - RNA, 17 nt, Human
caaccccccaccugcca

SEQ ID NO: 2288926 - RNA, 16 nt, Human
caaccccccaccugcc

SEQ ID NO: 2288927 - RNA, 16 nt, Human
caacccccauuucuau

SEQ ID NO: 2288928 - RNA, 14 nt, Human
caaccccccagcac

SEQ ID NO: 2288929 - RNA, 15 nt, Human
caaccccccagcacu

SEQ ID NO: 2288930 - RNA, 16 nt, Human
caaccccccagcacug

SEQ ID NO: 2288931 - RNA, 18 nt, Human
caaccccccagcacugag

SEQ ID NO: 2288932 - RNA, 10 nt, Human
caaccccuga

SEQ ID NO: 2288933 - RNA, 12 nt, Human
caaccccugagg

SEQ ID NO: 2288934 - RNA, 13 nt, Human
caaccccugagga

SEQ ID NO: 2288935 - RNA, 16 nt, Human
caaccccugaggaaga

SEQ ID NO: 2288936 - RNA, 19 nt, Human
caaccccccagcacugagg

SEQ ID NO: 2288937 - RNA, 20 nt, Human
caaccccccagcacugagga

SEQ ID NO: 2288938 - RNA, 22 nt, Human
caacuaacaagaaacucacccc

SEQ ID NO: 2288939 - RNA, 14 nt, Human
caaccccuguggag

SEQ ID NO: 2288940 - RNA, 12 nt, Human
caaccccugugg

SEQ ID NO: 2288941 - RNA, 18 nt, Human
caacuaauuuuuguauuu

SEQ ID NO: 2288942 - RNA, 18 nt, Human
caacucaccccagcccca

SEQ ID NO: 2288943 - RNA, 15 nt, Human
caacuagacauucug

SEQ ID NO: 2288944 - RNA, 21 nt, Human
caacuagacauucugucgccu

SEQ ID NO: 2288945 - RNA, 16 nt, Human
caacuagacauucugu

SEQ ID NO: 2288946 - RNA, 17 nt, Human
caacuagacauucuguc

SEQ ID NO: 2288947 - RNA, 17 nt, Human
caacucaccccagcccc

SEQ ID NO: 2288948 - RNA, 12 nt, Human
caacucagacua

SEQ ID NO: 2288949 - RNA, 21 nt, Human
caagaauuggaagcugcccug

SEQ ID NO: 2288950 - RNA, 21 nt, Human
caagaauggggaucacagaga

SEQ ID NO: 2288951 - RNA, 22 nt, Human
caagaauugaagcaggacuaaa

SEQ ID NO: 2288952 - RNA, 18 nt, Human
caacucuccccugaccug

SEQ ID NO: 2288953 - RNA, 13 nt, Human
caacucuagcugg

SEQ ID NO: 2288954 - RNA, 24 nt, Human
caacucuccccugaccugugagcc

SEQ ID NO: 2288955 - RNA, 17 nt, Human
caagaaugcugaaacca

SEQ ID NO: 2288956 - RNA, 15 nt, Human
caagaaugcugaaac

SEQ ID NO: 2288957 - RNA, 16 nt, Human
caagaaugcugaaacc

SEQ ID NO: 2288958 - RNA, 13 nt, Human
caagaaugcugaa

SEQ ID NO: 2288959 - RNA, 14 nt, Human
caagaaugcugaaa

SEQ ID NO: 2288960 - RNA, 21 nt, Human
caacuccuggaagcugugucc

SEQ ID NO: 2288961 - RNA, 14 nt, Human
caacuccugucuaa

SEQ ID NO: 2288962 - RNA, 14 nt, Human
caacucgcuuuagg

SEQ ID NO: 2288963 - RNA, 19 nt, Human
caacucgcuuuaggucagc

SEQ ID NO: 2288964 - RNA, 14 nt, Human
caacucuccuccag

SEQ ID NO: 2288965 - RNA, 17 nt, Human
caacuccuggaagcugu

SEQ ID NO: 2288966 - RNA, 14 nt, Human
caacuccuggaagc

SEQ ID NO: 2288967 - RNA, 23 nt, Human
caacucagucccuaaaaacacag

SEQ ID NO: 2288968 - RNA, 21 nt, Human
caagaauuuccuguuggauuu

SEQ ID NO: 2288969 - RNA, 19 nt, Human
caagacccaaaaggcagaa

SEQ ID NO: 2288970 - RNA, 18 nt, Human
caagaccacguuucuaaa

SEQ ID NO: 2288971 - RNA, 17 nt, Human
caagaccacguuucuaa

SEQ ID NO: 2288972 - RNA, 17 nt, Human
caagaugucagacuggc

SEQ ID NO: 2288973 - RNA, 16 nt, Human
caagaugucagacugg

SEQ ID NO: 2288974 - RNA, 15 nt, Human
caagaugucagacug

SEQ ID NO: 2288975 - RNA, 22 nt, Human
caagaugcuggaugucugccaa

SEQ ID NO: 2288976 - RNA, 21 nt, Human
caacaacauguauaauauuuu

SEQ ID NO: 2288977 - RNA, 22 nt, Human
caacaacauguauaauauuuuu

SEQ ID NO: 2288978 - RNA, 19 nt, Human
caacaaccucaacugccua

SEQ ID NO: 2288979 - RNA, 18 nt, Human
caacaaccucaacugccu

SEQ ID NO: 2288980 - RNA, 14 nt, Human
caacacacacacuc

SEQ ID NO: 2288981 - RNA, 11 nt, Human
caacacacaga

SEQ ID NO: 2288982 - RNA, 22 nt, Human
caacacacagauuugagcucag

SEQ ID NO: 2288983 - RNA, 21 nt, Human
caacacacagauuugagcuca

SEQ ID NO: 2288984 - RNA, 13 nt, Human
caacaccaagcac

SEQ ID NO: 2288985 - RNA, 20 nt, Human
caacacaagcuggaagcaca

SEQ ID NO: 2288986 - RNA, 19 nt, Human
caaagggugaagcuauuua

SEQ ID NO: 2288987 - RNA, 21 nt, Human
caaagggugaagcuauuuauc

SEQ ID NO: 2288988 - RNA, 20 nt, Human
caaagggugaagcuauuuau

SEQ ID NO: 2288989 - RNA, 23 nt, Human
caaagauauauacacaggauccu

SEQ ID NO: 2288990 - RNA, 22 nt, Human
caaagcagugcaugcugucccu

SEQ ID NO: 2288991 - RNA, 16 nt, Human
caaagauauuuugcuu

SEQ ID NO: 2288992 - RNA, 14 nt, Human
caaagauauuuugc

SEQ ID NO: 2288993 - RNA, 18 nt, Human
caaagcagugcaugcugu

SEQ ID NO: 2288994 - RNA, 21 nt, Human
caaagcagugcaugcuguccc

SEQ ID NO: 2288995 - RNA, 19 nt, Human
caaaguaucaggacgagaa

SEQ ID NO: 2288996 - RNA, 18 nt, Human
caaaggguuuuaauguag

SEQ ID NO: 2288997 - RNA, 19 nt, Human
caaaggguuuuaauguaga

SEQ ID NO: 2288998 - RNA, 22 nt, Human
caaaguagaagucuuagaugua

SEQ ID NO: 2288999 - RNA, 23 nt, Human
caaagggugaagcuauuuaucug

SEQ ID NO: 2289000 - RNA, 16 nt, Human
caaaggguuuuaaugu

SEQ ID NO: 2289001 - RNA, 22 nt, Human
caaagguaaaucagacuaugaa

SEQ ID NO: 2289002 - RNA, 14 nt, Human
caaagguaaaucag

SEQ ID NO: 2289003 - RNA, 20 nt, Human
caaagucaugcaaaggcugg

SEQ ID NO: 2289004 - RNA, 21 nt, Human
caaagucaugcaaaggcuggg

SEQ ID NO: 2289005 - RNA, 21 nt, Human
caaaguaucccuacuguaauu

SEQ ID NO: 2289006 - RNA, 19 nt, Human
caaaguaucccuacuguaa

SEQ ID NO: 2289007 - RNA, 19 nt, Human
caacaaauuagguuuugua

SEQ ID NO: 2289008 - RNA, 21 nt, Human
caacaaauuagguuuuguaca

SEQ ID NO: 2289009 - RNA, 20 nt, Human
caacaaaggguuuuaaugua

SEQ ID NO: 2289010 - RNA, 12 nt, Human
caacaaagcugu

SEQ ID NO: 2289011 - RNA, 19 nt, Human
caacaaaggguuuuaaugu

SEQ ID NO: 2289012 - RNA, 19 nt, Human
caacaaagccaacagucaa

SEQ ID NO: 2289013 - RNA, 17 nt, Human
caacaaagcacaguguu

SEQ ID NO: 2289014 - RNA, 16 nt, Human
caacaaagcuguugau

SEQ ID NO: 2289015 - RNA, 14 nt, Human
caacaaagaacacu

SEQ ID NO: 2289016 - RNA, 21 nt, Human
caaaugcugcgcccuucccca

SEQ ID NO: 2289017 - RNA, 20 nt, Human
caaaugcugcgcccuucccc

SEQ ID NO: 2289018 - RNA, 19 nt, Human
caaaugcugcgcccuuccc

SEQ ID NO: 2289019 - RNA, 18 nt, Human
caaaugcugcgcccuucc

SEQ ID NO: 2289020 - RNA, 21 nt, Human
caaaugcugacccaugcaaua

SEQ ID NO: 2289021 - RNA, 23 nt, Human
caaaugcuguaacuuucugaaau

SEQ ID NO: 2289022 - RNA, 19 nt, Human
caaaugcccaagggaaaga

SEQ ID NO: 2289023 - RNA, 18 nt, Human
caaaugcauggugcaguu

SEQ ID NO: 2289024 - RNA, 18 nt, Human
caaaugcccaagggaaag

SEQ ID NO: 2289025 - RNA, 20 nt, Human
caaaugagaucuaagccuuu

SEQ ID NO: 2289026 - RNA, 13 nt, Human
caaaugagccaug

SEQ ID NO: 2289027 - RNA, 12 nt, Human
caaaugagccau

SEQ ID NO: 2289028 - RNA, 22 nt, Human
caaaugaccagcagauucaaau

SEQ ID NO: 2289029 - RNA, 18 nt, Human
caaaugacccaaagacca

SEQ ID NO: 2289030 - RNA, 19 nt, Human
caaaugaaugaccuuguug

SEQ ID NO: 2289031 - RNA, 17 nt, Human
caaaugacccaaagacc

SEQ ID NO: 2289032 - RNA, 19 nt, Human
caaaucuuuuagucauuau

SEQ ID NO: 2289033 - RNA, 22 nt, Human
caaaugaauguugucuguuugu

SEQ ID NO: 2289034 - RNA, 13 nt, Human
caaaucuugaaau

SEQ ID NO: 2289035 - RNA, 19 nt, Human
caaaucuugaaauuaagaa

SEQ ID NO: 2289036 - RNA, 12 nt, Human
caaaucuugaaa

SEQ ID NO: 2289037 - RNA, 19 nt, Human
caaagucuaaaguuuacag

SEQ ID NO: 2289038 - RNA, 13 nt, Human
caaaucuggaagc

SEQ ID NO: 2289039 - RNA, 20 nt, Human
caaagucuaaaguuuacagu

SEQ ID NO: 2289040 - RNA, 21 nt, Human
caaaucuuaacuugaaggagu

SEQ ID NO: 2289041 - RNA, 23 nt, Human
caaaguccuuuuuuuccaucuuu

SEQ ID NO: 2289042 - RNA, 19 nt, Human
caaaguccuuuuuuuccau

SEQ ID NO: 2289043 - RNA, 13 nt, Human
caaagucuaaagu

SEQ ID NO: 2289044 - RNA, 15 nt, Human
caaagucuaaaguuu

SEQ ID NO: 2289045 - RNA, 16 nt, Human
caaagucuaaaguuua

SEQ ID NO: 2289046 - RNA, 17 nt, Human
caaagucuaaaguuuac

SEQ ID NO: 2289047 - RNA, 17 nt, Human
caaaguccuuuuuuucc

SEQ ID NO: 2289048 - RNA, 14 nt, Human
caaaguccuuuuuu

SEQ ID NO: 2289049 - RNA, 22 nt, Human
caaagucaugcaaaggcuggga

SEQ ID NO: 2289050 - RNA, 19 nt, Human
auucaauauccuuugccuc

SEQ ID NO: 2289051 - RNA, 14 nt, Human
auucaaucuguaaa

SEQ ID NO: 2289052 - RNA, 16 nt, Human
auucaaucuguaaacu

SEQ ID NO: 2289053 - RNA, 15 nt, Human
auucaaucuguaaac

SEQ ID NO: 2289054 - RNA, 18 nt, Human
auucaaucuguaaacugu

SEQ ID NO: 2289055 - RNA, 17 nt, Human
auucaaucuguaaacug

SEQ ID NO: 2289056 - RNA, 22 nt, Human
auucaaucgacuggguuuaugu

SEQ ID NO: 2289057 - RNA, 16 nt, Human
auucaauauccuuugc

SEQ ID NO: 2289058 - RNA, 13 nt, Human
auucaauaagcau

SEQ ID NO: 2289059 - RNA, 13 nt, Human
auucaauaaauug

SEQ ID NO: 2289060 - RNA, 21 nt, Human
auucaauaaaguauuuaauua

SEQ ID NO: 2289061 - RNA, 22 nt, Human
auucaauaaaguauuuaauuag

SEQ ID NO: 2289062 - RNA, 19 nt, Human
auucaaccacuguaaaaug

SEQ ID NO: 2289063 - RNA, 22 nt, Human
auucaaccacuguaaaaugaaa

SEQ ID NO: 2289064 - RNA, 18 nt, Human
auucaauaaaguauuuaa

SEQ ID NO: 2289065 - RNA, 20 nt, Human
auucaauaaaguauuuaauu

SEQ ID NO: 2289066 - RNA, 16 nt, Human
auucaaccacuguaaa

SEQ ID NO: 2289067 - RNA, 22 nt, Human
auucaacacucccuucccauga

SEQ ID NO: 2289068 - RNA, 18 nt, Human
auucaacagguuuuccug

SEQ ID NO: 2289069 - RNA, 20 nt, Human
auuauggaagauuuuaaauu

SEQ ID NO: 2289070 - RNA, 17 nt, Human
auuauggaagauuuuaa

SEQ ID NO: 2289071 - RNA, 16 nt, Human
auuauggaagauuuua

SEQ ID NO: 2289072 - RNA, 15 nt, Human
auuaugcuucuugga

SEQ ID NO: 2289073 - RNA, 12 nt, Human
auuaugcuucuu

SEQ ID NO: 2289074 - RNA, 19 nt, Human
auuaugccuuuuuugauca

SEQ ID NO: 2289075 - RNA, 20 nt, Human
auuaugcccaguuucugccu

SEQ ID NO: 2289076 - RNA, 22 nt, Human
auuaugcccaguuucugccucu

SEQ ID NO: 2289077 - RNA, 17 nt, Human
auuaugggaaucaagau

SEQ ID NO: 2289078 - RNA, 18 nt, Human
auuaugggaaucaagauu

SEQ ID NO: 2289079 - RNA, 22 nt, Human
auuauguaaaauguuuuagcaa

SEQ ID NO: 2289080 - RNA, 13 nt, Human
auuaaauuaggaa

SEQ ID NO: 2289081 - RNA, 23 nt, Human
auuaggacaaucaguccccuccc

SEQ ID NO: 2289082 - RNA, 14 nt, Human
auuaggauuucaug

SEQ ID NO: 2289083 - RNA, 16 nt, Human
auuaggauuucaugau

SEQ ID NO: 2289084 - RNA, 18 nt, Human
auuaaauuaggaauaaau

SEQ ID NO: 2289085 - RNA, 19 nt, Human
auuaggauuugccccuucc

SEQ ID NO: 2289086 - RNA, 17 nt, Human
auuaaaugcccagcccc

SEQ ID NO: 2289087 - RNA, 19 nt, Human
auuaaaugcccagccccuu

SEQ ID NO: 2289088 - RNA, 14 nt, Human
auuaguaaagaaau

SEQ ID NO: 2289089 - RNA, 21 nt, Human
auuagguuuuguacaauugaa

SEQ ID NO: 2289090 - RNA, 13 nt, Human
auuaguaacaugu

SEQ ID NO: 2289091 - RNA, 16 nt, Human
auuaguaaaugcuuau

SEQ ID NO: 2289092 - RNA, 15 nt, Human
auuagguuuuguaca

SEQ ID NO: 2289093 - RNA, 16 nt, Human
auuagggagaaaauuc

SEQ ID NO: 2289094 - RNA, 20 nt, Human
auuaguacuccccuccuuga

SEQ ID NO: 2289095 - RNA, 17 nt, Human
auuaguaacauguguua

SEQ ID NO: 2289096 - RNA, 16 nt, Human
auuaguaacauguguu

SEQ ID NO: 2289097 - RNA, 19 nt, Human
auuaguacugcucuuguuu

SEQ ID NO: 2289098 - RNA, 22 nt, Human
auuaguaccauaguaccauuua

SEQ ID NO: 2289099 - RNA, 22 nt, Human
auuaugaauuacauuuguauaa

SEQ ID NO: 2289100 - RNA, 19 nt, Human
auuaugaauuacauuugua

SEQ ID NO: 2289101 - RNA, 20 nt, Human
auuaugaauuacauuuguau

SEQ ID NO: 2289102 - RNA, 14 nt, Human
auucuugcaaagua

SEQ ID NO: 2289103 - RNA, 16 nt, Human
auucuugcaaaguauc

SEQ ID NO: 2289104 - RNA, 15 nt, Human
auucuugcaaaguau

SEQ ID NO: 2289105 - RNA, 17 nt, Human
auucuccuuguguuacu

SEQ ID NO: 2289106 - RNA, 12 nt, Human
auuccuugugaa

SEQ ID NO: 2289107 - RNA, 20 nt, Human
auuccuuggcaugccuucca

SEQ ID NO: 2289108 - RNA, 22 nt, Human
auuccuucuuugauaauguuaa

SEQ ID NO: 2289109 - RNA, 23 nt, Human
auuccuucuuugauaauguuaaa

SEQ ID NO: 2289110 - RNA, 19 nt, Human
auucuccuuguguuacuaa

SEQ ID NO: 2289111 - RNA, 18 nt, Human
auucuccuuguguuacua

SEQ ID NO: 2289112 - RNA, 18 nt, Human
auucucuaguuugauuaa

SEQ ID NO: 2289113 - RNA, 17 nt, Human
auucucuaguuugauua

SEQ ID NO: 2289114 - RNA, 22 nt, Human
auucuccuuguguuacuaaguu

SEQ ID NO: 2289115 - RNA, 21 nt, Human
auucuccuuguguuacuaagu

SEQ ID NO: 2289116 - RNA, 21 nt, Human
auuccuuggcaugccuuccag

SEQ ID NO: 2289117 - RNA, 19 nt, Human
auucucuaguuugauuaaa

SEQ ID NO: 2289118 - RNA, 18 nt, Human
auucucugagcugugcag

SEQ ID NO: 2289119 - RNA, 17 nt, Human
auucucugagcugugca

SEQ ID NO: 2289120 - RNA, 13 nt, Human
auucucugagcug

SEQ ID NO: 2289121 - RNA, 12 nt, Human
auucucugucuc

SEQ ID NO: 2289122 - RNA, 17 nt, Human
auucucugucucaucca

SEQ ID NO: 2289123 - RNA, 16 nt, Human
auucucugucucaucc

SEQ ID NO: 2289124 - RNA, 14 nt, Human
auucucugucucau

SEQ ID NO: 2289125 - RNA, 13 nt, Human
auucucugucuca

SEQ ID NO: 2289126 - RNA, 19 nt, Human
auucuucugcuucagccuc

SEQ ID NO: 2289127 - RNA, 19 nt, Human
auucucugucucauccauc

SEQ ID NO: 2289128 - RNA, 18 nt, Human
auucucugucucauccau

SEQ ID NO: 2289129 - RNA, 20 nt, Human
auucuucugcuucagccucc

SEQ ID NO: 2289130 - RNA, 22 nt, Human
auucuucuguacgucugacagg

SEQ ID NO: 2289131 - RNA, 23 nt, Human
auuccuuagcuuagaccucagcc

SEQ ID NO: 2289132 - RNA, 22 nt, Human
auuccuuagcuuagaccucagc

SEQ ID NO: 2289133 - RNA, 24 nt, Human
auuccuuagcuuagaccucagccu

SEQ ID NO: 2289134 - RNA, 14 nt, Human
auuccuucagggug

SEQ ID NO: 2289135 - RNA, 15 nt, Human
auuccuucaggguga

SEQ ID NO: 2289136 - RNA, 22 nt, Human
auuccuucagggugaugccagg

SEQ ID NO: 2289137 - RNA, 18 nt, Human
auuccuuccuguucugaa

SEQ ID NO: 2289138 - RNA, 17 nt, Human
auuccuuccuguucuga

SEQ ID NO: 2289139 - RNA, 14 nt, Human
auuccuucuuugau

SEQ ID NO: 2289140 - RNA, 15 nt, Human
auuccuucuuugaua

SEQ ID NO: 2289141 - RNA, 16 nt, Human
auuccuucuuugauaa

SEQ ID NO: 2289142 - RNA, 17 nt, Human
auuccuucuuugauaau

SEQ ID NO: 2289143 - RNA, 20 nt, Human
auuccuucuuugauaauguu

SEQ ID NO: 2289144 - RNA, 21 nt, Human
auuccuucuuugauaauguua

SEQ ID NO: 2289145 - RNA, 16 nt, Human
auuccuuccuguucug

SEQ ID NO: 2289146 - RNA, 14 nt, Human
auuccuuccuguuc

SEQ ID NO: 2289147 - RNA, 12 nt, Human
auuccuuccugu

SEQ ID NO: 2289148 - RNA, 21 nt, Human
auuccuuagcuuagaccucag

SEQ ID NO: 2289149 - RNA, 20 nt, Human
auuccuuagcuuagaccuca

SEQ ID NO: 2289150 - RNA, 22 nt, Human
auuccuguggauguaaagugau

SEQ ID NO: 2289151 - RNA, 16 nt, Human
auuccuuaaauaaacu

SEQ ID NO: 2289152 - RNA, 16 nt, Human
auuccuguagcaucuu

SEQ ID NO: 2289153 - RNA, 17 nt, Human
auuccuguagcaucuuc

SEQ ID NO: 2289154 - RNA, 18 nt, Human
auuccuguagcaucuucu

SEQ ID NO: 2289155 - RNA, 23 nt, Human
auuccuguagcaucuucuggagu

SEQ ID NO: 2289156 - RNA, 13 nt, Human
auuccuguauguu

SEQ ID NO: 2289157 - RNA, 16 nt, Human
auuccuguauguuguc

SEQ ID NO: 2289158 - RNA, 17 nt, Human
auuccuguauguugucc

SEQ ID NO: 2289159 - RNA, 18 nt, Human
auuccuguauguugucca

SEQ ID NO: 2289160 - RNA, 13 nt, Human
auuccugggcaca

SEQ ID NO: 2289161 - RNA, 10 nt, Human
auuccugggc

SEQ ID NO: 2289162 - RNA, 15 nt, Human
auuccugggcacagu

SEQ ID NO: 2289163 - RNA, 15 nt, Human
auuccugguacccag

SEQ ID NO: 2289164 - RNA, 18 nt, Human
auuccugguacccagcca

SEQ ID NO: 2289165 - RNA, 20 nt, Human
auuccugguacccagccauc

SEQ ID NO: 2289166 - RNA, 17 nt, Human
auuccugccugucuccu

SEQ ID NO: 2289167 - RNA, 18 nt, Human
auuccuggaaaccacagu

SEQ ID NO: 2289168 - RNA, 15 nt, Human
auuccugccugucuc

SEQ ID NO: 2289169 - RNA, 22 nt, Human
auuccugggaaauauucccuag

SEQ ID NO: 2289170 - RNA, 17 nt, Human
auuccugggaaauauuc

SEQ ID NO: 2289171 - RNA, 14 nt, Human
auuccucagggaca

SEQ ID NO: 2289172 - RNA, 17 nt, Human
auuccucaacguauugu

SEQ ID NO: 2289173 - RNA, 21 nt, Human
auuccuauugugauuugacug

SEQ ID NO: 2289174 - RNA, 23 nt, Human
auuccuauugugauuugacuguu

SEQ ID NO: 2289175 - RNA, 18 nt, Human
auuccuauugugauuuga

SEQ ID NO: 2289176 - RNA, 19 nt, Human
auuccuauugugauuugac

SEQ ID NO: 2289177 - RNA, 20 nt, Human
auuccuauugugauuugacu

SEQ ID NO: 2289178 - RNA, 18 nt, Human
auuccugcauuugugaaa

SEQ ID NO: 2289179 - RNA, 19 nt, Human
auuccugcagccuggaggc

SEQ ID NO: 2289180 - RNA, 22 nt, Human
auuccuccugggccccucaucu

SEQ ID NO: 2289181 - RNA, 17 nt, Human
auuccugcagccuggag

SEQ ID NO: 2289182 - RNA, 15 nt, Human
auuccugcauuugug

SEQ ID NO: 2289183 - RNA, 12 nt, Human
auuccuccuggg

SEQ ID NO: 2289184 - RNA, 20 nt, Human
auuccuccugcucauauugu

SEQ ID NO: 2289185 - RNA, 15 nt, Human
auuccuccaccugcc

SEQ ID NO: 2289186 - RNA, 16 nt, Human
auuccuccugcucaua

SEQ ID NO: 2289187 - RNA, 15 nt, Human
auuccuccugcucau

SEQ ID NO: 2289188 - RNA, 14 nt, Human
auuccuccugcuca

SEQ ID NO: 2289189 - RNA, 13 nt, Human
auuccuccugcuc

SEQ ID NO: 2289190 - RNA, 12 nt, Human
auuucagacucc

SEQ ID NO: 2289191 - RNA, 20 nt, Human
auuucauaccuaucaucuua

SEQ ID NO: 2289192 - RNA, 18 nt, Human
auuucauaaacaacuuaa

SEQ ID NO: 2289193 - RNA, 16 nt, Human
auuucauaugcuguau

SEQ ID NO: 2289194 - RNA, 14 nt, Human
auuucuaugaaaua

SEQ ID NO: 2289195 - RNA, 15 nt, Human
auuucugccuuccuu

SEQ ID NO: 2289196 - RNA, 23 nt, Human
auuucugcauauguugaauacuu

SEQ ID NO: 2289197 - RNA, 22 nt, Human
auuucugcauauguugaauacu

SEQ ID NO: 2289198 - RNA, 18 nt, Human
auuucugcauauguugaa

SEQ ID NO: 2289199 - RNA, 20 nt, Human
auuucuauuucuccuccaug

SEQ ID NO: 2289200 - RNA, 18 nt, Human
auuucuauuucuccucca

SEQ ID NO: 2289201 - RNA, 20 nt, Human
auuucugcugaauuuucaca

SEQ ID NO: 2289202 - RNA, 16 nt, Human
auuucugccuuccuug

SEQ ID NO: 2289203 - RNA, 17 nt, Human
auuucugccuuccuugc

SEQ ID NO: 2289204 - RNA, 14 nt, Human
auuucugcugaauu

SEQ ID NO: 2289205 - RNA, 16 nt, Human
auuucugcugaauuuu

SEQ ID NO: 2289206 - RNA, 22 nt, Human
auuucugcugaauuuucacaug

SEQ ID NO: 2289207 - RNA, 17 nt, Human
auuucuauuuauuuacu

SEQ ID NO: 2289208 - RNA, 15 nt, Human
auuucuauuucuccu

SEQ ID NO: 2289209 - RNA, 13 nt, Human
auuucuauuuauu

SEQ ID NO: 2289210 - RNA, 16 nt, Human
auuucuauuuauuuac

SEQ ID NO: 2289211 - RNA, 14 nt, Human
auuucuaugagaaa

SEQ ID NO: 2289212 - RNA, 12 nt, Human
auuucuauuuau

SEQ ID NO: 2289213 - RNA, 17 nt, Human
auuucuaugagaaaaga

SEQ ID NO: 2289214 - RNA, 23 nt, Human
auuucuauucaagguggccaaau

SEQ ID NO: 2289215 - RNA, 16 nt, Human
auuucugugggagaau

SEQ ID NO: 2289216 - RNA, 13 nt, Human
auuucugugggag

SEQ ID NO: 2289217 - RNA, 13 nt, Human
auuuaauaacauu

SEQ ID NO: 2289218 - RNA, 12 nt, Human
auuuaauaacau

SEQ ID NO: 2289219 - RNA, 14 nt, Human
auuuaauaacauua

SEQ ID NO: 2289220 - RNA, 16 nt, Human
auuuaauaacaauugu

SEQ ID NO: 2289221 - RNA, 16 nt, Human
auuuaauaaaugugcc

SEQ ID NO: 2289222 - RNA, 15 nt, Human
auuuaauaaucugua

SEQ ID NO: 2289223 - RNA, 19 nt, Human
auuuaauaauauacuugug

SEQ ID NO: 2289224 - RNA, 16 nt, Human
auuuaauaauauacuu

SEQ ID NO: 2289225 - RNA, 18 nt, Human
auuuaauaauauacuugu

SEQ ID NO: 2289226 - RNA, 13 nt, Human
auuuaauaauaua

SEQ ID NO: 2289227 - RNA, 15 nt, Human
auuuaauaauauacu

SEQ ID NO: 2289228 - RNA, 15 nt, Human
auuuaauaacauuac

SEQ ID NO: 2289229 - RNA, 17 nt, Human
auuuaauaacauuaccu

SEQ ID NO: 2289230 - RNA, 18 nt, Human
auuuaauaacauuaccuu

SEQ ID NO: 2289231 - RNA, 19 nt, Human
auuuaauaacauuaccuua

SEQ ID NO: 2289232 - RNA, 21 nt, Human
auuuaaugaaagacuguacaa

SEQ ID NO: 2289233 - RNA, 20 nt, Human
auuuaaugaaagacuguaca

SEQ ID NO: 2289234 - RNA, 15 nt, Human
auuuaaugaaagacu

SEQ ID NO: 2289235 - RNA, 16 nt, Human
auuuaaugaaagacug

SEQ ID NO: 2289236 - RNA, 21 nt, Human
auuuauaacucaucauaaaau

SEQ ID NO: 2289237 - RNA, 20 nt, Human
auuuauaacucaucauaaaa

SEQ ID NO: 2289238 - RNA, 19 nt, Human
auuuauaacucaucauaaa

SEQ ID NO: 2289239 - RNA, 18 nt, Human
auuuauaacucaucauaa

SEQ ID NO: 2289240 - RNA, 17 nt, Human
auuuauaacucaucaua

SEQ ID NO: 2289241 - RNA, 16 nt, Human
auuuauaacucaucau

SEQ ID NO: 2289242 - RNA, 15 nt, Human
auuuauaacucauca

SEQ ID NO: 2289243 - RNA, 23 nt, Human
auuuaauaacauuaccuuacugu

SEQ ID NO: 2289244 - RNA, 23 nt, Human
auuuauaacucaucauaaaauaa

SEQ ID NO: 2289245 - RNA, 22 nt, Human
auuuauaacucaucauaaaaua

SEQ ID NO: 2289246 - RNA, 22 nt, Human
auuuauaagcagauuuaacaau

SEQ ID NO: 2289247 - RNA, 14 nt, Human
auuuauaagcagau

SEQ ID NO: 2289248 - RNA, 22 nt, Human
auuuauaaucacuuuuuuccac

SEQ ID NO: 2289249 - RNA, 13 nt, Human
auuuauaaucacu

SEQ ID NO: 2289250 - RNA, 16 nt, Human
auuuauaagguuuuaa

SEQ ID NO: 2289251 - RNA, 17 nt, Human
auuuauaagcagauuua

SEQ ID NO: 2289252 - RNA, 15 nt, Human
auuuauaucacaugu

SEQ ID NO: 2289253 - RNA, 20 nt, Human
auuuauauauuuauaacuca

SEQ ID NO: 2289254 - RNA, 15 nt, Human
auuuauaaucacuuu

SEQ ID NO: 2289255 - RNA, 15 nt, Human
auuuauauguacaug

SEQ ID NO: 2289256 - RNA, 17 nt, Human
auuuauauguacaugag

SEQ ID NO: 2289257 - RNA, 16 nt, Human
auuuauauguacauga

SEQ ID NO: 2289258 - RNA, 16 nt, Human
auuuaucugugcaaau

SEQ ID NO: 2289259 - RNA, 19 nt, Human
auuuaucucuauuuaauau

SEQ ID NO: 2289260 - RNA, 20 nt, Human
auuuaucugggauuaugguu

SEQ ID NO: 2289261 - RNA, 19 nt, Human
auuuaucuugucucugggc

SEQ ID NO: 2289262 - RNA, 20 nt, Human
auuuaucuguguuuuugaaa

SEQ ID NO: 2289263 - RNA, 22 nt, Human
auuuaucucuauuuaauauuua

SEQ ID NO: 2289264 - RNA, 13 nt, Human
auuuaugaaaaga

SEQ ID NO: 2289265 - RNA, 22 nt, Human
auuuaucuuuacuuuuaaacag

SEQ ID NO: 2289266 - RNA, 17 nt, Human
auuuaugagcucuucau

SEQ ID NO: 2289267 - RNA, 23 nt, Human
auuuaugaauugaauuaucuugg

SEQ ID NO: 2289268 - RNA, 12 nt, Human
auuuauggagga

SEQ ID NO: 2289269 - RNA, 16 nt, Human
auuuaugauuuaauaa

SEQ ID NO: 2289270 - RNA, 17 nt, Human
auuuaugauuuaauaaa

SEQ ID NO: 2289271 - RNA, 19 nt, Human
auuuaugauuuaauaaaau

SEQ ID NO: 2289272 - RNA, 22 nt, Human
auuuaugcauauuauuuuaugu

SEQ ID NO: 2289273 - RNA, 19 nt, Human
auuuaugaguuuuugauag

SEQ ID NO: 2289274 - RNA, 13 nt, Human
auuuaugauuuaa

SEQ ID NO: 2289275 - RNA, 15 nt, Human
auuuaugauuuaaua

SEQ ID NO: 2289276 - RNA, 18 nt, Human
auuuaugaguuuuugaua

SEQ ID NO: 2289277 - RNA, 15 nt, Human
auuuaugaguuuuug

SEQ ID NO: 2289278 - RNA, 16 nt, Human
auuuaugcauauuauu

SEQ ID NO: 2289279 - RNA, 18 nt, Human
auuucacuuuagaugcug

SEQ ID NO: 2289280 - RNA, 19 nt, Human
auuucacuuuagaugcuga

SEQ ID NO: 2289281 - RNA, 17 nt, Human
auuucacuuaauaaugu

SEQ ID NO: 2289282 - RNA, 15 nt, Human
auuucacuuuagaug

SEQ ID NO: 2289283 - RNA, 12 nt, Human
auuucacuuaau

SEQ ID NO: 2289284 - RNA, 20 nt, Human
auuuaugccucuguauuuaa

SEQ ID NO: 2289285 - RNA, 19 nt, Human
auuuaugcauggaaaccug

SEQ ID NO: 2289286 - RNA, 18 nt, Human
auuguguguuauuuaaau

SEQ ID NO: 2289287 - RNA, 16 nt, Human
auuguguguuauuuaa

SEQ ID NO: 2289288 - RNA, 14 nt, Human
auuguguugugaau

SEQ ID NO: 2289289 - RNA, 20 nt, Human
auuguguucccauuucagcu

SEQ ID NO: 2289290 - RNA, 23 nt, Human
auuguaacuuggauguagccaug

SEQ ID NO: 2289291 - RNA, 15 nt, Human
auuguaacuuggaug

SEQ ID NO: 2289292 - RNA, 19 nt, Human
auuguaacuguucuugaau

SEQ ID NO: 2289293 - RNA, 15 nt, Human
auuguaacuguucuu

SEQ ID NO: 2289294 - RNA, 13 nt, Human
auuguaacuguuc

SEQ ID NO: 2289295 - RNA, 21 nt, Human
auuguaagaaauacuguacaa

SEQ ID NO: 2289296 - RNA, 20 nt, Human
auuguaagaaauacuguaca

SEQ ID NO: 2289297 - RNA, 14 nt, Human
auuguaagaaauac

SEQ ID NO: 2289298 - RNA, 12 nt, Human
auuguaagaaau

SEQ ID NO: 2289299 - RNA, 15 nt, Human
auuguuaaaauaacu

SEQ ID NO: 2289300 - RNA, 13 nt, Human
auuguuaaaauaa

SEQ ID NO: 2289301 - RNA, 13 nt, Human
auuguguuugugu

SEQ ID NO: 2289302 - RNA, 22 nt, Human
auuguguuugucauuagccuga

SEQ ID NO: 2289303 - RNA, 15 nt, Human
auuguguuugucauu

SEQ ID NO: 2289304 - RNA, 16 nt, Human
auuguguuugucauua

SEQ ID NO: 2289305 - RNA, 18 nt, Human
auuguguuugucauuagc

SEQ ID NO: 2289306 - RNA, 19 nt, Human
auuguguuugucauuagcc

SEQ ID NO: 2289307 - RNA, 13 nt, Human
auuguguuuguca

SEQ ID NO: 2289308 - RNA, 15 nt, Human
auuguguucccauuu

SEQ ID NO: 2289309 - RNA, 17 nt, Human
auuguguugugaauguu

SEQ ID NO: 2289310 - RNA, 23 nt, Human
auuguuaagucuaaauauuuccu

SEQ ID NO: 2289311 - RNA, 17 nt, Human
auuguuaacucuugucu

SEQ ID NO: 2289312 - RNA, 21 nt, Human
auuguuaagucuaaauauuuc

SEQ ID NO: 2289313 - RNA, 22 nt, Human
auuguuaagucuaaauauuucc

SEQ ID NO: 2289314 - RNA, 17 nt, Human
auuguuaauuuuuccua

SEQ ID NO: 2289315 - RNA, 12 nt, Human
auuguuguuucu

SEQ ID NO: 2289316 - RNA, 14 nt, Human
auuguuguuucuuu

SEQ ID NO: 2289317 - RNA, 16 nt, Human
auuguuguuucuuucu

SEQ ID NO: 2289318 - RNA, 19 nt, Human
auuguuguuucuuucuagu

SEQ ID NO: 2289319 - RNA, 20 nt, Human
auuguuguuucuuucuagug

SEQ ID NO: 2289320 - RNA, 19 nt, Human
auuguuguuugccauacuu

SEQ ID NO: 2289321 - RNA, 14 nt, Human
auugcuugcacaaa

SEQ ID NO: 2289322 - RNA, 16 nt, Human
auugcuuguuggauuu

SEQ ID NO: 2289323 - RNA, 15 nt, Human
auugcuugauacuuu

SEQ ID NO: 2289324 - RNA, 21 nt, Human
auugcuuacauuuuuacaaua

SEQ ID NO: 2289325 - RNA, 22 nt, Human
auugcuuacauuuuuacaauaa

SEQ ID NO: 2289326 - RNA, 17 nt, Human
auugcuuaaaauagcaa

SEQ ID NO: 2289327 - RNA, 16 nt, Human
auugcuuaaaauagca

SEQ ID NO: 2289328 - RNA, 17 nt, Human
auugcuguugucccucu

SEQ ID NO: 2289329 - RNA, 21 nt, Human
auugcuuacaagccuaagaau

SEQ ID NO: 2289330 - RNA, 21 nt, Human
auugcuguugucccucugcua

SEQ ID NO: 2289331 - RNA, 13 nt, Human
auugcuuacauuu

SEQ ID NO: 2289332 - RNA, 14 nt, Human
auugcuuacauuuu

SEQ ID NO: 2289333 - RNA, 16 nt, Human
auugcuuacauuuuua

SEQ ID NO: 2289334 - RNA, 19 nt, Human
auugcuuacauuuuuacaa

SEQ ID NO: 2289335 - RNA, 20 nt, Human
auugcuuacauuuuuacaau

SEQ ID NO: 2289336 - RNA, 11 nt, Human
auugcuuucug

SEQ ID NO: 2289337 - RNA, 17 nt, Human
auugcuuuauaaauaaa

SEQ ID NO: 2289338 - RNA, 14 nt, Human
auugcuuuccacug

SEQ ID NO: 2289339 - RNA, 16 nt, Human
auugcuuuacugucaa

SEQ ID NO: 2289340 - RNA, 13 nt, Human
auugcuuuauaaa

SEQ ID NO: 2289341 - RNA, 15 nt, Human
auugcuuuauaaaua

SEQ ID NO: 2289342 - RNA, 16 nt, Human
auugcuuuauaaauaa

SEQ ID NO: 2289343 - RNA, 17 nt, Human
auugcuuucugaaauua

SEQ ID NO: 2289344 - RNA, 16 nt, Human
auugcuuucugaaauu

SEQ ID NO: 2289345 - RNA, 15 nt, Human
auugcuuucugaaau

SEQ ID NO: 2289346 - RNA, 13 nt, Human
auugcuuucugaa

SEQ ID NO: 2289347 - RNA, 21 nt, Human
auugcuuugaagcaguugugu

SEQ ID NO: 2289348 - RNA, 10 nt, Human
auugcuuuga

SEQ ID NO: 2289349 - RNA, 23 nt, Human
auugcuuugaagcaguuguguca

SEQ ID NO: 2289350 - RNA, 14 nt, Human
auuguaacagacau

SEQ ID NO: 2289351 - RNA, 15 nt, Human
auuguaacagacauu

SEQ ID NO: 2289352 - RNA, 16 nt, Human
auuguaacagacauug

SEQ ID NO: 2289353 - RNA, 17 nt, Human
auuguaacagacauugu

SEQ ID NO: 2289354 - RNA, 18 nt, Human
auuguaacagacauuguu

SEQ ID NO: 2289355 - RNA, 15 nt, Human
auuguaacguugcug

SEQ ID NO: 2289356 - RNA, 19 nt, Human
auuguaacagacauuguuu

SEQ ID NO: 2289357 - RNA, 16 nt, Human
auuguaacguugcugu

SEQ ID NO: 2289358 - RNA, 17 nt, Human
auuguaacguugcugug

SEQ ID NO: 2289359 - RNA, 18 nt, Human
auuguaacguugcugugg

SEQ ID NO: 2289360 - RNA, 20 nt, Human
auuguaacguugcuguggga

SEQ ID NO: 2289361 - RNA, 21 nt, Human
auuguaacguugcugugggaa

SEQ ID NO: 2289362 - RNA, 19 nt, Human
auugcugugaauuagcuca

SEQ ID NO: 2289363 - RNA, 11 nt, Human
auugcugugcc

SEQ ID NO: 2289364 - RNA, 12 nt, Human
auugcuguguau

SEQ ID NO: 2289365 - RNA, 15 nt, Human
auugcuguguaucug

SEQ ID NO: 2289366 - RNA, 21 nt, Human
auuguuguuuguauguauaau

SEQ ID NO: 2289367 - RNA, 20 nt, Human
auuguuguuuguauguauaa

SEQ ID NO: 2289368 - RNA, 18 nt, Human
auuguuguuuguauguau

SEQ ID NO: 2289369 - RNA, 17 nt, Human
auuguuguuuguaugua

SEQ ID NO: 2289370 - RNA, 15 nt, Human
auuguuuaaaaucau

SEQ ID NO: 2289371 - RNA, 22 nt, Human
auuguuguuugccauacuuugu

SEQ ID NO: 2289372 - RNA, 17 nt, Human
caggagcuuuggaccua

SEQ ID NO: 2289373 - RNA, 13 nt, Human
caggaggaagggg

SEQ ID NO: 2289374 - RNA, 14 nt, Human
caggaggccagccu

SEQ ID NO: 2289375 - RNA, 15 nt, Human
caggaggccagccuu

SEQ ID NO: 2289376 - RNA, 16 nt, Human
caggaggccagccuug

SEQ ID NO: 2289377 - RNA, 23 nt, Human
caggagcugggcagaaggccaag

SEQ ID NO: 2289378 - RNA, 12 nt, Human
caggagcugggc

SEQ ID NO: 2289379 - RNA, 15 nt, Human
caggagcugggcaga

SEQ ID NO: 2289380 - RNA, 22 nt, Human
caggagcugggauccuaagggc

SEQ ID NO: 2289381 - RNA, 14 nt, Human
caggagcugggauc

SEQ ID NO: 2289382 - RNA, 13 nt, Human
caggagcugccca

SEQ ID NO: 2289383 - RNA, 22 nt, Human
caggagcugcccagaguugcug

SEQ ID NO: 2289384 - RNA, 23 nt, Human
caggagcucuucaggccucccuc

SEQ ID NO: 2289385 - RNA, 22 nt, Human
caggagcucuucaggccucccu

SEQ ID NO: 2289386 - RNA, 20 nt, Human
caggagcucuucaggccucc

SEQ ID NO: 2289387 - RNA, 19 nt, Human
caggagcucuucaggccuc

SEQ ID NO: 2289388 - RNA, 18 nt, Human
caggagcucuucaggccu

SEQ ID NO: 2289389 - RNA, 15 nt, Human
caggagcucuucagg

SEQ ID NO: 2289390 - RNA, 12 nt, Human
caggagcucuuc

SEQ ID NO: 2289391 - RNA, 15 nt, Human
caggacccugaaggg

SEQ ID NO: 2289392 - RNA, 14 nt, Human
caggacccugaagg

SEQ ID NO: 2289393 - RNA, 13 nt, Human
caggaacagaagg

SEQ ID NO: 2289394 - RNA, 13 nt, Human
caggacccugaag

SEQ ID NO: 2289395 - RNA, 14 nt, Human
caggaccccugagu

SEQ ID NO: 2289396 - RNA, 12 nt, Human
caggaccccuga

SEQ ID NO: 2289397 - RNA, 14 nt, Human
caggacccccuucc

SEQ ID NO: 2289398 - RNA, 15 nt, Human
caggacccccuuccc

SEQ ID NO: 2289399 - RNA, 16 nt, Human
caggacccccuucccc

SEQ ID NO: 2289400 - RNA, 17 nt, Human
caggacccccuuccccu

SEQ ID NO: 2289401 - RNA, 22 nt, Human
caggcagaucugugccccaugc

SEQ ID NO: 2289402 - RNA, 21 nt, Human
caggcagaucugugccccaug

SEQ ID NO: 2289403 - RNA, 19 nt, Human
caggcagaucugugcccca

SEQ ID NO: 2289404 - RNA, 18 nt, Human
caggcagaucugugcccc

SEQ ID NO: 2289405 - RNA, 17 nt, Human
caggcagaucugugccc

SEQ ID NO: 2289406 - RNA, 16 nt, Human
caggcagaucugugcc

SEQ ID NO: 2289407 - RNA, 15 nt, Human
caggcagaucugugc

SEQ ID NO: 2289408 - RNA, 13 nt, Human
caggcagaucugu

SEQ ID NO: 2289409 - RNA, 20 nt, Human
caggagguggagguugcagu

SEQ ID NO: 2289410 - RNA, 18 nt, Human
caggagguggcuauggcc

SEQ ID NO: 2289411 - RNA, 22 nt, Human
caggagguggcuauggccaccc

SEQ ID NO: 2289412 - RNA, 15 nt, Human
caggcacccccugga

SEQ ID NO: 2289413 - RNA, 16 nt, Human
caggcacccccuggag

SEQ ID NO: 2289414 - RNA, 18 nt, Human
caggcagauccaggacua

SEQ ID NO: 2289415 - RNA, 17 nt, Human
caggcagauccaggacu

SEQ ID NO: 2289416 - RNA, 15 nt, Human
caggcagauccagga

SEQ ID NO: 2289417 - RNA, 17 nt, Human
caggcacccccuggaga

SEQ ID NO: 2289418 - RNA, 14 nt, Human
caggcagauccagg

SEQ ID NO: 2289419 - RNA, 19 nt, Human
caggagguggagguugcag

SEQ ID NO: 2289420 - RNA, 15 nt, Human
caggagguggagguu

SEQ ID NO: 2289421 - RNA, 15 nt, Human
caggagguggucugg

SEQ ID NO: 2289422 - RNA, 18 nt, Human
caggcacccaccaucaug

SEQ ID NO: 2289423 - RNA, 22 nt, Human
caggcacccaccaucaugucug

SEQ ID NO: 2289424 - RNA, 23 nt, Human
caggcacccaccaucaugucugg

SEQ ID NO: 2289425 - RNA, 12 nt, Human
caggagggaggg

SEQ ID NO: 2289426 - RNA, 15 nt, Human
caggagggaggggga

SEQ ID NO: 2289427 - RNA, 17 nt, Human
caggaggccagccuuga

SEQ ID NO: 2289428 - RNA, 20 nt, Human
caggagguggaggcugcagu

SEQ ID NO: 2289429 - RNA, 12 nt, Human
caggagggcccu

SEQ ID NO: 2289430 - RNA, 17 nt, Human
caggagggcaagggcca

SEQ ID NO: 2289431 - RNA, 19 nt, Human
caggagggcaagggccaug

SEQ ID NO: 2289432 - RNA, 16 nt, Human
caggagggcccuaccu

SEQ ID NO: 2289433 - RNA, 18 nt, Human
caggagggcacuggagcu

SEQ ID NO: 2289434 - RNA, 22 nt, Human
caggagggauuggccgcuuggc

SEQ ID NO: 2289435 - RNA, 22 nt, Human
caggagggagcauagaaggcag

SEQ ID NO: 2289436 - RNA, 16 nt, Human
caggagggcaagggcc

SEQ ID NO: 2289437 - RNA, 23 nt, Human
caggagggagggggaaggcaggg

SEQ ID NO: 2289438 - RNA, 23 nt, Human
caggccagagggagugacagagg

SEQ ID NO: 2289439 - RNA, 15 nt, Human
caggcagcacagaga

SEQ ID NO: 2289440 - RNA, 11 nt, Human
caggcagcaga

SEQ ID NO: 2289441 - RNA, 12 nt, Human
caggcagcagag

SEQ ID NO: 2289442 - RNA, 14 nt, Human
caggcagcagagac

SEQ ID NO: 2289443 - RNA, 23 nt, Human
caggcagcagagacuugggacau

SEQ ID NO: 2289444 - RNA, 13 nt, Human
caggcagcauuua

SEQ ID NO: 2289445 - RNA, 19 nt, Human
caggccagagggagugaca

SEQ ID NO: 2289446 - RNA, 21 nt, Human
caggccagagggagugacaga

SEQ ID NO: 2289447 - RNA, 21 nt, Human
caggcggugggcacccacccu

SEQ ID NO: 2289448 - RNA, 16 nt, Human
caggcgggcucaagga

SEQ ID NO: 2289449 - RNA, 20 nt, Human
caggcuggcccugcccuggu

SEQ ID NO: 2289450 - RNA, 15 nt, Human
caggcuggcgugcag

SEQ ID NO: 2289451 - RNA, 16 nt, Human
caggcugggcuucagu

SEQ ID NO: 2289452 - RNA, 13 nt, Human
caggcuggcgcag

SEQ ID NO: 2289453 - RNA, 15 nt, Human
caggcuggcgcagcc

SEQ ID NO: 2289454 - RNA, 16 nt, Human
caggcuggcgcagcca

SEQ ID NO: 2289455 - RNA, 17 nt, Human
caggcuggcgcagccaa

SEQ ID NO: 2289456 - RNA, 15 nt, Human
caggcugggcuucag

SEQ ID NO: 2289457 - RNA, 15 nt, Human
caggcggugggcacc

SEQ ID NO: 2289458 - RNA, 17 nt, Human
caggcggugggcaccca

SEQ ID NO: 2289459 - RNA, 17 nt, Human
caggcuggcccugcccu

SEQ ID NO: 2289460 - RNA, 19 nt, Human
caggcuggcccugcccugg

SEQ ID NO: 2289461 - RNA, 18 nt, Human
caggcuggcccugcccug

SEQ ID NO: 2289462 - RNA, 17 nt, Human
caggcgccccuuccccc

SEQ ID NO: 2289463 - RNA, 17 nt, Human
caggcgccggcgggcgg

SEQ ID NO: 2289464 - RNA, 21 nt, Human
caggcgggagcgguggcccug

SEQ ID NO: 2289465 - RNA, 23 nt, Human
caggcgggagcgguggcccuguc

SEQ ID NO: 2289466 - RNA, 15 nt, Human
caggcgggcucaagg

SEQ ID NO: 2289467 - RNA, 23 nt, Human
cagggaggagguggcagcccugu

SEQ ID NO: 2289468 - RNA, 17 nt, Human
cagggaggaagaagcuu

SEQ ID NO: 2289469 - RNA, 18 nt, Human
caggcuggcgcagccaag

SEQ ID NO: 2289470 - RNA, 20 nt, Human
caggcuggcgcagccaaggc

SEQ ID NO: 2289471 - RNA, 19 nt, Human
cagggaggacgcucucugg

SEQ ID NO: 2289472 - RNA, 21 nt, Human
caggcuggcgcagccaaggcc

SEQ ID NO: 2289473 - RNA, 13 nt, Human
cagggagggccug

SEQ ID NO: 2289474 - RNA, 12 nt, Human
cagggagggccu

SEQ ID NO: 2289475 - RNA, 17 nt, Human
caggcugggcuucagug

SEQ ID NO: 2289476 - RNA, 19 nt, Human
caggcugggcuucaguggc

SEQ ID NO: 2289477 - RNA, 18 nt, Human
cagggaggacgcucucug

SEQ ID NO: 2289478 - RNA, 17 nt, Human
cagggaggacgcucucu

SEQ ID NO: 2289479 - RNA, 19 nt, Human
caggccucccucucucuuc

SEQ ID NO: 2289480 - RNA, 18 nt, Human
caggccucccucucucuu

SEQ ID NO: 2289481 - RNA, 17 nt, Human
caggccucccucucucu

SEQ ID NO: 2289482 - RNA, 16 nt, Human
caggccucccucucuc

SEQ ID NO: 2289483 - RNA, 15 nt, Human
caggccucccucucu

SEQ ID NO: 2289484 - RNA, 14 nt, Human
caggccucccucuc

SEQ ID NO: 2289485 - RNA, 13 nt, Human
caggccucccucu

SEQ ID NO: 2289486 - RNA, 23 nt, Human
caggccucccucucucuucugcu

SEQ ID NO: 2289487 - RNA, 22 nt, Human
caggccucccucucucuucugc

SEQ ID NO: 2289488 - RNA, 15 nt, Human
caggccugacucuca

SEQ ID NO: 2289489 - RNA, 22 nt, Human
caggccugaaagaggcugaggc

SEQ ID NO: 2289490 - RNA, 13 nt, Human
caggccucccugu

SEQ ID NO: 2289491 - RNA, 14 nt, Human
caggccucccuguu

SEQ ID NO: 2289492 - RNA, 14 nt, Human
caggccugccagac

SEQ ID NO: 2289493 - RNA, 12 nt, Human
caggccugccag

SEQ ID NO: 2289494 - RNA, 23 nt, Human
caggccugagauuucaucugcuc

SEQ ID NO: 2289495 - RNA, 19 nt, Human
caggccugagauuucaucu

SEQ ID NO: 2289496 - RNA, 21 nt, Human
caggccugagauuucaucugc

SEQ ID NO: 2289497 - RNA, 14 nt, Human
caggccugagauuu

SEQ ID NO: 2289498 - RNA, 23 nt, Human
caggccugaaagaggcugaggcc

SEQ ID NO: 2289499 - RNA, 16 nt, Human
caggccugagauuuca

SEQ ID NO: 2289500 - RNA, 18 nt, Human
caggccugagauuucauc

SEQ ID NO: 2289501 - RNA, 18 nt, Human
caggccugccagacggca

SEQ ID NO: 2289502 - RNA, 20 nt, Human
caggccugccuguucccauu

SEQ ID NO: 2289503 - RNA, 15 nt, Human
caggcgccccuuccc

SEQ ID NO: 2289504 - RNA, 20 nt, Human
caggcgauccaccugucuca

SEQ ID NO: 2289505 - RNA, 12 nt, Human
caggccucccuc

SEQ ID NO: 2289506 - RNA, 14 nt, Human
cagggagguggcug

SEQ ID NO: 2289507 - RNA, 17 nt, Human
cagggagguggcugggu

SEQ ID NO: 2289508 - RNA, 22 nt, Human
cagggaguccgaaagggacuug

SEQ ID NO: 2289509 - RNA, 18 nt, Human
cagggaggugaccccagg

SEQ ID NO: 2289510 - RNA, 16 nt, Human
cagggagggccugggc

SEQ ID NO: 2289511 - RNA, 14 nt, Human
cagggagggccugg

SEQ ID NO: 2289512 - RNA, 23 nt, Human
cagggagguuaagugacuugccc

SEQ ID NO: 2289513 - RNA, 13 nt, Human
cagggaguccccu

SEQ ID NO: 2289514 - RNA, 22 nt, Human
cagggaguccccuccccggccc

SEQ ID NO: 2289515 - RNA, 23 nt, Human
cagggaguccccuccccggcccu

SEQ ID NO: 2289516 - RNA, 20 nt, Human
cagggaguguaguaaagccg

SEQ ID NO: 2289517 - RNA, 22 nt, Human
cagugcaagagacucuggccuc

SEQ ID NO: 2289518 - RNA, 23 nt, Human
cagugcaagagacucuggccucc

SEQ ID NO: 2289519 - RNA, 15 nt, Human
cagugcacccacucu

SEQ ID NO: 2289520 - RNA, 24 nt, Human
cagugcaagagacucuggccucca

SEQ ID NO: 2289521 - RNA, 22 nt, Human
cagugcaaugguauaaauuuca

SEQ ID NO: 2289522 - RNA, 19 nt, Human
cagucugauucccaagcuc

SEQ ID NO: 2289523 - RNA, 20 nt, Human
cagucugauucccaagcucu

SEQ ID NO: 2289524 - RNA, 22 nt, Human
cagugcagcccguguggccccu

SEQ ID NO: 2289525 - RNA, 12 nt, Human
cagugcaggcac

SEQ ID NO: 2289526 - RNA, 16 nt, Human
cagugcagcccgugug

SEQ ID NO: 2289527 - RNA, 19 nt, Human
cagugcaugcugucccuua

SEQ ID NO: 2289528 - RNA, 22 nt, Human
cagugcaugcugucccuuacgu

SEQ ID NO: 2289529 - RNA, 23 nt, Human
cagugcaugcugucccuuacgug

SEQ ID NO: 2289530 - RNA, 14 nt, Human
cagugggagaaaac

SEQ ID NO: 2289531 - RNA, 13 nt, Human
cagugggagccag

SEQ ID NO: 2289532 - RNA, 17 nt, Human
cagugggagccagggcu

SEQ ID NO: 2289533 - RNA, 18 nt, Human
cagugggagccagggcug

SEQ ID NO: 2289534 - RNA, 11 nt, Human
cagugggagcu

SEQ ID NO: 2289535 - RNA, 12 nt, Human
cagugcccacag

SEQ ID NO: 2289536 - RNA, 19 nt, Human
cagugggacagggcauggc

SEQ ID NO: 2289537 - RNA, 16 nt, Human
cagugggacagggcau

SEQ ID NO: 2289538 - RNA, 19 nt, Human
cagugccaagcacagugcc

SEQ ID NO: 2289539 - RNA, 22 nt, Human
cagugccaauaaaauuuaggaa

SEQ ID NO: 2289540 - RNA, 23 nt, Human
cagugccaagcacagugccugca

SEQ ID NO: 2289541 - RNA, 15 nt, Human
cagugccaagcacag

SEQ ID NO: 2289542 - RNA, 14 nt, Human
cagugccagcaaug

SEQ ID NO: 2289543 - RNA, 15 nt, Human
cagugccagcaauga

SEQ ID NO: 2289544 - RNA, 17 nt, Human
cagugccagcaaugaca

SEQ ID NO: 2289545 - RNA, 21 nt, Human
cagugccagcaaugacaucuc

SEQ ID NO: 2289546 - RNA, 15 nt, Human
cagugccaaaaacaa

SEQ ID NO: 2289547 - RNA, 14 nt, Human
cagugcaggcacag

SEQ ID NO: 2289548 - RNA, 15 nt, Human
caguccuuccaccuc

SEQ ID NO: 2289549 - RNA, 16 nt, Human
cagucgauagagcugu

SEQ ID NO: 2289550 - RNA, 15 nt, Human
cagucgauagagcug

SEQ ID NO: 2289551 - RNA, 22 nt, Human
cagucugaugagaacucugagc

SEQ ID NO: 2289552 - RNA, 18 nt, Human
cagucucccuucucccau

SEQ ID NO: 2289553 - RNA, 17 nt, Human
cagucucccuucuccca

SEQ ID NO: 2289554 - RNA, 22 nt, Human
cagucugaucgugacgcugaau

SEQ ID NO: 2289555 - RNA, 11 nt, Human
cagucucccuu

SEQ ID NO: 2289556 - RNA, 17 nt, Human
cagucuccaccaggaac

SEQ ID NO: 2289557 - RNA, 16 nt, Human
cagucuccaccaggaa

SEQ ID NO: 2289558 - RNA, 14 nt, Human
cagucucaggagca

SEQ ID NO: 2289559 - RNA, 13 nt, Human
cagucucaggagc

SEQ ID NO: 2289560 - RNA, 17 nt, Human
cagucucacccagacuc

SEQ ID NO: 2289561 - RNA, 19 nt, Human
cagucucacugugggaagg

SEQ ID NO: 2289562 - RNA, 23 nt, Human
cagucucacugugggaaggccag

SEQ ID NO: 2289563 - RNA, 19 nt, Human
cagucucaggagcaugggg

SEQ ID NO: 2289564 - RNA, 18 nt, Human
cagucucaggagcauggg

SEQ ID NO: 2289565 - RNA, 14 nt, Human
cagucucccucccu

SEQ ID NO: 2289566 - RNA, 13 nt, Human
cagucgggggcug

SEQ ID NO: 2289567 - RNA, 14 nt, Human
cagucgggggcugg

SEQ ID NO: 2289568 - RNA, 16 nt, Human
cagucgggggcuggcc

SEQ ID NO: 2289569 - RNA, 17 nt, Human
cagucgggggcuggccu

SEQ ID NO: 2289570 - RNA, 18 nt, Human
cagucgggggcuggccua

SEQ ID NO: 2289571 - RNA, 19 nt, Human
cagucgggggcuggccuag

SEQ ID NO: 2289572 - RNA, 13 nt, Human
cagucgucgcaca

SEQ ID NO: 2289573 - RNA, 14 nt, Human
cagucgcgcugccu

SEQ ID NO: 2289574 - RNA, 15 nt, Human
cagucgcgcugccug

SEQ ID NO: 2289575 - RNA, 16 nt, Human
cagucgcgcugccugu

SEQ ID NO: 2289576 - RNA, 17 nt, Human
cagucgcgcugccugug

SEQ ID NO: 2289577 - RNA, 18 nt, Human
cagucgcgcugccugugu

SEQ ID NO: 2289578 - RNA, 20 nt, Human
cagucgcgcugccugugugg

SEQ ID NO: 2289579 - RNA, 20 nt, Human
cagucgucgcacagucucuc

SEQ ID NO: 2289580 - RNA, 14 nt, Human
cagucgugccugug

SEQ ID NO: 2289581 - RNA, 13 nt, Human
cagucgugccugu

SEQ ID NO: 2289582 - RNA, 17 nt, Human
cagucgucgcacagucu

SEQ ID NO: 2289583 - RNA, 18 nt, Human
cagucgucgcacagucuc

SEQ ID NO: 2289584 - RNA, 15 nt, Human
cagucucaggaaauc

SEQ ID NO: 2289585 - RNA, 14 nt, Human
caggguuggccccu

SEQ ID NO: 2289586 - RNA, 12 nt, Human
caggguuggccc

SEQ ID NO: 2289587 - RNA, 16 nt, Human
caggugauccacccac

SEQ ID NO: 2289588 - RNA, 17 nt, Human
caggugauccacccacc

SEQ ID NO: 2289589 - RNA, 20 nt, Human
caggugcagcccccacugcc

SEQ ID NO: 2289590 - RNA, 18 nt, Human
caggugcagcccccacug

SEQ ID NO: 2289591 - RNA, 15 nt, Human
caggugcacagacgu

SEQ ID NO: 2289592 - RNA, 23 nt, Human
caggugcacagacgucccuccac

SEQ ID NO: 2289593 - RNA, 20 nt, Human
caggugauccacccaccuca

SEQ ID NO: 2289594 - RNA, 15 nt, Human
caggugcaguggcuc

SEQ ID NO: 2289595 - RNA, 13 nt, Human
caggugcaguggc

SEQ ID NO: 2289596 - RNA, 12 nt, Human
caggugcagugg

SEQ ID NO: 2289597 - RNA, 23 nt, Human
caggugcagcccccacugccuuu

SEQ ID NO: 2289598 - RNA, 14 nt, Human
caggugcgaaagga

SEQ ID NO: 2289599 - RNA, 18 nt, Human
caggugcuaggaacacuc

SEQ ID NO: 2289600 - RNA, 20 nt, Human
caggugcuaggaacacuccu

SEQ ID NO: 2289601 - RNA, 14 nt, Human
cagguugguggggg

SEQ ID NO: 2289602 - RNA, 20 nt, Human
cagguugggaaugaggcuug

SEQ ID NO: 2289603 - RNA, 22 nt, Human
cagguugggaaugaggcuugcu

SEQ ID NO: 2289604 - RNA, 21 nt, Human
caggugcuacacccuuuucca

SEQ ID NO: 2289605 - RNA, 19 nt, Human
cagguugcugguugcugug

SEQ ID NO: 2289606 - RNA, 20 nt, Human
cagguugcugguugcugugu

SEQ ID NO: 2289607 - RNA, 21 nt, Human
cagguugcugguugcugugug

SEQ ID NO: 2289608 - RNA, 22 nt, Human
cagguugcugguugcugugugg

SEQ ID NO: 2289609 - RNA, 15 nt, Human
cagguugcuuugccc

SEQ ID NO: 2289610 - RNA, 17 nt, Human
cagguugcuuugcccug

SEQ ID NO: 2289611 - RNA, 18 nt, Human
cagguugcuuugcccugg

SEQ ID NO: 2289612 - RNA, 19 nt, Human
cagguugcuuugcccuggu

SEQ ID NO: 2289613 - RNA, 22 nt, Human
cagggucucacucugucgccca

SEQ ID NO: 2289614 - RNA, 21 nt, Human
cagggucucacucugucgccc

SEQ ID NO: 2289615 - RNA, 13 nt, Human
cagggucugcucu

SEQ ID NO: 2289616 - RNA, 14 nt, Human
cagggucugcucuu

SEQ ID NO: 2289617 - RNA, 17 nt, Human
cagggucugcucuuucu

SEQ ID NO: 2289618 - RNA, 20 nt, Human
cagggucugcucuuucucug

SEQ ID NO: 2289619 - RNA, 23 nt, Human
cagggucucuagugcugugaaaa

SEQ ID NO: 2289620 - RNA, 13 nt, Human
cagggucucugcu

SEQ ID NO: 2289621 - RNA, 15 nt, Human
cagggucucugcugc

SEQ ID NO: 2289622 - RNA, 16 nt, Human
cagggucucugcugcc

SEQ ID NO: 2289623 - RNA, 17 nt, Human
cagggucucugcugccg

SEQ ID NO: 2289624 - RNA, 18 nt, Human
cagggucucugcugccgc

SEQ ID NO: 2289625 - RNA, 17 nt, Human
cagggucucacucuguc

SEQ ID NO: 2289626 - RNA, 18 nt, Human
cagggucucacucugucg

SEQ ID NO: 2289627 - RNA, 21 nt, Human
caggguucccccagcccugug

SEQ ID NO: 2289628 - RNA, 20 nt, Human
caggguucccccagcccugu

SEQ ID NO: 2289629 - RNA, 18 nt, Human
caggguucccccagcccu

SEQ ID NO: 2289630 - RNA, 17 nt, Human
caggguucccccagccc

SEQ ID NO: 2289631 - RNA, 15 nt, Human
caggguucccccagc

SEQ ID NO: 2289632 - RNA, 18 nt, Human
caggguucaaaaugucug

SEQ ID NO: 2289633 - RNA, 15 nt, Human
caggguuaagaagac

SEQ ID NO: 2289634 - RNA, 13 nt, Human
cagggugugugcu

SEQ ID NO: 2289635 - RNA, 19 nt, Human
caggguguggcccugccau

SEQ ID NO: 2289636 - RNA, 23 nt, Human
caggguguugggauacugcaggg

SEQ ID NO: 2289637 - RNA, 21 nt, Human
caggguucuccucuccccucu

SEQ ID NO: 2289638 - RNA, 20 nt, Human
caggguucuccucuccccuc

SEQ ID NO: 2289639 - RNA, 17 nt, Human
caggguucuccucuccc

SEQ ID NO: 2289640 - RNA, 22 nt, Human
caggguucccccagcccugugg

SEQ ID NO: 2289641 - RNA, 15 nt, Human
caggguucuccucuc

SEQ ID NO: 2289642 - RNA, 18 nt, Human
caggguugaucacacucu

SEQ ID NO: 2289643 - RNA, 21 nt, Human
caggguugaucacacucuggg

SEQ ID NO: 2289644 - RNA, 20 nt, Human
caggguugaccccagaggau

SEQ ID NO: 2289645 - RNA, 19 nt, Human
caggguugaccccagagga

SEQ ID NO: 2289646 - RNA, 15 nt, Human
cagggucugggcagg

SEQ ID NO: 2289647 - RNA, 17 nt, Human
cagggucuucccuaccu

SEQ ID NO: 2289648 - RNA, 13 nt, Human
cagggucuucccu

SEQ ID NO: 2289649 - RNA, 16 nt, Human
cagggucugggcagga

SEQ ID NO: 2289650 - RNA, 21 nt, Human
cagggucugcucuuucucugc

SEQ ID NO: 2289651 - RNA, 22 nt, Human
cagggucugcucuuucucugcc

SEQ ID NO: 2289652 - RNA, 23 nt, Human
cagggucugcucuuucucugcca

SEQ ID NO: 2289653 - RNA, 19 nt, Human
cagggucucugcugccgcc

SEQ ID NO: 2289654 - RNA, 14 nt, Human
cagggucugggcag

SEQ ID NO: 2289655 - RNA, 20 nt, Human
cagggugggauggaggagaa

SEQ ID NO: 2289656 - RNA, 16 nt, Human
caggguggugcuggga

SEQ ID NO: 2289657 - RNA, 19 nt, Human
caggguggugcugggacug

SEQ ID NO: 2289658 - RNA, 17 nt, Human
caggguggugcugggac

SEQ ID NO: 2289659 - RNA, 18 nt, Human
caggguggugcugggacu

SEQ ID NO: 2289660 - RNA, 18 nt, Human
caggguguggcccugcca

SEQ ID NO: 2289661 - RNA, 15 nt, Human
cagucaaggaguggc

SEQ ID NO: 2289662 - RNA, 21 nt, Human
cagucaaccugggcaaagccu

SEQ ID NO: 2289663 - RNA, 20 nt, Human
cagguuucuggucucuaggc

SEQ ID NO: 2289664 - RNA, 17 nt, Human
cagguuucuggucucua

SEQ ID NO: 2289665 - RNA, 15 nt, Human
cagguuugggacccc

SEQ ID NO: 2289666 - RNA, 18 nt, Human
cagguuuaagcuguuacu

SEQ ID NO: 2289667 - RNA, 16 nt, Human
cagguuuaagcuguua

SEQ ID NO: 2289668 - RNA, 13 nt, Human
cagguugggccau

SEQ ID NO: 2289669 - RNA, 17 nt, Human
cagguugggccauacug

SEQ ID NO: 2289670 - RNA, 21 nt, Human
cagguugggccauacuggccu

SEQ ID NO: 2289671 - RNA, 22 nt, Human
cagguugggccauacuggccuc

SEQ ID NO: 2289672 - RNA, 23 nt, Human
cagguuugggaccccuggugguu

SEQ ID NO: 2289673 - RNA, 21 nt, Human
caguauugaagcauuuuauaa

SEQ ID NO: 2289674 - RNA, 18 nt, Human
cagguuugggaccccugg

SEQ ID NO: 2289675 - RNA, 21 nt, Human
caguauuuuggagaaauuauu

SEQ ID NO: 2289676 - RNA, 23 nt, Human
caguauuuuggagaaauuauuua

SEQ ID NO: 2289677 - RNA, 20 nt, Human
caguauuuuggagaaauuau

SEQ ID NO: 2289678 - RNA, 19 nt, Human
caguauuuuggagaaauua

SEQ ID NO: 2289679 - RNA, 19 nt, Human
cagucaaaacagagaugug

SEQ ID NO: 2289680 - RNA, 19 nt, Human
caguauuuugguucuuagu

SEQ ID NO: 2289681 - RNA, 15 nt, Human
cagucaaaacagaga

SEQ ID NO: 2289682 - RNA, 14 nt, Human
cagucaaccugggc

SEQ ID NO: 2289683 - RNA, 16 nt, Human
cagucaacaaacuauu

SEQ ID NO: 2289684 - RNA, 22 nt, Human
cagucaaccugggcaaagccua

SEQ ID NO: 2289685 - RNA, 16 nt, Human
cagucaaccugggcaa

SEQ ID NO: 2289686 - RNA, 15 nt, Human
cagucaaccugggca

SEQ ID NO: 2289687 - RNA, 20 nt, Human
cagucaccccggccaccugc

SEQ ID NO: 2289688 - RNA, 19 nt, Human
cagucaccccggccaccug

SEQ ID NO: 2289689 - RNA, 22 nt, Human
cagucaccccggccaccugcgg

SEQ ID NO: 2289690 - RNA, 15 nt, Human
cagucaccucaugga

SEQ ID NO: 2289691 - RNA, 15 nt, Human
cagcguacucaucau

SEQ ID NO: 2289692 - RNA, 15 nt, Human
cagcgguggccucuu

SEQ ID NO: 2289693 - RNA, 15 nt, Human
cagcgguuuggggag

SEQ ID NO: 2289694 - RNA, 21 nt, Human
cagccugagcaacucuugauu

SEQ ID NO: 2289695 - RNA, 23 nt, Human
cagcggggccuggcgggaugggc

SEQ ID NO: 2289696 - RNA, 14 nt, Human
cagcggggcgaagc

SEQ ID NO: 2289697 - RNA, 19 nt, Human
cagcggggcgaagcccagg

SEQ ID NO: 2289698 - RNA, 18 nt, Human
cagcgggggccagggaag

SEQ ID NO: 2289699 - RNA, 14 nt, Human
cagcgguggccucu

SEQ ID NO: 2289700 - RNA, 17 nt, Human
cagcguagccucuccgg

SEQ ID NO: 2289701 - RNA, 14 nt, Human
cagcgucccagucu

SEQ ID NO: 2289702 - RNA, 15 nt, Human
cagcguccuccucug

SEQ ID NO: 2289703 - RNA, 21 nt, Human
cagcgucccagucucuggcag

SEQ ID NO: 2289704 - RNA, 18 nt, Human
cagcguccuccucuguga

SEQ ID NO: 2289705 - RNA, 16 nt, Human
cagcguccuccucugu

SEQ ID NO: 2289706 - RNA, 15 nt, Human
cagcguccuguccac

SEQ ID NO: 2289707 - RNA, 14 nt, Human
cagcguccugucca

SEQ ID NO: 2289708 - RNA, 15 nt, Human
cagcgugcuuuaaaa

SEQ ID NO: 2289709 - RNA, 15 nt, Human
cagcggggacagcuc

SEQ ID NO: 2289710 - RNA, 20 nt, Human
cagccugagcaacucuugau

SEQ ID NO: 2289711 - RNA, 16 nt, Human
cagccugagcaacucu

SEQ ID NO: 2289712 - RNA, 16 nt, Human
cagcggggacagcucc

SEQ ID NO: 2289713 - RNA, 17 nt, Human
cagcggggacagcuccu

SEQ ID NO: 2289714 - RNA, 17 nt, Human
cagccucuuucuguccc

SEQ ID NO: 2289715 - RNA, 18 nt, Human
cagccugagcgacaguga

SEQ ID NO: 2289716 - RNA, 22 nt, Human
cagccugagcgacagugagacu

SEQ ID NO: 2289717 - RNA, 19 nt, Human
cagccugagcgacagugag

SEQ ID NO: 2289718 - RNA, 15 nt, Human
cagcccuuagcaggg

SEQ ID NO: 2289719 - RNA, 22 nt, Human
cagccccuggaugcagccucac

SEQ ID NO: 2289720 - RNA, 16 nt, Human
cagcccuuagcaggga

SEQ ID NO: 2289721 - RNA, 21 nt, Human
cagcccuuagcagggaaacag

SEQ ID NO: 2289722 - RNA, 17 nt, Human
cagccccuggaugcagc

SEQ ID NO: 2289723 - RNA, 18 nt, Human
cagccccuggaugcagcc

SEQ ID NO: 2289724 - RNA, 19 nt, Human
cagccccuggaugcagccu

SEQ ID NO: 2289725 - RNA, 21 nt, Human
cagccccuggaugcagccuca

SEQ ID NO: 2289726 - RNA, 12 nt, Human
cagccccuggau

SEQ ID NO: 2289727 - RNA, 13 nt, Human
cagccccuggaug

SEQ ID NO: 2289728 - RNA, 14 nt, Human
cagccccuggaugc

SEQ ID NO: 2289729 - RNA, 18 nt, Human
cagccgauucaccugagc

SEQ ID NO: 2289730 - RNA, 19 nt, Human
cagccgagccgggccuggg

SEQ ID NO: 2289731 - RNA, 14 nt, Human
cagccgagcucgug

SEQ ID NO: 2289732 - RNA, 22 nt, Human
cagccgagcucguguauccugg

SEQ ID NO: 2289733 - RNA, 23 nt, Human
cagccgagcucguguauccuggg

SEQ ID NO: 2289734 - RNA, 12 nt, Human
cagccgagccgg

SEQ ID NO: 2289735 - RNA, 14 nt, Human
cagccgagccgggc

SEQ ID NO: 2289736 - RNA, 17 nt, Human
cagccgagccgggccug

SEQ ID NO: 2289737 - RNA, 18 nt, Human
cagccgagccgggccugg

SEQ ID NO: 2289738 - RNA, 21 nt, Human
cagccgagauagccaaggcca

SEQ ID NO: 2289739 - RNA, 23 nt, Human
cagccccugccccagcccaaguc

SEQ ID NO: 2289740 - RNA, 15 nt, Human
cagcccuucuuucca

SEQ ID NO: 2289741 - RNA, 19 nt, Human
cagcccuucuuuccacaga

SEQ ID NO: 2289742 - RNA, 20 nt, Human
cagcccuucuuuccacagaa

SEQ ID NO: 2289743 - RNA, 14 nt, Human
cagccggcacccac

SEQ ID NO: 2289744 - RNA, 14 nt, Human
cagccggccucucu

SEQ ID NO: 2289745 - RNA, 15 nt, Human
cagccggccucucug

SEQ ID NO: 2289746 - RNA, 16 nt, Human
cagccggccucucugg

SEQ ID NO: 2289747 - RNA, 17 nt, Human
cagccggccucucuggc

SEQ ID NO: 2289748 - RNA, 18 nt, Human
cagccggccucucuggcc

SEQ ID NO: 2289749 - RNA, 15 nt, Human
cagccggcacagggu

SEQ ID NO: 2289750 - RNA, 17 nt, Human
cagccggcacagggucu

SEQ ID NO: 2289751 - RNA, 18 nt, Human
cagccggcacagggucug

SEQ ID NO: 2289752 - RNA, 23 nt, Human
cagccggcacagggucugcucuu

SEQ ID NO: 2289753 - RNA, 18 nt, Human
cagccgcuucugacugcu

SEQ ID NO: 2289754 - RNA, 22 nt, Human
cagccgcugcccggcgcccucu

SEQ ID NO: 2289755 - RNA, 13 nt, Human
cagccggcacagg

SEQ ID NO: 2289756 - RNA, 14 nt, Human
cagccgcuucugac

SEQ ID NO: 2289757 - RNA, 19 nt, Human
cagccgcagccucccucug

SEQ ID NO: 2289758 - RNA, 16 nt, Human
cagccgcagccucccu

SEQ ID NO: 2289759 - RNA, 19 nt, Human
cagccgauucaccugagca

SEQ ID NO: 2289760 - RNA, 11 nt, Human
cagccucuuaa

SEQ ID NO: 2289761 - RNA, 14 nt, Human
cagccucuguuccc

SEQ ID NO: 2289762 - RNA, 15 nt, Human
cagccgggcccugag

SEQ ID NO: 2289763 - RNA, 19 nt, Human
cagccggccucucuggccu

SEQ ID NO: 2289764 - RNA, 20 nt, Human
cagccggccucucuggccuc

SEQ ID NO: 2289765 - RNA, 22 nt, Human
cagccggccucucuggccuccc

SEQ ID NO: 2289766 - RNA, 23 nt, Human
cagccggccucucuggccuccca

SEQ ID NO: 2289767 - RNA, 24 nt, Human
cagccggccucucuggccucccac

SEQ ID NO: 2289768 - RNA, 12 nt, Human
cagccgggcccu

SEQ ID NO: 2289769 - RNA, 13 nt, Human
cagccgggcccug

SEQ ID NO: 2289770 - RNA, 21 nt, Human
cagccucuuaaagcugccugu

SEQ ID NO: 2289771 - RNA, 20 nt, Human
cagccucuuaaagcugccug

SEQ ID NO: 2289772 - RNA, 19 nt, Human
cagccucuuaaagcugccu

SEQ ID NO: 2289773 - RNA, 15 nt, Human
cagccucuuaaagcu

SEQ ID NO: 2289774 - RNA, 18 nt, Human
cagccucuuggccccaga

SEQ ID NO: 2289775 - RNA, 16 nt, Human
cagccucuuucugucc

SEQ ID NO: 2289776 - RNA, 16 nt, Human
cagcugcagagacaga

SEQ ID NO: 2289777 - RNA, 13 nt, Human
cagcugccagaga

SEQ ID NO: 2289778 - RNA, 15 nt, Human
cagcugcagagacag

SEQ ID NO: 2289779 - RNA, 18 nt, Human
cagcugcacugaugcugc

SEQ ID NO: 2289780 - RNA, 22 nt, Human
cagcugcaccugccagccuggc

SEQ ID NO: 2289781 - RNA, 12 nt, Human
cagcugcacuga

SEQ ID NO: 2289782 - RNA, 15 nt, Human
cagcugccagagaag

SEQ ID NO: 2289783 - RNA, 14 nt, Human
cagcugccagagaa

SEQ ID NO: 2289784 - RNA, 16 nt, Human
cagcugccagagaagc

SEQ ID NO: 2289785 - RNA, 15 nt, Human
cagcugccccagcca

SEQ ID NO: 2289786 - RNA, 12 nt, Human
cagcugccccgg

SEQ ID NO: 2289787 - RNA, 13 nt, Human
cagcugccccggg

SEQ ID NO: 2289788 - RNA, 17 nt, Human
cagcugccgaccagagc

SEQ ID NO: 2289789 - RNA, 18 nt, Human
cagcugccgaccagagcc

SEQ ID NO: 2289790 - RNA, 13 nt, Human
cagcugccucuuc

SEQ ID NO: 2289791 - RNA, 19 nt, Human
cagcugccgaccagagccc

SEQ ID NO: 2289792 - RNA, 12 nt, Human
cagcugccucuu

SEQ ID NO: 2289793 - RNA, 21 nt, Human
cagcucccccuguccccucag

SEQ ID NO: 2289794 - RNA, 19 nt, Human
cagcucccaccccaccccc

SEQ ID NO: 2289795 - RNA, 15 nt, Human
cagcucccaccccac

SEQ ID NO: 2289796 - RNA, 14 nt, Human
cagcucccacccca

SEQ ID NO: 2289797 - RNA, 12 nt, Human
cagcucccaccc

SEQ ID NO: 2289798 - RNA, 16 nt, Human
cagcuccccucggaga

SEQ ID NO: 2289799 - RNA, 18 nt, Human
cagcuccccucggagaag

SEQ ID NO: 2289800 - RNA, 17 nt, Human
cagcuccccucggagaa

SEQ ID NO: 2289801 - RNA, 20 nt, Human
cagcugauuuuaacaauaac

SEQ ID NO: 2289802 - RNA, 22 nt, Human
cagcucccccuguccccucagc

SEQ ID NO: 2289803 - RNA, 20 nt, Human
cagcuccccucggagaagag

SEQ ID NO: 2289804 - RNA, 21 nt, Human
cagcugcaccugccagccugg

SEQ ID NO: 2289805 - RNA, 20 nt, Human
cagcugcaccugccagccug

SEQ ID NO: 2289806 - RNA, 18 nt, Human
cagcugcaccugccagcc

SEQ ID NO: 2289807 - RNA, 17 nt, Human
cagcugcaccugccagc

SEQ ID NO: 2289808 - RNA, 21 nt, Human
cagcugauuuuaacaauaacu

SEQ ID NO: 2289809 - RNA, 16 nt, Human
cagcugcaccugccag

SEQ ID NO: 2289810 - RNA, 16 nt, Human
cagcuguccucuucug

SEQ ID NO: 2289811 - RNA, 22 nt, Human
cagcugucccugucaccaagcu

SEQ ID NO: 2289812 - RNA, 18 nt, Human
cagcugugaacauggacu

SEQ ID NO: 2289813 - RNA, 20 nt, Human
cagcugugaacauggacucu

SEQ ID NO: 2289814 - RNA, 13 nt, Human
cagcugugagccu

SEQ ID NO: 2289815 - RNA, 15 nt, Human
cagcugugagccuug

SEQ ID NO: 2289816 - RNA, 16 nt, Human
cagcugugagccuugg

SEQ ID NO: 2289817 - RNA, 17 nt, Human
cagcugugagccuuggc

SEQ ID NO: 2289818 - RNA, 18 nt, Human
cagcugugcucuggacag

SEQ ID NO: 2289819 - RNA, 15 nt, Human
cagcuucauuuccug

SEQ ID NO: 2289820 - RNA, 15 nt, Human
cagcuucagccagga

SEQ ID NO: 2289821 - RNA, 17 nt, Human
cagcuucagccaggagc

SEQ ID NO: 2289822 - RNA, 14 nt, Human
cagcuucagguuau

SEQ ID NO: 2289823 - RNA, 18 nt, Human
cagcuucauuuccugugu

SEQ ID NO: 2289824 - RNA, 12 nt, Human
cagcuucaguug

SEQ ID NO: 2289825 - RNA, 19 nt, Human
caggaaagcucagcuacug

SEQ ID NO: 2289826 - RNA, 18 nt, Human
caggaaaggcccagccac

SEQ ID NO: 2289827 - RNA, 15 nt, Human
caggaaaggaaucau

SEQ ID NO: 2289828 - RNA, 14 nt, Human
caggaaaggcucca

SEQ ID NO: 2289829 - RNA, 15 nt, Human
caggaaaggcuccag

SEQ ID NO: 2289830 - RNA, 12 nt, Human
caggaacagaag

SEQ ID NO: 2289831 - RNA, 22 nt, Human
caggaacacccgacuccucaaa

SEQ ID NO: 2289832 - RNA, 21 nt, Human
caggaacaaucgauggccuug

SEQ ID NO: 2289833 - RNA, 21 nt, Human
caggaaaugaaaaugucuugu

SEQ ID NO: 2289834 - RNA, 20 nt, Human
caggaaaugaaaaugucuug

SEQ ID NO: 2289835 - RNA, 13 nt, Human
caggaaaugaaaa

SEQ ID NO: 2289836 - RNA, 19 nt, Human
caggaaaggaaucauuucu

SEQ ID NO: 2289837 - RNA, 23 nt, Human
caggaaaucaaauaugcaaagca

SEQ ID NO: 2289838 - RNA, 13 nt, Human
cagcuccagcuca

SEQ ID NO: 2289839 - RNA, 23 nt, Human
cagcuccaaccugcaaagaucug

SEQ ID NO: 2289840 - RNA, 18 nt, Human
cagcuccaagaccuguug

SEQ ID NO: 2289841 - RNA, 20 nt, Human
cagcuccaagaccuguuggu

SEQ ID NO: 2289842 - RNA, 14 nt, Human
cagcuccagcucac

SEQ ID NO: 2289843 - RNA, 15 nt, Human
cagcuccagcucacc

SEQ ID NO: 2289844 - RNA, 20 nt, Human
cagcuccaaccugcaaagau

SEQ ID NO: 2289845 - RNA, 17 nt, Human
cagcuccaaccugcaaa

SEQ ID NO: 2289846 - RNA, 14 nt, Human
cagcuccaaccugc

SEQ ID NO: 2289847 - RNA, 23 nt, Human
cagcuccacucugacuggcacag

SEQ ID NO: 2289848 - RNA, 14 nt, Human
cagcuccagcugcu

SEQ ID NO: 2289849 - RNA, 15 nt, Human
cagcuccacccuggc

SEQ ID NO: 2289850 - RNA, 13 nt, Human
cagcuccacccug

SEQ ID NO: 2289851 - RNA, 22 nt, Human
cagcuccagcucaccagcccca

SEQ ID NO: 2289852 - RNA, 19 nt, Human
cagcuccacucugacuggc

SEQ ID NO: 2289853 - RNA, 17 nt, Human
cagcuccagguggcucu

SEQ ID NO: 2289854 - RNA, 21 nt, Human
cagcuccagguggcucugagg

SEQ ID NO: 2289855 - RNA, 21 nt, Human
cagcucccaaggcucugagca

SEQ ID NO: 2289856 - RNA, 16 nt, Human
cagcuccagcucacca

SEQ ID NO: 2289857 - RNA, 17 nt, Human
cagcuccagcucaccag

SEQ ID NO: 2289858 - RNA, 18 nt, Human
cagcuccagcucaccagc

SEQ ID NO: 2289859 - RNA, 20 nt, Human
cagcuccagcucaccagccc

SEQ ID NO: 2289860 - RNA, 16 nt, Human
cagaggggcaggcccu

SEQ ID NO: 2289861 - RNA, 18 nt, Human
cagaggggcaggcccugc

SEQ ID NO: 2289862 - RNA, 19 nt, Human
cagaggggcaggcccugca

SEQ ID NO: 2289863 - RNA, 20 nt, Human
cagaggggcaggcccugcac

SEQ ID NO: 2289864 - RNA, 23 nt, Human
cagaggggaaaccaguguagccu

SEQ ID NO: 2289865 - RNA, 22 nt, Human
cagagggccugcaagggaguga

SEQ ID NO: 2289866 - RNA, 20 nt, Human
cagagcuggggcugagggau

SEQ ID NO: 2289867 - RNA, 14 nt, Human
cagagcugggaggg

SEQ ID NO: 2289868 - RNA, 13 nt, Human
cagagcuggggcu

SEQ ID NO: 2289869 - RNA, 22 nt, Human
cagagcuguuuauggccucagc

SEQ ID NO: 2289870 - RNA, 13 nt, Human
cagagcuucccug

SEQ ID NO: 2289871 - RNA, 18 nt, Human
cagagcuucccugacuca

SEQ ID NO: 2289872 - RNA, 14 nt, Human
cagagcuucccuga

SEQ ID NO: 2289873 - RNA, 21 nt, Human
cagagcuguuuauggccucag

SEQ ID NO: 2289874 - RNA, 20 nt, Human
cagagcuguuuauggccuca

SEQ ID NO: 2289875 - RNA, 19 nt, Human
cagagcuguuuauggccuc

SEQ ID NO: 2289876 - RNA, 22 nt, Human
cagagcuguggacuuuguucac

SEQ ID NO: 2289877 - RNA, 20 nt, Human
cagagcugggauguuucugu

SEQ ID NO: 2289878 - RNA, 16 nt, Human
cagagcugccaccugc

SEQ ID NO: 2289879 - RNA, 18 nt, Human
cagagcugccaccugccu

SEQ ID NO: 2289880 - RNA, 23 nt, Human
cagaaguuugagaucagccuggg

SEQ ID NO: 2289881 - RNA, 22 nt, Human
cagaaguuugagaucagccugg

SEQ ID NO: 2289882 - RNA, 20 nt, Human
cagaaguuugagaucagccu

SEQ ID NO: 2289883 - RNA, 23 nt, Human
cagaaguuucugccgcagcccug

SEQ ID NO: 2289884 - RNA, 19 nt, Human
cagaaguuucugccgcagc

SEQ ID NO: 2289885 - RNA, 22 nt, Human
cagauauuuauauuuuuauuuu

SEQ ID NO: 2289886 - RNA, 21 nt, Human
cagauauuuauauuuuuauuu

SEQ ID NO: 2289887 - RNA, 20 nt, Human
cagauauuuauauuuuuauu

SEQ ID NO: 2289888 - RNA, 16 nt, Human
cagauauuuauauuuu

SEQ ID NO: 2289889 - RNA, 14 nt, Human
cagauauuuauauu

SEQ ID NO: 2289890 - RNA, 12 nt, Human
cagauauuuaua

SEQ ID NO: 2289891 - RNA, 11 nt, Human
cagauauuuau

SEQ ID NO: 2289892 - RNA, 14 nt, Human
cagagucagcagaa

SEQ ID NO: 2289893 - RNA, 15 nt, Human
cagauauuuuuucag

SEQ ID NO: 2289894 - RNA, 13 nt, Human
cagagucagcaga

SEQ ID NO: 2289895 - RNA, 21 nt, Human
cagagucacacgggggcagcu

SEQ ID NO: 2289896 - RNA, 20 nt, Human
cagaguauuugaaaaaugua

SEQ ID NO: 2289897 - RNA, 20 nt, Human
cagaguauggagcucagaga

SEQ ID NO: 2289898 - RNA, 20 nt, Human
cagagucagaaguuucugcc

SEQ ID NO: 2289899 - RNA, 22 nt, Human
cagaggggcaggcccugcacug

SEQ ID NO: 2289900 - RNA, 13 nt, Human
cagaguaugaaca

SEQ ID NO: 2289901 - RNA, 21 nt, Human
cagaguaugaacaccugggcu

SEQ ID NO: 2289902 - RNA, 14 nt, Human
cagaguauggagcu

SEQ ID NO: 2289903 - RNA, 18 nt, Human
cagaggggguggccuccc

SEQ ID NO: 2289904 - RNA, 17 nt, Human
cagaggggguggccucc

SEQ ID NO: 2289905 - RNA, 19 nt, Human
cagaggggguggccuccca

SEQ ID NO: 2289906 - RNA, 20 nt, Human
cagaggggguggccucccaa

SEQ ID NO: 2289907 - RNA, 20 nt, Human
cagcaccuacaguguacagu

SEQ ID NO: 2289908 - RNA, 21 nt, Human
cagcagguccccagcuuuggc

SEQ ID NO: 2289909 - RNA, 22 nt, Human
cagcagggucuuuucaucuggg

SEQ ID NO: 2289910 - RNA, 20 nt, Human
cagcagggucuuuucaucug

SEQ ID NO: 2289911 - RNA, 21 nt, Human
cagcagggucuuuucaucugg

SEQ ID NO: 2289912 - RNA, 19 nt, Human
cagcaggugcugcuacccu

SEQ ID NO: 2289913 - RNA, 23 nt, Human
cagcaggugcugcuacccucccu

SEQ ID NO: 2289914 - RNA, 19 nt, Human
cagcaguaccuauaaagua

SEQ ID NO: 2289915 - RNA, 11 nt, Human
cagcaggugcu

SEQ ID NO: 2289916 - RNA, 14 nt, Human
cagcaggugcugcu

SEQ ID NO: 2289917 - RNA, 15 nt, Human
cagcaggugcugcua

SEQ ID NO: 2289918 - RNA, 17 nt, Human
cagcaggugcugcuacc

SEQ ID NO: 2289919 - RNA, 15 nt, Human
cagcaccuacagugu

SEQ ID NO: 2289920 - RNA, 18 nt, Human
cagcaccguucugugcac

SEQ ID NO: 2289921 - RNA, 17 nt, Human
cagcaccguucugugca

SEQ ID NO: 2289922 - RNA, 16 nt, Human
cagcaccguucugugc

SEQ ID NO: 2289923 - RNA, 12 nt, Human
cagcacccugca

SEQ ID NO: 2289924 - RNA, 16 nt, Human
cagcacccgggcucag

SEQ ID NO: 2289925 - RNA, 13 nt, Human
cagcacagccaac

SEQ ID NO: 2289926 - RNA, 13 nt, Human
cagcacagcaagg

SEQ ID NO: 2289927 - RNA, 19 nt, Human
cagcacagcaaggaggcug

SEQ ID NO: 2289928 - RNA, 21 nt, Human
cagcacagcaaggaggcuggc

SEQ ID NO: 2289929 - RNA, 19 nt, Human
cagcaccccuuccaugugg

SEQ ID NO: 2289930 - RNA, 22 nt, Human
cagcaccccuuccauguggaga

SEQ ID NO: 2289931 - RNA, 23 nt, Human
cagcaccccuuccauguggagaa

SEQ ID NO: 2289932 - RNA, 12 nt, Human
cagcacagagag

SEQ ID NO: 2289933 - RNA, 16 nt, Human
cagcacagagaagaca

SEQ ID NO: 2289934 - RNA, 17 nt, Human
cagcacagagaagacaa

SEQ ID NO: 2289935 - RNA, 14 nt, Human
cagcacagagaaga

SEQ ID NO: 2289936 - RNA, 19 nt, Human
cagcacacagggcagugag

SEQ ID NO: 2289937 - RNA, 18 nt, Human
cagcacacagggcaguga

SEQ ID NO: 2289938 - RNA, 13 nt, Human
cagcacagagagg

SEQ ID NO: 2289939 - RNA, 17 nt, Human
cagcacagagagggggc

SEQ ID NO: 2289940 - RNA, 20 nt, Human
cagcacagagagggggccac

SEQ ID NO: 2289941 - RNA, 16 nt, Human
cagcacagagaccccc

SEQ ID NO: 2289942 - RNA, 22 nt, Human
cagcacagccucuuagaugcag

SEQ ID NO: 2289943 - RNA, 14 nt, Human
cagcauauuuauag

SEQ ID NO: 2289944 - RNA, 12 nt, Human
cagcauauuuau

SEQ ID NO: 2289945 - RNA, 22 nt, Human
cagcagugaaaacaagugcugg

SEQ ID NO: 2289946 - RNA, 22 nt, Human
cagcaguugaaaagacuccaaa

SEQ ID NO: 2289947 - RNA, 23 nt, Human
cagcauauucaggaagcucaggg

SEQ ID NO: 2289948 - RNA, 19 nt, Human
cagcauauucaggaagcuc

SEQ ID NO: 2289949 - RNA, 22 nt, Human
cagcauauucaggaagcucagg

SEQ ID NO: 2289950 - RNA, 14 nt, Human
cagcagugaaaaca

SEQ ID NO: 2289951 - RNA, 15 nt, Human
cagcagugaaaacaa

SEQ ID NO: 2289952 - RNA, 17 nt, Human
cagcagugaaaacaagu

SEQ ID NO: 2289953 - RNA, 23 nt, Human
cagcagugaaaacaagugcuggc

SEQ ID NO: 2289954 - RNA, 17 nt, Human
cagcaguugaaaagacu

SEQ ID NO: 2289955 - RNA, 21 nt, Human
cagcaguugaaaagacuccaa

SEQ ID NO: 2289956 - RNA, 20 nt, Human
cagcaguugaaaagacucca

SEQ ID NO: 2289957 - RNA, 18 nt, Human
cagccagcagccagcucu

SEQ ID NO: 2289958 - RNA, 17 nt, Human
cagccagcagccagcuc

SEQ ID NO: 2289959 - RNA, 18 nt, Human
cagcauauuuauagcaau

SEQ ID NO: 2289960 - RNA, 22 nt, Human
cagcauauuuguauaguugcuu

SEQ ID NO: 2289961 - RNA, 21 nt, Human
cagccagcagccagcucucag

SEQ ID NO: 2289962 - RNA, 19 nt, Human
cagccagcagccagcucuc

SEQ ID NO: 2289963 - RNA, 12 nt, Human
cagccaggagcu

SEQ ID NO: 2289964 - RNA, 14 nt, Human
cagccaggagcugg

SEQ ID NO: 2289965 - RNA, 11 nt, Human
cagccaggagc

SEQ ID NO: 2289966 - RNA, 22 nt, Human
cagccaggagcugggcagaagg

SEQ ID NO: 2289967 - RNA, 15 nt, Human
cagccaggagcuggg

SEQ ID NO: 2289968 - RNA, 16 nt, Human
cagccaggagcugggc

SEQ ID NO: 2289969 - RNA, 22 nt, Human
cagccaggccacaagacccuug

SEQ ID NO: 2289970 - RNA, 12 nt, Human
cagccaggccac

SEQ ID NO: 2289971 - RNA, 13 nt, Human
cagccaggccaca

SEQ ID NO: 2289972 - RNA, 14 nt, Human
ccaccagucacugu

SEQ ID NO: 2289973 - RNA, 18 nt, Human
ccaccaucaugucuggcu

SEQ ID NO: 2289974 - RNA, 19 nt, Human
ccaccaucaugucuggcua

SEQ ID NO: 2289975 - RNA, 14 nt, Human
ccaccauccugcag

SEQ ID NO: 2289976 - RNA, 15 nt, Human
ccaccauccugcagc

SEQ ID NO: 2289977 - RNA, 15 nt, Human
ccaccgcugccuaag

SEQ ID NO: 2289978 - RNA, 14 nt, Human
ccaccgcugccuaa

SEQ ID NO: 2289979 - RNA, 13 nt, Human
ccaccgcugccua

SEQ ID NO: 2289980 - RNA, 21 nt, Human
ccaccgcuccccagcccaggg

SEQ ID NO: 2289981 - RNA, 21 nt, Human
ccaccgcugccuaaguggcug

SEQ ID NO: 2289982 - RNA, 19 nt, Human
ccaccgggcugggagcucu

SEQ ID NO: 2289983 - RNA, 17 nt, Human
ccaccgcuccccagccc

SEQ ID NO: 2289984 - RNA, 15 nt, Human
ccaccgcuccccagc

SEQ ID NO: 2289985 - RNA, 14 nt, Human
ccaccgcuccccag

SEQ ID NO: 2289986 - RNA, 17 nt, Human
ccaccgccuccuacagc

SEQ ID NO: 2289987 - RNA, 15 nt, Human
ccaccaugcccagcu

SEQ ID NO: 2289988 - RNA, 16 nt, Human
ccaccaugccaggcua

SEQ ID NO: 2289989 - RNA, 22 nt, Human
ccaccaucuuugcagguugcuu

SEQ ID NO: 2289990 - RNA, 12 nt, Human
ccaccucacccc

SEQ ID NO: 2289991 - RNA, 14 nt, Human
ccaccucaccccac

SEQ ID NO: 2289992 - RNA, 20 nt, Human
ccaccuaucucgugggagag

SEQ ID NO: 2289993 - RNA, 21 nt, Human
ccaccuaucucgugggagagc

SEQ ID NO: 2289994 - RNA, 21 nt, Human
ccaccuaguggcuguccagug

SEQ ID NO: 2289995 - RNA, 22 nt, Human
ccaccuaguggcuguccagugc

SEQ ID NO: 2289996 - RNA, 23 nt, Human
ccaccuaguggcuguccagugcc

SEQ ID NO: 2289997 - RNA, 18 nt, Human
ccaccuaucucgugggag

SEQ ID NO: 2289998 - RNA, 22 nt, Human
ccaccuaggccacuccuccaaa

SEQ ID NO: 2289999 - RNA, 15 nt, Human
ccaccuaguggcugu

SEQ ID NO: 2290000 - RNA, 20 nt, Human
ccaccuaggccacuccucca

SEQ ID NO: 2290001 - RNA, 18 nt, Human
ccaccuaggccacuccuc

SEQ ID NO: 2290002 - RNA, 16 nt, Human
ccaccuaguggcuguc

SEQ ID NO: 2290003 - RNA, 18 nt, Human
ccaccuaguggcugucca

SEQ ID NO: 2290004 - RNA, 19 nt, Human
ccaccuaguggcuguccag

SEQ ID NO: 2290005 - RNA, 20 nt, Human
ccaccuaguggcuguccagu

SEQ ID NO: 2290006 - RNA, 17 nt, Human
ccaccuaggccacuccu

SEQ ID NO: 2290007 - RNA, 16 nt, Human
ccaccuaggccacucc

SEQ ID NO: 2290008 - RNA, 23 nt, Human
ccaccuagcagcaccguucugug

SEQ ID NO: 2290009 - RNA, 14 nt, Human
ccaccuagcagcac

SEQ ID NO: 2290010 - RNA, 13 nt, Human
ccaccuagcagca

SEQ ID NO: 2290011 - RNA, 21 nt, Human
ccaccuagacuguaaaccucu

SEQ ID NO: 2290012 - RNA, 12 nt, Human
ccaccuuggcug

SEQ ID NO: 2290013 - RNA, 14 nt, Human
ccaccuuggcugca

SEQ ID NO: 2290014 - RNA, 15 nt, Human
ccaccuuggcugcag

SEQ ID NO: 2290015 - RNA, 16 nt, Human
ccaccuuggcugcagg

SEQ ID NO: 2290016 - RNA, 18 nt, Human
ccacgcuggaccuugaac

SEQ ID NO: 2290017 - RNA, 17 nt, Human
ccacgccuguaauccca

SEQ ID NO: 2290018 - RNA, 21 nt, Human
ccacgcccuccccuccccugc

SEQ ID NO: 2290019 - RNA, 22 nt, Human
ccacgcccuccccuccccugcu

SEQ ID NO: 2290020 - RNA, 18 nt, Human
ccaccuuggcugcaggga

SEQ ID NO: 2290021 - RNA, 19 nt, Human
ccaccuuggcugcagggag

SEQ ID NO: 2290022 - RNA, 10 nt, Human
ccaccucagc

SEQ ID NO: 2290023 - RNA, 15 nt, Human
ccaccucacuccugu

SEQ ID NO: 2290024 - RNA, 16 nt, Human
ccaccucacuccuguu

SEQ ID NO: 2290025 - RNA, 18 nt, Human
ccaccucacuccuguuac

SEQ ID NO: 2290026 - RNA, 17 nt, Human
ccaccuuguuggagccu

SEQ ID NO: 2290027 - RNA, 18 nt, Human
ccaccuuguuggagccug

SEQ ID NO: 2290028 - RNA, 19 nt, Human
ccaccuuguuggagccugc

SEQ ID NO: 2290029 - RNA, 17 nt, Human
ccaccuuuauuaaaauc

SEQ ID NO: 2290030 - RNA, 22 nt, Human
ccaccuuguuggagccugcagg

SEQ ID NO: 2290031 - RNA, 20 nt, Human
ccaccuuguuggagccugca

SEQ ID NO: 2290032 - RNA, 21 nt, Human
ccaccuuguuggagccugcag

SEQ ID NO: 2290033 - RNA, 16 nt, Human
ccacgacugucuccau

SEQ ID NO: 2290034 - RNA, 20 nt, Human
ccacgauguggcccuggccu

SEQ ID NO: 2290035 - RNA, 17 nt, Human
ccacgauguggcccugg

SEQ ID NO: 2290036 - RNA, 16 nt, Human
ccacgagggucaggac

SEQ ID NO: 2290037 - RNA, 18 nt, Human
ccacgauguggcccuggc

SEQ ID NO: 2290038 - RNA, 13 nt, Human
ccacgcacuccau

SEQ ID NO: 2290039 - RNA, 13 nt, Human
ccacgcccccacu

SEQ ID NO: 2290040 - RNA, 21 nt, Human
ccacacuggacuccggcccuc

SEQ ID NO: 2290041 - RNA, 22 nt, Human
ccacacuggacuccggcccucc

SEQ ID NO: 2290042 - RNA, 19 nt, Human
ccacacuggggugccgccu

SEQ ID NO: 2290043 - RNA, 20 nt, Human
ccacacuggggugccgccug

SEQ ID NO: 2290044 - RNA, 16 nt, Human
ccacacuucaggcucu

SEQ ID NO: 2290045 - RNA, 20 nt, Human
ccacacuucaggcucuucuc

SEQ ID NO: 2290046 - RNA, 13 nt, Human
ccacacuggugac

SEQ ID NO: 2290047 - RNA, 22 nt, Human
ccacacuggggugccgccugcc

SEQ ID NO: 2290048 - RNA, 23 nt, Human
ccacacuggggugccgccugccc

SEQ ID NO: 2290049 - RNA, 14 nt, Human
ccacacuggugacu

SEQ ID NO: 2290050 - RNA, 21 nt, Human
ccacacuucaggcucuucucc

SEQ ID NO: 2290051 - RNA, 20 nt, Human
ccacagaagccaggagcaaa

SEQ ID NO: 2290052 - RNA, 21 nt, Human
ccacagaagccaggagcaaau

SEQ ID NO: 2290053 - RNA, 22 nt, Human
ccacagaagccaggagcaaaug

SEQ ID NO: 2290054 - RNA, 16 nt, Human
ccacagaagcuccagg

SEQ ID NO: 2290055 - RNA, 21 nt, Human
ccacagacaagguagcccugg

SEQ ID NO: 2290056 - RNA, 11 nt, Human
ccacagacaca

SEQ ID NO: 2290057 - RNA, 12 nt, Human
ccacagacacac

SEQ ID NO: 2290058 - RNA, 15 nt, Human
ccacagacaagguag

SEQ ID NO: 2290059 - RNA, 18 nt, Human
ccacagaagcuccaggua

SEQ ID NO: 2290060 - RNA, 22 nt, Human
ccacagagaaaguacuucucca

SEQ ID NO: 2290061 - RNA, 21 nt, Human
ccacagacacacacacgcacg

SEQ ID NO: 2290062 - RNA, 13 nt, Human
ccacagacacaca

SEQ ID NO: 2290063 - RNA, 14 nt, Human
ccacagacacacac

SEQ ID NO: 2290064 - RNA, 15 nt, Human
ccacagacacacaca

SEQ ID NO: 2290065 - RNA, 20 nt, Human
ccacagacacacacacgcac

SEQ ID NO: 2290066 - RNA, 15 nt, Human
ccacagcccugucag

SEQ ID NO: 2290067 - RNA, 14 nt, Human
ccacagcccuguca

SEQ ID NO: 2290068 - RNA, 13 nt, Human
ccacagcccuguc

SEQ ID NO: 2290069 - RNA, 21 nt, Human
ccacagcccacguccugucag

SEQ ID NO: 2290070 - RNA, 14 nt, Human
ccacagcccacguc

SEQ ID NO: 2290071 - RNA, 17 nt, Human
ccacagcccacguccug

SEQ ID NO: 2290072 - RNA, 18 nt, Human
ccacagcccacguccugu

SEQ ID NO: 2290073 - RNA, 19 nt, Human
ccacagcccacguccuguc

SEQ ID NO: 2290074 - RNA, 19 nt, Human
ccacagagagucccacugc

SEQ ID NO: 2290075 - RNA, 14 nt, Human
ccacagagcgggga

SEQ ID NO: 2290076 - RNA, 13 nt, Human
ccacagagagucc

SEQ ID NO: 2290077 - RNA, 18 nt, Human
ccacagagagucccacug

SEQ ID NO: 2290078 - RNA, 20 nt, Human
ccacagccaucccagccuug

SEQ ID NO: 2290079 - RNA, 13 nt, Human
ccacagccauccc

SEQ ID NO: 2290080 - RNA, 20 nt, Human
ccacagcccugucagugcag

SEQ ID NO: 2290081 - RNA, 21 nt, Human
ccacagcccugucagugcagc

SEQ ID NO: 2290082 - RNA, 23 nt, Human
ccacagcccugucagugcagccc

SEQ ID NO: 2290083 - RNA, 18 nt, Human
ccacagccgcagccuccc

SEQ ID NO: 2290084 - RNA, 16 nt, Human
ccaccaccccccacuc

SEQ ID NO: 2290085 - RNA, 20 nt, Human
ccaccaccccccacucugug

SEQ ID NO: 2290086 - RNA, 15 nt, Human
ccacagccgcagccu

SEQ ID NO: 2290087 - RNA, 12 nt, Human
ccacagccgcag

SEQ ID NO: 2290088 - RNA, 22 nt, Human
ccaccaccuaggccacuccucc

SEQ ID NO: 2290089 - RNA, 12 nt, Human
ccaccaccuccc

SEQ ID NO: 2290090 - RNA, 21 nt, Human
ccaccaccuaggccacuccuc

SEQ ID NO: 2290091 - RNA, 20 nt, Human
ccaccaccuaggccacuccu

SEQ ID NO: 2290092 - RNA, 18 nt, Human
ccaccaccuaggccacuc

SEQ ID NO: 2290093 - RNA, 12 nt, Human
ccaccaccuagg

SEQ ID NO: 2290094 - RNA, 24 nt, Human
ccaccaccccccacucugugccug

SEQ ID NO: 2290095 - RNA, 13 nt, Human
ccaccacccugag

SEQ ID NO: 2290096 - RNA, 20 nt, Human
ccaccacgauguggcccugg

SEQ ID NO: 2290097 - RNA, 19 nt, Human
ccaccacgauguggcccug

SEQ ID NO: 2290098 - RNA, 17 nt, Human
ccaccaccucccucacc

SEQ ID NO: 2290099 - RNA, 15 nt, Human
ccaccacgcccggcu

SEQ ID NO: 2290100 - RNA, 21 nt, Human
ccaccaggcuggcgcagccaa

SEQ ID NO: 2290101 - RNA, 23 nt, Human
ccaccaggcuggcgcagccaagg

SEQ ID NO: 2290102 - RNA, 18 nt, Human
ccaccagucugacuguuu

SEQ ID NO: 2290103 - RNA, 22 nt, Human
ccaccaggcugcucagggcugg

SEQ ID NO: 2290104 - RNA, 14 nt, Human
ccaccacuggccac

SEQ ID NO: 2290105 - RNA, 15 nt, Human
ccaccacuggccacc

SEQ ID NO: 2290106 - RNA, 12 nt, Human
ccaccaggcugg

SEQ ID NO: 2290107 - RNA, 18 nt, Human
ccaccaggcuggcgcagc

SEQ ID NO: 2290108 - RNA, 19 nt, Human
ccaccaggcuggcgcagcc

SEQ ID NO: 2290109 - RNA, 20 nt, Human
ccaccaggcuggcgcagcca

SEQ ID NO: 2290110 - RNA, 20 nt, Human
ccaccacuaggacucugagg

SEQ ID NO: 2290111 - RNA, 17 nt, Human
ccaccacuaggacucug

SEQ ID NO: 2290112 - RNA, 21 nt, Human
ccaccacgauguggcccuggc

SEQ ID NO: 2290113 - RNA, 16 nt, Human
ccaccacggccacugg

SEQ ID NO: 2290114 - RNA, 19 nt, Human
ccaccacggccacuggcca

SEQ ID NO: 2290115 - RNA, 20 nt, Human
ccacuccucugacucagggc

SEQ ID NO: 2290116 - RNA, 13 nt, Human
ccacuccucugac

SEQ ID NO: 2290117 - RNA, 14 nt, Human
ccacuccucugacu

SEQ ID NO: 2290118 - RNA, 23 nt, Human
cauugcuuugaagcaguuguguc

SEQ ID NO: 2290119 - RNA, 15 nt, Human
cauugcuuucugaaa

SEQ ID NO: 2290120 - RNA, 16 nt, Human
cauugcuuugaagcag

SEQ ID NO: 2290121 - RNA, 18 nt, Human
cauugcuuugaagcaguu

SEQ ID NO: 2290122 - RNA, 22 nt, Human
cauugcuuugaagcaguugugu

SEQ ID NO: 2290123 - RNA, 14 nt, Human
cauugcuuucugaa

SEQ ID NO: 2290124 - RNA, 12 nt, Human
cauugcuuucug

SEQ ID NO: 2290125 - RNA, 17 nt, Human
cauugcuuuacugucaa

SEQ ID NO: 2290126 - RNA, 22 nt, Human
cauugcuugugccacacccucc

SEQ ID NO: 2290127 - RNA, 13 nt, Human
cauuguaaaccac

SEQ ID NO: 2290128 - RNA, 21 nt, Human
cauuguaaaccacaaggcugu

SEQ ID NO: 2290129 - RNA, 19 nt, Human
cauuguaaauaguauuuga

SEQ ID NO: 2290130 - RNA, 17 nt, Human
cauuuauaauguuugcu

SEQ ID NO: 2290131 - RNA, 14 nt, Human
cauuuauaauguuu

SEQ ID NO: 2290132 - RNA, 21 nt, Human
cauuuauaaagcuaaaauaac

SEQ ID NO: 2290133 - RNA, 18 nt, Human
cauuuauaaagcuaaaau

SEQ ID NO: 2290134 - RNA, 23 nt, Human
cauuuaguuugauuauucagugu

SEQ ID NO: 2290135 - RNA, 21 nt, Human
cauuuauaauguuugcuauug

SEQ ID NO: 2290136 - RNA, 15 nt, Human
cauuuauacaaauua

SEQ ID NO: 2290137 - RNA, 12 nt, Human
cauuuauacaaa

SEQ ID NO: 2290138 - RNA, 20 nt, Human
cauuuauacaaauuagaaaa

SEQ ID NO: 2290139 - RNA, 19 nt, Human
cauuuauacaaauuagaaa

SEQ ID NO: 2290140 - RNA, 18 nt, Human
cauuuauacaaauuagaa

SEQ ID NO: 2290141 - RNA, 17 nt, Human
cauuuauacaaauuaga

SEQ ID NO: 2290142 - RNA, 12 nt, Human
cauuuauauauu

SEQ ID NO: 2290143 - RNA, 13 nt, Human
cauuuauauauug

SEQ ID NO: 2290144 - RNA, 11 nt, Human
cauuuauacuc

SEQ ID NO: 2290145 - RNA, 15 nt, Human
cauuuauacucuuuu

SEQ ID NO: 2290146 - RNA, 13 nt, Human
cauuuauauagau

SEQ ID NO: 2290147 - RNA, 15 nt, Human
cauugguucuuguau

SEQ ID NO: 2290148 - RNA, 16 nt, Human
cauuggaagaccccac

SEQ ID NO: 2290149 - RNA, 18 nt, Human
cauugguucuuguauuaa

SEQ ID NO: 2290150 - RNA, 15 nt, Human
cauuggaagacccca

SEQ ID NO: 2290151 - RNA, 22 nt, Human
cauugguucuuguauuaagaau

SEQ ID NO: 2290152 - RNA, 14 nt, Human
cauuuauucugcuc

SEQ ID NO: 2290153 - RNA, 15 nt, Human
cauuuauucugcuca

SEQ ID NO: 2290154 - RNA, 23 nt, Human
cauuuaugauuuaauaaaauaau

SEQ ID NO: 2290155 - RNA, 17 nt, Human
cauuuaugauuuaauaa

SEQ ID NO: 2290156 - RNA, 18 nt, Human
cauuuaugauuuaauaaa

SEQ ID NO: 2290157 - RNA, 20 nt, Human
cauuuaugauuuaauaaaau

SEQ ID NO: 2290158 - RNA, 21 nt, Human
cauuuaugauuuaauaaaaua

SEQ ID NO: 2290159 - RNA, 15 nt, Human
cauuuauauauugaa

SEQ ID NO: 2290160 - RNA, 22 nt, Human
cauuuauauauugaauuaauau

SEQ ID NO: 2290161 - RNA, 14 nt, Human
cauuuauguuuauu

SEQ ID NO: 2290162 - RNA, 20 nt, Human
cauuuauggucaacacuuaa

SEQ ID NO: 2290163 - RNA, 15 nt, Human
cauuucaggagcagc

SEQ ID NO: 2290164 - RNA, 21 nt, Human
cauuuauggucaacacuuaag

SEQ ID NO: 2290165 - RNA, 16 nt, Human
cauuucaggagcagcc

SEQ ID NO: 2290166 - RNA, 22 nt, Human
cauuucaggagcagccucagaa

SEQ ID NO: 2290167 - RNA, 13 nt, Human
cauuucaggaggg

SEQ ID NO: 2290168 - RNA, 18 nt, Human
cauuucaucuauuucuga

SEQ ID NO: 2290169 - RNA, 17 nt, Human
cauuucaucuauuucug

SEQ ID NO: 2290170 - RNA, 16 nt, Human
cauuucaucuauuucu

SEQ ID NO: 2290171 - RNA, 15 nt, Human
cauuucaucuauuuc

SEQ ID NO: 2290172 - RNA, 14 nt, Human
cauuucaucuauuu

SEQ ID NO: 2290173 - RNA, 20 nt, Human
cauuucaucuauuucugaga

SEQ ID NO: 2290174 - RNA, 15 nt, Human
cauuucauuccuaac

SEQ ID NO: 2290175 - RNA, 21 nt, Human
cauuucauuccuaacacagca

SEQ ID NO: 2290176 - RNA, 18 nt, Human
cauuucauuccuaacaca

SEQ ID NO: 2290177 - RNA, 17 nt, Human
cauuuggaauacuuuuu

SEQ ID NO: 2290178 - RNA, 12 nt, Human
cauuucauugua

SEQ ID NO: 2290179 - RNA, 15 nt, Human
cauuuggaauacuuu

SEQ ID NO: 2290180 - RNA, 21 nt, Human
cauuuggagacacaacuauuu

SEQ ID NO: 2290181 - RNA, 15 nt, Human
cauuuggauuggaug

SEQ ID NO: 2290182 - RNA, 23 nt, Human
cauuuggaguguuccccuuccac

SEQ ID NO: 2290183 - RNA, 23 nt, Human
cauuuggauuggggucccucuaa

SEQ ID NO: 2290184 - RNA, 14 nt, Human
cauuuggauugggg

SEQ ID NO: 2290185 - RNA, 20 nt, Human
cauuuggcaaugccaucauc

SEQ ID NO: 2290186 - RNA, 17 nt, Human
cauuugucacacacuuu

SEQ ID NO: 2290187 - RNA, 22 nt, Human
cauuugucuauucuccagcuga

SEQ ID NO: 2290188 - RNA, 16 nt, Human
cauuugugaaaugaug

SEQ ID NO: 2290189 - RNA, 14 nt, Human
cauuugugaaauga

SEQ ID NO: 2290190 - RNA, 17 nt, Human
cauuuuuuaaggaaaca

SEQ ID NO: 2290191 - RNA, 18 nt, Human
cauuuuuuaaggaaacaa

SEQ ID NO: 2290192 - RNA, 19 nt, Human
cauuuuuuaaaugcaccug

SEQ ID NO: 2290193 - RNA, 16 nt, Human
cauuuuuuaaaugcac

SEQ ID NO: 2290194 - RNA, 15 nt, Human
cauuuuuuaaaugca

SEQ ID NO: 2290195 - RNA, 18 nt, Human
ccaaucccagcuaccuca

SEQ ID NO: 2290196 - RNA, 16 nt, Human
ccaauccccuccuugg

SEQ ID NO: 2290197 - RNA, 17 nt, Human
ccaauccccuccuuggg

SEQ ID NO: 2290198 - RNA, 16 nt, Human
ccaaggccaaaggaag

SEQ ID NO: 2290199 - RNA, 18 nt, Human
ccaauccucacugggugg

SEQ ID NO: 2290200 - RNA, 17 nt, Human
ccaauccucacugggug

SEQ ID NO: 2290201 - RNA, 12 nt, Human
ccaauccugccc

SEQ ID NO: 2290202 - RNA, 18 nt, Human
ccaaucuaaccacaucaa

SEQ ID NO: 2290203 - RNA, 15 nt, Human
ccaauccucacuggg

SEQ ID NO: 2290204 - RNA, 14 nt, Human
ccaauccuauguuu

SEQ ID NO: 2290205 - RNA, 21 nt, Human
ccaauccccuccuugggcacu

SEQ ID NO: 2290206 - RNA, 13 nt, Human
ccaauccuauguu

SEQ ID NO: 2290207 - RNA, 13 nt, Human
ccaauccugcccc

SEQ ID NO: 2290208 - RNA, 15 nt, Human
ccaaugaaaaaaugu

SEQ ID NO: 2290209 - RNA, 23 nt, Human
ccaaugaaaaaauguauaugcac

SEQ ID NO: 2290210 - RNA, 23 nt, Human
ccaaugaaauacacaaguaaaca

SEQ ID NO: 2290211 - RNA, 24 nt, Human
ccaacggcaagggaacaaguacuu

SEQ ID NO: 2290212 - RNA, 22 nt, Human
ccaacggagagcgccugccccu

SEQ ID NO: 2290213 - RNA, 14 nt, Human
ccaagaaacgucuu

SEQ ID NO: 2290214 - RNA, 18 nt, Human
ccaagaaacugagaccaa

SEQ ID NO: 2290215 - RNA, 13 nt, Human
ccaagaaagcagg

SEQ ID NO: 2290216 - RNA, 13 nt, Human
ccaagaagcccag

SEQ ID NO: 2290217 - RNA, 21 nt, Human
ccaacggagagcgccugcccc

SEQ ID NO: 2290218 - RNA, 22 nt, Human
ccaaaugcuuuaaaaacuauuu

SEQ ID NO: 2290219 - RNA, 22 nt, Human
ccaaauggaaaugggcagagca

SEQ ID NO: 2290220 - RNA, 13 nt, Human
ccaacgucugugc

SEQ ID NO: 2290221 - RNA, 15 nt, Human
ccaacgucugugcca

SEQ ID NO: 2290222 - RNA, 21 nt, Human
ccaaggcagaagcagcagggg

SEQ ID NO: 2290223 - RNA, 17 nt, Human
ccaaggcaaggcaggug

SEQ ID NO: 2290224 - RNA, 22 nt, Human
ccaaggcaaggcaggugccucc

SEQ ID NO: 2290225 - RNA, 23 nt, Human
ccaaggcaaggcaggugccucca

SEQ ID NO: 2290226 - RNA, 15 nt, Human
ccaaggccaaaggaa

SEQ ID NO: 2290227 - RNA, 18 nt, Human
ccaaggaugccccguccc

SEQ ID NO: 2290228 - RNA, 22 nt, Human
ccaagcugggccccagcccacc

SEQ ID NO: 2290229 - RNA, 13 nt, Human
ccaaggcaaggca

SEQ ID NO: 2290230 - RNA, 15 nt, Human
ccaaggcaaggcagg

SEQ ID NO: 2290231 - RNA, 16 nt, Human
ccaaggcaaggcaggu

SEQ ID NO: 2290232 - RNA, 18 nt, Human
ccaagcugggccccagcc

SEQ ID NO: 2290233 - RNA, 19 nt, Human
ccaagcugggccccagccc

SEQ ID NO: 2290234 - RNA, 20 nt, Human
ccaagcugggccccagccca

SEQ ID NO: 2290235 - RNA, 21 nt, Human
ccaagcugggccccagcccac

SEQ ID NO: 2290236 - RNA, 12 nt, Human
ccaagcuggucc

SEQ ID NO: 2290237 - RNA, 19 nt, Human
ccaagcuggucccacucag

SEQ ID NO: 2290238 - RNA, 14 nt, Human
ccaagaagcccagg

SEQ ID NO: 2290239 - RNA, 11 nt, Human
ccaagcugggc

SEQ ID NO: 2290240 - RNA, 12 nt, Human
ccaagcugggcc

SEQ ID NO: 2290241 - RNA, 13 nt, Human
ccaagcugggccc

SEQ ID NO: 2290242 - RNA, 15 nt, Human
ccaagcugggcccca

SEQ ID NO: 2290243 - RNA, 16 nt, Human
ccaagcugggccccag

SEQ ID NO: 2290244 - RNA, 17 nt, Human
ccaagcugggccccagc

SEQ ID NO: 2290245 - RNA, 22 nt, Human
ccaaagugguauagaaaugcug

SEQ ID NO: 2290246 - RNA, 11 nt, Human
ccaaauaaaaa

SEQ ID NO: 2290247 - RNA, 16 nt, Human
ccaaauaaaaacuaaa

SEQ ID NO: 2290248 - RNA, 20 nt, Human
ccaaauaaaaacuaaauugu

SEQ ID NO: 2290249 - RNA, 15 nt, Human
ccaaauaagaaaccu

SEQ ID NO: 2290250 - RNA, 16 nt, Human
ccaaauaagaaaccua

SEQ ID NO: 2290251 - RNA, 17 nt, Human
ccaaauaagaaaccuaa

SEQ ID NO: 2290252 - RNA, 13 nt, Human
ccaaauauguccu

SEQ ID NO: 2290253 - RNA, 12 nt, Human
ccaaaugcagcu

SEQ ID NO: 2290254 - RNA, 15 nt, Human
ccaaauauguccugg

SEQ ID NO: 2290255 - RNA, 15 nt, Human
ccaaauaaugucucu

SEQ ID NO: 2290256 - RNA, 16 nt, Human
ccaaauaaugucucug

SEQ ID NO: 2290257 - RNA, 17 nt, Human
ccaaauaaugucucugu

SEQ ID NO: 2290258 - RNA, 17 nt, Human
ccaaaugcauggugcag

SEQ ID NO: 2290259 - RNA, 22 nt, Human
ccaaaugcauggugcaguugac

SEQ ID NO: 2290260 - RNA, 15 nt, Human
ccaaaugcuuuaaaa

SEQ ID NO: 2290261 - RNA, 18 nt, Human
ccaaaugcagcuuuaaaa

SEQ ID NO: 2290262 - RNA, 15 nt, Human
ccaaaugcagcuuua

SEQ ID NO: 2290263 - RNA, 13 nt, Human
ccaaaugcagcuu

SEQ ID NO: 2290264 - RNA, 22 nt, Human
cauuaugagaggcaaugauugu

SEQ ID NO: 2290265 - RNA, 14 nt, Human
cauuccuucuuuga

SEQ ID NO: 2290266 - RNA, 12 nt, Human
cauuccuguucc

SEQ ID NO: 2290267 - RNA, 13 nt, Human
cauuccuugccug

SEQ ID NO: 2290268 - RNA, 23 nt, Human
cauuccuucuuugauaauguuaa

SEQ ID NO: 2290269 - RNA, 15 nt, Human
cauuccuucuuugau

SEQ ID NO: 2290270 - RNA, 16 nt, Human
cauuccuucuuugaua

SEQ ID NO: 2290271 - RNA, 18 nt, Human
cauuccuucuuugauaau

SEQ ID NO: 2290272 - RNA, 19 nt, Human
cauuccuucuuugauaaug

SEQ ID NO: 2290273 - RNA, 13 nt, Human
cauucggcucccu

SEQ ID NO: 2290274 - RNA, 13 nt, Human
cauucucacuccu

SEQ ID NO: 2290275 - RNA, 14 nt, Human
cauucucaagcccu

SEQ ID NO: 2290276 - RNA, 16 nt, Human
cauucucaagcccugc

SEQ ID NO: 2290277 - RNA, 17 nt, Human
cauucucaagcccugca

SEQ ID NO: 2290278 - RNA, 19 nt, Human
cauucggcucccuggagcc

SEQ ID NO: 2290279 - RNA, 15 nt, Human
cauucggcucccugg

SEQ ID NO: 2290280 - RNA, 18 nt, Human
cauucggcucccuggagc

SEQ ID NO: 2290281 - RNA, 18 nt, Human
cauucuagguuugcaaga

SEQ ID NO: 2290282 - RNA, 14 nt, Human
cauucuauuguuaa

SEQ ID NO: 2290283 - RNA, 14 nt, Human
cauucucacuccua

SEQ ID NO: 2290284 - RNA, 16 nt, Human
cauguugcugaggagu

SEQ ID NO: 2290285 - RNA, 13 nt, Human
cauguugcugcca

SEQ ID NO: 2290286 - RNA, 14 nt, Human
cauguugcugagga

SEQ ID NO: 2290287 - RNA, 15 nt, Human
cauguugcugaggag

SEQ ID NO: 2290288 - RNA, 22 nt, Human
cauuaggugugacugaauuucu

SEQ ID NO: 2290289 - RNA, 17 nt, Human
cauuagggggaacucua

SEQ ID NO: 2290290 - RNA, 16 nt, Human
cauuaugagaggcaau

SEQ ID NO: 2290291 - RNA, 13 nt, Human
cauuaucucaaaa

SEQ ID NO: 2290292 - RNA, 23 nt, Human
cauuaucuagauacuguaucaug

SEQ ID NO: 2290293 - RNA, 12 nt, Human
cauuaucucaaa

SEQ ID NO: 2290294 - RNA, 12 nt, Human
cauguuggccag

SEQ ID NO: 2290295 - RNA, 13 nt, Human
cauguuggccagg

SEQ ID NO: 2290296 - RNA, 19 nt, Human
cauguugagccaggccugg

SEQ ID NO: 2290297 - RNA, 18 nt, Human
caugucagcaucagcuca

SEQ ID NO: 2290298 - RNA, 16 nt, Human
caugucaggccugugu

SEQ ID NO: 2290299 - RNA, 20 nt, Human
cauguccccaaaccugcaag

SEQ ID NO: 2290300 - RNA, 23 nt, Human
cauguugcacacccacucagcuc

SEQ ID NO: 2290301 - RNA, 22 nt, Human
cauguugcacacccacucagcu

SEQ ID NO: 2290302 - RNA, 18 nt, Human
cauguugcacacccacuc

SEQ ID NO: 2290303 - RNA, 18 nt, Human
cauguccaagaagcccag

SEQ ID NO: 2290304 - RNA, 18 nt, Human
caugucagcaaaaagcaa

SEQ ID NO: 2290305 - RNA, 20 nt, Human
caugucagcaaaaagcaaaa

SEQ ID NO: 2290306 - RNA, 22 nt, Human
caugucagcaaaaagcaaaauc

SEQ ID NO: 2290307 - RNA, 23 nt, Human
caugucagcaaaaagcaaaauca

SEQ ID NO: 2290308 - RNA, 21 nt, Human
caugucaggccugugugugaa

SEQ ID NO: 2290309 - RNA, 19 nt, Human
cauguccaagaagcccagg

SEQ ID NO: 2290310 - RNA, 20 nt, Human
cauguccaagaagcccagga

SEQ ID NO: 2290311 - RNA, 15 nt, Human
cauguauaauauuuu

SEQ ID NO: 2290312 - RNA, 18 nt, Human
cauguauaauauuuuuaa

SEQ ID NO: 2290313 - RNA, 20 nt, Human
cauguauaauauuuuuaauu

SEQ ID NO: 2290314 - RNA, 19 nt, Human
cauguaguaucaaauauua

SEQ ID NO: 2290315 - RNA, 20 nt, Human
cauguaguaucaaauauuag

SEQ ID NO: 2290316 - RNA, 21 nt, Human
cauguaguaucaaauauuaga

SEQ ID NO: 2290317 - RNA, 22 nt, Human
cauguaguaucaaauauuagau

SEQ ID NO: 2290318 - RNA, 16 nt, Human
cauguaguaucaaaua

SEQ ID NO: 2290319 - RNA, 17 nt, Human
cauguaguaucaaauau

SEQ ID NO: 2290320 - RNA, 18 nt, Human
cauguaguaucaaauauu

SEQ ID NO: 2290321 - RNA, 20 nt, Human
caugucaccggauccugggu

SEQ ID NO: 2290322 - RNA, 20 nt, Human
caugucaccguggaccuucc

SEQ ID NO: 2290323 - RNA, 22 nt, Human
caugucaccguggaccuuccug

SEQ ID NO: 2290324 - RNA, 23 nt, Human
caugucaccguggaccuuccugc

SEQ ID NO: 2290325 - RNA, 13 nt, Human
caugucacugugg

SEQ ID NO: 2290326 - RNA, 14 nt, Human
caugucacuguggu

SEQ ID NO: 2290327 - RNA, 15 nt, Human
caugucacugugguc

SEQ ID NO: 2290328 - RNA, 16 nt, Human
caugucacuguggucc

SEQ ID NO: 2290329 - RNA, 14 nt, Human
caugucagcaaaaa

SEQ ID NO: 2290330 - RNA, 16 nt, Human
caugucagcaaaaagc

SEQ ID NO: 2290331 - RNA, 17 nt, Human
caugucagcaaaaagca

SEQ ID NO: 2290332 - RNA, 21 nt, Human
cauguaucccaacuccuauaa

SEQ ID NO: 2290333 - RNA, 14 nt, Human
cauguaucuaccuc

SEQ ID NO: 2290334 - RNA, 15 nt, Human
cauguaucaucugga

SEQ ID NO: 2290335 - RNA, 20 nt, Human
cauguaucuaugcauuuucu

SEQ ID NO: 2290336 - RNA, 18 nt, Human
caugucaacuucuggcuc

SEQ ID NO: 2290337 - RNA, 22 nt, Human
caugucaacuucuggcuccuca

SEQ ID NO: 2290338 - RNA, 15 nt, Human
caugaagguuucuga

SEQ ID NO: 2290339 - RNA, 16 nt, Human
caugaaggugucauac

SEQ ID NO: 2290340 - RNA, 18 nt, Human
caugaagguuucugaaaa

SEQ ID NO: 2290341 - RNA, 21 nt, Human
caugacacgaauauugcugau

SEQ ID NO: 2290342 - RNA, 18 nt, Human
caugaaguuuccuuggcu

SEQ ID NO: 2290343 - RNA, 20 nt, Human
caugaaguguguuuccuuca

SEQ ID NO: 2290344 - RNA, 19 nt, Human
caugaagucguugugaggg

SEQ ID NO: 2290345 - RNA, 23 nt, Human
caugacacgaauauugcugaugg

SEQ ID NO: 2290346 - RNA, 23 nt, Human
caugaaguaauaugcacacauuu

SEQ ID NO: 2290347 - RNA, 22 nt, Human
caugaaguaauaugcacacauu

SEQ ID NO: 2290348 - RNA, 19 nt, Human
caugaaguaauaugcacac

SEQ ID NO: 2290349 - RNA, 15 nt, Human
caugaaguaauaugc

SEQ ID NO: 2290350 - RNA, 22 nt, Human
caugaagcccaagugaaaucaa

SEQ ID NO: 2290351 - RNA, 22 nt, Human
caugaaggaugccaagaaguuu

SEQ ID NO: 2290352 - RNA, 24 nt, Human
caugauuaaccacuucagcugacu

SEQ ID NO: 2290353 - RNA, 12 nt, Human
caugcacaaauu

SEQ ID NO: 2290354 - RNA, 18 nt, Human
caugcaauuuauuaaaau

SEQ ID NO: 2290355 - RNA, 22 nt, Human
caugaaguuuccuuggcuggug

SEQ ID NO: 2290356 - RNA, 14 nt, Human
caugcacaccuccc

SEQ ID NO: 2290357 - RNA, 23 nt, Human
caugauuaaccacuucagcugac

SEQ ID NO: 2290358 - RNA, 22 nt, Human
caugauuaaccacuucagcuga

SEQ ID NO: 2290359 - RNA, 20 nt, Human
caugaaguuuccuuggcugg

SEQ ID NO: 2290360 - RNA, 15 nt, Human
caugacauguuauau

SEQ ID NO: 2290361 - RNA, 12 nt, Human
caugacauguua

SEQ ID NO: 2290362 - RNA, 13 nt, Human
caugcuccuggcc

SEQ ID NO: 2290363 - RNA, 12 nt, Human
caugcugcccug

SEQ ID NO: 2290364 - RNA, 13 nt, Human
caugcugcccugu

SEQ ID NO: 2290365 - RNA, 23 nt, Human
caugcuaucucugugugcacaaa

SEQ ID NO: 2290366 - RNA, 16 nt, Human
caugcacgugugugca

SEQ ID NO: 2290367 - RNA, 23 nt, Human
caugcucagcccugacuggugcu

SEQ ID NO: 2290368 - RNA, 18 nt, Human
caugcucaucugcugguc

SEQ ID NO: 2290369 - RNA, 19 nt, Human
caugcucaucugcuggucc

SEQ ID NO: 2290370 - RNA, 15 nt, Human
caugcucagcccuga

SEQ ID NO: 2290371 - RNA, 20 nt, Human
caugcucagcccugacuggu

SEQ ID NO: 2290372 - RNA, 16 nt, Human
caugcucaucugcugg

SEQ ID NO: 2290373 - RNA, 17 nt, Human
caugcucaucugcuggu

SEQ ID NO: 2290374 - RNA, 19 nt, Human
cauggcaucaccuccacca

SEQ ID NO: 2290375 - RNA, 14 nt, Human
caugcugcccugug

SEQ ID NO: 2290376 - RNA, 15 nt, Human
caugcugcccuguga

SEQ ID NO: 2290377 - RNA, 14 nt, Human
cauggccagguggc

SEQ ID NO: 2290378 - RNA, 13 nt, Human
cauggccaggugg

SEQ ID NO: 2290379 - RNA, 18 nt, Human
cauggccaccuuuucagc

SEQ ID NO: 2290380 - RNA, 22 nt, Human
cauggccacuugggucuucccu

SEQ ID NO: 2290381 - RNA, 14 nt, Human
cauccccuggacug

SEQ ID NO: 2290382 - RNA, 19 nt, Human
cauccccgcagugugcacu

SEQ ID NO: 2290383 - RNA, 19 nt, Human
caucccccugcccucgugg

SEQ ID NO: 2290384 - RNA, 14 nt, Human
cauccccuguagag

SEQ ID NO: 2290385 - RNA, 19 nt, Human
cauccccuggacugggagg

SEQ ID NO: 2290386 - RNA, 15 nt, Human
cauccuguguuucua

SEQ ID NO: 2290387 - RNA, 21 nt, Human
cauccuucaagaacucugggc

SEQ ID NO: 2290388 - RNA, 22 nt, Human
cauccuguguuucuagggaaau

SEQ ID NO: 2290389 - RNA, 21 nt, Human
cauccuguguuucuagggaaa

SEQ ID NO: 2290390 - RNA, 12 nt, Human
cauccccccuca

SEQ ID NO: 2290391 - RNA, 21 nt, Human
cauccccauccuccagcuucu

SEQ ID NO: 2290392 - RNA, 12 nt, Human
caucccaucauc

SEQ ID NO: 2290393 - RNA, 23 nt, Human
caucccaguggccucaacccucc

SEQ ID NO: 2290394 - RNA, 20 nt, Human
caucccaguggccucaaccc

SEQ ID NO: 2290395 - RNA, 13 nt, Human
caucccaguggcc

SEQ ID NO: 2290396 - RNA, 13 nt, Human
cauccccccucac

SEQ ID NO: 2290397 - RNA, 14 nt, Human
cauccccccucacc

SEQ ID NO: 2290398 - RNA, 17 nt, Human
cauccccccucaccagg

SEQ ID NO: 2290399 - RNA, 18 nt, Human
cauccccccucaccaggg

SEQ ID NO: 2290400 - RNA, 11 nt, Human
caucccccugc

SEQ ID NO: 2290401 - RNA, 12 nt, Human
caucccccugcc

SEQ ID NO: 2290402 - RNA, 13 nt, Human
caucccccugccc

SEQ ID NO: 2290403 - RNA, 14 nt, Human
caucccccugcccu

SEQ ID NO: 2290404 - RNA, 19 nt, Human
caucccaggggaccacacc

SEQ ID NO: 2290405 - RNA, 14 nt, Human
caucccaggggacc

SEQ ID NO: 2290406 - RNA, 13 nt, Human
caucccaggggac

SEQ ID NO: 2290407 - RNA, 19 nt, Human
caucccaggcuucacccug

SEQ ID NO: 2290408 - RNA, 21 nt, Human
caucccaggacaccacaccca

SEQ ID NO: 2290409 - RNA, 22 nt, Human
caucccaggacaccacacccag

SEQ ID NO: 2290410 - RNA, 23 nt, Human
caucccaggacaccacacccagc

SEQ ID NO: 2290411 - RNA, 19 nt, Human
caucccauaugccugggca

SEQ ID NO: 2290412 - RNA, 15 nt, Human
cauccuucccugucu

SEQ ID NO: 2290413 - RNA, 21 nt, Human
cauccuucccugucugccagg

SEQ ID NO: 2290414 - RNA, 18 nt, Human
cauccuuccucacaccag

SEQ ID NO: 2290415 - RNA, 23 nt, Human
cauccuucaagaacucugggcug

SEQ ID NO: 2290416 - RNA, 22 nt, Human
cauccuucaagaacucugggcu

SEQ ID NO: 2290417 - RNA, 11 nt, Human
cauccuuaaag

SEQ ID NO: 2290418 - RNA, 22 nt, Human
cauccuucccugucugccaggg

SEQ ID NO: 2290419 - RNA, 14 nt, Human
cauccuuccuuccc

SEQ ID NO: 2290420 - RNA, 15 nt, Human
cauccuuccuuccca

SEQ ID NO: 2290421 - RNA, 16 nt, Human
cauccuuccuucccac

SEQ ID NO: 2290422 - RNA, 17 nt, Human
cauccuuccuucccacc

SEQ ID NO: 2290423 - RNA, 19 nt, Human
caucugccccucccccaac

SEQ ID NO: 2290424 - RNA, 20 nt, Human
caucugccgugccuggaucc

SEQ ID NO: 2290425 - RNA, 18 nt, Human
caucugccuuaaaaccaa

SEQ ID NO: 2290426 - RNA, 20 nt, Human
caucugccuuaaaaccaaag

SEQ ID NO: 2290427 - RNA, 12 nt, Human
caucugcuaaua

SEQ ID NO: 2290428 - RNA, 22 nt, Human
caucugcgugacaauaaaacau

SEQ ID NO: 2290429 - RNA, 23 nt, Human
caucugcgugacaauaaaacauu

SEQ ID NO: 2290430 - RNA, 16 nt, Human
caucugcgugacaaua

SEQ ID NO: 2290431 - RNA, 18 nt, Human
caucugcgugacaauaaa

SEQ ID NO: 2290432 - RNA, 19 nt, Human
caucugcgugacaauaaaa

SEQ ID NO: 2290433 - RNA, 21 nt, Human
caucugggaagauuucuaccu

SEQ ID NO: 2290434 - RNA, 14 nt, Human
caucugggaaagac

SEQ ID NO: 2290435 - RNA, 18 nt, Human
caucugggaguccccuuu

SEQ ID NO: 2290436 - RNA, 16 nt, Human
caucugggauucccac

SEQ ID NO: 2290437 - RNA, 19 nt, Human
caucugggaguccccuuuu

SEQ ID NO: 2290438 - RNA, 15 nt, Human
caucugggauuccca

SEQ ID NO: 2290439 - RNA, 13 nt, Human
caucugcucuccu

SEQ ID NO: 2290440 - RNA, 14 nt, Human
caucugcucuccuu

SEQ ID NO: 2290441 - RNA, 15 nt, Human
caucugcucuccuuc

SEQ ID NO: 2290442 - RNA, 12 nt, Human
caucugggaaag

SEQ ID NO: 2290443 - RNA, 13 nt, Human
caucccaggacac

SEQ ID NO: 2290444 - RNA, 14 nt, Human
caucccagccuugg

SEQ ID NO: 2290445 - RNA, 19 nt, Human
caucccaggacaccacacc

SEQ ID NO: 2290446 - RNA, 14 nt, Human
cauccauuccucag

SEQ ID NO: 2290447 - RNA, 15 nt, Human
cauccauuccucagg

SEQ ID NO: 2290448 - RNA, 15 nt, Human
cauccauguuuguaa

SEQ ID NO: 2290449 - RNA, 18 nt, Human
cauccauguuuguaaaac

SEQ ID NO: 2290450 - RNA, 19 nt, Human
cauccauguuuguaaaacu

SEQ ID NO: 2290451 - RNA, 18 nt, Human
cauccauguguggacuca

SEQ ID NO: 2290452 - RNA, 17 nt, Human
cauccauguguggacuc

SEQ ID NO: 2290453 - RNA, 16 nt, Human
cauccauguguggacu

SEQ ID NO: 2290454 - RNA, 19 nt, Human
cauccauggggcugauugu

SEQ ID NO: 2290455 - RNA, 16 nt, Human
caucaggccaggcccu

SEQ ID NO: 2290456 - RNA, 19 nt, Human
caucaggccaggcccucug

SEQ ID NO: 2290457 - RNA, 15 nt, Human
caucaggccaggccc

SEQ ID NO: 2290458 - RNA, 20 nt, Human
caucuggguagcuguaaggc

SEQ ID NO: 2290459 - RNA, 18 nt, Human
caucuggguagcuguaag

SEQ ID NO: 2290460 - RNA, 16 nt, Human
caucuggguagcugua

SEQ ID NO: 2290461 - RNA, 17 nt, Human
caucugggggaguggaa

SEQ ID NO: 2290462 - RNA, 18 nt, Human
caucugggggaguggaau

SEQ ID NO: 2290463 - RNA, 15 nt, Human
caucuggguccuugc

SEQ ID NO: 2290464 - RNA, 17 nt, Human
caucugggcuccuccag

SEQ ID NO: 2290465 - RNA, 16 nt, Human
caucugggcuccucca

SEQ ID NO: 2290466 - RNA, 11 nt, Human
caucugggcuc

SEQ ID NO: 2290467 - RNA, 20 nt, Human
caucugggcuccuccagggu

SEQ ID NO: 2290468 - RNA, 13 nt, Human
caucugggcuccu

SEQ ID NO: 2290469 - RNA, 15 nt, Human
caucugggggagugg

SEQ ID NO: 2290470 - RNA, 16 nt, Human
caucugggggagugga

SEQ ID NO: 2290471 - RNA, 23 nt, Human
cauacacacacacacacagccac

SEQ ID NO: 2290472 - RNA, 13 nt, Human
cauacaccagcau

SEQ ID NO: 2290473 - RNA, 23 nt, Human
cauaauuuguacauauguaaaau

SEQ ID NO: 2290474 - RNA, 21 nt, Human
cauaauuuguacauauguaaa

SEQ ID NO: 2290475 - RNA, 22 nt, Human
cauacacacacacacacagcca

SEQ ID NO: 2290476 - RNA, 21 nt, Human
cauacacacacacacacagcc

SEQ ID NO: 2290477 - RNA, 15 nt, Human
cauacacuuccuucu

SEQ ID NO: 2290478 - RNA, 23 nt, Human
cauacacuuauuggaacucugcu

SEQ ID NO: 2290479 - RNA, 20 nt, Human
cauacaccagcauuccuuuu

SEQ ID NO: 2290480 - RNA, 18 nt, Human
cauacaccagcauuccuu

SEQ ID NO: 2290481 - RNA, 14 nt, Human
cauacaccagcauu

SEQ ID NO: 2290482 - RNA, 20 nt, Human
cauacaccuaugucauuuca

SEQ ID NO: 2290483 - RNA, 15 nt, Human
cagugggagcugccu

SEQ ID NO: 2290484 - RNA, 13 nt, Human
cagugggagaaaa

SEQ ID NO: 2290485 - RNA, 18 nt, Human
cauaauucuaagacuaau

SEQ ID NO: 2290486 - RNA, 18 nt, Human
cauaauucuuguauauua

SEQ ID NO: 2290487 - RNA, 17 nt, Human
cauaauucuuguauauu

SEQ ID NO: 2290488 - RNA, 16 nt, Human
cauaauucuuguauau

SEQ ID NO: 2290489 - RNA, 15 nt, Human
cauaauuuguacaua

SEQ ID NO: 2290490 - RNA, 22 nt, Human
cauagcuuacaagccagcugga

SEQ ID NO: 2290491 - RNA, 13 nt, Human
cauagcuuccaug

SEQ ID NO: 2290492 - RNA, 14 nt, Human
cauagcugucuaga

SEQ ID NO: 2290493 - RNA, 15 nt, Human
cauagcugucuagag

SEQ ID NO: 2290494 - RNA, 18 nt, Human
cauagcuccuucucucuu

SEQ ID NO: 2290495 - RNA, 13 nt, Human
cauagcacuuccc

SEQ ID NO: 2290496 - RNA, 14 nt, Human
cauagcacuucccc

SEQ ID NO: 2290497 - RNA, 14 nt, Human
cauagcuccugcuc

SEQ ID NO: 2290498 - RNA, 15 nt, Human
cauagcuccugcucc

SEQ ID NO: 2290499 - RNA, 20 nt, Human
cauagcuccugcuccacagc

SEQ ID NO: 2290500 - RNA, 17 nt, Human
cauagcuccuucucucu

SEQ ID NO: 2290501 - RNA, 19 nt, Human
cauagcagagaaugaaagg

SEQ ID NO: 2290502 - RNA, 22 nt, Human
cauagcagagaaugaaagggcc

SEQ ID NO: 2290503 - RNA, 14 nt, Human
cauagcaagacaca

SEQ ID NO: 2290504 - RNA, 20 nt, Human
cauagcaagacacaucccua

SEQ ID NO: 2290505 - RNA, 15 nt, Human
cauagcaagacacau

SEQ ID NO: 2290506 - RNA, 23 nt, Human
cauagcaagauugcuuaaaauag

SEQ ID NO: 2290507 - RNA, 20 nt, Human
cauagcuugauaaagggcca

SEQ ID NO: 2290508 - RNA, 21 nt, Human
cauagcuugauaaagggccaa

SEQ ID NO: 2290509 - RNA, 22 nt, Human
cauaugccugggcagaaggaag

SEQ ID NO: 2290510 - RNA, 15 nt, Human
cauaugccugggcag

SEQ ID NO: 2290511 - RNA, 20 nt, Human
cauaugccugggcagaagga

SEQ ID NO: 2290512 - RNA, 22 nt, Human
cauauucaggaagcucagggcc

SEQ ID NO: 2290513 - RNA, 20 nt, Human
cauauucaggaagcucaggg

SEQ ID NO: 2290514 - RNA, 14 nt, Human
cauauucaggaagc

SEQ ID NO: 2290515 - RNA, 15 nt, Human
cauauucaggaagcu

SEQ ID NO: 2290516 - RNA, 20 nt, Human
auuuuaagacguguuugugu

SEQ ID NO: 2290517 - RNA, 17 nt, Human
auuugucuauucuccag

SEQ ID NO: 2290518 - RNA, 15 nt, Human
auuugucuugccuua

SEQ ID NO: 2290519 - RNA, 15 nt, Human
auuugucuuucagga

SEQ ID NO: 2290520 - RNA, 15 nt, Human
auuuguccaauucuc

SEQ ID NO: 2290521 - RNA, 18 nt, Human
auuugugaagguggaaau

SEQ ID NO: 2290522 - RNA, 21 nt, Human
auuugugaagguggaaauaaa

SEQ ID NO: 2290523 - RNA, 22 nt, Human
auuuuaaaaauacagauagaua

SEQ ID NO: 2290524 - RNA, 23 nt, Human
auuugugaaaugauggugaaagu

SEQ ID NO: 2290525 - RNA, 16 nt, Human
auuuuaaaagaaugau

SEQ ID NO: 2290526 - RNA, 17 nt, Human
auuugugaacucagcca

SEQ ID NO: 2290527 - RNA, 20 nt, Human
auuugugaacucagccaagc

SEQ ID NO: 2290528 - RNA, 21 nt, Human
auuugugaacucagccaagca

SEQ ID NO: 2290529 - RNA, 18 nt, Human
auuuuaaaaagucuucac

SEQ ID NO: 2290530 - RNA, 21 nt, Human
auuuuaaaaagucuucacucu

SEQ ID NO: 2290531 - RNA, 13 nt, Human
auuuuaaaaauga

SEQ ID NO: 2290532 - RNA, 16 nt, Human
auuuuaaccaaaacau

SEQ ID NO: 2290533 - RNA, 22 nt, Human
auuuuaaccuaugauauuuucu

SEQ ID NO: 2290534 - RNA, 22 nt, Human
auuuuaacaauaacuacugugu

SEQ ID NO: 2290535 - RNA, 13 nt, Human
auuuuaacucaua

SEQ ID NO: 2290536 - RNA, 14 nt, Human
auuuuaacucuguc

SEQ ID NO: 2290537 - RNA, 13 nt, Human
auuuuaacucugu

SEQ ID NO: 2290538 - RNA, 15 nt, Human
auuuuaacucugucu

SEQ ID NO: 2290539 - RNA, 16 nt, Human
auuuuaacucugucuu

SEQ ID NO: 2290540 - RNA, 16 nt, Human
auuuuaacaauaacua

SEQ ID NO: 2290541 - RNA, 15 nt, Human
auuuuaacaauaacu

SEQ ID NO: 2290542 - RNA, 14 nt, Human
auuuuaacaauaac

SEQ ID NO: 2290543 - RNA, 14 nt, Human
auuuuaaaaugaga

SEQ ID NO: 2290544 - RNA, 20 nt, Human
auuuuaaaagaugcaaugua

SEQ ID NO: 2290545 - RNA, 20 nt, Human
auuuuaaaagauaaauauua

SEQ ID NO: 2290546 - RNA, 17 nt, Human
auuuuaaaaaugaaauu

SEQ ID NO: 2290547 - RNA, 14 nt, Human
auuuuaaaaaugaa

SEQ ID NO: 2290548 - RNA, 23 nt, Human
auuuuaaaaauguuaaaauguau

SEQ ID NO: 2290549 - RNA, 23 nt, Human
auuuuaaaagaaugauuaugaau

SEQ ID NO: 2290550 - RNA, 19 nt, Human
auuuggccugcacuaauuu

SEQ ID NO: 2290551 - RNA, 16 nt, Human
auuuggccugcacuaa

SEQ ID NO: 2290552 - RNA, 18 nt, Human
auuugggaagugaagacu

SEQ ID NO: 2290553 - RNA, 14 nt, Human
auuugggaagugaa

SEQ ID NO: 2290554 - RNA, 13 nt, Human
auuugacuguuuu

SEQ ID NO: 2290555 - RNA, 17 nt, Human
auuugacuguuuuuacc

SEQ ID NO: 2290556 - RNA, 18 nt, Human
auuugacuguuuuuaccc

SEQ ID NO: 2290557 - RNA, 23 nt, Human
auuugacaaaauuuguugaaauu

SEQ ID NO: 2290558 - RNA, 14 nt, Human
auuugacugaagau

SEQ ID NO: 2290559 - RNA, 19 nt, Human
auuuggcauuuauuuguga

SEQ ID NO: 2290560 - RNA, 19 nt, Human
auuugacuguuuuuaccca

SEQ ID NO: 2290561 - RNA, 19 nt, Human
auuuguaaauuuaugugau

SEQ ID NO: 2290562 - RNA, 16 nt, Human
auuuguaaccucagcu

SEQ ID NO: 2290563 - RNA, 18 nt, Human
auuuguaaauuuauguga

SEQ ID NO: 2290564 - RNA, 17 nt, Human
auuugggagacauguga

SEQ ID NO: 2290565 - RNA, 19 nt, Human
auuugggccugcuccagac

SEQ ID NO: 2290566 - RNA, 19 nt, Human
auuugggagacaugugaca

SEQ ID NO: 2290567 - RNA, 23 nt, Human
auuugggccugcuccagaccuga

SEQ ID NO: 2290568 - RNA, 22 nt, Human
auuugggccugcuccagaccug

SEQ ID NO: 2290569 - RNA, 21 nt, Human
auuugggccugcuccagaccu

SEQ ID NO: 2290570 - RNA, 15 nt, Human
auuugucaacaaagu

SEQ ID NO: 2290571 - RNA, 13 nt, Human
auuugucaacaaa

SEQ ID NO: 2290572 - RNA, 17 nt, Human
auuugucaaugacaguu

SEQ ID NO: 2290573 - RNA, 14 nt, Human
auuugucaaugaca

SEQ ID NO: 2290574 - RNA, 18 nt, Human
auuuguaaguuucaggug

SEQ ID NO: 2290575 - RNA, 21 nt, Human
auuuguaaguuucaggugaca

SEQ ID NO: 2290576 - RNA, 17 nt, Human
auuuguauuuuuuugca

SEQ ID NO: 2290577 - RNA, 21 nt, Human
auuuguauuuuuuugcaagug

SEQ ID NO: 2290578 - RNA, 23 nt, Human
auuuguaaguuuaugucuaaaga

SEQ ID NO: 2290579 - RNA, 14 nt, Human
auuuguaaguuuca

SEQ ID NO: 2290580 - RNA, 15 nt, Human
auuuguaaguuucag

SEQ ID NO: 2290581 - RNA, 17 nt, Human
auuuguaaguuucaggu

SEQ ID NO: 2290582 - RNA, 19 nt, Human
auuuguaguguuggagaag

SEQ ID NO: 2290583 - RNA, 17 nt, Human
auuuguaaccucagcuc

SEQ ID NO: 2290584 - RNA, 19 nt, Human
auuuguaaccucagcucug

SEQ ID NO: 2290585 - RNA, 21 nt, Human
auuuguaaccucagcucuggg

SEQ ID NO: 2290586 - RNA, 20 nt, Human
auuuguaaccucagcucugg

SEQ ID NO: 2290587 - RNA, 14 nt, Human
auuuguaaguuuau

SEQ ID NO: 2290588 - RNA, 22 nt, Human
auuuguaaguuuaugucuaaag

SEQ ID NO: 2290589 - RNA, 22 nt, Human
auuuguaguguuggagaagaac

SEQ ID NO: 2290590 - RNA, 14 nt, Human
auuuguauaaaaua

SEQ ID NO: 2290591 - RNA, 16 nt, Human
auuucccguggcccca

SEQ ID NO: 2290592 - RNA, 18 nt, Human
auuucccguggccccagc

SEQ ID NO: 2290593 - RNA, 19 nt, Human
auuucccguggccccagcc

SEQ ID NO: 2290594 - RNA, 15 nt, Human
auuucccguggcccc

SEQ ID NO: 2290595 - RNA, 15 nt, Human
auuucccaggguuaa

SEQ ID NO: 2290596 - RNA, 21 nt, Human
auuucccaggcugaauuggga

SEQ ID NO: 2290597 - RNA, 19 nt, Human
auuucccaggacccugaag

SEQ ID NO: 2290598 - RNA, 16 nt, Human
auuucccaggacccug

SEQ ID NO: 2290599 - RNA, 14 nt, Human
auuucccaggaccc

SEQ ID NO: 2290600 - RNA, 18 nt, Human
auuucccaauuaggaagu

SEQ ID NO: 2290601 - RNA, 14 nt, Human
auuuccacaccaag

SEQ ID NO: 2290602 - RNA, 23 nt, Human
auuucccacaccguguaaaccaa

SEQ ID NO: 2290603 - RNA, 20 nt, Human
auuucccagcacaugaaacc

SEQ ID NO: 2290604 - RNA, 13 nt, Human
auuucccaggacc

SEQ ID NO: 2290605 - RNA, 12 nt, Human
auuucccaggac

SEQ ID NO: 2290606 - RNA, 17 nt, Human
auuucccaauuaggaag

SEQ ID NO: 2290607 - RNA, 15 nt, Human
auuuccaagagcuga

SEQ ID NO: 2290608 - RNA, 23 nt, Human
auuuccaacaccacagacacaca

SEQ ID NO: 2290609 - RNA, 21 nt, Human
auuuccaacaccacagacaca

SEQ ID NO: 2290610 - RNA, 22 nt, Human
auuuccaacaccacagacacac

SEQ ID NO: 2290611 - RNA, 17 nt, Human
auuuccaaauucacaag

SEQ ID NO: 2290612 - RNA, 19 nt, Human
auuuccaacaccacagaca

SEQ ID NO: 2290613 - RNA, 20 nt, Human
auuuccaacaccacagacac

SEQ ID NO: 2290614 - RNA, 17 nt, Human
auuuccaaauaaaauga

SEQ ID NO: 2290615 - RNA, 18 nt, Human
auuuccaaauaaaaugag

SEQ ID NO: 2290616 - RNA, 13 nt, Human
auuuccaaaugaa

SEQ ID NO: 2290617 - RNA, 17 nt, Human
auuuccaaaugaaugac

SEQ ID NO: 2290618 - RNA, 16 nt, Human
auuuccaagagcugag

SEQ ID NO: 2290619 - RNA, 19 nt, Human
auuucccaaagcagugcau

SEQ ID NO: 2290620 - RNA, 14 nt, Human
auuuauuuaaauuu

SEQ ID NO: 2290621 - RNA, 12 nt, Human
auuuauuuaaau

SEQ ID NO: 2290622 - RNA, 14 nt, Human
auuuauuucaaaaa

SEQ ID NO: 2290623 - RNA, 16 nt, Human
auuuauuuaauaacaa

SEQ ID NO: 2290624 - RNA, 14 nt, Human
auuuauuuaaaugu

SEQ ID NO: 2290625 - RNA, 13 nt, Human
auuuauuuaauaa

SEQ ID NO: 2290626 - RNA, 20 nt, Human
auuuauuuaauaacaauugu

SEQ ID NO: 2290627 - RNA, 12 nt, Human
auuuauuuaaua

SEQ ID NO: 2290628 - RNA, 20 nt, Human
auuuauuuaaaagauucauu

SEQ ID NO: 2290629 - RNA, 14 nt, Human
auuuauuuaaaaga

SEQ ID NO: 2290630 - RNA, 16 nt, Human
auuuauuuaaaagauu

SEQ ID NO: 2290631 - RNA, 16 nt, Human
auuuccaaagagaaaa

SEQ ID NO: 2290632 - RNA, 13 nt, Human
auuuccaaauaaa

SEQ ID NO: 2290633 - RNA, 15 nt, Human
auuuccaaauaaaau

SEQ ID NO: 2290634 - RNA, 14 nt, Human
auuuauuuuaauaa

SEQ ID NO: 2290635 - RNA, 14 nt, Human
auuuauuucaucau

SEQ ID NO: 2290636 - RNA, 13 nt, Human
auuuauuuccuag

SEQ ID NO: 2290637 - RNA, 18 nt, Human
auuuauuuccuaguucug

SEQ ID NO: 2290638 - RNA, 23 nt, Human
auuuauuuccuaguucuguagaa

SEQ ID NO: 2290639 - RNA, 16 nt, Human
auuugaaaauuuugau

SEQ ID NO: 2290640 - RNA, 15 nt, Human
auuugaaaauuuuga

SEQ ID NO: 2290641 - RNA, 11 nt, Human
auuugaaagaa

SEQ ID NO: 2290642 - RNA, 14 nt, Human
auuugaaagaaagg

SEQ ID NO: 2290643 - RNA, 18 nt, Human
auuugaaacacuuugcau

SEQ ID NO: 2290644 - RNA, 13 nt, Human
auuugaccuacaa

SEQ ID NO: 2290645 - RNA, 20 nt, Human
auuucuuccacaagagccca

SEQ ID NO: 2290646 - RNA, 23 nt, Human
auuucuuccacaagagcccaggc

SEQ ID NO: 2290647 - RNA, 18 nt, Human
auuucccugacuccucua

SEQ ID NO: 2290648 - RNA, 23 nt, Human
auuucccugaaggaaccaaagcg

SEQ ID NO: 2290649 - RNA, 17 nt, Human
auuucccugaaggaacc

SEQ ID NO: 2290650 - RNA, 22 nt, Human
auuucccguggccccagccugg

SEQ ID NO: 2290651 - RNA, 20 nt, Human
auuucccguggccccagccu

SEQ ID NO: 2290652 - RNA, 21 nt, Human
auuucccguggccccagccug

SEQ ID NO: 2290653 - RNA, 23 nt, Human
auuucccguggccccagccuggc

SEQ ID NO: 2290654 - RNA, 13 nt, Human
auuggguucauua

SEQ ID NO: 2290655 - RNA, 18 nt, Human
auuggguggguaaauuca

SEQ ID NO: 2290656 - RNA, 13 nt, Human
auuggguuaugaa

SEQ ID NO: 2290657 - RNA, 17 nt, Human
auuggguuaugaauauu

SEQ ID NO: 2290658 - RNA, 18 nt, Human
auugguaaagaauggaag

SEQ ID NO: 2290659 - RNA, 15 nt, Human
auugguaacauccuu

SEQ ID NO: 2290660 - RNA, 16 nt, Human
auugguaacauccuuu

SEQ ID NO: 2290661 - RNA, 20 nt, Human
auugggaaggggacccccgc

SEQ ID NO: 2290662 - RNA, 13 nt, Human
auugggaaaucuu

SEQ ID NO: 2290663 - RNA, 15 nt, Human
auugggaauaaauau

SEQ ID NO: 2290664 - RNA, 16 nt, Human
auugggaauaaauaug

SEQ ID NO: 2290665 - RNA, 17 nt, Human
auugggaauaaauaugc

SEQ ID NO: 2290666 - RNA, 20 nt, Human
auugggaauaaauaugccuc

SEQ ID NO: 2290667 - RNA, 17 nt, Human
auugggacuggggcuga

SEQ ID NO: 2290668 - RNA, 23 nt, Human
auuggguggggggcuucauacac

SEQ ID NO: 2290669 - RNA, 18 nt, Human
auugggagcuugggaaug

SEQ ID NO: 2290670 - RNA, 17 nt, Human
auugguccagcuugcuc

SEQ ID NO: 2290671 - RNA, 15 nt, Human
auugguucuuguauu

SEQ ID NO: 2290672 - RNA, 16 nt, Human
auugguucuuguauua

SEQ ID NO: 2290673 - RNA, 15 nt, Human
auugguccagcuugc

SEQ ID NO: 2290674 - RNA, 14 nt, Human
auugguccagcuug

SEQ ID NO: 2290675 - RNA, 18 nt, Human
auugguaucaagaaaguc

SEQ ID NO: 2290676 - RNA, 18 nt, Human
auugguauucacuaaucu

SEQ ID NO: 2290677 - RNA, 17 nt, Human
auugguaucaagaaagu

SEQ ID NO: 2290678 - RNA, 22 nt, Human
auuggauuauuuaauaacauua

SEQ ID NO: 2290679 - RNA, 19 nt, Human
auuggauuauuuaauaaca

SEQ ID NO: 2290680 - RNA, 20 nt, Human
auuggauuauuuaauaacau

SEQ ID NO: 2290681 - RNA, 22 nt, Human
auuggauucugagagcugugca

SEQ ID NO: 2290682 - RNA, 19 nt, Human
auuggauucugagagcugu

SEQ ID NO: 2290683 - RNA, 18 nt, Human
auuggauuauucauuuaa

SEQ ID NO: 2290684 - RNA, 19 nt, Human
auuggauuauucauuuaaa

SEQ ID NO: 2290685 - RNA, 21 nt, Human
auuggauuauucauuuaaaau

SEQ ID NO: 2290686 - RNA, 22 nt, Human
auuggauuauucauuuaaaaug

SEQ ID NO: 2290687 - RNA, 14 nt, Human
auuggauuauuuaa

SEQ ID NO: 2290688 - RNA, 16 nt, Human
auuggauuauuuaaua

SEQ ID NO: 2290689 - RNA, 17 nt, Human
auuggauuauuuaauaa

SEQ ID NO: 2290690 - RNA, 18 nt, Human
auuggauuauuuaauaac

SEQ ID NO: 2290691 - RNA, 12 nt, Human
auuggcagcaga

SEQ ID NO: 2290692 - RNA, 11 nt, Human
auuggcagcag

SEQ ID NO: 2290693 - RNA, 20 nt, Human
auuggcaccuaauccaggca

SEQ ID NO: 2290694 - RNA, 16 nt, Human
auugacuucgacugug

SEQ ID NO: 2290695 - RNA, 12 nt, Human
auugauuagaaa

SEQ ID NO: 2290696 - RNA, 20 nt, Human
auugauuauuacuggcaaaa

SEQ ID NO: 2290697 - RNA, 18 nt, Human
auugacuuuuuauggcac

SEQ ID NO: 2290698 - RNA, 13 nt, Human
auugacuuuuuau

SEQ ID NO: 2290699 - RNA, 22 nt, Human
auugauuauucugauuccacuu

SEQ ID NO: 2290700 - RNA, 16 nt, Human
auugauuucaagaccu

SEQ ID NO: 2290701 - RNA, 13 nt, Human
auugauuucaaga

SEQ ID NO: 2290702 - RNA, 18 nt, Human
auugcuuuggucauauga

SEQ ID NO: 2290703 - RNA, 21 nt, Human
auugauuuccguuaaaauacc

SEQ ID NO: 2290704 - RNA, 14 nt, Human
auugcuuuggucau

SEQ ID NO: 2290705 - RNA, 15 nt, Human
auugauuucugccuu

SEQ ID NO: 2290706 - RNA, 12 nt, Human
auugcuuugagc

SEQ ID NO: 2290707 - RNA, 21 nt, Human
auugcuuugauuaauccagaa

SEQ ID NO: 2290708 - RNA, 20 nt, Human
auuggaauuaaccuggugcu

SEQ ID NO: 2290709 - RNA, 19 nt, Human
auuggaauuaaccuggugc

SEQ ID NO: 2290710 - RNA, 16 nt, Human
auuggaauuaaccugg

SEQ ID NO: 2290711 - RNA, 15 nt, Human
auuggaauuaaccug

SEQ ID NO: 2290712 - RNA, 12 nt, Human
auuggaauuaac

SEQ ID NO: 2290713 - RNA, 14 nt, Human
auuggaauuaaccu

SEQ ID NO: 2290714 - RNA, 15 nt, Human
auugcuuuuucuaau

SEQ ID NO: 2290715 - RNA, 20 nt, Human
auugcuuuuucuaauguggu

SEQ ID NO: 2290716 - RNA, 19 nt, Human
auuggacaguaaaauccac

SEQ ID NO: 2290717 - RNA, 17 nt, Human
auuggacauuuucuuca

SEQ ID NO: 2290718 - RNA, 14 nt, Human
auuggacccuucca

SEQ ID NO: 2290719 - RNA, 19 nt, Human
auuggagcucgugggacag

SEQ ID NO: 2290720 - RNA, 22 nt, Human
auuggagggugggagagcccag

SEQ ID NO: 2290721 - RNA, 15 nt, Human
auuggaggaaagcaa

SEQ ID NO: 2290722 - RNA, 23 nt, Human
auuggaggaaagcaaccggugga

SEQ ID NO: 2290723 - RNA, 23 nt, Human
auuggagggugggagagcccagc

SEQ ID NO: 2290724 - RNA, 22 nt, Human
auuggaggguaaaugauguggu

SEQ ID NO: 2290725 - RNA, 21 nt, Human
auuuaaagacagggaagagca

SEQ ID NO: 2290726 - RNA, 14 nt, Human
auuguacaguuuuu

SEQ ID NO: 2290727 - RNA, 15 nt, Human
auuguacaguuuuua

SEQ ID NO: 2290728 - RNA, 17 nt, Human
auuguaaaaaaaaaugc

SEQ ID NO: 2290729 - RNA, 20 nt, Human
auuguaaaaaaaaaugccuu

SEQ ID NO: 2290730 - RNA, 21 nt, Human
auuguaaaaaaaaaugccuuu

SEQ ID NO: 2290731 - RNA, 22 nt, Human
auuguaaaaaaaaaugccuuug

SEQ ID NO: 2290732 - RNA, 23 nt, Human
auuguaaaaaaaaaugccuuuga

SEQ ID NO: 2290733 - RNA, 21 nt, Human
auuguacaguuuuuauugcuu

SEQ ID NO: 2290734 - RNA, 12 nt, Human
auuguaccucuc

SEQ ID NO: 2290735 - RNA, 15 nt, Human
auuguacauauuugu

SEQ ID NO: 2290736 - RNA, 20 nt, Human
auuguacauauuuguggaau

SEQ ID NO: 2290737 - RNA, 18 nt, Human
auuguaccucucuuauag

SEQ ID NO: 2290738 - RNA, 19 nt, Human
auuguaccucucuuauaga

SEQ ID NO: 2290739 - RNA, 14 nt, Human
auuguaccuuuuaa

SEQ ID NO: 2290740 - RNA, 15 nt, Human
auuguaccuuuuaac

SEQ ID NO: 2290741 - RNA, 16 nt, Human
auuguaccuuuuaaca

SEQ ID NO: 2290742 - RNA, 17 nt, Human
auuguaccuuuuaacac

SEQ ID NO: 2290743 - RNA, 13 nt, Human
auugucagcuacu

SEQ ID NO: 2290744 - RNA, 23 nt, Human
auugucagauauuuuuucagaaa

SEQ ID NO: 2290745 - RNA, 14 nt, Human
auugucagauauuu

SEQ ID NO: 2290746 - RNA, 19 nt, Human
auugucagaguucugcucu

SEQ ID NO: 2290747 - RNA, 22 nt, Human
auuguaccuuuuaacaccugau

SEQ ID NO: 2290748 - RNA, 23 nt, Human
auugucaaaguggugagaggcau

SEQ ID NO: 2290749 - RNA, 16 nt, Human
auugucaaagugguga

SEQ ID NO: 2290750 - RNA, 13 nt, Human
auugucuagugaa

SEQ ID NO: 2290751 - RNA, 19 nt, Human
auugucagcuacuaaugau

SEQ ID NO: 2290752 - RNA, 15 nt, Human
auugucaucaggaga

SEQ ID NO: 2290753 - RNA, 13 nt, Human
auugucauuaaag

SEQ ID NO: 2290754 - RNA, 15 nt, Human
auugucauuaaaggu

SEQ ID NO: 2290755 - RNA, 12 nt, Human
auugucccucug

SEQ ID NO: 2290756 - RNA, 15 nt, Human
auugucauuccugua

SEQ ID NO: 2290757 - RNA, 23 nt, Human
auugucccucugccccauccucc

SEQ ID NO: 2290758 - RNA, 17 nt, Human
auugucccucugcccca

SEQ ID NO: 2290759 - RNA, 12 nt, Human
auuguggcuccu

SEQ ID NO: 2290760 - RNA, 19 nt, Human
auuguggcuccuaucugug

SEQ ID NO: 2290761 - RNA, 20 nt, Human
auuguggcuccuaucugugu

SEQ ID NO: 2290762 - RNA, 13 nt, Human
auugugggaaggg

SEQ ID NO: 2290763 - RNA, 19 nt, Human
auuguggcugucagcagga

SEQ ID NO: 2290764 - RNA, 18 nt, Human
auuguggcugucagcagg

SEQ ID NO: 2290765 - RNA, 17 nt, Human
auuguggcugucagcag

SEQ ID NO: 2290766 - RNA, 20 nt, Human
auuguggggaugaugaaaua

SEQ ID NO: 2290767 - RNA, 21 nt, Human
auuguggggaugaugaaauaa

SEQ ID NO: 2290768 - RNA, 14 nt, Human
auugugggaagggg

SEQ ID NO: 2290769 - RNA, 20 nt, Human
auuguuugucugucuucaua

SEQ ID NO: 2290770 - RNA, 16 nt, Human
auuguuugucuuuaac

SEQ ID NO: 2290771 - RNA, 18 nt, Human
auugugguacaaucucaa

SEQ ID NO: 2290772 - RNA, 20 nt, Human
auugugggucuauuucuagu

SEQ ID NO: 2290773 - RNA, 19 nt, Human
auugugguacaaucucaaa

SEQ ID NO: 2290774 - RNA, 21 nt, Human
auuguuuggggaugagaaagg

SEQ ID NO: 2290775 - RNA, 13 nt, Human
auuuaaaagauac

SEQ ID NO: 2290776 - RNA, 21 nt, Human
auuguuugucuuuaacuguca

SEQ ID NO: 2290777 - RNA, 14 nt, Human
auuguuuuaaaaag

SEQ ID NO: 2290778 - RNA, 23 nt, Human
auuguuuuaaaaagaaacaagau

SEQ ID NO: 2290779 - RNA, 17 nt, Human
auuuaaaagauacaguu

SEQ ID NO: 2290780 - RNA, 22 nt, Human
auuguuuuaaaaagaaacaaga

SEQ ID NO: 2290781 - RNA, 13 nt, Human
auuuaaaagauuc

SEQ ID NO: 2290782 - RNA, 16 nt, Human
auuuaaaagauacagu

SEQ ID NO: 2290783 - RNA, 14 nt, Human
auuuaaaagauaca

SEQ ID NO: 2290784 - RNA, 16 nt, Human
auuuaaagacaaagac

SEQ ID NO: 2290785 - RNA, 13 nt, Human
auuuauuuaaaag

SEQ ID NO: 2290786 - RNA, 19 nt, Human
auuuaaagaacacccuaua

SEQ ID NO: 2290787 - RNA, 18 nt, Human
auuuaaacccauuuuagu

SEQ ID NO: 2290788 - RNA, 20 nt, Human
auuuaaacccauuuuaguca

SEQ ID NO: 2290789 - RNA, 13 nt, Human
auuuaaacccauu

SEQ ID NO: 2290790 - RNA, 14 nt, Human
auuuaaacccauuu

SEQ ID NO: 2290791 - RNA, 15 nt, Human
auuuaaacccauuuu

SEQ ID NO: 2290792 - RNA, 17 nt, Human
auuuaaacccauuuuag

SEQ ID NO: 2290793 - RNA, 16 nt, Human
auuuaaaagauucauu

SEQ ID NO: 2290794 - RNA, 19 nt, Human
auuuuaagacguguuugug

SEQ ID NO: 2290795 - RNA, 17 nt, Human
auuuuaacuuuaucaca

SEQ ID NO: 2290796 - RNA, 15 nt, Human
auuuuaacuuuauca

SEQ ID NO: 2290797 - RNA, 19 nt, Human
auuuuaacuuuaucacauu

SEQ ID NO: 2290798 - RNA, 20 nt, Human
auuuuaagugcuuuguaaug

SEQ ID NO: 2290799 - RNA, 15 nt, Human
auuuuaauaaacacu

SEQ ID NO: 2290800 - RNA, 16 nt, Human
auuuuaauaaacacuc

SEQ ID NO: 2290801 - RNA, 17 nt, Human
auuuuaauaaacacucu

SEQ ID NO: 2290802 - RNA, 15 nt, Human
auuuuccaugaaaau

SEQ ID NO: 2290803 - RNA, 13 nt, Human
auuuuaauaauau

SEQ ID NO: 2290804 - RNA, 21 nt, Human
auuuuccauuuuuauuucaaa

SEQ ID NO: 2290805 - RNA, 12 nt, Human
auuuuaauaaug

SEQ ID NO: 2290806 - RNA, 15 nt, Human
auuuuccccccacuc

SEQ ID NO: 2290807 - RNA, 14 nt, Human
auuuuccccccacu

SEQ ID NO: 2290808 - RNA, 14 nt, Human
auuuucccacugca

SEQ ID NO: 2290809 - RNA, 17 nt, Human
auuuucccacugcaccc

SEQ ID NO: 2290810 - RNA, 21 nt, Human
auuuuccccccacucucccca

SEQ ID NO: 2290811 - RNA, 20 nt, Human
auuuuccccccacucucccc

SEQ ID NO: 2290812 - RNA, 22 nt, Human
auuuuccccccacucuccccac

SEQ ID NO: 2290813 - RNA, 20 nt, Human
auuuucccccuuuucugcau

SEQ ID NO: 2290814 - RNA, 19 nt, Human
auuuucccuauuagagaag

SEQ ID NO: 2290815 - RNA, 14 nt, Human
auuuuccugaaaac

SEQ ID NO: 2290816 - RNA, 16 nt, Human
auuuuccugccaggca

SEQ ID NO: 2290817 - RNA, 13 nt, Human
auuuucccugcua

SEQ ID NO: 2290818 - RNA, 22 nt, Human
auuuucccccuuuucugcauuu

SEQ ID NO: 2290819 - RNA, 22 nt, Human
auuuuccuggugccaauuucaa

SEQ ID NO: 2290820 - RNA, 18 nt, Human
auuuuccuggugccaauu

SEQ ID NO: 2290821 - RNA, 15 nt, Human
auuuucuauaauuua

SEQ ID NO: 2290822 - RNA, 14 nt, Human
auuuucuauaauuu

SEQ ID NO: 2290823 - RNA, 12 nt, Human
auuuuccuugaa

SEQ ID NO: 2290824 - RNA, 14 nt, Human
auuuugaugaacaa

SEQ ID NO: 2290825 - RNA, 19 nt, Human
auuuugauccaagcugguc

SEQ ID NO: 2290826 - RNA, 23 nt, Human
auuuuccuggugccaauuucaag

SEQ ID NO: 2290827 - RNA, 15 nt, Human
auuuugauguuuuaa

SEQ ID NO: 2290828 - RNA, 19 nt, Human
auuuugcaaaauuuccagu

SEQ ID NO: 2290829 - RNA, 18 nt, Human
auuuugcaaaauuuccag

SEQ ID NO: 2290830 - RNA, 15 nt, Human
auuuugcaaaauuuc

SEQ ID NO: 2290831 - RNA, 14 nt, Human
auuuugcaaaauuu

SEQ ID NO: 2290832 - RNA, 14 nt, Human
auuuugauuauugu

SEQ ID NO: 2290833 - RNA, 16 nt, Human
auuuugauuauuguau

SEQ ID NO: 2290834 - RNA, 18 nt, Human
auuuugauuauuguauuu

SEQ ID NO: 2290835 - RNA, 22 nt, Human
auuuugauuauuguauuuauuc

SEQ ID NO: 2290836 - RNA, 17 nt, Human
auuuugauguuuuaagg

SEQ ID NO: 2290837 - RNA, 14 nt, Human
auuuugcauucaaa

SEQ ID NO: 2290838 - RNA, 16 nt, Human
auuuugcagcagugag

SEQ ID NO: 2290839 - RNA, 15 nt, Human
auuuugcagcaguga

SEQ ID NO: 2290840 - RNA, 14 nt, Human
auuuugcagcagug

SEQ ID NO: 2290841 - RNA, 12 nt, Human
auuuugcagcag

SEQ ID NO: 2290842 - RNA, 16 nt, Human
auuuugcauuugaaua

SEQ ID NO: 2290843 - RNA, 15 nt, Human
auuuugcauucaaau

SEQ ID NO: 2290844 - RNA, 18 nt, Human
auuuugccagugggaacu

SEQ ID NO: 2290845 - RNA, 23 nt, Human
auuuugcccuugacaaagucaag

SEQ ID NO: 2290846 - RNA, 15 nt, Human
auuuugcccuugaca

SEQ ID NO: 2290847 - RNA, 20 nt, Human
auuuugcuaaaugugaauga

SEQ ID NO: 2290848 - RNA, 18 nt, Human
auuuugccucuuuucucu

SEQ ID NO: 2290849 - RNA, 22 nt, Human
auuuugcccuuccauagccuaa

SEQ ID NO: 2290850 - RNA, 21 nt, Human
auuuugccucuuuucucugug

SEQ ID NO: 2290851 - RNA, 13 nt, Human
auuuugccugugu

SEQ ID NO: 2290852 - RNA, 17 nt, Human
auuuugcuauuguaaau

SEQ ID NO: 2290853 - RNA, 19 nt, Human
auuuugcuauuguaaauau

SEQ ID NO: 2290854 - RNA, 14 nt, Human
auuuugcuggaaua

SEQ ID NO: 2290855 - RNA, 21 nt, Human
auuuugcuauuguaaauaugu

SEQ ID NO: 2290856 - RNA, 22 nt, Human
auuuugcuauuguaaauauguu

SEQ ID NO: 2290857 - RNA, 21 nt, Human
auuuugcugucccuuuuccuu

SEQ ID NO: 2290858 - RNA, 16 nt, Human
auuuuguaauuauugu

SEQ ID NO: 2290859 - RNA, 21 nt, Human
auuuuguaauuauugugauuu

SEQ ID NO: 2290860 - RNA, 20 nt, Human
auuuuguaaacucaaaauau

SEQ ID NO: 2290861 - RNA, 20 nt, Human
auuuuggaaguuuucaggac

SEQ ID NO: 2290862 - RNA, 19 nt, Human
auuuuguaaacucaaaaua

SEQ ID NO: 2290863 - RNA, 17 nt, Human
auuuuguaacuuucucu

SEQ ID NO: 2290864 - RNA, 19 nt, Human
auuuuguaacgaagacaca

SEQ ID NO: 2290865 - RNA, 18 nt, Human
auuuuguaacgaagacac

SEQ ID NO: 2290866 - RNA, 13 nt, Human
auuuuguaucugc

SEQ ID NO: 2290867 - RNA, 14 nt, Human
auuuuguaucugca

SEQ ID NO: 2290868 - RNA, 15 nt, Human
auuuuguaucugcag

SEQ ID NO: 2290869 - RNA, 21 nt, Human
auuuuguaucugcaggcagac

SEQ ID NO: 2290870 - RNA, 23 nt, Human
auuuuguaucugcaggcagacac

SEQ ID NO: 2290871 - RNA, 20 nt, Human
auuuuguacaaauuuguuau

SEQ ID NO: 2290872 - RNA, 22 nt, Human
auuuuguaauuauugugauuuc

SEQ ID NO: 2290873 - RNA, 17 nt, Human
auuuuguauaauuguau

SEQ ID NO: 2290874 - RNA, 20 nt, Human
auuuuguauaauuguaucgu

SEQ ID NO: 2290875 - RNA, 14 nt, Human
auuuuguauauauc

SEQ ID NO: 2290876 - RNA, 10 nt, Human
auuuuguauu

SEQ ID NO: 2290877 - RNA, 19 nt, Human
auuuuguauuguuucaauu

SEQ ID NO: 2290878 - RNA, 12 nt, Human
auuuuguauuuu

SEQ ID NO: 2290879 - RNA, 15 nt, Human
auuuuguauuuucca

SEQ ID NO: 2290880 - RNA, 16 nt, Human
auuuuguauuuuccaa

SEQ ID NO: 2290881 - RNA, 20 nt, Human
auuuuguauuuuccaagugu

SEQ ID NO: 2290882 - RNA, 20 nt, Human
auuuugcuguagaagauggc

SEQ ID NO: 2290883 - RNA, 14 nt, Human
auuuugcuguauau

SEQ ID NO: 2290884 - RNA, 12 nt, Human
auuuugcuguau

SEQ ID NO: 2290885 - RNA, 23 nt, Human
auuuugcuauuguaaauauguuu

SEQ ID NO: 2290886 - RNA, 12 nt, Human
auuuugcuuugu

SEQ ID NO: 2290887 - RNA, 20 nt, Human
auuuugcuuugugauuuuug

SEQ ID NO: 2290888 - RNA, 18 nt, Human
auuuugcuuugugauuuu

SEQ ID NO: 2290889 - RNA, 20 nt, Human
auuuuggaaaauaaauuauu

SEQ ID NO: 2290890 - RNA, 23 nt, Human
auuuuggaaagcuccuagcagag

SEQ ID NO: 2290891 - RNA, 19 nt, Human
auuuuggaaaauaaauuau

SEQ ID NO: 2290892 - RNA, 14 nt, Human
auuuuggaaaauaa

SEQ ID NO: 2290893 - RNA, 12 nt, Human
auuuugugaaug

SEQ ID NO: 2290894 - RNA, 13 nt, Human
auuuugugaaugg

SEQ ID NO: 2290895 - RNA, 15 nt, Human
auuuugugaauggau

SEQ ID NO: 2290896 - RNA, 21 nt, Human
auuuugugaagacugggaagu

SEQ ID NO: 2290897 - RNA, 23 nt, Human
auuuugucauauaagauucauau

SEQ ID NO: 2290898 - RNA, 21 nt, Human
auuuugucuaaaaugccucag

SEQ ID NO: 2290899 - RNA, 13 nt, Human
auuuugucuaaaa

SEQ ID NO: 2290900 - RNA, 16 nt, Human
auuuugucuaaaaugc

SEQ ID NO: 2290901 - RNA, 22 nt, Human
auuuuguauuuuccaagugugc

SEQ ID NO: 2290902 - RNA, 14 nt, Human
auuuugucgaauuu

SEQ ID NO: 2290903 - RNA, 12 nt, Human
auuuugucuaaa

SEQ ID NO: 2290904 - RNA, 19 nt, Human
auuuugugcccccauguaa

SEQ ID NO: 2290905 - RNA, 19 nt, Human
auuuugugauauggagccc

SEQ ID NO: 2290906 - RNA, 20 nt, Human
auuuuguggcuuucuuucuu

SEQ ID NO: 2290907 - RNA, 17 nt, Human
auuuuguguuuaggaac

SEQ ID NO: 2290908 - RNA, 19 nt, Human
auuuuguugcuguuuugau

SEQ ID NO: 2290909 - RNA, 23 nt, Human
auuuuguugcuguuuugauuugu

SEQ ID NO: 2290910 - RNA, 18 nt, Human
auuuuguucuaguuuuca

SEQ ID NO: 2290911 - RNA, 19 nt, Human
auuuuguugcuuuugugaa

SEQ ID NO: 2290912 - RNA, 15 nt, Human
auuuuguuuaaauua

SEQ ID NO: 2290913 - RNA, 20 nt, Human
auuuuguugcuuuugugaac

SEQ ID NO: 2290914 - RNA, 15 nt, Human
auuuuucagaugcuu

SEQ ID NO: 2290915 - RNA, 14 nt, Human
auuuuucagaugcu

SEQ ID NO: 2290916 - RNA, 18 nt, Human
auuuuucagaugcuucug

SEQ ID NO: 2290917 - RNA, 16 nt, Human
auuuuucagauauaaa

SEQ ID NO: 2290918 - RNA, 19 nt, Human
auuuuucauugauaugaaa

SEQ ID NO: 2290919 - RNA, 19 nt, Human
auuuuucauauugugccaa

SEQ ID NO: 2290920 - RNA, 15 nt, Human
auuuuuccaaaauaa

SEQ ID NO: 2290921 - RNA, 13 nt, Human
auuuuucauauug

SEQ ID NO: 2290922 - RNA, 18 nt, Human
auuuuucauauugugcca

SEQ ID NO: 2290923 - RNA, 19 nt, Human
auuuuucaugauuuugaaa

SEQ ID NO: 2290924 - RNA, 22 nt, Human
auuuuucauugauaugaaaaau

SEQ ID NO: 2290925 - RNA, 20 nt, Human
auuuuuccuccacugaacua

SEQ ID NO: 2290926 - RNA, 10 nt, Human
auuuuuccua

SEQ ID NO: 2290927 - RNA, 21 nt, Human
auuuuucucaaaguuuugaaa

SEQ ID NO: 2290928 - RNA, 12 nt, Human
auuuuucuaaaa

SEQ ID NO: 2290929 - RNA, 17 nt, Human
auuuuucuaaaaaaaga

SEQ ID NO: 2290930 - RNA, 21 nt, Human
auuuuucuuagggaaggauac

SEQ ID NO: 2290931 - RNA, 12 nt, Human
auuuuucucaug

SEQ ID NO: 2290932 - RNA, 17 nt, Human
auuuuucucaaaguuuu

SEQ ID NO: 2290933 - RNA, 12 nt, Human
auuuuucugcac

SEQ ID NO: 2290934 - RNA, 14 nt, Human
auuuuucugcacug

SEQ ID NO: 2290935 - RNA, 23 nt, Human
auuuuguuuugcuuuuucugacu

SEQ ID NO: 2290936 - RNA, 24 nt, Human
auuuuguuuugcuuuuucugacuc

SEQ ID NO: 2290937 - RNA, 18 nt, Human
auuuuguuuugcuuuuuc

SEQ ID NO: 2290938 - RNA, 19 nt, Human
auuuuguuuugcuuuuucu

SEQ ID NO: 2290939 - RNA, 21 nt, Human
auuuuguuuugcuuuuucuga

SEQ ID NO: 2290940 - RNA, 22 nt, Human
auuuuguuuugcuuuuucugac

SEQ ID NO: 2290941 - RNA, 20 nt, Human
auuuuguuugguauuguauu

SEQ ID NO: 2290942 - RNA, 21 nt, Human
auuuuguuugguauuguauuu

SEQ ID NO: 2290943 - RNA, 22 nt, Human
auuuuguuugguauuguauuua

SEQ ID NO: 2290944 - RNA, 14 nt, Human
auuuuguuuugcuu

SEQ ID NO: 2290945 - RNA, 14 nt, Human
auuuuguuugguau

SEQ ID NO: 2290946 - RNA, 17 nt, Human
auuuuguuugguauugu

SEQ ID NO: 2290947 - RNA, 18 nt, Human
auuuuguuugguauugua

SEQ ID NO: 2290948 - RNA, 19 nt, Human
auuuuguuugguauuguau

SEQ ID NO: 2290949 - RNA, 21 nt, Human
auuuuguuuuugucuuaaaaa

SEQ ID NO: 2290950 - RNA, 17 nt, Human
auuuuucaauaaagcau

SEQ ID NO: 2290951 - RNA, 16 nt, Human
auuuuucaauaaagca

SEQ ID NO: 2290952 - RNA, 21 nt, Human
auuuuucaauaaagcauuuau

SEQ ID NO: 2290953 - RNA, 17 nt, Human
auuuuugaauguaguaa

SEQ ID NO: 2290954 - RNA, 22 nt, Human
auuuuucuggagguugauaacu

SEQ ID NO: 2290955 - RNA, 15 nt, Human
auuuuucugcacuga

SEQ ID NO: 2290956 - RNA, 16 nt, Human
auuuuucugcacugag

SEQ ID NO: 2290957 - RNA, 19 nt, Human
auuuuucuggagguugaua

SEQ ID NO: 2290958 - RNA, 21 nt, Human
auuuuucuggagguugauaac

SEQ ID NO: 2290959 - RNA, 22 nt, Human
auuuuucuuagggaaggauaca

SEQ ID NO: 2290960 - RNA, 15 nt, Human
auuuuucuuauuuca

SEQ ID NO: 2290961 - RNA, 20 nt, Human
auuuuucuuauuucauuucu

SEQ ID NO: 2290962 - RNA, 19 nt, Human
auuuuucuuauuucauuuc

SEQ ID NO: 2290963 - RNA, 23 nt, Human
auuuuuggaagaggacuccuuaa

SEQ ID NO: 2290964 - RNA, 19 nt, Human
auuuuugguugaauaaacu

SEQ ID NO: 2290965 - RNA, 17 nt, Human
auuuuugguugaauaaa

SEQ ID NO: 2290966 - RNA, 19 nt, Human
auuuuugguugucaauauu

SEQ ID NO: 2290967 - RNA, 15 nt, Human
auuuuugguugaaua

SEQ ID NO: 2290968 - RNA, 19 nt, Human
auuuuuggcagucugaauu

SEQ ID NO: 2290969 - RNA, 18 nt, Human
auuuuuggucauuguaau

SEQ ID NO: 2290970 - RNA, 17 nt, Human
auuuuugaaugugauuu

SEQ ID NO: 2290971 - RNA, 23 nt, Human
auuuuugauuuaugcauggaaac

SEQ ID NO: 2290972 - RNA, 13 nt, Human
auuuuugauuuau

SEQ ID NO: 2290973 - RNA, 15 nt, Human
auuuuugacaguguu

SEQ ID NO: 2290974 - RNA, 22 nt, Human
auuuuugaauguaguaaguaaa

SEQ ID NO: 2290975 - RNA, 15 nt, Human
auuuuugaaugugau

SEQ ID NO: 2290976 - RNA, 14 nt, Human
auuuuugccuucau

SEQ ID NO: 2290977 - RNA, 15 nt, Human
auuuuugccuucauu

SEQ ID NO: 2290978 - RNA, 21 nt, Human
auuuuugccucuuccagucuu

SEQ ID NO: 2290979 - RNA, 18 nt, Human
auuuuugccucuuccagu

SEQ ID NO: 2290980 - RNA, 14 nt, Human
auuuuugcaggagc

SEQ ID NO: 2290981 - RNA, 12 nt, Human
auuuuugccucu

SEQ ID NO: 2290982 - RNA, 22 nt, Human
auuuuugcccugaguccaagag

SEQ ID NO: 2290983 - RNA, 18 nt, Human
auuuuuuguuaaaugauu

SEQ ID NO: 2290984 - RNA, 18 nt, Human
auuuuuuuaaaauguuaa

SEQ ID NO: 2290985 - RNA, 15 nt, Human
auuuuuuuaaccaaa

SEQ ID NO: 2290986 - RNA, 16 nt, Human
auuuuuuuaaccaaag

SEQ ID NO: 2290987 - RNA, 18 nt, Human
auuuuuuuaaccaaaggu

SEQ ID NO: 2290988 - RNA, 19 nt, Human
auuuuuuuaaccaaaggug

SEQ ID NO: 2290989 - RNA, 21 nt, Human
auuuuuuuaaccaaaggugaa

SEQ ID NO: 2290990 - RNA, 13 nt, Human
auuuuuucugaau

SEQ ID NO: 2290991 - RNA, 20 nt, Human
auuuuuucucuaggaaauau

SEQ ID NO: 2290992 - RNA, 23 nt, Human
auuuuuucucuaggaaauauuua

SEQ ID NO: 2290993 - RNA, 13 nt, Human
auuuuuuauauau

SEQ ID NO: 2290994 - RNA, 19 nt, Human
auuuuuuacagcugccugc

SEQ ID NO: 2290995 - RNA, 15 nt, Human
auuuuuuaauuauua

SEQ ID NO: 2290996 - RNA, 20 nt, Human
auuuuuuaauuauuauuuau

SEQ ID NO: 2290997 - RNA, 19 nt, Human
auuuuuuaaguauuuauau

SEQ ID NO: 2290998 - RNA, 18 nt, Human
auuuuuuaaguauuuaua

SEQ ID NO: 2290999 - RNA, 17 nt, Human
auuuuuuaaguauuuau

SEQ ID NO: 2291000 - RNA, 16 nt, Human
auuuuuuaaguauuua

SEQ ID NO: 2291001 - RNA, 22 nt, Human
auuuuuuaaguauuuauauauu

SEQ ID NO: 2291002 - RNA, 20 nt, Human
auuuuuuaaguauuuauaua

SEQ ID NO: 2291003 - RNA, 22 nt, Human
auuuuuucagaaauaugugguu

SEQ ID NO: 2291004 - RNA, 12 nt, Human
auuuuuucagac

SEQ ID NO: 2291005 - RNA, 13 nt, Human
auuuuuucagaaa

SEQ ID NO: 2291006 - RNA, 15 nt, Human
auuuuuuauuuuacu

SEQ ID NO: 2291007 - RNA, 12 nt, Human
auuuuuuauugu

SEQ ID NO: 2291008 - RNA, 13 nt, Human
auuuuuuauuguu

SEQ ID NO: 2291009 - RNA, 18 nt, Human
auuuuuuauauauacagu

SEQ ID NO: 2291010 - RNA, 21 nt, Human
auuuuuuaucaugcauguccu

SEQ ID NO: 2291011 - RNA, 16 nt, Human
auuuuuuaucaugcau

SEQ ID NO: 2291012 - RNA, 13 nt, Human
auuuuuucccaaa

SEQ ID NO: 2291013 - RNA, 16 nt, Human
auuuuuucagaccgaa

SEQ ID NO: 2291014 - RNA, 13 nt, Human
auuuuuucagacc

SEQ ID NO: 2291015 - RNA, 14 nt, Human
auuuuuucagaccg

SEQ ID NO: 2291016 - RNA, 20 nt, Human
auuuuuuaaaguuacuuugu

SEQ ID NO: 2291017 - RNA, 18 nt, Human
auuuuuuaaauugaauuc

SEQ ID NO: 2291018 - RNA, 11 nt, Human
auuuuuuaagu

SEQ ID NO: 2291019 - RNA, 16 nt, Human
auuuuuuaaggaaaca

SEQ ID NO: 2291020 - RNA, 17 nt, Human
auuuuuuaaggaaacaa

SEQ ID NO: 2291021 - RNA, 14 nt, Human
auuuuuuaaaugca

SEQ ID NO: 2291022 - RNA, 13 nt, Human
auuuuuuaaaugc

SEQ ID NO: 2291023 - RNA, 22 nt, Human
auuuuuguuucuuccaaagcac

SEQ ID NO: 2291024 - RNA, 21 nt, Human
auuuuuguuuucauuaucuca

SEQ ID NO: 2291025 - RNA, 14 nt, Human
auuuuugucuugug

SEQ ID NO: 2291026 - RNA, 21 nt, Human
auuuuuguaucuacaucuuuu

SEQ ID NO: 2291027 - RNA, 21 nt, Human
auuuuuguacaguuugcugua

SEQ ID NO: 2291028 - RNA, 13 nt, Human
auuuuuguaucua

SEQ ID NO: 2291029 - RNA, 20 nt, Human
auuuuugugaaaugaaaaca

SEQ ID NO: 2291030 - RNA, 23 nt, Human
auuuuugucuuauauauauuucu

SEQ ID NO: 2291031 - RNA, 17 nt, Human
auuuuuguuucuuccaa

SEQ ID NO: 2291032 - RNA, 16 nt, Human
auuuuuguuucuaccu

SEQ ID NO: 2291033 - RNA, 22 nt, Human
auuuuugugauuuugugauuga

SEQ ID NO: 2291034 - RNA, 19 nt, Human
auuuuuguagagccagggu

SEQ ID NO: 2291035 - RNA, 12 nt, Human
auuuuuguaauu

SEQ ID NO: 2291036 - RNA, 20 nt, Human
auuuuuguacccuuccuaca

SEQ ID NO: 2291037 - RNA, 22 nt, Human
auuuuuguaagacaauccaugu

SEQ ID NO: 2291038 - RNA, 11 nt, Human
auuuuuguaca

SEQ ID NO: 2291039 - RNA, 12 nt, Human
auuuuuguacag

SEQ ID NO: 2291040 - RNA, 20 nt, Human
auuuuuguacaguuugcugu

SEQ ID NO: 2291041 - RNA, 14 nt, Human
auuuuggagaaauu

SEQ ID NO: 2291042 - RNA, 12 nt, Human
auucuagugcug

SEQ ID NO: 2291043 - RNA, 14 nt, Human
auucuagugcugcu

SEQ ID NO: 2291044 - RNA, 21 nt, Human
auucucaugccucagccuccu

SEQ ID NO: 2291045 - RNA, 20 nt, Human
auucuaggcaucccagggga

SEQ ID NO: 2291046 - RNA, 16 nt, Human
auucuaggcaucccag

SEQ ID NO: 2291047 - RNA, 13 nt, Human
auucuaggcaucc

SEQ ID NO: 2291048 - RNA, 15 nt, Human
auucuagcuuugagc

SEQ ID NO: 2291049 - RNA, 18 nt, Human
auucuaaugucuucauuu

SEQ ID NO: 2291050 - RNA, 14 nt, Human
auucuaaugucuuc

SEQ ID NO: 2291051 - RNA, 16 nt, Human
auucuaaugucuucau

SEQ ID NO: 2291052 - RNA, 15 nt, Human
auucuagcuaaugua

SEQ ID NO: 2291053 - RNA, 18 nt, Human
auucuagcuaauguaaua

SEQ ID NO: 2291054 - RNA, 17 nt, Human
auucucauuugucacac

SEQ ID NO: 2291055 - RNA, 14 nt, Human
auucuccacagcaa

SEQ ID NO: 2291056 - RNA, 13 nt, Human
auucuccacagca

SEQ ID NO: 2291057 - RNA, 15 nt, Human
auucucaugugaucc

SEQ ID NO: 2291058 - RNA, 22 nt, Human
auucucaugccucagccuccug

SEQ ID NO: 2291059 - RNA, 15 nt, Human
auucuagugcugcug

SEQ ID NO: 2291060 - RNA, 17 nt, Human
auucuagugcugcugaa

SEQ ID NO: 2291061 - RNA, 16 nt, Human
auucucauggagaagu

SEQ ID NO: 2291062 - RNA, 12 nt, Human
auucucauguga

SEQ ID NO: 2291063 - RNA, 11 nt, Human
auucugccugc

SEQ ID NO: 2291064 - RNA, 13 nt, Human
auucugccugccc

SEQ ID NO: 2291065 - RNA, 14 nt, Human
auucugccugccca

SEQ ID NO: 2291066 - RNA, 15 nt, Human
auucugccugcccag

SEQ ID NO: 2291067 - RNA, 16 nt, Human
auucugccugcccagg

SEQ ID NO: 2291068 - RNA, 17 nt, Human
auucugccugcccaggc

SEQ ID NO: 2291069 - RNA, 18 nt, Human
auucugccugcccaggcc

SEQ ID NO: 2291070 - RNA, 19 nt, Human
auucugccugcccaggccc

SEQ ID NO: 2291071 - RNA, 22 nt, Human
auucugccgugugcccucgggc

SEQ ID NO: 2291072 - RNA, 18 nt, Human
auucugcucacauaucug

SEQ ID NO: 2291073 - RNA, 20 nt, Human
auucugccugcccaggcccc

SEQ ID NO: 2291074 - RNA, 21 nt, Human
auucugccugcccaggccccu

SEQ ID NO: 2291075 - RNA, 19 nt, Human
auucugcucacauaucugu

SEQ ID NO: 2291076 - RNA, 20 nt, Human
auucugcucacauaucuguc

SEQ ID NO: 2291077 - RNA, 21 nt, Human
auucugcucacauaucuguca

SEQ ID NO: 2291078 - RNA, 22 nt, Human
auucugcucacauaucugucau

SEQ ID NO: 2291079 - RNA, 15 nt, Human
auucugcuaccucac

SEQ ID NO: 2291080 - RNA, 22 nt, Human
auucugcgucaugcuuguguua

SEQ ID NO: 2291081 - RNA, 19 nt, Human
auucugcuaccucacuggg

SEQ ID NO: 2291082 - RNA, 23 nt, Human
auucugguuccagggucccucug

SEQ ID NO: 2291083 - RNA, 20 nt, Human
auucuguaaaaugucuguua

SEQ ID NO: 2291084 - RNA, 12 nt, Human
auucuguaaaug

SEQ ID NO: 2291085 - RNA, 12 nt, Human
auucuguacaua

SEQ ID NO: 2291086 - RNA, 15 nt, Human
auucuguacauagcc

SEQ ID NO: 2291087 - RNA, 14 nt, Human
auucuguaaaaugu

SEQ ID NO: 2291088 - RNA, 14 nt, Human
auucuguacucuua

SEQ ID NO: 2291089 - RNA, 20 nt, Human
auucuguacauagccuauau

SEQ ID NO: 2291090 - RNA, 18 nt, Human
auucuguacauagccuau

SEQ ID NO: 2291091 - RNA, 19 nt, Human
auucuguacauagccuaua

SEQ ID NO: 2291092 - RNA, 13 nt, Human
auucuguacugau

SEQ ID NO: 2291093 - RNA, 15 nt, Human
auucuguacugauuu

SEQ ID NO: 2291094 - RNA, 21 nt, Human
auucuguacugauuuuuguaa

SEQ ID NO: 2291095 - RNA, 15 nt, Human
auucuguagauucug

SEQ ID NO: 2291096 - RNA, 19 nt, Human
auucuguuggccaguguga

SEQ ID NO: 2291097 - RNA, 21 nt, Human
auucuguuggccagugugaca

SEQ ID NO: 2291098 - RNA, 14 nt, Human
auucuguuggccag

SEQ ID NO: 2291099 - RNA, 13 nt, Human
auugacuuugucu

SEQ ID NO: 2291100 - RNA, 14 nt, Human
auugacuuguauau

SEQ ID NO: 2291101 - RNA, 14 nt, Human
auugacuucaauga

SEQ ID NO: 2291102 - RNA, 18 nt, Human
auugacuucaaugauagu

SEQ ID NO: 2291103 - RNA, 11 nt, Human
auugacuucuu

SEQ ID NO: 2291104 - RNA, 21 nt, Human
auugacuaucaaacugaagcc

SEQ ID NO: 2291105 - RNA, 18 nt, Human
auugacuaucaaacugaa

SEQ ID NO: 2291106 - RNA, 22 nt, Human
auugacucaaaucuccaguauu

SEQ ID NO: 2291107 - RNA, 17 nt, Human
auugaccugaggcccuu

SEQ ID NO: 2291108 - RNA, 19 nt, Human
auugacacuuaaaaauggu

SEQ ID NO: 2291109 - RNA, 17 nt, Human
auugacacagaaaaugu

SEQ ID NO: 2291110 - RNA, 22 nt, Human
auugacgacaagugcugaacag

SEQ ID NO: 2291111 - RNA, 21 nt, Human
auugacgacaagugcugaaca

SEQ ID NO: 2291112 - RNA, 20 nt, Human
auugacaauaauuucagguu

SEQ ID NO: 2291113 - RNA, 18 nt, Human
auugacaauaauuucagg

SEQ ID NO: 2291114 - RNA, 14 nt, Human
auugacacagaaaa

SEQ ID NO: 2291115 - RNA, 12 nt, Human
auugacacagaa

SEQ ID NO: 2291116 - RNA, 17 nt, Human
auugacaauaauuucag

SEQ ID NO: 2291117 - RNA, 15 nt, Human
auugacaagucauuu

SEQ ID NO: 2291118 - RNA, 15 nt, Human
auugacaagaacuga

SEQ ID NO: 2291119 - RNA, 17 nt, Human
auugacacuuaaaaaug

SEQ ID NO: 2291120 - RNA, 15 nt, Human
auugacacuuaaaaa

SEQ ID NO: 2291121 - RNA, 19 nt, Human
auugaacuuaaauaaaugu

SEQ ID NO: 2291122 - RNA, 23 nt, Human
auugaacucuuugaaugacaaag

SEQ ID NO: 2291123 - RNA, 15 nt, Human
auugaacucuuugaa

SEQ ID NO: 2291124 - RNA, 22 nt, Human
auugaagcauuuuauaaaucgc

SEQ ID NO: 2291125 - RNA, 15 nt, Human
auugaagcccuccaa

SEQ ID NO: 2291126 - RNA, 18 nt, Human
auugaaaaaauagagccu

SEQ ID NO: 2291127 - RNA, 14 nt, Human
auugaaaaaauaga

SEQ ID NO: 2291128 - RNA, 15 nt, Human
auugaaaaaccauuu

SEQ ID NO: 2291129 - RNA, 22 nt, Human
auugaaaaaauagagccugagg

SEQ ID NO: 2291130 - RNA, 19 nt, Human
auugaaaaaauagagccug

SEQ ID NO: 2291131 - RNA, 16 nt, Human
auugaaaugacuaaaa

SEQ ID NO: 2291132 - RNA, 20 nt, Human
auugaaaucuuuuugcuuug

SEQ ID NO: 2291133 - RNA, 17 nt, Human
auugaaaucuuuuugcu

SEQ ID NO: 2291134 - RNA, 18 nt, Human
auugaaaucuuuuugcuu

SEQ ID NO: 2291135 - RNA, 23 nt, Human
auucuuccaucugauugugaugu

SEQ ID NO: 2291136 - RNA, 17 nt, Human
auucuuacaaacaugug

SEQ ID NO: 2291137 - RNA, 13 nt, Human
auucuuccaucug

SEQ ID NO: 2291138 - RNA, 15 nt, Human
auucuuccaucugau

SEQ ID NO: 2291139 - RNA, 14 nt, Human
auucuuccaucuga

SEQ ID NO: 2291140 - RNA, 19 nt, Human
auucuuccuaguuuucucc

SEQ ID NO: 2291141 - RNA, 17 nt, Human
auucuuccuaguuuucu

SEQ ID NO: 2291142 - RNA, 20 nt, Human
auucuucccuaucuuugcca

SEQ ID NO: 2291143 - RNA, 12 nt, Human
auucuuccuagu

SEQ ID NO: 2291144 - RNA, 21 nt, Human
auucuucccuaucuuugccac

SEQ ID NO: 2291145 - RNA, 22 nt, Human
auucuuaagggaacuuccacau

SEQ ID NO: 2291146 - RNA, 16 nt, Human
auucuuacaaacaugu

SEQ ID NO: 2291147 - RNA, 21 nt, Human
auucuuacaaacaugugguua

SEQ ID NO: 2291148 - RNA, 17 nt, Human
auucuguagauucugug

SEQ ID NO: 2291149 - RNA, 14 nt, Human
auucuuaaauaugu

SEQ ID NO: 2291150 - RNA, 13 nt, Human
auuggcagcagau

SEQ ID NO: 2291151 - RNA, 12 nt, Human
auucuaaugucu

SEQ ID NO: 2291152 - RNA, 13 nt, Human
auucuaaugucuu

SEQ ID NO: 2291153 - RNA, 15 nt, Human
auucuaagugaaauu

SEQ ID NO: 2291154 - RNA, 19 nt, Human
auucuaacuuuuuugcuau

SEQ ID NO: 2291155 - RNA, 18 nt, Human
auucuaagacuaaugcuc

SEQ ID NO: 2291156 - RNA, 17 nt, Human
auucccuagaucuuucu

SEQ ID NO: 2291157 - RNA, 21 nt, Human
auuccccuaucucuagaauuu

SEQ ID NO: 2291158 - RNA, 20 nt, Human
auuccccggggcguuucuuu

SEQ ID NO: 2291159 - RNA, 13 nt, Human
auuccccucugcu

SEQ ID NO: 2291160 - RNA, 15 nt, Human
auuccccucugcugc

SEQ ID NO: 2291161 - RNA, 22 nt, Human
auuccccucugcugcugucccu

SEQ ID NO: 2291162 - RNA, 23 nt, Human
auuccccgucucugguuccuccc

SEQ ID NO: 2291163 - RNA, 23 nt, Human
auucccccuggccaccacccccc

SEQ ID NO: 2291164 - RNA, 21 nt, Human
auucccuagaaacuuccaaau

SEQ ID NO: 2291165 - RNA, 20 nt, Human
auucccuagaaacuuccaaa

SEQ ID NO: 2291166 - RNA, 17 nt, Human
auucccuagaaacuucc

SEQ ID NO: 2291167 - RNA, 20 nt, Human
auucccagggaagugcucug

SEQ ID NO: 2291168 - RNA, 22 nt, Human
auucccagggaagugcucugau

SEQ ID NO: 2291169 - RNA, 15 nt, Human
auucccauuuugcaa

SEQ ID NO: 2291170 - RNA, 15 nt, Human
auucccaucugucac

SEQ ID NO: 2291171 - RNA, 20 nt, Human
auucccauuuugcaaaauuu

SEQ ID NO: 2291172 - RNA, 18 nt, Human
auucccauuuugcaaaau

SEQ ID NO: 2291173 - RNA, 23 nt, Human
auucccauuuugcaaaauuucca

SEQ ID NO: 2291174 - RNA, 23 nt, Human
auucccagagacaggaaaauccu

SEQ ID NO: 2291175 - RNA, 19 nt, Human
auucccagagacaggaaaa

SEQ ID NO: 2291176 - RNA, 16 nt, Human
auucccagagacagga

SEQ ID NO: 2291177 - RNA, 12 nt, Human
auucccagagac

SEQ ID NO: 2291178 - RNA, 13 nt, Human
auuccagccccuc

SEQ ID NO: 2291179 - RNA, 14 nt, Human
auuccagccccucu

SEQ ID NO: 2291180 - RNA, 12 nt, Human
auucccagccca

SEQ ID NO: 2291181 - RNA, 19 nt, Human
auucccagagcaaaauaau

SEQ ID NO: 2291182 - RNA, 17 nt, Human
auucccagagcaaaaua

SEQ ID NO: 2291183 - RNA, 19 nt, Human
auuccagagcguguaguga

SEQ ID NO: 2291184 - RNA, 12 nt, Human
auuccagaggaa

SEQ ID NO: 2291185 - RNA, 20 nt, Human
auuccagaucugcagucacu

SEQ ID NO: 2291186 - RNA, 21 nt, Human
auuccagagaguggcuccucc

SEQ ID NO: 2291187 - RNA, 19 nt, Human
auuccagagaguggcuccu

SEQ ID NO: 2291188 - RNA, 13 nt, Human
auucaggaagcuc

SEQ ID NO: 2291189 - RNA, 16 nt, Human
auucaggaagaugaaa

SEQ ID NO: 2291190 - RNA, 22 nt, Human
auucaggaagcagcuuucccca

SEQ ID NO: 2291191 - RNA, 12 nt, Human
auucaggaagcu

SEQ ID NO: 2291192 - RNA, 22 nt, Human
auucaggaaaacugacagagga

SEQ ID NO: 2291193 - RNA, 20 nt, Human
auucagcuucauuuguguca

SEQ ID NO: 2291194 - RNA, 19 nt, Human
auucaggaaaagccucugu

SEQ ID NO: 2291195 - RNA, 12 nt, Human
auucagcuucau

SEQ ID NO: 2291196 - RNA, 18 nt, Human
auucagacagcugccugg

SEQ ID NO: 2291197 - RNA, 14 nt, Human
auucagacagcugc

SEQ ID NO: 2291198 - RNA, 15 nt, Human
auucagacagcugcc

SEQ ID NO: 2291199 - RNA, 16 nt, Human
auucagacagcugccu

SEQ ID NO: 2291200 - RNA, 17 nt, Human
auucagacagcugccug

SEQ ID NO: 2291201 - RNA, 13 nt, Human
auucagaaauugg

SEQ ID NO: 2291202 - RNA, 14 nt, Human
auucagaaauugga

SEQ ID NO: 2291203 - RNA, 13 nt, Human
auucacauuguau

SEQ ID NO: 2291204 - RNA, 20 nt, Human
auucacauuguauucagagu

SEQ ID NO: 2291205 - RNA, 11 nt, Human
auucagacagc

SEQ ID NO: 2291206 - RNA, 13 nt, Human
auucagacaagca

SEQ ID NO: 2291207 - RNA, 15 nt, Human
auucagaaggggagg

SEQ ID NO: 2291208 - RNA, 12 nt, Human
auucagacagcu

SEQ ID NO: 2291209 - RNA, 13 nt, Human
auucagacagcug

SEQ ID NO: 2291210 - RNA, 19 nt, Human
auuaucuauacauaucuuu

SEQ ID NO: 2291211 - RNA, 14 nt, Human
auuaucuauacaua

SEQ ID NO: 2291212 - RNA, 20 nt, Human
auuaucuauacauaucuuua

SEQ ID NO: 2291213 - RNA, 21 nt, Human
auuauguuaaaacugggacag

SEQ ID NO: 2291214 - RNA, 18 nt, Human
auuaucuagauacuguau

SEQ ID NO: 2291215 - RNA, 14 nt, Human
auuaucuagauacu

SEQ ID NO: 2291216 - RNA, 19 nt, Human
auuaucuaaaaucugcuag

SEQ ID NO: 2291217 - RNA, 17 nt, Human
auuaucuaaaguguguu

SEQ ID NO: 2291218 - RNA, 23 nt, Human
auuaucuaaaguguguuguugcu

SEQ ID NO: 2291219 - RNA, 15 nt, Human
auuauauuuauuacu

SEQ ID NO: 2291220 - RNA, 18 nt, Human
auuauauuuauuacugua

SEQ ID NO: 2291221 - RNA, 21 nt, Human
auuauuaguaagaaaacauca

SEQ ID NO: 2291222 - RNA, 22 nt, Human
auuauuagccagguaaugugaa

SEQ ID NO: 2291223 - RNA, 15 nt, Human
auuauuaguacugcu

SEQ ID NO: 2291224 - RNA, 22 nt, Human
auuauuaguuuugauuuaaugu

SEQ ID NO: 2291225 - RNA, 17 nt, Human
auuauuauuaaaaauau

SEQ ID NO: 2291226 - RNA, 15 nt, Human
auuauuauucuucau

SEQ ID NO: 2291227 - RNA, 22 nt, Human
auuauuaguuuacaucauuuuu

SEQ ID NO: 2291228 - RNA, 15 nt, Human
auuauuauuuggccc

SEQ ID NO: 2291229 - RNA, 13 nt, Human
auuauuacuguuu

SEQ ID NO: 2291230 - RNA, 21 nt, Human
auuauuacuuauuuuugacag

SEQ ID NO: 2291231 - RNA, 20 nt, Human
auuauuacuuauuuuugaca

SEQ ID NO: 2291232 - RNA, 23 nt, Human
auuauguuaaacuagcauaucug

SEQ ID NO: 2291233 - RNA, 12 nt, Human
auuauguuaaac

SEQ ID NO: 2291234 - RNA, 13 nt, Human
auuauguuaaacu

SEQ ID NO: 2291235 - RNA, 14 nt, Human
auuauguuaaacua

SEQ ID NO: 2291236 - RNA, 22 nt, Human
auuauguuaaacuagcauaucu

SEQ ID NO: 2291237 - RNA, 11 nt, Human
auuauuucaga

SEQ ID NO: 2291238 - RNA, 21 nt, Human
auuauuucacuuuagaugcug

SEQ ID NO: 2291239 - RNA, 17 nt, Human
auuauuuauuuaauaac

SEQ ID NO: 2291240 - RNA, 18 nt, Human
auuauuucacuuuagaug

SEQ ID NO: 2291241 - RNA, 16 nt, Human
auuauuucuaggaaga

SEQ ID NO: 2291242 - RNA, 20 nt, Human
auuauuucuaggaagaauuu

SEQ ID NO: 2291243 - RNA, 22 nt, Human
auuauuucuaggaagaauuuua

SEQ ID NO: 2291244 - RNA, 15 nt, Human
auuauuuauuuauuu

SEQ ID NO: 2291245 - RNA, 23 nt, Human
auuauuuauucagcuucauuugu

SEQ ID NO: 2291246 - RNA, 14 nt, Human
auuauuuauuuaau

SEQ ID NO: 2291247 - RNA, 16 nt, Human
auuauuauucuucaua

SEQ ID NO: 2291248 - RNA, 15 nt, Human
auuauuauuuguguu

SEQ ID NO: 2291249 - RNA, 14 nt, Human
auuauuugaaaaca

SEQ ID NO: 2291250 - RNA, 23 nt, Human
auuauuugaaaacauauaaagca

SEQ ID NO: 2291251 - RNA, 11 nt, Human
auuauuugcau

SEQ ID NO: 2291252 - RNA, 15 nt, Human
auuauuuguguaaua

SEQ ID NO: 2291253 - RNA, 12 nt, Human
auuauuuugaug

SEQ ID NO: 2291254 - RNA, 23 nt, Human
auucacaguucuuugggccagac

SEQ ID NO: 2291255 - RNA, 20 nt, Human
auuauuuugguacuuuuaug

SEQ ID NO: 2291256 - RNA, 22 nt, Human
auucacaguucuuugggccaga

SEQ ID NO: 2291257 - RNA, 20 nt, Human
auucacaucuaaccucaucu

SEQ ID NO: 2291258 - RNA, 17 nt, Human
auucacaucuaaccuca

SEQ ID NO: 2291259 - RNA, 20 nt, Human
auucaaacagucucaggaaa

SEQ ID NO: 2291260 - RNA, 19 nt, Human
auucaaacagucucaggaa

SEQ ID NO: 2291261 - RNA, 18 nt, Human
auucaaacagucucagga

SEQ ID NO: 2291262 - RNA, 16 nt, Human
auucaaacagucucag

SEQ ID NO: 2291263 - RNA, 17 nt, Human
auuauuuguguaauaga

SEQ ID NO: 2291264 - RNA, 19 nt, Human
auuauuuugguacuuuuau

SEQ ID NO: 2291265 - RNA, 16 nt, Human
auucuaguuuugucaa

SEQ ID NO: 2291266 - RNA, 22 nt, Human
auuauaauuuuuuucaauauuu

SEQ ID NO: 2291267 - RNA, 23 nt, Human
auuauaauuuuuuucaauauuua

SEQ ID NO: 2291268 - RNA, 17 nt, Human
auuauaauuuaaugcau

SEQ ID NO: 2291269 - RNA, 14 nt, Human
auuaguuaauauau

SEQ ID NO: 2291270 - RNA, 18 nt, Human
auuaguuuacaucauuuu

SEQ ID NO: 2291271 - RNA, 22 nt, Human
auuaguguaugcuuugaaugua

SEQ ID NO: 2291272 - RNA, 15 nt, Human
uuuguggccucagaa

SEQ ID NO: 2291273 - RNA, 17 nt, Human
auuagugcuaaguguga

SEQ ID NO: 2291274 - RNA, 18 nt, Human
auuagugcuaagugugaa

SEQ ID NO: 2291275 - RNA, 20 nt, Human
auuagugcuaagugugaacu

SEQ ID NO: 2291276 - RNA, 22 nt, Human
auuagugcuaagugugaacugg

SEQ ID NO: 2291277 - RNA, 14 nt, Human
uuuguggccucaga

SEQ ID NO: 2291278 - RNA, 12 nt, Human
uuuguggccuca

SEQ ID NO: 2291279 - RNA, 22 nt, Human
uuuguggccaaggagcugcuau

SEQ ID NO: 2291280 - RNA, 21 nt, Human
uuuguggccaaggagcugcua

SEQ ID NO: 2291281 - RNA, 20 nt, Human
uuuguggccaaggagcugcu

SEQ ID NO: 2291282 - RNA, 18 nt, Human
uuuguggccaaggagcug

SEQ ID NO: 2291283 - RNA, 11 nt, Human
uuuguggccaa

SEQ ID NO: 2291284 - RNA, 17 nt, Human
uuuguggaugucuuccu

SEQ ID NO: 2291285 - RNA, 17 nt, Human
uuuguggcaccuuuucu

SEQ ID NO: 2291286 - RNA, 14 nt, Human
uuugugcuucuaau

SEQ ID NO: 2291287 - RNA, 20 nt, Human
uuuguggaaagucacagguc

SEQ ID NO: 2291288 - RNA, 12 nt, Human
uuuguggaauaa

SEQ ID NO: 2291289 - RNA, 14 nt, Human
uuuguggaugucuu

SEQ ID NO: 2291290 - RNA, 11 nt, Human
uuuguggaaaa

SEQ ID NO: 2291291 - RNA, 13 nt, Human
uuugugcuguggg

SEQ ID NO: 2291292 - RNA, 12 nt, Human
uuugugcuucua

SEQ ID NO: 2291293 - RNA, 18 nt, Human
auuauauuguuaaucaau

SEQ ID NO: 2291294 - RNA, 20 nt, Human
auuauauuauuaguuuugau

SEQ ID NO: 2291295 - RNA, 14 nt, Human
auuauauuaugaag

SEQ ID NO: 2291296 - RNA, 15 nt, Human
auuauauuuacaaau

SEQ ID NO: 2291297 - RNA, 19 nt, Human
auuauacuaagaaaagaua

SEQ ID NO: 2291298 - RNA, 17 nt, Human
auuauacuaagaaaaga

SEQ ID NO: 2291299 - RNA, 15 nt, Human
auuauacuaagaaaa

SEQ ID NO: 2291300 - RNA, 12 nt, Human
auuauacuguau

SEQ ID NO: 2291301 - RNA, 18 nt, Human
auuauacuguauuaagag

SEQ ID NO: 2291302 - RNA, 13 nt, Human
auuauauuaaaau

SEQ ID NO: 2291303 - RNA, 14 nt, Human
auuauauuaaaaua

SEQ ID NO: 2291304 - RNA, 22 nt, Human
auuauacagaccgaacuguugu

SEQ ID NO: 2291305 - RNA, 19 nt, Human
auuauacccccugcaaagc

SEQ ID NO: 2291306 - RNA, 19 nt, Human
auucagacagcugccuggg

SEQ ID NO: 2291307 - RNA, 16 nt, Human
auggcaggauggccug

SEQ ID NO: 2291308 - RNA, 14 nt, Human
auggcagcugccac

SEQ ID NO: 2291309 - RNA, 20 nt, Human
auggcagcuguuuaaauguu

SEQ ID NO: 2291310 - RNA, 17 nt, Human
auggcaggauggccugg

SEQ ID NO: 2291311 - RNA, 22 nt, Human
auggcaggauggccuggccagg

SEQ ID NO: 2291312 - RNA, 16 nt, Human
auggcacuugcaucug

SEQ ID NO: 2291313 - RNA, 17 nt, Human
auggcacuugcaucugu

SEQ ID NO: 2291314 - RNA, 14 nt, Human
auggcaccagaggc

SEQ ID NO: 2291315 - RNA, 13 nt, Human
auggcacccagug

SEQ ID NO: 2291316 - RNA, 17 nt, Human
auggcaccuucagacuu

SEQ ID NO: 2291317 - RNA, 21 nt, Human
auggcaccuucagacuuugcu

SEQ ID NO: 2291318 - RNA, 20 nt, Human
auggcacuuagcuaucagaa

SEQ ID NO: 2291319 - RNA, 22 nt, Human
auggcacuuagcuaucagaaga

SEQ ID NO: 2291320 - RNA, 20 nt, Human
auggagacuccaugagaagc

SEQ ID NO: 2291321 - RNA, 22 nt, Human
auggagaagaaaggccaucaga

SEQ ID NO: 2291322 - RNA, 14 nt, Human
auggagacuccugc

SEQ ID NO: 2291323 - RNA, 18 nt, Human
auggagacuccugcccug

SEQ ID NO: 2291324 - RNA, 18 nt, Human
auggagacugucucaaga

SEQ ID NO: 2291325 - RNA, 13 nt, Human
auggagagaaaac

SEQ ID NO: 2291326 - RNA, 20 nt, Human
auggagacuccugcccuguu

SEQ ID NO: 2291327 - RNA, 21 nt, Human
auggagacugguccugugugc

SEQ ID NO: 2291328 - RNA, 14 nt, Human
auggcacuaguauu

SEQ ID NO: 2291329 - RNA, 16 nt, Human
auggcacuaguauuuc

SEQ ID NO: 2291330 - RNA, 14 nt, Human
auggccccagcaca

SEQ ID NO: 2291331 - RNA, 15 nt, Human
auggccccagcacag

SEQ ID NO: 2291332 - RNA, 17 nt, Human
auggccccagcacagcu

SEQ ID NO: 2291333 - RNA, 18 nt, Human
auggccccagcacagcuu

SEQ ID NO: 2291334 - RNA, 20 nt, Human
auggccccagcacagcuuga

SEQ ID NO: 2291335 - RNA, 22 nt, Human
auggccauggaguguacaagua

SEQ ID NO: 2291336 - RNA, 15 nt, Human
auggccaugguaccc

SEQ ID NO: 2291337 - RNA, 14 nt, Human
auggcccaguguca

SEQ ID NO: 2291338 - RNA, 17 nt, Human
auggccagugucugucc

SEQ ID NO: 2291339 - RNA, 22 nt, Human
auggccagugucugucccgggg

SEQ ID NO: 2291340 - RNA, 17 nt, Human
auggcauccugugaagu

SEQ ID NO: 2291341 - RNA, 15 nt, Human
auggcaucaccucca

SEQ ID NO: 2291342 - RNA, 16 nt, Human
auggcauccugugaag

SEQ ID NO: 2291343 - RNA, 15 nt, Human
auggcauccugugaa

SEQ ID NO: 2291344 - RNA, 17 nt, Human
auggcauccaagagugc

SEQ ID NO: 2291345 - RNA, 15 nt, Human
auggcagugucuuuc

SEQ ID NO: 2291346 - RNA, 18 nt, Human
auggcaguguuccuauuu

SEQ ID NO: 2291347 - RNA, 11 nt, Human
auggcccuggg

SEQ ID NO: 2291348 - RNA, 18 nt, Human
auggcccuucccacugga

SEQ ID NO: 2291349 - RNA, 20 nt, Human
auggcggguggggguggaau

SEQ ID NO: 2291350 - RNA, 11 nt, Human
auggccccucu

SEQ ID NO: 2291351 - RNA, 18 nt, Human
auggccccucugaccugc

SEQ ID NO: 2291352 - RNA, 23 nt, Human
auggccccucugaccugcacugg

SEQ ID NO: 2291353 - RNA, 20 nt, Human
auggcgugucccucucggaa

SEQ ID NO: 2291354 - RNA, 17 nt, Human
auggcgugaucucggcu

SEQ ID NO: 2291355 - RNA, 19 nt, Human
auggcuaagcaaaauguga

SEQ ID NO: 2291356 - RNA, 18 nt, Human
auggcucacuauggugcc

SEQ ID NO: 2291357 - RNA, 19 nt, Human
auggcucacuauggugcca

SEQ ID NO: 2291358 - RNA, 22 nt, Human
auggcucacuauggugccaaug

SEQ ID NO: 2291359 - RNA, 15 nt, Human
auggcuccagaaaug

SEQ ID NO: 2291360 - RNA, 16 nt, Human
auggcuccagaaaugu

SEQ ID NO: 2291361 - RNA, 16 nt, Human
auggcucacuaugaau

SEQ ID NO: 2291362 - RNA, 18 nt, Human
auggcucacuaugaaucu

SEQ ID NO: 2291363 - RNA, 20 nt, Human
auggcucacuaugaaucuau

SEQ ID NO: 2291364 - RNA, 19 nt, Human
auggcuauauggcaagaaa

SEQ ID NO: 2291365 - RNA, 18 nt, Human
auggcguggucaagcacu

SEQ ID NO: 2291366 - RNA, 14 nt, Human
auggcuauauggca

SEQ ID NO: 2291367 - RNA, 18 nt, Human
auggcuaauguacugcau

SEQ ID NO: 2291368 - RNA, 17 nt, Human
augggacugggagggcc

SEQ ID NO: 2291369 - RNA, 16 nt, Human
augggacugggagggc

SEQ ID NO: 2291370 - RNA, 13 nt, Human
augggacuucuuu

SEQ ID NO: 2291371 - RNA, 19 nt, Human
augggacuucuuuucacau

SEQ ID NO: 2291372 - RNA, 15 nt, Human
augggacugggaggg

SEQ ID NO: 2291373 - RNA, 14 nt, Human
augggacugggagg

SEQ ID NO: 2291374 - RNA, 23 nt, Human
auggcuccgaacacccucgaagc

SEQ ID NO: 2291375 - RNA, 22 nt, Human
auggcuccagucugcugcccuc

SEQ ID NO: 2291376 - RNA, 20 nt, Human
auggcuccagucugcugccc

SEQ ID NO: 2291377 - RNA, 13 nt, Human
auggcuccagucu

SEQ ID NO: 2291378 - RNA, 17 nt, Human
auggcuccagaaauguc

SEQ ID NO: 2291379 - RNA, 23 nt, Human
auggcuccagucugcugcccucc

SEQ ID NO: 2291380 - RNA, 17 nt, Human
auggcucccacaggagu

SEQ ID NO: 2291381 - RNA, 22 nt, Human
augggagaaauaguguggaaau

SEQ ID NO: 2291382 - RNA, 20 nt, Human
augggacuucuuuucacauu

SEQ ID NO: 2291383 - RNA, 23 nt, Human
augggacuucuuuucacauucuu

SEQ ID NO: 2291384 - RNA, 17 nt, Human
augggagacccuugaca

SEQ ID NO: 2291385 - RNA, 18 nt, Human
augggagacccuugacac

SEQ ID NO: 2291386 - RNA, 15 nt, Human
augggagagaagaga

SEQ ID NO: 2291387 - RNA, 19 nt, Human
augggagagaagagaaugc

SEQ ID NO: 2291388 - RNA, 22 nt, Human
augggagcugguuagaaaugca

SEQ ID NO: 2291389 - RNA, 20 nt, Human
augggagcugguuagaaaug

SEQ ID NO: 2291390 - RNA, 15 nt, Human
augggagaguagaug

SEQ ID NO: 2291391 - RNA, 23 nt, Human
augggagcugaggccacacucag

SEQ ID NO: 2291392 - RNA, 23 nt, Human
augggaggcucacccccuucucc

SEQ ID NO: 2291393 - RNA, 21 nt, Human
augggagcugguuagaaaugc

SEQ ID NO: 2291394 - RNA, 20 nt, Human
augggagggggcuugaagcc

SEQ ID NO: 2291395 - RNA, 18 nt, Human
augggagggaggcucagg

SEQ ID NO: 2291396 - RNA, 21 nt, Human
uuucccgagcaaagucuaaag

SEQ ID NO: 2291397 - RNA, 20 nt, Human
uuuccccugcccccagaccu

SEQ ID NO: 2291398 - RNA, 13 nt, Human
uuuccccucccug

SEQ ID NO: 2291399 - RNA, 16 nt, Human
uuuccccucccugggu

SEQ ID NO: 2291400 - RNA, 18 nt, Human
uuuccccggucccuugag

SEQ ID NO: 2291401 - RNA, 21 nt, Human
uuucccccuuuucugcauuuu

SEQ ID NO: 2291402 - RNA, 17 nt, Human
uuuccaugaaaaugcaa

SEQ ID NO: 2291403 - RNA, 16 nt, Human
uuuccaugaaaacguu

SEQ ID NO: 2291404 - RNA, 17 nt, Human
uuuccaugaaguuugaa

SEQ ID NO: 2291405 - RNA, 23 nt, Human
uuuccccccacucuccccacacu

SEQ ID NO: 2291406 - RNA, 16 nt, Human
uuucccccuucuacau

SEQ ID NO: 2291407 - RNA, 23 nt, Human
uuucccccugcauucuuucugua

SEQ ID NO: 2291408 - RNA, 13 nt, Human
uuucauuauuagu

SEQ ID NO: 2291409 - RNA, 21 nt, Human
uuucauuauuaguacugcucu

SEQ ID NO: 2291410 - RNA, 12 nt, Human
uuuccaucuuua

SEQ ID NO: 2291411 - RNA, 17 nt, Human
uuuccaugaguccccug

SEQ ID NO: 2291412 - RNA, 18 nt, Human
uuuccaugaguccccugu

SEQ ID NO: 2291413 - RNA, 14 nt, Human
uuucaaauuucaca

SEQ ID NO: 2291414 - RNA, 23 nt, Human
uuucaacaaguagcuaaagucug

SEQ ID NO: 2291415 - RNA, 21 nt, Human
uuucauuaauacagggcauuu

SEQ ID NO: 2291416 - RNA, 18 nt, Human
uuucauuauguaaaaugu

SEQ ID NO: 2291417 - RNA, 20 nt, Human
uuucauuauguaaaauguuu

SEQ ID NO: 2291418 - RNA, 14 nt, Human
uuucaaagaaggaa

SEQ ID NO: 2291419 - RNA, 17 nt, Human
uuucaaagggagagaga

SEQ ID NO: 2291420 - RNA, 16 nt, Human
uuucaaagauucaaaa

SEQ ID NO: 2291421 - RNA, 17 nt, Human
uuucaaagcuuuuucca

SEQ ID NO: 2291422 - RNA, 14 nt, Human
uuucaaauuguauc

SEQ ID NO: 2291423 - RNA, 16 nt, Human
uuucaaauugagagaa

SEQ ID NO: 2291424 - RNA, 21 nt, Human
uuucaaauuggagcuucaugg

SEQ ID NO: 2291425 - RNA, 13 nt, Human
uuucaaauaucac

SEQ ID NO: 2291426 - RNA, 14 nt, Human
uuucaaaugugcug

SEQ ID NO: 2291427 - RNA, 20 nt, Human
uuucaaauagggucuaacuc

SEQ ID NO: 2291428 - RNA, 19 nt, Human
uuucaaauagggucuaacu

SEQ ID NO: 2291429 - RNA, 18 nt, Human
auggacucuacacuguga

SEQ ID NO: 2291430 - RNA, 16 nt, Human
auggacucuacacugu

SEQ ID NO: 2291431 - RNA, 14 nt, Human
auggacucuacacu

SEQ ID NO: 2291432 - RNA, 21 nt, Human
auggacuccagccugccuggc

SEQ ID NO: 2291433 - RNA, 15 nt, Human
auggacucugcacau

SEQ ID NO: 2291434 - RNA, 17 nt, Human
auggacucuucccccac

SEQ ID NO: 2291435 - RNA, 16 nt, Human
auggacugaugcuuuu

SEQ ID NO: 2291436 - RNA, 16 nt, Human
auggacuuguauauuu

SEQ ID NO: 2291437 - RNA, 17 nt, Human
auggacuuguauauuug

SEQ ID NO: 2291438 - RNA, 23 nt, Human
auggacuuguauauuuguacaaa

SEQ ID NO: 2291439 - RNA, 14 nt, Human
auggagaaacccug

SEQ ID NO: 2291440 - RNA, 22 nt, Human
auggacuuguauauuuguacaa

SEQ ID NO: 2291441 - RNA, 22 nt, Human
auggagaagcagaaauacauau

SEQ ID NO: 2291442 - RNA, 11 nt, Human
auggacuuugu

SEQ ID NO: 2291443 - RNA, 12 nt, Human
auggacuuuguu

SEQ ID NO: 2291444 - RNA, 18 nt, Human
uuucccguggccccagcc

SEQ ID NO: 2291445 - RNA, 19 nt, Human
uuucccguggccccagccu

SEQ ID NO: 2291446 - RNA, 20 nt, Human
uuucccguggccccagccug

SEQ ID NO: 2291447 - RNA, 21 nt, Human
uuucccguggccccagccugg

SEQ ID NO: 2291448 - RNA, 13 nt, Human
uuucccgccaagc

SEQ ID NO: 2291449 - RNA, 15 nt, Human
uuucccguggcccca

SEQ ID NO: 2291450 - RNA, 16 nt, Human
uuucccguggccccag

SEQ ID NO: 2291451 - RNA, 14 nt, Human
uuuccccuguccug

SEQ ID NO: 2291452 - RNA, 23 nt, Human
uuuccccuguccugauggucagc

SEQ ID NO: 2291453 - RNA, 21 nt, Human
uuuccccuguggggaucucag

SEQ ID NO: 2291454 - RNA, 22 nt, Human
uuucccgagcaaagucuaaagu

SEQ ID NO: 2291455 - RNA, 21 nt, Human
auggacaccccuuauccagga

SEQ ID NO: 2291456 - RNA, 22 nt, Human
auggacaccccuuauccaggac

SEQ ID NO: 2291457 - RNA, 22 nt, Human
auggacacuuugaaauguguuu

SEQ ID NO: 2291458 - RNA, 22 nt, Human
auggacuaucugucugguggcc

SEQ ID NO: 2291459 - RNA, 20 nt, Human
auggacuaucugucuggugg

SEQ ID NO: 2291460 - RNA, 21 nt, Human
auggacuaucugucugguggc

SEQ ID NO: 2291461 - RNA, 13 nt, Human
auggacuaucugu

SEQ ID NO: 2291462 - RNA, 17 nt, Human
auggacuaucugucugg

SEQ ID NO: 2291463 - RNA, 19 nt, Human
auggacacuccagugccag

SEQ ID NO: 2291464 - RNA, 15 nt, Human
auggacacuuugaaa

SEQ ID NO: 2291465 - RNA, 23 nt, Human
auggacacuuugaaauguguuuc

SEQ ID NO: 2291466 - RNA, 19 nt, Human
auggacuaacuugucuuug

SEQ ID NO: 2291467 - RNA, 11 nt, Human
auggacacucc

SEQ ID NO: 2291468 - RNA, 23 nt, Human
auggacaccccuuauccaggacu

SEQ ID NO: 2291469 - RNA, 13 nt, Human
auggacacuccag

SEQ ID NO: 2291470 - RNA, 15 nt, Human
auggacacuccagug

SEQ ID NO: 2291471 - RNA, 17 nt, Human
auggacacuccagugcc

SEQ ID NO: 2291472 - RNA, 21 nt, Human
augcuccagccaaccccugug

SEQ ID NO: 2291473 - RNA, 20 nt, Human
augcuccagccaaccccugu

SEQ ID NO: 2291474 - RNA, 19 nt, Human
augcuccagccaaccccug

SEQ ID NO: 2291475 - RNA, 18 nt, Human
augcuccagccaaccccu

SEQ ID NO: 2291476 - RNA, 17 nt, Human
augcuccagccaacccc

SEQ ID NO: 2291477 - RNA, 12 nt, Human
augcuccagcca

SEQ ID NO: 2291478 - RNA, 18 nt, Human
augcuagguuaauuccaa

SEQ ID NO: 2291479 - RNA, 13 nt, Human
augcuaucucugu

SEQ ID NO: 2291480 - RNA, 22 nt, Human
uuuauuaagauggauucucaga

SEQ ID NO: 2291481 - RNA, 23 nt, Human
uuuaucaugacauguuauauauu

SEQ ID NO: 2291482 - RNA, 16 nt, Human
uuuauuaauaaacauu

SEQ ID NO: 2291483 - RNA, 21 nt, Human
uuuauuaauaaacauucuauc

SEQ ID NO: 2291484 - RNA, 17 nt, Human
uuuauuaauugcuuuga

SEQ ID NO: 2291485 - RNA, 17 nt, Human
uuuauuaaugcacuuuc

SEQ ID NO: 2291486 - RNA, 12 nt, Human
uuuauuaaugca

SEQ ID NO: 2291487 - RNA, 22 nt, Human
augcuagaacucccuuucaaca

SEQ ID NO: 2291488 - RNA, 16 nt, Human
augcuagcucugagcc

SEQ ID NO: 2291489 - RNA, 15 nt, Human
augcuaggucucgga

SEQ ID NO: 2291490 - RNA, 21 nt, Human
augcuagaacucccuuucaac

SEQ ID NO: 2291491 - RNA, 20 nt, Human
augcuagaacucccuuucaa

SEQ ID NO: 2291492 - RNA, 18 nt, Human
uuuaucacacuucuguga

SEQ ID NO: 2291493 - RNA, 17 nt, Human
uuuaucacacuucugug

SEQ ID NO: 2291494 - RNA, 14 nt, Human
uuuaucacauguau

SEQ ID NO: 2291495 - RNA, 16 nt, Human
uuuaucacauguaugu

SEQ ID NO: 2291496 - RNA, 18 nt, Human
uuuaucacauguauguuu

SEQ ID NO: 2291497 - RNA, 15 nt, Human
uuuaucacacuucug

SEQ ID NO: 2291498 - RNA, 18 nt, Human
uuuaucaaucaguauaau

SEQ ID NO: 2291499 - RNA, 14 nt, Human
uuuaucaaaucagu

SEQ ID NO: 2291500 - RNA, 21 nt, Human
uuuaucaaucaguauaauucu

SEQ ID NO: 2291501 - RNA, 12 nt, Human
uuuauauuuuua

SEQ ID NO: 2291502 - RNA, 22 nt, Human
uuuaucaaacagaauuuuaaag

SEQ ID NO: 2291503 - RNA, 18 nt, Human
uuuaucaugugaaaucau

SEQ ID NO: 2291504 - RNA, 15 nt, Human
uuuauuaagauggau

SEQ ID NO: 2291505 - RNA, 17 nt, Human
uuuaucauucaagugua

SEQ ID NO: 2291506 - RNA, 14 nt, Human
uuuaucauucaagu

SEQ ID NO: 2291507 - RNA, 15 nt, Human
uuuaucauucaagug

SEQ ID NO: 2291508 - RNA, 17 nt, Human
uuuaucaugugaaauca

SEQ ID NO: 2291509 - RNA, 23 nt, Human
uuuaucaugcauguccuguaaag

SEQ ID NO: 2291510 - RNA, 22 nt, Human
uuuaucaugcauguccuguaaa

SEQ ID NO: 2291511 - RNA, 16 nt, Human
uuuaucaugcaugucc

SEQ ID NO: 2291512 - RNA, 14 nt, Human
uuuaucaugacaug

SEQ ID NO: 2291513 - RNA, 15 nt, Human
uuuaucaugacaugu

SEQ ID NO: 2291514 - RNA, 23 nt, Human
augcuaaagaaaaagucauccaa

SEQ ID NO: 2291515 - RNA, 14 nt, Human
augcuaacaucuaa

SEQ ID NO: 2291516 - RNA, 16 nt, Human
augcuaacaucuaaaa

SEQ ID NO: 2291517 - RNA, 17 nt, Human
augcuaacaucuaaaaa

SEQ ID NO: 2291518 - RNA, 19 nt, Human
augcuaacaucuaaaaaua

SEQ ID NO: 2291519 - RNA, 16 nt, Human
augcuaagacucagug

SEQ ID NO: 2291520 - RNA, 16 nt, Human
uuuauauuagaagugu

SEQ ID NO: 2291521 - RNA, 14 nt, Human
uuuauaugucaaag

SEQ ID NO: 2291522 - RNA, 14 nt, Human
uuuauauuuaguga

SEQ ID NO: 2291523 - RNA, 14 nt, Human
uuuauauuuaguua

SEQ ID NO: 2291524 - RNA, 14 nt, Human
augcugugugacuc

SEQ ID NO: 2291525 - RNA, 22 nt, Human
augcuuccugacaaucaacucu

SEQ ID NO: 2291526 - RNA, 20 nt, Human
augcuuccugacaaucaacu

SEQ ID NO: 2291527 - RNA, 16 nt, Human
augcuuccugacaauc

SEQ ID NO: 2291528 - RNA, 15 nt, Human
augcuuccugacaau

SEQ ID NO: 2291529 - RNA, 15 nt, Human
augcuuccuagaagu

SEQ ID NO: 2291530 - RNA, 16 nt, Human
augcuuccuagaaguu

SEQ ID NO: 2291531 - RNA, 17 nt, Human
augcuuccuagaaguua

SEQ ID NO: 2291532 - RNA, 21 nt, Human
augcuuccuagaaguuacuga

SEQ ID NO: 2291533 - RNA, 23 nt, Human
augcuuccuagaaguuacugaau

SEQ ID NO: 2291534 - RNA, 20 nt, Human
auggaaccgcaggaagcugc

SEQ ID NO: 2291535 - RNA, 19 nt, Human
auggaaccgcaggaagcug

SEQ ID NO: 2291536 - RNA, 18 nt, Human
auggaaccgcaggaagcu

SEQ ID NO: 2291537 - RNA, 17 nt, Human
auggaaccgcaggaagc

SEQ ID NO: 2291538 - RNA, 13 nt, Human
augcuucucacug

SEQ ID NO: 2291539 - RNA, 18 nt, Human
auggaaccugacguagcu

SEQ ID NO: 2291540 - RNA, 21 nt, Human
auggaaccuccuuucucuucu

SEQ ID NO: 2291541 - RNA, 13 nt, Human
auggaaccuccuu

SEQ ID NO: 2291542 - RNA, 14 nt, Human
auggaaccuccuuu

SEQ ID NO: 2291543 - RNA, 20 nt, Human
augcucccccauccuccccu

SEQ ID NO: 2291544 - RNA, 18 nt, Human
augcucccccauccuccc

SEQ ID NO: 2291545 - RNA, 15 nt, Human
augcucccccauccu

SEQ ID NO: 2291546 - RNA, 13 nt, Human
augcuccagucaa

SEQ ID NO: 2291547 - RNA, 24 nt, Human
augcuccagucaacaaacuauuuc

SEQ ID NO: 2291548 - RNA, 22 nt, Human
augcucccccauccuccccuuc

SEQ ID NO: 2291549 - RNA, 21 nt, Human
augcucccccauccuccccuu

SEQ ID NO: 2291550 - RNA, 23 nt, Human
augcucccccauccuccccuucc

SEQ ID NO: 2291551 - RNA, 14 nt, Human
augcucccuccccu

SEQ ID NO: 2291552 - RNA, 13 nt, Human
augcugcuggaca

SEQ ID NO: 2291553 - RNA, 13 nt, Human
augcugcuacuua

SEQ ID NO: 2291554 - RNA, 21 nt, Human
augcugcuacuuaauuccuuu

SEQ ID NO: 2291555 - RNA, 23 nt, Human
augcugcucauccccaccugucu

SEQ ID NO: 2291556 - RNA, 13 nt, Human
augcugcuuuccc

SEQ ID NO: 2291557 - RNA, 17 nt, Human
augcugcuuuccccugu

SEQ ID NO: 2291558 - RNA, 18 nt, Human
augcugcuuuccccugug

SEQ ID NO: 2291559 - RNA, 20 nt, Human
augcugcuuuccccuguggg

SEQ ID NO: 2291560 - RNA, 22 nt, Human
augcugugcccuaaaguguauu

SEQ ID NO: 2291561 - RNA, 17 nt, Human
augcugugcuaugaauu

SEQ ID NO: 2291562 - RNA, 23 nt, Human
augcugcuuuccccuguggggau

SEQ ID NO: 2291563 - RNA, 18 nt, Human
augcugugcuaugaauuu

SEQ ID NO: 2291564 - RNA, 20 nt, Human
uuucaaaauaaaaaccaaga

SEQ ID NO: 2291565 - RNA, 15 nt, Human
uuucaaaaugcuuuu

SEQ ID NO: 2291566 - RNA, 13 nt, Human
uuucaaaaugcuu

SEQ ID NO: 2291567 - RNA, 12 nt, Human
uuucaaaaugcu

SEQ ID NO: 2291568 - RNA, 22 nt, Human
uuucaaaauuguuacaaauugu

SEQ ID NO: 2291569 - RNA, 16 nt, Human
uuucaaacauauauaa

SEQ ID NO: 2291570 - RNA, 22 nt, Human
uuucaaacuuuacuauggcccu

SEQ ID NO: 2291571 - RNA, 17 nt, Human
uuucaaacacaaaugca

SEQ ID NO: 2291572 - RNA, 16 nt, Human
uuucaaacacaaaugc

SEQ ID NO: 2291573 - RNA, 16 nt, Human
uuucaaacuuuacuau

SEQ ID NO: 2291574 - RNA, 17 nt, Human
uuucaaacauauauaac

SEQ ID NO: 2291575 - RNA, 21 nt, Human
auggaaccugacguagcugca

SEQ ID NO: 2291576 - RNA, 16 nt, Human
uuuauuuuguguuuag

SEQ ID NO: 2291577 - RNA, 15 nt, Human
uuuauuuuucauauu

SEQ ID NO: 2291578 - RNA, 12 nt, Human
uuuauuuuucau

SEQ ID NO: 2291579 - RNA, 20 nt, Human
uuuauuuuguguuuaggaac

SEQ ID NO: 2291580 - RNA, 20 nt, Human
uuucaaaacucauuuccuau

SEQ ID NO: 2291581 - RNA, 18 nt, Human
uuucaaaaccuuuugaaa

SEQ ID NO: 2291582 - RNA, 23 nt, Human
uuucaaaacacaucuuuccuguc

SEQ ID NO: 2291583 - RNA, 21 nt, Human
uuucaaaaauauaacuuaaaa

SEQ ID NO: 2291584 - RNA, 17 nt, Human
uuucaaaaauauaacuu

SEQ ID NO: 2291585 - RNA, 18 nt, Human
uuucaaaaauauaacuua

SEQ ID NO: 2291586 - RNA, 15 nt, Human
uuuauuuuugcaugg

SEQ ID NO: 2291587 - RNA, 20 nt, Human
uuuauuuuucauauugugcc

SEQ ID NO: 2291588 - RNA, 16 nt, Human
uuucaaaaauauaacu

SEQ ID NO: 2291589 - RNA, 17 nt, Human
uuuauuuuucauuuagu

SEQ ID NO: 2291590 - RNA, 16 nt, Human
uuuauuuuucauauug

SEQ ID NO: 2291591 - RNA, 17 nt, Human
uuuauuuuucauauugu

SEQ ID NO: 2291592 - RNA, 22 nt, Human
uuuauuuuuccauuuacaacaa

SEQ ID NO: 2291593 - RNA, 15 nt, Human
uuuauuuuucuaaaa

SEQ ID NO: 2291594 - RNA, 24 nt, Human
augcaccugaauguuagauaguua

SEQ ID NO: 2291595 - RNA, 18 nt, Human
uuguuuucuucuguaugu

SEQ ID NO: 2291596 - RNA, 23 nt, Human
uuguuuugauguuuguggccuca

SEQ ID NO: 2291597 - RNA, 20 nt, Human
uuguuuugagcuuuccaugu

SEQ ID NO: 2291598 - RNA, 24 nt, Human
uuguuuugagcuuuccauguugcu

SEQ ID NO: 2291599 - RNA, 20 nt, Human
uuguuuucuucuguauguua

SEQ ID NO: 2291600 - RNA, 19 nt, Human
uuguuuugacggaugauug

SEQ ID NO: 2291601 - RNA, 17 nt, Human
uuguuuugagcuuucca

SEQ ID NO: 2291602 - RNA, 15 nt, Human
uuguuuugcuuuuuc

SEQ ID NO: 2291603 - RNA, 18 nt, Human
uuguuuugcuuuuucuga

SEQ ID NO: 2291604 - RNA, 19 nt, Human
uuguuuugcuuuuucugac

SEQ ID NO: 2291605 - RNA, 16 nt, Human
uuguuuugcacuuuuu

SEQ ID NO: 2291606 - RNA, 20 nt, Human
uuguuuugcacacuuugcca

SEQ ID NO: 2291607 - RNA, 14 nt, Human
uuguuuugcacuuu

SEQ ID NO: 2291608 - RNA, 15 nt, Human
uuguuuugcacuuuu

SEQ ID NO: 2291609 - RNA, 18 nt, Human
uuguuuugccaacauugc

SEQ ID NO: 2291610 - RNA, 19 nt, Human
uuuaaaaaucauaaacugu

SEQ ID NO: 2291611 - RNA, 16 nt, Human
uuuaaaaaucauaaac

SEQ ID NO: 2291612 - RNA, 15 nt, Human
uuuaaaaaucauaaa

SEQ ID NO: 2291613 - RNA, 13 nt, Human
uuuaaaaaucaua

SEQ ID NO: 2291614 - RNA, 12 nt, Human
uuuaaaaaucau

SEQ ID NO: 2291615 - RNA, 14 nt, Human
uuuaaaaauauuuu

SEQ ID NO: 2291616 - RNA, 17 nt, Human
uuuaaaaauagacacuc

SEQ ID NO: 2291617 - RNA, 22 nt, Human
uuguuuuggcugaaauucuccu

SEQ ID NO: 2291618 - RNA, 14 nt, Human
uuuaaaaaugaaau

SEQ ID NO: 2291619 - RNA, 12 nt, Human
uuuaaaaaugca

SEQ ID NO: 2291620 - RNA, 11 nt, Human
uuuaaaaauga

SEQ ID NO: 2291621 - RNA, 12 nt, Human
uuuaaaaaugaa

SEQ ID NO: 2291622 - RNA, 20 nt, Human
uuuaaaaaucauuguaugga

SEQ ID NO: 2291623 - RNA, 22 nt, Human
uuuaaaaaucuaccuucuguag

SEQ ID NO: 2291624 - RNA, 18 nt, Human
uuuaaagaagaaacgucu

SEQ ID NO: 2291625 - RNA, 13 nt, Human
uuuaaagaaugcu

SEQ ID NO: 2291626 - RNA, 14 nt, Human
uuuaaagagagguu

SEQ ID NO: 2291627 - RNA, 15 nt, Human
uuuaaagagagguua

SEQ ID NO: 2291628 - RNA, 19 nt, Human
uuuaaauaaaagugaucaa

SEQ ID NO: 2291629 - RNA, 13 nt, Human
uuuaaauaaagua

SEQ ID NO: 2291630 - RNA, 21 nt, Human
uuuaaauaaaguaucaugcau

SEQ ID NO: 2291631 - RNA, 22 nt, Human
uuuaaauaaaguaucaugcauu

SEQ ID NO: 2291632 - RNA, 23 nt, Human
uuuaaauaaaguaucaugcauuc

SEQ ID NO: 2291633 - RNA, 20 nt, Human
uuuaaaguguuucuguuauu

SEQ ID NO: 2291634 - RNA, 16 nt, Human
uuuaaauaaaacccuu

SEQ ID NO: 2291635 - RNA, 23 nt, Human
uuuaaauaaaagaaaaaauaucu

SEQ ID NO: 2291636 - RNA, 19 nt, Human
uuuaaaguguuucuguuau

SEQ ID NO: 2291637 - RNA, 18 nt, Human
uuuaaagugauuaaacgu

SEQ ID NO: 2291638 - RNA, 17 nt, Human
uuuaaagugauuaaacg

SEQ ID NO: 2291639 - RNA, 22 nt, Human
uuuaaaggggcagaaaaacucu

SEQ ID NO: 2291640 - RNA, 16 nt, Human
uuuaaaggggcagaaa

SEQ ID NO: 2291641 - RNA, 16 nt, Human
uuuaaaguagauuaga

SEQ ID NO: 2291642 - RNA, 23 nt, Human
uuuaaaguaugaaucuaugccaa

SEQ ID NO: 2291643 - RNA, 23 nt, Human
augauucgcccaaagccagacag

SEQ ID NO: 2291644 - RNA, 23 nt, Human
augauucuaauuuuuaagcaaaa

SEQ ID NO: 2291645 - RNA, 23 nt, Human
augauucuauuuauauguacaug

SEQ ID NO: 2291646 - RNA, 22 nt, Human
augauucuauuuauauguacau

SEQ ID NO: 2291647 - RNA, 15 nt, Human
augauuccuuccugu

SEQ ID NO: 2291648 - RNA, 20 nt, Human
augauucuuuguuacaggca

SEQ ID NO: 2291649 - RNA, 23 nt, Human
augauucugcuuuuaccaugccc

SEQ ID NO: 2291650 - RNA, 22 nt, Human
augauuccuugauggagauauu

SEQ ID NO: 2291651 - RNA, 15 nt, Human
augauucugcuuuua

SEQ ID NO: 2291652 - RNA, 16 nt, Human
augcaaggaaggaaag

SEQ ID NO: 2291653 - RNA, 15 nt, Human
augcaaggaaggaaa

SEQ ID NO: 2291654 - RNA, 14 nt, Human
augcaaggaaggaa

SEQ ID NO: 2291655 - RNA, 13 nt, Human
augcaaggaagga

SEQ ID NO: 2291656 - RNA, 16 nt, Human
augcaacaggcacuca

SEQ ID NO: 2291657 - RNA, 12 nt, Human
augcaagauauu

SEQ ID NO: 2291658 - RNA, 13 nt, Human
augauuggauuau

SEQ ID NO: 2291659 - RNA, 14 nt, Human
augauuggauuauu

SEQ ID NO: 2291660 - RNA, 15 nt, Human
augauuggauuauuc

SEQ ID NO: 2291661 - RNA, 16 nt, Human
augauuggauuauuca

SEQ ID NO: 2291662 - RNA, 21 nt, Human
augauuggauuauucauuuaa

SEQ ID NO: 2291663 - RNA, 22 nt, Human
augauuggauuauucauuuaaa

SEQ ID NO: 2291664 - RNA, 14 nt, Human
augauuguaaaaua

SEQ ID NO: 2291665 - RNA, 19 nt, Human
augcaacauguguacuuaa

SEQ ID NO: 2291666 - RNA, 23 nt, Human
augcaagauaguuuaucuaacuu

SEQ ID NO: 2291667 - RNA, 23 nt, Human
augcaagcuaguggcuucaaaau

SEQ ID NO: 2291668 - RNA, 14 nt, Human
augcaccauuagaa

SEQ ID NO: 2291669 - RNA, 13 nt, Human
augcaccuggaau

SEQ ID NO: 2291670 - RNA, 15 nt, Human
augcaaggaccagga

SEQ ID NO: 2291671 - RNA, 14 nt, Human
augcaaggaccagg

SEQ ID NO: 2291672 - RNA, 20 nt, Human
augcaaggaaggaaagaaag

SEQ ID NO: 2291673 - RNA, 18 nt, Human
augcaaggaaggaaagaa

SEQ ID NO: 2291674 - RNA, 22 nt, Human
augcaccagcccuuagcaggga

SEQ ID NO: 2291675 - RNA, 16 nt, Human
augcacuuuguucugg

SEQ ID NO: 2291676 - RNA, 17 nt, Human
augcacuuuguucuggc

SEQ ID NO: 2291677 - RNA, 19 nt, Human
augcacuuuguucuggcuc

SEQ ID NO: 2291678 - RNA, 20 nt, Human
augcacuuuguucuggcucu

SEQ ID NO: 2291679 - RNA, 22 nt, Human
augauauguaaacauaauucuu

SEQ ID NO: 2291680 - RNA, 13 nt, Human
augaucaguuuuu

SEQ ID NO: 2291681 - RNA, 21 nt, Human
augauccaacuaaugccuuac

SEQ ID NO: 2291682 - RNA, 15 nt, Human
augaucaguuuuuuu

SEQ ID NO: 2291683 - RNA, 22 nt, Human
augaucauuugcccuuaaggac

SEQ ID NO: 2291684 - RNA, 21 nt, Human
augauauguaaacauaauucu

SEQ ID NO: 2291685 - RNA, 13 nt, Human
augauauguaaac

SEQ ID NO: 2291686 - RNA, 22 nt, Human
augauacccugaauuuggccug

SEQ ID NO: 2291687 - RNA, 15 nt, Human
augauacauccaaag

SEQ ID NO: 2291688 - RNA, 17 nt, Human
augauacuugaaaauua

SEQ ID NO: 2291689 - RNA, 21 nt, Human
augauacuugaaaauuaacau

SEQ ID NO: 2291690 - RNA, 17 nt, Human
augauaguaagaaaagu

SEQ ID NO: 2291691 - RNA, 19 nt, Human
augauuacucuuugagaua

SEQ ID NO: 2291692 - RNA, 14 nt, Human
augaucucucugaa

SEQ ID NO: 2291693 - RNA, 15 nt, Human
augaucucccugccg

SEQ ID NO: 2291694 - RNA, 16 nt, Human
augauuaauucaccuu

SEQ ID NO: 2291695 - RNA, 18 nt, Human
augauuaaguaaugauaa

SEQ ID NO: 2291696 - RNA, 14 nt, Human
augaucucccugcc

SEQ ID NO: 2291697 - RNA, 12 nt, Human
augaucucccug

SEQ ID NO: 2291698 - RNA, 21 nt, Human
augaucuagguuuaacucaga

SEQ ID NO: 2291699 - RNA, 22 nt, Human
augaucuagguuuaacucagau

SEQ ID NO: 2291700 - RNA, 15 nt, Human
augaucuagguuuaa

SEQ ID NO: 2291701 - RNA, 16 nt, Human
augaucuagguuuaac

SEQ ID NO: 2291702 - RNA, 17 nt, Human
augaucuagguuuaacu

SEQ ID NO: 2291703 - RNA, 19 nt, Human
augaucuagguuuaacuca

SEQ ID NO: 2291704 - RNA, 14 nt, Human
augauuaaguaaug

SEQ ID NO: 2291705 - RNA, 22 nt, Human
augauccaugaguuugcccugg

SEQ ID NO: 2291706 - RNA, 21 nt, Human
augauccaugaguuugcccug

SEQ ID NO: 2291707 - RNA, 15 nt, Human
augaucuaggaagac

SEQ ID NO: 2291708 - RNA, 13 nt, Human
augaucccugugu

SEQ ID NO: 2291709 - RNA, 17 nt, Human
augaucuaggaagacuu

SEQ ID NO: 2291710 - RNA, 20 nt, Human
augaucuaggaagacuuugg

SEQ ID NO: 2291711 - RNA, 11 nt, Human
uuguucccagu

SEQ ID NO: 2291712 - RNA, 20 nt, Human
uuguucuugguuuguaaauu

SEQ ID NO: 2291713 - RNA, 22 nt, Human
uuguuccaagacauugucaaua

SEQ ID NO: 2291714 - RNA, 21 nt, Human
uuguuccaagacauugucaau

SEQ ID NO: 2291715 - RNA, 12 nt, Human
uuguuccagcuc

SEQ ID NO: 2291716 - RNA, 13 nt, Human
uuguuccagauuc

SEQ ID NO: 2291717 - RNA, 13 nt, Human
uuguucuuuuuau

SEQ ID NO: 2291718 - RNA, 15 nt, Human
uuguucuuuguucuu

SEQ ID NO: 2291719 - RNA, 14 nt, Human
uuguucuuuaaagu

SEQ ID NO: 2291720 - RNA, 18 nt, Human
uuguugacaguucugaag

SEQ ID NO: 2291721 - RNA, 21 nt, Human
uuguugacaguucugaagaau

SEQ ID NO: 2291722 - RNA, 15 nt, Human
augauaacuggaaac

SEQ ID NO: 2291723 - RNA, 18 nt, Human
uuguugagcuauugcugu

SEQ ID NO: 2291724 - RNA, 17 nt, Human
augauacaagauuagaa

SEQ ID NO: 2291725 - RNA, 17 nt, Human
uuguugacuuauuuucu

SEQ ID NO: 2291726 - RNA, 14 nt, Human
uuguugacuuauuu

SEQ ID NO: 2291727 - RNA, 17 nt, Human
augauaaguaaaugcua

SEQ ID NO: 2291728 - RNA, 21 nt, Human
uuguuccacaaguuaaauaaa

SEQ ID NO: 2291729 - RNA, 17 nt, Human
uuguuccaagacauugu

SEQ ID NO: 2291730 - RNA, 19 nt, Human
uuguucauuuugagcugaa

SEQ ID NO: 2291731 - RNA, 16 nt, Human
uuguuccaagacauug

SEQ ID NO: 2291732 - RNA, 17 nt, Human
uuguucauuuugagcug

SEQ ID NO: 2291733 - RNA, 15 nt, Human
uuguucaucuguaac

SEQ ID NO: 2291734 - RNA, 16 nt, Human
uugguggagauaaaga

SEQ ID NO: 2291735 - RNA, 22 nt, Human
uuggugcuuacacaucucagac

SEQ ID NO: 2291736 - RNA, 15 nt, Human
uuguucauagcccag

SEQ ID NO: 2291737 - RNA, 20 nt, Human
uuggugccuggccuggcaca

SEQ ID NO: 2291738 - RNA, 22 nt, Human
uuggugccuggccuggcacaca

SEQ ID NO: 2291739 - RNA, 13 nt, Human
uuguguuacuaag

SEQ ID NO: 2291740 - RNA, 20 nt, Human
uuguguuacuaaguuuuuau

SEQ ID NO: 2291741 - RNA, 15 nt, Human
uuguguuacuaaguu

SEQ ID NO: 2291742 - RNA, 13 nt, Human
uuuaauuaaauaa

SEQ ID NO: 2291743 - RNA, 15 nt, Human
uuuaauuaaaugcuc

SEQ ID NO: 2291744 - RNA, 20 nt, Human
uuuaauuaaaugcucaucug

SEQ ID NO: 2291745 - RNA, 19 nt, Human
uuuaauuaaucaugaaugu

SEQ ID NO: 2291746 - RNA, 22 nt, Human
uuuaauuaaucaugaaugugua

SEQ ID NO: 2291747 - RNA, 17 nt, Human
uuuaauuaaugaaauau

SEQ ID NO: 2291748 - RNA, 19 nt, Human
uuuaauuaaugaaauaucu

SEQ ID NO: 2291749 - RNA, 22 nt, Human
uuuaaugugcuguguaaaguua

SEQ ID NO: 2291750 - RNA, 20 nt, Human
uuuaaugugcuguguaaagu

SEQ ID NO: 2291751 - RNA, 21 nt, Human
uuuaaugugcuguguaaaguu

SEQ ID NO: 2291752 - RNA, 16 nt, Human
uuuaaugugcugugua

SEQ ID NO: 2291753 - RNA, 17 nt, Human
uuuaaugugcuguguaa

SEQ ID NO: 2291754 - RNA, 18 nt, Human
uuuaaugugcuguguaaa

SEQ ID NO: 2291755 - RNA, 19 nt, Human
uuuaaugugcuguguaaag

SEQ ID NO: 2291756 - RNA, 18 nt, Human
uuuaagugcguguguaga

SEQ ID NO: 2291757 - RNA, 20 nt, Human
uuuaagugcguguguagagu

SEQ ID NO: 2291758 - RNA, 21 nt, Human
uuuaagugcguguguagaguu

SEQ ID NO: 2291759 - RNA, 15 nt, Human
uuuaaugugcugugu

SEQ ID NO: 2291760 - RNA, 21 nt, Human
uuuaauuagggguugcuaaga

SEQ ID NO: 2291761 - RNA, 22 nt, Human
uuuaauuaaugaaauaucugua

SEQ ID NO: 2291762 - RNA, 14 nt, Human
uuuaauuagugcua

SEQ ID NO: 2291763 - RNA, 15 nt, Human
uuuaauuagugcuaa

SEQ ID NO: 2291764 - RNA, 17 nt, Human
uuuaauuagugcuaagu

SEQ ID NO: 2291765 - RNA, 19 nt, Human
uuuaauuagugcuaagugu

SEQ ID NO: 2291766 - RNA, 20 nt, Human
uuuaauuagugcuaagugug

SEQ ID NO: 2291767 - RNA, 18 nt, Human
uuuaauuguuaagauaug

SEQ ID NO: 2291768 - RNA, 17 nt, Human
uuuaauucaccaaagua

SEQ ID NO: 2291769 - RNA, 23 nt, Human
uuuaauuauuauuuauauaugua

SEQ ID NO: 2291770 - RNA, 12 nt, Human
uuuaauucaguu

SEQ ID NO: 2291771 - RNA, 14 nt, Human
uuuaauuauuauuc

SEQ ID NO: 2291772 - RNA, 23 nt, Human
uuuaauuauuauucuucauaaca

SEQ ID NO: 2291773 - RNA, 21 nt, Human
uuuaauuagugcuaaguguga

SEQ ID NO: 2291774 - RNA, 22 nt, Human
uuuaauuagugcuaagugugaa

SEQ ID NO: 2291775 - RNA, 21 nt, Human
uuuaaauauaauucuguaaau

SEQ ID NO: 2291776 - RNA, 20 nt, Human
uuuaagguuauuuauuuaaa

SEQ ID NO: 2291777 - RNA, 21 nt, Human
uuuaagguuauuuauuuaaau

SEQ ID NO: 2291778 - RNA, 12 nt, Human
uuuaaguauuua

SEQ ID NO: 2291779 - RNA, 16 nt, Human
uuuaagguuuuuacug

SEQ ID NO: 2291780 - RNA, 18 nt, Human
uuuaaguauuuagguuuu

SEQ ID NO: 2291781 - RNA, 13 nt, Human
uuuaaguauuuag

SEQ ID NO: 2291782 - RNA, 20 nt, Human
uuuaaguauuuauauauuua

SEQ ID NO: 2291783 - RNA, 15 nt, Human
uuuaaguauuuauau

SEQ ID NO: 2291784 - RNA, 14 nt, Human
uuuaaguauuuaua

SEQ ID NO: 2291785 - RNA, 13 nt, Human
uuuaaguauuuau

SEQ ID NO: 2291786 - RNA, 21 nt, Human
uuuaaguauugcaucuguaua

SEQ ID NO: 2291787 - RNA, 18 nt, Human
uuuaaauauaugcuaagu

SEQ ID NO: 2291788 - RNA, 20 nt, Human
uuuaaauacagucuuccauu

SEQ ID NO: 2291789 - RNA, 12 nt, Human
uuuaaauauaau

SEQ ID NO: 2291790 - RNA, 13 nt, Human
uuuaaauauaauu

SEQ ID NO: 2291791 - RNA, 15 nt, Human
uuuaaauauaauucu

SEQ ID NO: 2291792 - RNA, 16 nt, Human
uuuaaauauaauucug

SEQ ID NO: 2291793 - RNA, 18 nt, Human
uuuaaauauaauucugua

SEQ ID NO: 2291794 - RNA, 20 nt, Human
uuuaaauacgcacuacaugu

SEQ ID NO: 2291795 - RNA, 23 nt, Human
uuuaauuguuguuucuuucuagu

SEQ ID NO: 2291796 - RNA, 24 nt, Human
uuuaauuguuguuucuuucuagug

SEQ ID NO: 2291797 - RNA, 16 nt, Human
uuuaauuguuguuucu

SEQ ID NO: 2291798 - RNA, 18 nt, Human
uuuaauuguuguuucuuu

SEQ ID NO: 2291799 - RNA, 21 nt, Human
uuuaauuguuguuucuuucua

SEQ ID NO: 2291800 - RNA, 22 nt, Human
uuuaauuguuguuucuuucuag

SEQ ID NO: 2291801 - RNA, 16 nt, Human
uuuaauuuaugaguuu

SEQ ID NO: 2291802 - RNA, 16 nt, Human
uuuaauuuauuuauua

SEQ ID NO: 2291803 - RNA, 22 nt, Human
uuuaauuuauuaauugcuuuga

SEQ ID NO: 2291804 - RNA, 21 nt, Human
uuuaauuuauuaauugcuuug

SEQ ID NO: 2291805 - RNA, 19 nt, Human
uuuaauuuuuuugagacag

SEQ ID NO: 2291806 - RNA, 20 nt, Human
uuuaauuuauuuauuaagau

SEQ ID NO: 2291807 - RNA, 19 nt, Human
uuuaauuuauuuauuaaga

SEQ ID NO: 2291808 - RNA, 19 nt, Human
uuuacaaaacuacaugaga

SEQ ID NO: 2291809 - RNA, 15 nt, Human
uuuacaaaaauauaa

SEQ ID NO: 2291810 - RNA, 16 nt, Human
uuuacaaaaauauaaa

SEQ ID NO: 2291811 - RNA, 12 nt, Human
uuuacaaagugu

SEQ ID NO: 2291812 - RNA, 16 nt, Human
uuuacaaaguguguau

SEQ ID NO: 2291813 - RNA, 18 nt, Human
uuuacaaaguguguauua

SEQ ID NO: 2291814 - RNA, 22 nt, Human
augcagcgaaccaauauuugua

SEQ ID NO: 2291815 - RNA, 20 nt, Human
augcagcgaaccaauauuug

SEQ ID NO: 2291816 - RNA, 22 nt, Human
augcagcccaugcccaccugcc

SEQ ID NO: 2291817 - RNA, 14 nt, Human
augcagcuaucugg

SEQ ID NO: 2291818 - RNA, 18 nt, Human
augcagccucacaguccu

SEQ ID NO: 2291819 - RNA, 15 nt, Human
augcagcugcacccu

SEQ ID NO: 2291820 - RNA, 13 nt, Human
augcagcgugaag

SEQ ID NO: 2291821 - RNA, 21 nt, Human
augcagcugcacccucccucc

SEQ ID NO: 2291822 - RNA, 23 nt, Human
augcagauggggcucccgcccgu

SEQ ID NO: 2291823 - RNA, 20 nt, Human
augcagcagggaugcccugg

SEQ ID NO: 2291824 - RNA, 19 nt, Human
augcagcagggaugcccug

SEQ ID NO: 2291825 - RNA, 17 nt, Human
augcagcaucuaaguaa

SEQ ID NO: 2291826 - RNA, 16 nt, Human
augcagcaaaauguga

SEQ ID NO: 2291827 - RNA, 22 nt, Human
augcagauuuugcccuugacaa

SEQ ID NO: 2291828 - RNA, 23 nt, Human
augcagcccaugcccaccugccc

SEQ ID NO: 2291829 - RNA, 16 nt, Human
augcagccgugaucaa

SEQ ID NO: 2291830 - RNA, 21 nt, Human
augcagcccaugcccaccugc

SEQ ID NO: 2291831 - RNA, 15 nt, Human
augcagcccaugccc

SEQ ID NO: 2291832 - RNA, 18 nt, Human
augccauggacagaagaa

SEQ ID NO: 2291833 - RNA, 19 nt, Human
augccauggacagaagaag

SEQ ID NO: 2291834 - RNA, 12 nt, Human
augcccaaggga

SEQ ID NO: 2291835 - RNA, 15 nt, Human
augcccaagggaaag

SEQ ID NO: 2291836 - RNA, 11 nt, Human
augcccagccc

SEQ ID NO: 2291837 - RNA, 21 nt, Human
augccauuuaaagcuuauuaa

SEQ ID NO: 2291838 - RNA, 17 nt, Human
augccauuuaaagcuua

SEQ ID NO: 2291839 - RNA, 17 nt, Human
augccauggacagaaga

SEQ ID NO: 2291840 - RNA, 22 nt, Human
augccacaccaagcugugccac

SEQ ID NO: 2291841 - RNA, 23 nt, Human
augccacaccaagcugugccacc

SEQ ID NO: 2291842 - RNA, 18 nt, Human
augccacacagagugguc

SEQ ID NO: 2291843 - RNA, 16 nt, Human
augccacacaucaccc

SEQ ID NO: 2291844 - RNA, 16 nt, Human
augccacacagagugg

SEQ ID NO: 2291845 - RNA, 15 nt, Human
augccacacagagug

SEQ ID NO: 2291846 - RNA, 15 nt, Human
augccacaccaagcu

SEQ ID NO: 2291847 - RNA, 17 nt, Human
augccacaccaagcugu

SEQ ID NO: 2291848 - RNA, 20 nt, Human
augccacaccaagcugugcc

SEQ ID NO: 2291849 - RNA, 21 nt, Human
augccacaccaagcugugcca

SEQ ID NO: 2291850 - RNA, 23 nt, Human
augccaaagaucacuuguuguuu

SEQ ID NO: 2291851 - RNA, 22 nt, Human
augccaauuagcaauugacugu

SEQ ID NO: 2291852 - RNA, 19 nt, Human
augccacaaggacuuccug

SEQ ID NO: 2291853 - RNA, 16 nt, Human
augccacaaggacuuc

SEQ ID NO: 2291854 - RNA, 18 nt, Human
augccaaaaaaagacagg

SEQ ID NO: 2291855 - RNA, 23 nt, Human
augcauuuuguuugguauuguau

SEQ ID NO: 2291856 - RNA, 18 nt, Human
augccaaagcuagggugg

SEQ ID NO: 2291857 - RNA, 17 nt, Human
augccaauauuaaaucu

SEQ ID NO: 2291858 - RNA, 16 nt, Human
augccaaagaucacuu

SEQ ID NO: 2291859 - RNA, 18 nt, Human
augccaaagaucacuugu

SEQ ID NO: 2291860 - RNA, 20 nt, Human
augccaaagaucacuuguug

SEQ ID NO: 2291861 - RNA, 19 nt, Human
augcauuuugcagcaguga

SEQ ID NO: 2291862 - RNA, 18 nt, Human
augcauuuugcagcagug

SEQ ID NO: 2291863 - RNA, 13 nt, Human
augcauuuugcag

SEQ ID NO: 2291864 - RNA, 12 nt, Human
augcauuuugca

SEQ ID NO: 2291865 - RNA, 19 nt, Human
augcauuuuguuugguauu

SEQ ID NO: 2291866 - RNA, 22 nt, Human
augcauuuuguuugguauugua

SEQ ID NO: 2291867 - RNA, 23 nt, Human
augcauuuuauuuuagacacaaa

SEQ ID NO: 2291868 - RNA, 13 nt, Human
augcagugcuucc

SEQ ID NO: 2291869 - RNA, 23 nt, Human
augcagugguaugaucacggcuc

SEQ ID NO: 2291870 - RNA, 18 nt, Human
augcagggauugcugcca

SEQ ID NO: 2291871 - RNA, 23 nt, Human
augcauuugaggucaaguaagaa

SEQ ID NO: 2291872 - RNA, 14 nt, Human
augcauuugcauuu

SEQ ID NO: 2291873 - RNA, 13 nt, Human
augcaguucugaa

SEQ ID NO: 2291874 - RNA, 20 nt, Human
augccucagcccugacccug

SEQ ID NO: 2291875 - RNA, 19 nt, Human
augccgauauacucuagau

SEQ ID NO: 2291876 - RNA, 16 nt, Human
augccucagccuccug

SEQ ID NO: 2291877 - RNA, 21 nt, Human
augccgaaugcccucagggga

SEQ ID NO: 2291878 - RNA, 15 nt, Human
augcccuuaaaucau

SEQ ID NO: 2291879 - RNA, 16 nt, Human
augcccuggagguggc

SEQ ID NO: 2291880 - RNA, 14 nt, Human
augcccuggaucca

SEQ ID NO: 2291881 - RNA, 23 nt, Human
augcccugugcaaccucuuggcc

SEQ ID NO: 2291882 - RNA, 13 nt, Human
augcccugugcaa

SEQ ID NO: 2291883 - RNA, 15 nt, Human
augcccuggaggugg

SEQ ID NO: 2291884 - RNA, 14 nt, Human
augcccuggaggug

SEQ ID NO: 2291885 - RNA, 12 nt, Human
augcccugugca

SEQ ID NO: 2291886 - RNA, 14 nt, Human
augcccuccucucc

SEQ ID NO: 2291887 - RNA, 23 nt, Human
augcccuccucucccauuguccc

SEQ ID NO: 2291888 - RNA, 15 nt, Human
augcccuccucuccc

SEQ ID NO: 2291889 - RNA, 14 nt, Human
augcccagccccuu

SEQ ID NO: 2291890 - RNA, 12 nt, Human
augcccagcccc

SEQ ID NO: 2291891 - RNA, 13 nt, Human
augcccagccccu

SEQ ID NO: 2291892 - RNA, 24 nt, Human
augccucagcccugacccugugga

SEQ ID NO: 2291893 - RNA, 14 nt, Human
augccucaguguau

SEQ ID NO: 2291894 - RNA, 20 nt, Human
augccuccaccccccagaac

SEQ ID NO: 2291895 - RNA, 20 nt, Human
augccucaguguauuuguau

SEQ ID NO: 2291896 - RNA, 16 nt, Human
augccucaguguauuu

SEQ ID NO: 2291897 - RNA, 19 nt, Human
augccucaguguauuugua

SEQ ID NO: 2291898 - RNA, 21 nt, Human
augccuccaccgcugccuaag

SEQ ID NO: 2291899 - RNA, 17 nt, Human
augccuccaccgcugcc

SEQ ID NO: 2291900 - RNA, 13 nt, Human
augccuccaccgc

SEQ ID NO: 2291901 - RNA, 12 nt, Human
augccuccaccg

SEQ ID NO: 2291902 - RNA, 17 nt, Human
augcgggcugggcagcu

SEQ ID NO: 2291903 - RNA, 18 nt, Human
augcgggcugggcagcug

SEQ ID NO: 2291904 - RNA, 23 nt, Human
augcuaaagguuguauugcauau

SEQ ID NO: 2291905 - RNA, 14 nt, Human
augcuaaagaaaaa

SEQ ID NO: 2291906 - RNA, 22 nt, Human
augcuaaagaaaaagucaucca

SEQ ID NO: 2291907 - RNA, 23 nt, Human
augcuaaaccuuaguacugaguu

SEQ ID NO: 2291908 - RNA, 21 nt, Human
augcguacguuuccugagaag

SEQ ID NO: 2291909 - RNA, 19 nt, Human
augcgggcugggcagcugu

SEQ ID NO: 2291910 - RNA, 14 nt, Human
augcgguagccagc

SEQ ID NO: 2291911 - RNA, 18 nt, Human
augcgguagccagcacac

SEQ ID NO: 2291912 - RNA, 15 nt, Human
augcgguagccagca

SEQ ID NO: 2291913 - RNA, 21 nt, Human
augcgguagccagcacacagg

SEQ ID NO: 2291914 - RNA, 20 nt, Human
augcgguagccagcacacag

SEQ ID NO: 2291915 - RNA, 15 nt, Human
augcggucuagggaa

SEQ ID NO: 2291916 - RNA, 17 nt, Human
augggucuggcugagcu

SEQ ID NO: 2291917 - RNA, 21 nt, Human
augggguuggcugggcccaga

SEQ ID NO: 2291918 - RNA, 18 nt, Human
auggguaauauaaagugu

SEQ ID NO: 2291919 - RNA, 18 nt, Human
augggguuggcugggccc

SEQ ID NO: 2291920 - RNA, 19 nt, Human
auggggugggccucugguu

SEQ ID NO: 2291921 - RNA, 19 nt, Human
auggggugggguagggcug

SEQ ID NO: 2291922 - RNA, 16 nt, Human
auggggugggccucug

SEQ ID NO: 2291923 - RNA, 18 nt, Human
auggggugggccucuggu

SEQ ID NO: 2291924 - RNA, 17 nt, Human
auggguagagaaacacu

SEQ ID NO: 2291925 - RNA, 22 nt, Human
auggggggccaacaccagggau

SEQ ID NO: 2291926 - RNA, 16 nt, Human
auggggggccaacacc

SEQ ID NO: 2291927 - RNA, 16 nt, Human
auggggguagcagcug

SEQ ID NO: 2291928 - RNA, 17 nt, Human
auggggguagcagcugg

SEQ ID NO: 2291929 - RNA, 18 nt, Human
auggggguagcagcugga

SEQ ID NO: 2291930 - RNA, 15 nt, Human
augggggugcauuug

SEQ ID NO: 2291931 - RNA, 21 nt, Human
auggggugaugcugggcuggc

SEQ ID NO: 2291932 - RNA, 15 nt, Human
auggggugggccucu

SEQ ID NO: 2291933 - RNA, 17 nt, Human
auggggucuguaaaauc

SEQ ID NO: 2291934 - RNA, 18 nt, Human
auggggucuguaaaaucu

SEQ ID NO: 2291935 - RNA, 16 nt, Human
auggggucuguaaaau

SEQ ID NO: 2291936 - RNA, 17 nt, Human
augggguccuggccauc

SEQ ID NO: 2291937 - RNA, 16 nt, Human
augggguccuggccau

SEQ ID NO: 2291938 - RNA, 19 nt, Human
auggggguagcagcuggac

SEQ ID NO: 2291939 - RNA, 21 nt, Human
augggggagucugaagcagau

SEQ ID NO: 2291940 - RNA, 15 nt, Human
augggggcaagaaga

SEQ ID NO: 2291941 - RNA, 14 nt, Human
augggggcaagaag

SEQ ID NO: 2291942 - RNA, 20 nt, Human
augggggagucugaagcaga

SEQ ID NO: 2291943 - RNA, 19 nt, Human
augggggagucugaagcag

SEQ ID NO: 2291944 - RNA, 19 nt, Human
augggggaggggggaagga

SEQ ID NO: 2291945 - RNA, 21 nt, Human
augggggaacucagauccagg

SEQ ID NO: 2291946 - RNA, 19 nt, Human
augggggaacucagaucca

SEQ ID NO: 2291947 - RNA, 18 nt, Human
augggggaacucagaucc

SEQ ID NO: 2291948 - RNA, 22 nt, Human
augggggaaagcacaggugggc

SEQ ID NO: 2291949 - RNA, 18 nt, Human
augggggaaauggugccu

SEQ ID NO: 2291950 - RNA, 15 nt, Human
augggggccuggauu

SEQ ID NO: 2291951 - RNA, 17 nt, Human
augggggcacugaggac

SEQ ID NO: 2291952 - RNA, 14 nt, Human
augggggugcauuu

SEQ ID NO: 2291953 - RNA, 24 nt, Human
auggggcugcaccggcuggccugg

SEQ ID NO: 2291954 - RNA, 22 nt, Human
auggggccagauccagccuggg

SEQ ID NO: 2291955 - RNA, 21 nt, Human
auggggccagauccagccugg

SEQ ID NO: 2291956 - RNA, 11 nt, Human
augggggaaag

SEQ ID NO: 2291957 - RNA, 16 nt, Human
augggggaaagcacag

SEQ ID NO: 2291958 - RNA, 12 nt, Human
auggggcugcac

SEQ ID NO: 2291959 - RNA, 19 nt, Human
auggggccagauccagccu

SEQ ID NO: 2291960 - RNA, 15 nt, Human
auggggccagaucca

SEQ ID NO: 2291961 - RNA, 14 nt, Human
auggggccagaucc

SEQ ID NO: 2291962 - RNA, 13 nt, Human
auggggccagauc

SEQ ID NO: 2291963 - RNA, 14 nt, Human
uuucuuuuucuucu

SEQ ID NO: 2291964 - RNA, 19 nt, Human
uuucuuuuucuucuucccu

SEQ ID NO: 2291965 - RNA, 23 nt, Human
uuucuuugggaauauuugaaucu

SEQ ID NO: 2291966 - RNA, 21 nt, Human
uuucuuugccuguucaguuac

SEQ ID NO: 2291967 - RNA, 17 nt, Human
uuucuuugggaauauuu

SEQ ID NO: 2291968 - RNA, 19 nt, Human
uuucuuugggaauauuuga

SEQ ID NO: 2291969 - RNA, 21 nt, Human
uuucuuugggaauauuugaau

SEQ ID NO: 2291970 - RNA, 15 nt, Human
uuugaaaucagcaua

SEQ ID NO: 2291971 - RNA, 15 nt, Human
uuugaaaacauauaa

SEQ ID NO: 2291972 - RNA, 16 nt, Human
uuugaaaaauuccuau

SEQ ID NO: 2291973 - RNA, 22 nt, Human
uuugaaaaauuccuauugugau

SEQ ID NO: 2291974 - RNA, 15 nt, Human
uuugaaauauugacu

SEQ ID NO: 2291975 - RNA, 12 nt, Human
auggggaugcag

SEQ ID NO: 2291976 - RNA, 20 nt, Human
auggggauagauguguggac

SEQ ID NO: 2291977 - RNA, 16 nt, Human
auggggaucacagaga

SEQ ID NO: 2291978 - RNA, 17 nt, Human
auggggaucacagagac

SEQ ID NO: 2291979 - RNA, 19 nt, Human
auggggaucacagagacau

SEQ ID NO: 2291980 - RNA, 19 nt, Human
augggcugcagcagaggca

SEQ ID NO: 2291981 - RNA, 16 nt, Human
augggcuaaugaagau

SEQ ID NO: 2291982 - RNA, 17 nt, Human
augggcuaaugaagauc

SEQ ID NO: 2291983 - RNA, 21 nt, Human
augggcucugacagaaagcag

SEQ ID NO: 2291984 - RNA, 20 nt, Human
augggcuggguucuacccag

SEQ ID NO: 2291985 - RNA, 18 nt, Human
augggccuccugugugug

SEQ ID NO: 2291986 - RNA, 19 nt, Human
augggccugcuuccugucu

SEQ ID NO: 2291987 - RNA, 20 nt, Human
augggccuggccaccucucu

SEQ ID NO: 2291988 - RNA, 16 nt, Human
uuugaaauguguuucu

SEQ ID NO: 2291989 - RNA, 18 nt, Human
uuugaaauuaaccucuca

SEQ ID NO: 2291990 - RNA, 19 nt, Human
uuucuguucuguggaaagu

SEQ ID NO: 2291991 - RNA, 22 nt, Human
uuucuguucuguggaaagugua

SEQ ID NO: 2291992 - RNA, 15 nt, Human
uuucuguucugugga

SEQ ID NO: 2291993 - RNA, 16 nt, Human
uuucuguucuguggaa

SEQ ID NO: 2291994 - RNA, 17 nt, Human
uuucuguucuguggaaa

SEQ ID NO: 2291995 - RNA, 12 nt, Human
uuucuuucuagu

SEQ ID NO: 2291996 - RNA, 13 nt, Human
uuucuuuccagag

SEQ ID NO: 2291997 - RNA, 13 nt, Human
uuucuuucuagug

SEQ ID NO: 2291998 - RNA, 13 nt, Human
uuucuuucuuaga

SEQ ID NO: 2291999 - RNA, 15 nt, Human
uuucuuucuuagaaa

SEQ ID NO: 2292000 - RNA, 16 nt, Human
uuucuuugaaugcuuu

SEQ ID NO: 2292001 - RNA, 22 nt, Human
uuucuuugaaugcuuuuugaau

SEQ ID NO: 2292002 - RNA, 23 nt, Human
uuucuguccuuuuggcacugaga

SEQ ID NO: 2292003 - RNA, 15 nt, Human
uuucugucccuucug

SEQ ID NO: 2292004 - RNA, 15 nt, Human
uuucugucucugccu

SEQ ID NO: 2292005 - RNA, 17 nt, Human
uuucugugccugaauau

SEQ ID NO: 2292006 - RNA, 11 nt, Human
uuucugugugc

SEQ ID NO: 2292007 - RNA, 20 nt, Human
uuucugugugcaccuuacca

SEQ ID NO: 2292008 - RNA, 22 nt, Human
uuucugugugcaccuuaccaac

SEQ ID NO: 2292009 - RNA, 19 nt, Human
uuucuguuauauaaauggu

SEQ ID NO: 2292010 - RNA, 19 nt, Human
uuucugguagauagaaaua

SEQ ID NO: 2292011 - RNA, 17 nt, Human
uuucuguauauacuuuu

SEQ ID NO: 2292012 - RNA, 15 nt, Human
uuucugucaagaaga

SEQ ID NO: 2292013 - RNA, 17 nt, Human
uuucugguagauagaaa

SEQ ID NO: 2292014 - RNA, 15 nt, Human
uuucugguagauaga

SEQ ID NO: 2292015 - RNA, 15 nt, Human
uuucugguggucugu

SEQ ID NO: 2292016 - RNA, 17 nt, Human
uuucugguggucuguug

SEQ ID NO: 2292017 - RNA, 20 nt, Human
uuucugguggucuguuggca

SEQ ID NO: 2292018 - RNA, 21 nt, Human
uuucugggcugucuauucuag

SEQ ID NO: 2292019 - RNA, 19 nt, Human
uuucuggcuggagccuaga

SEQ ID NO: 2292020 - RNA, 23 nt, Human
uuucugggcaccggggccucgga

SEQ ID NO: 2292021 - RNA, 16 nt, Human
uuucugggauaaguaa

SEQ ID NO: 2292022 - RNA, 19 nt, Human
uuucugggcugucuauucu

SEQ ID NO: 2292023 - RNA, 21 nt, Human
uuucugcagccacuauuguua

SEQ ID NO: 2292024 - RNA, 23 nt, Human
uuucugggagacagaaaacaugu

SEQ ID NO: 2292025 - RNA, 17 nt, Human
uuucugcacugagcaga

SEQ ID NO: 2292026 - RNA, 18 nt, Human
uuucugcacugagcagag

SEQ ID NO: 2292027 - RNA, 14 nt, Human
uuucugcagaaaca

SEQ ID NO: 2292028 - RNA, 13 nt, Human
uuucugcacugag

SEQ ID NO: 2292029 - RNA, 22 nt, Human
uuucugauuguaacguugcugu

SEQ ID NO: 2292030 - RNA, 19 nt, Human
uuucugcagccacuauugu

SEQ ID NO: 2292031 - RNA, 11 nt, Human
uuucugauugu

SEQ ID NO: 2292032 - RNA, 23 nt, Human
uuucugauuguaacguugcugug

SEQ ID NO: 2292033 - RNA, 13 nt, Human
uuucuccccugcc

SEQ ID NO: 2292034 - RNA, 14 nt, Human
uuucuccccugccc

SEQ ID NO: 2292035 - RNA, 16 nt, Human
uuucuccccugccccc

SEQ ID NO: 2292036 - RNA, 17 nt, Human
uuucuccccugccccca

SEQ ID NO: 2292037 - RNA, 19 nt, Human
uuucuggcuaugcauuuga

SEQ ID NO: 2292038 - RNA, 18 nt, Human
uuucuggcuaugcauuug

SEQ ID NO: 2292039 - RNA, 16 nt, Human
uuucuggcuaugcauu

SEQ ID NO: 2292040 - RNA, 15 nt, Human
uuucuggcuaugcau

SEQ ID NO: 2292041 - RNA, 15 nt, Human
uuucucccccugggc

SEQ ID NO: 2292042 - RNA, 14 nt, Human
uuucucccccuggg

SEQ ID NO: 2292043 - RNA, 13 nt, Human
uuucucccccugg

SEQ ID NO: 2292044 - RNA, 12 nt, Human
uuucuccccagg

SEQ ID NO: 2292045 - RNA, 18 nt, Human
uuucucccagucauuuaa

SEQ ID NO: 2292046 - RNA, 17 nt, Human
augggcaaaacugaauu

SEQ ID NO: 2292047 - RNA, 14 nt, Human
augggcaaaacuga

SEQ ID NO: 2292048 - RNA, 17 nt, Human
uuucucccagucauuua

SEQ ID NO: 2292049 - RNA, 23 nt, Human
augggauucagugcuucuuaaag

SEQ ID NO: 2292050 - RNA, 18 nt, Human
augggaugguggagggcc

SEQ ID NO: 2292051 - RNA, 15 nt, Human
augggauccuggagu

SEQ ID NO: 2292052 - RNA, 22 nt, Human
augggagggggcuugaagccaa

SEQ ID NO: 2292053 - RNA, 23 nt, Human
augggagggggcuugaagccaaa

SEQ ID NO: 2292054 - RNA, 16 nt, Human
augggagugagacaga

SEQ ID NO: 2292055 - RNA, 16 nt, Human
auggugcugagaagcu

SEQ ID NO: 2292056 - RNA, 14 nt, Human
auggugcugaccuc

SEQ ID NO: 2292057 - RNA, 12 nt, Human
auggugcugaga

SEQ ID NO: 2292058 - RNA, 14 nt, Human
auggugcugagaag

SEQ ID NO: 2292059 - RNA, 13 nt, Human
auggugcugagaa

SEQ ID NO: 2292060 - RNA, 20 nt, Human
auggugcuacgccugcaugu

SEQ ID NO: 2292061 - RNA, 16 nt, Human
auggugccuucauuug

SEQ ID NO: 2292062 - RNA, 14 nt, Human
auggugccuucauu

SEQ ID NO: 2292063 - RNA, 23 nt, Human
auggugccugagaggcaggcaua

SEQ ID NO: 2292064 - RNA, 22 nt, Human
auggugccugauucggcugucu

SEQ ID NO: 2292065 - RNA, 12 nt, Human
augguggcuggg

SEQ ID NO: 2292066 - RNA, 13 nt, Human
augguggagggcc

SEQ ID NO: 2292067 - RNA, 20 nt, Human
augguggacucgccuguaau

SEQ ID NO: 2292068 - RNA, 14 nt, Human
augguggagggcca

SEQ ID NO: 2292069 - RNA, 13 nt, Human
augguggcugggu

SEQ ID NO: 2292070 - RNA, 15 nt, Human
augguggcuggguug

SEQ ID NO: 2292071 - RNA, 16 nt, Human
augguggcgcgcaccu

SEQ ID NO: 2292072 - RNA, 17 nt, Human
augguggcuggguugga

SEQ ID NO: 2292073 - RNA, 22 nt, Human
auggugugaaagucagaugccc

SEQ ID NO: 2292074 - RNA, 18 nt, Human
auggugugaaagucagau

SEQ ID NO: 2292075 - RNA, 19 nt, Human
augguguucaaaaaacuug

SEQ ID NO: 2292076 - RNA, 12 nt, Human
augguguaauaa

SEQ ID NO: 2292077 - RNA, 22 nt, Human
auggugguaaacauucucucag

SEQ ID NO: 2292078 - RNA, 21 nt, Human
augguggugcaugucugcaaa

SEQ ID NO: 2292079 - RNA, 14 nt, Human
augguguaauaaga

SEQ ID NO: 2292080 - RNA, 16 nt, Human
augguguaauaagaca

SEQ ID NO: 2292081 - RNA, 18 nt, Human
augguguaauaagacaua

SEQ ID NO: 2292082 - RNA, 20 nt, Human
augguguaauaagacauaac

SEQ ID NO: 2292083 - RNA, 22 nt, Human
augguguaauaagacauaacgu

SEQ ID NO: 2292084 - RNA, 13 nt, Human
augguguacauaa

SEQ ID NO: 2292085 - RNA, 18 nt, Human
augguguacauaauguau

SEQ ID NO: 2292086 - RNA, 15 nt, Human
augguuacaaucauu

SEQ ID NO: 2292087 - RNA, 19 nt, Human
augguuacaaucauugcug

SEQ ID NO: 2292088 - RNA, 16 nt, Human
augguguuucucccuc

SEQ ID NO: 2292089 - RNA, 21 nt, Human
augguguuuucuuaugcagga

SEQ ID NO: 2292090 - RNA, 20 nt, Human
augguguugcccugagugga

SEQ ID NO: 2292091 - RNA, 20 nt, Human
augguuacaaucauugcuga

SEQ ID NO: 2292092 - RNA, 14 nt, Human
augguuauaaaagu

SEQ ID NO: 2292093 - RNA, 16 nt, Human
augguuauaaaaguga

SEQ ID NO: 2292094 - RNA, 16 nt, Human
augguuccaugccuga

SEQ ID NO: 2292095 - RNA, 17 nt, Human
augguuccaugccugag

SEQ ID NO: 2292096 - RNA, 18 nt, Human
augguuccaugccugagg

SEQ ID NO: 2292097 - RNA, 20 nt, Human
augguuccaugccugagggu

SEQ ID NO: 2292098 - RNA, 22 nt, Human
augguuccaugccugagggugg

SEQ ID NO: 2292099 - RNA, 11 nt, Human
auggugccuga

SEQ ID NO: 2292100 - RNA, 20 nt, Human
auggugcaguugacagcagg

SEQ ID NO: 2292101 - RNA, 9 nt, Human
auggugccu

SEQ ID NO: 2292102 - RNA, 14 nt, Human
auggugccugagag

SEQ ID NO: 2292103 - RNA, 15 nt, Human
auggugccugagagg

SEQ ID NO: 2292104 - RNA, 16 nt, Human
auggugccugagaggc

SEQ ID NO: 2292105 - RNA, 17 nt, Human
auggugccugagaggca

SEQ ID NO: 2292106 - RNA, 18 nt, Human
auggugccugagaggcag

SEQ ID NO: 2292107 - RNA, 20 nt, Human
auggugccugagaggcaggc

SEQ ID NO: 2292108 - RNA, 21 nt, Human
auggugccugagaggcaggca

SEQ ID NO: 2292109 - RNA, 22 nt, Human
auggugccccaggaccagcuca

SEQ ID NO: 2292110 - RNA, 21 nt, Human
auggugccccaggaccagcuc

SEQ ID NO: 2292111 - RNA, 20 nt, Human
auggugccccaggaccagcu

SEQ ID NO: 2292112 - RNA, 19 nt, Human
auggugccccaggaccagc

SEQ ID NO: 2292113 - RNA, 18 nt, Human
auggugccccaggaccag

SEQ ID NO: 2292114 - RNA, 17 nt, Human
auggugccccaggacca

SEQ ID NO: 2292115 - RNA, 16 nt, Human
auggugccccaggacc

SEQ ID NO: 2292116 - RNA, 15 nt, Human
auggugccccaggac

SEQ ID NO: 2292117 - RNA, 19 nt, Human
auggugcaaugaccuuuca

SEQ ID NO: 2292118 - RNA, 18 nt, Human
auggugcaguugacagca

SEQ ID NO: 2292119 - RNA, 14 nt, Human
auggugccccagga

SEQ ID NO: 2292120 - RNA, 16 nt, Human
auggugcaaugaccuu

SEQ ID NO: 2292121 - RNA, 17 nt, Human
auggugcaaugaccuuu

SEQ ID NO: 2292122 - RNA, 19 nt, Human
auggugagaugcagcugga

SEQ ID NO: 2292123 - RNA, 12 nt, Human
auggugcaauga

SEQ ID NO: 2292124 - RNA, 13 nt, Human
auggugcaaugac

SEQ ID NO: 2292125 - RNA, 15 nt, Human
auggugcaaugaccu

SEQ ID NO: 2292126 - RNA, 16 nt, Human
auggugaugaaaugua

SEQ ID NO: 2292127 - RNA, 17 nt, Human
auggugaugaaauguaa

SEQ ID NO: 2292128 - RNA, 22 nt, Human
augggugaagggagagccagcu

SEQ ID NO: 2292129 - RNA, 19 nt, Human
augggucuggcugagcuga

SEQ ID NO: 2292130 - RNA, 14 nt, Human
auggugaugaaaug

SEQ ID NO: 2292131 - RNA, 15 nt, Human
augggugcuuggagg

SEQ ID NO: 2292132 - RNA, 20 nt, Human
auggugagggauacccaucc

SEQ ID NO: 2292133 - RNA, 21 nt, Human
augguuugaauauaaacacua

SEQ ID NO: 2292134 - RNA, 13 nt, Human
augguuucaaaga

SEQ ID NO: 2292135 - RNA, 18 nt, Human
augguuguauuagauguu

SEQ ID NO: 2292136 - RNA, 21 nt, Human
augguuguauuagauguucuc

SEQ ID NO: 2292137 - RNA, 23 nt, Human
augguugguaacacaaauuuuca

SEQ ID NO: 2292138 - RNA, 18 nt, Human
augguugucuguuuuugu

SEQ ID NO: 2292139 - RNA, 13 nt, Human
augguuguacaua

SEQ ID NO: 2292140 - RNA, 12 nt, Human
augguuguauua

SEQ ID NO: 2292141 - RNA, 13 nt, Human
augguuguauuag

SEQ ID NO: 2292142 - RNA, 14 nt, Human
augguuguauuaga

SEQ ID NO: 2292143 - RNA, 16 nt, Human
augguuguauuagaug

SEQ ID NO: 2292144 - RNA, 16 nt, Human
augguugagaaaugaa

SEQ ID NO: 2292145 - RNA, 15 nt, Human
augguugccuuaaag

SEQ ID NO: 2292146 - RNA, 17 nt, Human
augguugccuuaaagaa

SEQ ID NO: 2292147 - RNA, 18 nt, Human
augguugccuuaaagaaa

SEQ ID NO: 2292148 - RNA, 19 nt, Human
augguugagaaaugaauaa

SEQ ID NO: 2292149 - RNA, 13 nt, Human
augguucugugcc

SEQ ID NO: 2292150 - RNA, 16 nt, Human
augguucucaggccug

SEQ ID NO: 2292151 - RNA, 16 nt, Human
augguucguucuguuu

SEQ ID NO: 2292152 - RNA, 18 nt, Human
augguucguucuguuuac

SEQ ID NO: 2292153 - RNA, 19 nt, Human
augguuccccuguucacuc

SEQ ID NO: 2292154 - RNA, 20 nt, Human
augguuccccuguucacucu

SEQ ID NO: 2292155 - RNA, 21 nt, Human
augguucccuugaugaagaag

SEQ ID NO: 2292156 - RNA, 22 nt, Human
augguuugaauauaaacacuau

SEQ ID NO: 2292157 - RNA, 22 nt, Human
augguuugacucccgaacauca

SEQ ID NO: 2292158 - RNA, 16 nt, Human
augguuugcaaggaag

SEQ ID NO: 2292159 - RNA, 17 nt, Human
augguuugcaaggaagc

SEQ ID NO: 2292160 - RNA, 18 nt, Human
augguuugcaaggaagcc

SEQ ID NO: 2292161 - RNA, 15 nt, Human
augguuuucaaaaua

SEQ ID NO: 2292162 - RNA, 14 nt, Human
augguuuucaaaau

SEQ ID NO: 2292163 - RNA, 16 nt, Human
augguuuucaaaauaa

SEQ ID NO: 2292164 - RNA, 14 nt, Human
augguuuucuugug

SEQ ID NO: 2292165 - RNA, 17 nt, Human
auguaaaagacuuuuuu

SEQ ID NO: 2292166 - RNA, 21 nt, Human
auguaaaagagucaucuggua

SEQ ID NO: 2292167 - RNA, 18 nt, Human
auguaaaaggccaaaccu

SEQ ID NO: 2292168 - RNA, 15 nt, Human
auguaaaaggccaaa

SEQ ID NO: 2292169 - RNA, 23 nt, Human
auguaaaaggccaaaccucuguu

SEQ ID NO: 2292170 - RNA, 22 nt, Human
auguaaaaggccaaaccucugu

SEQ ID NO: 2292171 - RNA, 21 nt, Human
auguaaaagguauuaaauuga

SEQ ID NO: 2292172 - RNA, 18 nt, Human
auguaaacaaaauuuagu

SEQ ID NO: 2292173 - RNA, 13 nt, Human
auguaaaauguuu

SEQ ID NO: 2292174 - RNA, 19 nt, Human
auguaaacaaaauuuaguu

SEQ ID NO: 2292175 - RNA, 16 nt, Human
auguaaaauguugaau

SEQ ID NO: 2292176 - RNA, 17 nt, Human
auguaaaauguugaaua

SEQ ID NO: 2292177 - RNA, 23 nt, Human
auguaaacauaauucuuguauau

SEQ ID NO: 2292178 - RNA, 22 nt, Human
auguaaacagugccugcugaau

SEQ ID NO: 2292179 - RNA, 20 nt, Human
auguaaacagugccugcuga

SEQ ID NO: 2292180 - RNA, 14 nt, Human
auguaaacugugca

SEQ ID NO: 2292181 - RNA, 17 nt, Human
auguaaacagugccugc

SEQ ID NO: 2292182 - RNA, 16 nt, Human
auguaaacagugccug

SEQ ID NO: 2292183 - RNA, 15 nt, Human
auguaaacagugccu

SEQ ID NO: 2292184 - RNA, 14 nt, Human
auguaaacaggaga

SEQ ID NO: 2292185 - RNA, 14 nt, Human
auguaaagauauuu

SEQ ID NO: 2292186 - RNA, 19 nt, Human
auguaaagaacauaaauaa

SEQ ID NO: 2292187 - RNA, 21 nt, Human
auguaaagauauuuuuaucuu

SEQ ID NO: 2292188 - RNA, 16 nt, Human
auguaaagugauauuu

SEQ ID NO: 2292189 - RNA, 20 nt, Human
auguaaaggagucaaaacua

SEQ ID NO: 2292190 - RNA, 13 nt, Human
auguaaaguaugu

SEQ ID NO: 2292191 - RNA, 17 nt, Human
auguaaaguauguaaac

SEQ ID NO: 2292192 - RNA, 12 nt, Human
auguaaauagug

SEQ ID NO: 2292193 - RNA, 17 nt, Human
auguaaauagugcagaa

SEQ ID NO: 2292194 - RNA, 18 nt, Human
auguaaaguauguaaaca

SEQ ID NO: 2292195 - RNA, 12 nt, Human
auguaaauauuc

SEQ ID NO: 2292196 - RNA, 15 nt, Human
auguaaauauucuau

SEQ ID NO: 2292197 - RNA, 21 nt, Human
auguaaaugcaucuguccuca

SEQ ID NO: 2292198 - RNA, 13 nt, Human
auguaaaugugca

SEQ ID NO: 2292199 - RNA, 12 nt, Human
auguaaaugugc

SEQ ID NO: 2292200 - RNA, 14 nt, Human
auguaaaugugcau

SEQ ID NO: 2292201 - RNA, 19 nt, Human
auguacauuucugaaauga

SEQ ID NO: 2292202 - RNA, 20 nt, Human
auguacauuuccaaauucac

SEQ ID NO: 2292203 - RNA, 14 nt, Human
auguacauuaauua

SEQ ID NO: 2292204 - RNA, 19 nt, Human
uuugacgggaaacaaaacu

SEQ ID NO: 2292205 - RNA, 17 nt, Human
uuugacauguggaaagu

SEQ ID NO: 2292206 - RNA, 14 nt, Human
uuugacggaugauu

SEQ ID NO: 2292207 - RNA, 19 nt, Human
uuugaccuuuuauguagua

SEQ ID NO: 2292208 - RNA, 20 nt, Human
uuugacgccaucccagcccc

SEQ ID NO: 2292209 - RNA, 21 nt, Human
uuugacuagggauucaggcug

SEQ ID NO: 2292210 - RNA, 19 nt, Human
uuugacuagaugauggaug

SEQ ID NO: 2292211 - RNA, 21 nt, Human
uuugacucuggcaaagcuuuu

SEQ ID NO: 2292212 - RNA, 18 nt, Human
uuugacucuugcaaucca

SEQ ID NO: 2292213 - RNA, 20 nt, Human
uuugacucuggcaaagcuuu

SEQ ID NO: 2292214 - RNA, 19 nt, Human
uuugacucuggcaaagcuu

SEQ ID NO: 2292215 - RNA, 19 nt, Human
uuugaugcuggagagguua

SEQ ID NO: 2292216 - RNA, 15 nt, Human
uuugaugcuguuuga

SEQ ID NO: 2292217 - RNA, 12 nt, Human
uuugacucuuuu

SEQ ID NO: 2292218 - RNA, 19 nt, Human
uuugacugaagaugcagcu

SEQ ID NO: 2292219 - RNA, 15 nt, Human
uuugacuggauauuc

SEQ ID NO: 2292220 - RNA, 13 nt, Human
uuugacgccaucc

SEQ ID NO: 2292221 - RNA, 14 nt, Human
uuugacgccauccc

SEQ ID NO: 2292222 - RNA, 16 nt, Human
uuugacgccaucccag

SEQ ID NO: 2292223 - RNA, 19 nt, Human
uuugacgccaucccagccc

SEQ ID NO: 2292224 - RNA, 23 nt, Human
uuugauuaaauucuugcaaagua

SEQ ID NO: 2292225 - RNA, 21 nt, Human
uuugauucagacagcugccug

SEQ ID NO: 2292226 - RNA, 21 nt, Human
uuugauuaaauucuugcaaag

SEQ ID NO: 2292227 - RNA, 18 nt, Human
uuugauuaaauucuugca

SEQ ID NO: 2292228 - RNA, 11 nt, Human
uuugauguuaa

SEQ ID NO: 2292229 - RNA, 14 nt, Human
uuugauguuaacac

SEQ ID NO: 2292230 - RNA, 15 nt, Human
uuugauguuaacaca

SEQ ID NO: 2292231 - RNA, 16 nt, Human
uuugauguuaacacau

SEQ ID NO: 2292232 - RNA, 17 nt, Human
uuugauguuaacacauu

SEQ ID NO: 2292233 - RNA, 13 nt, Human
uuugauuaaauuc

SEQ ID NO: 2292234 - RNA, 22 nt, Human
uuugauguucuuucacccuuuu

SEQ ID NO: 2292235 - RNA, 12 nt, Human
uuugcaaggaag

SEQ ID NO: 2292236 - RNA, 14 nt, Human
uuugcaaggaagcc

SEQ ID NO: 2292237 - RNA, 21 nt, Human
uuugcaaggaagccacagcug

SEQ ID NO: 2292238 - RNA, 14 nt, Human
uuugcaagccagau

SEQ ID NO: 2292239 - RNA, 15 nt, Human
uuugccguuauuaaa

SEQ ID NO: 2292240 - RNA, 12 nt, Human
uuugcccuuuga

SEQ ID NO: 2292241 - RNA, 21 nt, Human
uuugcaagggaaaagucucuu

SEQ ID NO: 2292242 - RNA, 20 nt, Human
uuugcaagggaaaagucucu

SEQ ID NO: 2292243 - RNA, 19 nt, Human
uuugauguuuguggccuca

SEQ ID NO: 2292244 - RNA, 17 nt, Human
uuugauguuuguggccu

SEQ ID NO: 2292245 - RNA, 20 nt, Human
uuugauucauaguaacuucu

SEQ ID NO: 2292246 - RNA, 15 nt, Human
uuugauucauaguaa

SEQ ID NO: 2292247 - RNA, 22 nt, Human
uuugauucagacagcugccugg

SEQ ID NO: 2292248 - RNA, 12 nt, Human
uuugauucuccu

SEQ ID NO: 2292249 - RNA, 13 nt, Human
uuugauucuccuu

SEQ ID NO: 2292250 - RNA, 14 nt, Human
uuugauucuccuuc

SEQ ID NO: 2292251 - RNA, 16 nt, Human
uuugauucuccuucag

SEQ ID NO: 2292252 - RNA, 14 nt, Human
uuugcaaccucgcu

SEQ ID NO: 2292253 - RNA, 14 nt, Human
uuugccugagggcg

SEQ ID NO: 2292254 - RNA, 20 nt, Human
uuugccucuuuucucugugc

SEQ ID NO: 2292255 - RNA, 17 nt, Human
uuugccucuuccagucu

SEQ ID NO: 2292256 - RNA, 13 nt, Human
uuugccucugccu

SEQ ID NO: 2292257 - RNA, 11 nt, Human
uuugccugugc

SEQ ID NO: 2292258 - RNA, 20 nt, Human
uuugcucucccgguucuucc

SEQ ID NO: 2292259 - RNA, 18 nt, Human
uuugcucuucaagaaauc

SEQ ID NO: 2292260 - RNA, 10 nt, Human
uuugcugcca

SEQ ID NO: 2292261 - RNA, 15 nt, Human
uuugcuggaauaagu

SEQ ID NO: 2292262 - RNA, 17 nt, Human
uuuggcaaugccaucau

SEQ ID NO: 2292263 - RNA, 23 nt, Human
uuuggcaaacucuccaccacacg

SEQ ID NO: 2292264 - RNA, 13 nt, Human
uuugcucuuucuu

SEQ ID NO: 2292265 - RNA, 12 nt, Human
uuugcucugcca

SEQ ID NO: 2292266 - RNA, 20 nt, Human
uuugcucuucaagaaaucug

SEQ ID NO: 2292267 - RNA, 19 nt, Human
uuugcugagcauguacuga

SEQ ID NO: 2292268 - RNA, 14 nt, Human
auguacguuuguau

SEQ ID NO: 2292269 - RNA, 21 nt, Human
auguacguuuguaugugugua

SEQ ID NO: 2292270 - RNA, 18 nt, Human
auguaccaugaaacaaag

SEQ ID NO: 2292271 - RNA, 15 nt, Human
auguaccauguacau

SEQ ID NO: 2292272 - RNA, 15 nt, Human
auguaccauuugcau

SEQ ID NO: 2292273 - RNA, 21 nt, Human
auguaccauguacaugaagaa

SEQ ID NO: 2292274 - RNA, 18 nt, Human
auguaccauuugcauggc

SEQ ID NO: 2292275 - RNA, 22 nt, Human
auguaccauuugcauggcucca

SEQ ID NO: 2292276 - RNA, 19 nt, Human
auguacuguaguuuuucuu

SEQ ID NO: 2292277 - RNA, 16 nt, Human
auguacuguaguuuuu

SEQ ID NO: 2292278 - RNA, 16 nt, Human
auguacuugucaaaga

SEQ ID NO: 2292279 - RNA, 17 nt, Human
auguacuugucaaagaa

SEQ ID NO: 2292280 - RNA, 18 nt, Human
auguacuugucaaagaag

SEQ ID NO: 2292281 - RNA, 19 nt, Human
auguacuugucaaagaagg

SEQ ID NO: 2292282 - RNA, 16 nt, Human
auguacuucaugcugu

SEQ ID NO: 2292283 - RNA, 17 nt, Human
auguacuccucuuuaca

SEQ ID NO: 2292284 - RNA, 20 nt, Human
auguacuccucuuuacacug

SEQ ID NO: 2292285 - RNA, 18 nt, Human
auguacugagccuuguaa

SEQ ID NO: 2292286 - RNA, 14 nt, Human
auguacugagauuu

SEQ ID NO: 2292287 - RNA, 16 nt, Human
auguacucuacugaua

SEQ ID NO: 2292288 - RNA, 22 nt, Human
auguacucuacugauaucuaaa

SEQ ID NO: 2292289 - RNA, 23 nt, Human
auguagauauugugaaguacaua

SEQ ID NO: 2292290 - RNA, 22 nt, Human
auguagauauugugaaguacau

SEQ ID NO: 2292291 - RNA, 19 nt, Human
auguagauaacaagaccuc

SEQ ID NO: 2292292 - RNA, 19 nt, Human
auguagauaaacucagaaa

SEQ ID NO: 2292293 - RNA, 18 nt, Human
auguagauaaacucagaa

SEQ ID NO: 2292294 - RNA, 19 nt, Human
auguagaggggaaaagaga

SEQ ID NO: 2292295 - RNA, 19 nt, Human
auguagaggagaaacugga

SEQ ID NO: 2292296 - RNA, 17 nt, Human
auguagaggagaaacug

SEQ ID NO: 2292297 - RNA, 12 nt, Human
auguagaaagcu

SEQ ID NO: 2292298 - RNA, 13 nt, Human
auguagaagcugc

SEQ ID NO: 2292299 - RNA, 14 nt, Human
auguagaaaauuug

SEQ ID NO: 2292300 - RNA, 13 nt, Human
auguagaggagaa

SEQ ID NO: 2292301 - RNA, 12 nt, Human
auguagaggaga

SEQ ID NO: 2292302 - RNA, 17 nt, Human
auguagguaugaauaag

SEQ ID NO: 2292303 - RNA, 16 nt, Human
auguagguaugaauaa

SEQ ID NO: 2292304 - RNA, 20 nt, Human
auguagggcauaaugaugau

SEQ ID NO: 2292305 - RNA, 18 nt, Human
auguaggguaaggugccu

SEQ ID NO: 2292306 - RNA, 17 nt, Human
auguaggcauucuggag

SEQ ID NO: 2292307 - RNA, 15 nt, Human
auguaggugucugca

SEQ ID NO: 2292308 - RNA, 21 nt, Human
auguaggugucugcacccagg

SEQ ID NO: 2292309 - RNA, 17 nt, Human
auguaguauaaagaaaa

SEQ ID NO: 2292310 - RNA, 16 nt, Human
auguaguauaaagaaa

SEQ ID NO: 2292311 - RNA, 18 nt, Human
auguaguaauugacaugu

SEQ ID NO: 2292312 - RNA, 14 nt, Human
auguaguaguacuu

SEQ ID NO: 2292313 - RNA, 17 nt, Human
auguaguaauugacaug

SEQ ID NO: 2292314 - RNA, 16 nt, Human
auguaguaauugacau

SEQ ID NO: 2292315 - RNA, 13 nt, Human
auguaguaauuga

SEQ ID NO: 2292316 - RNA, 16 nt, Human
auguaguaaguaaauu

SEQ ID NO: 2292317 - RNA, 13 nt, Human
uuugacaugugga

SEQ ID NO: 2292318 - RNA, 20 nt, Human
uuugacauugcguuugaccu

SEQ ID NO: 2292319 - RNA, 12 nt, Human
uuugaccucugc

SEQ ID NO: 2292320 - RNA, 19 nt, Human
auguaguauaaagaaaagu

SEQ ID NO: 2292321 - RNA, 23 nt, Human
auguaguaucaaauauuagaugu

SEQ ID NO: 2292322 - RNA, 21 nt, Human
auguaguaucaaauauuagau

SEQ ID NO: 2292323 - RNA, 18 nt, Human
uuugacaguguugaaaau

SEQ ID NO: 2292324 - RNA, 19 nt, Human
uuugacaguguugaaaaug

SEQ ID NO: 2292325 - RNA, 23 nt, Human
auguagccaugaccuuacauuuc

SEQ ID NO: 2292326 - RNA, 16 nt, Human
auguagccaugggacc

SEQ ID NO: 2292327 - RNA, 23 nt, Human
auguagcccccuggccucugugc

SEQ ID NO: 2292328 - RNA, 21 nt, Human
auguagcccccuggccucugu

SEQ ID NO: 2292329 - RNA, 19 nt, Human
auguagcccccuggccucu

SEQ ID NO: 2292330 - RNA, 18 nt, Human
auguagcccccuggccuc

SEQ ID NO: 2292331 - RNA, 20 nt, Human
auguagcaaaacgcauggag

SEQ ID NO: 2292332 - RNA, 21 nt, Human
auguagcaaaauacaugacau

SEQ ID NO: 2292333 - RNA, 17 nt, Human
auguagcaaaacgcaug

SEQ ID NO: 2292334 - RNA, 20 nt, Human
auguagauuuauuucaucau

SEQ ID NO: 2292335 - RNA, 17 nt, Human
auguagaugugcauuuu

SEQ ID NO: 2292336 - RNA, 17 nt, Human
auguagauuuauuucau

SEQ ID NO: 2292337 - RNA, 16 nt, Human
auguagauuuauuuca

SEQ ID NO: 2292338 - RNA, 15 nt, Human
auguagcugguuucc

SEQ ID NO: 2292339 - RNA, 14 nt, Human
auguagcugguuuc

SEQ ID NO: 2292340 - RNA, 12 nt, Human
auguagccaugg

SEQ ID NO: 2292341 - RNA, 23 nt, Human
auguaggagcugccuuggcucag

SEQ ID NO: 2292342 - RNA, 14 nt, Human
auguaggaaguagg

SEQ ID NO: 2292343 - RNA, 22 nt, Human
auguaggaaagaccauuuuucc

SEQ ID NO: 2292344 - RNA, 19 nt, Human
auguagccccucuccugga

SEQ ID NO: 2292345 - RNA, 13 nt, Human
augugauuuaaua

SEQ ID NO: 2292346 - RNA, 22 nt, Human
augugauuguggaauggagauu

SEQ ID NO: 2292347 - RNA, 16 nt, Human
augugauuuaauagug

SEQ ID NO: 2292348 - RNA, 17 nt, Human
augugauuuaauagugu

SEQ ID NO: 2292349 - RNA, 18 nt, Human
augugauuuaauaguguu

SEQ ID NO: 2292350 - RNA, 20 nt, Human
augugauuuaauaguguuaa

SEQ ID NO: 2292351 - RNA, 17 nt, Human
augugauuguggaaugg

SEQ ID NO: 2292352 - RNA, 15 nt, Human
augugauuguggaau

SEQ ID NO: 2292353 - RNA, 14 nt, Human
augugauuguggaa

SEQ ID NO: 2292354 - RNA, 23 nt, Human
augugauuccuuugaagaggaaa

SEQ ID NO: 2292355 - RNA, 15 nt, Human
augugauucuaaugu

SEQ ID NO: 2292356 - RNA, 18 nt, Human
augugacucugaagcuga

SEQ ID NO: 2292357 - RNA, 20 nt, Human
augugauuccuuugaagagg

SEQ ID NO: 2292358 - RNA, 23 nt, Human
augugcacaugcacgugugugca

SEQ ID NO: 2292359 - RNA, 14 nt, Human
augugauuuuucug

SEQ ID NO: 2292360 - RNA, 20 nt, Human
augugauuuuaacucugucu

SEQ ID NO: 2292361 - RNA, 19 nt, Human
augugauuuuaacucuguc

SEQ ID NO: 2292362 - RNA, 18 nt, Human
augugauuuuaacucugu

SEQ ID NO: 2292363 - RNA, 16 nt, Human
augugauuuuaacucu

SEQ ID NO: 2292364 - RNA, 15 nt, Human
augugauuuuaacuc

SEQ ID NO: 2292365 - RNA, 14 nt, Human
augugauuuuaacu

SEQ ID NO: 2292366 - RNA, 21 nt, Human
augugauuuaauaguguuaau

SEQ ID NO: 2292367 - RNA, 13 nt, Human
augugcaaaacag

SEQ ID NO: 2292368 - RNA, 14 nt, Human
augugcaaaacagc

SEQ ID NO: 2292369 - RNA, 16 nt, Human
augugcaaguguaugc

SEQ ID NO: 2292370 - RNA, 14 nt, Human
augugcaaaugcaa

SEQ ID NO: 2292371 - RNA, 15 nt, Human
augugauuuuucuga

SEQ ID NO: 2292372 - RNA, 13 nt, Human
augucucuucuga

SEQ ID NO: 2292373 - RNA, 17 nt, Human
augucucuucugagcua

SEQ ID NO: 2292374 - RNA, 16 nt, Human
augucucuucugagcu

SEQ ID NO: 2292375 - RNA, 23 nt, Human
augucucuuuaaugucacaggca

SEQ ID NO: 2292376 - RNA, 13 nt, Human
augugacucugaa

SEQ ID NO: 2292377 - RNA, 12 nt, Human
augugacucuga

SEQ ID NO: 2292378 - RNA, 20 nt, Human
augugacccagauccucaca

SEQ ID NO: 2292379 - RNA, 19 nt, Human
augugaccacucugucuug

SEQ ID NO: 2292380 - RNA, 16 nt, Human
augugaugagaggaaa

SEQ ID NO: 2292381 - RNA, 23 nt, Human
augugacuugcaucguggagaca

SEQ ID NO: 2292382 - RNA, 17 nt, Human
augugaugagaggaaau

SEQ ID NO: 2292383 - RNA, 19 nt, Human
augugaugagaggaaauca

SEQ ID NO: 2292384 - RNA, 17 nt, Human
uuugugaauggauugga

SEQ ID NO: 2292385 - RNA, 18 nt, Human
uuugugaauagaacucug

SEQ ID NO: 2292386 - RNA, 20 nt, Human
uuugugaagguggaaauaaa

SEQ ID NO: 2292387 - RNA, 19 nt, Human
uuugugaauggauuggauu

SEQ ID NO: 2292388 - RNA, 18 nt, Human
uuugugacuaauuguaua

SEQ ID NO: 2292389 - RNA, 23 nt, Human
uuugugaauggauuggauuauuu

SEQ ID NO: 2292390 - RNA, 22 nt, Human
uuugugacuaauuguauaacag

SEQ ID NO: 2292391 - RNA, 14 nt, Human
uuugugacuauaua

SEQ ID NO: 2292392 - RNA, 21 nt, Human
uuugucuuguguuucuuuagu

SEQ ID NO: 2292393 - RNA, 22 nt, Human
uuugugaaaugauggugaaagu

SEQ ID NO: 2292394 - RNA, 17 nt, Human
uuugucuuuaacuguca

SEQ ID NO: 2292395 - RNA, 16 nt, Human
uuugucuugaaugucu

SEQ ID NO: 2292396 - RNA, 20 nt, Human
uuugugaacucagccaagca

SEQ ID NO: 2292397 - RNA, 22 nt, Human
uuugugaacaagucccuguaau

SEQ ID NO: 2292398 - RNA, 17 nt, Human
uuugugaagcaaaauuu

SEQ ID NO: 2292399 - RNA, 23 nt, Human
uuuguaaugucaccaccuuccca

SEQ ID NO: 2292400 - RNA, 12 nt, Human
uuuguaauuauu

SEQ ID NO: 2292401 - RNA, 14 nt, Human
uuuguaauuauugu

SEQ ID NO: 2292402 - RNA, 18 nt, Human
uuuguaauugcuuacauu

SEQ ID NO: 2292403 - RNA, 21 nt, Human
uuuguaaucguuaugugugua

SEQ ID NO: 2292404 - RNA, 18 nt, Human
uuuguaaucguuaugugu

SEQ ID NO: 2292405 - RNA, 16 nt, Human
augugcacccaugggc

SEQ ID NO: 2292406 - RNA, 13 nt, Human
uuuguaaugaaaa

SEQ ID NO: 2292407 - RNA, 14 nt, Human
uuuguaaugaaaac

SEQ ID NO: 2292408 - RNA, 12 nt, Human
uuuguauaaaag

SEQ ID NO: 2292409 - RNA, 15 nt, Human
uuugucuucucccca

SEQ ID NO: 2292410 - RNA, 16 nt, Human
uuugucuucuccccag

SEQ ID NO: 2292411 - RNA, 20 nt, Human
uuuguaauugcuuacauuuu

SEQ ID NO: 2292412 - RNA, 19 nt, Human
uuuguaguguuggagaaga

SEQ ID NO: 2292413 - RNA, 21 nt, Human
uuuguaguguuggagaagaac

SEQ ID NO: 2292414 - RNA, 12 nt, Human
auguauguuuac

SEQ ID NO: 2292415 - RNA, 14 nt, Human
auguauguuuacau

SEQ ID NO: 2292416 - RNA, 13 nt, Human
auguauguuuaca

SEQ ID NO: 2292417 - RNA, 16 nt, Human
auguauguuuacauau

SEQ ID NO: 2292418 - RNA, 16 nt, Human
auguauguguaaguau

SEQ ID NO: 2292419 - RNA, 14 nt, Human
auguauguguguau

SEQ ID NO: 2292420 - RNA, 15 nt, Human
auguauguguguaug

SEQ ID NO: 2292421 - RNA, 17 nt, Human
auguauuauucugcagc

SEQ ID NO: 2292422 - RNA, 16 nt, Human
auguauuauucugcag

SEQ ID NO: 2292423 - RNA, 14 nt, Human
auguauuauucugc

SEQ ID NO: 2292424 - RNA, 13 nt, Human
auguauuauucug

SEQ ID NO: 2292425 - RNA, 16 nt, Human
augucaguauguggaa

SEQ ID NO: 2292426 - RNA, 17 nt, Human
auguauuaauauucauu

SEQ ID NO: 2292427 - RNA, 16 nt, Human
auguauuaauauucau

SEQ ID NO: 2292428 - RNA, 18 nt, Human
auguauguuuacauauca

SEQ ID NO: 2292429 - RNA, 17 nt, Human
auguauguuuacauauc

SEQ ID NO: 2292430 - RNA, 20 nt, Human
auguauguuuugguaucugu

SEQ ID NO: 2292431 - RNA, 14 nt, Human
auguaugauuacau

SEQ ID NO: 2292432 - RNA, 14 nt, Human
auguaugcagcuau

SEQ ID NO: 2292433 - RNA, 17 nt, Human
auguaugcagcuaucug

SEQ ID NO: 2292434 - RNA, 14 nt, Human
auguaugcuucaua

SEQ ID NO: 2292435 - RNA, 15 nt, Human
auguauguguaagua

SEQ ID NO: 2292436 - RNA, 16 nt, Human
auguaugcuucauaca

SEQ ID NO: 2292437 - RNA, 15 nt, Human
auguaugcuucauac

SEQ ID NO: 2292438 - RNA, 13 nt, Human
uuuggcagaguuc

SEQ ID NO: 2292439 - RNA, 20 nt, Human
uuuggcagagcuucuuccag

SEQ ID NO: 2292440 - RNA, 11 nt, Human
uuuggcacugg

SEQ ID NO: 2292441 - RNA, 17 nt, Human
uuuggcacuggggcacu

SEQ ID NO: 2292442 - RNA, 22 nt, Human
uuuggcaggggcagaaaacucu

SEQ ID NO: 2292443 - RNA, 13 nt, Human
uuuggcaggugca

SEQ ID NO: 2292444 - RNA, 19 nt, Human
auguaugaggaauuucugu

SEQ ID NO: 2292445 - RNA, 18 nt, Human
auguaugagguacaaccu

SEQ ID NO: 2292446 - RNA, 20 nt, Human
uuuggcaucuguuuaaagua

SEQ ID NO: 2292447 - RNA, 19 nt, Human
augucucgugguaggacug

SEQ ID NO: 2292448 - RNA, 21 nt, Human
augucucucagaauucuucag

SEQ ID NO: 2292449 - RNA, 17 nt, Human
augucucucagaauucu

SEQ ID NO: 2292450 - RNA, 16 nt, Human
augucucucagaauuc

SEQ ID NO: 2292451 - RNA, 13 nt, Human
augucucucagaa

SEQ ID NO: 2292452 - RNA, 17 nt, Human
augucucugagcauuag

SEQ ID NO: 2292453 - RNA, 21 nt, Human
augucucugugagacucgaga

SEQ ID NO: 2292454 - RNA, 23 nt, Human
augucucugugagacucgagaac

SEQ ID NO: 2292455 - RNA, 15 nt, Human
augucucgugguagg

SEQ ID NO: 2292456 - RNA, 16 nt, Human
augucucgugguagga

SEQ ID NO: 2292457 - RNA, 13 nt, Human
augucgccucugc

SEQ ID NO: 2292458 - RNA, 14 nt, Human
augucgccucugca

SEQ ID NO: 2292459 - RNA, 14 nt, Human
auguccuguaaagg

SEQ ID NO: 2292460 - RNA, 17 nt, Human
augucucaggucccugc

SEQ ID NO: 2292461 - RNA, 22 nt, Human
augucucaggucccugcagggc

SEQ ID NO: 2292462 - RNA, 13 nt, Human
auguccuguaaag

SEQ ID NO: 2292463 - RNA, 14 nt, Human
auguccacugugua

SEQ ID NO: 2292464 - RNA, 22 nt, Human
auguccagaagaauauucagga

SEQ ID NO: 2292465 - RNA, 23 nt, Human
auguccagaagaauauucaggac

SEQ ID NO: 2292466 - RNA, 16 nt, Human
auguccacuguguaua

SEQ ID NO: 2292467 - RNA, 17 nt, Human
auguccacuguguauag

SEQ ID NO: 2292468 - RNA, 12 nt, Human
auguccagaaga

SEQ ID NO: 2292469 - RNA, 21 nt, Human
auguccagaagaauauucagg

SEQ ID NO: 2292470 - RNA, 12 nt, Human
augucaguguga

SEQ ID NO: 2292471 - RNA, 13 nt, Human
augucagugugac

SEQ ID NO: 2292472 - RNA, 17 nt, Human
auguccacugguucuuc

SEQ ID NO: 2292473 - RNA, 16 nt, Human
auguccacugguucuu

SEQ ID NO: 2292474 - RNA, 23 nt, Human
aucauuuuuccuucccuucucca

SEQ ID NO: 2292475 - RNA, 13 nt, Human
aucauuuuuguac

SEQ ID NO: 2292476 - RNA, 18 nt, Human
auccaagcuggucccacu

SEQ ID NO: 2292477 - RNA, 21 nt, Human
auccaagcuggucccacucag

SEQ ID NO: 2292478 - RNA, 13 nt, Human
auccacccaccuc

SEQ ID NO: 2292479 - RNA, 15 nt, Human
auccacccaccucag

SEQ ID NO: 2292480 - RNA, 16 nt, Human
auccaguaucuugaag

SEQ ID NO: 2292481 - RNA, 15 nt, Human
aucauuuucccccca

SEQ ID NO: 2292482 - RNA, 14 nt, Human
aucauuuucccccc

SEQ ID NO: 2292483 - RNA, 13 nt, Human
aucauuuuccccc

SEQ ID NO: 2292484 - RNA, 19 nt, Human
aucauuuuauaugucaaag

SEQ ID NO: 2292485 - RNA, 17 nt, Human
aucauuuuauaugucaa

SEQ ID NO: 2292486 - RNA, 18 nt, Human
aucauuuuauaugucaaa

SEQ ID NO: 2292487 - RNA, 16 nt, Human
aucauuuuagaagacu

SEQ ID NO: 2292488 - RNA, 22 nt, Human
aucauuuuagaagacucuacca

SEQ ID NO: 2292489 - RNA, 23 nt, Human
aucauuuuagaagacucuaccag

SEQ ID NO: 2292490 - RNA, 17 nt, Human
aucauuuuccccccacu

SEQ ID NO: 2292491 - RNA, 22 nt, Human
aucauuuucuuaucuucugcaa

SEQ ID NO: 2292492 - RNA, 13 nt, Human
aucauuuugcauu

SEQ ID NO: 2292493 - RNA, 15 nt, Human
aucauuuugcauuca

SEQ ID NO: 2292494 - RNA, 17 nt, Human
aucauuuugcauucaaa

SEQ ID NO: 2292495 - RNA, 18 nt, Human
auccaagcaaaugugaau

SEQ ID NO: 2292496 - RNA, 19 nt, Human
aucauuuugccucuuuucu

SEQ ID NO: 2292497 - RNA, 19 nt, Human
aucauuuugcauucaaauu

SEQ ID NO: 2292498 - RNA, 14 nt, Human
aucauuuuuccuuc

SEQ ID NO: 2292499 - RNA, 23 nt, Human
uucuggggccccuuuuuacuccc

SEQ ID NO: 2292500 - RNA, 20 nt, Human
aucauuuuaccuuugacaaa

SEQ ID NO: 2292501 - RNA, 14 nt, Human
uucuggggccccuu

SEQ ID NO: 2292502 - RNA, 21 nt, Human
uucuggggccccuuuuuacuc

SEQ ID NO: 2292503 - RNA, 19 nt, Human
uucugggcaucuguucugg

SEQ ID NO: 2292504 - RNA, 16 nt, Human
uucugggcuucaucug

SEQ ID NO: 2292505 - RNA, 20 nt, Human
aucccagcuacucaagaggc

SEQ ID NO: 2292506 - RNA, 13 nt, Human
aucccagccuugg

SEQ ID NO: 2292507 - RNA, 23 nt, Human
aucccagcccuuugggaggcuga

SEQ ID NO: 2292508 - RNA, 18 nt, Human
aucccagcuacucaggag

SEQ ID NO: 2292509 - RNA, 17 nt, Human
aucccagcuacucagga

SEQ ID NO: 2292510 - RNA, 23 nt, Human
aucccagcuacucaagaggcuga

SEQ ID NO: 2292511 - RNA, 15 nt, Human
aucccagccuuggca

SEQ ID NO: 2292512 - RNA, 20 nt, Human
aucccagcuacucaggaggc

SEQ ID NO: 2292513 - RNA, 18 nt, Human
aucccagcuacuugggaa

SEQ ID NO: 2292514 - RNA, 22 nt, Human
aucccagcuacuugggaggcug

SEQ ID NO: 2292515 - RNA, 13 nt, Human
aucccagcucacg

SEQ ID NO: 2292516 - RNA, 20 nt, Human
aucccagcuacuugggaagc

SEQ ID NO: 2292517 - RNA, 12 nt, Human
aucccaggacac

SEQ ID NO: 2292518 - RNA, 17 nt, Human
aucccaggacaccacac

SEQ ID NO: 2292519 - RNA, 18 nt, Human
aucccauaugccugggca

SEQ ID NO: 2292520 - RNA, 22 nt, Human
aucccaaagccuugugucuaca

SEQ ID NO: 2292521 - RNA, 12 nt, Human
aucccagcccca

SEQ ID NO: 2292522 - RNA, 19 nt, Human
aucccaaacccuucagugc

SEQ ID NO: 2292523 - RNA, 20 nt, Human
aucccaaacccuucagugcc

SEQ ID NO: 2292524 - RNA, 13 nt, Human
auccaucaggcca

SEQ ID NO: 2292525 - RNA, 14 nt, Human
auccaucaucaugu

SEQ ID NO: 2292526 - RNA, 19 nt, Human
auccauaguggacauuguu

SEQ ID NO: 2292527 - RNA, 16 nt, Human
auccauaguaguauga

SEQ ID NO: 2292528 - RNA, 18 nt, Human
auccauauugagucaaau

SEQ ID NO: 2292529 - RNA, 20 nt, Human
auccauauugagucaaaugg

SEQ ID NO: 2292530 - RNA, 21 nt, Human
auccaguaucuugaagacuuu

SEQ ID NO: 2292531 - RNA, 18 nt, Human
auccacauuguuuuaaaa

SEQ ID NO: 2292532 - RNA, 19 nt, Human
auccacauuguuuuaaaaa

SEQ ID NO: 2292533 - RNA, 14 nt, Human
auccaccaccuccc

SEQ ID NO: 2292534 - RNA, 17 nt, Human
auccaccaccucccuca

SEQ ID NO: 2292535 - RNA, 19 nt, Human
auccauagcaccuccacau

SEQ ID NO: 2292536 - RNA, 16 nt, Human
auccaguucaugagaa

SEQ ID NO: 2292537 - RNA, 17 nt, Human
auccagugucucacagc

SEQ ID NO: 2292538 - RNA, 21 nt, Human
auccagugauccuuacaaguu

SEQ ID NO: 2292539 - RNA, 16 nt, Human
auccagugauccuuac

SEQ ID NO: 2292540 - RNA, 18 nt, Human
aucaguagccagcaucug

SEQ ID NO: 2292541 - RNA, 19 nt, Human
aucaguaagaaaaagaaga

SEQ ID NO: 2292542 - RNA, 15 nt, Human
aucaguaauauuuau

SEQ ID NO: 2292543 - RNA, 13 nt, Human
aucagguggggag

SEQ ID NO: 2292544 - RNA, 13 nt, Human
aucaggucuccca

SEQ ID NO: 2292545 - RNA, 20 nt, Human
aucaggugcccaucccugga

SEQ ID NO: 2292546 - RNA, 15 nt, Human
aucagguuccauccc

SEQ ID NO: 2292547 - RNA, 14 nt, Human
aucaguauaaacaa

SEQ ID NO: 2292548 - RNA, 10 nt, Human
uucuccugga

SEQ ID NO: 2292549 - RNA, 15 nt, Human
uucuccuuagucuuc

SEQ ID NO: 2292550 - RNA, 12 nt, Human
uucuccugugcu

SEQ ID NO: 2292551 - RNA, 15 nt, Human
uucuccuucagcccu

SEQ ID NO: 2292552 - RNA, 20 nt, Human
uucuccuucagcccucaccc

SEQ ID NO: 2292553 - RNA, 21 nt, Human
uucuccuuguguuacuaaguu

SEQ ID NO: 2292554 - RNA, 20 nt, Human
uucuccuuagucuucucaua

SEQ ID NO: 2292555 - RNA, 12 nt, Human
uucucuaggaaa

SEQ ID NO: 2292556 - RNA, 17 nt, Human
uucucuaguuugauuaa

SEQ ID NO: 2292557 - RNA, 15 nt, Human
uucucuaguuugauu

SEQ ID NO: 2292558 - RNA, 21 nt, Human
uucucuuccacucuccuugcu

SEQ ID NO: 2292559 - RNA, 20 nt, Human
uucucuaguuugauuaaauu

SEQ ID NO: 2292560 - RNA, 13 nt, Human
uucucuuccugua

SEQ ID NO: 2292561 - RNA, 12 nt, Human
uucucuuccugu

SEQ ID NO: 2292562 - RNA, 20 nt, Human
uucucuuccuuuuaucagua

SEQ ID NO: 2292563 - RNA, 12 nt, Human
uucucuucucug

SEQ ID NO: 2292564 - RNA, 14 nt, Human
uucucuucuugaac

SEQ ID NO: 2292565 - RNA, 14 nt, Human
uucucuucucuguu

SEQ ID NO: 2292566 - RNA, 15 nt, Human
uucucuugggcugag

SEQ ID NO: 2292567 - RNA, 22 nt, Human
uucucuugggaacugaacucac

SEQ ID NO: 2292568 - RNA, 17 nt, Human
uucucuugggaacugaa

SEQ ID NO: 2292569 - RNA, 22 nt, Human
uucugaacucaaacugaggaau

SEQ ID NO: 2292570 - RNA, 18 nt, Human
uucugaacucaaacugag

SEQ ID NO: 2292571 - RNA, 17 nt, Human
uucugaacucaaacuga

SEQ ID NO: 2292572 - RNA, 16 nt, Human
uucugaacucaaacug

SEQ ID NO: 2292573 - RNA, 19 nt, Human
uucugaacuuggcgcugcc

SEQ ID NO: 2292574 - RNA, 22 nt, Human
uucugaacuuggcgcugccccu

SEQ ID NO: 2292575 - RNA, 19 nt, Human
uucugcccacauuggaccc

SEQ ID NO: 2292576 - RNA, 19 nt, Human
uucugcccaaaaauauggu

SEQ ID NO: 2292577 - RNA, 16 nt, Human
uucugccagggagcuu

SEQ ID NO: 2292578 - RNA, 15 nt, Human
uucugccagggagcu

SEQ ID NO: 2292579 - RNA, 13 nt, Human
uucugcccuggcu

SEQ ID NO: 2292580 - RNA, 14 nt, Human
uucugcccuggcug

SEQ ID NO: 2292581 - RNA, 19 nt, Human
uucugcccaauuggaggaa

SEQ ID NO: 2292582 - RNA, 15 nt, Human
uucugccauauucug

SEQ ID NO: 2292583 - RNA, 23 nt, Human
uucugaacuuggcgcugccccug

SEQ ID NO: 2292584 - RNA, 21 nt, Human
uucugccugcccaggccccug

SEQ ID NO: 2292585 - RNA, 15 nt, Human
uucuggcucuuccag

SEQ ID NO: 2292586 - RNA, 14 nt, Human
uucugccuggagac

SEQ ID NO: 2292587 - RNA, 16 nt, Human
uucugcccuggcugcu

SEQ ID NO: 2292588 - RNA, 13 nt, Human
uucugccuguuau

SEQ ID NO: 2292589 - RNA, 17 nt, Human
uucugccugcccaggcc

SEQ ID NO: 2292590 - RNA, 18 nt, Human
uucugccugcccaggccc

SEQ ID NO: 2292591 - RNA, 19 nt, Human
uucuggcugaacacuggca

SEQ ID NO: 2292592 - RNA, 15 nt, Human
uucugccuguuauaa

SEQ ID NO: 2292593 - RNA, 14 nt, Human
uucugccuguuaua

SEQ ID NO: 2292594 - RNA, 22 nt, Human
uucuggcuggagccuagaacag

SEQ ID NO: 2292595 - RNA, 11 nt, Human
uucuggcugcc

SEQ ID NO: 2292596 - RNA, 20 nt, Human
uucuggcugccccaaccugc

SEQ ID NO: 2292597 - RNA, 23 nt, Human
uucugggaaauggcuugaagcca

SEQ ID NO: 2292598 - RNA, 17 nt, Human
uucugggaaauggcuug

SEQ ID NO: 2292599 - RNA, 20 nt, Human
uucuggcuuccuucucucaa

SEQ ID NO: 2292600 - RNA, 21 nt, Human
uucugggagggcagcagggcu

SEQ ID NO: 2292601 - RNA, 14 nt, Human
uucugggagggcag

SEQ ID NO: 2292602 - RNA, 16 nt, Human
uucuggcucuuccagg

SEQ ID NO: 2292603 - RNA, 17 nt, Human
uucuggcucuuccaggc

SEQ ID NO: 2292604 - RNA, 17 nt, Human
auccguaguucccugaa

SEQ ID NO: 2292605 - RNA, 21 nt, Human
auccgucuuuggccuccucca

SEQ ID NO: 2292606 - RNA, 23 nt, Human
auccuaaaacaaaagcucaucca

SEQ ID NO: 2292607 - RNA, 19 nt, Human
auccuaaaacaaaagcuca

SEQ ID NO: 2292608 - RNA, 15 nt, Human
auccggcagccugga

SEQ ID NO: 2292609 - RNA, 22 nt, Human
auccggcaacaucaacccgagu

SEQ ID NO: 2292610 - RNA, 16 nt, Human
auccguaguucccuga

SEQ ID NO: 2292611 - RNA, 20 nt, Human
auccggcccccagagcgccc

SEQ ID NO: 2292612 - RNA, 13 nt, Human
auccgaggcaggg

SEQ ID NO: 2292613 - RNA, 13 nt, Human
auccgccagggcc

SEQ ID NO: 2292614 - RNA, 23 nt, Human
auccgacuugaauuuucccacug

SEQ ID NO: 2292615 - RNA, 14 nt, Human
auccgccagggccc

SEQ ID NO: 2292616 - RNA, 19 nt, Human
auccgccagggcccacacc

SEQ ID NO: 2292617 - RNA, 15 nt, Human
auccgccagggccca

SEQ ID NO: 2292618 - RNA, 12 nt, Human
auccuaagcuau

SEQ ID NO: 2292619 - RNA, 14 nt, Human
auccuaaaacaaau

SEQ ID NO: 2292620 - RNA, 14 nt, Human
auccuacaagacac

SEQ ID NO: 2292621 - RNA, 19 nt, Human
auccuacaagacacaguga

SEQ ID NO: 2292622 - RNA, 18 nt, Human
auccuacaagacacagug

SEQ ID NO: 2292623 - RNA, 16 nt, Human
auccuaggcauuugcu

SEQ ID NO: 2292624 - RNA, 19 nt, Human
auccuagccuuauccucug

SEQ ID NO: 2292625 - RNA, 20 nt, Human
auccuagccuuauccucuga

SEQ ID NO: 2292626 - RNA, 21 nt, Human
auccuagccuuauccucugau

SEQ ID NO: 2292627 - RNA, 22 nt, Human
auccuagccuuauccucugauc

SEQ ID NO: 2292628 - RNA, 11 nt, Human
auccuccuccc

SEQ ID NO: 2292629 - RNA, 16 nt, Human
auccuccucagaucuu

SEQ ID NO: 2292630 - RNA, 14 nt, Human
auccuaccaaugca

SEQ ID NO: 2292631 - RNA, 22 nt, Human
auccuacacaccuaagggacau

SEQ ID NO: 2292632 - RNA, 15 nt, Human
auccuaccaaugcau

SEQ ID NO: 2292633 - RNA, 16 nt, Human
auccuaccaaugcaug

SEQ ID NO: 2292634 - RNA, 17 nt, Human
auccuaccaaugcaugc

SEQ ID NO: 2292635 - RNA, 18 nt, Human
auccuaccaaugcaugca

SEQ ID NO: 2292636 - RNA, 21 nt, Human
auccuaccccaauuccuugua

SEQ ID NO: 2292637 - RNA, 21 nt, Human
auccuacccucgggcccaccu

SEQ ID NO: 2292638 - RNA, 22 nt, Human
auccuacccucgggcccaccug

SEQ ID NO: 2292639 - RNA, 16 nt, Human
auccuaccuguuuugu

SEQ ID NO: 2292640 - RNA, 21 nt, Human
auccuagagauuugguguaca

SEQ ID NO: 2292641 - RNA, 23 nt, Human
auccuagagauuugguguacaau

SEQ ID NO: 2292642 - RNA, 14 nt, Human
auccuacuucucca

SEQ ID NO: 2292643 - RNA, 15 nt, Human
uugaaauuguacaua

SEQ ID NO: 2292644 - RNA, 19 nt, Human
uugaacccgggaggcagag

SEQ ID NO: 2292645 - RNA, 12 nt, Human
auccgaggcagg

SEQ ID NO: 2292646 - RNA, 17 nt, Human
auccgacugcuuuggac

SEQ ID NO: 2292647 - RNA, 22 nt, Human
uugaacgcccccccccaccccu

SEQ ID NO: 2292648 - RNA, 19 nt, Human
uugaaauuguuuaaguguu

SEQ ID NO: 2292649 - RNA, 17 nt, Human
uugaaauuguauuacaa

SEQ ID NO: 2292650 - RNA, 16 nt, Human
uugaaagcauccaugu

SEQ ID NO: 2292651 - RNA, 12 nt, Human
uugaaagcugug

SEQ ID NO: 2292652 - RNA, 22 nt, Human
uugaaagauucagguauguugc

SEQ ID NO: 2292653 - RNA, 21 nt, Human
uugaaaggcauucucugaaga

SEQ ID NO: 2292654 - RNA, 20 nt, Human
uugaaaggcauucucugaag

SEQ ID NO: 2292655 - RNA, 19 nt, Human
uugaaaggcauucucugaa

SEQ ID NO: 2292656 - RNA, 22 nt, Human
uugaaagcuguggccagcuugu

SEQ ID NO: 2292657 - RNA, 21 nt, Human
uugaaagggguugugaagagg

SEQ ID NO: 2292658 - RNA, 20 nt, Human
uugaaauuaagaaggcaaaa

SEQ ID NO: 2292659 - RNA, 18 nt, Human
uugaaauguguuucugua

SEQ ID NO: 2292660 - RNA, 19 nt, Human
uugaaauguguuucuguau

SEQ ID NO: 2292661 - RNA, 18 nt, Human
uugaaauuaaccucucac

SEQ ID NO: 2292662 - RNA, 18 nt, Human
uugaaauuauguauguuu

SEQ ID NO: 2292663 - RNA, 19 nt, Human
uugaaauuauguauguuua

SEQ ID NO: 2292664 - RNA, 21 nt, Human
uugaaauuauguauguuuaca

SEQ ID NO: 2292665 - RNA, 23 nt, Human
uugaaauuauguauguuuacaua

SEQ ID NO: 2292666 - RNA, 21 nt, Human
uucuuaagacgugauuuugcu

SEQ ID NO: 2292667 - RNA, 23 nt, Human
uucuuaagacgugauuuugcugu

SEQ ID NO: 2292668 - RNA, 22 nt, Human
uucuuaaggauugugauauuuu

SEQ ID NO: 2292669 - RNA, 20 nt, Human
uucuuaaggauugugauauu

SEQ ID NO: 2292670 - RNA, 22 nt, Human
uucuuaaguauguuauuuucug

SEQ ID NO: 2292671 - RNA, 13 nt, Human
uucuucucccuca

SEQ ID NO: 2292672 - RNA, 19 nt, Human
uucuuaaucuuuucacaaa

SEQ ID NO: 2292673 - RNA, 20 nt, Human
uucuuaaucuuuucacaaau

SEQ ID NO: 2292674 - RNA, 21 nt, Human
uucuuaaucuuuucacaaaua

SEQ ID NO: 2292675 - RNA, 14 nt, Human
uucuucucccucag

SEQ ID NO: 2292676 - RNA, 13 nt, Human
uucuucugaacuc

SEQ ID NO: 2292677 - RNA, 14 nt, Human
uucuucucugcugc

SEQ ID NO: 2292678 - RNA, 15 nt, Human
uucuucuccuaugug

SEQ ID NO: 2292679 - RNA, 17 nt, Human
uucuucuccuaugugua

SEQ ID NO: 2292680 - RNA, 18 nt, Human
uucuucuccuauguguaa

SEQ ID NO: 2292681 - RNA, 14 nt, Human
uucuucucuagcug

SEQ ID NO: 2292682 - RNA, 13 nt, Human
uucuucugcuuca

SEQ ID NO: 2292683 - RNA, 15 nt, Human
uucuucugcuucagc

SEQ ID NO: 2292684 - RNA, 21 nt, Human
aucccaggacaccacacccag

SEQ ID NO: 2292685 - RNA, 22 nt, Human
aucccaggacaccacacccagc

SEQ ID NO: 2292686 - RNA, 24 nt, Human
aucccauaugccugggcagaagga

SEQ ID NO: 2292687 - RNA, 13 nt, Human
aucccaugagccu

SEQ ID NO: 2292688 - RNA, 16 nt, Human
aucccaugaacacacu

SEQ ID NO: 2292689 - RNA, 18 nt, Human
aucccaugaacacacugu

SEQ ID NO: 2292690 - RNA, 14 nt, Human
aucccucauccuca

SEQ ID NO: 2292691 - RNA, 18 nt, Human
uucuuaagacauguauca

SEQ ID NO: 2292692 - RNA, 13 nt, Human
uucuuaaccaucu

SEQ ID NO: 2292693 - RNA, 13 nt, Human
aucccucauccuc

SEQ ID NO: 2292694 - RNA, 21 nt, Human
aucccucauccucauacccac

SEQ ID NO: 2292695 - RNA, 23 nt, Human
aucccucauccucauacccaccc

SEQ ID NO: 2292696 - RNA, 17 nt, Human
uucuucuuuuugcuuca

SEQ ID NO: 2292697 - RNA, 21 nt, Human
uucuucuuuuugcuucaaaaa

SEQ ID NO: 2292698 - RNA, 13 nt, Human
uucuugaaagcug

SEQ ID NO: 2292699 - RNA, 14 nt, Human
uucuugaaagcugu

SEQ ID NO: 2292700 - RNA, 15 nt, Human
uucuugaaagcugug

SEQ ID NO: 2292701 - RNA, 21 nt, Human
uucuugaacacucaugcugaa

SEQ ID NO: 2292702 - RNA, 18 nt, Human
uucuuugccuguucaguu

SEQ ID NO: 2292703 - RNA, 14 nt, Human
uucuuugccuguuc

SEQ ID NO: 2292704 - RNA, 20 nt, Human
uucuugaacacucaugcuga

SEQ ID NO: 2292705 - RNA, 18 nt, Human
uucuuugggaauauuuga

SEQ ID NO: 2292706 - RNA, 20 nt, Human
uucuuugggaauauuugaau

SEQ ID NO: 2292707 - RNA, 17 nt, Human
uucuuugccuguucagu

SEQ ID NO: 2292708 - RNA, 20 nt, Human
uucuucugcuucagccuccc

SEQ ID NO: 2292709 - RNA, 23 nt, Human
uucuucugaacucaaacugagga

SEQ ID NO: 2292710 - RNA, 20 nt, Human
uucuucugaacucaaacuga

SEQ ID NO: 2292711 - RNA, 15 nt, Human
uucuucuucagaaga

SEQ ID NO: 2292712 - RNA, 13 nt, Human
uucuucuucccuc

SEQ ID NO: 2292713 - RNA, 13 nt, Human
uucuucuuccuga

SEQ ID NO: 2292714 - RNA, 14 nt, Human
uucuucuuccugaa

SEQ ID NO: 2292715 - RNA, 15 nt, Human
uucuucuuuuugcug

SEQ ID NO: 2292716 - RNA, 16 nt, Human
uucuucuuuuugcugu

SEQ ID NO: 2292717 - RNA, 13 nt, Human
uucuucuucagaa

SEQ ID NO: 2292718 - RNA, 22 nt, Human
uucuucuuccaacguggcccag

SEQ ID NO: 2292719 - RNA, 13 nt, Human
uucuucuguauuu

SEQ ID NO: 2292720 - RNA, 22 nt, Human
uucuuugguggagauaaagauu

SEQ ID NO: 2292721 - RNA, 13 nt, Human
uucuuugggccag

SEQ ID NO: 2292722 - RNA, 22 nt, Human
uucuuugggaauauuugaaucu

SEQ ID NO: 2292723 - RNA, 15 nt, Human
uucuuuguaaugaaa

SEQ ID NO: 2292724 - RNA, 23 nt, Human
uucuuuuugcuguuguuucuaaa

SEQ ID NO: 2292725 - RNA, 13 nt, Human
uucuuuuugcugu

SEQ ID NO: 2292726 - RNA, 14 nt, Human
uucuuuuugcuguu

SEQ ID NO: 2292727 - RNA, 13 nt, Human
uugaaagaccuuc

SEQ ID NO: 2292728 - RNA, 14 nt, Human
uucuuuuuuuguga

SEQ ID NO: 2292729 - RNA, 15 nt, Human
uugaaagauucaggu

SEQ ID NO: 2292730 - RNA, 14 nt, Human
uugaaagaguccua

SEQ ID NO: 2292731 - RNA, 20 nt, Human
uugaaagagaaccaguuuca

SEQ ID NO: 2292732 - RNA, 14 nt, Human
uugaaagagauggc

SEQ ID NO: 2292733 - RNA, 17 nt, Human
uugaaagagaaccaguu

SEQ ID NO: 2292734 - RNA, 22 nt, Human
uucuuuuuugugugauuuaaga

SEQ ID NO: 2292735 - RNA, 20 nt, Human
uucggcagauacugucucuu

SEQ ID NO: 2292736 - RNA, 17 nt, Human
uucggauuuggggugga

SEQ ID NO: 2292737 - RNA, 18 nt, Human
uucggaaaccuuggugua

SEQ ID NO: 2292738 - RNA, 14 nt, Human
uucggccuccaucc

SEQ ID NO: 2292739 - RNA, 12 nt, Human
uucggaaaccuu

SEQ ID NO: 2292740 - RNA, 13 nt, Human
aucacuggaugaa

SEQ ID NO: 2292741 - RNA, 22 nt, Human
uucgcuucuugccucugugcug

SEQ ID NO: 2292742 - RNA, 17 nt, Human
aucacuggagcccagga

SEQ ID NO: 2292743 - RNA, 16 nt, Human
aucacuggagcccagg

SEQ ID NO: 2292744 - RNA, 12 nt, Human
uucgcugcaacc

SEQ ID NO: 2292745 - RNA, 15 nt, Human
aucacuggagcccag

SEQ ID NO: 2292746 - RNA, 14 nt, Human
aucacuggagccca

SEQ ID NO: 2292747 - RNA, 13 nt, Human
aucacuggagccc

SEQ ID NO: 2292748 - RNA, 12 nt, Human
aucacuggagcc

SEQ ID NO: 2292749 - RNA, 23 nt, Human
aucacuggagcaccaggcacgaa

SEQ ID NO: 2292750 - RNA, 19 nt, Human
aucacuggagcaccaggca

SEQ ID NO: 2292751 - RNA, 17 nt, Human
aucacuggagcaccagg

SEQ ID NO: 2292752 - RNA, 10 nt, Human
aucacuggag

SEQ ID NO: 2292753 - RNA, 15 nt, Human
uucgcuccugugucu

SEQ ID NO: 2292754 - RNA, 19 nt, Human
uucgcuccugugucuugca

SEQ ID NO: 2292755 - RNA, 23 nt, Human
uucuaaaugcauauccugagcca

SEQ ID NO: 2292756 - RNA, 13 nt, Human
uucuaaaugcaua

SEQ ID NO: 2292757 - RNA, 22 nt, Human
uucuaaagguguugucccuucu

SEQ ID NO: 2292758 - RNA, 18 nt, Human
uucuaaaugaauguuuac

SEQ ID NO: 2292759 - RNA, 21 nt, Human
uucuaaaugaauguuuacacu

SEQ ID NO: 2292760 - RNA, 14 nt, Human
uucuaaaugaagug

SEQ ID NO: 2292761 - RNA, 20 nt, Human
uucuaaagguguugucccuu

SEQ ID NO: 2292762 - RNA, 12 nt, Human
uucuaaaugaau

SEQ ID NO: 2292763 - RNA, 15 nt, Human
uucuaaaugaauguu

SEQ ID NO: 2292764 - RNA, 21 nt, Human
uucuaaaucuccaaaauaaaa

SEQ ID NO: 2292765 - RNA, 21 nt, Human
uucuaaaggcuaccuuuguau

SEQ ID NO: 2292766 - RNA, 20 nt, Human
uucuaaaggcuaccuuugua

SEQ ID NO: 2292767 - RNA, 15 nt, Human
uucggaguugggggu

SEQ ID NO: 2292768 - RNA, 19 nt, Human
uucuaaaggcuaccuuugu

SEQ ID NO: 2292769 - RNA, 15 nt, Human
uucggccuccauccu

SEQ ID NO: 2292770 - RNA, 20 nt, Human
uucuaaaugcauauccugag

SEQ ID NO: 2292771 - RNA, 12 nt, Human
uucuaagagaag

SEQ ID NO: 2292772 - RNA, 13 nt, Human
uucuaagagaagu

SEQ ID NO: 2292773 - RNA, 13 nt, Human
uucuaagaaguga

SEQ ID NO: 2292774 - RNA, 23 nt, Human
uucuaagaagugaaaaucuacac

SEQ ID NO: 2292775 - RNA, 16 nt, Human
uucuaaguaaaaccac

SEQ ID NO: 2292776 - RNA, 15 nt, Human
uucuaaguaaaacca

SEQ ID NO: 2292777 - RNA, 12 nt, Human
uucuagcacugg

SEQ ID NO: 2292778 - RNA, 14 nt, Human
uucuagcacuggcc

SEQ ID NO: 2292779 - RNA, 15 nt, Human
uucuagcacuggccu

SEQ ID NO: 2292780 - RNA, 16 nt, Human
uucuagcacuggccug

SEQ ID NO: 2292781 - RNA, 17 nt, Human
uucuagcacuggccugc

SEQ ID NO: 2292782 - RNA, 16 nt, Human
uucuagcuagaaauau

SEQ ID NO: 2292783 - RNA, 17 nt, Human
uucuagcuagaaauaug

SEQ ID NO: 2292784 - RNA, 18 nt, Human
uucuagcuagaaauauga

SEQ ID NO: 2292785 - RNA, 17 nt, Human
uucuagcuaauguaaua

SEQ ID NO: 2292786 - RNA, 12 nt, Human
uucuagcuguug

SEQ ID NO: 2292787 - RNA, 19 nt, Human
uucuagcuagaaauaugau

SEQ ID NO: 2292788 - RNA, 22 nt, Human
uucuagcuagaaauaugauuuu

SEQ ID NO: 2292789 - RNA, 20 nt, Human
uucuagcuguugagcuguuu

SEQ ID NO: 2292790 - RNA, 21 nt, Human
uucuagcuguugagcuguuuu

SEQ ID NO: 2292791 - RNA, 16 nt, Human
uucuagcauggcugcc

SEQ ID NO: 2292792 - RNA, 18 nt, Human
uucuagcccauggacuuc

SEQ ID NO: 2292793 - RNA, 18 nt, Human
uucuagcccgaauacaaa

SEQ ID NO: 2292794 - RNA, 21 nt, Human
uucuagcccgaauacaaacac

SEQ ID NO: 2292795 - RNA, 20 nt, Human
uucucaggcucugcccugcc

SEQ ID NO: 2292796 - RNA, 17 nt, Human
uucucaggccaucauca

SEQ ID NO: 2292797 - RNA, 12 nt, Human
uucucagggcuc

SEQ ID NO: 2292798 - RNA, 13 nt, Human
uucucagggcucc

SEQ ID NO: 2292799 - RNA, 15 nt, Human
uucucagggcuccug

SEQ ID NO: 2292800 - RNA, 16 nt, Human
uucucagggcuccugc

SEQ ID NO: 2292801 - RNA, 17 nt, Human
uucucagggcuccugcc

SEQ ID NO: 2292802 - RNA, 18 nt, Human
uucucagggcuccugccu

SEQ ID NO: 2292803 - RNA, 16 nt, Human
uucucagguguugcca

SEQ ID NO: 2292804 - RNA, 19 nt, Human
uucucagggucucugcugc

SEQ ID NO: 2292805 - RNA, 20 nt, Human
uucucagggucucugcugcc

SEQ ID NO: 2292806 - RNA, 13 nt, Human
uucucagggucuc

SEQ ID NO: 2292807 - RNA, 16 nt, Human
uucucagggucucugc

SEQ ID NO: 2292808 - RNA, 17 nt, Human
uucucagggucucugcu

SEQ ID NO: 2292809 - RNA, 18 nt, Human
uucucagggucucugcug

SEQ ID NO: 2292810 - RNA, 19 nt, Human
aucacuugaggucaggagu

SEQ ID NO: 2292811 - RNA, 21 nt, Human
uucucagggucucugcugccg

SEQ ID NO: 2292812 - RNA, 17 nt, Human
aucacuugaauccuagg

SEQ ID NO: 2292813 - RNA, 17 nt, Human
uucucagguguugccaa

SEQ ID NO: 2292814 - RNA, 19 nt, Human
uucucagguguugccaaau

SEQ ID NO: 2292815 - RNA, 18 nt, Human
aucacuuguacaaaauaa

SEQ ID NO: 2292816 - RNA, 17 nt, Human
aucacuuguacaaaaua

SEQ ID NO: 2292817 - RNA, 16 nt, Human
aucacuuguacaaaau

SEQ ID NO: 2292818 - RNA, 14 nt, Human
aucacuuguacaaa

SEQ ID NO: 2292819 - RNA, 11 nt, Human
aucagaauucu

SEQ ID NO: 2292820 - RNA, 18 nt, Human
aucagaaguuucucagcu

SEQ ID NO: 2292821 - RNA, 19 nt, Human
aucagaauagccacauuug

SEQ ID NO: 2292822 - RNA, 22 nt, Human
aucacuugucaauaaaauccau

SEQ ID NO: 2292823 - RNA, 16 nt, Human
aucacuuucucaguuu

SEQ ID NO: 2292824 - RNA, 17 nt, Human
aucacuuguuguuuuac

SEQ ID NO: 2292825 - RNA, 21 nt, Human
aucacuuguacaaaauaaaca

SEQ ID NO: 2292826 - RNA, 19 nt, Human
aucacuugagacaaaucua

SEQ ID NO: 2292827 - RNA, 13 nt, Human
aucacuuguuguu

SEQ ID NO: 2292828 - RNA, 19 nt, Human
uucucacagugggagccag

SEQ ID NO: 2292829 - RNA, 21 nt, Human
uucucacagugggagccaggg

SEQ ID NO: 2292830 - RNA, 22 nt, Human
uucucacagugggagccagggc

SEQ ID NO: 2292831 - RNA, 14 nt, Human
uucuaggaagaauu

SEQ ID NO: 2292832 - RNA, 18 nt, Human
uucuaggaagaauuuuaa

SEQ ID NO: 2292833 - RNA, 19 nt, Human
uucuaggaagaauuuuaaa

SEQ ID NO: 2292834 - RNA, 23 nt, Human
uucuaggaagaauuuuaaaaaug

SEQ ID NO: 2292835 - RNA, 16 nt, Human
uucucacuccaccacc

SEQ ID NO: 2292836 - RNA, 15 nt, Human
uucucacuccaccac

SEQ ID NO: 2292837 - RNA, 14 nt, Human
uucucacuccacca

SEQ ID NO: 2292838 - RNA, 16 nt, Human
uucucacuccuaccug

SEQ ID NO: 2292839 - RNA, 12 nt, Human
uucucaccagga

SEQ ID NO: 2292840 - RNA, 13 nt, Human
uucucaccaggaa

SEQ ID NO: 2292841 - RNA, 18 nt, Human
uucucacuccuaccuggu

SEQ ID NO: 2292842 - RNA, 17 nt, Human
uucucagcucccccugu

SEQ ID NO: 2292843 - RNA, 18 nt, Human
uucucagcucccccuguc

SEQ ID NO: 2292844 - RNA, 20 nt, Human
uucucagcucccccuguccc

SEQ ID NO: 2292845 - RNA, 14 nt, Human
uucucagcucuucu

SEQ ID NO: 2292846 - RNA, 18 nt, Human
uucucagcucuucugacu

SEQ ID NO: 2292847 - RNA, 17 nt, Human
uucucaggcaugaacau

SEQ ID NO: 2292848 - RNA, 23 nt, Human
aucagcaacaaccagcaucccuu

SEQ ID NO: 2292849 - RNA, 21 nt, Human
aucagcaaaccggggccuacu

SEQ ID NO: 2292850 - RNA, 21 nt, Human
aucagauugcaugugacucug

SEQ ID NO: 2292851 - RNA, 18 nt, Human
aucagauugcaugugacu

SEQ ID NO: 2292852 - RNA, 16 nt, Human
aucagauugcauguga

SEQ ID NO: 2292853 - RNA, 15 nt, Human
aucagauugcaugug

SEQ ID NO: 2292854 - RNA, 14 nt, Human
aucagauugcaugu

SEQ ID NO: 2292855 - RNA, 12 nt, Human
aucagaauucuc

SEQ ID NO: 2292856 - RNA, 22 nt, Human
aucagaauagccacauuuggaa

SEQ ID NO: 2292857 - RNA, 13 nt, Human
aucagcacgauuu

SEQ ID NO: 2292858 - RNA, 15 nt, Human
aucaggccaggcccu

SEQ ID NO: 2292859 - RNA, 16 nt, Human
aucaggccaggcccuc

SEQ ID NO: 2292860 - RNA, 18 nt, Human
aucaggccaggcccucug

SEQ ID NO: 2292861 - RNA, 15 nt, Human
aucaggcuauguaug

SEQ ID NO: 2292862 - RNA, 16 nt, Human
aucaggccugccagac

SEQ ID NO: 2292863 - RNA, 21 nt, Human
aucagcaagucucuuuauaug

SEQ ID NO: 2292864 - RNA, 16 nt, Human
aucaggcucugccuca

SEQ ID NO: 2292865 - RNA, 13 nt, Human
aucaggcugaggu

SEQ ID NO: 2292866 - RNA, 16 nt, Human
aucaggccauuguccc

SEQ ID NO: 2292867 - RNA, 13 nt, Human
aucaggccauugu

SEQ ID NO: 2292868 - RNA, 21 nt, Human
aucagggcaaucccaacacau

SEQ ID NO: 2292869 - RNA, 17 nt, Human
aucaggguuaguauugu

SEQ ID NO: 2292870 - RNA, 20 nt, Human
aucagguccucagagaauuu

SEQ ID NO: 2292871 - RNA, 16 nt, Human
aucagguccucagaga

SEQ ID NO: 2292872 - RNA, 18 nt, Human
aucagggaggucauuuug

SEQ ID NO: 2292873 - RNA, 15 nt, Human
uuccugaaccugaug

SEQ ID NO: 2292874 - RNA, 23 nt, Human
uuccuguccuucucucaccuccu

SEQ ID NO: 2292875 - RNA, 24 nt, Human
uuccuguccuucucucaccuccua

SEQ ID NO: 2292876 - RNA, 14 nt, Human
uuccugucuuccug

SEQ ID NO: 2292877 - RNA, 11 nt, Human
uuccugugucu

SEQ ID NO: 2292878 - RNA, 21 nt, Human
uuccuguggauguaaagugau

SEQ ID NO: 2292879 - RNA, 15 nt, Human
auauuuuuaucuuua

SEQ ID NO: 2292880 - RNA, 14 nt, Human
auauuuuuaucuuu

SEQ ID NO: 2292881 - RNA, 22 nt, Human
auauuuuuaucuuuauaugaag

SEQ ID NO: 2292882 - RNA, 20 nt, Human
auauuuuuaucuuuauauga

SEQ ID NO: 2292883 - RNA, 20 nt, Human
aucaaauuucacgucgucuu

SEQ ID NO: 2292884 - RNA, 21 nt, Human
auauuuuuuuaaaauguuaaa

SEQ ID NO: 2292885 - RNA, 15 nt, Human
auauuuuuucugaau

SEQ ID NO: 2292886 - RNA, 20 nt, Human
auauuuuuuguuaaaugauu

SEQ ID NO: 2292887 - RNA, 20 nt, Human
auauuuuuuauauauacagu

SEQ ID NO: 2292888 - RNA, 16 nt, Human
auauuuuuauuuuauu

SEQ ID NO: 2292889 - RNA, 18 nt, Human
auauuuuuucagaaauau

SEQ ID NO: 2292890 - RNA, 18 nt, Human
auauuuuuuguuaaauga

SEQ ID NO: 2292891 - RNA, 14 nt, Human
aucaacauuucuca

SEQ ID NO: 2292892 - RNA, 15 nt, Human
aucaacaucuuuucu

SEQ ID NO: 2292893 - RNA, 13 nt, Human
aucaacaucuuuu

SEQ ID NO: 2292894 - RNA, 16 nt, Human
aucaagcacagaagga

SEQ ID NO: 2292895 - RNA, 13 nt, Human
aucaagcccuuua

SEQ ID NO: 2292896 - RNA, 14 nt, Human
aucaagcagccaag

SEQ ID NO: 2292897 - RNA, 21 nt, Human
aucaagaugugacauguuuua

SEQ ID NO: 2292898 - RNA, 22 nt, Human
aucaaauuucacgucgucuucu

SEQ ID NO: 2292899 - RNA, 16 nt, Human
aucaacaaaaauuguc

SEQ ID NO: 2292900 - RNA, 18 nt, Human
aucaacaagaguugucuu

SEQ ID NO: 2292901 - RNA, 14 nt, Human
aucaacagauaaau

SEQ ID NO: 2292902 - RNA, 18 nt, Human
aucacggcucacugcagc

SEQ ID NO: 2292903 - RNA, 19 nt, Human
aucacggcucacugcagcc

SEQ ID NO: 2292904 - RNA, 21 nt, Human
aucacugaacuuugcugagcc

SEQ ID NO: 2292905 - RNA, 18 nt, Human
aucacgcuuuccugaauc

SEQ ID NO: 2292906 - RNA, 18 nt, Human
aucaccuuaggcagggaa

SEQ ID NO: 2292907 - RNA, 17 nt, Human
aucaccuuaggcaggga

SEQ ID NO: 2292908 - RNA, 16 nt, Human
aucaccuuaggcaggg

SEQ ID NO: 2292909 - RNA, 20 nt, Human
aucaccuuaggcagggaagu

SEQ ID NO: 2292910 - RNA, 22 nt, Human
aucaauggcgcagugccucugg

SEQ ID NO: 2292911 - RNA, 13 nt, Human
aucacgccacugc

SEQ ID NO: 2292912 - RNA, 14 nt, Human
aucacgcuuuccug

SEQ ID NO: 2292913 - RNA, 15 nt, Human
aucacggcucacugc

SEQ ID NO: 2292914 - RNA, 16 nt, Human
aucaauccuuguucag

SEQ ID NO: 2292915 - RNA, 21 nt, Human
aucaaucauuguacaguuugu

SEQ ID NO: 2292916 - RNA, 14 nt, Human
aucaaugaguaaca

SEQ ID NO: 2292917 - RNA, 15 nt, Human
aucaccuuaggcagg

SEQ ID NO: 2292918 - RNA, 12 nt, Human
aucaaugacaga

SEQ ID NO: 2292919 - RNA, 21 nt, Human
aucaauggcgcagugccucug

SEQ ID NO: 2292920 - RNA, 17 nt, Human
aucaagcuagaaggcca

SEQ ID NO: 2292921 - RNA, 16 nt, Human
aucaagcuagaaggcc

SEQ ID NO: 2292922 - RNA, 20 nt, Human
aucaagcuagaaggccacau

SEQ ID NO: 2292923 - RNA, 11 nt, Human
aucaagcugug

SEQ ID NO: 2292924 - RNA, 12 nt, Human
aucaagcuguga

SEQ ID NO: 2292925 - RNA, 21 nt, Human
aucaagcuucaguuuccuggu

SEQ ID NO: 2292926 - RNA, 15 nt, Human
aucaaggcacugccu

SEQ ID NO: 2292927 - RNA, 16 nt, Human
aucaaggcacugccug

SEQ ID NO: 2292928 - RNA, 22 nt, Human
aucaagcuucaguuuccugguc

SEQ ID NO: 2292929 - RNA, 13 nt, Human
aucaaggcacugc

SEQ ID NO: 2292930 - RNA, 14 nt, Human
aucaaggcacugcc

SEQ ID NO: 2292931 - RNA, 17 nt, Human
aucaaucauuguacagu

SEQ ID NO: 2292932 - RNA, 19 nt, Human
aucaaucauuguacaguuu

SEQ ID NO: 2292933 - RNA, 13 nt, Human
aucaaucauugua

SEQ ID NO: 2292934 - RNA, 14 nt, Human
aucaaucauuguac

SEQ ID NO: 2292935 - RNA, 15 nt, Human
aucaaucauuguaca

SEQ ID NO: 2292936 - RNA, 16 nt, Human
aucaaucauuguacag

SEQ ID NO: 2292937 - RNA, 23 nt, Human
aucaagggaauguaacugcugaa

SEQ ID NO: 2292938 - RNA, 23 nt, Human
uucccguggaacguuuuuccugu

SEQ ID NO: 2292939 - RNA, 21 nt, Human
uucccggacugcaagcagggc

SEQ ID NO: 2292940 - RNA, 20 nt, Human
uucccgucccauauccugcc

SEQ ID NO: 2292941 - RNA, 15 nt, Human
uucccuauuagagaa

SEQ ID NO: 2292942 - RNA, 21 nt, Human
uucccucaccuuggcaccaga

SEQ ID NO: 2292943 - RNA, 20 nt, Human
uucccucaccuuucccaucu

SEQ ID NO: 2292944 - RNA, 16 nt, Human
uucccgcucagcccuc

SEQ ID NO: 2292945 - RNA, 18 nt, Human
uucccgcucagcccuccc

SEQ ID NO: 2292946 - RNA, 21 nt, Human
uucccgcucagcccucccugc

SEQ ID NO: 2292947 - RNA, 22 nt, Human
uucccgcucagcccucccugcc

SEQ ID NO: 2292948 - RNA, 16 nt, Human
auagcaaacuuggaau

SEQ ID NO: 2292949 - RNA, 22 nt, Human
auagcaaagcgacguuagucgu

SEQ ID NO: 2292950 - RNA, 23 nt, Human
uuccggauuggcuuguguguuuc

SEQ ID NO: 2292951 - RNA, 17 nt, Human
uucccucaucucuccuc

SEQ ID NO: 2292952 - RNA, 21 nt, Human
uucccgucccauauccugccu

SEQ ID NO: 2292953 - RNA, 15 nt, Human
uucccucaucucucc

SEQ ID NO: 2292954 - RNA, 19 nt, Human
uuccguagguuauuuucag

SEQ ID NO: 2292955 - RNA, 16 nt, Human
uuccguuaaaauacca

SEQ ID NO: 2292956 - RNA, 14 nt, Human
uuccguuaaaauac

SEQ ID NO: 2292957 - RNA, 17 nt, Human
uuccgugaaaacggagc

SEQ ID NO: 2292958 - RNA, 18 nt, Human
uuccgugacgucacugga

SEQ ID NO: 2292959 - RNA, 18 nt, Human
uuccguagccagcugcuc

SEQ ID NO: 2292960 - RNA, 17 nt, Human
uuccguaacccaacucu

SEQ ID NO: 2292961 - RNA, 14 nt, Human
uuccggcuccugug

SEQ ID NO: 2292962 - RNA, 22 nt, Human
uuccucuuuccaucuacccucc

SEQ ID NO: 2292963 - RNA, 17 nt, Human
uuccucuuuccaucuac

SEQ ID NO: 2292964 - RNA, 13 nt, Human
uuccucuuuccau

SEQ ID NO: 2292965 - RNA, 13 nt, Human
uuccucugccugc

SEQ ID NO: 2292966 - RNA, 14 nt, Human
uuccucugccugcc

SEQ ID NO: 2292967 - RNA, 15 nt, Human
uuccucugccugccc

SEQ ID NO: 2292968 - RNA, 16 nt, Human
uuccucugccugcccc

SEQ ID NO: 2292969 - RNA, 14 nt, Human
uuccugaaccgaug

SEQ ID NO: 2292970 - RNA, 12 nt, Human
uuccucuuugca

SEQ ID NO: 2292971 - RNA, 15 nt, Human
uuccucuuugcaugg

SEQ ID NO: 2292972 - RNA, 17 nt, Human
uuccucuuugcauggaa

SEQ ID NO: 2292973 - RNA, 18 nt, Human
uuccugaagaauugaaaa

SEQ ID NO: 2292974 - RNA, 19 nt, Human
uuccugaagaaccaguccc

SEQ ID NO: 2292975 - RNA, 16 nt, Human
uuccugaagaaccagu

SEQ ID NO: 2292976 - RNA, 14 nt, Human
uuccucuuugcuuu

SEQ ID NO: 2292977 - RNA, 13 nt, Human
uuccucuuugcuu

SEQ ID NO: 2292978 - RNA, 15 nt, Human
uuccugaagaaccag

SEQ ID NO: 2292979 - RNA, 13 nt, Human
uuccuaauuuuag

SEQ ID NO: 2292980 - RNA, 14 nt, Human
uuccuaauuuuagu

SEQ ID NO: 2292981 - RNA, 23 nt, Human
uuccuaauuuuagugacagcucu

SEQ ID NO: 2292982 - RNA, 18 nt, Human
uuccuaauuccacagcug

SEQ ID NO: 2292983 - RNA, 17 nt, Human
uuccuaauuccacagcu

SEQ ID NO: 2292984 - RNA, 16 nt, Human
uuccuaauuccacagc

SEQ ID NO: 2292985 - RNA, 17 nt, Human
uuccuaauccucuagga

SEQ ID NO: 2292986 - RNA, 16 nt, Human
uuccuacaaagauguu

SEQ ID NO: 2292987 - RNA, 23 nt, Human
uuccuacaagagcagccuguggc

SEQ ID NO: 2292988 - RNA, 22 nt, Human
uuccuacaagagcagccugugg

SEQ ID NO: 2292989 - RNA, 20 nt, Human
uuccuacaagagcagccugu

SEQ ID NO: 2292990 - RNA, 17 nt, Human
uuccucugagccuuggg

SEQ ID NO: 2292991 - RNA, 14 nt, Human
uuccucugagccuu

SEQ ID NO: 2292992 - RNA, 13 nt, Human
uuccucugaggcu

SEQ ID NO: 2292993 - RNA, 21 nt, Human
uuccucugaggcuggauccua

SEQ ID NO: 2292994 - RNA, 21 nt, Human
uuccucugaggcugaaauuca

SEQ ID NO: 2292995 - RNA, 22 nt, Human
uuccucugcagcugaccucugu

SEQ ID NO: 2292996 - RNA, 12 nt, Human
uuccucugccug

SEQ ID NO: 2292997 - RNA, 10 nt, Human
uuccucugca

SEQ ID NO: 2292998 - RNA, 13 nt, Human
uuccucugcagcu

SEQ ID NO: 2292999 - RNA, 17 nt, Human
uuccucugcagcugacc

SEQ ID NO: 2293000 - RNA, 19 nt, Human
uuccucugcagcugaccuc

SEQ ID NO: 2293001 - RNA, 14 nt, Human
uugcauauauacau

SEQ ID NO: 2293002 - RNA, 23 nt, Human
uugcauauaacuuauauuguaag

SEQ ID NO: 2293003 - RNA, 14 nt, Human
uugcauauguauga

SEQ ID NO: 2293004 - RNA, 13 nt, Human
uugcaucaauuuu

SEQ ID NO: 2293005 - RNA, 22 nt, Human
uugcaaguauguuuuagcaugu

SEQ ID NO: 2293006 - RNA, 21 nt, Human
uugcaaguauguuuuagcaug

SEQ ID NO: 2293007 - RNA, 16 nt, Human
uugcaagucauggcug

SEQ ID NO: 2293008 - RNA, 23 nt, Human
uugcauaguaccaaucauuuuaa

SEQ ID NO: 2293009 - RNA, 15 nt, Human
uugcaagucauggcu

SEQ ID NO: 2293010 - RNA, 19 nt, Human
uugcaauggcuauauggca

SEQ ID NO: 2293011 - RNA, 22 nt, Human
uugcauauaacuuauauuguaa

SEQ ID NO: 2293012 - RNA, 17 nt, Human
uugcauauaacuuauau

SEQ ID NO: 2293013 - RNA, 14 nt, Human
uugcauauaacuua

SEQ ID NO: 2293014 - RNA, 20 nt, Human
uugcaaugguguugcccuga

SEQ ID NO: 2293015 - RNA, 22 nt, Human
uugcauugaacacaaacuguaa

SEQ ID NO: 2293016 - RNA, 18 nt, Human
uugcauugaacacaaacu

SEQ ID NO: 2293017 - RNA, 15 nt, Human
uugcauugaacacaa

SEQ ID NO: 2293018 - RNA, 14 nt, Human
uugcauugaacaca

SEQ ID NO: 2293019 - RNA, 17 nt, Human
uugcauugaauauauua

SEQ ID NO: 2293020 - RNA, 23 nt, Human
uugcauugaacacaaacuguaaa

SEQ ID NO: 2293021 - RNA, 14 nt, Human
uugcauugaauaua

SEQ ID NO: 2293022 - RNA, 21 nt, Human
uugcauugaccgcgacuaauu

SEQ ID NO: 2293023 - RNA, 21 nt, Human
uugcauuuaaaacagacacug

SEQ ID NO: 2293024 - RNA, 20 nt, Human
uugcauuuaaaacagacacu

SEQ ID NO: 2293025 - RNA, 15 nt, Human
uugcauuuaaaacag

SEQ ID NO: 2293026 - RNA, 18 nt, Human
uugcaccacugcacucca

SEQ ID NO: 2293027 - RNA, 16 nt, Human
uugcaccacugcacuc

SEQ ID NO: 2293028 - RNA, 15 nt, Human
uugcaccacugcacu

SEQ ID NO: 2293029 - RNA, 14 nt, Human
uugcaccacugcac

SEQ ID NO: 2293030 - RNA, 16 nt, Human
uugcaauggcagccuu

SEQ ID NO: 2293031 - RNA, 22 nt, Human
uugcaagggaaaagucucuugu

SEQ ID NO: 2293032 - RNA, 17 nt, Human
uugcaauggcagccuug

SEQ ID NO: 2293033 - RNA, 19 nt, Human
uugcaauggcagccuuggc

SEQ ID NO: 2293034 - RNA, 12 nt, Human
uugcaaggaagc

SEQ ID NO: 2293035 - RNA, 12 nt, Human
uugauuauucug

SEQ ID NO: 2293036 - RNA, 13 nt, Human
uugcaaggaagcc

SEQ ID NO: 2293037 - RNA, 23 nt, Human
uugcaaggccgcuguucacccac

SEQ ID NO: 2293038 - RNA, 17 nt, Human
uugcaaggccgcuguuc

SEQ ID NO: 2293039 - RNA, 14 nt, Human
uugcaaggccgcug

SEQ ID NO: 2293040 - RNA, 19 nt, Human
uugcaagggaaaagucucu

SEQ ID NO: 2293041 - RNA, 13 nt, Human
uugcaagggaaaa

SEQ ID NO: 2293042 - RNA, 17 nt, Human
uugauuauucaguguca

SEQ ID NO: 2293043 - RNA, 15 nt, Human
uugauuauucagugu

SEQ ID NO: 2293044 - RNA, 20 nt, Human
uugauuauucugauuccacu

SEQ ID NO: 2293045 - RNA, 22 nt, Human
uugcaagccagauuuuccugaa

SEQ ID NO: 2293046 - RNA, 16 nt, Human
uugauuauuagccagg

SEQ ID NO: 2293047 - RNA, 13 nt, Human
uugauuaugcaga

SEQ ID NO: 2293048 - RNA, 13 nt, Human
uugauuaugcaua

SEQ ID NO: 2293049 - RNA, 21 nt, Human
uugauuauccauauugaguca

SEQ ID NO: 2293050 - RNA, 20 nt, Human
aucugaccagcagcgccuuu

SEQ ID NO: 2293051 - RNA, 18 nt, Human
uugauuaauccagaauaa

SEQ ID NO: 2293052 - RNA, 14 nt, Human
uugauuaaauucuu

SEQ ID NO: 2293053 - RNA, 22 nt, Human
uugauuaagaucucagugguua

SEQ ID NO: 2293054 - RNA, 12 nt, Human
aucugaaaaugu

SEQ ID NO: 2293055 - RNA, 14 nt, Human
aucugaaaauguga

SEQ ID NO: 2293056 - RNA, 23 nt, Human
aucugaaaauguauguguaagua

SEQ ID NO: 2293057 - RNA, 14 nt, Human
aucugacaucccca

SEQ ID NO: 2293058 - RNA, 15 nt, Human
aucugacaucucugc

SEQ ID NO: 2293059 - RNA, 20 nt, Human
aucugacaucucugcaaucu

SEQ ID NO: 2293060 - RNA, 16 nt, Human
aucugacaucucugca

SEQ ID NO: 2293061 - RNA, 13 nt, Human
aucugaaauguga

SEQ ID NO: 2293062 - RNA, 22 nt, Human
uugauguuuguggccucagaau

SEQ ID NO: 2293063 - RNA, 12 nt, Human
aucugacccagu

SEQ ID NO: 2293064 - RNA, 13 nt, Human
uugauuaaauucu

SEQ ID NO: 2293065 - RNA, 23 nt, Human
uugauguuuuaaggaugcuugua

SEQ ID NO: 2293066 - RNA, 16 nt, Human
aucugaccagcagcgc

SEQ ID NO: 2293067 - RNA, 15 nt, Human
aucugaccagcagcg

SEQ ID NO: 2293068 - RNA, 14 nt, Human
aucugaccagcagc

SEQ ID NO: 2293069 - RNA, 23 nt, Human
aucugacaugauuccuuccuguu

SEQ ID NO: 2293070 - RNA, 20 nt, Human
aucugacaugauuccuuccu

SEQ ID NO: 2293071 - RNA, 19 nt, Human
aucugacaugauuccuucc

SEQ ID NO: 2293072 - RNA, 18 nt, Human
aucugacaugauuccuuc

SEQ ID NO: 2293073 - RNA, 16 nt, Human
aucugacauccccacu

SEQ ID NO: 2293074 - RNA, 12 nt, Human
aucuagaagacu

SEQ ID NO: 2293075 - RNA, 21 nt, Human
aucuagaacacaggcaaaauc

SEQ ID NO: 2293076 - RNA, 21 nt, Human
aucuagaauguguuuucugaa

SEQ ID NO: 2293077 - RNA, 19 nt, Human
aucuagacccaucuucuuu

SEQ ID NO: 2293078 - RNA, 21 nt, Human
aucuagacucaagguucccag

SEQ ID NO: 2293079 - RNA, 18 nt, Human
aucuagagcuugaugcca

SEQ ID NO: 2293080 - RNA, 19 nt, Human
aucuagaggcuuccuucau

SEQ ID NO: 2293081 - RNA, 17 nt, Human
aucuagaggcuuccuuc

SEQ ID NO: 2293082 - RNA, 23 nt, Human
aucuagaggcuuccuucauuucc

SEQ ID NO: 2293083 - RNA, 14 nt, Human
aucucagggccugg

SEQ ID NO: 2293084 - RNA, 16 nt, Human
aucucagguucuccuu
